United States Patent 6,833,447 (MYXOCOCCUS XANTHUS GENOME SEQUENCES AND USES THEREOF) - sequence listing, part 6

SEQ ID NO: 6877 - DNA, 2310 bp, Myxococcus xanthus
ccctgcgcccagcctcccgaggaggcccgtggcccctccgtggggcccatcgcgacggtggcgggcggcctccccgccgtcatctccgccatgcggcacgtctacggtgaaatggacgtggtgcgcgggacgaagctgctgctcaaggtgaaccagaaggagggcttcgactgccccggctgcgcgtggcccgacccgggacaccgctccatggcggagttctgtgagaacggcgccaaggcggtggcggaagaggccatgtccgcgcgggcgacgccggagttcttccgtcgatggagcgtggcggacctcgccctccagacggaccattggctgggcaagcagggccggctgacgcacccgatggtgcttcgcgaaggcgccacgcactacgagcccctgtcctgggacgaagccttcgcgctggtggccgaggaactgaacgcgctcgacacgccagacgccgcgagtttctacacctccgggcgtacgagcaacgaggcggcgttcctctaccagctcttcgtgcggcagttcggcaccaacaacctgccggactgctcgaacatgtgtcacgagtcgagcggctccgcgctcaatgagacggtgggcatcggcaagggcactgtcacgctggaggacttcgaccaggcggatgccatcttcgtcatcgggcagaacccggggacgaaccatccgcgcatgttgtcgtcgctcgaggccgccgcgcgacggggctgccagattgtcagcatcaacccgctgccggagacggggctcaaccgcttcaagcacccgcaggacgtgctgcacctcatcgggcccggaacggcgctcaactccctgttcgttcaggtccgcatcaacggcgacgccgcgctgctgcagggcatcgccaaggcgctgttcgagatggaggacgcgaaccctggctcggtggtggccaagggcttcatcgacgacaagacgctcggcttcgaggcctacgcggcccacatgcgcgcggtgaagtgggaggacgtggaggaggggagtggggtgccgcgcgcgcaggtgctcgcggcggcggaaatcctcgcgcgctccgagcgcaccatcttctgctgggccatggggctgacgcagcaccgcaacggcgtggcgtgcattcaggaaatcgtcaacctgacgctgctgcgcggcgctatcggcaagccgggcgcgggcctgtgcccggtgcgcggtcacagcaacgtgcagggcgaccgcacgatgggcatctgggagaagccgcccgaggccctgttgacggcgctgtcccgggagttcgggttcgagccgccgcggcaccacggcatggacgtggtggacacgctgcacgccatgcacgacggccgggtgaaggtgttcttcgcgctcggtggcaacttcctctccgccacgccggacacggagttcaccgccgaggccctgcgccgcacgcgcctcaccgtccacgtgtccaccaagctcaaccgctcgcacctggtccacggacggcgggcgctcatcctgccgtgtctgggccgcaccgagcgcgacgtgcaggccggcggggcccagttcgtcaccgtggagaactccatgggcgtggtgtcgtcttcgcggggctcggtggcgcccgcgtcggagcacctgctcagcgaacccgtcatcgtcgcccggctggcgacggcggtgctgggggcgcgctctcgcgtgccctggctgtcgctggtggaggactacgaccgcatccgtgagcagatttcgcgcgtcatccccggcttcgatgacttcaatcgccgcgtgcgggagccgggcggcttcgcgctgccgaatggtccgcgtgagggacgcttcaccacgaagagtggcaaggctcacttcacggtgcatgcgctacagcccattgccctggagccgggacagctcctgatgatgacgattcgcacgcatgaccagttcaacacgacggtgtacgggctggatgaccgctaccgcggcatccgcaatggccgccgggtggtgttgctgcatcccgcctacatgaaggcgcaggggctggcggctgaccagcttgtcgacctgcggagccacttcgaaggcgagacgcggctggcgcgtggcttccgcgtggtgccgtacaacatcccgcgcaggtgcgcggccacctacttccccgaggccaacgtcctcgtccccgtgaacagcttcgcggagaagagccgcacgcccacgtcgaagtcggtggtcatcagcatcaccccggccggagaagcgcgggccctgcccgctggcgcggtggcatga

SEQ ID NO: 6878 - DNA, 888 bp, Myxococcus xanthus
atggcgcggcaggagacgatgctggctgcgttgcaggaggtgggggacgtggacacggccgcgcgggtgcggcgtgagacggaagccaccgtcaccacggtactgacgcgcatcctgaagcggcacccggacgcgctccagtccctcgtcggcgacgcgccgtgtaccttcgacggccgggccctgcgcttccacggcgcggtggaggtggacctgcgtcaggtgttgggcaccggcgcgaagtccgtcgcgctgctggagcaactgcgcgcgctgatgccggcgacggctgcggacgggcgcgaccggttggcggagttcatccggacgcgggccgcgcggctgccgtggcgggaagcttcggaggtcctggccgagcggctcttctcgctggcgacgtcgccggagggccgcagcggcatgagtggcttcctggcgtgctaccccggtggacgcaaggagccggactggtgcgctcgggcggggctcttgctgtcgcgcacgctggaggtcggcggtcctcccgaagtggtggagaacctgtgcgagctgctggcgcgcttcgatgcgccgccggtggacggcctgcgcggggcgctgggcgctttggtgaacggcgacttcgaggcctcggcggacctgggccccgtgcgcttcgtgctcgaccactgccaggccacgctgcgcaagggcgagccgggtctggtgctcacgctgttgtggctggaggagcggttgttccgtgccgccgtgcgcaagggcgcgccagatgcctttgaccgccgcaagcgcgcgctgtcgaagctcaagccgggggcgccgggattcgaccagctccactggttggcggaagaatgtgccgagctgtggcctcgcttcatgctgtag

SEQ ID NO: 6879 - DNA, 1269 bp, Myxococcus xanthus
atgtcccgcgtcatccgcgccccccacggttccaccctgtcctgcaagggctgggtccaggaggccgcgctccggatgttgatgaacaacctcgacccggacgtcgccgagcgccccgaggacctcgtcgtctacggcggcaccggcaaggccgcccgcgactggccctccttcgaccgcatcgtgtcgagcctccagaacctgggcgacgatgagaccctgctcgtccagtccggcaagcccgtgggcatcttccgcacgcacccggacgcgccgcgcgtgctcatcgccaactccaacctcgtgggccgctgggccaactgggagcattttcacgagctggagaagaagggcctgatgatgtacggccagatgaccgcgggctcgtggatatacatcggcacgcagggcatcctccagggcacctacgagaccttagccgccgccggccgcttccacttcggcaccgacgacctggcgggccgcctcatcctctccggcggtctgggtggcatgggtggcgcgcagccgctggccgccaccatgaacaacgcggtgttcctcggcgtggagatcgaccccacgcgcgctcgccgccgcgtggagacgcgctacctggacgtcgtcgccaaggacctggatgaggcgctggccctggtgaaggacgcccaggagaagcgcgtgggccgctccatcgccgtcatcggcaacgcggcgtcggtgttccgcgagctgtaccgccgtggcatcaagccggacctcgtcacggaccagacgagcgcccatgacccgctcaacggctacatccccacggacctgtcgctggaggccgccgccgagctgcgccagcgggatccggagacgtacgtccgccgcgcgcgcgagtcgatgatgatgcacgtgcaggcgatgaacgacttccagaaggccggcagccacgtcttcgactacggcaacaacctgcgcggccaggcggagctgggcggcatggagaacgccttcgagttccccggcttcgtccccgcctacatccgtcccctcttctgcgagggcatggggcccttccgctgggtggcgctctcgggtgacccggaggacatccgcgtcaccgaccgcgtggtgcgcgagctgttcccccagaaggcctcgctccagcgctggctgaacatggccgaggagcgcgtggcgttccagggcctgccctcgcgcatctgctggctggggtatggcgagcgcgccaaggcgggcctcgcgttcaacgagctggtg

SEQ ID NO: 6880 - DNA, 255 bp, Myxococcus xanthus
atgcagagctgggtggacgccgaggacgtggacatccgcgtgcgggacggcgtggtgctgctggccggcgtggtgcgcagccaggatgaacggcacgcgacggaagcgctcgcccgggacgtgctgggagtgaaggaggtcatcaacgacattcgcatcgaccgcgaggacggcgtcgtggaccggcccgcgtcacgcagccccgtccagactccgggcatggacgcctccgacgacgacacgctgcattcgtga

SEQ ID NO: 6881 - DNA, 4119 bp, Myxococcus xanthus
cgagagctgggggcgctgggccctcggccgacgtacctccgcgcggatgccgcggacgaaggcgcgctgcgagaggcctaccggaagattcgggagcagcactccgccatccatggcgtcgtgcactcggccatcgtattgagggaccagagcctggcggcgatggacgaggaccgcttccgcgcgagcctggccgccaaggtggagaccagcatccacatggcccgggtgttccagcaggagccgctggacttcatcgtgttcttctcatccatcaacagcttcacgaaggcgccggggcagagcaactatgcggccgggtgcaccttcgttgacgcgctggcctcgcacctggcgcagacatcgcggtgcgcggtcaagacgctcaactggggctattggggcaacgtgggcatcgtggccacggaggagtatcgccgccggatggagcagttcggcatcggctccctggctcccgccgaggcgatgaaggcgctggaaacccatctgtgctcgccgctggagcaggtggggatgctgaagaccacccggcccgcagcgctggctggcgtcagcacagatgaccggctcagtgttcagcgtggccctgcgcgcgcgtcactcgtcgcatcggcgacccggggcgccgccgcccgcgccgcgggaatcgcggagacgaaggccgcggtggggctcgaggcagaacggctggcggcggtcgagtcgcttctggtggacctgctggccgcccagttgcatgacatggggcccggtgtggcctccagccatcgccactggttcaccgaaagcatggccatcctggcgcgtcgtggctacgtggccgctgacggcacccgcttcctcgaaggaaaggtgccggaccgggaacaggcgtgggcacggtggacgcagtcgagcgccgagtggcggcaggtacccacgttgcgagccgtcgtcgggctgctcgaaccggcactgcgggcgctccctgacatcatcaccggcaagcgccgcaccacggacgtgatgttcccgggcggccggatgacgctggtcgaggacctctacaagcacaaccccgtctccgacttcttcaaccaggcgacgtcggcggccgtcgcggactgcgtcgccgagcgcgtgcggagcgcgccttccgccgggcttcgagtgctcgaaatcggcgcgggcacgggcagcacgacggcctcggtgctggcggcgctggcgccataccggacgcacgtcgcggagtattgcttcacggacgtgtcgaaggccttcctgctgcacgcgcgagaagcctatggcgcggcccatccgttcatgcggttccagttgttcgacgtgtcacgtccgctggcggagcaggacctggagcagggcgcctacgacatcgtgattgccagcaacgtgattcacgccacgaccgatgtccgggagagcctgcggaacgcaaaggcggcgctggcccagggtggcgtgctggcactcaacgaactcacggccaacacgttgatggcgcacctcacgttcgggttgctcgacgggtggtgggcgttcgcggacaaggcctcgcggctgctaggcggtccggcgctctctccttcgctgtggaagcgcgcactggagcgcgagggctaccgctcggtcgcgttccccgtggaggacgcgcatcacctggggcagcagattgtcctcgcggagagtgacggcatcgtccggcagcctcgggccgctcggacgaaggcactcgcagggcggggggaagacgcgcgtcacaccgtcgccgcgccggccgtcgcgtcgccgaagtccacgggcctgtcggggggcgagctgcggaccgtcgtccgggactgcctggccgcgtgcgtggagatggcgccagcggcggttgcgaacgaccgcaggttcaccgaatacggcgtggactccatcatcgccgtcaagctgatcaacgcgattggccagcggctgggcctggtgctggagaccacgctgctgttcgaccacggcaccgtcgacgagctcgcggacgcgctggtggcccggtatggcgctcagctccaggtgtcgcgtcccctggcgaagaaggcggcgcccgcgccgcagcctgaggttcccgcggcgctggggctcacgccctccgccgaggcgcccctggtgtgcagggtgctgttggagcggccggggcaggcggatgacatcaaacgcatcatgaacaccgcgcagccgctggaagaccgcgaggtccgtgtggcggtgagggcgttctcgctcaacttcggcgacctgctgtgcatcaagggcctctatcccacgatgcctccctatcccttcaccccgggcttcgaggcgagcggcgtggtggtggagataggggcggcggtgcgctcgctcaagccgggagacgcggtggtcgccggcatgggagagatgctgggcgcgcatgccacgtccatcgtgtgctccgagtcgcgggtgttcctcaagcccgcgaacctgagcttcgaggaagcgtgcgcgttgcccgccgtgtcgctcaccatgattgacgccttcaagaaggcggacctccagccgggcgagcgcatcctgattcagacggccacgggcggcacgggcttgattgccgtccagctcgcgcagcttcagggcgcggagatcttcgccaccgcgggctcggccgagaagctcgagtacttgaagcgtctgggcgtccatcactgcatcaactacctcgaggaggatttcgaggcggcggtgaagcaactcacccatggcgagggggtggacgtggtcatcaacaccctgtcggggaccgccatccagaagggcgtgaggtgtctgcggccgggaggcaggtacatcgagctggcgatgaccgcgctcaagtccgagaagtcgttcgacttgtccgtgctcaatgacaatcagactttcttcagtctcgacctgagaaagctggcgagctcgcggccggatgtcattgcccggcatcaacatgagttcgtcagactggtggaggagggcaagctccgggcgaccattcaccgcacgttccccttcagcgacgtgcagagcgcgtacaaggccctggaggaccggaagaacatcgggaagattgtcgtcaccatcgactcgccgcatctggatacacaggacgtgagcgcgcctgccgcggtgggccgttcgacggagcccctggaccttggcgcgttcacccgcttccaggaactggtccgtctcaacggcagcaccgagggccggcccatcttctggttccacgcgagcatggctggcgtcgaggtctaccgcgccctgtcccaggagatccgccgtcccttcctggggattcaagcgcgcggctggatgagccaagaggcgcccatcgccggcatcgaggccatggcgtcctactacgtggacatcctcctggcggcccagcccgaggggccctatgagctggggggctactccctgggcggaatgctggcctacgaggtgactcgccagttgcaggaacgcggggcgcgggtggcttccatcgtcatgctggatgcacccgacagcacccatctggatgtgttccagttctcacggcgcacggcgacgttccaggcggtcaacacggccctgttctcctccattgcccatcacccggaacggctggagcagacgctcatccaccgcgatgaggtggaggcggacctggatgacacggctctgctgcgccagctgatggggctcgcgcagtcgcgaggcctgagcaaggacgagaaccaggtgcgtttcatggtcgagcagaacgctcgggtccatgcggcgtacgacgtgggccggttccggctcaagcccctgcttcgtccggaggaggtggcggtgttctatctgcgcaatggcagttgcagcttcttcggcaacctggagccgtatctcaccctgacgcccggcgagttgacgttcgacggaaccaactactgggcggagtgggaacggttcctgccccggatgcagattctggaagtcgcttcgtcaaaccatctcatgttgctcgcggagcccgctgttcaacgggtgattgccggattctgtgcccggttctacgggaaatag

SEQ ID NO: 6882 - DNA, 472 bp, Myxococcus xanthus
gtcgcccggttccaatacaacatggcgtcgaagatgtactcacaccagggctacaagttcatcaactgtggctacgcggacatggagggcgaccacaaggcggtggatttcaaccggccggagaatgtgtatgtgttgtgggaaagcctgtaccagcgcgtggtggggcaggcggagctttccggtcgcgaagtgctggaggtcggctgcggccgcggcggtggcagtgaatacctgatgacgcggctgaagcctcgctcactgacggcggtggacctctccgacgtggccatcgcgcgctgcaaggagaactaccggctggacgggctgtccttccaggtgggcaatgcctgcgcgctcccgttcgaggacaggcgcttcgacgtggtggtgaatatcgagtcgtcgcactgctacccctcgcagttgacgttcttcgaggaggtcaagcgggtgctcaagcccgggggcg

SEQ ID NO: 6883 - DNA, 219 bp, Myxococcus xanthus
atggaggcactgaccttgagcaccgatcaaaagggcacccggatcctggcgcgcacgttcttcaaccagttgcgcgcgagcggctacaccccgcaccaggtgattggcatcgccacggagctgctcgagctggtgacggcggacatcaaggaaggcgacaaggcgacggccgtccaggcggcgcaggagcaggccccggagcgtcgcccgcacgcctga

SEQ ID NO: 6884 - DNA, 369 bp, Myxococcus xanthus
atgggatacgtcgtgcggacgccggagggcgagctggtctaccccagcctgctggatgtggagcgggcctacgtccaggggctggtggacgcggaggacgaagtccgggaggagaccgcgaccacctggcgcaaggcggcgagcatccccgttcttgcccgggcgaaacccgcgcgctcgggggcattgcagcggggccaggtgcttcgcgtcgcggccgtggtgctgctgagcgcgctggccctgtccctggtgttccgcgacgaattgcggctgcgcggtatcggcatcgtcctggcactggtggccagctccctgctcttccaggtcaccaccaaggccttcaagcgcacgcccagcggaggctga

SEQ ID NO: 6885 - DNA, 1596 bp, Myxococcus xanthus
atggcgtatcgggtgaacaacatcgggctgtggctggacgagccagaggagctgctcggtcagcgcgccgcggagaagttgggcgtcacccgctccgacctcgcgtccgtgcgggtggtgcgctccgtgctggacgcgcggaagaagggcagcccgcgctacatctacacgctggaggtggagctggcccggggcaagaagccggcgaagctgccaccggacgtgggtgagacgccccctcctcccgaagcgctgggcccggtgaaggcgccggagcagtggcccatcatcatcggcacgggccccgcggggctcttcgccgcgctgggcctgctggagcgcggcgttcgcagcatcctgctggagcgaggccgcgaggtggtgtcgcgccgcaaggacgtggcgaagctcatgcgcgacgggacgctggaccccgaaagcaacatgaacttcggcgagggcggcgcgggcgcgtacacggacggcaagctgtccacgcgcatcaaccaccccatggtgcgcaaggtcatcgaggccttcgcccgttacggcgcgccggaccacatcctcatcgagggcaagccgcacatcggctcggacctgctgcccggtgcggtggcgaagctgcgtgaggagctcatcgctggcggctgcgaggtccacttcagcacgcgcgtggacgacctgctctacaaggacggccacatcgcgggcgtgaagctgtccgacggacgcacgctggagagcaaccgtgtcatcctggctcccggcaactccgcgcgcgagctttacgagcgcttcgccgccgacggccgggtgattgtggaggccaagcccttcgccctgggcttccgcgccgagcacccgcagacgctcatcaacagcatccagtacggcaacgcggccaagaatccgcgcctgcccccggcggactacaagctggcggagaacctggaggtggacggcgaggtgcgcggcgtcttctcgttctgcatgtgccccggcggcatcgtggtgcccacgcccacgcaggacggactccagtgcaccaacggcatgagcaactcgcggcgcaacgcgcgctacgccaactcgggcatcgtcgtgtccgtgtccgtggcggacttcgagcgcgagggcttccgcgggccgctggcgggcctggagttccagcgtcactgggagagcaaggcgtatgagctgggcggaggccgcttctacgcgccggcccagacgattcctgactacctggccgggcgcgtgaagaaggacccgggcggcaccagctaccgtcccggcctggcgcacacggacctcaaccaactcttcccggcgcggctcaccgagtcactgaagcaagccctgcgcaccttcgagcggaagatgcgcggcttcatcagcgaggagggcaagctcatcggcatcgagagccgcacgtcctcaccggtgcgcgtcacccgcggcgaggacctgcagtcggtgtccatgaagggcctctacccggcgggcgagggctgcggctacgcgggcggcatcgtttcgtccgccgttgatggactgcgcgtcgctgagcagattgccaccgaactgtcctga

SEQ ID NO: 6886 - DNA, 807 bp, Myxococcus xanthus
gtgctctcaagtcaacaacagcgcgagcagtgcgccacccagacggacacgaagagggtaggaaggggcattcacagggtcggaccataccccttcacgacgaaggggcaatccgtcccgcgggtgttagcctcccccgcgctttcgccatcgatgaacgcacctccccggccaccctcatccttccccccccgtcacggttcggggctgctcgcctcgttcggtcacgcgtgggcggggctcatccacaccgtcatctaccagcgcaacatgcgcgtccacctcatcgccgccgtgctggtggggctggtgggcagcggtatccctctggggctcgcggagaaggtgacgctcatcttctgcgtcctgctcatcttcttcgccgaaatcctcaacagcgcgctggaacacctggtggacctggccgtccagcagttcgacgagaaggcccggctggccaaggacgcggccgccgcgggcgtgctggtgctcgcgctgggcacggtggtcatcttcgccgccatcctggtgcacaactgggacacggtgcgcacgagcaccgacgccatcatccgccaggtggcgctgggtctgccgctgacggcctgcatcctggtgctggtgttgccgcagcgccgtcccgcgtgggtggatgtggctgccttcaccgcgggcggcgtgctgatggcgctccaggccacgcagacggccagtagcgtcttcagcgccctcaccgcgggtctgctctttgtcgccggcgcggctgcgtaccagcggaggcgggagcagagggcgccccgcgcctga

SEQ ID NO: 6887 - DNA, 1176 bp, Myxococcus xanthus
atgacaggcttgtcacctgcggccgcgccggacttcgtgcaactgcggagcttccatgcggcgggcgagcccgcggcaacgagccccgtctcctccgtaggaacaccttgcgcgacggcgacccagccccagacatgtctgtctgagctcgaggcgttggcgcctgcccgtgggttccgcgacgcctgcggcttcatctgcaccgactatttcctcgcgacgacccggggcgacgtggtgtctgccatctcctcgctggaggccctgaagtcgttcctagggccgattgatacggcgcaggaggccgcgctgacggcctttgccgcgggctacgcagtgcgctgtggcgggctcaagtatggggcggtgaaggagttgggcgacggtgcgttcggcgtcgtcggcaccaagggcatggcgtgtggcaaggggacggagttgacgcagtatgctctgcgcgtgtcgtcaacgggcgaggtggtggaggaggagcgcaatgtgttggagcggggtgcggataactgttccgtggggcgcaggcccggaggactgcgctcacaaggcgcggtggcgtgtgacgatgtgctgggacagcacttcgccgccattgcccatctggaggccgcgtccatccaggccttcctgttgctccgggaggagctggccgcgcatggcgcggacctcgcgctgcaggacgcggcgctgatgagtgccctggaggaggtcatgcacacggaggtcagcgcccgcctggcggggcggcacggcgcgacgccccaggctcccagggtggacgcggcggcgccccgttccctgttcgcggtggcgctggacaacgcggtggagggctgtgtgcgggagacattcggcgcgctggtggcgcggcaccagtcgctccatgcccaggacgccgaggtgcgcgcctccatggcccgcatcgcggaggacgagacgcggcacgcggagctctcgtggaagattgatgcctgggcgcaggcgcggctgtcggagggggagcgcgaggtgctccggctggcgaagcagcgggccgcggcggccctgcgcgaggaggcctgcgtgccggtgaatcccgtgctcgtgtccgaggccgggctgcccccgcccgaggtcgccgtggcgatggtggacacgctcgctcaggagctgtgggcctga

SEQ ID NO: 6888 - DNA, 1515 bp, Myxococcus xanthus
atgagtacgggctccatccttggcatcgacttcgggaccaccaacaccgccgcggccttcttcgacaaggccggcaagcttcgtgtcgttccggtgacggacaagagcgtcacgctgccctccgtcgtctggttccacgcggcggacaaggccatcgttggccacgccgcgcgccggcaaatcattgacgaccctcgccacaccgtcttcggcgccaagcgcttcctgggccgccgcttccagtccgagtacgtcacccagcacaaggacaagtacgccttcgggctcgtcgaggccgaggacggctacacggccgtgacgatgtacgggaagcagacgtcgctgacggacgtggcgcacctcatcatcaagcagattcacacgttggcgaaccacgccgccggcacgcccttccgcgagtgcgtgctcaccgtgcccgcgcacgccagcagtcgccagcgcgcggcggtgcgccatgccgcggagcaggccggcctccaggtgcgcgccatcatcaacgagcccaccgccgccgcgctctactacgccaacctgcgcaaccccgagcagacggtgatggtgttcgacctgggcggcggcaccttcgacgccaccctgctcgcggtgcagaacaaggtggtgaaggtgctggccaccggcggtgatgccttcctgggcggcgccaacttcgacgagcgcatcgtggagatgctggtgaacgacttccagcagaagcacggcatcgacctgcgcgggaacaaggtggtgatgcagcggctcgtcttcgccgctgagtccgcgaagatggcgctgagccagcgcgacgccacggtgctccgcgtgccgtgcatcgcccagaaggacggcggcttcatcgacttcgactacacgctcacccgcaagcgcctggaggagatggccttccagctcatcgagcgcaccgcatccgcctgcgacgacgtgctagagcgcgcgaagctgaaggcagaccagattgacgagctggtcctcgtcggcggccagacgcgcatgcccgccatccgccagcgcttctcccacttcaagcgcatgtcctccgacaaggaggtcaacccggagctcggcgtcgcggtgggcgcggccatcctcggccggaacctggcgcgcggcatcaccggcctggcggacgtggtgcccatgcccatcagcatcatggtccccggcggcgcgcagcacgaggtcatccccgccaacacccccgtgcccgcgacgaagtccgtgacgatggagctgccgatgattcccgggccgctctccatcgccctcttcgaggcgctggacaccaccaccgtggaccgcgagctgctgggcaccgtccgcgtcgagttggactggcgcaccacctacaagggccccaccacgctggagctccgcatgggtcaggacttcgtcctcagcgccgcgctcgtctcccctcagggcgcccggcatccgctggccatcagcgacatgcgcgcacccaagcgctccgcgtaa

SEQ ID NO: 6889 - DNA, 390 bp, Myxococcus xanthus
atggtgggtaagtccgcggtgggtttgacgttgatccgcgtggtgttcggtctctcgttggcgctggggcacggcctgcccaagctcaccggcgacatgagcaagttcgcggcgggcgtggcgcagctcggattcccgtttccgacgttcttcgcctggtgcgccacgttggctgagttcctgggcgggctgctggtggccgtgggcctcttcacgcgtccggcggcggcaatggcgggcttcaccatggcagtggccctctaccggcaccgcgcggaccccttcggccgcatggaaatggcgctgctctacctcgccgtcatggccggaatcgcgctcatcggcgcggggccgtggagcctcgacgcgaaagtccgccgtcgcgcctga

SEQ ID NO: 6890 - DNA, 270 bp, Myxococcus xanthus
atgactggaatcgatcgctcttcgtcttcaagaagctcccagcgggaatcgcgcgtgtcgggaggggacgccgcccgcggcctccggaatgagacgaaccggcgcgaggacgcgcggcagcccgagcagaacaaggccaagggctattcggtgaaggacggctgggattcgcggcccgcccacgcggcgaagcagtcgcaaccggcggtcgaggcccaggccgtggccgcggaggacggagttgccgccgcgacggagccggagtcttga

SEQ ID NO: 6891 - DNA, 309 bp, Myxococcus xanthus
atgacgctgctccccatcctggttctggcggcgggcacctatgccttccggctcgcgggcccgctgctgagccagcgcatgcaggtgtccgcgcgggtccagggcctgctgtccctctccgcgattgcgctgctcaccgcgctggtggccacggccacgctgacgtcgaacgggggcttctcgggctgggcacgtccggcgggggtgctcgctggcgccgtgctggcgtggcggaggctgcccttcgtcgtcgtggtggtgggggcggcgggtgttacagctttgttacgaatggcgggtgtaggttga

SEQ ID NO: 6892 - DNA, 609 bp, Myxococcus xanthus
atgtccgtgttcgtcttcgcgggcggttcgcagttcatggccgtgggggtggtggcgggcggtggcagtcccgtggccgcggtcatcgcggggctgctgctcaacgcgaggcacctgccgttcggtctggtgatttcggacgtgcttggaaggcactggctcgtgcggctgattggcacgcacttgatggtggacgagtccgtggcgttcgcgctcgcgcagtccacgccggagcgtcggaaggcggcgtactggctgtgcggtggggcgctgttcgtggcctggaatgtgggcgtcctcgtcggcgccctggcgggaacggcgctgggcagcccggaggcgatggggctcgatgccgcgtttcccgccgggttgctggcgctgctgctgccgtcgctgaccgcccccgccaagcctccgaacgccgagcccggtaccgcggagggggaggtcgagacagcacgcgcccacgaagcccgcgcggcggctgcccgggcgcgctgggtggcggggggcgcggcgctcatcgcgctcgccaccacgccgattcttcccacaggggttcccgtgctgctctcgctgctggcgctcgggctggtgctgcgatga

SEQ ID NO: 6893 - DNA, 141 bp, Myxococcus xanthus
ccggacccgcaggagtcttgggtcctgctcccgctgctggtgccttgcgccgagaaggcgctgaacgtctaccaggtgtcgcgcgtggtgaactcccctgccaacgacaccccggagtgtgtggaacgcgtgcccgcctga

SEQ ID NO: 6894 - DNA, 1950 bp, Myxococcus xanthus
gtgtggatcaccctcggctccgatgccctcgaacacgtgaacgccgctttcgccaacgccggacatgcggcgccatcgatgagagggcagacggcggacgtcaccgcgctacgcgtgcgtgagtcccagctcaacctcatctcgcgaatgatgcacgagaagctcaaccgctgcggtggcttcatctaccacgacactgaagcggccgcgctcaccgccctggacccgtcggtcgcggcgaaggccgccaaggccaccgccgtcacgtacagcctggacaacgcgtcgacggtcaacgcgttgcaagcgggggttcaggagctggccatccgatgggtcatcgaccacctgtccagctacgcgacgcgttactacacgtcgacgacgggcgtggcgtcagccaactggctgaagggccattgggagtcgctggttccgccggcgcgctccgacgttaccgttgaactcttcaaccacgcctcgtgggcgcagccttccgtcatcttgacgattaccggcaccaccctgtcggaagaggtcgtcgtgctcggtggccacctggactccaccagcaacggcagcacggctcccggcgcggacgacgatgcatcgggaatcgccacgctcaccgaggtgattcgcgtggccatgctccagaactaccgcccggagcgcaccgtgaagttcatggcctacgcggccgaggaagtgggcctgcgcggctcttcggcaatcgccaccaagtacgcggcggatgcagtcgacgtggtgggcgtgctccagctcgacatgacgaactacaacctgcggtcgaacatcgacgtggccttggtgagcgaccggacgaacgcggcgcaaaacacgttcgtcaccaacctcatcgacacgtatcagcccgaactcgaatggaccacgacgacgtgcggctacgcgtgctcggaccatgcgtcatggacgagcgcgggcttcgcggcctcgatgcccttcgaggcgccgctgagcgcgtccaacccgtacatccacaccgtcaatgacacgctccacaacagcgggggcgatgcccgtcacgcgctcaagttcgcgaagctggccgccgcgtacgtggcggagctggcgaagggtggggtgacgattgacgagacgccgccggaggtcgccatcaccgcccctgccgccggaagcacggtggctggagttacgaccgttacggtctcggccacggatgcttccggtgtgaaccgcgtggagttcttcgtggacggcgaactgaaggcgacggacaccacggcgccgtacgcgttcgactgggacacggccgcggtgcccaatggcagccacatcgtgacggcgcgggcggttgacctcgtgggcgtcgcggcgaccagcgccggggtgtccgtgacggtgagcaacgcgaccagtacggctggattcgattctgtcctgagggcgccgcggtgtgcctcggcctccaacgcgtgtgattccggtacgctgctcaatggccgcggcggcttcgtcgggcccgaggtgaacgcgccgaacaccatcaagaactcctgcagggacggcttgtcgggtgcgcacctggttgaccagtcgaacgagcgcatcgtggtgtccacgctggacgggacgaacttcgcgccgggcaagttggtgcgcgtcgatgcaacggtcttcgcctacaacaagctcaacgacaagttggacctgttctacgcggccgacgccaacaaccctgtctggcagctcatcaccacgatgcccgttccgtccaagggcctccacacgctgtccgccacctacacgctgccggagggcgacgccgcccaggccgtgcgagcggtcttccgcaaccgcggaagcacggcgccttgcgtggaaggcaactacaacgaccacgacgacctcatcttcgccgcgcagccgtccgcgctgctgcgctga

SEQ ID NO: 6895 - DNA, 303 bp, Myxococcus xanthus
atgcgcacgcggagcccgcaggcttcagcggtgcttcgcgagctgctcgcggccatcgacaacgcggaagcgccggacatgcgcgtggcgcccaccgccgtgggtgacgtgttcgccggaagcgctggtgggctggggcatggcgaagtgccccggctggccttgactccggaggccgtgcaggccgtcatcgaccgcgagcttcaagagcggcgtgacgcggtggccctctacgagaagctcggcaagcaggacgaggcgagtgccgtgaaggcccagttggatgtgctcctggcgctatga

SEQ ID NO: 6896 - DNA, 450 bp, Myxococcus xanthus
atgaagttcgcgaggggggcgttcgcactgctggcgggcggggtggtggcggtagggggtggtggctgtgcacacgcgcctcctcgggtgtccccggagctgagcgcccggctggagtcggagccgggcacctgggtgtccggtagcgcctcgggccttgggcgcaaggccgtcctcaacaacaaggacttcatctggggcctggccttcgcgccccaaggcgcccgggtggcgtactcgcgcctgggcagcaagtcctacttcctctccgtgtgggagctgggctccgccgagccgacgatgctggcggacccggccatcaacccctacgagttcgacgtggagggcgtggccttctccccggatggcacgcgcgtggccaccgcgggcaaggacagcgtggtgcgcctcttccacgcggccaccggcgcgcttgtaggcggagcgccc

SEQ ID NO: 6897 - DNA, 1020 bp, Myxococcus xanthus
atgagccggcaggacggcatcaccgagctgggcagctacgtcttccgcaacatgctcaccaacgcggcgcaggcggaggccatcgccgactacgcgatgaacgtgaagggctacaagcgcttcgcgctgctgtacccgaacatcccctacggcgtggagctggcggatgccttctgggaccaggtggtggcgcggggcggcggcgtgcgcggggcggagcgctattcgcacgaccagacgaccttcaccaccgaggccaagaagctggtgggccgctactacctggatgaccgcggcgactacatcgagggcgtgcgcgacgtgcagggggagaacctggacgccttccgccgccgcaaggcgatggagaaggtgaagagcggcgtggagcccatcatcgacttcgacgccatcttcatgccggacgactggcgccgcgtcagcctggtggcgcccgcgctggcggtggaggacatcgtcaccaacgcgtgtgacccgcgtgatttggagcgcatccgcaagacgacgggcaagaaggagctgaagacggtgacgctcttcggcgccaaccagtggagcagccccaagggccgctcggggctgccggagctggtggagcgcggcggcaagttcgtcacctgctcggtgttcgtggacggcttcttcgtggactcgcagcgtccggccacgcgccgcttcgtggagcagtaccgcgaggcctaccgggcggagacggggcgggacccgggtctgctggaggccattggctacgactccggtcggatgttgcggcagctcatggagcagaaggatgcaccgcgcacccgcgcgcagatgcgtgacgcgatggccaacctgaaggacttcgacggggccaccgggcgcacgtccttcaacgcgaagcgcgaggcggtgaagcagctgttcctgttgtccatcgacaacaagggcgtcacggaaatcaacgtcgagaaggagcggcagaaggccgcctcggcgtcaggaggctcagggacatga

SEQ ID NO: 6898 - DNA, 261 bp, Myxococcus xanthus
atgcgctacatcacccagatccgtctcgagggaggcgcgcttcacgaacacattgcccgccttcgctggaaggagggcaacgaggtgggggagggcagccgcttggagctggtccagtggctcaaggcggggggagatgcccgggtacagacgtggccccgggacgtgaaggtcgaggtcatcgacgcccggcctccgtacctgcggacgaaggccaatggcatcctcacggacaacctgctggagctgccgcgcttctga

SEQ ID NO: 6899 - DNA, 1095 bp, Myxococcus xanthus
atggatgtcctgcccaccctgcgccgctcgctcgtcatcgccctggccctgctgctgacggcctgcccccggtccacccgcacgccctccggaggtgacaccggcggggacctgccttcgggagacccgttccccacgcgtccttcggtggaggcgaagaaggaccccaccgccgacgcggcgctggcgcaggcatcccagacggcccgcgccaccccggacaagaagaaggccgcggaggcctacctgtcggtgcgcaaggcgtatcccgccaccaccgcgggccaggacgcgctctatcaggccggcgtcctcttcttcgagtccaaggacttcgtcaacgcgcgcaagagcttcaacgagctgctcttcgagaacccgctccattcgcgggcggatgacgccaagcacaagctggccgtctccgcgatggaggtgggcgcctaccgcgacgcgtaccagacgctctccagcctcgccgagcgcgccagtggcgccgagcgcacccaactgctcaacgaggccgctcgcgccgcggagggcgccggcctctacgggcaggcgctgcagattgcggtggacgaggcgggccaggcccagggcgctcaggcgcaggccgccgcggtggccaaggtggaggcgctggtggagggccgcgcgggcttcgtggacatcgcccgcgtggcggagggcctgtcgccgtccaacccggcgtggcccgtcatcaccttcaagttggcgcgcgtctactaccacctgcgggactggacgcggctggaggagacgctgaaccgtttcctcgcccaggcgcccggccacgccttcgcgccgcaggcccgcgagctgctggcccgcgccacgcgccgggtggaggcccgcccccgcacggtgggcgtgctgctgcccatgacggggccgctaccagcccattggcgaggcggtgctgcgcggcatccagctggggctggaaggcagcggcgtggagctggtggtgaaggacacgcagggcgacgtcaacaagacgggccaggccatggagcaactggccttcgacgacggcgccatcgccgtgttggggcccctgctggcggatga

SEQ ID NO: 6900 - DNA, 630 bp, Myxococcus xanthus
ccctgctcggcgtcggcgggcagcggcgagctgcgctacacccagggcttcttcgcggtgtcccggccctgtggtgactgcggcggcacgggcgcggtggtgccggacccgtgcacgcgttgcaagggctcgggcaaggtgccctccgaggaggtcatcgaggtggccatcccgggcggcgtggacaacggcacgcgcgtgcggctgtccggcatgggcgagcctggagaccggggcggtccgccgggtgacctctacgtcaccgtcatcgtgaaggagcacccgctcttccagcgcgaggagtacgaggtcttctgcgaggtgcccatctccttcacgcaggcggcgctgggcgcgaaaatcgacgtccccacgctggacggcaaggtgaagatgaccgtccccaacggcacccagtccggcaaggtgttccggctcaagggcaagggcatcccccacctgcacagccagcagcggggagaccagcacgtgcgcgtcgtggtggagacgcccaccgagctgtcgtcgaagcagcgcgagctgctggagaagttcgcggaggcctccggcgaggagtcgcacccgcagtcgaagagcttcatcgccaaggtgaaggagctgttcggctga

SEQ ID NO: 6901 - DNA, 792 bp, Myxococcus xanthus
ggctacgtctccgtgctcaccggcggaacggactgcaacgacaacaacgcgagcatccacccggctgcaaccgagctttgcaacgacgtcgacgacaactgcaacggacagtcggacacggtagagctgcgcctgggccagagctgcacggagggcgaaggctgtgagggcgtccgcgcgtgcggtgggaacggcgaggttctctgcgacatgccgttggccgtgtatgcctaccccgacgtagaccaggacagacatggcgaccggaaagccgctcccgtcgcattctgcaccggtatcccgcagggctatgtcacgggtcccgcggatgactgcaacgacaacaacgccagcatccggcctggcgcgacggagctctgcaacggcgtcgatgacaactgcaacgaccagattgacgagaccttccccgacctcggcacggcgtgcaccgcagccgcccagtgcgctggcgtctacgtctgtgacgcctccggcatcgccaccacctgccagcccacgatgttccccaacaactggtacctggatggcgacggggatggctttggtgttggcacggccgtgtcgtcctgcgtcccgcctggcacggactacgccaccaccggtggcgactgcaacgacggcaacccgttcacctaccctggcgcgccggagttgtgcgacgccctggacaacaactgtgacgggaatgtcgaaggccccgaggtctgcccaagcggcggtgccagttgggcagcccgctccgtgggcgcgagcgatcaggagggctttaga

SEQ ID NO: 6902 - DNA, 1314 bp, Myxococcus xanthus
atggaacccattgtcatcctgggcgcgggcctcgcgggcctctccaccgcccacttcctgaacaagccctggcgcctcatcgagaagtccgaccgtgtcggcggcctcatcaagaccgaggtcatccaggggtgttattttgaccccaccggtcactggctccacctgcgcgacccggaaatccaggccctggtgaacacgctgtggctgccggagcagatggtccgcatccagcgcaaggccggcatcttcacgcgcggggtgttcacccgcttcccgtaccaggtgaacacccacggtctgccgccggaggtggtggcggagaacctcaccggctacgtggaggccgtctacggtgagaagggccgcgagctgcgcgagcgcgagccgcgcaacttcgaggagttcatcctccgctacatgggcgagggcttcgcgaagaacttcatggtgccctacaaccagaagctgtggacggtgcacccgcgtgagatgtccgccgcctgggtgggccgcttcgtgccccgtcccaacctcaaggaagtggtggacggcgcgctgggcgctggcagcgacgcggtcggctacaacgcgtcgttcctgtacccgcgagagggcggcatcgagagcctcgcccgcgccatgctgagccacctgaagggcggccagctcagcacccataccgagcccaccgccattgattggaaggcccggaaggtgacgctgtccgacgggagcgtgcagccctatgcggggctggtgtccagcatctccctgcccgggttggtgaagctgctcgccaagggcgaggccggcgtgcccgacgcggtgcaggacgcggcgaagcagctgcgcgccaccaccgtcacctatgtggccgtgggcgccaagggggccaaccgccagccctggcattggatctacctgccggagccggagttccacacgtaccgcatcggctcgccctccgcggtgtacgcgccgctggcgccgccggacacgtccaccttctacgtggagtacagccaccacggcgagctgtccctggccgcggcggagaagtacgcggtggaggacctggtgcgctcgcagatgattcacgccgcggacgacgtgctcttcgcccaggcgcgcgagattccccacgcctacgtgctctacgacgacgcctacggtccggcgaagtcggagattctgcgcttcctggagcataccggaatccagattgccggccgctatgggcagtgggagtactcctccatggaagacgccatcctcgccgggcgtgcgtgcgcgaggatactcaacggttga

SEQ ID NO: 6903 - DNA, 711 bp, Myxococcus xanthus
atggccccgcacctcaccgtcgtcatccctgtctacaacgaggagtccatcatcgcctcggcggcggaggagttgcgccaggggctggacgcgcgcgggctcgactacgaaatcatcttcgcggagaacggctcgcgcgacgccacgccggtcatcctcgaagagctgtgcgcgagcaacccgcgcctgcgctggttccactcggagacgcccaactacggcgtggcgctcaaggccggcatcctcaaggcccggggcacctacgtcatctgtgatgaaatcgacctgtgcgacctgaccttctacgacgcggcgctgccgcggctggagcggggcgaggcggacatggtggtgggctccaaggcggccaagggcgccagtgaccagcgcccgctgattcgccgcgcggccacgcgggtgcacaacaagctgctgaaggtggcgctgggcttccagggcacggacacgcacggcctgaaggcgttccgccgagaggcgctgctgcccgtcatccagaagtgcgtggtggacatggatgtgttcgccagcgagttcgtcatccgcgcgtggcgcgagggcttgcgggtgatggagattcccatccagctccacgagaagcgccagccctccatccacctgttcaagcgcgtgcccaacgtgctcaagaacgtgggcaagctattctacgtcatccgcgtccgcgggacctga

SEQ ID NO: 6904 - DNA, 450 bp, Myxococcus xanthus
atgggggccctgtcggtgctggggcgtccgtcccgctccgtgctggacacgccccgcgtgctgctggcgcctcgggtgccgtaccggcccgacccggcgcagccctaccggcggggctcgggcaccgtgctggagttgcccatgacggtgacgcccgcgctgcgcttccccctcatcggcaccttcgccaccacgctgccccgcgcgtccctgcacgcgctgtggcgcacgtgccggcgggacaccttcttcaacttcgaactgcacggcgtggacgtgctggacgcgtcggacgggattcccccggagctggtgcggcagcagcgggatttgcgcgtcagcgccacccagaagatggcgcgcctgcgcgaggtgttcggctggctgaagtcggagcgcgaggtcctcacgctgcgcgacgtcgccgggcggctgtcggcctcggtgtaa

SEQ ID NO: 6905 - DNA, 749 bp, Myxococcus xanthus
  unsure (1)..(749): unsure at all n locations
atgctggagaacgtcaccgaccgagtgaagaagggcctgcgcgagtggacggaccggctggccaacaccgaacagaagcagcggctccacggcctgtcgcgcccgggtaacgagtacggggtggacccgttcggcttcgatctggactacagcctgtccgcggtggccccgctcctgtggctctaccggaactacttccgcgtggagacgtttggcatcgagaacgtgcccgccggccgggtgctgctggtgtccaaccactccggccaactgcccatggacggcgccatgattggcgtggcgatgatgctggatgccagcccgtcccgcgtcatccgcagcatggtggagaagtgggtgtcgtcgctcccatacgtgtccaccttcatggcccgcgtggggcagattgttggcacgccggagaactgccggcggctgctggagtcggaggaggccatcctcgtcttccccgagggcacgcgcggcatcaacaagctgtggccccagcgttaccagctccaggagttcggcctgggcttcatgcgcctggcgctggagacgaacacgcccatcgttcccgtggccgtcattggcgcggaggagcaggctccggcgctgatggacctcaagccggtggcgaagcttctgggcttcccgtccttccccatcacccccacgggcctgcccattcccctgcccacgaagtaccgcatctacttcggngagccgctgcacttctccgggcgccc

SEQ ID NO: 6906 - DNA, 1098 bp, Myxococcus xanthus
gggggcatcatgggctgcggcatcgcgctgcggctgcggcaggccggagtgcgcgtcgtcgtgctggagcgctccattccaggtgcggaggcctccagcgcggcggcgggaatgctcgcgccccagatggagtccgacggtccgggcgccttcctggaattgtgcctgcgcagccgcggcctctatcccgccttcgccgccgagctgcgcgagctttccggcgtggacgtggcctaccggccctgcggcatcctcaaggtcgccttcaacgaggccagcctgcaccacctggacgccacggtggcgtggcagcgtggcatgggcctccgggccgaattgctcgacggcgccgcggcccgcgccctggagcctcgcctttccgcgaaggccgtgggcgccgcgcacttcccggatgaccatcagttggacaaccggctcctggtgcgagccctgacgatggccgccgcccggctgggcgcggagttccgcagcggctacgtgcgcggcgtggtgcaggagggtggccgcgcggtgggcgtggacctggacggcgagctgctgcgcgccgacgcggtggtgctggccgcgggctcctggtccgccctggtccacggcgccggcgtggaggcacgggcggtgcggcccgcgcgcgggcagatggttcaattccagacacgcctgcccctgctggaccgcatcgtcacgtccgagaagggctacctggtcccgcgcgcggacggccgcgtcatcgctggcagcaccatggagctggtgggcttcgacaagcaggtgaccgcggcggggctggcgcgcatcctcgacatggccctggagctgtgcccggagttgggctcggcgcccgtcacggagacgtgggcgggcttccggccgtggaccgaggacaagcggccctacctgggtgaaggccccgtgcccgggctcttcctggccacgggccacttccgaaacggcatcctcctggcccccatcaccgcgaagctcgtcgcgcaggccgtactgggtgagcgtcccgccgtggacctggcccccttccggtacgatcgctcgcccgcccaaccccgcacctgacgcaacccg

SEQ ID NO: 6907 - DNA, 1143 bp, Myxococcus xanthus
ggctacaactgtgtcgtcgccaacggggccgagatggccctggacctggcgggcgaggaggagacgccgctcgtcatcagtgacatgaagatgccgggcaaggacggcctctggctcctggagaacctccgcgagcggctccccgacacctccgtcatcatgctcacgggctacggtgacaccgaatcggcagtggactgcctgcgccgcggcgcggtggactacctgctcaagccacccaagctcacggacctcatccgggccatcgagcgggcgctggccgagcgccgcatcgagatggcccgcaagcgctaccagaagaagctggagcgcaaggtccgggacaggacggccgagctgttctttttcctgcgagacatcgccaacacgaaccataacacgctgctggtcccacgggtggtgctggacgggcgcgagcacgagacgagcgaccactcccagcgcgtggtcagctacacgtccgccatcgcgcaggaccagggcggcctggttcaggtgctgcaggagatagcactgggcctgcagctgcaccatattaggaagattggcgagccggacgctgcgctgcttaagccgagcaagctcaccccggacgagtgggtggagatgcgcaagcacccggacatcggcttccagatgatccaggccattccgttcctggacacgcctgcctccatcgtcctttcgcaccaggagcgctgggacggcgccggctatccgcgcaacctccagcggcacgaaatccacatcggcgcgcgcatcttcgccgtggcggacacgctggacgcgatgacgagcgaccggccctaccgcaagggcacgacgttcaccaacgccatccaggagatcaaacgctgcgccaacacgcagttcgatccggaggtcgtgcgggcgttcctcgacattggcgaggaggggctgatccgcatcaagcaggagatggcgacgaagaagctccagctcccgcaggccgagcaggacgcccatgacgccgaggcggagctggcccggctcacggatctggacgacgacgtggacgccgccgtgcctgggcactccgccagtgacgaggacgagcccaagtccgccgtcgttcgttcggtggctggcaacaaggggtga

SEQ ID NO: 6908 - DNA, 894 bp, Myxococcus xanthus
caggggcggcggatgacgtacctgaggctgagcatcaccgaccggtgcaacttccggtgcagctactgctcgcccgcttcgtggggtggcaagcgggacctgctgggccccgaggagttggagcgaatcacctccgtcttcgcccgcatgggaatccgccgcgtgcggctcaccggcggcgagccgttgatccgcccggacatcctcgacatcgcccggcgcatcgccgcggtgcccggcatccagcacctggccatcaccagcaatgccagccacctggagcggctcgcccgccccctgcgcgaggcgggcgtcacccagctcaacctgagcctggacaccctcctggcggagacgttccgccgcatctccaaacagggggatttcgacgcggtgctgcgaggcgtggacgcggcggcgggcgccggctacgcgtctctcaagctcaacgtcgtcgtcatgcggggcgtgaacgacgaggaagcctccgccctgatcgcctatgcgcacgcgcgcggcttcacgccccgcttcatcgagctgatgcccttcggtcagggcacgccggtgcccaccccggagctggtagatcgtctcgaggcgtcaggactgccgctggatctatagcctgatgacgcgggagacccggccgggccggcgcgctagtggcgtgcgcccggaggccgagtgggcttcatctccccgctcactcagaacttatgcggcacttgcaaccgcgtgcgtgtggcgtccaatggcgacttgcgcagcttcttctgcgaccgggggcaggcgccgctgcaccagctcatccacggcggtgccagcgacgtggagctggcagtggccatccaccgggcgctgggggacaagccataagggcaccggttctcc

SEQ ID NO: 6909 - DNA, 567 bp, Myxococcus xanthus
ggcaccatcgacaccgagggctatatccactacctgattcagacctaccactatgcgcgctggagcacgccgatgctggcggaggcgggccaccggctcgagcgccagggccggcacccgcacctggcggagctgctggtgcagaaggccggagaggaacgcggccacgagaagtggctgctgtcggacctgaagaacctggggtgtccggaggtgcgcgtggagaccgcggcgcggactcccgcggtggacgcctacaccggctggaacttcttcacctcccggtccggcgtgccgacggcggtgctggggaccgcgtatgtgctggagtacctgtcccagacgcgagcgacgggggtcgtggaacgtctgattgcggccgacgcgattccgaacatccggaagtccgtcaccttcctgcgcagccacggcgcgctcgacggggaccatgtggcggagatggaagcggtgctgcggacgctgacggaccccgaggaccaggcggcggtgattttctccgcccgcgccacgcggtgcatctacccgggcatcttccgcgagcgctga

SEQ ID NO: 6910 - DNA, 861 bp, Myxococcus xanthus
atgctgctgaagattgctctgcccaacaaaggccgcctctcggacgaagtacgggagttgttcaatgacgcgggcctggaggtgcgggcccggggtgagcgcgcgctcaccgcgtcattgggcggagagttcgaggccatcttcgtccgcgcccaggacatcccggagttcgtggcggacggcgccgcgcatgcgggtgtcaccggttgggacctggtgtgtgagtccggacgtgagctggacctgctgatggacctggagttcggcaggtgtcgcctggtggtggcggcgcgggaggagggcggcttcgcctcgccggaagacgtgaaggagggcatgcgggtcgcgtcctgcttcccccggctgacgcaggagttcttcgccaggcgcgggcagcgggtggcggtggtaccagtatcgggcgcggcggagattgcgccccatctgggcatcgcggacatcgtcgtggacctgacgtccaccggctccacgctgaagatgaatggcctgcgcgaggtcggcacggtgctggagtccagcgcgcggctggtggcgtgcaagggcaatccggtggacacccagcagaagctggacgagctgaagcaggcgctgggctcggtgttggcggcgcgcgacaagcgctacctgatggccaacgtgccgaaggattcgctcatccgggtgcgcgaagtcctcccgggcctcaatggtcccaccgtggtggacgtgctggacggtggtgacttcgtggccgtgcacgcggtggtgccggcgaagaccatctaccgcaccatcaacgcgctgaaggcactgggctgcgagggcatcctcgtcacccgcattgaaaggttgatggcatga

SEQ ID NO: 6911 - DNA, 93 bp, Myxococcus xanthus
atgccggtggaggacatgggcgccgccgcgcaggcgcgcgcgaagaagggtgacaccgcgggcgcggcggcctgcgcgcgcgcggcgctggcg

SEQ ID NO: 6912 - DNA, 135 bp, Myxococcus xanthus
atgacgctgctgcctggggacatcgtcagcaccgggacgccgtcgggtgtggggaagctgtcggccggggacacggtggaggtggagctggagggaatcggaaccctggtgaaccctgttgagatggagccgtga

SEQ ID NO: 6913 - DNA, 816 bp, Myxococcus xanthus
atgattcgcaccgtcatcaccggcatcaccggccgcatgggcagcacgttgcttcgcctggcgctcgactcgggagacctgcgggtggtgggaggcacggcgcggccgggcagtgcctcggtgggccaggacgccggggtggcgacgcggctgggcccggtggacgtgacggtggtggacagcctggagcgcgcgctggacgccgcgcaggcggacgtcgtcatcgacttcaccagcgcggagctgagcgtggcgcacgcgaaggtgtgtgccgcgcgcggcgtggccctggtggtgggctccaccggcttcacgccggaggcgtccgcggcgctggcggagagcgcgaaggcggtgcccatcgtcgccgcgccgaacatgtcggtgggcgtcaacctggtcatccgcatggcggcggagctggcgcgggtgctggggccgggcttcgacgtggaggtgctggaggcgcaccaccgcatgaagaaggacgcgcccagcggcaccgcgctgcggctggcggaagtgctgacggaggccctggggcgcacccaggaggacctcaccttcgcgaggcatgggcagattggcgcgcggcccgcgcgcgagattggtgtgcagacgctgcggggcggcgacgtggtgggcgagcacaccgtgtacttcctgggtgagggcgagcgcatcgagctcacgcaccgcgccaccaaccgagaccagttcgctgctggcgcgctgagggccgcgcgctgggtggcggggcgcgcgcctggtctccatgacatggccgacgtgctcggcttccagaggacttcatga

SEQ ID NO: 6914 - DNA, 874 bp, Myxococcus xanthus
ggctccatgacggcgctggccactccgtttcgcaacggagcgctcgatgagcccgcataccgggcgctggtccgccagcagattgaagggggcaccagcgtgctggtccccatgggcaccaccggcgaggccgtgacgatgacggctactgagctgggcccgtgcggtcaaggtggtggtgtacaaggcgaagggccgcgtgacggtggtgggtggctccggctccactagctcggcggagaccatcgacggcgtgcccagcgtgcgctacgcgggcgcggacggcacgctcatcgtcacgccctactacaacaagcccacgcaggagggcttgctggagcactaccgcgcggtggccaaggcgcacccgggcttccccatcatcgcctacaacgtgccgggccggacgggcgtggacctgctgcccgacaccgtgctgcggctgtgtgacatccccgaggtggtggcgctcaaggaggccactggcagcatgcctcgggccatcgacatcctggagaagtgcggcgaccggatgacgctcttgtccggtgacgacttcaccgtgctgcccttcatcgcttgcggcggcaagggcgtcatctccgtgtcgtccaacgtggcgccgcggatgatggcggacctggtggcggcggcgcgcgcggggaatatcgcggtggcgcgcgacctccaggtgcggatgaacgagttgcaccgcctgctcttcatcgaatccaaccccacgcccgtgaagtggggattgcacgtgatgggattgttcgggcccgaagtgcggttgcccctggtgcagatgaccgagcccaacgccgcgaagcttcgcgacaccctgcgccagctgggcctgctcacgggctga

SEQ ID NO: 6915 - DNA, 1215 bp, Myxococcus xanthus
gtgccccacgcggcggatgtgccgctggcggccatcgccgagtccgtgggcacgcccatttacgtgtactccaccgccacgctcacccggcacatccgggtggtgacggaggccttcggagaccggccgcacctcatctgttactcggtgaaggccaactcgaacctggccatcctccggctcatcgccgagcggggcggcgggttcgacatcgtctccggcggcgagctggcccgggtgcggcatgtgggcggggacgccgggaagacggtgttcgctggcgtgggaaagacgcacgaggagatggaggcggcgctggccgcgggcatcctcctcttcaacgtggagagcgccgaggagctggaggcgctggacgccgtgggccgccgcctggggcgccgcgcgccattcgccctgcgcgtgaatccggacgtggatgcgcgcacgcaccgttacatctccaccggcctgaagacgtcgaagttcggagtgccgttcgaggaggcggtggccctctacgcgcgcgcgaagaagatgaagggcctgctggccgccgggttggattgccacatcggctcgcagctcacccagacggcgcccattcgcgcggccttgtccaaggtggcgggcctgtattccgcgctcaaggaaaagggccatccgctggcgtacctggacgtgggcggcgggctgggcatcacctatctggacgagacgccgccgtctccggaggagtacgcccgcaccgtgctggccgcggcgggtgccaccggggccacgctcatcctggagccgggccgggcgctggtgggcaacgcgggcgtgttgctcacgcgcgtgctgtaccggaagaagacgccagcgcggcacttcgtggtggtggacgcgggcatgaatgacttgctgcgccccgcgctctacgaggcgcaccacggccttcagcccctggtgaagcggcggggcaaggcggtggaggtagacgtggtggggccggtgtgtgaatccaccgacgtgctggcgaaggcacggcccctggtgcttccgcaagcaggcgagttgttcgctttcatgagcgcgggcgcgtacggcatgagtatgtcgtccacttataactcccggccacgcccggccgaggtgctggtggacggtgcggcgtggcgcgtggtccgggagcgggagcgcgtcgaggatctctggcgcggtgagcgggcctga

SEQ ID NO: 6916 - DNA, 288 bp, Myxococcus xanthus
tgctctaaagacggcaagctgaggctggtgactggtcacgaaagcgaccggtgcttcttcgcggagacggacaccggcacgggtatcgaggagaagcacctgcctctcatcttcgagccgtcgttcaccaccaaggccccgggtgaaggcaccggcctggggctctccattgcctaccgcatcgtccaggaccacgggggcagcttccacgtggacaccgaggtcggagaaggctcctgcttcaccgtttttctgcccatccccctgcagctcgagaggttgccgtga

SEQ ID NO: 6917 - DNA, 1386 bp, Myxococcus xanthus
attctccagcgcgagggccacccggtggtggccattgacgacgcggtggagggcctggcggccgcgaaggatccgaccatcgacgtggtcgtcctcgacatcaagatgcccaacctgtccggcatggacctgctgcgcggcatcaaggccgaccgcccggacgtggaggtcatcatgatgacggccttcgccaccgtggagacggcggtggaggcggtgaaggcgggggcgtacgactacctcaccaagcccttcgagaacatcgacgaggtcagcctcacggtggccaaggcggccgagcgcaaggcgctcaaggaccgcacccgcgcgctggaggaggccctcacggtccgcagccagttcgaggacctcatcggccagtccacgcagatgcgctccgtcttcaagctggtggagacggtgagccactccaccgccacggtgctcatccagggggagagcggcaccggcaaggagctggtggcccgcgccatccactaccgcagcgcgcgcaaggacaagcccttcgtggcggtcaactgttcggcgctgacggagacgctgctggagagcgagctcttcggccacgtgaagggcagcttcaccggcgccaccggcaacaagaagggcctcttcgaggcggctgacggcggcaccatcttcctggacgaaattggcgacgtgcccccggccacccaggtccgcctgctgcgcgtgctccaggaaggggaagtcaaacgcgtgggcgccaacgagccggtgaaggtggacgtgcgcgtcatcgccgccacccacgtggacctgtcccgcgccaaggagcagggcaagttccgcgaggacctcttctaccgcctcaacgtcatcaccatcgacctgccgcccctgcgtgaccggcccgaggacgtgcccctgctggcgcaccacttcctcaagctctacgcctccaaggcggacaagaaggtgacgggcatctccccgcgcgccatggaagccctcacctgcaaccggtggacgggcaacgtgcgtgagctggagaacgtcatcgagcgcgcggtggtgctgacgggcaacgaggtcatcgacgtggaggacctgccgccgggcttccagtccgcgccgcagccggactccacggtggaggtgttcagcctggcacacctgccgtacgcccaggccaagcgcctggcgatgcgtgccttcgagcgccgctacctgtccgccctgctggagaagaacaaccagaacgtctccagcgccgcgcgcgcggcgggcgtggaccgctccaacttccgtcgtctgctcaagcagtacgaggtggccggccggtccatgaagccccgcgtggtctcccaggaccacggcgaggcgctggaagccgcgtcctga

SEQ ID NO: 6918 - DNA, 681 bp, Myxococcus xanthus
gacctgatggtggtgctgggcggtgacggcacgctcatctacgcggcgcgcctgctcggcggccgcggggttccgattctgggcgtcaacctgggcagcctgggcttcatgacggaagtcccggtggaagagctgtaccccatgctggagcaggtgctcgcggggcgcttccaggtggactcccggatgaagctctcctgccgcctgctgcgcgggggcagggtgctcatcgaggacgaggtcctcaacgacgtggtcatcaacaagggcgcgctggcgcgcatcgccgaccacgagacgtccatcgacggggtgcccatcaccacctacaagtcggacggcgtcatcctggctacgcccaccggctccacggcgtactcgctgtcggcgggtgggcccatcgtccacccgtcggtggactgcacggtgctgtcgcccatctgttcgcacgccctcacgcagcgctccatcgtcgtgccggcggaccggaccatccgggtgacgctgcgcagtgagacggcggacacgtacctgaccatcgacgggcagacgggccacgggctccagggcggggactgcatcgaggtggtgcgctcgcacaaccgggtgaacctggtgcgcaacccgaaggtggcctacttctccatcctccggcagaagctccactggggcgagcgctga

SEQ ID NO: 6919 - DNA, 211 bp, Myxococcus xanthus
atgcgggcggcggaggcgggggcggtgcggtccttccagccgggggccacgtatgacgccgtcatcgtcctggggggcgcgttggatccggccgccacggagcgcaccggcgtgccggagtacaacgcggcggcggagcgggtaaaacggggcttcgagctgctgcacgagggccgggctcggcgggtgctcctctcgggcggtttgctgg

SEQ ID NO: 6920 - DNA, 702 bp, Myxococcus xanthus
atgccgccgtcgcgtcgcgaggtgagctgtttcgacacgctggacaccaccgtgcatctggtcgtctatgcggacgcggccccggtggctacgttgcggctgctgctgcccaacccggaggtggcggatgccatcggcggacggctggggctggagctggagcagaagctggacctgtccgaggtggtccgcccgggcatggtcgtcgcggagacgtcgcgcttctgcgtgctcgacggctggcgccactccgaggccgtcacccggctgcacgcgggcatctacgaggagagccggcggcgcggcgtgacgcactggcttgcgtccgcgaacctggacacggattcgcgcgaggacgcgatgctgtcctgtcaggtggccgcctaccggggctggatgagccagcgctggcgcgtggacgtgccggagccggtggatgcacccgtcatccccagcaatccctactacacgcccatggagcggctgcgcgcggagcagggcctgctggacggcttgcgcgtgccgagggcgcccacgctcttcgcccggaagatgggggcgcgcttcatctccgagcctctctacgacgccagcttccgtcgcttcaccctgccgctcatcgccgcgctggatgaggttcccgccagcaccctggcgcgcttcaacgcgctggcgcagcacccccttcgccgcgccgcctag

SEQ ID NO: 6921 - DNA, 807 bp, Myxococcus xanthus
gaggtgcgtcagcgcgtgtcccgcagcgagcgcgtcctggtgacgacgctcaccaagcgcatggcggaagacctcacggagtacttctccgacgtaggcgtgcgcgtgcgctacctgcactcggacatcgacgcgattgagcgcatggccatcatccgtgacttgcgcaagggcgagttcgacgtcctggtgggcatcaacctgctgcgcgagggcctggacatccccgaggtgtccctggtggccatcctggacgcggacaaggaaggcttcctgcgcagccacgtctccctcatccagacgattggccgcgcggcccgtaacgtgagcggccgcgtcatcatgtacgcggacaacgtcaccgactccatgaagaaggccctggaggagacgacgcgccgccgcgacatccagcgcgcgtacaaccaggagcacggcatcaccccgcgttcggtgaagagcaacatcaccgacttgtccgagcacgcggcctacgatgcgggtgacgtgggcgccctgccgatggcggccgaaggcgaggacgacgtcctccagccgaaggaaatcaagcggctcatcgaggaattcaccaaggacatgctcgccgccgcggacgagatgcagttcgagaaggcggccgagtaccgggaccgcgtgcagctcttgaaggacatggacctggggctcaagccggcgtcgcgctcgctgctgcgggccccggcgaaggcggcggaagcggaagccccgaagaagggcaaggggcgcgggggcggaggacgctccgcgcgggcccggagccgcaagtag

SEQ ID NO: 6922 - DNA, 1941 bp, Myxococcus xanthus
atggacgcgaagctcctggagaagctggacgcactgccccccgagcccggcgtgtacctgatgaaggaccgccggggtcaggtcatctacgtgggcaaggccatcaacctgcgcagcagggtgcgctcgtacttcaaccgcaccggcgacacgcgcgtcttcgtgtccttgttggaccagttgctgggtgacctggagacggtgctcgtcagcaacgagaaggaagcgctgctgctcgaaaacgagctcatcaagaagcaccggccgcgcttcaacgtcctgctcaaggacgacaagcagttcatctccctgcgcctggaccgcacccagccctatccgcgcctggaagtggtgcgcaaatacgagcgcgacggcgcgcgctacttcgggccgtactccagcgcgggggccatccgcgagacgctgcgggtggtcaaccgcttcttccgcctgcgcacgtgcaccgaccacgtgctggccaaccgcaagcggccctgcttgttgcaccagattggccgttgcccggccccgtgcgtgtacccggtgccccaggaggactaccaccgcagcgtggacgaggtggtgatgttcctggagggcaaggcgggggagctggtggagggcctgcgcctgcgcatgaagcgcgccgcgcaggagctgaagttcgaggaggccgcgcggatacgggaccagctcaacgccatcgagcggagcctggagcggcagaaggtcgccaccaccgacttcaaggaccaggatgtcttcgccttccaccgggaaggggaccgcatcctgttctacgtcctgtgggtgcggcagggccggctcaacggcgggcaggccttccccttcggcagccaggagtttcccgacgaggagctgatcgcctcgttcgtcaacctctactacgaccagggcagcttcgtgccggaggaggtgctgctgccgctggagctggaggacggcaccggggggctcgaggcactcctcacggagcgcaagggcgagcgcgtgcgcgtcctggtgcccaagcgcggggagaagctggacctggtgaagatggcggcgaagaacgccgaacaggccttcgtggagcgccgacgcacgaaggacgaaacggacaccgtgctgtcccggctccaacagcggctggggctgcgcaacttcccgtgccggatggagtgcttcgacatctcgcacttccaggggtcggccatcgtcgcgtcgcaggtggcggtgacggacggggacgcggacaagtcgcgctaccggaagtacaaaatcaagacgctggagaagcaggacgacttcgccagcatgtacgaggtcatctcccgccgcctgaagaagggcctggaggacaatgacctgccggacctgctcgtcatcgacggaggcaaggggcaactggccagcgcgcacgcggcgatgaaggacgtgggcgtggagtcggtggacgtggtgggtctggccaagagccgcgacctggaggtgttcgaccgcgacgcggagagcgcccggagccccgagcgcatcttcgtggtggggcgcaaggaccccatcgtcctgtcccagaactcggcggagatgttcatgctcacgcgaatgcgggacgaggcccaccgcttcgccatcaccttccagaagcaggtgctgcgcaagagccgggtgcgttcggcgctggaggacatcccgggcgtgggggagacgcggcgcaagcaactgcttcggcacttcggctcgctcaagcgggtgggggacgcctccatcgaggagctcgcggaggtcgtcggaccggccatggcggaacgcgtccatgcgggccttcacggacatccagaagaggatgcggaagatcccgtacgggaggcttcccttgacgacgcgcacgaacccgttgacgaaaaaacgcagggagggtcgccacccggggcagcgtga

SEQ ID NO: 6923 - DNA, 519 bp, Myxococcus xanthus
atgaggctgtatccgaaggtgatcccgatcatctcgcgcgaggccgttcagcagctcatgcaggacggggacatcgaggtggagccgatgcgcgtggccgacgccgagatggacctgtcagccatcatgcgtgagtaccttgcgaacgaggagcgtgtgaaccaggcgacgcgtgaagcgctggagcgtcgcggctacgactattccaagttcaaccaggtgaagcgcgagatggcggacgtccgcggcttcaagatgggcgacgagggcatcgagtacgtcatcaaccagatgattgaattcctgctcatcagccggaacgtcgaagaggtgtactcggcggataacgggctgcgtcagaagatcttcgccgtcatgaagcgtcacctcgacgtggacgacgaaatcgacaaggaggctcgctcccgcctgaagcacctgcaggagggcaccagcgccttcgacatcgagtacaacaagacggtcgagcagatccgcagggcgcgcggcctcatctag

SEQ ID NO: 6924 - DNA, 874 bp, Myxococcus xanthus
atggcgggacccttcaccacgttcgttctgtccggtttgctggctgcggcgccaggtgggttcacgttcgagggccgcgaggccagcgcgaggaccgagcagccagacggcttcttcatccaaggctcacttcccttcacggacctcgctgaaagcggcacggggagcgcgtcgctgacggtggaggaccgcgtgtcccttccgggcgctacctttggggataaggggacgctggaagcgtccttccgcctgggggccacggagtaccgggtcgagctgatgcggcctggtttcccgccggagcaggggaaggggggctcgggcccgcctcctcgcccgcctcaacatgccattggcggcggcgtgttgctggacgtcccgctctatggggacagtggcctgggctggacggcgatgacgcgtacccacgccgcggtggctgtctggggcgtgggtagcgtctggcgcaacggacagcttctgacggacacggccttcgtgcacgcggcggcgctggccgcaggcgcgtacgcggatgacgacacccaccggctgctgcgtcaggctcgctacgacgacacggagctcgtggtgctggtgtggaacctcccgccgcagctcgagccgcgcggcttcatccagttcgtgtttgaggacgtagccatcgacgtgggcggcacggcggtgcgttcacggcccttcgtggagaacacgggcaatccgccgctgagctggcgctcactgacgccggtaccgccctccgccgtggtaggggcgcctgttaccgcgtcgcctccgcccgcgccttcggccatcggaggcggtgggacggctggggcgcttcaggatacgggggccgtgacgcgggtgacgg

SEQ ID NO: 6925 - DNA, 93 bp, Myxococcus xanthus
atgtcctaccgaggcaccttcaagaacgtctcctttgaccggttgcccgatgccactgacggggcggagtttgactaccaccgcctgatcccc

SEQ ID NO: 6926 - DNA, 960 bp, Myxococcus xanthus
gagctcaccctgtcgggctgcgccgcgccgacgttcgagtcggcttccgcgacatcgctgacggagcttgtgctcagcttcagccgcaacatctcggcggcgagcatcaccaacgcgccggagcagttcacgctcaccgagagcctgactgtttccgcgttccgcgtcgaagggaagcaggtcttcctgaccacgagcgagcagaccccgggcaccaactactctgtcaccgttgcgaacaccgtgacggacttggcgggtggcgttgtggccgccgagggcagcacgcaggcgttccgcggcttccgcacgccggccgttctccgtctgaccgaggtgcagccgaacgccgcgtcgcaccaggatctggtcgagctgcaggtcattactgcgggaacaaccaacaatatcaccgttgagatggatgtgactactgctcggctgttggcgaggctccctgacgtggacgtcgctgcgggagacatcatcgtggtgcatatcaatgcgcccgccaccgtgaaggcggagaccacgtccaaggaccagttccccacgagcaccgcggctggcaactacgacacggcttgggacttcgtcggcgaaagcaagggcacggactccgcgatcacctactccagccgcgtcatcctcgtgaaggacgccgcaggcgctatccaggatgcggtgcccttccgtgccgcgggaactccgcctggtgcattcccgggcaacctgcaggccatgcaggccgctggtcagtggtccccggtggattgcaacggtgccccctgcaccaacacgtccacgccctccgctggtgacgtgtccgcatcctgggcgggcattccgaacaacgctgatgccacgagcaacagcgtccgccgcatcagcgcgacggacaccaacatgaaggaagactgggcggtgggtgctccttcgtggggcgtgcccaacctgtag

SEQ ID NO: 6927 - DNA, 1320 bp, Myxococcus xanthus
atggtcatcgcgcaggaggcgggcgaaatcgacaagggcctggccgcgggtgagcgctttctcaaggagtacccgcgcagccccttcgagctgaaggcgcgttactcgctggcgggcctctacgagaaggtcgctgagtaccggaaggccgccgtcatggcggagtccctcgtcgccagctacgacgccgcgatgaaggcggacgatgccaacggcaagcgcaaggcgaccaaggcggccgccaaggtgagcgtcgcgccgggcgccgaggacgcggagtccaagcgcgagcgggtggccgccgagcgcaaggcgctgctggaagaggccggcggctggatggcggatgcgcagttcaatgcgggcgtctggtgggaaggcgcgggtgagccgcagaaggcggtggctgcctacaacacgtacgtctcccgcttcaaggaccgcaaggacgtgccgcaggtggccttcgcggcggcgctcgcgtgggagaaggagaagaagtggagcgaggcggcccgggcgttcggcgccttcgcggagacgtacggccgtgactcgcgctccagctcggcgcaggtgtaccaggcgcgctaccacgagctgctggcgtacgagcacctgaggaacgcacgcgagcaggagcgcgtgcagggcgagctggtgcgggcgtggaaccggctgccggagagtgctcgcaaggacgcggcggtgctcaatgcttacggccatgcgcgcttcctgtcgctggagccggcgtggaagcgttacgtgggcatccgcttctcgcgggtgagcaccatccgccgggacctggcggcgaagcagaaggagattcagcggctggagaaggagtacctcgccgtcctgtccaccggctccggtgattggggcatcgcggcgctcacgcgcatcggcctggcctatgccgacttcgcgcgcaacatcatggactcgccggacccgtccgggctcgatgaggagcagctcgccatgtaccgcagcgagctggagaacctggcgttgccgctggaggacaaagccgccgaggccctggagaaggccctggagaaggcctacgagctgggcgtctacagcccgtggaccctggccgcgcaggaccaggtgaaccgcctgcgtccgggggcctacgcacaggtgcggcaggtggactaccgcggcagcgacacactcgtccgctcggacctggtgcgcgtgctggaaggcgccaccgcgacgacgccggccccggcggactcctcgaagccctcggatgacgaggcgcaggcacccacggcggcgcgcggggaggtgctgcgatga

SEQ ID NO: 6928 - DNA, 1499 bp, Myxococcus xanthus
atgaagctgtttcgcatcgattcctttcaggttggggcggggaagacgcagatgacctggttccgttcgctcctcgtcggctcgctggcctttacggcggcgtgcgcctcggggcctcagaagaagcagaccgctgcgccggaggtgacgccgcccgcggcgcaacagcccgcgcccgagcagaagccggtgccgcctcccgcgcagaagtccggcagcgcgcagtccgccttcgcggcggcgctccagtcctatgaagcgggggacctggacggtgcgcgcaagggcttcgaggcggtggtggatgaactgccgcagagcctcaacgcgcagttcaacctgggcgtcatcgcggagcgccagggccgtccggatgacgcgcgcgtggcctacgagaaggtcctcctgttggacccggcgcacgtgcccgcggtggtcaacctgggcgtcatgtatcgggcgcaggggcggctggacgaagccatcgcgttgttccagcgggcgctgaagacgcctggtcgcgagtacgacgcgtcgctgctcaacagcctgtccatcacctatcgcgttgccggaaagctggacgagtccgaggccgccgcgcgccgcgtgctggtgcgcaacaaggacgacccgggggcctacaagaacctggcgcacgtggcctacgcacgggagaagtaccggctggcggagctgctggccggcaccgcgcgcaagcactcggagaacgacccggcgctctacaacctgctgggcatggtctacctgaagctggacgaccgggcgcgcgcgctggtgcagttccagaaggccatctccctggatgcgaaattcaccccgggctacctcaacctgggcgccctggcgctgagctaccgcgactacgtgggcgccgagcgctccttcggaaaggccgtggagctggagccgggctcaccggacgcgacgctgtacctggcctgggcgctggacgggcagaaggggcgtgacccgaagaagggcctggccgcgggcgaggcgttcgagaaggtgctggccacgcgcgcggacctgccggaggccgtgtgcggcgcgggctgggcgtatgcgtcggaccgcgcgggctggcagaaggccatcgcgttcctcgaccgctgcaagggcctggagacgacgaccgacaatgacaagcagatgatcaccgcgaaggtccagggcctgcagaacatgctcaaggccccaccacccgaggccgcgcccgccaccgcggaaggggaaggcgatggcgctccggcggatgaggccattggcggcggtggtgcgcagcccgcggggggcgccgagggcgtggcgcctggacagggctcggatgtggcgccggaaggcgatgccacgggcggcgcgggcgcacatcctgggcagggcactgatgcgatgcccgcggacgacgcgaccggtggcgtgggcagtggggcgccgcttgctcccggtgggaaaggcacgcccgcgggcaagta

SEQ ID NO: 6929 - DNA, 465 bp, Myxococcus xanthus
atgacgggcgacgagcggccctacggctatgtctcgcgcaaacaggtgaagcagctcatcggcgacacgctggagcaggacctgccggtgaaacacgtggtggacgagctgcagctcacctacgagccgttcgtcctcatcccggacctcgcgcggcggcgcaactgcgagcgtgactggcgggagctgctcggcgaccgcgtcatctgcctggaggcccccaccgacaccgtggaggtggcggcggggctggtggggctgtacgagggcgcgttctccgacctcgatgcgctcgcctggcacttgaagaagcaggacctgtcgcggcagcggctgggcgccgtcatccgcgcgctcacgcccttcgcggcgacgctgggacgggacggcatcccccggcccgagttggaggacgagcacctgcccacgaacgacgacaactcggggtaccggcgtctgcgctga

SEQ ID NO: 6930 - DNA, 750 bp, Myxococcus xanthus
atggtccacgcggaccccgtgctccccaagacctgcttccacaacgagctgggatacacgaagaccttcctcgacgtcaccgagtccatcgccacgggcctcacctccacggcgcgggagcagccggtggcgccctactacagcgacgtgcaggtgatgcggctgggcgacgtacccctcgggttccagtacacggcgctcttcggcgccaaggcgggcgggagcatccttgaggtcagcaccacgatggtgcgtcccggggccccggcccagctccagttccaggacaccaacatcacggagcaggcggacatctcgggagtgctcgtcgccaagagctattccaagcgggtcaacgacacggtcgccgcgaatgtgcgcctgcgccgggagcagaacgggagctacggcgtctcgggtcaggtggccgccaaggaggtgcaggctcagttcgggggcgaactcatcggcgaggtggggctcgccgcgcggctccgcgagggcctgctgaagggccagggcgacgcgctcgaggccctgctgtgggtacctcccgccgacgcgtccgcaccgacgaagatggtcatccgcccccgcgaggaggcgggagcccgcgccgccacgatggagctgggcccgatgtccgtgaaggtggagctcgacgcccacggcttcccccagcggacggaaatcccctcgggaagcgccactgtcgtccaggagcggctgtcccagactggcgagccgtag

SEQ ID NO: 6931 - DNA, 658 bp, Myxococcus xanthus
ccgtgcgcccacctggtctgcgagcggtgttacgacggaagcgactacagcgcgtgtcccatctgtcaccgtcgcttgtctccgtccgagccgttcctcaagcccacggcgctcgaggccgccgagcgcgtgtatgcactggccgtcaaccggctgacgcggctgtccttggggaccgacgccgctcgtcatcgacctcgtcgagaagcagctccgttgggtggatgtgaaggttcctcccgaggatggcttccagagtgtgcacagctcgcgaggcgagctcgcgaaccttggaaaggacaccctggcctatttcggaaccggcgcccgccccacgccctgggagctggcctgccttcacgtcgccgcgcgcagtcgcacggtgcaggtccggcgccgggatggcacggtgtccgtcctgaagcggggctcggacgaggacaccgccgccttcctgcgtaggctgcgtggccttgaagtggatgccaccagccacgccttcgcgcctggctcggcgcccacgttcttcgcggggatgacggaccacccctcgctcccggccggcagcgagggctatgcgctgcgcttcctccacacctccgcggaatccgtttcatggctggccgcgggcgatttggtggccgcgctgaaggcatag

SEQ ID NO: 6932 - DNA, 309 bp, Myxococcus xanthus
atgagtccctcccgcacagcccacctcgtcgttgagctcggcttcggagacaccagcaagggcacgctcaccgactggctggtgcgccgccacggcgcggggctcgtggtgcgcttcaacggcggagcccaggccggccacaacgtcatcaccgatgacgggccgcaccacaccttctcgcagttcggcgcgggcaccttcgtcccgggcgtgcgcacgcacctggcgctgaccaccctcctccatcccctggccatgcgggtggaggtcagctcccccctgtgtcagggaagttgtcgcctcggctga

SEQ ID NO: 6933 - DNA, 357 bp, Myxococcus xanthus
atgacgccgccgcccgaggagaagaagcccgctggcccgaagaagtggacgcccgaggagaagctgcgcgtgctggtggcggcccaggggcttgagggtgaggagttgggggcgctgctgcgccgcgagggactgcacgaggtgcagttgaaggagtggcggcaggcggctgccggggccctgtcgggcgagtccaccgggccactgacggccagccagcgccgccggctggcctcttcggagaagcgggtgaaggaactcgagcgagagctgcgccgcaaggagaaggcgctggccgagacggcggcgctgctggtgctcgaaaaaaaacttcaggcgatgggctgggacctttag

SEQ ID NO: 6934 - DNA, 1533 bp, Myxococcus xanthus
atgagctgtgcggattccgcggaggtggacggtaccgtcgagggggcacgcggcgtccgtgtccagcgagctggcctggtggaacaggtcgaacagctggacctgcgtccaggtgacatgggggcagatcccacctcgctcgcggttctcaatgggactgtgtacttcgccgccagacaggacagcactggcgtggagctgtggaagagcgatgggaccgagaccggcacggtcctcgtcaaggacctcgctcctggcacctccacctccaaccccaggagcttcctcctggtgaatgacacggttgtcttcgtggcccatggggtctggaagaccgacggaaccccggagggcacggttcaactgttcgccggcacgcctcaggggggcgccggcgaaaacctcctggtcccgatgaatggggcggcctacttcgtggcgagcggcaacaacggtcgggaggccctgtggcggagcgatggcacggtggcggggactgtcgcggtgacatcccttggctcctggacctcaagcccctggctgacggccgtgggccagcgcctctatttcaacgtctacgacgacgcgacgggcctggagttgtggacgagcgatgggacggcggccggtacggtccgggtgagggacatccatccgggcagcggtagctccgctcctcgcaatctcatcggggtgaacggcacgctctacttcacggccaatgatggtgccaacggagaggagttgtggcgcagcgacggcacggcggcggggacgtattgcctgaaggacctcttcacggctcctcactcgagctcgaagccggagttcctcaccgacgtcaacggcacgctcttcttcgtattcaccatcaatctcaacaccaaggcgctgtggaagagtgacgggacgacggaggggaccgtcaaggtcgccgacatctccggcgtcatcatgtcccctttcttcacggccgtagggtcgacgctctacttcgccacgtcgggcgggagtccccttgccaattaccgcttgttcaagagcgacgggacgagtgaaggcacggtgcccgtgctgggattcaatggaagttccgcctggcccgtcatcgcgaatctgacggacgtggagggcacgctccatttcgtcttcaacggcctccagggcagcgagctgtggaagacagatgggacggaggccgggtcggtgcgcatcaccacgttcgtgcctgcgccgcgtgacgccatgatctcatccatcgtctttgatgccgggacgctctacttctccgccaacgatggcgtccatggcagcgagctgtggaaaagcgatgggacggccgaaggcacggcgctggtgcgcaacatccagacccgcggcgtcagttccgagccacgttcactcacggatgtggacgggacgctgttcctgctggccacgaacggccgtgatggtctccagctctggaagagcaatggcacgatggaggggaccgggcgcgtcaagctgatgacctttggcactccggggcaa

SEQ ID NO: 6935 - DNA, 1113 bp, Myxococcus xanthus
atgattctgatgttcagcatgtacctcacggagttggtgagggcgaagctcaagctccaggaggcggcgcgctacgccgtctgggagatgacgagctacgcgctctccgacttcgcgaacgggaagcacgatgacgccttcgaggacgcccgccgggaggcgcacaaggagttcgtcgagcgctacaaggacatggactcggtggagcccaacggcactggcggcaatttcattgcccgctacacggacgtgacggcgaccatctccaacaaggagatcgcgctcctcgagagcgggatgctcagccgcccgagtaccagcgaaggaggcggcctggcgggcgccatcctcagcccgttgaacaacggcatgggatgggttttgaaccagtggggcttcaacaacaagggctgggtcgaatccgaagtcgagatgaactacgagaacgtcatcctgccgacgcggtacctcgacaagagcggtggcaacggcggcttcttcaaagagaacatgatgggcgggcgcgacctgggcagcctgcggctcaagtcgaagtactccatgtacgccaacggctggcacatgccggacggcggtgacgccatcgtccgtggccgccgcgccggtcagcacaccggtggttccctcagccagccccacggcctctaccgccaggtggaccggatggtgttcctgggcttcgcctccacgttggacagcctgggcatcggcgccatcctggatgtggtcgcctcggtgctccccaacttcctggggaccttcgtggtgtcccggaactacggcgtgggcgcctcgcagaagggcgactgcaccggccttgcccagtatgatgcgaaggccagcagcggcctccacgtcatgcacaagcgcagcttcgagctgaccgaccacgaacggcccaactgcttcgacaccgcgccgttccgcgacgagatgacgtacgcgaacagcaactacatcaaggtcttcaacgcgcgtggcgagttctacatggggtgcaagcgggccatggcggatgacccgaccgacccggatgcccgcccggaggccacggagaatgacgagcaagacctcaaggttccctgtgagtag

SEQ ID NO: 6936 - DNA, 2016 bp, Myxococcus xanthus
atggtgttgatcatgtccatcgccgtgttgaccacggtcaacatcggccacacggtgcatgaacgcatccgcctgcagaacacggcggactccgcgtcgtactccatggccgccatggaggcgcgcgcgttcaacttctacgcgtacgcgaaccgcacgcaggtgtcgcactacgtgtcggcgatgatgtggcagtcgctgctgtcactcatctattccgccgaggcgttcctcacggacatctacggcttcatgcgcacgttgaatccatgcgcgggcaagacgaacaacctcttctggaagatcgcttgtcccatcctggaaaacgtcattccgtatgtgagcgcggtcatcaaggccattggccggatcatgaccgcgtaccggaactacttcctcagacccatccaacaggtcatcacgcggctgaatccggaccggatcgtcggtgagtggatcatccccgcgcaccgggtgatgaacggcgtgatgtacttcgcgtcgcaggcggtgatgatgtccgcgtccacgcacgtgacgcagaccacgcagacggtcatcgacgacaacgacagcaacatctcctcgctggccagccagttggcgacgggtctctacagccagtgtctcttcagccaggcgcacagcccgcacgcgggtggcaagccgctggcgccgaacacgtggaagaacccgttcggcgcgctggacgtgacgaagaaggcggccaaagaccccatcgcccgtgccaagcgctccatgggtggaatcacgaacgccacgcgctacgcgtgtgacgccaacggtggcgcgtgcccccagggcttcatcaccagccgccgcatgggtgacctgctgccgctgccggacatgctcagcttcatgcgcgacttcttcaacggcggcgtggacatcccgggcatcttcgagttcggcaagatcggccagacgcgcatgctctccacgggcttccccaacgccaacgcgatccgcgccggccgcggtcccggccaggagggccgcaactacatccgtgattggaacgacaacatcaatccctggggcatgacggcccagggtgacaacatcggttcggatgacccgtactggctcaagttcggcccgccggagatcgacgtgggcgtgggcaaggcggacaacccggtgtcgtgcaccaagaacgacgactactggaagtgcttcggcgacaaccgcaagggcaaggggaacaacaacaccaccaagctgccgtacaagcacatgacgaagacgagcatctgggcgctcaacgacaccgacagcggtcgtcaccggggcggcatgcactggcgcgtcaactacccgagcaacccggagcgctggtccggccacatgcggccgggtggccccgagcgcgacgtggggctgcaccgctcgaaaatctgcgtgctggagctggcgttcgtgtgctgggcccgtacggacgtcttcgcggccaacgtgcggccggtgcaggacggccaccaccgctggggtggcctgacgccgttcatgcacttcgagcctggccagctcggctcggtgtgcaaccccaccgccaacgcgtccatggacgacgcggccaagcgccaggcggacttcaaccagcccaccgcctgggtggcgctgaacaaggagccggagcaggtcgtgaaccgggacaacaaggacggcaccggcaccaacgcgcccgccctgttgaaccaggagggcaaggtgaagttcgccttcactccggatacggacggcctggagatgctgaacaaccggaagaagttcctgggcctggtcgaaggcctcaacgtcatctcccgtgggcagacctactaccaccgtcccggcaactgggcggagcagcccaacttcttcaacccctactggcgcccgcgtctggcgtccgtgttccagggccggaactcgctgccgaagattggtgagatgatggacgcgctgcccggaccgcttcagggcattgccccgaagatcatgacgcactga

SEQ ID NO: 6937 - DNA, 906 bp, Myxococcus xanthus
atgccgctcgccgtcttcatgacgctggggatcatccagctcacgatgatgcagcacgcgaagctgatgacggagtaccccgcctaccaggccgcgcgtgccggcatcgtgtggaacggcaacaacgagcgcatgcatgacgcggccatcgtggcgttgcttcccaccatggggcgtaccgacgacatcgtcgagctggggaagacgttcgtcctccaccagctctacgactccggcatgcgcatgctgaacttcggtggcggccgcgtgccccggacggtgaacggctccaacctgttcggcgtcatccgcgtggacaccgtcagtcccgcgtacttcacgcccatcgattcgatgtggaagctgcgcagcggctacaactggcaggagctggacttcgacggcgcggactccttcccggaggtgccctcgctggagaaccacatccgaaagttcttcaacctgccggagcctgacgacgcggagctggtgttccgcaagtccacgcgactgaccatccgcctgcgctactggtaccaactgcgcgtaccgttcgcgaactccatcatcttctactggtggttcacctggaacgcgggcatggcgctgcaaggcgccattgaccgcggcaccgtggacccgcgcgcgaacatgatgaaccggcgtggcaacctcaacccgttgctcgctggcgcccgcggtatcgagcacgagatggggtacgactccgtctatccgctcgagatgaccgtgctttggatgctggccaacggcagcatcccgatcgtttccaacctggctggcaagcggtacttcatgccgctgacggccacgtacagcatgcgcatgcagtccaacttccaccgcaagtggatcatgcacctgaaccccgactggggtctgtaa

SEQ ID NO: 6938 - DNA, 495 bp, Myxococcus xanthus
atggcgaagtcgaatctgggggtgctcatcttcaacctgcacctggagctgatgacgcagcagcactatctggaaacggtccgcggaaacaatgccgagacgctggatccgctgttctgcaacctgctcaagcaccactggctcgaagaggcgcagcacacccggctggacttcctggaggcgcagaaaatcctcgcccgggaacccgacacgctggacgaagccctcacggagtacgcggagctgctccaggcactgagggggacgttgaacgcccaactcgcgctggatctccagacgctggagaaggcggtggggcgcacgttcaccccggaggaacacaagcacctcgccgagtcccaggagcgttcgtatgtctggggcttcatcggaatgggaatgaaggcgcccctcttcctctcacgcctgcgcgcgctctcccccatcgccgagcagcgcatcctggagctggcgccgacgtactactgtgattga

SEQ ID NO: 6939 - DNA, 1037 bp, Myxococcus xanthus
  unsure (1)..(1037): unsure at all n locations
gagccgcccgctcccctcgcccatgcggtcccgcgccagcgtcccattgcgaaccgatacatcgtcgtgctccgcccggaggcccgcgccgcatcccaggggccccagaagacgcgggagcacgtgtcgaacctcgccaagacgcatggcgcgaaggtgctccacacctatgcgcatgcgctccagggcttctcggcggagctggacgacgcgcgcttggaggcgctgcgcgccgacgagcgcgtggccttcatcgagcaggatgcatgggtgcgcccgctcgtcacggcggagacggtggcgtggggcctggaccgcgtggaccaggaggacctgcccctggatggtctctatcgcccggcgctgagcggcgcgggtgtccacgcgtacgtgctcgacacgggcatccgctccacgcatgccgagttccagggacgcctgggcgagggcttcgacgcggtggaccccgacggtggcgcggaggactgcgacgggcacggcacccacgtcgcgggcatcctcggtggcacgacctggggcgtggcccgggccgtgacgctgcatcccgtgcgcatcctgaactgtgacggagaaggccccctgtcgggcatcatcgccggcatcgactgggtcgccgcccatcaccagtcccccgcggtcgccaacctgagcatcgggctggaggtctccgaggcgctggaccaggcggtccgcaacgtcgtggccgccggcgtcaccgccgtggtggccgcgggcaacttcggcgtcagcgcgtgcgacgagtctcctgctcgcgcggcggaagccctcaccgtgggcgccaccaacgtggaggactcccgcgcgtcattctcgaatcacggcccctgcgtcgacctgtacgcgccgggcgaggacattcgctccgccggcatcagcaacgacacggcaagcgaggtcttctccggtacctgcatggccacccctcacgtcgccggcgccggcgngctctacctggagatgcaccccaccgtcaccccggcccaggtgatggacgc

SEQ ID NO: 6940 - DNA, 345 bp, Myxococcus xanthus
atgtcccgcggcgagtaccgcctcggcttcaccgggcactatgagaaggagcccttggtgctcgtctccggtggagagcaacaaggtgtcatcgtctccaaccgcgtgacggtgcacctcagtggtgcatatgccatcaccgactggttggagctcggcgcgcaggtgcccatcgtttcccagtggggaccggacaccgcggcgctgggcgtcgccacgccgtccacgagcgcgcttggcacgccgtgggtccaggcgcgcgcgggaatcctctccgagcagcgcggagggctgatggatttggagcctgcacctcggcgcggccctgcccattggcagcagtta

SEQ ID NO: 6941 - DNA, 942 bp, Myxococcus xanthus
atgtccttcctgcagcaggcgctcgtgttcctcgcggcggcggtgctggcggttcctctctcgcggcggctcggactgggctccgtgctgggctacctggcggcgggcgcggtcatcggcccctggggactgaagctcatcagcgacgtggagcacatcttccacgtggcggagctgggcgtggtgctgctgctgttcgtcatcggactggagctgcagcccagccggctgtgggcgctgcgccgctccgtcttcggcctgggcggcgcgcaggtgctgttcaccggcgcgctgctggccagcgtgggcctgctgtgcagcctgacgtggggcgcggccatcgtcacgggctttggcctgtcgctgtcctccaccgccttcgcgctgcaactgctggccgagcgcaaccggctcaccacgccgtatggccaactggccttcggcatcctcctcttccaggacctggccgtggtgccgctgctggccctgctgccgctgctgggagacggcggcgcgccctccccggggccggtgtggctcctgctcctgaaggacgtgggcgtgctgctggcggtggtgctgagcggccgctacctggtgcgcccggtgttccgcgccgtggccgccacccacagccaggagctgttcaccgccaccgcgctgctgctggtggtgggcaccgcgtcggtggtcaacgcagtgggcttgtccatggcgctgggggccttcctcgcgggcgtgctgttggcggactccgagtaccgccacgagctggaagcggacctggcgcccttcaagggactgctgatgggcctgttcttcatcagcgtgggcatgtcggtgaatctgagcctcatcctccagaagccgctgctcgtcttcggactggtgctggggctggtggccctcaagggcgcggtgctctacgggctggggctgtag

SEQ ID NO: 6942 - DNA, 105 bp, Myxococcus xanthus
atggtggcgtcgctcgtgcacttcacctggtgcggcaacgtgctccgggagaacgcattctatgaccccgccgacgtacactcggccaccacccgcttcctgtaa

SEQ ID NO: 6943 - DNA, 192 bp, Myxococcus xanthus
atgtatggcgccatgggggcccacaatcacagccaggccaatcagttcaccacggactgtcttgcctacctggcggccattgggtgcacgaacgtgacggcgacgggcagcttcgcgagcaaccaggccgagccgcttcatggcaaggagatgcgctgggacgtgctcctaagcaagtgggtgaaagcttag

SEQ ID NO: 6944 - DNA, 1731 bp, Myxococcus xanthus
ccttccagccagtccccattcatggcaggtcgactccccgcatccctcgccactgttttcgccgggctccccgacccgtcctacgtcctgaatgatccggggcgggtcctggtgtgcagccaggcggccgcaaggacagtgggtcggctccccgaggagttggtgggcaggcactggggggagctgggcttcccgcccgaggagttggcgcggctggagacagcgcgcgcgcgggtgatgctcatccaagacacctgcgaactggaagcgccctgggccacgcagacgggcctccggcgtcacgcgctgatgctcagtccgctgccctcggaggatggggggccgtgctgcgtactggtgacggcgcgccccctcaccgacgcggaggccgtgttctcccgcgccatggagctggaactggccgcgcgggcggaggtggagcaggccgagcgccgccgctccttcctctaccaggcgatgacgacgctcttcacccacccgccggacccgcagggcatgtacacgctgctggcgcacctggcggtgcccgacgtggcggactggtgcctggtggacgcgctggagcagggcccctgggtgacgcgcgtggcggcggcgtgcctggacccgacgcagcaggagcgctcgggcgcgctgcccacccgcaccgagctgcgggacgacgccgccgtgggcctcttgcgcgtgctgcgcaccggagagccggagctggtgccggcggtgacggactccctgctgcgcgccgccgcggcggagcccgcgcaccccgcgctgctgcggctgctccaggcgcgctcgtacatgattgtgcccctgcgcgcgcgaggtcacacgctgggcgccgtcaccttcgtgtcctcgggctccgggcggcgctacggcccggacgacctggcgctggcggaggacctgtgcctgcgcgccagcctcgccatcgacaacgcgcggctggtgggtgagtcccggcgcgcggcgcgggcccgcgaggatttgctggccgtggtgtcgcacgacttgaagaacccgctgggcgtggtgcacttgggcgcggcgctgctgctgcgcggcgcgggggcgaagccgggcggcgaaagcgtggccaagcaggccacccgcatccaggacgccacagagcgcatgtcccgcctcatctccgacctgctcgactggggccgcctggagccgggcgacctccttctggagtggggcgaacacggcgtggtggggctgctcaccgaggcgctggactccatccgcccgctggcggaggccaagcgcctgcgcctgtccgtggagttccccgccgcgggcgtgcgcgtgcgctgcgacaaggtgcgggtgctccaggtgctgggcaacctgctgggcaacgcggtgaagttcaccaccgcggggggcgacctgatgctgggcgcccgggcgcgcggcggtgaggtgtccgtccacgtgcgcgacaccggctccggcatcactccggacgcgctgccccacatcttcgaccgctactggcaggcccgcgacgcggccagccgcggcaccggactgggcctggccatcgccaaggggctcgtcgaagcccacggcggtggcatccaggcggagagcaccctgggcgaaggcagtgtgttcaccttcaccctgccctccgcgggtgcctcggcgtcccacgctgtacacccgccgctcgcacgcagggccacggacgcctga

SEQ ID NO: 6945 - DNA, 1062 bp, Myxococcus xanthus
atgaagaacgacccgttgcgcatcctggtggccgaggactcgcccaccgcccgacgcctgctggtggaaatcgtccgcgccgaccccgccctgacggtggtgggcgaggccagggacggtgtggaagcggtggagctggcccagcgcctgcggcccagcctggtgaccatggacatccagatgccccggatggacggcctggaggccacccgccgcatcatgacggaggtgcccacgccggtggtggtggtgtccaccctggtggagcgcgacatccagacgtccatggccgcgctgcgcgccggcgcgctcgcggtgctccagaagcccctgggcccggagtccccggacttcgacgcggacagccgccgcctgcgcgacaccctcaaggccatggccgaggtgaaggtggtgcgccgctggccggaccgcaccgcgccccccgcgcccgtgcccaccccgcccgcgccgcccgtgtcgcccacgcgccccggcgtggtggccctggccgcctccacgggcggtcccgcggcgctcttccgcctcctgtccgagctgcccgccagcttccccgtccccctgctggtggtgcagcacatcgccattggcttcagcgagggcctggcgcagtggctgcgcaccgcggggcccttgcccgtgaaggtggcggaggatggcgagcccctgctccccgggcatgtgtatctggcgccggatgatcgccacctgggcgtgcgaggcgaaggccgggcggaggtctcccgggccgcgccggtgaatggcttccggccgtccgcgacgtggatgttccgctcggtggctcgcgcctacgggcccgcgtcgctcgccgtcatcctcaccggcatgggccaggacggactggaaggcgtgcgcgaactccacggcgccggaggccgcatcctggcccaggacgagcagtcctccgtcgtctacggcatgcccggcgtggtggtgggcgccaacctggcccacgaagtcgtcgccctgcccgacctggcgagccggctcacctcggttttccgcggtagcgggggagtctga

SEQ ID NO: 6946 - DNA, 696 bp, Myxococcus xanthus
cccgcgtgggcctccggtgacgcgctggtgccgttggcctcgctggcggaggtgctggggctgccgcccggcccgcctcgcgcgcgccggggcgcggtggtgctggccgcgggcagcgcgcgcgccgtggtggtggtggatgaagtgctcgccgaacaggaggcgctggtgcgctccctgggccaccgcgtgcgccgggcccggcacgtgtccgcggcggcggtgctgccggacggacggctgtcgcttctgctcaaccccgtgtccctggtccgcgcggcgggtggccgccccgcggcctcgctcttccccgcccccgccacccagcggacgcggcggcgagtggtgctggcggacgactcgcccaccacgcgcgcgctggagcagagcatcctggagagcgcgggctatgaagtggtggcctgcgtggacggcgcggacgcctgggagcggctccagtcgggcggcgcggacgcgctggtgctggacgtggagatgccgcgcatggacggcttcgccctcaccgaggcggtgcgggcctcgccgcgcttctcccggttgccggtggtgctcgtcaccgcccgtggcaagccagaggacaaggcgcgcggcctgcaagctggcgcgagtgcctatctggtgaagagcgcgttcgacccgacgagcctgctggagacgctgagacgactgctatga

SEQ ID NO: 6947 - DNA, 510 bp, Myxococcus xanthus
aaagcgcggcatccgggcgcgcgggtgctgctcatgagcccccgagggcccaccttcacccaggccactgcgcgtgagctggtccgtcacgaggcgggcctcatcctggtctgcggccgctacgagggcgtggacgagcgggtgatggcgcacctcgacggggagctgtctctgggggacttcgttctcactggcggcgagctggcggccatgacggtggtggatgcggtggcgcggctggtgcccggggtgctgggcaacgtggactcgtccgtcacggagagcttcgaggaaggcctgctggagcatccccagtacacccgcccgcctgtcttccggggcgtcgaggtgccggccgccctgcagtccggcgaccatgcccggattgcccgctggcggcgctggaagtcgttggtgctcacccatgagcgccgcccggacctgtatgcccgcgtggtgctgtcaaaggctgaccagaaacttctggcccgtcgggaggaagagctgtaa

SEQ ID NO: 6948 - DNA, 384 bp, Myxococcus xanthus
atgcgcaacgccgccattcagcacatcgaggccaagttcctgcgccaggatgtcaccgtgttcaataccggtgattccgtgcgcgtccactggaaggtcaaggagggcgagaaggagcgcgtgcaggcgttcgagggcatcgtcattcggaagaccaagggcaaccaccgcgctaccttcacggtgcggaagctctccttcggcgtcggcgtggagcgcgtgttcccgctgcacagcccccgctacgagaagatcgaggtcctgtcgcgcggtgacgtgaaccgcaagcgcctgttctacctccgcgccctcaagggcaaggcggcgcgcgtcgacgtcatcgaagagccgaagccgtccaagaaggccgcctcggcctcctga

SEQ ID NO: 6949 - DNA, 1026 bp, Myxococcus xanthus
atggggttctgggccggcctgggcgcgggagtgctgttcctggcgctggccgtgggcctgggctttggagtggaccggaccttccgctacctggcgctgctggacatcccggccttcggcgtcgccgccttcctggcgctgcgctacgtggatgacctgcagaaggccacgcgtcatggcagcaaggagaaccgcttcgacatccgggagaagaagatcctcgaggagtacgaagcggaagccgcgccgctgcgcatggcgcagaaggcgctcgacgtggaagagctggacggcatcgcgccggccctggagcgcagggagctgctggccgcgcgcgtcgcggagctgcaggaccagttgcacaccatggagtcggatccggactacctcgcggcggccgctcaggttcagtcgctgaaggcggaggcggaagcgctcaacgacgagctgacgcagaagggcacctacgtgcgcgacgtgcgcgaggtggagcgtgagatgggccggctgaaggagtccattgccctggccaaggcgcctccgccgccggccgcgccgggcccggatggctccgtgcccgtggagacgctggaggatccgtcgcccatgctcctgtcccaggcggcggacgtgttcaccacggacatcctgtccgtgcaggcgatgctgaaggagcggtgcgtccagtacctcaccgcgctcacggaccggcggtaccagagcatcgagtgggaccgcgagggcaaggccttcgccctggcctcgggccggcgggtgccggtgggcgagctccctgcgaaagatttggacctgtactacctggccctgcggatgacggtggtggagaaggcgagcgcccgagtgaagcgtcccttcctgctggaggacgtcttcactgggatggaggaggtgaagctccccctcatcgctcggatgctgaagcacctgggtacgctgacgcaggtgctgcacgtcacctcgcacccgggcttcgcacagatgtcggacgggcccgttaacgtctga

SEQ ID NO: 6950 - DNA, 345 bp, Myxococcus xanthus
gggaatgcgggggaggaggcggcggtgcgcttcctggaggcacaggggtggcgggtgcgggatcgcaactggacctgccgcttcggggaactggacgtggtcgccgaacgtgacgacctggtgtgcttcgtggaagtgcggatgcgctccactgccacctggggcgacccctcccacagcgtgtctttcgccaagcagcgcagggtggtgaaggcggcgcttcggtacctgttcgcgcatgacttgcgtggacggatgttccgtttcgacgtgatttcggtggtggggcgcggcgagcgcgccaccgtggaccacatccctggcgccttcgacgcggggatgtga

SEQ ID NO: 6951 - DNA, 454 bp, Myxococcus xanthus
atggctggaacgctctatctggtggcgacgcccatcgggaacctgggggacgtcacatcgcgcgcgttggagaccctgcgcgcggtgcgcttcatcgcgtgtgaggacacgcggcactcgcgggtgctgctcgaccacttcggcattggcgggaaggacctggtgagcctgcccgccttcgcggaagggcagcgagccggacgcatcctggaccggattggggaaggggaggactgtgcgctcgtgactgacgcgggcagccccgccatcagtgacccgggcgagaagctggtggccgaggcgctggagcgcggattgacggtggtgccggtgccaggccccacggccctggtcgcggcgctgagcgcctctggattgcccacggggcgcttccacttcctgggcttcctcccgcgcaagggcgccgagcgccgggcgatgctggaggaggtgg

SEQ ID NO: 6952 - DNA, 123 bp, Myxococcus xanthus
atgcccgcccagaagggaaatcgttccaagaagaaggtcgccaaccgcgccaagggccggaaggcccagctgaagcgccgccgcagccgcgccaagaagggccagtccaacaacaaggtctag

SEQ ID NO: 6953 - DNA, 536 bp, Myxococcus xanthus
atggcccgcgaaaaggacaacatcgctctctccgacgagcacaacactcgtggaatcgagctggcggaccggggttggctcgacgaggccatcaaggagttcaagaaggccatcgacctcgacccgagctccgcgcacgcccacgacaacctggcgaccgtctacgcggagaagaagctcttccgcgaggccctgtcggagtacctcaccgccctgaagctggagccggagagcgccacggcgcactacaacctggcctgcttcctctccacccacgcgggggagatggcggtggaggagtacaaggaagccatcgagttggatccggagtatccggacgcccacctcaacctgggcctcacctacgcggaccagggccgcgtggaggaggcgatgcgcgagctccagacggccatcgagctggactcccaggatgccttcccccgtcacgagctggccgcgctgatgatggacgagggcgactaccgctccgccatcacccagttgaaggaagtggtgcgcctggagccggacaa

SEQ ID NO: 6954 - DNA, 747 bp, Myxococcus xanthus
aggcgcatccatatgtctggaattgaagggaaggtcattgccatcaccggagcgagcagcggaatcggggaggcgacggctcgcctgctcgcgaagcgtggggcgcacgttgtcttgggcgcgcgccggacggaccggctcgaaaccctggtgtccgccatccgcgcggagggcggctccgcgcgctaccggaagctggacgtcacgaagcgggacgacgtcgagtccttcatgggcttcgtccgcgccgagcacggccgcatcgacgtcatcatcaacaacgcgggcgtgatgccgctgtcgaagttggaggcgctcaaggtcgaggagtgggaccggatgattgacgtcaacatccgcggcgtcctgcacggcatcgccgcggggctgcccatcatgcaggcgcagcgctccggccagttcatcaacctctcctccattggtggccaccaggtggtgcccacggccgccgtgtactgcgcgaccaagtacgccgtcatcgccatctccgagggcctgcggcaggaggttggcggcgacatcagggtcaccgtcatttcaccgggcgtgacgacctccgagctcgccgactccatctccgatccggtcgcgcgcgagggcatgcgcgaataccggcgggtggcgattccgccggaggccattgcgcggagcatcgccttcgccatcgagcaacccgacgacgtggacgtgaacgaaatcatcgtccgtcccaccgctcagtcctga

SEQ ID NO: 6955 - DNA, 519 bp, Myxococcus xanthus
atggacaagatcgtcatcaagggcggccaggcgctgcacggcgaagtgcaggcctcgggcgcgaagaacgcggcgctgcccatcctcgcctcggcgctgctggccgacggcacatccacctaccgcaacgtgccggccctggcggatgtcgccaccatgctcaaggtgctgcgcaccatgggctgcgacgcggagcgcgactcggagacgacggacgtctgccgggtcggcgtcaacggccacatcaccccggaggcgccgtacgacctggtgaagacgatgcgcgccagcgtgctggtgctggggccgctggtcgcccgcttcggccgggcgcgggtgtccatgccgggcgggtgcgccattggcgcgcggcccatcgaccagcacctcaaggggctcaaggcgctgggcgcggacatccacctcacggaaggctacgtggaggccacggcgaagcagctcaagggtggcaccgtcaacttcgacgtcatcaccgtcaccggcacggagaacgtgatg

SEQ ID NO: 6956 - DNA, 882 bp, Myxococcus xanthus
atgagcagcgagccctggaccatccgcagggtcctcacctggacgacgcagcacttcgagaagcgacaggtggatgcgccgcggctcaccgcggaaatcctcctgtcgcacgtgctcaagctcagccgcgtccggctgtacgtggacctggaccgcccgctctccaaggacgagctgggcgcctaccgtgccctcatcgagcggcgcatggcgggcgagcccacgcagtacctgacgggggtgcgtgagttctacaaccgccccttcaaggtggacgcccgggtgctgattccgcgcccggagacggagctgttggtggaggcggcgctgcgcatgcttcccaaggacgcgcccggccgcgcgctggacgtgtgcaccggctccggctgcatcgccatcagcctcgcggccgagcggccacaggccaccgtcatcgccaccgacctgtctccggacgcctgcgcgctggcgcgggagaacgcccaggcgctgggcgtggcggaccgggtgacggtgctgcagggcgacctcttcaccccggtgcccgcgggcgagcgcttccaggtggtggtctccaacccgccgtacatcgcctccggggagattcccggcctgtccgccgaggtgcgacgcgagccgacgctggcgctcgacggcgggccggacgggctggtggcggtgcgccgagtggtgacgggtgcgcgccagtggttggagcctggcggcctccttgcattggagattggcgaggaccagggccccgccgtcctggagctcctgcgtgccgcgggttacgcggacgcgcgggtggagaaggacctggagcggcgggaacggatggcatttgggacacagcccgtggccagcgagccacagggctga

SEQ ID NO: 6957 - DNA, 1089 bp, Myxococcus xanthus
atgattgacaaactcgaagacgtcgaacgccggttcgaacgcctgaccgccgacctgtcgaaccccgacgtgctcgccgactcggcgaggctccagaaggtgtccaaggagcgcgcgggcctggagaagctggtcgaggccttcaggacctaccgcaaggtgctcgccgacctcagcgaggtcgaagcatggctcggcagcagcgacgccgacgagaaggccttcgcacgcgagtccctgcccggactgaaggaacagcgcgacgagctggaggccagcctcaagattctcctcctgcccaaagacccgaatgacgagaagaacgtcatcctggaaatccgcgcgggcgcgggcggtgacgaggccgccctcttcgccgaggaggtcatgcagatgtacctccgctacgcggaccgccggggctggaaggcggacatcctggacatgagcccgggcaacgccggcggcgtgaaggacgccacggtgacgctgtccggtgacgccgtgttcagcagcatgaagtacgagtccggcgtgcaccgcgtgcagcgcgtgccggccacggagacgcagggccgcatccacacgtccaccatcacggtgtcggtgatgccggaggcggaggacgtggacgtgcaggtgaacccggcggacatcgagatgcaggtgatgcgctccacgggctcgggcggccagagcgtcaacaccacggactccgcggtgcgcctcatccaccacccgacgggcatcgtagtgaagtgccagcaggagaagagccagttgaagaaccgcaccatggccatgcgcatgctgcgggcgaagctctacgacatcgagcaggagcgcatccgcaacgagcgcgactccgcgcgccgcgcccaggtgggcaccggcgaccgcagcgagaagattcgcacctacaacttcccgcaggaccggctgacggaccaccgcatcggcctcacggtgcacaacctgccgggcgtcatggccggtgacgtggaagacgtcatcaccgcctgccggaccttctaccaggccgaagcgctcaaggcgcagacggccggcggcccgaagccctccgcatga

SEQ ID NO: 6958 - DNA, 939 bp, Myxococcus xanthus
tacgggttccaggaggtgaagcccctgacggacgccgccgacctgttcgtcgtcaacctggagtgccccttcaccgagcgcggtgagaagctgcccaagaacttcaacttccgcgcgaagccggagctggtgggcatcctcaccgccggcggcgtggacgtggtgagcctggccaacaaccacctgatggactacggcgcccagggcctgctcgacacgctggacaccctggacgcggcgcacatcccctacttcggcgcgggccggaacctggcggaggcccggcgcccggccatcgtcaccgtgggcggccagcgggtcgcgctgctgggctacttcttcctgggcacgcgcaacatcgaaccgcccggggtctacgccacggagacgacccctggggtcgctggccacttctccgacgaggccgtcatggagcagatgctccgggaggacatcgccgcggcccgggcccaggcggacatcgtcctgccctacttccactggggacgcgaaggcacctacaccccggagccctaccaggtccgcctggcccacgtcgccatcgacgcgggcgccgcgggtgtgctgggcgcccacccgcacgtcctccaggccatggagctgtaccagggcagaccggtcgtctactcgctggggaacttcgtcttcggggggaactggaaccctcgcgacaagcgcggcgccctgtggaagggccacttcgggcccgacggcggctacctgtccagcgagattctgcccttgaggaccgaccgcttcccggagctgcccttccagccggtgcccgtcacgggcgaggcggcggaggcggtgctgcggctcctggcggagtcttcagaaggcgtggagcggatgctgcccgaattggaaccgtgggcacgtccgcctccctcccccgaagtccgagggagggagtag

SEQ ID NO: 6959 - DNA, 501 bp, Myxococcus xanthus
atggacccgctcatccagcacatggtggaccgcttccgggccgcggggctcttcatctcctcttcaccggaggcgctcaactcgccgattgccgagcccatgctcacggcgctggataccgagacgctcacggcctacacggtcatcttccagaagaaccaggacaacaccgtcacgttgatcctggggacctccgatgtgtccaagtacaccccgggcggcagcattcagctggactgggcaccggtgatggctggcgcggagcaggtgacgcggtccaatctggaaggctcacagatggccatgtacgccgtgaaggccacgtctgcggaggtccgggagttctatcaggtcgagttgacccgggcgggctttgtcgaggaccgggaacagcccggtgtgtttcaacgaggcacggagcaactgaccatccgcactcagcccgaaggcgacatgctgatggtcgggctctatcgcaagctgggcgtgcagccgaagtga

SEQ ID NO: 6960 - DNA, 768 bp, Myxococcus xanthus
atgcgctaccgggacttcgacagccgcacgaccaccaacagcgcgggcgtcatcacgctcgcgttgacccggacggacgggatgcaggtgtcgtgtacccagggcggtccgaccttcgacccgcatcccgtcttcacgtcggttgcctaccgcgacggcggcggcatctcctgtaccgcgcaggcggacctcacggccttccggattccgcagcgtgtcgcccagcgggagtcggggggcttcttccaggcggagcactaccggatgctccccattcgcgtgtgcgccatggggcgcgcccagggcggcaactgcacgggccgtctgaccagcatgctggatgactggggactgacgggctcgggtgagtccggctcgtgccccatcatccccgatattcccgccccctgccccttgaacctgccgtactggggaatggcttccagcgtctatggcgtcagcctgatggtgaatgcctttggaccggacttctcggcgagccgtctggcgcagacggttgtcggagggctgccgctgcccttcttctttggcgcggagaacatgttctggatgagcgccgtgggcgaggaggccttcttcggtcagccactgcccgctgactccatgggcggcctggcgaccatggggttcaagggctggcccacgtccccgggcttgttgccaccggggctcaactggcaggccattccgtaccccgtctcatatggccgccgggactcgtgcttcctggggaatgagtgtccctga

SEQ ID NO: 6961 - DNA, 1356 bp, Myxococcus xanthus
atgctgagcactactacgcgccagattgcgccacgcggatgcctcaccatcgcgatgcttccctacatcgcgttgttgccgtgctgcattccctattcggggtgcagcagcttctgcaggtgcgccatccagggcgtccgggacatcacccgcagccagaacgcgctctctcgctacgaccggacggagattgctcctcagtgggatcagctcgagcggcccgccgcgcagcgagcgttgcggctcagccaggccgcgcagcagatgttcgtcgtggggcaggtcgtccagtacgggcgcatgatgctcgaattgaacaaccagtccgccgcgaacgacatcatcgacagcgccggcgcgggcagccgctgggcgggggagctccgagtggatggggtctccaccacgcgccgcgaggtggcgccctacctgggggccgtggcgtggcccaacctcatcaacgggcatcacgtctacgcggccatgggcagccgggggcacagcttcgtcgccaaccgtggcatcttccccactgatgactggctcgtcacggcgggtatccagcggcggttgactaccccggacacggtgatgattcagggggatggcagcacctactgggctcgcacgccgcttcatggcacgtatctgggcacgacggacacgtactccatcgcggatgaccatggtctggccttcgtcaccttcgcccgtggccggtccccgtgccccacgcagacttttggaatcggtgtcgcggagtcgctgctcatcgcctcggattcgagcgaccccagggaccggcaccgctggtctccgcgcctgggaacgggtgacctggagccggcgcagacgcgtcacaacatggggacctgttatggccgcaatcggatggggtgcccgtccgtctggcccatgttcgtcgactacaacggcgtcaaggtcatggacaaggatgacaactggggccagccgaagaacttcgcggtcatccagcgggactatgccgtgcgtggcacccaggcggacccctggaacctgctgttccgcttccggttcggggggacggacagcgggttcgacaacagcggactcgtcctggggccggcgggcggcgggttgaacatcagccgccagacggcggtgtccaccgggctggcctactaccatcgtcgcgagcactggcgcgagcctcccaatctgctcaatccgtactggcgcgccacgttggtccccgccaccgtggactccagcggcgcggaggatttcgtggacgagctgaacggcgccggcgtgggctgggcggcggaggcatacgaggccctgcgtgcacagggctacaggggagggccgtga

SEQ ID NO: 6962 - DNA, 1401 bp, Myxococcus xanthus
atgaaaagcgctgtcgacctgcagggcaacccactgagcgacatctccctcgccgcgatgcggcgatggctcctcgaagccgatgtgctgggctacctgccacagattgccgccacggagtctgaaggccgcctctggacgtactacgggttcggcgtccggcgcatcgatgcgttcgtccgcgcgaacgggtacgcggccctcgacgacgccaccctcctcaccgatgacctggacgccatcgtggcgctgcgggagttcatggccgccgcgcccccgctcatcgacggccgccggaggctcgtggagcagcttcgcgccttcgccgcggaacgggacgcgctggaccagggccgtccgctcactgcgcacgagctgttctccctctggtacctgaaggccgttccgggcgcctacatggcgcagcggctccagctcgcggacgtggacgaagccacggtgcggcgcatcgcgaagctctccgccgtgggactgcagatgttcgacgacggggtggacctccaggcggatctcgaccgggggcgcttgtggttgagcgcggaggagctcgagctgctgggactgtccatgacgccgcccgcgacgctggccaccaccgcgggggagcgcatcatccggctgcgcaaggccatctgcctcgagtacttcctcgcggtgtatgacgaagcctctcgcatcgcctcgccggagagtcgcaagcgcgcccagtccttcgcggaggcctggctgagcttcctccagcaggactacctcaagctgtacacgcccggagaccccaagccctgggactccgtgcagcgcgtcctgaaggcgctgccaggctcggagaccgtgaagctgcccgtgctgcactcgctgttctccctcatctccgccctgccgcttccgcccgtggacgtggaggcctgccggcgggagctgcaacagctcgggggctgccctcgggcgctggcgccagaagtggccctggacgccatgggtgtctgcgaggcggagggagacgcggcgaacttcgacgtgcccgggccggaggcctccgtgctggagcgcgtgctgctggcctcgccctccaagcacaccgcggcggacttcgcgcggcgctgccgcgaatcaaccgagggctctccgtccaacctgcgcgaccccaacctgtcggaggtgttcgccagcggcatcaagctcgcggagcgctccgcgcggaactccgtcaccgcccgggagaacttcctccagcagcttcgccctggctcaaagcgggccccggtggtggacgccgagctggccgagcggttctcgcgcgacggcgcggactggctcgcgttgggaatcgaggccctcgcggcgacggcccgcggggtccgcgacgtctgccggaaatag

SEQ ID NO: 6963 - DNA, 87 bp, Myxococcus xanthus
atgaacgtcatggagaaggccacggttcccgctgccacgacggccatgaacctgacctgcaggcgcatctactgctccccctactga

SEQ ID NO: 6964 - DNA, 927 bp, Myxococcus xanthus
atgcccgtgacgggcggcatcacctcgctgttccatgggacctacgagcacagccccgtgggagtccacctggaccgcttcaccacgttcatgttcgcgctgcgcggacgcaagcggatgcgcttctggcacaagcggccgtggagcgaggacgtctccaccatcctggactaccagccctacctggcgtcgtccttcgtcgcggaggtcgagcccggcgacatcctctactggccctccacgtactaccacgtgggcgagagcgccggcgcaggcgtggccagcagcctgaatgtcggcatccccatcaccgagcaccacgtcatctattccgtggacgacctgctgcgcgggatgctcgacgagacgtcgctcgccgaccaggagtggaagcagacgcggctcgcgcgggtatcggcctcgcccctggcccgcggtgccctctcgaagaacggtgtcctggccacggagctgccccgggcgctcaccgaagccgtgcgcgcgtttcgcgatgtcagccacccgaaagaggcgcgacggcacatccaatccacctggctcaagcggttgacctcgggaggcttcgagcccgtgccaccgcccacccgtgaaaagcctttgcgtgactcacaccacgtgcgggtggacccgagcttccccgtcctcttcgaacgagacagcgccacacggtggatttgttccgccaacggccatgccctgcgcggcgcgggtggtggacgcgccattgaaatattcttccgaaagctgaactccggcgcggctgtaagcgtcgaggagttgctgagcccgtttgggacacggcgcgctgcgagacatgattcagaagtcatcgccgcaacgcgtgaaggaatgcgtggcgtcctgaaaaaacttcacgcagttcgcgcaatcactctcagcgcttga

SEQ ID NO: 6965 - DNA, 741 bp, Myxococcus xanthus
atgaaaaggctgctgctctgtgccctgtcgctggcggtcgtggtgggctgttccggcgcgccgcctgaacagtccatcgcgcaggagggcttcaaggtccttcagcacgacgcgacgacgctggaggccacgtacggctccgggggggctgtggtgcggatgctcgcggtggagacgcaggccaacgtcgtcgaggtgacgtacgactttggcgaccccgtcatcgggttccacatcgacttcaatcagggcgtaggccagttcatgccgtcgggcagcccgttggacgcggcccattcgcacctgctcgcgtcgctgatggaggggcttgcccgcgagctccccgaagagggccgcacccgcgtcgaggacgccgccgagcgccagacgagcttcatgcaaatcgtccccgtgggcgaggtcctcacggcgtacgagtacgtgtccgagcgcggctggacgcacatctcctgctcctgcggccggcagtacatcggctctggctactaccgcacggcgggcatgggctgcggctgcaccggcggctcgggcaacggctgcaagggccgttgcgggcagggctgcggcgtcaccagcctgccgcgttgcgtgggcaccacggcctacacgcaggactgcgccaagcacgactacggcctgggcagcttcgcggcggcgtcggatgattactcgttcgcgcgcaacaactgcagctgcagcggcgtgggttcgtgcagttga

SEQ ID NO: 6966 - DNA, 954 bp, Myxococcus xanthus
cagctccacgtcgaacaaccgttcatgttcgacttcgccctctggagcgccttgcgagacttcctcagggggctcctggagcgcgtgggcgtcccggtgctgcccatggccaccgacctgttgctgggccgcttctcacgaggcccttacggcatcgcgaagcggccccaccattcgctggtgacgctggtgctccagggccggctgcgcgtccggctctggaagaagctctggggctcgccccccaacgaaaccgaggacttcgaccgccacctggacaaggccaccaccctggaggccggtcccggtgagctgctctacagcccctctcgctactggcagctcgaagaagcccagggggactgcatggccgtccgggtatggattcccgtcaaggggagccggcccacggacgcggccaaggacgtgctcgtggggctcctcgaagcgcggcacgcgcacgatgagcgtgtgccctaccacccctacccctggcgccggccgcgcaggggcgcgcaggcaaccattccatccgtcgagcaggccgcggatacgctccacgcgctgactcgggaagaagacgttcagcaggtcctgcgcctcatctgggcccggagggtcagcgcttgcgcgctcgagcccgtgccgccgccggaccaggccccacccctgtcagaccccgaccgggtgaggaagacgccgaccgtggacatcatccggatgaaggacccttcggggctgtggatctgggccgtcaacggacatgccttccccggccccaacgaggccctgggacagcggctcatcaacgcactgtcctcggaagcgccgccttgcgtcggtgagctgtgcaaactggctcgccccggtccgcagcgagaggccagtcgcgccacgctggcggcgctcctccggctgcgcgggattcacgtcatcaccggagcggaggcctga

SEQ ID NO: 6967 - DNA, 297 bp, Myxococcus xanthus
atgcccgttgccgcctcgcgccccgtcgtccggattcccgcgctgctcttctccgtggcggtggtgggcggtctcatcggcttctcatgggagcacgctgtctaccggggcagcgacagccatcaggaatggagcccgccggagctgggcaccgaggtggagacatcctcccgcgggtgggtgcgcacgcccgcggaggaggccatcctccagcgggcactggtccacttcccgccgtaccccaacgccacccgttccgaaccgctcgcagccgactacctggggcctggggcgccc

SEQ ID NO: 6968 - DNA, 1062 bp, Myxococcus xanthus
atgctcgtcatcgtccccgtgttcctctactcgctgttcctcttcgacctgctgcgccacatgttggactcgcaggagacctccctgtccacggcctgggactacaccgtcctggactatgagaaggagcccgagagcgtcgcgacggaggacggggggacgacgacggaggccttctccggcttcgagatggcacaggcctattcgcggtacatgtactgcgaccacgagtcgggtatcgacagctacggcccaggaaagggtccggagtgcagcgccaatcccgattcagaagaccaccacacggacgttgtcgcccatgcgtgctggctcaaccctggcgcacggcaggtgtactgcaccctggatgcacaggccgtgggcgcgtacggagtctcactccaccagtccttcatggataccttcgggcggggtggcctcatccgttgttccgcgcgtctgggcgtccagaactatctcttgccggagtcgttcctgccggaattctccgaggtgaagctggccaaggagaagcaggagcgggccaacggcatccacagaaacgcaacgggcgaaaatctcccggagggccatgcccgaggcgacaacgtctatctgctcccctgggagcagattgccatcctcaccgacacctgggcgctcacggagcacgcggacgtgcggccgggcaccgcgggtgggcgagggatgcacgagcgcgtcacccagctctatcagaacgaggacaacagcggcttcaccgacatgtcgagcgcgtccgagcggttggtgaaccaggccatcaactcgggtctcctccatgacagcctgaggctggaatcccagagctacaggacgcctggggatgatcctcgcaatcccagcctcgccatcaagcccgaccagagtggtgacggcgccgtggaggaaatcgagcagcagggaggccgccagggctacttcagcaacgagtggcaggactgggggcgcaacaacaaccagcgcacctacgaggcgcgtggcaactggtacctgggttgcgcgaggtcggagtcgtgctga

SEQ ID NO: 6969 - DNA, 1461 bp, Myxococcus xanthus
atggtgacgctgagcttcaacctcgcacatgcgctgcgccagaagatgggtttgcagcagcacagcgacgcgttggcgtactccatggcggtcctggaggcgcggtcgctcaattactatgcagtcagcaaccgggccatcgcggcttcctacgtcgcgatgaacagcatccacgcatacatggtggcggcgagcgtgacgggttcgatgatgcgggcctcggaggcgaacttcaaggagttcgcaaggcgcgagaaaatcatgtgcggttgcaaggggtgctacgagcactgcttgcacgccattgaagcgacgaagatcgcgaccgagttcgccaacgcgggccgtgagtacgaccagaaggtccgtgccctggagtccagcttcaacgccgcgatccgggggctcgacgtcatggtagacaacctgcatgcctcccagcgtgaggcgcattcccagacgcttcaggccatccaggatggccgcagccatggcctgtcgctcctggcggactacaccgcgccggacgttggtgcgctaccgcaggccgtgggggggctcaacgcgaatgaattcaactgcgcggtggatgggatgaactgccgggggagcgtggagaacgcttcgcccgaagcgctcgccagggtcatgacggaaatctccaacgccacccgttctggctggccggcggcacgaaagaccgcagcgcgcggggttgcaaagcctccgtacctgcatgacgacgtcatccgggaccttcgggacatcgcacagaagaagccgtacacggtgacctctcacgagggaacggcgaagtcggttcaggacaagggccaggtcaacgacggcgggaagaaaggcggtaatcaggggacgacggtcgccgcgcgagaggaaggggcgattcggaatacctgggagcaccagctcacgtcgacgaccgactacgaggcggaagtctggagcgatgccaacggcggtgaccataccccgggtggcgcgcactcgggctcgcacaacttcgagggcatcaacgccaacgcattgtcgggctgcgcccggtcgggcaactgcttcatgaagttccgagccaacccctcctctggcagggattgggggcagccgcgcgtgtacagctacctgacgcggcgactccgggtcggcgacccgagccgggcgccctgggagttgaacgcgtcggcccagattcaactggaccatggcgcgcaggggacagcgacgctgacgctcgcggcgcaggatggcgtggcgctctccaaggcgctcgtctactaccaccgcttcggtgcgaatggctggcgtgaggcgcccaacctcttcagtccctactggcgcgcgaagctgcaccccatctcatccgacgaggccgcggaggtcctggaagcggcaggcaacacggacgcatcccggctggcgcgggtccccggggtgtccctgtga

SEQ ID NO: 6970 - DNA, 783 bp, Myxococcus xanthus
atgggcagcattcgtgagaggaatcagtcgggccaggcggccgtcgaagctgccattgtccttcccctgttcgtcttcctcatcctgggcatcctccagctggggctgatgcaccaggcgcggctgctgaccaagtacgccgcctacaaggctgtgcgggctgggtcgctgaacagcgccaaggtcgaggagatggagaaggccgcgctcgcggtgctgatgccgatgctgagcgttcccgggcagaagggggcttacatccccccggtgggaagcgcggcggagttccaggccaagtggcgtgacgtgtcgggcaaccagattcccggtacgtcactgaaacacgcgcaggtcaccgtctgcggccccacgcggagcgatgccggcggaggtgggccggagctggacttcgatgacccccggaacaccgcgcccacgggctggaaggagagccaccgcaccaagctgcgcgtccaggtgacgttcaactaccggatgatcatccccttcgcggactgggtcatctacgaatccacccgtggccgcgagctgcagaaggaactgcgaatgtatcgcaagcctaccgatccaaagaatcagggcgacaaaccggaccgcacggagtccctcctggagcaggcggctgcgcagaaaatctacatcacccccattcgcgccacctacaccatgcggatgcagtccaacttcttcctcaaccgggcagccctcccagggagcaacgaatgcgtcttcccattctcctacaaaggcaaggcgccgtga

SEQ ID NO: 6971 - DNA, 963 bp, Myxococcus xanthus
tcgaaggacgcgcggctgttccaggcgctccggttgcgccccaccttcggtgagctgatggagcgcaccgggttcgacacggaggtggtgctccggcggttgtacgcgctgtgcctgctggaggtcgcgggcttcgtggaggacgtggacgcgaaggcggcccggctgagcgcggggaaggggacggcgcccgccgcgcccgcgcccgaaccggtggcgcctccggtggcggcgccagctccgcaggggacgccgttctccgacgaggacgaggcggcgcgcaatgccctggtgagcgccttcatgtcgcaccggagcaaggaccccttcgcgctgttggacgtgcccgaggacgtgcagccggtgccgctgcgcaaggccttcctggccctggcggaccgctacgcgcccctgcgcttccacacgccggagctccgcgagaaggcggaggtgctgctggcggcccatgcgaaggcgtttggcgcgctgtcggacgcggagcagaacctgctgtggcgcaagcggcgcgcggcgcatcgggagaaggaccggggcacgcggcccaccacggccgaacagttccgcatccgcacggacttgctggatgcgacgacgcagttcgaagaggcgaaattccggctggccgcgcggaaccacgcgggggccttcgagtacttcgagtacgcctgcgacatcgacccgaagccgctgtaccaggcctaccgggcctacgcgcgctatctgatgaagccggaggcgcacggacggctggcgcagcaggagttgcaggaggtgttgcgccaggagcccacgctggaggagggctgggccttcctgggagaagtggcccagggcgaaggccagtgggggcaggccgaagacgcgtttcgcagggcgttcaagctgaacccgaagaaccgccgctacgtcgaactcatccaggagattgtccggcggcgctag

SEQ ID NO: 6972 - DNA, 1803 bp, Myxococcus xanthus
gcccggaatggcagccgcatccccatggtcgaagcaagcgagggcaccgcgcaaatcaccctggaagtccccggtggcgtgagcgccacgcttgaagcaggccaacggaggcgagctcacgctggaggcagcgggcaacactgtcacgctcgcccagcaaggcgtcaccgtccgggccgcgaccacggtgtccgtcaccgccagtcaggtggaggtgagcgccggtcaggtcacggtcaacgcggcgatgtcgtccttctcgggcgtcgtgaagtgcgacacgctgcagaccaactcggtgatgggcgtgacgtacacgccaggggcgggcaacgtatggtgagccaccccgtcaagctgcgcgggctcgttttcgacggagccaccggagccccgctggcggcccagcgcggcgcccccgcgttcatcgagcggcaggaccaggagttcgttcaagccatcttcggagagctcaggtccgaggaaggccgcaaggcgctggcgggcaccctcatctccgatgggacactcaacccccaggggctcaagctgctccagcccgttcacggggtgttcaacgtggccttgctggaggcctgctgcgacgtgttcggtgagcctcgggtcgaggcgacccgaatcgaaagcgcggggctcgtcatccgacgtgtgggcgcgggcaatacgcgcgaggcctgggttcggcgggacggcaaggtcgccggctgggtcacgctcgacggtgaggaacaggagcgcgaacccgaccctggacggcgcgaagggcccgcgggccccggccccgcggacgtccggcgcgaactgctgcgcctcatgcgggccaccagccgggaccaggagaccgtgacatcgctcttcatcgcgccgcccgacgcgtgcgccgcggcgaagcgcaccgtgctatacgggctgctccaggtagcgagcggtgaagcaccggagggagcatccagcacagcgcccgcgttcgatgacgcgcaggtgcggagcctgctgtccccctacttcgccgcgggaaagacggtggactggacagggctcgaaggcctgtcggtcacctaccaggatgtcgcccagcgcagattgccgcaggcgaagcacgacaagctcgccctgttcatcgacttcctgcgtggactggtcgcggtgttcgacgccttccaagtgcccgcgctcatgacggcgatgaaccgcgtacagctcgactatggcaatggccagaagcggcccgcgggcacggcgctctccgggctggcggacgtcctcgtccaggggaagacgggcacggtggtgttgcctcgttcgtggacgcatcccaatgcctcggaggcggcccaggtcctccaggcggcgaaggccgccaccgcgccacggatgcgggacctcatcccgcctgagcggcgcttcgagcggcgtggctcgcgctacgtggccagggccttcgtccggatccaccgcgaagatggctgcccacccgccatcgtctggagcgaggagagcgcgcccttcaccatcgccgcctggcacgagcgcggaaaacggccgcccgtcctcatcccccttccgtcgctcaaggacctgagcgccttcaagcccaacgtcaccttccaggtgccgccggggatgaacgagctgctgaacaagaactcgccgaaggactttcctcgaaggcttcagccagtacccccgcgggtcagggcatcgggtggctctgtgggttcaacattcccatcatcaccctctgcgccttcatcgtcctcaacctcttcctgtcgctgctga

SEQ ID NO: 6973 - DNA, 402 bp, Myxococcus xanthus
atgagcccgaagcctcccgacaggcgccctcccgtgggctttccgctgcggctcgtgccggacgaacgcggcgagctggcgtttccttcgctagaagccagcgtgcggcagtccatcgaggtcatcctccgcacgcgccccggcgagcagctcatgcgacagggcttcggcgccgggctggagcggatggtgggacaacccaacaccgtgtccacccgccggcgcatccaggagctggtgcagcgcgcgctcaccgagtgggagccgcgcctggaactcatccgcgtggacgtgctggagctggcggacctgcccgcccaggtccgcgtggaaatcgtctaccgcctgcgccgcacgggtgacgtgcagcagctcgggctcgccatggacctcggaggctag

SEQ ID NO: 6974 - DNA, 399 bp, Myxococcus xanthus
atggaggtccccgccctgtccgagctgctcggtgcgcgcggccggctgccacacgtctgggaggtaacgggcactcccgccgcggacgggttgccggtgtaccaccggctcaccgtcgtggcggactcgacgcaggagctgtcccgccggggcgtcgtgcggctgctgttgccatccgacctgggcgcgccggtcaatgacgtgagggcggacgcgcgcgccggcctgggcgaccggccgccacgcctggacgacccaagggtggcggcgcgattggtgacctggctgcgcctgcgtcccagcggaaagccggagcgcttcgcgctgggctgggtggacatcaacgcggtcgaagtggaccagcgcgagacgaccggcggacgcctgattggacagagc

SEQ ID NO: 6975 - DNA, 1392 bp, Myxococcus xanthus
ggtggagaggtgtgcgggatgctccaggtgctgcgcgcgccggggaagccgttcgacgaacgggacctgcgcctgctgggcacgctgtcggagttgctggtgacgctgctggagcagcgccggctgcgggccgagtcctcgcgccaactggccgagacgcgcctcctgctggacctggcgcgcaccacgtccggtgtgctggagacgtcgagcatcctggacgtggccgccgacttcctcgtccgcctgctggacgtgtccaactgctacatcctgctgtacgacgagggcgcccggctgctgcgcggcgccgcggcctccatcgcgcaccgcgactacttccgcacggtggtgttgcccctccatggagacggcctgacggcgcgcgtggcgcgtgagcgcaggcccatcgcggtggaggacgtgtcctccgcggacggaggcttcaacccggagctcgcgcaccgcttcgacgagaaggcgctgctggcgctgccgctcacctcgcgcgaggagctcatcggcgtggtggtggtggacgacacgcggggcccgcgcgccttcggtccggagctcatcgagctggcggaggccacgtgtggccagctggcgttgtccatcgccaacgcgcgcttgtacgagtcactgtgggccagctacgcggagctggccgccacgcgcgcggagatggtgaagcgcgagcggctggccgcgctgggcgagctgtccgcgattgtcgcccacgaggtgcgcaatccgctgggcgtcatcttcaacgcggtggcctcgctgcgccggctgttggtgccgggcggggacgcggccatgttgctcgacatcctgggggaggagagcgaccggctcaaccgcatcgtcggtgacttgctggactacacgcgtcccagggacccggtgctccagcaggaggacctgggccgcgtgctccaggattcgctggaggccgcgcggatgcagggcggcggcgcggaccgctccatccgcatccaatccgacgtggagcccggcctgccgccggtacccatggaccgtcgcctcatccgacaggcgctggtcaacgtggcggtcaacgccatccagtccatgccgcagggtggactcgtgcaggttcgcgcgcgccgtgaagcccacgcggggcgcgagcaactgcgcatcgatgtggtggaccagggcccgggcatccccgccgagctgctccaccgcgtcttcgagccgttcttcaccaccaaggcccagggcaccggcctggggctggccgtcgtcaggcgcatcctcgaggagcaccggggcgaaatcgccgtggacagtattccggggcgcggtaccaccttcaccttccggctgccgttctcgcagcctccgtccttcccatga

SEQ ID NO: 6976 - DNA, 444 bp, Myxococcus xanthus
gggaagaagcacggccgttgggcggagtggcacgccaccggggcgctgaagacggaaggcacctacgtcgacgggaagatggagggccgctgggtcagctacttcgaggacggcgtgaagcagttcgaaggtgactatcgtggcgggctcaagcaaggactgtggaccctttactaccaggagggccagaataaccgcgaggagctccattcacccggctccggcccggtgaagtggaccgcctggcgctcggacggctcgaagtgggcggaagggacgctggcggggcatcgctcgcagggcgcttattcggagtggcacccccatggcgcgctggccgtgcagggccagtacgagaagggggagaagacgggtgagtggaagtactgggatgtcgcgggcgtcgccacggatgttccgcagggcgacttcgacagcgagtga

SEQ ID NO: 6977 - DNA, 1386 bp, Myxococcus xanthus
atgcgcgccaccaccgccctgttgttgcgggcggagaactacaccgtcttcgaggccgccaccggcgaggaagccctggcccagctcgccagcggcagcatcgacctgctgctgacggacctgaaaatggagcccatggacgggctcacgctcctgcggcgcgcgctggaggtggctccccggctccaggtcatcatgatgacggccttcggctccatcgagagcgccgtggaggccatgcgcctgggggcctacgactatgtcaccaagcccttcaaggagagcgagctgcgctaccgcgtggagcgcgccctggagcgcgcgcgcctgcagcgcgacgtggacaacctcaccaccgacttcaaccagcgccacggcctgtccgccctggtggggcgcagcgccgccatgcgcgagctcaccacgcggctgatgcgcgtggcgcagagtgacgccaccgtcctcatccagggcgagagcggcacgggcaaggagctggtggcgcgcgcgctccatgcgcacagccgccgcaaggcccgctccttcgtgcctgtcaactgcgcggccatcagcgagtccctgctggagagcgagctgttcggccacgccaagggcgccttcaccggtgcggtgaagtcccgccggggcctcttcgaggaggcggacggcggcacgctcttcatcgacgaggtgacggagaccagccccaccttccagtccaagctgctgcgcgccctccaggagggcgaggtccgccgcgtcggtgagtccaccgcgctgcgtgtggatgtgcgcatcgtcgccgccaccaaccgggacatcgagctggaggtgcgcgacaagcgcttccggcaggacctctactaccgcctcaacgtggtggccctccgcgtcccgcccctgcgcgagcgcctggaggacgtgccagcgctggcggagcacttcctggagcgggccaatgcccgcagccccaaccccaagcgcctttccgccgccgcggtgtctcacctgatgagctacggcttccccggcaacgtgcgcgagctggagaacctggtggagcaggccgccgcgctcgcggagggcgatgagctgctgcccgaggacttccccgtgcggcagggccgcatgacgccggcccatggcacccccagcgtcgccttcctggacgggcagggcggggcgctcgggcgcaacgccagcgcggggcccacgctggcccaggtggtggaagaggcggagcgccacgccatcacccaggccctggagcggcacggggtggacctggcgcgcgtcgcggatgagctcggcgtctcctccaccacgctctggcggaagatgaagcggctcaacctccgcccccccagtgagctggcccgggaatag

SEQ ID NO: 6978 - DNA, 81 bp, Myxococcus xanthus
atgattcccggcaagctggcggcctccgcggccagtgactcgcaccggctgctggggctcatcgacccccaagcccctgcg

SEQ ID NO: 6979 - DNA, 297 bp, Myxococcus xanthus
atgacctctgtcgcatcctcctcatgcgccccttcgtcatcgcaggccttcaccgtgctcatcccacgcggccttcaggcggccgtggaggggctcgcggcggagacccgccaggagctgctggccgagctgttccgcctggccgcgctggcccggcaggaggaaagtcagctactccccgagttcccgtacacgctgcggctggacgtcgccggctgccaggtcagcgtggagctggacccgtcccgctcgcgcctcaccctagtgggcctgctgcggccccagccgctggagtga

SEQ ID NO: 6980 - DNA, 297 bp, Myxococcus xanthus
atgtcgcgccgtgctggatacgcagaatcctgggacctcacgtacctggtggagcagctccgggagctgattgggcacgacctgcgcctgggctcggccctcagcgatgagctggaggacgtcctgggcagcctggtgcagcgcaatcagcgcctgagggtcctgcagcgcatggtgaccgcggaacgcgccccagaggacctggcggcccttcgcggggcattggaggagatggaccgggagctgatgacccggctgcctgcgttgctcgaacagctgcgcctggcgctggcttga

SEQ ID NO: 6981 - DNA, 1713 bp, Myxococcus xanthus
atgtgccccgacagcggggtgccggcggagggtttccccatcgacttctatcggggcgagcgcatcgggaagtacgaggtcgtcacgcagctctccgtgggcggaatggcggagctgttcctgggcttcacttcgggtccgggtggcttccgcaagtacgtggtcatcaagcgggtgctgccggacgcgcgggacaatgcgcagttcgaacgcatgttcctggacgaggcgcgcatcaccgcggccttcaaccacccgaacatcgcgcaggtgttcgacctggggcgcgaggatgacgggctctacctggccatggagttcatcgccgggcagaacctgaaccagattaccggcgcgtgcctgcgccgccaggagcagctcccgctgggcttcacgctgtcggtggcgcgcgacgtctgcatggcgctgcactacgcgcacacctatacggcgccctccggcgcgcccagccccgtcatccaccgcgacgtcgcccagaagaacatcatggtgacgtacgacggcgtggtgaagctgctcgacttcggcatcgccaaggcgaaggacagcttggagcgcaccaacgtcggcacggtgaagggcaccaccgggtacatgtccccggagcaggtgcggggcgatacactggatggccgcagtgacttgttctccgtcggggtgatgatgcacgagctcatcaccggcgcgcgcctgttcgcgggcaagaatgagcgcgacgagatgatgaagatcctggaggcgcccgtcccctggccctcgcacgtcgcgccgcacgtgcccgaagaggtgtccaaggtggtgatgcgggcgctggagcgcagccgcgagaagcgcttcgccaacggccgggacatggcccgggcgattgaagcggcggcgggcaagttgctgctggacgcgcatgaccgggccgcgctgatgcaggactggttcgccgagcgcatgtccgccacgcgcgtcatgctggagtccgcggacggcaccaccaacggcgtcatgctggactccgcgaagcgggccctgcgcagtgatgacggaccctacctccccgagcgcaaggacatcccgacgccgtcgaacggcgtggccggcatgccgcgcaagccctcgcgcaaggtgcccgctgctgcggcgccccggaaggcttcggcggccgtggagggcacgccgcagccgccggagagcaaggcctccaatgtgctgtgggggctggtgctgatgggcatcctggtgggcggtggctatgccgcctggcacctgtcgaaggtgctgaacgagacggtggatgaaaaggacgcgagcgcgctgcgcaccctcccccaacacgacccgaacctgcccgtctacctgggaccaggctcgggcccgcccacggatgccggcaacacggagactccagcgaaggtgtcgggcggcgaggacgcggagggctcccgttccaaggaggcggcgagcgcccgtccggtgaagggccggggcaagctgaccttgctggtgctgccggaggcggaggtcttccgaggcaagaagcgggtgggccgcacgccgatgttcaacgtggcgatgcccgcgggggagcacgacctgaccatcgtgggcccggacggcaagaagcgcatgctgtcggtgccgatcagcgccggggagacgacccagttccggctgaagctggcggaaatccccgagcgctga

SEQ ID NO: 6982 - DNA, 969 bp, Myxococcus xanthus
atggcccctctgaccattggcttcctgatggacccgctcgagacggtgcgggtggaccacgactccacgttcgcgttgatgctcgaagcgcagaagcgcggccatcaggtgcgctacttcgaacagggctggttgcgcttcaacggcacgtgcgcggaggcgcgcatgcgccacgtcaccgtgcgccgcgaactggggcggcacttcgatatcctcgacgaggcccctcgcccggtgtcctcgctggacgtgctcttcatgcgcaaggacccgccagtggacgcggagttcctgcacgccacccagttggtggagctgtgcggcacgggccggccccctgtcttcatcaacgagccggcgggcctccgcgacgcgaacgagaagctcttctccctgcgctacccggacctgatgccggacacgcgcgtcaccagcgagctgccggtgctgctggacttcattgcgcgcaacgcggcgggcaccatcctcaagccagtggatggcttcgcgggcaagggcatcctcttcctgtccgccacggaccggaacgcgcgctccgcggtggacatgctcacccggggcggccgcgaggccgtcatggcgcaggcgtacatcccggagagccgccagggcgacaagcgcatcctcctggtggacggcgagccggtgggcggcgtgctgcgcgtcccgtccgacgacaaccaccgcggcaacatggccgccggcggcgtgccccaaaaggccgtgctcaccccgcgggatttggagatttgcgagcgcctgaagccggagctggtgaagcgcggactgcggctggtgggcatcgacgtgctgggcacctacctcaccgaggtcaacgtgacgagccccaccggcctggtggaggcgaaccagctggacgacgtgtgcgtggaggccaaggtgctggacgtggcggagcggctcgtcgccgagcgcgccgcgcgctga

SEQ ID NO: 6983 - DNA, 254 bp, Myxococcus xanthus
ctgacgcaggtgacaagcttcggtagcaaccccggcaacctgcagatgttccgtcacgtaccgtccggcatgccggccaacgctccgctggtggtggtgatgcacgggtgtacgcagcgggccgcggggatggagggcgccggctggtccgcggcggcggacgtctacaagttctacgtcgtctatccgcagcagcagggtggcaacaacatgaccagttgcttcaactggttcgagcccggtgacttctcacg

SEQ ID NO: 6984 - DNA, 237 bp, Myxococcus xanthus
atgctggggtggggagcggcggcttgtcgggacacaccgtccctgtcgggggcggaggggcggttgcggttgtcggcgcggcgtgtggacttcccgcatgcctacccgggcacccggcgggaggccgaggtccgcgtggtgaatggcggccgggccccgctggatgtcacgtggacggacgtgacggcacccttctcgttggaggcggcgctgccggtccgggtgctggcgggagag

SEQ ID NO: 6985 - DNA, 1794 bp, Myxococcus xanthus
tgctctaaagccgggccggccgtcgtgtcatcttccgaggccacgtcgaacccacaggacagcgaagcgggcgctaccggcacggacgcatcggctcctggaccggaaaccttgggcacgcccggagcgtcgtctggcgcgaccgacagcgcaccagttaccgcgcccgacggccacgaggcaccgtcaatgggcacggagccaccgccgccagaggacccgctggcgcaggggattcccacgccgggagacctcaagcgcctggacttccgtgggggtgagcctcgcgtacccgtgcgcctgatggagggccggaacgaggtcaccttctctccgcgcggccggatgcgcctgcgcttcggagggcccgacgagaagatgctcgacgcggccgcgggcacgcgctggacggtccgggtgacgcaggggagcccggcggtgctgtccgcgcgcgtgcaactggcggagttccgcatggccgaccgcgcgggactccaggcggcgctggagtcatggcgtgagaaggggctcgcggtccgagcccaggtcctgggctccgtctacggcatcgccggcaaggtcatcgacaaccggcgcaccctgctgctggtggacgaggtcctcacgcccgaggccgccggccacaagcaggcagagttgctgcgcagccacggcgtccagacaacgctctttgaagaagtgcgcacgccctccaaggccatcctggaggtgcgcgacgaggcgggcgtcgtcgtgggattggcccaggaccggctggacgcggagacgcccgacggcgcgggcttcgacgtgcgccaggtcgaatacggcgtgggctacgacttccacggcttcgaggaccgcaccttccggggcgcgctccagctcgtcgtggaccgttcgggccggctggcggtggtgaacgtcgttcccctggaggacctgctcaagggcctggtccccgcggaaatcttcgcccgcgcccactcggaggcgctcaaggcccaggccgtcaccgcgcgcggcgaggtgctggcgaaggtgggcatcaagcacctggcggacccctacctcctgtgctcggagcaacactgcgccgtctaccggggccgtaccggtgaggccgccagcaccaccgccgcggtggaggccacccggggcgagggcctcttcagtgaggacggccgcctggtggactccgtctacagcgccgtctgcggcggccacaccgaggacaacgacgtggtgtggggcgggcctccggaccccagcctgcgtggccgcccggacgtcatcggccccgtgggcgcccatcccctgcccgccagcctggagcgctggctgacgaccgccaacctcccggcggcctgccggctgtccagcttcgcgcagcccagcaagttccggtgggagaagcgcttcacggccgagcaggtggacacccgcctgaagcggctgggcgtggggcgcgtccaggccctggcgctgacggaccggggcgtctccggccgcgcggccgtgctgacagtgtccggcgacaagggggccacccaggtgcgcggcgagctcaacatccgccgcctgttcggcatgctcaacagcagcatggcggtggtggaggccgaacgggacgccgggggccggctcaccggctggcttttccgtggcggcggctgggggcacggcgtaggaatgtgccagacgggcgccattggccgggcggaggccgggcagcgctaccaggacatcctccgtcactacttcaacggtgccgaggtggcccccatctattga

SEQ ID NO: 6986 - DNA, 729 bp, Myxococcus xanthus
atggccggcaacaacggcatgggcaacgacgaccggcccgtgtcccagggtggccagaagcccgccttcgagattcccgacgcccgaaagaagaacgaggtggcgatgaagacggacccgacgtcgccgggtccgggcatgacggtgaacaaccagaacgagagcgacgaggtggtgggcaactccaagcgcctcaacatccagcccggcaccggcggcgaggaagccggctccacggtccgcgcgggcgctccggggctggcgtcgctgacgccgtcgcgcgccgtcatggacaaggtcctgggcgccgcgcccaacgaccacctgcaggacgcagaggaaggcgatggcaccctcctcaacacgcgtgagtggaagtacgccagcttcttcaaccgcgtgaagcagagcgtgggcatgcactggaaccccaacgagcagctgcgccggagagaccccaccggtggcatctacacggggagagaccggtacacgctgctgcaaatcacgctcgacgagcgcggccaggtgacggacatccaggtggagaagagcagcgggctcgacttcctcgacttcgaggcagtgtcgtccttcaaacgcgcgcagcccttccccaacccgccgcccggcctgctttcggacgacgccaaggtgaagttccagttcggcttcttcatggagatgggcggcggcccgaagatgcggctgttccgccagcccaactga

SEQ ID NO: 6987 - DNA, 525 bp, Myxococcus xanthus
atgtcgtgcggcggggacagcggtggcccggtgttcatcgaacaggacggcgtcgagcgcctggtcggtgtgacttcgtttggtgacctctcctgcaccacggggacgaacagccgcgtcgacgtgcacgcggacttcatccaggtcgccatcgaggacgcctcgcgaggcgcgcccgtccggacgctggtggacccggatgtggacgcctgcgcgcagtggtgccgtgcgcatgcggactgccccgtgggcatggcgtgtgtcgcgcgggcggacggcacccggagttgcgcggtggcggggctcgaggcgggccacttcgggcctgcctgcaccggcgcgcagggtgagcatccctgtgtgaaggcgggctcggcgtgccggctgtggctgccctgctccgagccgcgggatgcaacagcgccgggcgggtgcgcggcggcagggggcggaaaccccggcctgattccgctggtgcttctggcctggtcctggggacgcggccgtcgcgcgaagggcgggtag

SEQ ID NO: 6988 - DNA, 801 bp, Myxococcus xanthus
cggaaggtccgcagagtgctgctgggcatcctcgtggccaactgggtggtggccagcgccaagctgatcttcggaatgctcagccagtccgcggcggtaacggcggacgggctgcactcgttcatcgacggcggctccaacgtgctggggctggtggccatgggcgtggcgtcacgcccggcggacgaggaccacccctacggccacggcaagttcgaggcgctcgcgtcgctgggcattggcgcgatgattggcgtgggcatgctggagctggggcgcatggcgctcgactccgtgctcaacgacaagcacccgcaggtgacgggtaccatggcggccgtcatggccttcaccctggtggtgaacatggtggtgacgcgggtggagcggtactacgggcgcaagtacaagagctccctgctgctggcggacgcgagccacacgatgtccgacgtctacgtcaccctcgcggtgctgagctccctgctgctggtgtggctgggctacccgcgcgcggatgggctgattgcgctggcggtgatggtgttcgtggcctgggtggcctacggcatcgtccggcaggcggtgggcatcctctccgacacggcgcgcctggaccccgacgaggtgaagcggcacacgctggcagtgccgggcgtgcggtcctgccgcgacgtgcgcagccgcggcatggaggagagcgtctacgtggacctcaaaatcgaggtggacccgcagctcaccaccgcgcaggcccatgaggtagcggaccgcgtggagcgcacgctgcaaggcgcctat

SEQ ID NO: 6989 - DNA, 483 bp, Myxococcus xanthus
ggaacccaggcggtgacgctcgaggccgtcgcggcgcacgcgggggtgacgaagggcggcctccagcatcatttcaagagcaagcagctgctgctcgacgcgctgttcgaggagatgaaccggcagttcgtcgagtcgttccacgcgaacatcgcggaagacccggaggcccatgggcgcgaggcgcgtgcgtatctgcgtgccatggtctccagtcccgccaactccgagcagattcggggcttgagagccctgattggaagcatgatggtggagcccgaccttcgcgaacgatggaactgtagctggcaggatgacctccagctgaagtccggtgaggtcagcccccaggacatcaattccatcatctgcaggctcgcgaccgacggcctgtggttcgcggacctgctcgaggaccagggaatcaggcctgaagtgagagccgccgtcatccgaaggctcgaggaactcacccgggagtag

SEQ ID NO: 6990 - DNA, 1076 bp, Myxococcus xanthus
tgtgacggcaagcaggaagaagcagccttcgcaccgccggtccagaaggtgtccacgctgaaggtgcaaggggaggccgttgtccttcacgacgaattccccgcgcgtgtctccgcgttccgggtcgcggaagtccgccctcaggtgggcgggctcgtgcgcagccggcgcttctccgaaggagacacggtccagaaggggcagccgctctaccaactggaagcggcggtgttccgcgcgaatgtagaaggcgcggcggcggcccatgcggccagtgaggccgggcggctccaagcggagctgcatgcggggcgcatccagtccctcttcgagaaaggcgcgagcacccagcaggcgcacgatgacgcccgggccgcgctcgccatcgcgaatgcggaggtggcgcgcgcccgcgcggcgctggacagggcccgcgtcgacctggactacgccacgattaccgcccccatcgcggggcacatcggcatctccaggtcaatgaaggcgcgctcgtcggccccgcggatgccacgccgttgagcgtcatccagcagattgaccgcgtcttcgtcgacatcaagtcacccgtggagcgcgcggcgggcttgcagtcactccagggaggcaccggagaggcgggggcggaagtcatcgtgctctcctcgacgggggcgccctatccggagcgaggccgcgttcagttctcggacatctcggtcgaccccgggtccggcgagctcacggtgcgcgccctggtccccaacgcacagcggaagctcctgccgggcatgttcgtgaaggcgcgcgtcgtgctcggagaggtggccggtgcgctcctcgttccccagcaggccgtgcttcacgacgcgcagggccaggcgcaggtcttcatcgtccgagaggacaacaccgcggaggcgcgcaacgtccgcgccggacgcatcgtcagcggacgctacctggtggaggagggactctccgccggagagcgtgtcgtggtcgaggggcaggaccgtcttgcgccaggccagcaggtcacccccgtcgagtggcagcacgccccggcctcgcgctga

SEQ ID NO: 6991 - DNA, 2962 bp, Myxococcus xanthus
ttcttcattgaacgcccggtcttcgcctgggtgattgccatcttcatcgtgctcgccggagccatctccattccccggctccccatcgagcgctacccgtccatcgcgccgccgagcgtgacgattaccgccacctatcccggcgccacgccggccgcgatgaacgacagcgtcgtgtcgttgattgagcgcggcctgtccggcgtgaagaacatcctgtacttcgagtcgtcgagcgacacgtcgggcatcgcgcaaatcgtggtgacgttcgcgcccggaacggacccggacctggcgcaggtcgacatccagaaccgtctgaagaccgtcgaatcgcggctgccgcagatggtccggcagctcgggctccaggtggagacgaccaccaccaacttcctgctcttctccacgctcgtgtcgagcgacggccgctacgacgaggccgagctgggggacttcctgagccgcaacgtggtcgaggacctgcgccgcgtgcccggcgtggggcgcgtccagctcttcacgccggcccgcgcgctgcgcgtctggttggacccggagcggctcatctcgcacggaatctccgtggatgaggtcgcggcggcgattcgcgcacagaacgcggaggcctctcccggacggctgggggacatgcccgcggttccaggccagcgcgtcaccacccccctgatgctccaggggcagctcctggacgtcgcggacttcgagcgcgtcatcatccgggccaatccggatggctcgaacgtgctgctcaaggaactcgccaaggtggagctggggccccagagctacgcctcgtccacccggcagaatgggaagaacgccgccacgttcggcgtgcagctggccccgggggcgaacgcgctcgatacctccgagcgcatccgcgagcggatggcggacctctcccgggcctttcccgcgggcgtcgagtacacgattccgtacgacgcggcgccgttcgtgcgcgtctccatccagaaggtcgtccagaccttcttcgaggcgatgctgctcgtcttcgcggtgatgtatctcttcctgcagagcgtgcgttacacgttgattcccgccatcgtcgcgcccatcgcgctgctgggaaccttcgcggtgatgctggcgtcggggttctccatcaacgtgctgacgatgttcggcatggtgctggcgattggcatcatcgtcgatgacgccatcgtcgtggtcgagaacgtcgagcgcctcatggcggaggaggggctttctcccctcgaggccacgaagaaggcgatgaaggaaatcacgggcgccgtcatcggcatcaccctggtgctcacgtccgtgttcatccccatggcgttcgccacgggctccgtcggcaccatctaccgccagttcagcctggcgatggccgtgtcgattctcttctccgcgttcctcgcgctcacgctcaccccggcgctctgcgcgacgctgctgcgcccggtggagcccggccacgcggggaagcgccgcggcttcttcggcggtttcaaccggctcctggagcgggtgacggggcgctatgcgaactggacccgggccattgtcgggcgtctgggccgggcgttcttcgcgtacgccgtggtggtcgccatggtggccctggcgttctggcggctgccgggcgccttcttcccggaggaggaccaggggttcctcaacgtctcggtgcagctcccgtcggacgccacggccgagcggacgaacagcgtgctcggggagctggaggccttcttgagcgagcgcgagggcatccaggacgtgctgaccatccagggcttcggcttcttcggctcgggggcgaacgctggcctcatgttcgtgatgatgcgcgactgggacgagcgccagggggagacggcggcgggtgaggtcgccgccgccaacgcgcgcttcgcctctccgagggagggcatggtcatcaacgtgctgccgcccgcggtggacgggctcggcaacagcgcgggcttcgccatgcggctggaggaccgtgccggacacggcccgcaggcgctcaacgacgccatgaaccacgtcctccggcgcgcctcggacagtccggtcatcgccttcccctatcaggaggggttgccggacggctcgacggtgcgaatccaggtggaccgtgagcgcgcggcggcgctcggtgtgtcgttcgcggaaatcaactcggttatctccaccgcgctggggtcgacgtacgtcaacgacttccccaacaagggctacatgcagcaaatcatcctgcaggcgcgcgcggagtcccgcatgcaggtggaggacgtgctcaagctccccgtgcgcaacgcgcgcgggcagatggtgcccctgtcctcggtggccgagcccgtctgggagcgggggcccatgcagttggtccgctacaacggctaccccgccgtgcgcatcgccggggcggcggcaccgggcttcagcagcggtgacgccatggcggagatggagcgcatcgcgggcgaactaccacccggcttcgcggtggagtggacggggctctcctatcaggagcggctctccggctcggaggcgcccatcctcctggcgctgtcgatgctcgtcgtcttcctggtgctggcggcgctctacgagagctggtcgattccgctgtcggtcatgctcgtcgtgccgctgggactcatcggcgcgctggcggccgtgatgtctcgcgggttgatgaacgacatcttcttcaaggtgggcctcatcaccatcatcggcctgtccgcgaagaacgcgattctcatcgtcgagttcgcgaagcagctcgaggagcagggacgctcaccgctccaggccgcggtggaggcggcgcggctgcgtttccgtcccatcctgatgacgtcactcgccttcgccctcggcgtggtgccgctggtggtggccaacggcgcgagcgccg

SEQ ID NO: 6992 - DNA, 567 bp, Myxococcus xanthus
atgtcggtgaacatccagctcgagtggaccccgaaccccagcacgctgaagtacgtggtggaccggcggttgttggcgggcggggcggtgaacttcacgaaccccgaggacgcccaggcgaagtccccgttggcgcgcaagctgatggacgtgcgcggcgtcacggcggtgatgattggcaccaacttcgtgacggtgacgaagggggaagagggcgagtgggacgagctcaatgacgaggtcatgtccgcgctggacacccacctgacggccaacgagccggtggtggacgaggcggcgctggcggcggcccgcgaggcggcgggaccgtccggtggtggcacggttgaagggcgcatccaggacatcctggacaacgaaatccgcccggcggtggccatggacggtggtgacatcaccctggaccgcttcgaggacggcatcgtctacctgcacatgaagggggcgtgcgcgggatgcccgtcgtccacggcgacgctgaagatgggaatcgaggggcgcctgcgggaaatgattcccgaggtcctcgaggtggtgtccgtctga

SEQ ID NO: 6993 - DNA, 870 bp, Myxococcus xanthus
cagtcccccgcgctgctgcgcgagctgcatctgctcacgcgcgaggggcacctcaacgcggacgcgctgcgcaagctcaagcaggtgaaccacctgatgggcttgctgcgtcccgccgtggaggatgtccaggcgcgccacccgaacgcggtgatggtggacgcgggcagcggcaacgcctacctgggcttcgtcctctacgagctgttcctcaagggctccgccagcggcacgctgctgtccattgaaggccggccggacctgacggagcgggcccagggccgcgcccaacggctgggcttcacgcggatgcagttccagacggcgcacatcgacacggcgcagtacccagagcgcatccacctgctgatggcgctgcacgcgtgtgacacggccaccgatgatgcactcgtcgcggccatccgccatggcgcggaccacgtcgcggtggtgccgtgctgccaggcggaggtggccgcgcagctcaaggagaagcgccccgtcgtggccagcagcggcagcatgtcactgctgtacgcgcatgcctggcaccggcgcgagttcggctcgcacctgacgaacgtcatccgcgcgctgacgctggaggctttcggctaccaggtgacggtgacggagctgacgggctgggagcactcgctgaagaacgagctgattctggggcgccgcgtacaccgggagaaccggcgcgcgcgcatgcaactggagcggctgttggcggagaccggggtgaatcccaagctgacgcgtgagctgggcgtgaagccggcggtgtcggccgcggtggagactgtctccgcgccggagccggatgtctccgaagaggcctccgagcacgtcgtcgcgcgctga

SEQ ID NO: 6994 - DNA, 510 bp, Myxococcus xanthus
atgtccccgccaccgccccgcgtgcccgccagcgtgttcgaggggttcttcgtgcggggtctccaggcggagggccggctggcccaggaactggaggcgctggggtacgacagccgaaagccggagttggactaccccattgcgctctggcagcgggcggtggccctggcacggcgggagcgatacgcggagctcggtgacgaggacgcctaccggcaactgggccgccagggcgtcttcggcttcgcgcagacgctggtaggccgcgtggccgcggtggccctgcccatgattgggcctgcgcaggccctggagcgggtgcctcgctacctggcgatgatgggccgctcggacgtggacgtctcgatgtcctccgaaggcgagcgcggccgccgcctctccctgtcggaccgctacaaccggcccgagctgatggcggggggcctggaaggaatgttggagatggccaacgcccggcctcgaatctccgtggaggagcgcagcagcggg

SEQ ID NO: 6995 - DNA, 492 bp, Myxococcus xanthus
gacgcgccgtcgcgcgcggccatgaagctggaggaggccctggacggactggccttcgagcctgggcgcggcgatgtgtgcgtggacctgggcgcggcgccgggcggctggacgcagcggttggtgagccgcggcgcgaaggtggtggcggtggacccggcccggctgatgccggagctgaccgggaacccgcgcgtgaagcacgtccaggagagcgccttcgcctatgcgcccgacgagccggcggactggctcttctgcgacatggcgtggcgccccctggaagtggcgcagttgctggccaaatggggccgccgcggttgggcgcagcacctggtggccaacatcaagctgcccatgaaggacaagaaccccatcctgctgcgggtgcgccacacgctcggccaggagggcggctgggaggggctcaccgtccgccagctctaccatgaccgggatgaggtcaccgtcaccgcgcacaagatgaagtga

SEQ ID NO: 6996 - DNA, 705 bp, Myxococcus xanthus
atgccctacccactcgacgacgccacggccaccgccctcatcgccctccatccctgggtgctcacccgcagcccccaggccccggtgcaggccgccgtggaggtgctcgtccaggcggagcaggcccggcgtggccagccggacgcgaaaacgggcgcactccaggtgcctgcactcacccagggcaacctcctcaaggaggagtacgacttgtccacccacggccatcatgacgggtggcgcgtgggcgccgtcatcgcggacgtgcaggggatgatcaacgtcaacgcccgcttcggcttccccaccggggacgcggtgctgcgcgccaccgtggagtccctctccgctcagtaccccggcgcgaaggtggtgcgcatccacgcggacgctttcgccgccctgctcgtgccgacgtcgcagctcacggtggaggagcacctcgccgcgccgacgcgcgaacggttggcgcagggcgtgcgccctgtgctgcccccgggaacgcccgacgcggacgtgccctcatggacggtgagcctgctggagttgacggtggacgcgccctcgcactggcaggtgctggggccgctgctgtgggcggagctggagcgcacccacgtcatggagcgcaccggccgcgcgcaggggcttcagcgcaggcgcatccggctggatggctccattcccggcccagcgacgctctga

SEQ ID NO: 6997 - DNA, 1491 bp, Myxococcus xanthus
atgatcgaatggacgctgaagaaactgattgggaccaagaacgagcgcgagctcaagaaggcccacgcgaaggtcgcccgagtcaatgagctggaaacccgcatgcgggccctcaaggacgaggacttcgtctccgagacgaaccgcatgcggcaggagatccagaacggccgttcgctggatgacctgctcttcgaggcctttgccatcacccgcgaggcggcgcgccgcgtcattggccagcgtcactatgacgtgcagctcattggcggcatgttcctccacgagggctgcatcgcggagatgcgcaccggtgaaggcaagacgctgacggcgacgctgcccacctacctcaacgcgctgtccggccggggcgtgcacgtcgtcacggtgaacgactacctggcccgccgcgacgcggagtggatggggcgtgtctaccgcttcctgggcatgacgacgggctgcgtgctgcacgagctgaacgacaagcagcggcaggaggcgtaccgctcggacatcacctacgggcagaacaacgagttcggcttcgactacctgcgcgacaacatgaagttccgcctgcaggactacgtccagcgcgagctgaacttcgccatcgtcgacgaggtggactccatcctcatcgacgaggcccgcacgccgctcatcatctccggtcccaccgaggacagcaccgacaagtactaccgggtggaccaggtcatccccgggctggtgcctgaccaggactacaccctggacgagaagcaccgctccgtgtcgctcacggatgacggcatcgagaagctccagaagcggctgggtgtgggcaacctgtacgacccgggcgaaatcgagatgctgcaccacgtggaccaggccctgcgcgcgcacacgctctacaagcgcgacaaggactacgtggtgaaggacggcgaggtcgtcatcgtcgacgagttccccgtccgccagataccgggacgccgctggtcggacggccttcaccaggccatcgaggccaaggaaggcgtgaagatcgagaacgagaaccagacgctcgcgacggtctccttccagaactacttccgcatgtactccaagctgaccggcatgacgggcacggcggacacggaggcggaggagttcgccaagatctacaacctcgacgtgcgagtcatccccaccaaccgtccgcccatccgcaaggacctgcaggacgtggtgtacaagacggagcgtgagaagttcgaggcggtggcggcggagatcgaggagctgcacaagaacgggcagccggtgctcgtgggcacggtgtccatcgccaagagcgaggtggtggccagcttcctcaagaagcgcggcatcccgcacaacgtcctcaacgccaagcagcaccagcgcgaggcggacatcgtcgcgcaggccggccgcaagggcgccgtcaccatctccaccaacatggccggccgcggaacggacatcctttag

SEQ ID NO: 6998 - DNA, 132 bp, Myxococcus xanthus
atggacctcgaattccctcggatgaagggggacttctcggccatgaagaagtaccgcttctcgcgcgatgaggcccggttcgccgcgcccaaggacggcaggcgcctgacgcacgcgatggatgcgccctga

SEQ ID NO: 6999 - DNA, 369 bp, Myxococcus xanthus
cgcggctgggtgacgagtgatttcggttcgcgcctggacccgtacaccgcggaccgcgtcatgcacggcggcatggacatcgcggcgccgcacggcaaggaagtcttcgcgccgtcggacggcacagtggtgttcgcgggcctggagggcggctacggcaacgtgctcgtcatcgaccatggctacggcatcaagacgcgctacggccacctgtcgaagatgctggtgaaggccggcgacaaggtgaagcgcggcatgcacatcgccgccgtcggcaacaccggccgctccacgggtccgcacctccactacgaggtccgcgtcaacggcatcgggcagaatccccgcaagttcatcctcgaggagtag

SEQ ID NO: 7000 - DNA, 1215 bp, Myxococcus xanthus
tcccgggaagccatccttccgcgtcaagttcagccaggaggcgacgggcaaggcgtctgcctccgaagtgcttgccgcgcacctgctgcaacgggagtccgggcggatcgcggccttcgagaagaaggcctggccccacctggagaagaagtacaccgcgcgcgccgccgaggccatggcggcgctgcgcaaggcgtgtggcacgtcaccgaccttcacgttcgactggaagaccttcgacgatgcggtgatggcggagctggacgtctgggcggcgtgtgcgccgctcgcgacgcgggcccgggctcgctgtgtcgccgtgaaggatgtcacggtcctcacctgtcgcttcgggcctgcgctcgcgttcgagcggggtgccgacgcgctcatcttcaccaccactcaagggggcgcggccgaggggcccgcgttcctggacgcgaggctcaagtgatgcgtcgactgcccatggtgctggcgtacctcctggcggcgccggtgctggctcgcccggccgcgacgctcgaagacctccgggcgctggccgtgcagaagtcctgggcggagctgctggagcgcgcggaggaggttcctcccgccacgcgctccgacacatggcgtgcgctcgtgacggaagcggcgacggccgaagtcgaatcggccacggctgcggacgacaaggacccgttcgccaccgcccggaaggcgcgcgctctggggcagcggtatgccttcctcgccaaggcacccggcttctcctcggcgcgcgatgcgcgaggattgaaggacctggagcgttgcctcgaactcgagcggagtggctgcatcgacacgtaccgggagctgacggtggacgcgagcgctgagacgacgctccaggccgcgcggctcgtgaagaggggccacttcgcctacgtcgcgatgccgctcttcgcctcggcggtgcggggcgggaaggaggctggcgcctgcaaggacgaggcgctcgcggaggcagtgctggccgcactggacctgcccgcgacggatgcccgcgcgggtgatgcgaggaaggtggcgttcgagtggtgctggtcggcgctcggcgcgagactcaagagtgcgacggtgggcgcctcgtcctacttcctggccaacacctgccagcccatgcgggcgcggaaggcgctgacggagctgcagaacgacctctgcaaggacgaggggttgtaa

SEQ ID NO: 7001 - DNA, 3111 bp, Myxococcus xanthus
acgagctccaacttcaacaacgcctacgtggtcccggactacgccagcacgccgcagcagatggtgatgccttcccacctgacgctggagctgttccacctgttcaacctgggcgaggtggacgtcggcgacgtggcctgccacgaggccgtccactacgtgcagctccagcagacggacggggtctggggtttcctcaacctcgtcaccgggggcctgttccagcccaactcctatacggagtcgtggttcctggaaggactggccacctactacgaagggcagttcgaaaaggacgcgggacggccccacagccccatctggcgcggctggtacgactccgtggtgcaggccaccggaggacggctgaaccccggctacctgtcccccgagcagcgcgcgctggacccgttcggcggcaactacatcaccggcatgcacttcgtggagtacctcgcgaaccgctacggggagtcgaagctgtggaagctggtggatgaacagggcggctccctggtgccgccgctggcggtgaccctgcgcttcaagcgcgtgtacgggcgggacatcggctcgctgttcgcggagtacacgcagtcgctgcgagagaacctgcaggtgcgcgagcggccctcggcgcagcgaacgtgggtgcccgacgcgggatacttctcccgattggcctcgcacgcggccagccgggtcaccgcgacggtgggcgtgggccgggagcgctacacgcggttgacggtgctggagccggatggccgcgtgcgtttcgaacggccgctggtggagctgctgcccgggcgccgctgggtgctgggctccccgacgctggtcagcggcatgtcgttcagccgcgatggcgcgtggctgtacctggtgatggccgacctgaacacggaagggggctacacggcgaagctgtggaaggtggatgcgcgcacgggtgacgtcgttcggctctgggacgacgtgatggggatgggtggcagcatcacgccggatgggacggcctacgtctacgtccgcgtcgatggggattcggccaacgtggtgcggctggatttggagacggacacccggaaggccctcaccgacttcggcgccagcacctccgtggggccgcccgcggtcgctccggatggcgagcgggtcgtcttccccctctcaggggacgcgggttgggacctggtcctgcgggaagcggatggacgccttcggtggctgacgcgcgatggccgcttcaactactcgcccaggtggatggatgatgaacgcctcgtgttcctccgggaacatgaggggcgactccaggcccacgtcctcacggtggcgacgcgggaagtggttcgcatcacggacgcgccgcacctggtgatggacgttcatcccgtggggaccgaggaagtggtgttcctcaaccgggacggtctgaacttcaccatcgaccgcgccccactggtgcccattgcgccgacggaggctgacgctggcacggcgcgcgtggaggtggcagggcacgcggtgctggcgcaggcgccccacccttcggctccgtctcccgagaccgaacccggagcgccccggctccccgaagtgcgcacggagactccagcatcggaatcggagcagacgcccacggccgcaccttccgagtccgagttcgccgcgttccccatgcccggcgctccggtccagcccgatgcggcgcaaccgccctcaccgtcagagaccgcgccgggccatggagcaccgctatccggacagccgtccaccagcgatgaggcgtcacctccgccaggggccgcgccggaccacggagcgccgccctccgaggagtcgcccgccaataccgccgagggcgcagtacctccaccgctggcccctcagtcggagcagcctgctaccgaggacaccgcaccgccgtccccatctcccgcggccgaagacgcgcccacggcgctcacggctctcgacggtcctgtcgaagccccgcctgacccgggcatggagctccagattctctcggacgagccctactcgccgctggagcgcttgttcatccccgagctccgcgtgccctacctgctcgcgggagccgaccccgacaacacggacgacacgtacacgatgggcgggttggccctggcgggacaggaccggctcggcttccacgcgtactcgctgctgctctccttcgacacgcgagaagacgcccccagcctctcgctggcctacggcaacgcgcaactcgcgccctggtacatccaggtgtcgggcgcgtacatccgccagaatcagcgcacagatctccaggccacggccttcgcctcgcgctcgttctggacgacgccggtgaccttcggcgtgctggcgctgcgccgcgagtacgacgccacggaccgcttcccgcgcatgctgacgcgcatcgtcggcccggaggtctccgtgtcgtacttcgcgggtgacgccacgtcctacggcagcacccagcgcggcctgggcatgacagcggtcgcgggtgtgtaccccggcgcattcctccgggactccaccatgggcgatgtgcgcctgggactcgacgccttcacggggggccttcccttcacggggcgcgacaacctccgcctcaccgcagtggggcgcttcctccccggcgcgccgtccgggctgctccaggtcggcggcctgagagcggggcaaatctggtacaccaaccgcgagagccagcagaccgccccgctgcccctgcagttgcagccgggcatcgccttcagtgagtacctgcgcggctacgaggacctggagattcgcgcgcgcgacgcgctcatcggctccgcgacgtaccagtaccgggtccccatcgactacggatgggcctccacgctgtggctcttcccgtccctcttcgtgcgcgacgtcggcgtcgaggccttcggctcgctggcccgcaccgacaaccgcgccaaccacgcggccgtgggggcctcggcgtcactgcacctcaccttcgggcaggcgattccggtgtccctctattaccaatatgcctaccgcttcgagcggggcctggaccacctgcacctcgtcggcttcggactctga

SEQ ID NO: 7002 - DNA, 78 bp, Myxococcus xanthus
atgtgggacgcgccggtggatgcgcagggccagcaccggtacgcgcaccgccgctccgaggtccgagaggggctttag

SEQ ID NO: 7003 - DNA, 2580 bp, Myxococcus xanthus
atgcactcgactctgttcggtgagccgcggctgggcgcggcgaaggcggttgccggtcgccgcgccctgcgcgccggcctgcctctttccatcatgctgtgcgtgctgtccctcgccgtcccttcgagcgcggcagcgcaggaggccgcggaggcggaggctcccgccaaggtgaaacgccggaagcgggtggtgaagcccgcggcccccgcgcgtcccgccgcgaagacggcgaagaagccgaagaagcccgtgaagccgcccatcgaggacgcggatgagccggagattcccgtcctgggtggcgggcctgccacggatgatccgtcgcccgcgagcgcgccggcacccgtgcccacgccgccctccgccgcgcccctgacgccggccacgcccctgacggccgagcctgcctcaccgcaggcgctgccgccggtcggcgcggacttcaacccgccggacgcgccgacgcatctctcgccggccaccgcgacgctgcccgcgcaccagcccgcgccctcgtcgaacattcccatcagcgcgcccttcgcggagccgaccctggatcgccccttgccgccgcagtccgggctcgcgggcctggggacggacccgctggacggcgccgacgcgctggaggagtccgtcaaccgcgtgctgagcgaggcggtggtgaccaccgccggcaagcgcaaccagcgcatctccgacgtgcccctcacggtgtcctggattccggccgacgagttggaaggcactggccagttcacgctgtgcgaggccatccagtacttccccggcatggagtgccgccggggctccatgcgcaaggcggcggtgagcgcgcgcggcctgggctccaactacctgtccaaccgcctgttgctgctccaggacggccgtccgctgacggacccgtggacgggccagttctacggggacgaaaccacgccgctcaccaacctcaagcaggtggaggtcatccgcggcccgggttcctcgctgtacggctccaacgccttcagcggcgtcatcaacgtcatccagcgccagccgtcggacctcatcgagaagggcaagaacgtgggcgccgaggcccgggtgctggcgggccaggaccagacgtggcgtctgcatggcaccgtggcgggccgtggtggtccggtggaggcgctgctgggctactacggcttcggctcggacggcccgcagctcttcaacgacccgcgcgtgggccgggtggacaccaaccaggactcactggttcaccaggtcaacggcaaggtgcgcatcgggcccctggcgctggacgcggacttcacggacgcggagattggccgcccgggtggcacgcacatctccaccgtgggcaactgcggccgctgccactacacgccgaacgactccgagtcggtgcagaacttcaacgcgtccgcgcaggtggaccagcaagtcaccgataacctgcgcctcttcggccaggcgtacggcctcttcaagcgccgcgacgtgttgatggagaacgccttcggcggcgaccccacccgtgcgctgggcaagcggcgccggctgggcggcgaggcgcgcgcgctgtggacgatgggcgacctcaacgtcaccttcggtggtgacttgaaggcggacgccgtcaacgtgcccaacgtcctgcccgagctgagcatggacgacacgcggcagaccatcctgggcggcttcgtggacgcggagtaccgcctcttcaaccggctggtgttcggcgcgggtgcccgttacgaccgctaccagattccggagcgggtctggcagaaccgcacggaccaggtttcgccgcgcgccagcgtcgtgttccacgcggtgccggagttgctgacgttgcgcaccaactacggccgcgccttccgtgcgcccacgttggcggagctggccatcaaccagcagatgtacgcggccacactggtgggcaactccaaccttcgcgcggagacgctggacaccatcgaggcatcggtggatttctggcctttcgatcggagggtgcgcctgacgggtacgggcttctacaatctggcgaagaacttcatcaaccagcagctcgtcttcggctctgtgtcgcagttccagaacctgggcgacgcgcgggtggcgggcttcgagctggaagcggccgcgcagattccgtccatcaactcgtccttcgacatcgcgtaccagttcctcgacgccaaggcgctgccgtacgacgacggccctcagtcaccgctggactacgcgccggcccatcgcatctacgcgcgtggccggaccaacatcggcaaggtcgccttcgtggagctgtacgcgctgctggtgggctcacgttatgacccgggcttcgaggtggacgagacgacgggcctgcccaccacccgcgtgcagctgcccagctacgtcacggccagcgcgcgtgtgggcttcaacgtctacgacggcatctccgtgtcgttcctcggctccaacctcttcaacgcgaagtacgaggagtcccacggcttcccagcaccgccccagtcgttcttcagcgaagtcaaggttcgatactag

SEQ ID NO: 7004 - DNA, 747 bp, Myxococcus xanthus
gtgctctacagaccgcccgtggccgccaagagcttcggccgctacgaggacttctcccgcgcggtggcgggcgggatggtggacttcgcggtggtggatgcgtgggccgcggtgcagttgggcgcgaaggcgaagccggtggcctgggcctcacgcgcgggtgacacgcagcagcgttgggccattgtcgcgttgcagcgcggcgtggtgaaggacctcgccggcaagcgcctggcgcacgtgaagggcgcgggcccggcggacccgaagttcgtcacccacgtcgtgctcggtggcgacctggacgcccagaagcacttcaagctggcccccgtgccgaacgtggagtccgcgctgaagatgctggaggccaagggcgcggaggcggcgctcgtcccgctggcgcacgtgcccaagggcaaggatgtgcgcgtgctcttccgcagtggccgggtgccgggtgccgtgctggtggacctgcgcaaccacgaggccgcgctcaccggcgcgctggggaaggtgggcgcggtggcgcccttcgatgccttcgcgcggctccaggacaaggacttcgacgagttcagcaagctcgtcacgcgtggcccgccgcggcgtcagccggtgctggcggaaggggccgagcttcacgtggaggccgaggtgctggtgcgctcggaggagctgggccccgcgcttccgtccttcgttggagacctcgccgtctccgcggaacagccggacgactga

SEQ ID NO: 7005 - DNA, 837 bp, Myxococcus xanthus
gtccctttcacccccgccaccgggcgccgcgtgctggtggccccgggcgaggaccgcgccgcgcccgaggcggagctgtacgccgccgcccaggagttcgcccgggccgagcgcctgtccggcatccacgtcctcttccccaccgaggaggaactgcccgccctggtggcccagggcttcgccgtgcggctgggcgtgcagtaccactggcgcaaccagggctaccggacgctggaggacttcctcgcccgcttccacgccaagcgccgcaaccagctgcgccgggagctgcgggccccgaccgagcacggcatcgaggtccgcaccctgcgcggggacgcgctggcggacgcggacgcggacaccgtctacggcctgtacgccaccacggtggacaagtatccgtggggccagcgcttcctcaccccggaattcttcgctcgcatgctcgcccgcttccggcaccgctgcgagtgggtggaggcccgccgggaaggccgactggtggccggtgcgttcaacttcaccggtgccaacgttctctatggccgttactggggctgcttcgaggagcaccccttccttcacttcaacgtctgcctgtaccaccccatctcggagggcatcacctccggactggagcgcttcgagccgggcgcgggtggagagcacaagctcacccggggattcgagccgcgcctcacgtacagtgcgcacctgctcctccacccgggcatggacagggccgtgcgcggcttcctggcccacgagcgggcagccgtcgaaggaagcctgccccagtggcgggcggagactggtttcaaggagggggactga

SEQ ID NO: 7006 - DNA, 240 bp, Myxococcus xanthus
atgtccatcagccacctgcgcttcttcagcctggagcacccactgctgatgctcctggccctcacggccgcgcacgccacctccgcgatgacgcggcgggaggcgcccgcccaatccaagcaccgcacctgggcggtggggctcctgctggccatgctgttcgtcgcactggccattccctggcccggcttgccccacggacggccctgctccgggacttctagccagacaaaccgttag

SEQ ID NO: 7007 - DNA, 324 bp, Myxococcus xanthus
atggcgcagaagcatgagcacgacacctccgtcatcacggagtccgcccccaagcagaagctcaagaaaccgccgctctacaaggtgctcctgcacaacgacaactacacgacccgggagttcgtcgtggccgtgctcaaggaggtcttccacaagtcggagacggatgccgtgcagatcatgctgcacgttcattacaacggtgtcggggtagccggcgtctatacgtacgacgtcgccgaaacgaagattcagacggtggaggccgcggcgcaggagaacgacatgccgctgcgactctccatggaacccgaggaaggttga

SEQ ID NO: 7008 - DNA, 2286 bp, Myxococcus xanthus
ctgattgccaaagagttgcaggccagcttccgcaccgccctggacgaggcgcggaagatgcgccacgagtacctgacgctggaacacctgctcctggcgctcaccacggacgcgcgcacgcgcgaagtcctcaaggggtgcggcgccaacgtgaagcaactccaggagcgcctggtctccttgatgcaggagacctttgaacgcctgacacaaggggtggaccccgagccgcagcagaccatcggcgtggagcgggtgctccaccgcgccgccatgcacgcgctgtccgccgagcagaagctcatcgacggtggggacgtgctggtggccctcttccgcgaggacgagagccacgcgctctacctgctccagcaggagggcgtcacccggttggatttgctcaactacatctcccacggcgtcaccaaggacggcgagggtgaaggtgagggcgaggagagcgccggccacgccacccccgcgggcgacgacgacgagggcgagtccccgaagaagagcccactcgaggcctacacggtgcagctcaacatcgaggccaaggaggggcgcatcgacccgctcatcggccgcgagaaggagctggagcgcaccatccaggtgctctgccgccgccggaagaacaacccgctctatgtgggtgaggcgggcgtgggcaagacggccatcgccgaagggctggcgctgcacatccacgaaggccgcgtgccggaggtcctgaaggacgccatcgtctactcgctggacatgggcgcgctgctcgcgggcaccaagttccgcggccagttcgaggagcggctcaagggcgtgctcaaggccctgaaggagcagcagaacgccatcctcttcatcgacgaaatccacaccatcgtcggcgcgggcgccaccagtggcggctccatggacgcgtccaacctgctcaagcccgcgctggccagcgggcggctgcgctgcatcggctcgacgacgtaccaggagtacaagtccgccttcgagcgggaccgggccctgtcacgccgcttccagaagattgaggtgggtgagccctccgtcgaggacaccatcctcatcctggaggggctgaagagccgctacgaggagcaccacggggtgaagtaccaacccgaggccatccgcgcggcggcggagctgtccgccaaacacatcaacgaccggttcctgccggacaaggccatcgacgtcatcgacgagacgggctcggccgagcggctcaagccggagggccagcgctccaacaccgtcagcggcgcggacgtggaggccgtcgtcgcgaagatggcgcgcatccccgccaagagcgtgtccgccagcgagggcgtgcagctccagaatctggagaaggagctccaaggcgtcatctacggacaggactcggccatcaaggacctggtcagcgccatcatgctggcgcgctccggactgcgcgcgccggagaagcccattggttcgttcctcttctccggccccacgggcgtgggcaagacggagctggccaagcaactggcgcagtcgctgggcgtggagttcctgcgctacgacatgagcgagtactcggagaagcacacggtgagccggctcatcggcgcgccgccgggctacgtcggcttcgaccagggcggcctgctcacggacgccgtgcgcaagcacccctactcggtggtggtgctggatgaaatcgagaaggcccacccggacctcttcaacatcctgctccaggtcatggaccacgcgacgctgacggacaacaacggccgcaaggccgacttccgcaacatcgtcctcatcctcaccaccaacgcgggcgcccaggagatgagcaccaaggccattggcttcggggacctcgcgaagccggtggacgccacccgcgcgaagaaggcgattgagcgcaccttcacgccggaattccgcaaccgcctggacgggtggattctcttctccggcctcccgcccgaggtcatcctcaaggtcgtggacaaggaagtgcgcctgctccagaagatgctggacgagaagaaggtgaagctggcgctgacgcccgccgcccgcgcgtggctggccgagcacggctatgacccggccttcggcgcgcggcccatggcccggctggtggacaactcgctgaagaagccgctcgcccaggcgctcctcttcggggacctgaagaatggcggcaccgcccactacgacgtggcggacgacagcctcaagctgcgcacggagcccgccaccgccgaggtggcatag

SEQ ID NO: 7009 - DNA, 1563 bp, Myxococcus xanthus
ttgtcgcagcagttccgccagtcgctggggctggcgccgaagttcgtgctcgtcaccgcgctcatcagcgcgacggcggccaccctgctcaccggtgtcgccacgcggcggctggagagcgacctggcggacagctacctgggcgcggggcggcacgttgcccgcgggctggcggtggcggcggagcagggggtggcggcgggggcgagcgcgctccagcccatgctggacgccagcgtgggccattcggacctggcttatgcattcattcaagactcggccggcaacgtggtggcccacaccttcccggacggcttcccggacgcgctgaaggaggcggtcgccaccgcgggcgcgggctcggtgctggaagcggacgccgggggcgtccgcctgcgcgccatggacgtggtggcgccggtggccggtggccgcctgggctcggtgcacgtgggcgtgtcccgggaccacatcgacgaactggtgtccgcgctgcgcgtccggatggtgggcttcgcggcgctgctggtggccctgggcgtggcggtgtccgcgctgttcggccgcagcatcgtcggcccgttgaagagtctgacggaggtggccggccacatcgtggagtccggcgatttgacgcgccccatccaggtgaagagcggtgatgaggtgggccggctggccagctccttctcgcagatggtggatcggctgcgcgaggtgacgctcaacctccagcaggcggcagtggcactcacccagtccaccgagcacctgaattcgtcgtccacggagcaggcgcagaccatctcccggcaggccgcggcgctgcaggagacgcaggtgacggcgcaggaaatcaagcagacctccatgctggccgcgcagaaggcggagagcgtgctgtcggtggccgagcgcgccgacacgctggccaagtccggcgaggcctccatcgagctcaccatggcggggctcaacgacatccgcgtccaggtgggggagattgcccagaaaatcgtcgagctgggcgagcgcacgcagcagattggtggcatcacccagacggtgaaggacctggcggaccagtccaacatgctggcgctcaacgccgccatcgagtccgtccgctccggcgagcacggcaagggcttcggcgtggtggcgcgcgaaatccgcgccctggcggaccagtccatcgaagccaccacgcgcgtgcgcgagctgctggacgacatcgccaaccaggtgacgttggcggtgcgaatcacggagcgcggcgccgagcgcatggagtcgggcctggcccaggtgcgcaccagcgggcagaacctgcgcgagctgtcctccatcgtccaggacaacgccgccgccgtccggcagattgccgccgccgtcagccagcagaacgtgggcatcaaccaaatcaccctggcggtgaatgacttgtccaagatgatggacgagacggtggctcgcatcggctccaccggcgaggccgccaccacgctgcaaatcatctccgagcagctctccagcgcggtgaagagctaccgcgtcgagtag

SEQ ID NO: 7010 - DNA, 1173 bp, Myxococcus xanthus
aacgcgttcaacccgcaggcggcgcggctcatcatcgacagcctccgctactgggtgacggagatgcacgtggacgggttccgcttcgacctcgccacggtgctgggccgcacgggtgaaggcgcgttcgaccgcgacgcggcgctgttccagattctccaccaggacccggtgctcggccgcgtgaaactcatcgccgagccctgggacgtgggcctcggcggctaccaggtgggcggattccctccgccctggcgcgagtggaacggcaagtaccgggacgcgctgcgccgctactggaagggcgatgagaacctcgccagtgagatgggctaccgaatcacgggcaacgcggacctgtacgcggaggcgcgccggcggccccaggcgagcatcaacttcgtcaccgcgcatgacggcttcacgctgcacgacctggtgacgtacagccacaagcacaacgaggccaacggcgagcacaaccgtgacggcgcggacgacaaccagtcgtggaactgcggcgtggagggtgagacggacaaagcggacgtcatcgccctgcgcgagcggcagaagcgcaacctgctggcctcgctcttcctgtccaccggcatcccgatgattgtcgcgggtgacgagatgggccgcacgcagggcggcaacaacaacgcgtactgccaggacaacgagctgtcgtgggtggattggaacctggatgagcggcggcggaagctgctggcgttcacgcgcaagctcatccacttccgccaccgccagccggtgctccagcgccgccgcttcttcaagggtcagcacctgtgggactccgagcacaaggacctgacgtggttccggccggatggcccggagatgaaggcggaggactgggagaagcccttcgtgcgctcgctggcattcctcctgggcggcgacgccatccccacgccggacgagcgcgggcagcgcatcatcggtgacgcgctgctgatactgctcaactcgcaccatgagccggtgacgtacaagctgccgcctgccgcgcagagccagcgatgggagctggagctctgcaccaccgacgacaaccggggaccggagccggtgaaaggtgagacgttcgagctcatcggccgctcgctcgcggtgttccggcaggtcgcggactgaggcaga

SEQ ID NO: 7011 - DNA, 753 bp, Myxococcus xanthus
atgctagggttccccgccgaggccttccccggcgggtgcggcatgccggtgcctaagcgaagcaggtccgccgccagggcgctcgcacgagccggaggaaccgtgtcgcgggatgcacaggaagagggcgtgaagcaggtgtacggggagattgcctcggcctacgaggtgctcttccccgccctgcaccggtacgaggaacgggtggagcggttcctcgcggcggtggtggcgcccggcgcccgcgtgctcgacgtggggtgtgggccggggcttcacacccgcggactggacgcctccatcgccgtggttggcaccgacctctccgaggacatgctcgcgctggctcggacagcgcggccgggtggcgcgtggcatgtacacagctaccaccagccgattcctcccgactggggccgcttcaccgtcgcactcgccattggctgtctggacttctgcgacgacctgcctcgcgtgctgaagcacctcgcggaggcgctggagccgggcggcaagctgctcttcaccgtgctggagcgacggccggggttggacgggcacgaggcgcccgtgcagccgattcaaacggcggggccggcggtgacgctgcacctgtactcattcgaggagaccgcccgggccgtcgcggaagcagggctgctcccacgcacgtacgcgcatgcacccggctgggttcagctcacggagcagcggaccatgtggttcgggtggtgggaggtggagcggcgctga

SEQ ID NO: 7012 - DNA, 1029 bp, Myxococcus xanthus
atgacgcggccctgcccccgggacagggactggtcgattggggtgaggggaatgccacctggcgctaccggttcgacggcaagggctggctcaccacctcccatctctccgaggcgcactgattcggtacaaccggggcacaccgcgccaggccccaggcccgcctcggtgtgccgcgcgaatccctccactccgacgcggcatcgccgctgccgaggcctcttgacgatgacgttgtttcctcttcgttggttttgtgccggtgctcttctcatcaccctgagcaccgcctgcacccgctccacgccggccgcgacggtggagcggaacatccccgtgaaggcgcagtcccagggtccggacgaatacgtgctggcggatgacgtgagcgtgcggaagctcgcgcctggcgtgtggctgcacatcacggtggtgacgttggagccattcggccgcgtctccaccaacgggctcatcatcgaggacggtgaaacgtccttgctggtcgacacgggctgggatgcacggcagggcgcgctactgctcgactgggcccgggacacgcttcggcgtccggtccgcgcggcggtggtgacgcacttccatgaagatcgcctcggtggtgttccggcgctcgccccgcatggcatccccgtccatggcttggaggagacggcacggattgccacgtccctgggcctgccaggccccacggagaccttcgccaagacgagcacggtggactccctggagctcttcttcccgggggcgggccacgcgaaggacaacatcgtcgtgtggcaccgggacagcggcgtgctgttcggcggctgcttcgtgaaggacggcgcctcgacgaacctgggcaacgtggcggacgcggacgtagcggcctggcccgcgagcctgtcgcggacgcggcagcggtttccggaggcgcgcgtggtggtcccgggtcacggacagcccggtgggccggagctgctgggccacacggaagcgctgctccgctgagcgacctcgcggagc

SEQ ID NO: 7013 - DNA, 255 bp, Myxococcus xanthus
atggagcagcgggacggttgctgggtgaagcagacccgggcctttccctccacgctcaaggaggaagtggggccgtgcgctcggcccgtgcccatctggtccgaggaccggctcacgcggctggtgcaggagtgcgtgatgcacacggactaccggtggcaaagcagagcgttggtggcgtggaaccgaaacgaacccctgccggatcgggaatccgaggagaaagtactcgcggactgcatgtcccgggcggag

SEQ ID NO: 7014 - DNA, 166 bp, Myxococcus xanthus
  unsure (1)..(166): unsure at all n locations
atgctcttcttcgccgtcaacgccctctgggcgctggcgcagaccgncgtggccagcaccctgggggcacgacccgtgtccgtcgtcctcggctacgggcccaccctgctcttncgccgcctggggagcatnctgtgggccttccgccccctggcgcttcgcagcg

SEQ ID NO: 7015 - DNA, 1002 bp, Myxococcus xanthus
ctgaagaatcgcactgcgtacgctgcggagcgaaactggacgcgtgacaaggagggggttcactggtggctcgtcgcggtcaaagcgacttttgacatcgcgcccggggggagactccaactggcggacgaacagcctcctcctgtgctgataccggaatacttcggagcgcctggtcagtcgagcttgcgctatgattcggacctgctggcggtgaaaccgggcacggaggtgctgctcgatggttgcgcgcacgcgcctcgcggtaagcccgcagagacggtgccggtctcgctgcggctcggaccgctccacaaggtcctgctcgtgcacgggccacgcacctactctcgggggatgctcgggatggcagtgagccggccccagccgttcaccacgagccccattcgctatgaagccgcgttcgggggctatgacacgacggactccgaccccagcaagcatcggatcgatgagcgtaatcctgtcgggcgtggcttcgcgacacgtcaggcccaactgacgggcaagcccgcccataccatcgagtatcccagtggtgagccggcgacccgaggccccgcagggttcgggcccatcgacgccgcctggatgccgcgacgcaagctcgcggggacgtacgacgcccggtgggagcgtacgaagaagcccctgcttcccgacgactacgaccccacattcgcgttgagcgccccgggggaccagcgactcgacgggccgctcaccggcggcgagcgggtcgaattgatgaacatgacgcccgaaggggtccttcgcttcgaattgccccgaatctcgcttggttttaccacgcatgtgggccggcggagcgaggagcacggcgcacgcctgaccacggttctcgtggagcctgaagccaggcgcctctcgctggtgtggcagggaacgctgtgtgtgcccgcgccggatgcggactacctcgacgagacggagattgcagaattgaaggaggcggaatga

SEQ ID NO: 7016 - DNA, 111 bp, Myxococcus xanthus
atggccgccgcactggggacgtcgttcggggatcagcctcagagcgacatcgtcgtcgcggacgtcttccagttcgggccggcgctgacgctcatcaacatcagcgggtga

SEQ ID NO: 7017 - DNA, 1047 bp, Myxococcus xanthus
atgtccccgccacgcgcgagtgcgctgctgctcaccatcgtcgtgtccgccggaggctgtaccaagacgcccaccgaggaggtccggaaggaagccaacggcagcatccagtgccagacgctccagcacctggcctgcacgggcctctacggcgagggcggcaccgggtgggcgacccgggcgattccccccgaggtgcgcccctacgagcccggcctccagctctggagcgacggcctggacaagacgcgcttcatctacctgccgcccggcacgaaggtggacacgtccaagagcgacgagtggcgcttccccgtgggcacgaagctctggaaggagttcagttggaaggggcggcccatcgagacgcgcttcctctggaagcgcccggacgggagctggctgcggaccacctaccgctggagcgacgacgggaagacggcgctcgagttgaccagcggtgagaaggacgtgcccggcacggagggctacgaaatccccagccagcaggactgccagtcctgccaccgaggtcgcggcgacgaggtgctcggcttcgaggccgtcgcgttggcccacgacggcgcgcgaggcctcacgctggcgaagctggtggaggagggacacctgagccacccgcccgcgcaggtgccccgcattcctggcacgccggtggagcaggccgccctgggctacctgcacatgaactgcggcgtgtcgtgccacagcgccaaccgcatggcgctgggcaacagctccggcctgcacctgcgcctggaagcgggcgagctcggctccgtgcaggagacggacacctggcgcacgtccgtgaatgtgaaggcgctcatccagacgtcgggcatgttcgggaagagctcgcagcgcgtcgcgccgggtgacgtccagcacagctcgctgctctaccggatgggccagcgcggggacttcatgcaaatgccacccctgggcaccctcgtggtggatgaacagggtcgggcgctcatccagcgctggattgaagcgatgcccgtgaagaagggggggtag

SEQ ID NO: 7018 - DNA, 2529 bp, Myxococcus xanthus
tggctgccgcgggagagggcggcccgcagtaccttgcgacgggccggtgtgagacacttcccgcttcccatggtcgaagactcccactccgagcgacaagtcattggcgaccgttacgtcctggagcggcggctggcgggcggtggcatgggtaccatctgggtggcgttggatcccaagctccagcgccgcgtggccctcaagctgatggcggcccactgcgcgcccgcgcccctggctcgccggcagttcgaatgggaagcgcaggcgattgcccgcctccagaacccccacgtcatccaggttcacgactgcgacctctccggtgagacgccctacatcgtcatggagtggctggtgggcgaggacctggaggccctgttgaaccgccgcggccggctgtccctggccatggtggagcggttggtggcgcagacggcccgtgcgctcaccgccgcgcacgccgcgggcgtcatccaccgcgacctcaagccggccaacctgttcctcgcgcgcacggagcatggcgaacaggtgaaggtgttggactttggtctggcgctgctgatgtcgggcggcgcggcccggccgcatcccgaggaggagatggccggcacgccccggtacatgagccccgagcagctccgagggctggagccgcggctggaccaccgctgtgacctctgggcgctggccgtggtggcgtaccgcgcgctgaccggacagcacccgttccccctggagtccttgcggcagatgcgcctgggcaacgtgccgccgcccgcgacgccttccagcctgtccccggagctgggcatggaggtggacgccttcttcgcgcgcgccctggacgtggaccccgcgcaccgcttccagtccgcgcacgagctggcctccgccctcaccagcgcggtggatgcgggccggccgtcgcgcccggcgaaaatcctggtcgtcgatgacgagccggacatcgtcgtgctgatggagcagagcttccgcaagcagatccgccgctctgtctaccagttcctcttcgccgcggacggcgaggaggcgctggaggagatgcgccagcatcccgacatcgaagtcgtcctctgcgacatcaacatgccgcgcatggatgggctgacgttcctgtcgcgcgtgggggagatcagctcgctgacccgggtggtcatcgtctccgcgtatggcgacatgaacaacatccgcacggcgatgaatcgcggcgccttcgacttcatcaccaagcccatcgacttcccggatctggaggcgacgctcgtcaagacactgaagcacgtgcgcgagctgcgccgcaccgtgcgctacacggaggagaacggcctgctgcgcatgttcgtcccgggcgcggtgctggagcgtctgccgccgttgctccagggctcggatgccatggcgggcgagtgggtggacggcacggtggtgttcatcgacgtggatgccttcacgccggtgctgcaccaggaggcgccgccggagtccctgcgccgtctcaatgccaacttcgaggccattgtcccggagttgctcgcgcgcggcggcatcgtggacaagttcatgggggacgcggtgatggccgtcttccgaggccccgggcacgtgggacctggcgctggaggcctggcacgccatccaccggcaactcggcgcgctggcgtcgcgtggcggcgagggcgcaccgtacgcgcatggcgtctgcatgggcctggattcgggcgacctggtggccggcagcgtgggggcgaaggcctccggccggctggacttcaccgtgctgggggacgtggtgaataccgcggcgcggctggcggcgagggccgggcgtgggcaggtgctggtcagcggtcgggcccaggcgcgcgcggcgtcacgcttccgcctgtcgcccgtggagacgggcctcttcgagctggcccgcgacgagggccacggctcaccgggccccgacgatgcgaccgccttcctggcgccggacgcggcggcagaaggccggggaaccacgcagggcggctgaggggccgcgcccgctgttccgtgctgcggaaggccggggtggtcgagggcgctccgctccctgcgcacgggagcggggcaggggacttcaatcaggcattgctgacgcgcaccgtggtcttcatctcgcgaccggacaccgggtcgcgggcgcgcatggtgaggatgccttccacgttcgcgtcgaaggtgatctccacgagcgcggggccggcgcggccgggctggatgccggagaaggtgaactcgcccagcatgtcgttgcgggccaccagctcgttgtcgccctggaagatgcgcacggcgagctcggtctggttgtccatgctggtggtggccagcaattgcttggcattggggatggacgcgttgcgcgggaagacggtgtggaaggcgccgcccgccttctccaggccaatggccatgggaatcacgtccaggagctggatgcgcaggttggtgtcgtcctggagcgagtgcgcgtag

SEQ ID NO: 7019 - DNA, 1521 bp, Myxococcus xanthus
atgcacaaggagcccatcatcggcatcgacctcggcacgaccaactcgtgcgcggcgatcgtcgaggacagcgggaacgtcaagctcatcccctacaagggcggcgagtacaccatcccctcgatcttcgcgatcgacgacaaggggaacgaactcatcggctacgaggccaagcgccagtggcagctcaacccgcgcaacaccgtctacggttccaagcggctggtgggccgaggcttcggcagcgaagtcgtcgacacgatgaagcaggtcgtggcgtacaacatgcgccccggcaagcagagcgacgtcatcctggacgtggggaagaaggagttcgccctccaggagatcagcgccaagatcctggggaagatccgcgaggtcgcctccaactacctgaagatgcccatcaagcgggcggtggtgacggtgccggcctacttcaacgaccggcagcgccagtcggtgaaggacgcgggcaagctcatcgacctggaagtggtgcgcatcatcaacgagcccaccgcggcggcgctggcctacggcgtgggcaaggggctgaaggagaaggtcgtcatctacgacctgggcggcggcaccttcgacgtctccatcatcgagatccgtgaccgcgtcttcgaggtgaaggccaccggcggtgacgtcttcctgggcggcatcgacttcgacaacgccatcatccaccacgtcctcaaggacttcgcggcgaagacgggcctcgacctcgccacggacccggtggcgatgcagcgcatcaaggacctggccgagcgcacgaagatcgacctgtccgcgcgcgaggaggtccccttcaacatccccttcatcacgatgacgtcccagggccagcccctgaacatcgagatgaagttcagccggaagatgctggagcagctcaccaaccagctcgtggaccgcaccctgcagatggtggcgcgcgtgctggtggactcgggactgtccaccaaggacgtcgacgaggtcatgctcgtgggcggccagacgcgcatgcccatcgtccaggaccggctcaccaagttcttcggcaagccgcccagcaagggcgtgcacccggacgaggccgtggcgattggcgccgcgctctacgcgcactcgctccaggacgacaccaacctgcgcatccagctcctggacgtgattcccatggccattggcctggagaaggcgggcggcgccttccacaccgtcttcccgcgcaacgcgtccatccccaatgccaagcaattgctggccaccaccagcatggacaaccagaccgagctcgccgtgcgcatcttccagggcgacaacgagctggtggcccgcaacgacatgctgggcgagttcaccttctccggcatccagcccggccgcgccggccccgcgctcgtggagatcaccttcgacgcgaacgtggaaggcatcctcaccatgcgcgcccgcgacccggtgtccggtcgcgagatgaagaccacggtgcgcgtcagcaatgcctga

SEQ ID NO: 7020 - DNA, 66 bp, Myxococcus xanthus
atgaaggagggcgtgaaggacaacttcgccaagtccatcgagggcggcaagaacccaaaggactga

SEQ ID NO: 7021 - DNA, 975 bp, Myxococcus xanthus
gacgccaccctgccgtatgtcgcgcccagcaaccatgggctgcgcgacgtgcgctacgtccacttcctcgcggagctgggggatgcggactgccgcacgaagctggaggccttccagcaggacgtgctgctacgccgcggggagctgctgcccttcgtggatgcgctaggtacgaagtggaacaccggcttcaccgtcgtgggcggtccggaccgcgcgctggagttctccgccgtcgaggcatccttctacttctggcagtacggcaccgcgtccgcttgcgcgagcattcccgccgccggcgcgccggcggcggagacattcgccttcctggacgatgtcgtcggcgttgccttcacctactcggaccgcttcatcgcccccttcgagtacgcctactaccaagccgcgacgcagttgggctggtcgcgctaccccgcgaatcacctgcgagggcttctgcgctacccaggggagaacacgcccgacgtgtacgtgagcttccctgtgacggagccgttcgacatgagggccatgcttcgggtggagcactgggtccgcaaccacggcaagcggatgctcttcatctacggggagaacgacccgtattccgccacggcattttccgtgcgcgaggacaacgacgcgttccgctacttcgctccggagggcaaccacggtgcgagcatcggcggccttgccgagcccgagcgggccctcgtcatggagcgcctcttcacgtggatggggatgagcgttccctccgcggcggttcgcgcgcaggcactcgagcatgcgaccgaggcggcgacttcgaagcccgctgcgtcatgggtgccacgaggccaccttcagcagcgcgtccatgcgagtgagtgggacgcgcggtcatcgggcttcatccgcctggacagcgacgcgcccaaccgcaagacgatggcggagtcgctccaagccccaagggcccgccggtga

SEQ ID NO: 7022 - DNA, 324 bp, Myxococcus xanthus
gacgccggaacgattctcaatccggagcgcgtgcgctcacagatggagggctcgatcatcttcggcatgagcatcgcgttgcatggcgccgtcaccatgaagcgcggcgtgacggagcagtcgaacttccgcgacctcaagctggtgcgcatcggcgaggcgccgcggaagattcatgtcgacatcgttcccagtgagctgccgtccgggggcattggcgagcccggcgtgcctccggtggcgcccgccatcatcaacgccatcttcgcgctcacgggcacgcgcatccgcgagttgccggtgtcccgcacgctggcagtctga

SEQ ID NO: 7023 - DNA, 465 bp, Myxococcus xanthus
atgaacgtccacaacgtcctgaagctcctgcacctcatcgccgtcgtggtgttcctgggcgacatcgtcgtgacggccgtgtggcggttgctcgcggacaggacgcgcgagccccgggtgattgtctatgccctgcggctggtgcagttcaccgacaagtacctgctggtgccaagcgtcttcgcgctcgccgccaccggcatgctgcgcgcgcacctccaggacatccccctgtggacgaacccggcgctcgccgcgggacaggtctgcttcatgctgtgcggcatcgtctggcagctcacgctgcgccccatccaggcgcgtcagttggccatggccgaggctttcggcgacaccggggcctcgttcgacgactacctgctgctcacgcagaagtggttccgctggggcatcctggccatggccctcgccttcggctccatggcgctgatggtcctccactga

SEQ ID NO: 7024 - DNA, 3270 bp, Myxococcus xanthus
gagcaaggagtgcgagcctacatggcattgctcgcagcctttggcgcttacctgggccgggtgagtgggcaggacgacgtggtcatcggctcaccgttcgcgggccgccgcatcgcggagacggagccgctcatcgggttcttcgtgaactcgctgcccctgcgcatcgacctgggcggagagcccacgttcctcgagctcctccagcgtgtccgccgccaggtgctcgacgcccatgagcaccaggacgtcccgttcgagaagctggtcgaggtgctcaagccggagcgcgtgctcggaaccagtccgctcttccaggtgatgctcgcgtaccagcagacgcacaccgcgaagatggcgctgccgggcctggaggtcaccccggtggccatccccagcggcgccgccaagttcgacctcaccctgacgctgtccgagacggcccaggggttcgaaggcgtgctggaatacgaccgcgacctcttcgacgcatggcgcatccaggcaatggtgcgccagctgacgggcttcatcacgcggctggccgccgagccgcggtcgaaggtcgtggatgtcgacctgctgggcgccgaggagcgtgcccggctcacgcctcgcgcaccggaggcggcaccgtccctgcccgccgtgcacgaggtcatcgcggcccaggcggcgaagacgccgacggccatcgccgtcgaggccgaggacggcaccctcacctacgcggccctggaggcccgcgcgaaggccgttgcccaggcgctggtccaacgcggcgtcacgccaggaacactggtggccctcgccgtggaacgctccgtggggatgatggcggggctgctcggcatcctcaaggcgggcgcggcctacgtcccgctcgacccggcctacccccgcgagcggctgacgttcatgctcgaggacagcggcgcgcgggtggtcatcacgcaagcgcacctcacctcgcggtttccggggaccgacgtggtggtgctcggggacgacaccctggagtcgttcgagccacggagcggcgcgctggcgtactgcctgttcacctccggctcgacggggcagcccaagggcgtgctgattgagcactccgccctggccaaccacatggcgtggatggacgacgccatgccgctggctcacgaggaccgggtgctccagcgcacgtcgctcagcttcgacgcctccgtctgggagctgttcgccccgctgatggtgggtgcccggctggtgctggcgccgcacggccttggcgcggatacggagcacctggcccgcgtgctgcgcgagcgcgacgtctccgtgctccaactggtgccctcgctgctgacggcgctggtggaggagcccggcttcgcgaacctcccggcgctccggcgcgtctgcgtgggtggagagcccctgccctccgcgaccgtcgccacgctcttcagccgttcgaaggcggaggtgtggaacctctacggaccgacagaggcgaccatcgattcgctggcgcaccggtgtctgcccggacaggtgggcgcgcacggcccgaccgagcccattggcctgcccatccaccggatggaagcgctcatcctggatggcaggcttcgccctgtcccggagggtgtccccggagagctctatctcgcggggcccggcctggcgcgcggctacctcaaccgcccggagctgacgcagtcgcgcttcatcgaacacgccttccccggaggcccgacgctgcgcatgtacaagacgggtgacgtggtccgccggctggcggatggcacgttcctgttcgtgggccgcgccgaccggcaggtgaagctgcgcgggcatcgcatcgagctgggcgaggtcgaagccgccattgcccggcacccggcggtgcgtgaagccgtcgcgctggtgcgcggcacgggtggagactcccggctggtggccttcgtggtgccccatgcgtccgcgcagcgccccgagcccaccgagctccggagcttcgtcgagcagcagctcacggcgaacatggtgcctgggcagttcgtcctcctggacgcgctgccgctcgcgcccaacggaaaggtggatacgcgagcgctgagcgcgatggagctcgccgacgcgcgcgtcaccgccctggagggcctgccgcgtgatgcgctggagctggagatggtccggctcttcgaggaggtgctcggcgtgcgcgccgtgggcatccacgacagcttcttcgacctgggcggccactcgctgctggcgctcaagatgaagctcgcggtggagaagcgcctgggccgcccgcttccgctggtgtccctgttcaggaacccgacgcccgcgcagctcacggcggtcctccggaccgagaacgcggccgtctctccgctggtgccgctcacccccgaggcccacgcactcatggccgccggcgccgcgaacccgaaccggacgccggtgctctacctggtgcccggtggaggctcgacgccgttctacctgttgtccctcgccagacacatggaaggcgtccccgtgttcggcctccagccccatgtcttgcatggcgacgtgcctcccccagacacggtggaggccatcgccacatggtacgcggacgccatcttgcccatgcagcctgaaggcccctactccgtcggtggacactccatgggcggacacatcgcctatgagctggcccaggagctcaaggcccgcggccgcgaggtgggcgtcgtcgccatgctggataccctggcgcccttccccgacgtcacccggccgcagggcgagggttgggacacggcgcagtggatgctccacctcgccggcatcatggaggcgttcttcaacgtgaagatcgacctcgccctgcccgaagtgcgcgccatgggcgaagccgagcggctccagttcttcgtcgcacggctccaggccgcggcggtcctccccgaaggcgcgcagcccgtccacgtgcagggcatcctcaacgtggcgcgggcccatgacgccctgaactaccggccccgccgtggacaaccggtgcccctggcggtgttccgtgcggaggaccgcagtggccccagcacggcggcgctcgacgcgctcgtgcaagacggcacgctcggctggagccagttgacgcagcaggcctgctcggcctaccccgtccctggcacccacctgtcgctgctccgcgatccgcacgcggcggtgctcgcccagcacctgctcgcgctcattccacgtccgacacccaccccatga

SEQ ID NO: 7025 - DNA, 1230 bp, Myxococcus xanthus
gccctggagttcgacatggaggcgctgcgcgccggccaggtgcagctgacccacttcaccggcatcctccccgacgggctgccggtctccttcgagtccggagacgcggaggcgccgcccgctcggcccgcggatggctacttcccgcccgcccagcgcaccctggacgtgtacctgggcgtgccgcgcgaacgcagcggcgtggagagcttcggcagcggggagcggctgggcagcagcccgcgctacacccccgcctcccgccccgtcagtgatttgacggcctccacctccatctcgcaggtggccttcggtcagcgcaacgtgcgcctgctgttcggcaccgagccgcgcgacgacttcgagtccatcaagctgtgcgagctgtcccgcgaccgctccggcaacctgatgctggtggagtccttcatcccgccgtgcctgcgcatcgacgcgtccccgttcgtcatgaacgagctgcggacgatgttgcggctgatggtgtccaagcagcggcagttgtcctcgcggcggcggcaccgggacgcctcggcgctggagttcaccgcgggcgacgtgacgctcttcctggagctcaacgcgctcaacggcaccatccccttcatccagcacgcgctggacgcgggcaacctgcggcccagggacttgtacctggcgctggcgcagtgcgcggggcaattgtgcaccttctccgtcagcgcggacccgtccacgctgcccaccttccagttcaccaacctgcgcgccaccttcgaggagctgttccgccgcctctccgagctgatgcgcgcggtggcgctggagcagtgcctgtcggtggacctgacggcgggcgcagacggcatgttccgcggccggctggaggacgaccggctggagcgctgcggccacttcatcctcgcggtgcgcagcgagctgccggagcgggtggtggccgagcagctccccaagctgtcgaaggtggccgcctgggaggacatccgcgcgctggtgcaggccgccgcgcccggcgtgccgctggcggtgacgtaccggccaccgcccgaagtccccgtgcagccaggcaccgtctacttcagcctctccatgaatgacggctactggaggaacgtgatgcgggaccgcaacctcgccatctacctcccgcagccgttcgacgcgaaccgaacgaccgtggaactgctcgcggttcccaccgccaatcgctga

SEQ ID NO: 7026 - DNA, 552 bp, Myxococcus xanthus
atgccaccaggtgaagcccccgccacggtgctcgtcaccgacgacgacgagcgattccgagagcggctggtgcgcgccttcgtgcggcacggcttccaggctcacggcgcggccagcgcgcacgcggcgctcgaggccgcgcgggcgttgcgtccgggttacgccgtcgtcgacctgcgcctgcccgacggctccggcctggagttggtgcgcgagctgaaggccctggacgcgaacaccaccgtcgtggtgctgacgggctacggcagcatcgccacggcggtggaggccgtccggcgaggcgccacacactacctggccaagcccgcggacgtggacgacatcctgctggccttcgccggcgccaccctcccctccgggcaggaggccgcgctcacccacgaggtgccctccctggcgcgcgcggagtgggagcacatccagcgcgtgctcgccgactgtgggggcaacatctcccaggccgcccggttgctgcgcatccagcggcggagcctgcaacgcaagctgtccaagtaccccgttcccaagtga

SEQ ID NO: 7027 - DNA, 717 bp, Myxococcus xanthus
atggaccgagtcaccgaagccacgaaggattgtttcgacgccgccatccaactgcgcggctccgaagcctcggcggtgcccccgcccgagacgctgcaccaccgccttcgcggcgtggtggacgagacgctgcgccgcgccgccgtgctgggcttcagccatcaggatgcccaggacatggcctacgcgctcgtggcgctcatcgacgaggtcgtcctgggccgcccggaggagtaccgacagctctggatgcccctccagctccactacttcaacgagaacgtcgctggcgacggcttcttcgcgcgcctcaacaccgtgcgaaaggacccgcaccggcacgaggtgctgcaggtctactatctgtgcatgctcttcggcttccagggccgctaccgcatccgcggcggcgagctggagctgatgacgctcatcgacacggtgcagaaggacctggagcgcgcgcggcccttcgacttcgacgtgctgtcgccgcacggggaccggcccaccgaatcgctgctctccaagcgcaagaaggcgtcaatggtgagcatctccgccggggcgctcgcggtggccgtcctgttctacggcgtgctgcagttcttcctcaacgacaaggtcggtgagctgagaagccgcatcgaggtccacgcggcccgcaacacggcgacgagcgccagccagacgcaggcaacggggggggcgcagtga

SEQ ID NO: 7028 - DNA, 2208 bp, Myxococcus xanthus
atggcgtacctgttaccgctgttgggcatcggcgcgccgatgttcgccctgatgacctacctgggcctcaccatgcagcaggcggccatcgtcgccgcgctcgcgggcctgctggccgccggcgtggtgtggctggtcaagcgcatccgcgcgcgcgccgccgccaagaagctggagggcgcgctggcggcccaggcggatgagcaggccaccaccgtgcggccggacctgcagcctgaaatcaaggccatgcagtcggagttcaccaaggcggtggaggcgctcaaggcctccaagctggcgcgcggtggcaaggacgcgctggcggtgctgccctggtacctcatcgtcggtccaccgggcgccggcaagagcaccgcgctgcgcaactccgggctgaagttcccgtatctctccgcgcgcggcggcgtgcgcggcgtgggcggcacgcgcaactgtgactggtggctgaccaacgaggccgtgctgctggacacagccggccgctacaccagcgcggaagaggaccggccggagtggctggccttcctggacacggtggcgaagcaccgccccagccgtcccatcaacggcctcatcgtggccatcagcgtcagcgagctgctgaacgcggacccgcaggccgtgggggagatggggcagaccatccgcgagcgcctggatgaaatcacgacccggctgaagatgctggtgccggtgtacgtgatgatcaccaagtgcgacctgctgcccggcttcgtggagatgttctccgacctgtcgcgcgtggagcgcgggcagatctggggcttcaccgtgccgctggagcagcagcgcgaggcgagcacggacctgttccgcgagcgcttcgaccagatgctctccgtgctggagcagcgctcgctgcgccggctgggccaggagcgccggctggagacgcgcgagaagatctacggcttcccgcagaagttcgacgcgctccggaagaacctggcggagttcctccagccgctcttcctggagaacgtgttccaggacacgcccgtcttccgcggcctctacttcaacagcggcacgcaggagctgcgcccggtggacaaggtgtccccgtccgcggcggagatcttcggcagcaccaacggccgggcgcagacggatggcgccacggacggccgcagctacttcctctgggacgtcttcaccaaggtgatgttccaggaccagcaggtggccgtgcgcagctcgctggaggaagcgagggtgcgccgccagcggatgatgttggccagcgcggcctccgccgccacggtgctgctgctgtcgctacccacggtgtccttcttcaagaaccgcaacatggcggaggccgtcaccgaggccatcaccagtgtgaatctggacccgcgtgacgacatccgccgcgtcgaggacctgattccgctgcgcaaccgggctccagagctgacggagtacgaggaaggcagcgcccccggtgttcatgcgcttcggcctctaccagggccacaagctgctgccgcaggcgcggcagttctacaacgcggcgctgcgcagggtgctgctcggcaagcagttcgagctcatccagcagcgcctggacacgttcgggaagaacccggacctgctgacggtgcgcagcgacgaggactacagcaagcacttcgacgcgtaccgccagtacttcgacgacttgaagatgtacctgctggtgaccacgccccgcgacccgcgcgagccggagctggacgaactgcagcgcaagtggctccaggacgaaatcgtcaagcactggaagcgcgtgcggggcgacgcggtggacgagcgggccgtggcgaaccacgcggagacgttcctgctgatgctcgccaacgagcagatgctccccgaggagcggaagccggcgcgcgagcagcgcatcgccttcggccgcgtcaccggcgtggtgcagtcggcgcgccgctcgctcaacaacgtgcccctggtgcggttggagctggcgcagttggtggccaacatgagcggcgcgtacccggacgtgacgctggagcagctcgtgggctcggtgccgcatatgagcgccacctcgcgcgtgcggggcgccttcacgcgcaaggcctacgacgacgtcatccgcgagcggctggacctggccttccaggaccagcagtcgtgggtgctggaccgcgatga

SEQ ID NO: 7029 - DNA, 2007 bp, Myxococcus xanthus
atgcgcttcggcctctaccagggccacaagctgctgccgcaggcgcggcagttctacaacgcggcgctgcgcagggtgctgctcggcaagcagttcgagctcatccagcagcgcctggacacgttcgggaagaacccggacctgctgacggtgcgcagcgacgaggactacagcaagcacttcgacgcgtaccgccagtacttcgacgacttgaagatgtacctgctggtgaccacgccccgcgacccgcgcgagccggagctggacgaactgcagcgcaagtggctccaggacgaaatcgtcaagcactggaagcgcgtgcggggcgacgcggtggacgagcgggccgtggcgaaccacgcggagacgttcctgctgatgctcgccaacgagcagatgctccccgaggagcggaagccggcgcgcgagcagcgcatcgccttcggccgcgtcaccggcgtggtgcagtcggcgcgccgctcgctcaacaacgtgcccctggtgcggttggagctggcgcagttggtggccaacatgagcggcgcgtacccggacgtgacgctggagcagctcgtgggctcggtgccgcatatgagcgccacctcgcgcgtgcggggcgccttcacgcgcaaggcctacgacgacgtcatccgcgagcggctggacctggccttccaggaccagcagtcgtgggtgctggaccgcgatgagaaggtggacacggtgagctcgcggcgcgagctgcgcacccgctacttcgaggcctacacccaggagtggaaggacttcctcggcgccatccgtgtgcaggcaccggagaacctgacgcagatggagagcctgctgacgaacctgacgcgtggcaagcccaagccctacgggcggctgttccgcgcgctcacgtacaacgtggtgctcgacaagcgcgacgccaaggcggcggaggccgacacgggcttcctggccaaggcggggaagctgttcggctcggagcccgggaaggacgtgccgcagaagcgcgagctgctgaacgccaactcaccttccggcgcccaggaagtcacggcccgtgacctggagcgcgagttcgcctcgctcatccgcttcgccacggagacctccaagacggaggacggtgaggagtccctgacggcgctggattcgtatgaagaccagctggccaccgtccagacgacgctgctggcggtgaaggacaagccggccgagtccggcctgctgttggacaagattgagtccacccgcaacaacgtggagatgatggtccgcaagcagacggacaacgtcgccatcttcgagcggctgctgctgccgccgttccaggagatgcgctcggtggtgttcgtgggcgtggcctgcaacaagagcaagctgtggcaggaccaggtggtgatggcgtggagcagcgccttcaagggcaagtacccgtttgaccgcgcgtcgcaggcagacgcgccgctgcccgaggtcgcggagttcctgcgccccgaaggcggcctggtgcgcaagttcgtcaaggagcagctcctggaggacgtggtggccaccggacgccggtgggagttcacctcgtcaggcggggtcatgtaccggcctgacctgctcggcttcctggagaagacgggcgcgctctccaccacgctcttccccggcggcgacacggtggacccgctggtccgcttccaggtgcgcctgcgcccgggcgtctccgcggacggcatggcttcgcagatttcatccatcaccctgacgctcgacgggacggacgagacgtaccgcaacggcccggacacggtgtggaagccgatgatctggcccggtcaggcaggcaagctcggcgcccgcatcaccgtgcagagcgcggatggctccacggagacgacgctggaggccgagggtgactggggcctgttccgcctgctggagcgcgtcaagcgcatcgagcccagcgcggacggccgctacttcaccgcgacgtgggaaatctag

SEQ ID NO: 7030 - DNA, 117 bp, Myxococcus xanthus
atgaacggcgcgctggtctccatcgacttccgtccggagcgcaccgccaacccgttattcgggatgtcgggcaacacgtccaagctgctggccatcttccgggacccgcggttacag

SEQ ID NO: 7031 - DNA, 324 bp, Myxococcus xanthus
atgggtttgaatgtggaagacgtgaaggtgggcaccggcacggaggcaacggccggcaagtccgttaccgtgcactacgtggggacgctgaccagcggctccaagttcgatagcagccgggaccggggccagggcttcacgttccgcctgggcgccgggcaggtcatcgagggttgggacaagggcgtggccggtatgaaggtgggcggcgtgcgcaagctcaccatcccgccggagatgggatatggcgcgcgagggttcccgcccgttattccccccaactccaccctgctgttcgaggtggagctcctggacgttcgttga

SEQ ID NO: 7032 - DNA, 381 bp, Myxococcus xanthus
ctgatggcggcggtcgaaatcaccaaggacaacttcaaggagacggtgtccaaagagggcatcgtcatcctggactggtgggcgtcgtggtgcggcccctgccgtgccttcgcacccatcttcgagcagacctcgaacaatcatccggacattgtcttcgggaagattgatacggatgcccagcaggagctgtccggggcgttcgagattcgctccattcccacgctcatggtgtttcgtgacgggattctcctgttcgagcagcccggagcgctgccggccgccgcgctggaggacctgctcaagcaggtgaaggccctggacatggagcaggtccgcaaggaagtcgccgccaagcgcggtgagccgccgcaggcctga

SEQ ID NO: 7033 - DNA, 1230 bp, Myxococcus xanthus
ccttccgttattcgagacgccccgggtgaggatgcgccgcgtgcgcgcgtcctcctggtggacgacacgcccgccaacctgctgtccctggaagccatcctggagccgcttggccaggagctggtgctggcccgctccggcgaggaggcgctgcgcgagctgctgcgaggagagttcgcctgcatcctcatggacgtgcagatgccagggctgaatgggttggagacggcgcatctcatccgggcgcgtgagcgcacgcgctacctgcccatcctcttcatcacggcgttgagccgcgaggcggccttcgtcacccggggctatgcccagggggcggtggactacctgctcaagcccgtggacccggacatcctgcgcgccaaggtgcaggtcttcgtggcgctgtacctgcgcggcgaggaggtgaagcggcaggcggtggagctcgcggagcggcgccggtccgaggaagcggcgcagcgggcctccgaactggagcagcagctcatgggcatcgtcggccacgacatccgcacgcccctctccgtcgtgttgacgacggcgaagagtcagctcgccagtggcgcgttggagccggcgcagcagaaggcgttcgagcgagtggcgcgcagcggcgagcgcatccagcacatcgtggacctgctcacggacttcacccgctcgcggctggggggcggcatccccgtcatacctcgggcgggcgacctcaacgagctgtgccgcgaggtggtggacgagctgcaggtggccaggccgggccgcaccatccggtgcgacttctcacgcgacagtctgcacggcgtctgggacctggagcgcatggggcaggtggtggccaacctgttggacaacgccttgaagtacagcccggagccgtccgccgtctgccttgccacctgggagaagccggacgccgtcttcctggaggtccacaacgagggcgcgcccattcctccctcgctgctgccgcacctgttcgagcccttccaacggggcgaggactcgcgtgagcgggcccgcaccagcctgggcctggggctctacatcgcccgggccgtcgtggaggcgcaccgggggcggctgaccgtccgttcctcggaagccgatggcacgaccttccggctctgcctgccccggcgggcggacgcgcggctgcctgccggcggcgcgagcgacgcggggacctctcccgcgcccatgacggcgtga

SEQ ID NO: 7034 - DNA, 101 bp, Myxococcus xanthus
atgagtgccgcgctgcgctggcgcttccaaccggcacggcgcggcgaagaagccatcgacgtgcgggtggatgtgcccgtcaccttcgtgcctgagagcac

SEQ ID NO: 7035 - DNA, 912 bp, Myxococcus xanthus
atgttgcaattaaccatctattgcatgaacacggagcggcggaagtcccggaagtggtggtgcgcgaccctggtggtgtggggcctggcgggcacggcctgtgacaacgtggccacgggcgacgtccaggtctcgatgagtgggggtgatggcacgcagcgtggactcccggacacgctcttccaggatggctggtccatccagttcacccgctacctggtgtcgctgggcgacgtcaccctcacctccgcttctggcgaaacccaccgcagcagccgccacgtgctggtggacgtgcagaaaggcgacatccccctggtggaattgacgggcgttccggcgggccgctgggacgtgggcttccgggtgagcccgcccgaagcccgcaccgagctggcggacggacaggtctccgcggaggacctcgcgatgatgcgcgagcgtggcttcagctatttcgtggaaggccacgcgacgaagcagggcgagcccgtgctgcgcttccgcatgggcttccccgtcaacgcactgatgaacaactgcatcaacggcgcggacggaacgcagggcatcatcgtccccgagggctccgtggcccggcccgaggtcaccatccacgccgagcacatgttctacgaccggctgggcacgcaccggggcgtgcagttgcgcttcgaggccatcgccgccaccgcgggcgaggaccacgtcatcacccccggggggctcgccacgcaggagctcaccgacctccggggccgcgacggcaacgagctgcgcgacgcccagggccagcccgtcatctaccagcctggcgcgttcgacgtgcgcacgctccaggagttcatcacccagagcgtggtggatcaggcccacctcaacggcggcggcgtctgcaccgtggtgaagtga

SEQ ID NO: 7036 - DNA, 1296 bp, Myxococcus xanthus
atggcagacggcgatggcagcgccaacggcgtgtcggaggacatgcttcgtcgggtattcatctcccggccgcgcgtggactactgcaagctgggccccgacaacaacctcgggccggtcaacgtcttctaccggccgggcgacatcacgcgcgtgaaggtggccggtcaggtgtacgcggcgggcgtcacccagggcggtggcgcgggctcgggcctggtggcgcagctcggctacggtccggcggactcggacccgcgcagcgacagcggctggacgtgggtgaacgccacgtacaagacggaccacggcaacaacgacgagtgggaggccgacctgcccaacccgggcaccgtgggcacctggcgcgtcgcctaccgcttcagcatcagcgagaacgtgtggcgcttctgcgacgcggacggcgtcaacgacagcgacgagggcaacctgaccttcagcctgtccaagctgggcacgctcaccgtgggcgacgaggcgccgaagccggcggtgacgtggtgcaagattggcctcgaccggacggcgccggaggccatcaactacacgacgacacagacgtcgggcctgaagacggtgtacgcccaggtcaacctgccgggcgtgacggaccgcgaaggcgcagggcctggcctggcgggccagctcggctggggtcccgtgggcgaggacccgcgcacctcgtcacgatggaactggtcgacccagttgaccttcgaccaggacaacttcgaggtgaacgaccagtggaagggcacgctgcccaacccggccatcaacggcgagtaccgctacgcggtgcgcttcaaccacgacggtggccccatccgtgtgtgcgacggcaacggcgtggacgacggcggtcagaacttcgagatggaccagctcggcacgctcaacgtgacgggccagcccgtcatcccgcgcgtcattggttactgcaagctggggccgaatgagaacaacacgccgcagtcgctggcgtacaccaccggggatgcggccagccacgtcatcatcgcgtccgtcaacgtggcgggcctcaccaacaccaccacgggcgaagtcgcggccatcgtgggccaactcggctggggacccgccggtgaggctccggccacgtcagacgagtgggactggaccacgacggcccagttcaagggcgacttctgggacaacgacgagtacgaggccacgttgcccaacccaggcgtggtgggcagctaccgattcgcctaccgcttccaggtgaacggcggcgagttcctctactga

SEQ ID NO: 7037 - DNA, 1308 bp, Myxococcus xanthus
gccttccgacgctccaccggggacatggcggcgcgattgtcctccagcgacatcgcgctcgggtggctggtccgcctgcgctggcacgccgtcgccggacaagcgctgacggtgggcgttgccgtccgggtgctggagctggagttgcccgtgatgcccctgctggccctggtggccacgacggcggtgtccaacctgctcctcgcgctctggctccgccgcgagcccgaggtccgtcccggcctgctgggcgccgtgctcgcgttcgacaccgcgctgctgacggggctgctcgcgctgtccggtggcccggccaacccgttcgccatgctgtatctcgtccacgtgacgctggcggccatcgtgctgggcccccgttggacggcgctcatcgcgatgctgtcggtgctgggctcgaccagcctcttcgcctgccatgtcccactgcccgacacggtgaacccgccgggcagccacggcctggactcgctccacgtcgtgggcatgtgggtcgccttcacgctgacggcgctcatcatcggcttcgtcgtcgcccgcgtggccgccgcgctgagagaccggcatgccgcgctggcgcgcacgcagcggctggcggcgcgcgcggagaagctggcgtcgctgtccacgctggcggccggcgcggcacacgagctgggcacgccgctgggcaccatcgccatcgcggccaacgaactggacgcgctcatcctggaggcgccccaggaagcgctggaggatgcccgcctcatccgggacgaggtggagcgctgccgggacatcctggagcgcatgagcgcccgcgccggacagacgatgggcgaggtccccgaacggacgacgccgagcgacgtgctcgcccgcctccgggaacaactgggcaccgccgaccaggcgcgcctccaactcgagcccggcccggacgtgcccttctggtgccccgtgcgaggactggtgcaggtcctgacgaacctggtgcgcaacgggctgcatgccagcgaggccaccggagcgaacgtcgtggtgtccgcgcaccgcgaggaggaccgcctgcgcttcatcgtggaggaccggggcaccggcatcccgcgcgcgctgctgccccggctgggcgagcccttcttcaccaccaagcccgcgggccagggcatggggctgggcctgttcctcacccagacgtacgccgagctgtgtggaggccgcctggagctcagctccgaggagggacagggaacgcgcgtgacgctggagctgcccttgaggaaggagtcgtccgatgccaccaggtga

SEQ ID NO: 7038 - DNA, 825 bp, Myxococcus xanthus
atggccgccatccacgccggactgacgctgctgtgcatggccacgctctacccggtgctctgggtggtgaagatggcgctgtcgcccacggacgggctggcgctcaccgccaaccccttccccgaaaccgtcacgctggagcacttccggcaggtgctctccggcacggacgcggcggggcggtgggtgttcggccggcagctcctggcgagcatcgtcgtggcgggcgccaccacgctggtgggcctgacgctggcagtgtccgcggcctacgcgctgtcgcgcttccgcttccccggcaaggaaggcgggatgcaggcgctgctggtgacgcagatgttcccggcgacgctgatgatggtgcccatctacagcatcctccagaagctgcacctgctggacagcctcacggggctcgtcctcgtctacgccaccaccgccctgcccttctgcatctggaacctcaagggctacttcgacacgctgccgcgcgagttggaggaagcggcggtgatggacggcgcctccaccttccaggtgttcgtgcgcgtggtgctcccgctggcccggcccgcgctggccgtgacggcgctcttctccttcatgacggcgtggaacgagttcatcctcgccgccacgctgctcaacgacccgtcccgcttcaccctgcccgtcgcgctccagcgcttcgtcggcgagcacaaggtggagtggggcaagttcgccgcgggcgcgctcatcgtctccgcgccggtcatggcgttgttcttcgcgcttcagaaacacctcgtcggcggtttgaccgctggcggcgtcaaggggtga

SEQ ID NO: 7039 - DNA, 2097 bp, Myxococcus xanthus
tggcacgcgtaccgcggcggcgaggagatggcgctcgtccaggccacggagctcttcacctcgaagacgggcgtccaggtggagctgctcgccctgccctacgacgcctacgctgccaagctgaccaacgccattccccatggcgtgggcccggacgtcttcatcttcaaccacgagcggctgctcaacttccacgcgatgcacctggtggctcccgccagtggcctggcgcgcgaggactacttccccaacgccgtggaggcgctggaggtggatggccaggtgtacggctatcccatgtcgctcaagtcgctagcgctctacgtcaatacgaagctcgtgccccagccgccagagacgacggacgcgctgctggcgatgctgcccgcgctgtcggacgcggacgcgggccgcttcgggctggcctacgagagcggcgacttctacttccacgcggggttcctcttcggcttcggcggcgagctgttcgatgcaaacggccgcgcgagcttcgacacacaggggatggcccgttccctggcctttgtgaaggacctgcaggaccagcgcttcattccccaggaggcatcgggcgcgctggtgaagagcctcttcaacgacggccgtgccgccatgatcatcagcgggccgtggttcgctggggagattgccccccaggtggactaccgcgtggtggggctgccggcggtgagcaccacgaacatccccatccgccccttcctgggcgtggagacggcctacgtatccgcgcgctccgagcgagcggagcaggcccaggcgctggcgcgcttcatctccctgggcgaggcctctcgcgtgcgagccatggtgggccggcagattccggcggacgtggccgcgtacacgctgaaggaggtgcgggaggacacgctcatctcctccttccgcgaggcggcccgccacgccacgcccatgcccaacacgctggagatggcgcgcgtctgggagcccatgaagctggcgctgcgcgcggtgctccagggcggcaccgcgccccaggacgccggcgcgctggcggaccggcgctaccgcgcgctgcaccgcgagcgccctcccgacgccagccctctgccctggctgggattggtgggcgccatggcgctgggcggctccgtctgggtcctgcggcgcccggcggcgacgctgcctttcaagcagcggtaccctgacgtggcgcaggcggtggcgtacatcacccccgcggcgactggcgtggcgctgctggtgttcgtccccttcgcggtgggtctcagcctgtcgctgttccaccacgaggcggggggatacgccttcgtgggcctggccaacttcgtggatatcctggccagccgcggctacagcatcaccgagcccctctccttctatttcacgctggccgtgacgctactgtgggcggtggtcaacgtggtgctccacgtcagcatcggcctgttcctggcgctgctgttgaaggatccgctgctgaagctgcggggtgtctaccgggtgctgctcatcatcccctgggccgtgcccaactacatcaccgcgctcatgtggaagggcatgttccaccggcagttcggcgccatcaacggcctgctggtcgccctggacctggagccggtgagctggttcacgcgcttctccacagccttcgcggccaacgtggtcaccaacacctggctggggtttcccttcatgatggtggtggcgctgggcgcgctccagtccatcccccaggagctctacgaagccgcggaggtggacggcgcgagcaagtggacgcagttccgccgcatcaccctgccgctgctgaggcccgccatgctgcccgccgtcatcttgggcagcgtgtggaccttcaacatgttcaacatcatctacctggtgtccggcggggagccgggcggcggcaccgacatcctggtgtccgaggcctaccgttgggccttccagcgcaacgagcagtacggcttcgcggcggcgtactcggtcctcatcttcgtggtgctgctggtctggtccgccttcaccaggcgattgatgcggtcgtcctcggaggtgatgggatga

SEQ ID NO: 7040 - DNA, 288 bp, Myxococcus xanthus
gaagccacggtgctgctgggcctgcgtccccaggatttgcgcgtggagtcccaggggcccctcaccggcaccgtggacgccgtggagcgactgggcttcgacgggtacgccttcgtcaaaacggaagccggactggtggcggctcgcttcgacaagggcgtgaacgtctcggtgggtgacaaggtgcacctggcccccgtggcggacgcgctgcacgtcttctccaaggacggcgcgaaggcgctgcgccatccggagcagcgcgccgcgctggagatcgcgtcgtga

SEQ ID NO: 7041 - DNA, 99 bp, Myxococcus xanthus
ctccagaagctggcgaccgtgtggcctcgcatcgcggagctggtgaagcgcatggcgaacgtgcgcgagtacacgggccagccggccgaggcgctctag

SEQ ID NO: 7042 - DNA, 1845 bp, Myxococcus xanthus
atgtcgggcgacgacctgacgttgcgccgcacggaggagcgcgcgaacacgggccgcgagctgctgcaggcgtacgccgtgtacggacgcgagggcatccgcgcctacgaggcggagcccgtcagcggcggcagcgcggcggccttcgtgctggatgcggcggcggtgcgcgtgtaccccgacggcagcatcgtcaaccgcatccacacggtgcagaaggcgctggagcagtcgggcgtgcaggagatcgccgaggtgaacgtgccgcgcggcgcgcaggtgctggcgctgcgcacgctgaaggcggacggccgggtgctggagccggagaacatcgaaggcaaggacacggtgagcctgcccggcgtggccgtgggtgactacgtggaggtggagtacctgctcgcggagcctccgcgcggccccgcgcagccgggcttcacggggtccgccttctacttccagattgcgaaccagcccaacgcctgggtgacgtacacggtggtggcgcccaagggcgtgggcatgaaggtggacgcgcacgggatgaaggtgccggagcccaaggtggacggcgacctggaggtgttccacttcgagacgcgccgcgtgccgccgttcatccccgagccggacgcgccgccctccgccaacgagtacctgcccttcgtcatcgtgggcgcgggcgacacgggcaacgagagcctggtgaagctctatggcgatgccttccaggagcgctggctgcgcacggcggaagtggacgccttcgcgcgcaaggcggcggagggcaagtcgggcctggacgcggtgaaggccttgcacgcggcggtgatgcagcgcttctccggccgggacgcgagcctgagccagacggcggcgtccacggtggcccaggaccggggcagccggctgacggtgatgaaggccggcctggacgcgctgggcatcccctcgcgggtggtggcggtgcggaccttcaacaccgacccgtcggcctacaccttcccccaggacgcgctgctgccgtacgcggcgctgcgcgtggaggtgcccggcagcgagccggtgtgggtggacacgtccgtgcgctacggccccttcggcgagctgccggagctggccatgggcgggcgggaggcgtggctgctgcccgaacccggccgcccgttgcagaaggtgcagacgccgcccctgaaggaaacccccggcaaggaagtgaagctggcgctgaagctcgccgaggatggaacgctcagcgggcagggcgaggagacgtactccggcttcgaggcggcgcagattgccgaggccttcaaccaactgtcggcggagagccgcaaccaggcgctgcagggcgcggtggcgcggtacttcggcggtgcgtcgctgtcgagcgtgaagctggagaaccaggagcaggtgggcgcgcccttcgtgctccgctacgagttcaccgtgccgcgcttcgggcggatggagggcggccagcggatggcgctggggcccctcaccttccccgcgcagttgggccggcggttcgtgcagctgagcacgcgccgcaccccgctctacatcgacaccaccgaggccagccgcacgcaggtgacgctgtccatgcccaagggctggaagctcgccgacccccaggcctcgctggaggcgaacaacgccttcggccgcttcacccggtccgagaagcaggacggctcgacgctcagcgtcaccgagtcgctgcgcgtgccacgcaaccgcgtcatgcctggccagtacgagctgttctctgggttcaccggagacgtggacctcatccagacgcgggagctggtcctggtgaagccctag

SEQ ID NO: 7043 - DNA, 645 bp, Myxococcus xanthus
atggacggctaccggttcatcaacggctactgggagccggatggccggatgtggcggtgggtgtccggcggctgggcccgccatgactccccggtggtggagattcccatcgccgtggcgagcgaggagctgtccacgcagcaggcgcctccgccgctccgcgtcgagcacgcgccgccgccgccagccccctcctacgtctggacgcccggctactggtactgggccggcgccaactacgtgtgggtggacggcatgtgggccgccccgccccgtcctgggctcgtctacgtgtcgtcccggtggatgcgccgcgggccctcctggtacttctccgctggcggctgggccacccggggctcggtgcgtgtcacggtgcccgtctaccgccacgcgcacgtcaccgtggcgcgccggcacccgcactacttcacgcactcctggcgccgctaccccgcggtgcgccaccacgtctaccaccccgggaaccactaccggcgtggccccggcccggtgcgtcagcactaccgtggcaacaacggcaatcactggggcaatggcaactaccaccgggcgtcgcccggcgggaacgggggcgggggacatcaccgccgcgatgggggacatcgcggcggccgggactga

SEQ ID NO: 7044 - DNA, 1011 bp, Myxococcus xanthus
aggcccccctcgcgtgatgcacccgcgcccaagccgaagtgggggctggtcatccacggcggcgcgggtgtcatctcccgggagaatctctccccagagcgcgaggaggaggtccgcgccgcgctgacccagtccctccaggcgggacacgcggtgttggccagtggtggctccgcgctggacgcagtgagcgccgcggtccgcatcctggaggactctccgtacttcaacgcgggcaagggcgccgtcttcacgcacgacggggtcaacgagctggatgccgccatcatggatggcacgacgcgcaaggcgggggccgtggcgggcttgcggcacgtgaagaaccccatctcgctggcgcggctcgtcatggagcagtcgccgcacgtgatgatggtgggggagggcgcggaggccttcgcgaagtcgcagggtgtggagttggtggacccgaagtacttctacacggaggaccggtggcagggcctccagcgcgcgctggagaaggagcgctcgcagccgcagccatcctccgcgctcccggcggggtatgacccggtgagcggggaccacaagttcggcaccgtgggcgccgtggccctggaccagacgggcgcgctcgccgcggccacgtccacgggaggcatgacgaacaagcgctacggccgcgtgggggactcgcccatcatcggcgcggggacgtatgcggacgcgcgctgcgccgtgtccgccaccggccatggcgagttcttcattcgctacaccgtggcgcgcgacatctgcgcccgcgtggaataccagaacgtgccgttgccggaggccgccgacgtcgtcatcaacgacgtgctggtgaaggtcggcggcgagggcggcgtcatcgcgatggaccgcgagggcaacgtggccatgcccttcaactccgccggcatgtaccgcggctacgtgggcgaggacggcaagcccgtcgtggccatcttccgggatgcggcggaggccgctggcgcgaagtag

SEQ ID NO: 7045 - DNA, 1107 bp, Myxococcus xanthus
atgaccaaccccgaggcggcgatgaacgcgcccgagcacccgccgacgttgaccgcgcccgcaagcaggcccgtgccacgcttcgggtcccagagcttcttgggggagacctggaggccctgggcgcgtagccacgccgggtccagctccaggacctgctggggagtccacttgccttccccggccagagcgggggcagccacgagcgacagaaggaggagcgtcttcttcatggtgtcccctccctactccgtccggcgcccgcaagcgaatcccttcgccgtgacgcttcgcggccaggaggccgggctttttcgtggaagacgaacccggattaagtgttggggtgtcccaggaggggagcgaccgatgcggaccgccagcggtgcacagctcgatttcggccggttggccttgctcgccctcatgctgggggtgggctggtatttctgggattcacccgccctgtggcccatgaaggtgctggtggtgatgatgcacgagagcgggcacgccctggcgacgctgctggtgggcggctccgtggaccgcatccacctggcggccaacgagtcgggctcctgcctgtctcgcctgccgcccgggctgttcgccaaggtggccgtctactcgggggggtacctgggcagcgcggtggcgggcgcggggctgatgctggccaccttccgcttccggctccgccgctgggtgctgggcaccgccagcgtgtggctcaccgtcatgggcctggtgtacgcgggggacggcttcaccctgctcttctgcctgggcacggccgtggtgctggccctgggcgcgaagttcctgccggatggggtggttgacgcgctgaacctgttcatcgcggccttcacggcgctgtatgcgctgttcgacttgcgctcggacttgtggaacagcgcggtgcgctcgcagagtgacgcggcgctcctggcggacctcacctacgtgcccgccgtggtgtgggcggcgctgtggtcgctgatcgccatcggactgctggcggtggcggcgtacacgtccctgcacgccaggcccaaggggctccagatgccttccatcacggcgcgggcgcgacgggtgtag

SEQ ID NO: 7046 - DNA, 1776 bp, Myxococcus xanthus
ggggaaggcaagtggactccccagcaggtcctggagctggacccggcgtggctacgcgcccagggcctccaggtctcccccaagaagctctgggacccgaagcgtggcacgggcctgcttgcgggcgcggtcaacgtcggcgggtgctcgggcgcgttcatcgccgcctcggggttggtcatcaccaaccaccactgtgccttcggcgtcatccaggagcacagcacgccgcagcgcgacctcatcacccagggcttcctcgcctccaagcgcgaggacgaactgcccggcaagggctcgcgcgtccaggtcccgcgcagcttcaccgatgtgacgaagacggtgctcgccgcggtgcccgcggacgcggacgacatcacgcgctacaaggccatcgagcggaagcagaaggagctggtcgccgagtgcgagaagcgccccgccacccgctgccaggtggccaccttcgatgggggcgtcaactacacgctggtggatgcggtggagctcaccgacgtgcggctcgtgtacgcgccgccgcgcgcggtgggtgagtacggcggcgaggaggacaactggatgtggccgcgccacaccggtgacttcgccatccttcgtgcgtacaccgcgccggacggcacctccgcgccgtacagcgacaagaacgtcccctacaaggcggaattcttcttcccgctggccacccagggcgtgaagcccaacgacttcgtcatggtgctgggctacccgggcatgacgtaccgcgcgctgctcgcggaggagatggccgagcgccagtcccgcctctacccgcgcatgcgcgacgtgttcggcgaggccatccgcatcctcgaagcggaaggggagaaggaccccgcgggcaagattgccgtcgcctcgcagctcaagggcctgcacaacgtctacaagaactcgggcggtcagctcgccggcctgaagcgcggccacatcgtggagaagcagcgcgaggcggaagccgccgtcgcggtgtgggccaagaaggcgggcgcgaagtggcagccggcgctggacgcgcgggccgcgctgctcgtcgaacagtccgccatcgcgaagtccttcgaccgtgagttcctcctggccgcatcgtcgcgcctggcgcggggcccggccctggcggtggtggtgtcgcggctggccgcggagcgcgcgaagccggacctggagcgccgcccggagtacatggagcgcgagcacgtccgcatcaaggaccggctggagcgcgaccagaagaacctgttcctccccgccgagcgtcagctgctgctggccttcgtgcgccgcgcgcaggcgctgggcgccgaggagcgcatcgccgcggtggacaagcacttcggcaagacgttctcggagaaggacgtcctggcgaagattgacgccatgtacgcgggctccaaggtgctgacgctggacgagcgcatgaagatggccaccgagtcggtgggccagctcgaggcgcgcaaggatccgctgctcgcgttcggcctggacctggcgaaggagcaggccgcgctggacgaggtgaaggacaagcgccagggcgccgcgctgcggttgcggccggagtggcgcaaggcggtgctggcgcacgcgggcaagccggtggcccccgacgccaacagcacgctgcgcgtcagcttcgccaaggtgcagggctacgcgccgcgggacggcgccatctacacgccgcagacgacgctgtcgggcatgctggccaagcacaccggcgaggagccc

SEQ ID NO: 7047 - DNA, 762 bp, Myxococcus xanthus
cgctgctggacggtgcgcggacttccaggcccaccggcgacaacgggcgcccctgccctgcgcggcgtggacctggaggtgcgcgcgggtgaaatcgtcggcatcgcgggcgtggacggcaacggacagcgcgagctggcggaggtcctcaccggcctgcgcccgctgacgtctgggagcggagcgctcctgggaggccccttgagcgacctcacgccggcccaggcgcggacgcgcggcgtgggacacatccccgaggaccggctccaccgcgcggtggtgaaggcgctcagcgtggaggagaacgtggccctgggccggcacacgcggccgcccttcgcgaagggcccgtggattgatttcaagggccgccgcgagcgcacgcgcgagctgaccgtggcctacgacgtgcggcctcccgacccggaagtcgccctgcgggccctgtccgggggcaatcagcagaaggtggtggtggcgcgcgagctggatgcgcggccccggttgctggtggtggtgcagcccacgcgcgggctggacgtgggcgcggtggcgcaggtccacgcgaagctgcgcgaggcgcgcgaccagggcacgggcgtgctgctggtgtcactcgatttggaagaggtgctggccctgtcagaccgcgtctatgtcttcttcgaaggccgcgtgacgggccacttcctccgtcacgagttcgacgaacgcgagctgggacggcgcatgctggggaccacggagccgggccatgcctga

SEQ ID NO: 7048 - DNA, 267 bp, Myxococcus xanthus
atgcgcgagcggctgacggtgcggcgggcgcgaacaccggctcgcggcgattcaggaggcgacgaggtccaccgcaatgagaccaacggcgcggggcgcgagctcgaggccgagacgcccgtgggggccacggtggtgctggactacaaccgggcctacaaccccacttgtgccttctccgcctacagcctgtgcccgctgtcgccgcgccagaaccggcttcccttgcgcgtgccggcaagcgagaaacgcccgcagagtcagtga

SEQ ID NO: 7049 - DNA, 3711 bp, Myxococcus xanthus
gtgcccgcggagatggactttccttccgacgagcgccgcatccaggccttctggaaggaccgccgcatcttcgagcgctcgctcgaaacgcgtgaggatgcccccagcttcgtcttctacgagggcccgccgaccgccaacggcctgccgcacaacggccacgtcctcacgcgcgtcatcaaggacctgttcccccgctacaagacgatgacgggccactacgtcccccgcaaggccggctgggacacccacggcctgcccgtggaggtggaggtcgagaaggaactgcgcatccacggcaaggcggagattgagcgctacggcgtggagcccttcaccgagcgctgcatcgaatccgtcttccgctacacctccgagtgggagcggctcaccgagcgcatcggcttctgggtggacctgaatcaggcctacgtcacctaccaccgtccgttcgtggagagcgtgtggtgggcgctggcggagctgcaccgcaagggcctgctgtaccagggccacaaggtggtgtggtggtggccgcagggcggcaccgcgctgagcgccgcggaggtgggcctgggctacaagacggtggacgacccgagcgtctacgtcgccttcccgctgcgcgacacgccggacaccgcgctggtggtgtggacgaccacgccctggacgctgccgtccaacatgtacgcggccgtcaacccgggcgtggactacgtcaccgtggacgcgggcgagcgcaagctcatcgtcgccgcggcgctgcgcgaggcgctggcgaagaagctcaagcaggacctgccggtgctcgccacgcagaagggcagcgacctggtgggccagcgctaccagccgcccttcgacctctaccaccagcgcgcgggcgacacgcggctgccgctgaaggacggcggtgaggacgcgcaggcctggcgcgtgctgggcgcggacttcgtgacgctcgacagcggcacgggcatcgtccacatcgccccggcttttggcgaggacgactacgaggccttccgcaaggacaaggcccgcttcgcccagccggaagcgctggagctgttctgcgcggtgaagccggacggcaccttctccgacgacgtgccgctcgtcgcggggcgcttcgtgaaggaggcggacaaggacatccagcgccacctgaaggagcgcgggctggtcctcttcacggagcagtacaagcacgagtaccccttctgctggcgcgcggacgacgacccgctcatccagttcgcccggcccgcctggtacatccgcaccacgtccgtgaaggacgaggcgattgccaacaaccgcgccgtcaactgggtgcccgagcacatcaaggaaggccgcttcggcgacttcctggccaacaacgtggactgggccctgtcgcgcgagcgctactggggcacgccgctgccgctctgggtgcactcggagacgggcgaggtggaggccatcccctcgctccaggcgctgcgcgagaagccgggcaacaacgtggccgcggtggaggcggagctgaatgccttcctcgcgggcaagccccacgaggccaacgccagacacctcatcgtccacaagccgtggatcgacaaggtgacgttcgagaagcccggcatgccggggcgcttccagcgcgtgcccgaggtcgtcgacgtgtggttcgactccggttgcatgcccttcgcgcagtggggcttcccgcacgcgccgggctcgcgggagatcttcaaccgcgccttccccgcggacttcatctccgaggccatcgaccagacgcgtggctggttctactcgctgctgatggtgagcacgctcctcttcgacgaggagacgcaggctcgcatgggcctgtcaccccagcgcggctggccgcagccgtacaagagctgcatcgtgctgggccacgtctccgacaaggaggggcgcaaggagtccaagtccaagggcaactacacgccgccggaaatcatcctggacgaagtgcgcatggacttcgcggtcctcactgccacggaggccggcgttccgggtgagccgggcgtggcgctcatcgctcgcgaggacctggagggcctggacatccaggagggcgccaaggtgcagctcttccggccagaccgtccggacgtggtcatcaccgcgacggtgaaggcgcacaagaagctcaagcgccgcgtgctgctgctggcgcccgctgacctgcagacgctggacgtggcgccctccgagcgtggcgccagtgtcatgccggtggaggcgccccggatggcgccttccgagcgcgtggtgctgaaggacccccccgccaaggcgccgggcgcggacgcgttccgctggttcttctacgcggcgagccccacctggtcgaacacgcggcactcgctgagcaacgtgcgactgttgcagaaggacttccaggtcaagctgcgcaacgtctactcgttcttcaccatctacgcgaacatcgacggtttcaacccggcggccggcaacacggacgcgaccgactcgccgtgggaagccatccgccgcagccagggctggcgtgaggtgaaggcgcggccggtgctggaccgctggattctgtccgaggtccacctcaccctgcgcgacgtcaccagcgcgctggacacctaccaggtctacgacgcggcccagcggatggtggcgctggtggacgcgctgtccaactggtacctgcgccgcagccggtcgcgcttctgggcgccgggcttcgaacaggacaagcaggacgcgtacttcacgctctacgaggcgctcaccaccattgcctcgctgtccgcgcccttcatccccttcttcgccgatgagatgtggggcaacctggtgcgcaagccctggcccaccacgcagccggagagcgtccacctggcgcgcttccccaccgtggatgcgtccctcatcgacgaggggctcgcggcggagatgggcgcggtgagggacctggtctccctgggcctcaaggtgcgcacggacaaccgcctcaaggtgcgccagccgctgtcgcgtgcggacgtcatcctggcgcgcaaggagctgacggaccgcgtggcggtgtatcgcgacctcatcgcggacgaactgaacgtccacgaggtgcgcttcgtggagccgggcagcccggaggcggacgtggtgcgcttccgcgtccggcccaacctgcgcgcggtgggcggacggctgggccccaagctggccccggtgcgcaaggccttcgacacgggtgacggcgccgcgctgcaccgcgagttgctccagacgggccgcgtggccatgacggtggccggcgaggacctggtcttcaccgccgaggagctggagacgctggtggaggccaaccccggctacgccgccgccggcatgggcgtgggcgtggtggtgctccacaccgagctgaccgagtccctggtggatgagggcctggtgcgcgagctgctcgcccgcgtgcagggcgcgcgcaaggacatggagctgggctacaccgaccgcatccagctctgggtggacggcgacgcgcgcgtgaagcgcgtgacggacgaagcacgggagttgatcgctcgggagacgctggcctccagcatcctcgtgggccccgagggcctcaccggcaaggaagaagaagccagcatcaacgggctgcccgcgcgcatccgcgtggaacgggcctga

SEQ ID NO: 7050 - DNA, 1095 bp, Myxococcus xanthus
atgcttccgtcggtgctctccgtgctgctggcgctgggcgtgtgctgggcgctcatcgcgctcaccatggagccgggcaccgcgacggacgcctatctgcagatgctgtggggtggcatcggcaactggcccgcgtgcctggacggcgccgcggccaccgtcatcacccgcccgctgggcgagtccgcgatgaaggccgcgattctcaccctcaccggcctgtccgtggcggtggcgttcaaggtgggcctgttcaacatcggcgcgcagggacagatgctgctgggcgcggtggccgccgcggtggtgggcgcccaggtgtcactgccgggcgtgctgcacgtgcccgcggccctgctgggcgcggcgctcgcgggcgcggcgtgggcgggcatcgccgggctgctgcgcatctaccggggcgtgcacgaggtcatctccaccatcatgctcaactgggtggcgctgagcctggtggacaactggctggtggtgggcccgctgcgcggcgcggccgaaggcggccagtccatcaccggcaccgccgaaatccaggccaccgccgtactgccccggctgctgggggaaggctcgcggctcaacctgggcttcccgctggcgctcgccgcggcgctggcggtgtgggtgtggctgacacgcacgcgctccggcttcgagacgcgcgcggtgggcctgggcgccgaggccgcgcgcgccgcgggcatccccgtggcccggcgcatgggcctggccatggcgctcgcgggggccatggcggggctggcgggcgcggtgctggtgctggggacggaggggcgctaccccggcacactgggcgcgccctacgggttcgacggcatcgccatcgcgctcatcggcaacaaccacccgctgggcgccaccgtgtccgcgctcttcttcggcgtgctgcgcgcgggcggaacgcgcatgcaactgctcggcgtgcacaagagcttccccgagctcatccagggcctcgcgctgctcttcgtcgccgggcgcatggtctggctggcgctgctgcgccggcggaacgtggcgcccgcggcgtcggcggaggtgccccgtgcttga

SEQ ID NO: 7051 - DNA, 846 bp, Myxococcus xanthus
tccgagcgcgcgggcgtgattgccgtgggcatggaggggatgatgcgcgtgggcgccttctgcgcggcggtggcggcgctgacgatgcccacgcccctggccgtcgtcatgggcatgctcgcgggcgcggccctggccggcgtgcatggcttcctgagcatccgctggcgctcggaccaggtggtgtccggcatcgccctcaacctggtggccctggccggcggcaccttcctgctggagtcgctctacggccccaatggcaccccgcccatccagcagctcacccgctggaacatccccgggctcggcgccgtgccggtgctgggcgcgctgtccgggcactcggcgcccacgtacctggcgctgctgctgcccttcgcattccagggcctgctgacccgcacgcccctgggcctgcggctgcgcgcggtgggcgacaagccccaggccgtggcgacgctgggcctgtcggtaccggggctgcgctggggcgcggtgctgggcagcggactgctggcgggcctgggcggcgcggtgctgtccaccgccgtactggaccgtttcgagcagcacacccccgcgggcctgggcttcatggccctggccgccatggtgttcggccggtggacgcccgtgggcgccttcctcgccgccaccttcttcgccttcggtaacgcgctgcgcatcggcctggtgtcgagcgcccccggactggtcgagctgatcccccagggcgtcctcctggccctcccctatctgctcaccttggtggtgctgaccctccagggccaacgcagcagcgcccccgccgcgctcggaacgccctacgaacaagagtcgcgctga

SEQ ID NO: 7052 - DNA, 1095 bp, Myxococcus xanthus
atggagcggctgtgctccatcctcgcgccggcgggttatgacgtgctgaccgcgagcggactgggggcggccgcggcggcccatcaatccgcggacctggtgctgctcgacgtggagcgtcctggcacggatggcctcgcgacgtaccggcgccttcaggacgcgctgggaagcccggccctccccgtgctcatgctgacgcccagcgcggaccgggagacgcgccgcgaggtgctcgaggcgggcgtggatgacctgctcatcaccgagcccctggacccgctggagctgaaggtccgcatccacacgctgctggagctcaaggcgcaccgcgagcgcggtggccagcgcgccgaagcgctgcaggacccgcgcgtccgctgggtggagatggagcggctggcccgcgtgggcacgctggccgcggacgtggcgcagaacctgggccgcgtgggcgaaggcctccagcgggcgctggagcacgttcgcactcgcgcgctgcaaggcctgccgccggacgcagacgagctcaagaagctgggcgtggccggcgagcagatgcgcctgcacggccagcacctgctgtcgctgggcaccaccaatccgaaggacatccagcgcttcgacctgcgcgacctggtccccgcggtggtggagcggatgcgtgacgccggccgcctcggcaccgccgaggtgaaggtgcagctgccggacgaggccatcgccgttgtcttcaaccgccgtcagttggagcaggtgctggtggagctgctggccaacgcggtggatgcggtggaggacgtgacggaccgcccgcgtcgcatccatgtgggcgtggagcttccggacatcttcggggacttcggcccgcgcctgtacgtgaaggacacgggcatcggcatcttcgaggacgagctgcaggccgtcttcgagccctactacacgacgaaggcgcccgagaagggcgccgggctgggcctcaccgtcgcgcgcaccctggtggaagccatgggtggcgcggtgacggtgcacagccgcgtcaacctgggcagcaccttcacggtggagctgcccgagcagacgtcgtcctggtag

SEQ ID NO: 7053 - DNA, 528 bp, Myxococcus xanthus
gggcaccaccgccttcatggccagataggctggcccggcatctccctgggcctgctgcacggtggctcggagcgcttcgacatcggcggcaagttcagcttcaactggggccgcgagggctgggtccgctacacggacccgggcatcaagctccaggcgtggatgcggttgcagctcgtcaaggagcgcaacttctcgctggcgctcaccttccagccgggcccgttcttctacttcaaccggcatgacaccgacgtgggcctggcgctgcccgtgggcgtggtggtgggcatccccgccggcagcgccgtcatggtgaacctgggcctggacatccccttccacgtctacttcggcgagggaatcggtccggtgttccccgtcctcgtgggcggcggcctggagtacttcgtcaaccgccagctgggcgtcaccttcaacgtccggctggggcccgccgtcatcccggacatcgacgacaccgagttcacgctggaagcgctcttcggcgtcgcctaccgcttctag

SEQ ID NO: 7054 - DNA, 1818 bp, Myxococcus xanthus
atgaacctgaccgccgaccccgccctcaccagcgccgccaccggaggcacggtttccccgcgcaacgacgccacgcagctcgtggcacacggacaggcctacctgtgtggccgcccgctgggggaaatcctgcgcgccatcgtcccctcgctcaccgaggagaagctccaggaggcgctcgccatccaggacgagaaggggcagcgcattggcgaggccctcgtggggatgaaggcggtctccgaggaggacgtggccaaggccctggggcaccagttggacctgccctacctggcgcgcatcttcgccgaagaggtggacgcggagctcgtcaagcgcatccccatcaacttcgccaagcagtcacgcatcctcccgctgtccctggagggtgacacggtggcggtggcggtggcggacccgctggacaccgccgcgctggaccacgtgcgtgtgctgctgggccagagcgtcagccagcgcatcgcgctgggctccaccatcaccgacgccatcaacagcgtctacgaccgctccgtcaacgagacggaacagctcgtggacgagatggaaacgcaggacctggacgccatcgcccacgagctggacgagcccaaggacctgctcgacgaggacgacgaggcgcccgtcatccggctggtgaactccgtgctgttccgcgccgccaaggagcgcgccagcgatatccacatcgagccgatggagcgcgagctgctggtgcgcttccgcgtggacggtgtgctgcaggaggtcatcaagccgcccaagcgctaccagaacgccatcgtcagccgcgtgaaggtcatggggcagctcaacatcgcggagaagcgcctgccgcaggacggccgcatccgcatcaagctggccggccgcgacatcgacatccgtctgtccaccatccccacgtccttcggcgagcgcatcgtcatgcgtctgctggacaagacggcgacgctgctggacctggcggaaatcggcatgagccagaagacgctcgagtcgatggaagccgtcatcaaacgctcgcacggcatcatcctggtgacgggccccacgggctccggcaagacgacgacgctctacggcgccctgtcgaaaatcaatacgcccgacctcaacatcctcaccgtcgaggacccggtcgaataccagctcaagggcattggccacatggccatcagccccaacatagggctgacgttcgcgcaggggctgcgctcctttctacgacaggacccggacgtcatcatggtaggggagattcgcgacaaggagacggtggaaatcgccatacgggcctcgctgagagtccacctggagctgtgcaccgtacaaaccaatgacgtcgctggtgacgtgacacgtctggtggacatgggcgtggagcccttgctggaggtgtgctcgctcaccggcatcctggcccagcggctggtgcgccgcgtgtgcccggactgccgcgtgcccttcgagcccaccgacgcggagctcaaggagctgggccactcggtggcctccttcaagcagcgctacggcgtggaccgcatctacaaggcctccggttgcccctcctgcaaccgcaacggctaccgcgggcgaaccggcatctacgagttcctccccgtggatgacgacgtgcgccagctcgtgctgaagaacgtggacgcctccaccatcaagcggtccgccacgtccaagggcatgacgacgctgctggatgacggcgcgcggaagattgccctgggcgagacgaccatcgccgaggtgctcagcatcacccaggaggacatgtag

SEQ ID NO: 7055 - DNA, 1257 bp, Myxococcus xanthus
atgccggtcttcgagtacagaggtctcaattccgcgggcaagcagatcaagggcctgctcgaggcggactcacccaagacgctgcggtccaagctgcgcgccgacggcatcttcctcacggatgtgctggcccaggccgaaggcagccgcgccgccgtggccaagggcaccaacgcggcgctggtggcgcgcgacatcgacctgcgcaagctgggccggggccgcgtcaacaccgacgacgtggccatcttcacccggcagctctccacgctgctgggtgcgggcgtcacgctggtggagtcgctcagcgcgctggtggaccaggtggagaaggagcgcttcaagcgcgccctctccgacatcaagcagcgcgtcaacgaaggctcgtccctggcggaagccatggggcagcacccgaaaatcttccccagcatctacgtgaacatggtgcgcgcgggtgaggcctccggcgcgctggacgcggtgctcacgcgcctggcggacttcacggagaaccaggcccggctgcagcagaagattctcagcaccatgctctaccccgccatcatgatggtggtgggcggcgggatcctcgtggccctcatggtcttcgtggtgccgaaggtgacgaaaatcttcgagacgatgaaggccacgctgcccctgagcacgcgcttcctcatcgcctccagcaacttcttccagagctggtggttcatcctgctgccggccatggcgctgggcgtggtcctcttcatgcgctggacgaagagcccctcgggaaagcccaagtgggaccgcatcacgctcaaggcccccgtggtgggcaacctggtgcgcctgctgtccatctcccgcttcgcccgcacgctgtccacgctgctcaagagcggcgtcccgctgctggcggccatggacatcgtcaaggccatcatgaccaacaccgtcctggcggaggtcgtcgagaaggcccgcgactccatccgcgagggcgagagcatcgccaacccgctgaagcgctccggggaattccctccgctggtgtaccacatggtcgccatcggtgagcgctccggccagttggaggagatgctcaccagcgtggcggacaactacgagacgcaggtgaacgtgcgcatcagcgccctcacctcgctgctggagcccctcctcatcgtggtgatgggcgcggtgattgcattcgtcgcgctctccatcctgatgccgattctgcaggtgaactcggccatccggtga

SEQ ID NO: 7056 - DNA, 916 bp, Myxococcus xanthus
atgcgccagagccagaagcagcagaggaagcagcgccgcaaccgcggcatgacgctcatcgaaatcatggtggtcatcaccatcctcggtctcatcgccgcggcggtgggcgtggccgtcatcccgcagttggagtccgcgcgccgggatcgcgccgcgctggacatcaagaacatccagggcgcgatgaagctctactacacgaagaaggggaagtacccggacacggcctccggcctgcaagcgctggtggaggcgcaggcgctcgagcagatgcccaaggacccctggaacaacgactacgtctacatcaacgagggcggaaagccggtcatcatctcctatggcgcggacggcgcctccggcggtgagggcaacgacgcggatatctcctccgcggacgcggcgacctccgccaagaagtgacgaacaagtcgcgcgcgacacacgttgacagggcttgggcatgaaagagcacgacgccattccatccccgacgccctcgcacgaggggccggaccgccgccggagactggggcggttcctcctcgcgttcgtcttcgtggccgccacggggcttgccttcacgctggtctacgtgacggaggaccggacgctggataccaaccagcgccgggcacgcacggacatccgccagttggagagcatgttcaagtcccaccaccggctgatgggccgcttcccctcccaggcggaaggcttcacgccgctcatccaggcccggatcctggaccgcgtgccggaggacccctggggccatccgtacgtgtactggatggacggctccacgggcgccgtcatctcctatggcgcggacggcaagccgggcggcacgggacctgacgcggacctgagcagtggcggtgtgctggccgccggttgggcggagccatga

SEQ ID NO: 7057 - DNA, 427 bp, Myxococcus xanthus
atgacgaagcggagccaccgcgcccagcgcggcctgacgctcatcgaaatctccatcgccatcatcatcgtcgcgatgctgttctccgcggcggtgatgggcatcggctccatcaccggcgccaaggccaagggcagcgcgggcgagctggcgggcctcatccgctcgctctacgactcggcggcgctgcgcgggcagacgtgccggctggtcttcgagattcccgaccccaagagcgagcaggccacgcgctatcacgccgaatgcgcggagggcgccgtcaccaccgcgagagaccgcgacgagacgctacgcgcggagaacagcgagcgcgagcgcgccgcgcgcaaccggagcagcggcagcggccgtgacgagcggcgcaactacctgtccggcggcagcgggacgaacgcccccagcgcgc

SEQ ID NO: 7058 - DNA, 519 bp, Myxococcus xanthus
atggccaacgagacccagacccagaagtccacgggcgtcgccaatgacgcctcgctgtccctgctcgacgaaatcctgtccgaggccaagctgaagccgaaggacgagggttacgacgtcgccaagcgcggcgtgcaggccttcatcaccgagatgctggcgcccaaccgctccgaggagcgcgtggacaaggcgctcgtcgacgcgatgattgccgaaatcgacaagcgcctgtcctcccaggtcaacgaaatcctccacgcgaaggagttccagaagctggagtcctcgtggcgctcgctgaagttcatggtggaccgcaccgacttccgcgagaacacccgcgtggagatgctgaacgcctccaaggaagacctgcagaaggacttcgaggacgcgcccgaggtcaccaagagcggcctgtacaagctcgtgtactccaacgagtacggcgtcttcggtggcaagccctacggcatcatctccgccaactacgacttcaacgtgggcccgcagggc

SEQ ID NO: 7059 - DNA, 90 bp, Myxococcus xanthus
atgtacgcctactacagcccggactggggctactacatcaaccgcgacgtctgtggccgcaacgggccgctcatctgtccgctgtactga

SEQ ID NO: 7060 - DNA, 495 bp, Myxococcus xanthus
atgagcaaagagagttccgtcgcccctaccgagcgcgtcaacatcgtctacaagcccgccaccggcaacgcgcaggagcaggtggagctgccgctgaaggtgctgatgctgggggacttcacgggtcaggaagacgcccgtccgctggagcagcgcgcgcccatcaacgtggacaaggccaacttcaacgaagtcatggcccagcagaacctcaaggtcaccctgaccgccgccgacaagctttcggcggacccgaacgccacgatgaacgtgtcgctccagttcaagaacctgaatgacttttcgcccgagagcgtcgtcaatcaggtgccggagctgaagaagctgctcgagctgcgcagcgcgctcaacgccctcaagggccccctgggcaacctgccggcgttccgcaagaagctccaggctctgctcgccgacgaggacggacgcaaggcgctcatcaaggaactgggtctgaccgaagagaccaagtag

SEQ ID NO: 7061 - DNA, 1977 bp, Myxococcus xanthus
gagcccgtgccgggggcgtccccggccggcgtgcaggcgaagcacgagcccgcatacgaggccgtcgcgctggaagtcgcgaagttggagtctccggccagcaacgccgtgcgctgggatgacgtcgtcgagggcgccagcgagctgctgaagcacaccaccaaggacctctggctcgcctcgtacatggcctatggcctgtatgccacgcgaggcctggacggcgcggccaccggcacggccgtgctcgccgaggtgacggagcgctactggcaggacctcttcccggaggcgaagcggctgcgcggccgagccaacgccgtggcctggttcgtggaccggctgggccgcatcctgcccaccgtagaccaggcctccgtgagcgcggagcccctggatgcgctggcggtcgcggtgaagcgcctggcccagctctcacgcgagcggttctccgacatggcccccgcgttcgggccgctccaggatgccatcgcccggctccgcgccggactccccgagcccgaacccgagagcgtaccggatggacgcaccgcgtcctcggaggacgcagacgcctcgcagccgccggtggatgggactgcgtcgtcccaggacgaggacaccccgtccggcgaggatggagagaccgttgtgcgcgcggcggactccgcgaatggcacgcggccaggagcgccttcggacagcgctgaaacgcccacgaacggcaatggcaaccgctccgctcgggaggcgggcaatgccagcgccaacggcaaacctgctcaagccaacggtgctggaaacagcgccgccccgggtaaaggcaacaccgccccgggcaatcccacggcgaagaacgcccccgccccggccaaaatcagcaccgctcagggcaccgccaaagccagcgcagccagccagggcggcgcctccgccaacggcacacccgcaccaccgcgcgccgccatcgaagtcccgcccctccccgagcttcccgccgccccggatctgtccagcgtggaggcgatcaccgacttcctgcgcaccgtgggcggcgcgctgctgggagccgcgggcgcgctgcgccgggccagccccgaggatccgctctcctaccgcctcaaccgcatgggcctgtggttgcacctgacccagccgcccgccacggatggcaatggccgcacccagattcacccactgccggacctgctgggaaccaagctggagaccctggagcagaaccagcgctggggcgagctgctggacgagtccgagtcggccctggcccgccaccgcttcacgctgacgctccaccggtacagcgccaccgccctggaggggctgggtgccgcgtacgccggggctcgcaccgcgctggtacaggaattggccatccagctccgccgcatgaccggcgtggagacgctcatctccaccttgggaagcccgctcacggacgacgccacccaggactggctgcgcgaccacgtcctccgcgcgagcgcgcccccacccgccccttccgccgccgtggcgtcggtgtccacgaccctggcgctggggcccctgtcgctgggcccgtctgtccatgccgacagcgcggcgctggaagccgaagcccgcacgttgctggaggaaggccgtgtccacgaagctgtcacccggttgcaggccgccgtcgccgccgccagcaccggccgcgcccgcttcatctcccggctggagctggcgcggttgtgtgccaatgcgggccagttgccgctcgcgcgcgccgtctatgacgcgctggacgaagaggtctccgcccacgcgctcgacacctgggagccagcgctcgccgccgcgtgtctggaggggtggctgcaaacccgcaccgaagccgaaaaggagtctggaccggtggcagtgaaatttcgaaaccggtatcgtcgtctagcgttgctggactcttccgccacgctgcgcgtcggcgcttga

SEQ ID NO: 7062 - DNA, 825 bp, Myxococcus xanthus
atggaagcgggcgtggagcgttcgcgaagagcccgggtggacctgcccgccgagcccgtctgtttcgtcttcaccgcgcccggccagaagcaagcactggtggggctgatggcgcccagccaggacagcgtgggccgggcgttccccctggccgtcttcaccgaggtgtcctccgcggagacggcctcgcggctcgcgttgacgcccgaggcgtaccagcccttcctgcgcgccgccggtgcgctggcgcagtccgccgcggagctggaggtgccacagctgctggagcgcgtggcggcgctgcccctgccggggccgggggactacagcctcgcgaagcggctgctcaacgccgtgctggcggaccaccacaccgtggacctgctgggcccggtggtggagggcacgccggaaggtgggcgttactacgcgctgcacaccttcctcaccgcgtgcgcgggcgagcgcggcaaggagcagtcaccggctggcgtcaccctggactgtccgctgaccacgcgcgtgggacccgtggcctggctggagctgtcctcgcggctgctcaagtggacgcaccagccgccggccttcttctggtccgagggcgagaagccccggctgctcatcagcctgggagcggcctccccggccctcttcctcgcgctggcccagcccagccgtccgggcgcccaggtgtggccgctgcgcaccgagcgccccgccgccatcgacaacgcgcgcaagggcctcacggcctcggcgcgacaggtcatcgacgcgccgtccaccaccctggaacagctgttgcagacgctttcgcgctga

SEQ ID NO: 7063 - DNA, 453 bp, Myxococcus xanthus
gaccccgccgcggcgagcgcctctttcttgaaggacctcagcagccagaacggcaccttcctcaaccgccatcgcatcacctcggaggtcgagctgatgccgggggacgaggtgtccctcggcaacgccctgctgcgcctgcgcggccccggtggaacccctgccctgggtgtgcccgccgtctcccacgacgaaaagccgccttcgcgcggggccttgagcacggtgggtgtggccctgggcgccgcggcgctgggttcgggtgtggccgcgctcatcgcgctgctttccaccgcgccggccggcggcgcggagcacacctctcccgtcccgccaccggcggccccccagcatgcggccgccgcttcgccgaccgtggtcgcgtcgggtgcgccgacgcggctcgacatggaagtgcccgcggccggcagcgccgagaaaacagaagacggg

SEQ ID NO: 7064 - DNA, 456 bp, Myxococcus xanthus
ttcctgggactgcgcttgaagctgccggccggtgccttcctggggcccgtgttgctgggcatcccgctcacggcgctgggcctgccggtaggcgcgtggccgccgggcctcctcccgttggccttgtgggtgctgggcgtgcgcgtgggcagccagttcgatgcctcggcggtgcaggagctgaagcgcgtcgcccacgtcgcactggcggcctcggtggcgatggtggtggggtgtctgctgctcgcgtggggctggtccgccgccacgggcgtggacctgctcaccacctacttcgcgacgtctccgggcggcgtcgactccgtgctggccatcgcgctgggcacgcgtgccactttgtccgtcgtgctggcggtccaggtgggacggctgctcttgatttttctcgtcgcgccgccgttcctgcgcaggctgtctcccgcccggggcgcgtga

SEQ ID NO: 7065 - DNA, 834 bp, Myxococcus xanthus
cccagcctcgctccgagcatggaggcgctggtctcattgctcacgcgccgcagcacggtggtgctcaccggggcggggtgcagcaccgagtcaggcatccccgactatcgggggcccgggacgcgggcgcgggcgcgcaaccccattcagcatcgcgagttcctcacgcgccccgaggtccgggcgcgctactgggcgcggagcctgatgggctggccgcgcttctcctcggcccggcccaacgctgcgcacgcggcgctggcggagctggagcaggcgggccacgtccgaggcctcatcacccagaacgtggacgggctgcaccatgccgctggcagctcgcgggtgattgagctgcatggcgcgctggcccaggtccggtgcctggcgtgcggcgcgcaggaggcgcgcgaggcgttgcaggcgcggctgctgtcactcaaccctggcttctccctcgaggtgctggagctgcgtccggacggtgacgcggacctgacctccgagcagctgtcgtccttccaggtccctgcgtgcctggtgtgtggtggaacgctcaagccggacgtcgtcttcttcggcgacaacgtgccggttcccaccgtggcgtcggcgttcgccctgttggaggagggcgacgcgctgctggtggtgggctcttcgctggccatcttctccggctaccgcttcctggtgcgcgcgtccgagcgccggatgcccatcgccattctcaacctgggggagtgccggggcgtggagctcgcggacgtgcacctggaggcgcgggcaggggatgcgctcccccggctcgcggcggcactggcccggagctga

SEQ ID NO: 7066 - DNA, 963 bp, Myxococcus xanthus
atgtcgagccccaccgagtctgccgtgcaccctcgccgcttccatgccgagtccctggtccacatccatcggcacttgctggcgtcgctccgggcggggcccgtcaccatcgaggtgccagacccggacctgggcaggggttgctaccccggcgagcgggtgggcccgtccggcgcgctgctccatcggcccctgcgcagttggtgcgacctggcggaggggctcgcgtgccggctgctcacgccccgcgcggtggatgcgacgcacatcgcgctgaccttcgagcggctggggcccgaggcgacctggcacgcgggaggccaggcggacgaagcggtgtcactgcaagaacgctatggcgcggcctccgcgttcgcgcgcctgcgcaagctggaggacgcgggcttcttgctgccgtggctcgaagcgcttgggcgcatccggttgccggagtccggccgcgtgctcgacctgggtgtcaaccgcggggatgagctggcggcgttctcgtggctggaggaggccccggatgtgcgcttcgtgggggtggaccacagcgccagcgccatcgaagaggcgcgtgcccgcttccccgatgcgcggcaccgcttcgtcgtcgccgacctcaacgcgctgccggaggacctggggcgcttccacctggtggtgtcggtgggcacactgcagagccctggcgtggatgaccatgccctgctgcgcaggctggtgcaggagcacctggagccgcgctcggcgctgctgctgggcttcccgaattcccgcttccgggatggtgaggtcgtctatggcgcgcgggtgcggaacctgcgcgagcccgacctgtcgctgctggtgaaggacctgtctttctaccgtcgctatctgcaccagcacggcttccgtacgttcctgggcggcaagtacgacctgctcctcaccgcggtgcggggcgcgagtgattga

SEQ ID NO: 7067 - DNA, 603 bp, Myxococcus xanthus
atgaacacatccctgcggttgaagctgctcggcaccctggtggcgcatgactcgcagtggtcgctcgcctcggtcgaagacctcgacgcgaagcgcatccgcagcgtgatgaccggtgacgacctgcagggcgctcgcgtcgtctccatcgagcgcgagcgcatcaccttcctgatggacggccaggaggagttcatccgcgccgaccgccatggaggcgtctcacacgcgcccttcctggcgaacgccgcgcccgcgcacacgggcgtccgcgcggtgggtgcgcatacctatgaggtgtcccgccgcgctgtcgaagacgcgcttgccaatatggacggcctgctcacccaggcccgtgtggtgccagccttccgcgacggcaagccccagggcttcaaggtcttctccatcaagaagggctccctctacgagcagctcggcatccagtctggtgacgtgctccggcgcatcaatggcgtctcgctcgacgcgcccgacagagccctggaggccttcatgctgctacggggcgcttcgcacctcgagctcgacatcgagcgaggagggagcccggtccgcaaggtgtacgacgtgaggtga

SEQ ID NO: 7068 - DNA, 570 bp, Myxococcus xanthus
attgcgcggattcaacctggggacttccggctcacggcgaaccagaacctcgtcatcgcaggtgtgacgccctagtctcgcgacgccatcggcgcgctggtgacggcgcacgcgctggacagcttccgcagcgccagcccggtgcgtcgcaacgcgctggcgtgcgtggcgctgccgacgtgcgggctcgccatggcggaggcggagcgctacctgcctaccttcgtgggacggctggaggaccggctgcgggcgcatggcctgcaggacgccaacctgctgctccgcatcaccgggtgccccaacggctgcgcgaggccgtacctggcggaggtgggactcgtgggcaaggcgccgggccgctacaacctgcacctgggcggagatgcgcgaggccagcgcctcagtcacctctacagggagaacatcgacgaggacgccatcctcgccgcgctggagccattgttcgaaggctacgcacgcgaacgtcagcccggtgaaggctttggcgacttcgtggtgcgcgctggccacgtccccagcccagccgttcagcctcggccgtcctga

SEQ ID NO: 7069 - DNA, 2019 bp, Myxococcus xanthus
tccgggacatcacccgccatcaaacaggcggaggcagcgcttcgcgcggaggaagagaagttccggagcctctacaggtacacgcccgcgatgatgcactccatcgacgcggagggccggctggtcagcgtcagcgagttctggctgcgcaccctgggctattcgcgcgaggaggtcctgggccgtcgctccgtggacttctttacgccggagtctcgccggtatgcgaccgagcacgtcctgcccgtgttcttcaagacgggcgtctgcaaggacgtgccgtaccagattgtgaagaagaacggcgaggtgctcgacgtcctcctctccgccatctcggagcgggatgcgtcgggccggatggttcggtcgctggcggtgctgaccgacgtgacggagcgcaagcgcgccgaggacgcgctcgccgagagcgagaagcggctgcgcgccatcctggacaacgccaacgccgtgttcttcatcctcgaccggcaggagcgctacatcttcgtgaaccgcgagtgggagcggctcttccaccgcacgctgcaggaggtcgccgggaagtccactgcggacatcttccccgggccgcaggcggcgcgcttccatgagacgagtcaggctgtcttcaccaccggggagctcgtccagcgggaggagtgcatccccctggaagacggcgttcacacccacctcacgcagaagttcccgctcatcgattcgtcgggcacgctctatgcgctgtgcggtatctccaccgacgtcaccgaactcaagcagatggagctggggcagcgcttcctgtcggaggccagccaggcgctggtgacgtcgctcgactcggagaccacgctccagcgcgtggcggagctgtccgtccccaccctgagggagctgtgcgtcgtctccctgttggggaaggacgcggcgctgcgccccgtggccgtcgccgccagttcgcccgaagggggccgcaccgttcgcgagttcctccagacccatccccccgtctccggtccgcgggatggtccttatggggtgctggagacgggacattcggagtcgtctccggatgccatgggcctgctggacccggatgggctccgagacgaacggtggagcgcggtgcgggcactgagcgctcgggcatccctgaatgtcccgctgcgagcgcggggccccatcctgggcgtgctgtccgttgtcgcggcgcatccgggacgtccgtatggcccacgcgagcgctcattggccgaggaactggggcagcgcgcagcctttgccatcgagaacgccgagctctatcgcaaggcccaggagtccatccgcgctcgcgacgagttcctgtcgattgcctcgcatgagctgaagacgcccgtcacctccatgaagctgcgtgtgcagcaactgactcggaccctgtctcggcaggagtccggacagcttcccgtggagaaggtggccgccctgctggatgtcttcggggaccagctccggcgtctgtcgcacctggtggagcacctgctggacgtgtcgcgcgtcaacgagcgccaggtggacctgcggctcgaggacatggacctggtggcggtggcccgggacgtcacgggccatctgcggggacagatgggccgtgcgggctgcgtgttcgaactggtggcgcccacgcccgtcctggggcgatgggaccggctccggatggagcaggtgatgatcaacctgctgaccaacgcgatgaagtacggcgccggcgagcccatccgcatggaagtgtcacgcgtcggggagggtgcccgcatccgcatccaggaccatggcgtgggcattcccctggaggcgcagccgcgcatcttcgatcgcttcgagcgcgccgcgtcccgcaactacggaggtctggggctggggctcttcatcacccggaggctcgtggaagcgcacggcgggacgattcgcgtcgaaagccagccagggaagggcgccaccttcgtcgtcgaccttcccctggaggctcgctga

SEQ ID NO: 7070 - DNA, 447 bp, Myxococcus xanthus
gctctaaagagcctgctggtggcggccttcgcgctgtacgaagaggcccgcatggcgcccacgccggccgcgcgtgacgcgctgatcgccatgggaaacaactacatcgcctggcgtgagcagcacgacatggcccagcctgtcttctcccccgccgttcagcgcccagacgaggtctcgcgcgtcgaactgctgcgcgccatcaccccgctgctgtccacggacttcgggacgatgacgtggacgtacgcggacttcgcctacagccggccggaccgcgacggcaacccgctcacctcgccgcccactgagtacaactgggccctcttctgggaccgctggacgggcattctcttcgcattcgacgcggcctatcttcagcccacggcgctctgggtcatgcctgaacccctggtggaccccacggcggcagcgaacggaggctga

SEQ ID NO: 7071 - DNA, 816 bp, Myxococcus xanthus
gaactcgacatcgcccgccgcgtagcccgccaggcgggagccatcctcctggaggtctacgccacgcccttcgccgtccatgacaaggcgggaggcatggggcccgtcaccgaggccgacgagcgcgccaacgccttcatcgtggaagcgctgcgcgacgcatttccttccgacggtgtcgtggccgaggagtccgacaacacctccggcgcgagccgcttcgagcgctgctggttcgtggaccccatggacggcacgcaggagttcgtcaaccgcaacggcgagttcgccatccacatcgggctcgccatcgcggggaaggccacgctgggcgtcgtgtaccggcccgttggagacacgctgtactggggcgtggtggggcagggcggcttcgtggagcacgcgaaggggcgccgcgccctgcgggtgtcggacacggcggagccgtccgcgctgcggctggtggtgtcccgctcacaccgctcgcgcctgacggacgcggtggtccggcggctgggcatcacgcacgagcaggcgtgcggctccgtgggcctcaagtgcggtctgctggcggaggccgcctgcgacctctacctgcacgtcagcgacaagagctatcgctgggacaactgcgcgcccgaagcggttctgcgcgcggcgggcggcatcctcacggacctgggcgggacgccgtacgcctatgacggttcggagctccagaaccgccgcggcctgctggcctgcaacgccgccgccttcgagcacgtggcgcccgtggtggccggattcgcccgcgaggccggcatccttcgctga

SEQ ID NO: 7072 - DNA, 948 bp, Myxococcus xanthus
atgccgcacatcgtcaccctgacgctcaacccgaccatcgacgtggctacgtccgtgccggaagtcacgccggagcacaagctgcgctgtggccccgtgcgcagggacccgggtgggggcggcatcaacgtggcgcgcgtggtgcgtgagctgggcggtgaggccatcgccgtctacacgcggggcggggccaccgggagccagttggaggagctcctggaggagaagggcctgctgcgccgctccgtgccgttgcaggacgccacccgggagagcttcacggtggcggaaggcacgggcgcgcgtgagtatcgcttcatcctgccagggcccacgctgtccgagcgcgagtggcagcgctgcctcgacgcactggaggacgtggccgtgggcgcgacctacatcgtcgccagcggcagcctggcgcccggcgtaccggaggacttctatgcccgtgtggcccggctggggaagcgcctggccgtgcgcgtggtggtggacaccaacggtccgccgctgcgggccgcgctggaagagggcgtgttcatggccaagcccaaccgccgcgagctgcgggacctgagcggcgcgtcggtggaagacttcgccacccaggccgccgcggcgcgcgagctggtggcccagggccgcgccgaagtgctggcggtgtccatgggcgcggacggcgcgctggtgacgacgcgcaccgcccagttccgggcgacgccgcccccggtgcggacgtacagctcggtgggcgcgggggacagctttgtcgcggggatgacgcttgcgctcgcgcggggccagtccaccgaggacgcgctgcgctggggcatcgcctccgggacggccgcgctgctcacccaggggacggacctgtgttaccgggcggacgtggagcggctcttcacccaggtgaaggcggagccggtgtcgcgtccgtag

SEQ ID NO: 7073 - DNA, 239 bp, Myxococcus xanthus
atgacgcgaggcacggattcgggtgggcagaactaccagcgcgacaacatcgcgcggcagctcacgcagtgggagtcctacggcgtgacgacggtgacgtcgctgggtctcaacacgccgctcatctacgaactccagaaggaggtcgagcagggcacgctgccgggcgcatccatcctcagcggggacccaggcatcggcgtgccggaaggggcgccgccgatgaaggtcgtcgagca

SEQ ID NO: 7074 - DNA, 561 bp, Myxococcus xanthus
atgaacgtatcgcagctactcctggagcgcggcttcgagaccgcgacagtctcggaggccctgggccaggtaggcgtcgcgctcgacgtcgaccgcgtctacatcttcgagaacgccaccagccccacgggcgagctgctgtgcaaccagcgctacgagtggaccgcggccgcggcctccgcgcagttggacaaccccgagctccagaacgtcccctactcggaggtcatgccctcctgggtcgcgccgctgtcgtcgggcaaggccgtccagggaccgccccgtgccttcccgtcgcccgctcgggagctgctggaggcccaggacatccggtcactgctggtctgccccatcaccgtgggcggcgagtggtggggcttcgtgggcttcgacgactgccggacggagcgcaagtggccgccgacggaggtctccgtgctccaggccctgtccaacgcgctcgcgggctcgctccgccatgcgcgactgcgcagcatgctctccggcgtgcagtcccagttgcgcaccatcatccagcgctgcgagacgacggcgtcctga

SEQ ID NO: 7075 - DNA, 501 bp, Myxococcus xanthus
atgccggacgtcatcgcgccccggctgcgcgtgctcttctgcggcatcaaccccagcctctactccgcggtggtgggctatcacttcgcgcggcccggcaatcgcttctggcccacgctgcatgccgcgggcatcactccgcacactttccaacccacggagcaggaggccttgctcgcgctgggctacggcatcaccaacgtggtggaccgcgccaccgccaccgcggacctgctgaaccccgccgagctggcccggggcgcgaaggcgctggaagccaaggtggcgcgctaccagccccgcttcctcgcggtgctgggcgtgagcgcctaccgcatcgcctttggccgtcccaaggccgcgctgggcacgcaaccggagcgcctgggcgacacgcgcttgtgggtgctgcccaatcccagcgggctcaacgcgcactaccaactcgacgcgctgggccgccttttcgccgagctgcgacgcgccgtggagcagggctga

SEQ ID NO: 7076 - DNA, 903 bp, Myxococcus xanthus
atgacgttggagcagctcgagcacttccgccggttgagccacgtgacccgggacacgctgattggcgacgcgcaggtcagctgcgttgactacagcatccccgggtaccagggcgccgaaatcgtggtctcggtcattgcccggcaaggccactcggttcccggtcccgccgtctatcacatccatggcggcggcatggtgatgggcacccgcttcgcgggggcgaagccgctcgtggagtgggcgctccgccatgatgcggtctgcgtcaccgtcgagtaccggctggcgcccgagcatccagcgcccaccctggtggaggactgctacgccggcctggcgtggatggcggcgcacgcggacatgctccggtttgatccgaatcagctggtcatcttcgccggaaccgccgccgaaggcctcccggcggccaccacgcttttggctcgggaccgccagggccctcggctgctgggccaacttctgcaatgcccgatgctggatgaccggaacgagacggaatccgcgcaccgatacgatggcgtccgcgtctgggaccgcaccagcaatctgaccgcatggagagccgtgctgggagacctttgtggaggccccgaggtgtctccgtattccgcacccgcgcgagcatcggacttgagcggactgccgcccaccttcatcgacgtcggaggagcggagacgtttcgagatgaagctgtcgcctatgcccgcggaatcctggcggcgggtggggagtgcgagctgcacgtctggggcggagccttccatggcttctatgacatcgcgccgcagtccgacctggcgcgcgcatgcatcgcggcacgcgacgcgtggattgcacggatgttcgcccgcggcgccatgagcccgtgccctccgtaa

SEQ ID NO: 7077 - DNA, 348 bp, Myxococcus xanthus
atgccgggctcgctgagctactccggcaaggtcttcgaactcttcgcgtcggatggcacccccattgacggcgttccattcgtccgagcctccggggagatgccgtccaacatcgtcgccgcggtccagcgcctgcaggcagaccgggtctgggacccgacgccttgtgtgcatgacctccagacagggttcgcccgtgaccggtactgccgcaacatcgctgtggactggtccaacatgaacgcggacgcaaacgtcatgcgcatcgccggggactcgccgctgacgacgcccgggactcggacgcagtggagcagcccactgccttcacgctggggcacctactag

SEQ ID NO: 7078 - DNA, 390 bp, Myxococcus xanthus
atgaactccgcccgcgcgttcgtggacctgctcggctcggtgattccggcccagcgtgccgcgccggtcgctgctgcccgccactacaacatcgagtccctgggcccttccaacgcgatgcagcaggcggcccatgcgagggaggttctcccctccctgctgggcctgctgaccgatgagcgcatggcgcgctgcgtcgacgaggccttccgggaaatcttccagggcgaccggtggccgcgtggaccggagcggtccaagtggctgggcttcgcgcgtgagcttcgcgccaacgaccccaaaatcaccgccgagcaggtccgctctgccatcgcgaatgagctgcggctcgagcgggacgggctggatgtcgcgacggtcgagaacatc

SEQ ID NO: 7079 - DNA, 486 bp, Myxococcus xanthus
cccaacggtgagcacatcgaccagatgaaggcgctggtggaggggctgaagaagaaccccgactcgcgccgccacatcatcagcgcgtggaacgtggcggacctgccgtccatgaagctgccgccctgccacgtcctcttccagttctacgtggccaacgggcggctgtcctgccagctctatcagcgcagcgcggacctcttcctggggctgcccttcaacatcgcctcctactcgctgctgacgatgatggtggcgcaggtgacgggcctgcaggcgcacgagttcatccacaccgtgggcgacgcgcacctgtacctgaaccacgtcgagcaggcgaagacgcagctgtcgcgcgaaccgcgccccctgcctcgcatacacatcaaccccgaggtgacggacctcttcgccttcaagtacgaggacttcacgctcgaaggctacgacccgcaccccgccatcaaggcgcccgtggccgtatga

SEQ ID NO: 7080 - DNA, 480 bp, Myxococcus xanthus
atgaaactgtccgccatcgtcgccatggcggcgaaccgtgtcatcggcgcgggcaaccagctcccgtggcggctgcccgcggacctcgcgcgcttcaagcgcatcaccatgggccacaccctggtgatggggcgcaagacgtacgagtccatcggccgcccgctgccgggccgcaccttcatcgtcgtcacccgccagcgtgacttcgcgcccccgggcgtccaggtggcgcactccgtggacgaagcgctctccctggcaaaggccagtggcgactcggaggtcttcatcgccggaggcgcggacctctacgcccagacgatggaccgcgtgcagcgcatctacctcacgcacatcgcccggaacttccctggcgacacctggttccccgacgtggacctgtccggttggacatgcgtcgaagagcaagcacatcccgacgccgagccaccccacaccttcctcacctacgagcgctga

SEQ ID NO: 7081 - DNA, 1428 bp, Myxococcus xanthus
gtgctgcaggagatgatgggcgaggccttcttcacgctcgacgcccacggccgcgtccgcgagctgaacacgcacgccgccgccctgctgggtgtgtcggccgagcaggtgcgcggccaggagccctggcttgcgcagcccgagctttcgggcacggtgctgcacgaacggctgatgacggcgctgaccacgcgtgagggcggtcgcttcctggcggagctgccgtcgcggacctggctggaggtgacggtccgcgtggtgggtgacgagacgtgggtgctggccacggacatcacccagcgccagcacgcggagaacgaagtggcgcgcaccgaggagcgcttccgccagttgggcgagcgcttccaggtggcactcgactccgcgcagatggccgtctgggagacgaacctcgtcaccggccaggtgttccgctccgaggcgcatgaccggctctacggctacgcgcagccacaggcggagtggacgcacgagaagttcctcgcctccatccacccggaggaccgcgcggaggtggaggcccaggtcgccgcgctcttcacccggcacgtggacgcctacacgtccaccttccgcacccgctggccggacgggagctggcactggctcaccagccgggcgacggtgattcgcgatgccacgggcaacgtcgtggtggtgcgcggggccatcctggacatcaccgcgctgaaggagacggaggccgcgctgcaacaggcggtgcgcacgcgggacgacttcctctccatggccagccacgaactgcgcacgccgctgacgtccctgcgcctccagttgcagttgctgcggcgcctgggcgcctccacacctggcgcgacgctcggctcggacaaggtcgccgggaagctggacaacacggagcgccagttgcgcaggctgggcgcgctggtggacaacctgctggacgtcagccgcatccagacggggaagctggacttccagttcgccgacggagacctggcaagcgtggtgtcggacgtcgtctcccgcttcgccgaggaggcccgcctggcgggcgtgcgcctggactcgcacgtggacgcgccggccccgtgccgcttcgaccggctgcgcatggagcaggtggtgagcaacctgctcaccaacgccttccgctacggcacgggcaagccggtgaaggtgtcgctgacgtacgcccccgacaggacccggctggtagtgcaggacagcgggccgggcattcccgcctccgaccgggatcgcgtcttcgagcgcttcacccagggcgacaacgcccagcggcgcggcggcctggggctggggctccacatcgtccggcaaatcatcgacgcgcacggcggccgcgtccacgtggaggaaacgcccggaggcggcgccgccttcgtggtggatttgccacggtag

SEQ ID NO: 7082 - DNA, 189 bp, Myxococcus xanthus
atgatggcctgtggcggccccgtggaagaggctcccgtggacgaaacgggcagcgccgcgcaggagctgcgccggtgtgacctgcaggggcgctgtgccgccaacgaggtctgcgtgggcggccccgatggcatctgctacccgtgcaaccgctacccgcagtactgcgaaatcatcatcgagaactag

SEQ ID NO: 7083 - DNA, 1854 bp, Myxococcus xanthus
atgactcgcgccgcctcgctgctgctgttcctcctgcttgccttgcctatcgcgtcccgcgcggacgacggcgcctccgaggaacgcacgtggcaccggctcatcggcatcctccagtacctggaggcggactatccgctcgccatcgagtcgcagtccgcgttcgagctggcggagcagaagagcttcgcggcggaggcggtggacgcggcgcgcggcctgggccccgcggcagcggccttcctgccgcgcgtgcaggacatccaggcccgcgtggacaagggcgaggaccctgacggcgtcagccgcgagtgcggtgagctggtggagaacctcgtcaccgccggagggttggcccgcagcccacgccgcccgccggacctggcgctgggccagtcgctgttcgccaccaactgcgccgcgtgccatggcgccgacggcagcgcgaacgtggccatcgccgccaacatggagccggcgcccgccaacttccaggacgcggagctgatggaaggcctcacgccgtacaaggccttcaacaccaccagcttcggcgtgcccggcaccgcgatgccggcctaccccaccctgtccgaggaggagcgctggtcgctggccttctacgtcttcaccatgcgcctgcccgagtgcgagggcacgccgccgcgcgtctccctggagcggctggccaacgccaccgacgcggatctggtgaaggagttcggtcaggagaacctcgcctgtctgcgccggaagatgctggacgcggacgaggagcgctcgctgctcgccgcccgggagaacgtgcagcaggccatgcgcctgggcgccgcaggtgacatcgcgggcgcgaaggcggccctgctggacggctacctcaacggcgtggagccggtggagcccaagctcagcgcgcgcgactcggcgctgacgctgaaaatcgagcagggcttcctcaaggcccggatggcggcggagcgcggcagcccgcaccttcaagacgagggccgggagctgctggccctgctggaccaggcgcggcgtgactcgggcaccaccgcgagcctgctgtccacgatgtggctgacgctgctcatcctgctgcgcgagggcttcgaggcgaccatcatcgtcgcggcgctgctggccgcgctgcgaaagatgaaggccaccgagcacgcccgcgtggtgcatttcggatggatttccgcgctcatcgtcggagcgctgtcctacgtgctcggccgccacctgctggccggcgcccagcgcgagtggatggaaggcatcgccgcgctcgcggcggtgggcatgcttgtgtacgcggcgctgtggctcaacgcccgctccaacatcagccagttcatgggcgagctgcgcgagaagatgcagggcgcgctgggccgaggcagcatgctgggcctgttcctcatcgccttcaccgccgttctgcgtgagagcttcgagacggccatcttcctccaggggctcgcgctggactcgccacagggcgtggcctggggcgcgctcgcgggcgcggtggccatggtggtgatggtcctcttcatcaaccggctggggtaccgcctgccgatgaagacgctcttcaacgcgtccaccgtcatcctggtcctcaccgccgtgatgctgctgggcaagggcctccactcgctgcaggaagtcggcgcgctgccgctcgcgcccgtgcccttcatcaccgtggacatgctgggcatctatccggacgcgctctcgctcgctccccagctcctgctgggcggcatcccgctggccatcgtgctgctgcgccgcaagggccgcccccagcctgtttccgaggcctccgctggttag

SEQ ID NO: 7084 - DNA, 460 bp, Myxococcus xanthus
atgctggtcctctcgggccagaacgccgcttgggcgcaggagctccccgcgagcgaacccgcccgggcacccgcctccgagctgacgccgccgcccctggttccagccccgggcggctgggacgcgccgacacgccacgacgaagacgccggggacgactcccgcacgagccaggagacggagggcacgacctccgtcaatgaacaggcccttcctggcaaggcccgcgcccgcgccacggaccccgtgccacgggtggcggtggagttcctgggtggcgccggtggcggcatcatcgcgggctccctgggcctcatcacgggcttcttcgtgggtgcgtccacggtgggctgcgacgagtgcggcatcgtcgcgagcgtcggtggattgacgggtgtcgtggtgggaatcccggccgggacatggctgggtggaaagctcatgggcgggcggggcacct

SEQ ID NO: 7085 - DNA, 3813 bp, Myxococcus xanthus
cggctgctccatgtggaggatgcgctggagtcttccggtgccctggcggagcgtccggccccagccccggaagcgctggcgtggcttctgcccgtgggcgccaaccagtcgccgtgggccctggtgcaccaggggctcaccgagctcttcgacgcgctcgacatgcggctgcgcccctcggagggcgccacgtgggtggccgccgcggagtcctcggcggagcgtcctgagctggaggccctgtgggccctgtctcgtggactgaccgtgacgttcccctccgagcaggtgacggctcagtgggaagtgctccagggcggcggtccgcgccagggagcgatggacctgagcctcatctacttcgccaacgatgaagactcgctcgtcggcccgaagtacgagctgctgattgaaggcgcgaagtacgcggatgccaacggcttctcggcggtgtggacaccggagcggcacttccactcgttcggcggcctctatccccagccggcggtggtggcgggcgcgctggccaccatcacccgcaacctgagcctgcgctcgggcagcgtcgtcctcccgctgcatgacccgctgcaagtcgccgagcagtggtccgtggtggacaacctctccggaggccgcgcgggtctgtcgattgcgacgggctggcacgtggcggacttcaccttcgccccgcagaacttcgaggaccgccgcaacgtcctcctgcggaacctggagacggtccgcgccctctggcgaggcgagaagctccgccgtccgggtggcggcggcgtcacggtggaggtgggcctgcggcccaagcccgtccagaaggagctgcccgtgtggctcacggccgccggcagcccggagacgttccgcctggctggcgaggtgggcgctggcgtgctcaccggattgctcacgcagtccttggaggagctgaagcagaaggtggccctctaccgcgaagcctggcgccgcaacgggcacccgggccgagggcacgtcgcgctgatgctgcacgcgttcatcggcgacgatgaacaggaggtgctgcgcacggtccgcaagccgctgctcagctacttccggagctcggcggagatcaccgccacgctgctggccgcgcagggctaccagggcgaaatcgacaaggtgtccgaggaggacgtgaatgccctgctcgaacacaccttcgagcaccacgcgaagggcaccggcctcatcggcacggtggagagcggcgtgcaacgcctgctccacgtccgggaagccgacgtggacgaggtggcctgcctcatcgacttcggcctggacacgccagtggtgctggagggactgcgccggctgaccgtgattcgcgagcgcctggtgcaggacgcctcgcagcggaaggtccagcggcaggcggagggaacgctggcggtcgacgagctgctggcgctggcccggcagtcgggcgccgtcctgttgcatgcctcggcgcggctcgcgcgcacgctggtggagttgccgcaggcccgcgaggccctggagcccgtgggcgcgctcgtcctggacggcgcctccgcggagctggccttgtcgctgcaccggaacctgggaacggaggtcctgctcgcgggcgccgctggcgagggaggcctgctgcctcggcctccctcggagcgtgtccccgaagggctccagtcctgggtgctggacgcggccggattgccggttcccccaggcgtcgtgggtgagctggccctggagggcgcgggccttccctgggacttgtggcgcgccaacgagcaggagcgccgccgcttcgtgcagcacccgtcgagcagctcggcccggctcttccggaccggacggcacgcgcggctccgcgtggacggccgcgtggagcacgtcaccctccccgccgcgcccaaggtgcaggcccccgtggccgcgcagaagcccaagcccaaggcgccttccgtgccagcgctgcaacccgagcactcggcgattccccgcgtgccccggacccggccgctgcccctgtccttcgcgcagcagcggctctggtacctccagcagctcgacccgagcagtacggcgtacaacaacggatccagtttccgcctcactggtccgctgaacgtcgaggcgctccaggctgcgctcaacgaggtggtgcagcggcacgaagtcctccgcaccacctaccagctcacggaagaaggcgcggtccagctcatccacgcggagggctcgctgccgatgccggtggaggatgtccccggcgagacgccggaagcgcgtgaagcggagatgctgcggcggtgcgcggcgctcggagcgcttccgttcgacctggacaaggggccggtggcgcgcgcggtgctgctccggatgggactggaggagcacgtcctgagcctgatgcagcaccacgtcatctccgacgcctggtgcaccctggtgctgggccgcgagctgtcggtgctctacgcctgcttcagcgcgggcatcccgtcgccgcttccgccgctggaggtgcagtacgccgactacgcggtgtggcagcgccagtggctggaaggcgcggtgatggaggagcaggttcggtggtggaaggagcggctcacatccgtccccgcgctcgagctgcccacggaccggcctcggcccgcggtgcagtcctacgcgggcggcagcttccgcttcgagctgccctccgatgtctcggagcccctcctcgccttcgggcggcgcgagggcgccacgtcgttcatggtgctcatggcgctgttccaggcgctgctggggcgcacggcgggccaggaggacttcgcggtgggcatccccacggccggtcgttcccggccagaggtggagggactgctgggttgcttcgtgaacacgctcgcgctgcgctcgcggttggagggggcaccgtcgttccgggagttgctgggccgagtgaagagccagtcactggatgcgttcgcgcatcaggacgcgcccttcgagcgcatcatcgaagcgctccagttgccgcgtgaccagagccgcacgcccgtgttccaagccgtcctcaacgtggtcaacacgcccaccgtggacgtggcgcatcaatcgctgaagttgagccagctcggcatcgaggcggatacctccaagttcgacctgagcctggaaatcgtcgagcgcaagaacaccctgttctgccgtttcgagtacgcgtcgagcctcttcgatggcggcaccgtgcagaggctcgcgggccatctgattgaacttgcccgggccgtcatcgtcacgccggacctgccgctgcaacgtgtcgccatcctctcggaggacgagcgccgccaggtactgaagggcttccagggacgtgagatggcgcccgcttccgaggcgagcatccacgcgctgatggaagcgcaggtggcgcgcacgccggacgcggtggcggtggcgttcgagtcggagcggctgacgtaccgggagctggacgcgaaggccaaccaggtggcgcaccacctgagggggctgggggtggcaccagagtcgctggtgggcgtgtgcctggagcgctcggtggacatggtggtggcgctgctgggcgtgctgaaggcgggcgcggcctacgtgccggtggacccggcgtacccgaaggagcgactggggtggatgctggaggacaccggggcgtcggtactgctgacgcacgagaagtggaagacggtgcttccgcccagcgccgcgcgagtcgtgtgcctggacagcgcagcgggagaagtggcgaagcagccggtggcgaagctttag

SEQ ID NO: 7086 - DNA, 576 bp, Myxococcus xanthus
atggccgccaccctggggctgatggcctgtgcgcggcaggtgcccgcctcggctacgcccacctccacctcgaccgagccccgtgccgttcggctcctgctggacacgcccgcccgggagacacacacgctgaccaggctgcgcgaagacatcgaggtggacgccaccgaaggcgagcgcacgccgcgcgtcgtcgccaccggccagacgcccacgctgagcctcgacggacaccgggcccgcctctacggcgacgcgaagggcacgctcggcatcgccgtggacaacttcctgctgctggaggtgctggacgccagtgggcaggtgacccggcgcgccacggtgggcttcaccgaggcggtccacatgggccgggagcaggtggacagcgtgggccgccgcgccttcaacttcgaggcgggcgaagtggacatcacccacctgctgcccgactccgcccccttccaggtccgcgcgaccgcgctggacacctggggcgtgggacgggtgagcgacgtgtacctgctgctcgccccgggcagccgcgccgacaacgacgacctgcgcgaccagtag

SEQ ID NO: 7087 - DNA, 543 bp, Myxococcus xanthus
atgcaccgcgccctgcccacactggccctccacctcagtgtcctctccctcaccgcgtgctccgcgaaggcgccgccccggacggagcccgtgccgccccctccacccgcggtgaagattcccgccagctgtgagcagaaccagggcggcgagtaccaccacgcggggaatccagccttccggtactacggcgacgatgacggcagcacactctcactcgccgtcgtccgcgcacatgactcggcagcggtggacgccccggacgcgggctcgccgtccatcgtcctgcggcgcacccccgcgggcttcgtgggcgaaacgcgtgccaccggcttctccggcgcggggacgccctgccccgtcacctttccgacagaggtggtgcggtgcacggacgcgggcctgacgctgcgctcggcggccagcacctccatcgacgaggactgccgcacggctccgtcgggcgcccccagcgtgcggctggagcaggtgctgctgcggggcccgccggacgcgggcacttcgccggacgccggcacctag

SEQ ID NO: 7088 - DNA, 816 bp, Myxococcus xanthus
atgggcgaggtcccggagcgggatgggcgggtgcgctacgccttcgccgccgcggcggtgcgcgactttcccctcttcgtgtcgcggggctacgccagctccaccgccacggtgaatggcgtcacggtggagagccactacgccgcggcggaccaggccgcgggcgagcgcgtgttgaagtacgccacgtcgatgctggcggagttcgagcgccgtctggggccgctgccgtacacgcacttccgcgtggtgcaggcgccgctgtcgggaggcgcgggcggcatggagttcccggggctggtcaccatcgcgacgcaactgtatcgcggcgcggcgggggcctccgagatgctgggcggtagcatgcagggcatggaggacctggaggcgatgctgggcatgctggggcagagcgggggcgggggaggggtgctggggcagctcaacggcgccatggagcgcacgctggagttcaccgtggcgcacgaggtggcgcaccagtacttcgcggggctcgtgggctcggaccccatcctggagccggtggtggacgagtcgctggcccagtacgccgcgctcctctacctggaatggaagcacggcaagaaggtggcggagtcggtgcgccaggagacgctggtggggcagtaccacctgtaccggatgacgggtgggaaggacggccgcgcggaccggcccacgggccacttcgcggatgagatggagtacggcgcgctcgtctacggcaaggcgcccctgctgcaccacgcctcgcggaagctggtgggagacgccgccttcctcaaggccctgcgc

SEQ ID NO: 7089 - DNA, 531 bp, Myxococcus xanthus
atggtggacgggcagcaggtgggcgccgtgccgcaggccaacgtgttgctgcgcccgggttcgcgtgagattgagttccgggccccgggcttcaagccggacgtgcacaacatcaccgtgttcgcgggccggacgtacgaggtgacgggcaacctgcggcccctgctggacacgtccgtggccaccgccgacgtgccgaagaacccggtgttggagccgtcctcgaagctggaccccgacgacgagacggccccgggcctgtcgttcgcaggggacccggagacgcccgaggtggagggctccaagccgtggtacggccgctggtacgtgtgggctggcattggcgcggtggtcgccgccggcacggtgggcgcggtgatggcgacacagggtggtggcgccagcccgctgagccccgatgatgtgtgcaggcccgccaactgtgacgccgtgctgggtggcatccgctcggtgcgcggtggaggtgtgcggcttcaggctcctcctcccgccggcgcgatccgcttctga

SEQ ID NO: 7090 - DNA, 1062 bp, Myxococcus xanthus
gccgcgcctgacttgacggtgttcgaggtgctgccgattctgacgtctgtcaatgcggacgcccccatccctggcctgttcgacttcatccggcgccgcccctttgtctatgaatcagcggtgctcaagcatggtgagcgccgagtcgacctgcggggagcccaactgtcccggctcacgctcgacgtgacgggcgtccacgagctctatctgaacgacggccttgaggacctgtccctggtcggccagccggacccggcgctgaagattcacggcgaggcggatgggcgctggctgaccttgtccctgggcgctccggacatgccctggtccggtctggacacactggacagccttcatctgcgggccgcgcgcgacgtggatgcgtcgcgcatcgtgcggcgctttccgaacctgacggagctgcgcatctggggagccccgggctacctgagaaacaccgaggagctggcgaagctcccggccctggccatgctgacattgagcgacctgttcgggatgtcacccgacgagtttcccggtccggagcagctcccccacctgggcatgctgtggttgacgagcattcccgcggacgtcgccgcccaggtgaagaaagcctacaaggccgctgcgcgcgagggattggacctgtcggtgcgacagccgcgcaaggccgactggctggcggagaacctggacaacccctttcgcgtctgggacggagccgacaacatcagtccagcccaggcgaagaaggcctcggcgctgtaccgccaggcacggtcggccgcgctcaagtctgtatccgaaggagaccgctcccccgccgccttagtgtccgcgctcacccccatcgtcacggcctacaccgatggcttcaacaagctggatgcccgccacaccttcatcttcaccgaggagcgtgagcagatttatctcgcgctgatgggcatcttcgacgcagtggatgaaaagctccggtccacggaaggaactcccgccgagccgctcaatcgagatgccctggtgtcggtgatggattcgattcgagacttctag

SEQ ID NO: 7091 - DNA, 762 bp, Myxococcus xanthus
atgcgcacttccctcagcttcgcgtccctcctcgtcgcatcttccctcaccgttggctgtctcggccccgagacggacactgatacggatgcggttcagtccatcgagcagcaggccacggaccccttgttccgcgtccacaacatcgtcgaggcggtgctcccggccgccaactacgacggtgtcgctggcaacgagtgcatcgcgctcgtgaaccccgagcaccgactccgcaagatcatcatcgtcgagacggccggtgccaacggcgcttgcgcgctcaatgcctacagcgctggcggcgccctcagcttcacctggggcgacaccgccgtctaccagggcccggccggcatcgcctccatccgcgcggcgctctccgacaccgatggcgccgtgcaccgcctcaccggcacgctcacctccgaggccaccaccctggcgcacctgcagtccttcctcacgcagaccaacacccagcaggccagccagctcgccacgttcaccgcggagcgcgtccactcccgctacgacttcgagggccaggagcaggtctacgccgaggccgcctaccaggccgtccgagtcacccagccctgtgagaaccccggctacccgaccctcgaggcccgcgtccacaacggcttcgtctatggctacaaggccagcaacacgggcagctgccgcagcggctggttccccctgcgctacgtctacaaccgcaactggcagctcgtcgacagctacgagtactccgagtag

SEQ ID NO: 7092 - DNA, 2080 bp, Myxococcus xanthus
atggagttgtcgagtctcgagtcgagtttctgggcaatcgcaccgggcgtggtcggcgccgtggggctgctcttcgctgcggtcttctacttccgcgtcaaggcgctcccggagggtgacgcgacgatgaaccgcatcgcgggctacatccgcgacggcgcgatggcgttcctcgtccgcgagtacaaggtgctcgccgcgtactgcgcggtcatcgcggtgctcatcggcctggcgctggggccgctcgccagcgggagcttcgtgctcggcgcgttcctctcgctgctggccggctacatcggcatgaaggccgcgacgttcgcgaacgtgcgcaccgcgcaggccgcgcgcaccggctccaagccgaacgcgctgctggtcgcgctcgacggtggcgcggtcatgggcctcgccgtcgccggcctgggcctcatcggcatgggcggcgtctactacgccttccaggggcatccgcagctttcccccgtcctccactccttcgccgtgggcgccagctccatcgcgctcttcgcccgcgtgggcggcggcatctacaccaaggccgctgacgtcggctccgacatcgccggcaaggtcattgagaacatccccgaggacgacccgcgcaacccgggcgtcatcgccgacaacgtgggcgacaacgtgggtgacgtggccggcatgggcgccgacatctacgagtccatggtggccgcgattgtcgccgccatggccatcgcgctgaccgccagcgccgcggacctctcccgcctcgtggtggacccctccgcgatcggaagcgcgaaggtggcgggcgtggtgatcccgctggtgctgtccgccgtgggcctggtggtcagcctgctgagcatcttcatcgcgcgcgcgctcaagcacatgaaccccgcgcaggtgctgcgcagcgccctcatcctgcccccggtcatcctggtgggtctgtccttcgtgatgatgcaggtgttcggcctgtcccaggccatcacggtggcgctggccgcgggcgcccttcggcggcgccatcatcggcctcgtcacggactactacacgtcgtccacgccggtgcagcgcatcgcggaggcctccgtcacgggtgccggcaccaacctcatccgcggcctcgccgtcggcatggagagcgtgggcatcccgatggccaccatcgccgtggtggcctacatcgccgaccaggcgcttggcctgtacggcatcgcgctggcggccgtgggcatgctgggcggcaccgccgtggtgatgaccgtggatgcctacggccccatctccgacaacgccggtggcatctccgagatgtccggcctgggccccgaggtccgcgccatcaccgatgagctggacgcggtgggcaacaccacggcggccatcggcaagggcttcgccatcggctcggcgacgctcaccgtcatcgcgctcttctccgccttcaacctcgaggtcaaccacacgcgcatcgccgctggcctgccggagatgagcctgcaactgaccaacccgaacgtcatcgtcggcctgctgctgggctccatcctcccgttcctggtgggcgcctccacgatgctcgccgtgggtcgcgcggccggtgccatcgtcgaggagattggccgtcagttccgcgagattccggggctgatggagctcaaggcggacccggaccccaagaagatcgtcgacatcgccaccaagagcgccctgcaagagatggtcttcccgggcatcatcgccgtcgccgccccgcccctggtgggctacctgctgggccctggtgcgctggcgggtctgctggccggctcgctcgtcgtcggcgccacgatggccctctacatggccaacgcgggcggcgcgtgggacaacgccaagaagttcatcgagaagggcaagctgccgggccacgcgaagggctccgcggtccacaaggccgccgtcgtcggtgacatggtcggtgacccgttcaaggacacctccggtcctggcgtggccatcctcatcaaggtcatgagcgtcgtgtccctgctcgtggcctcgctcatcgcgctgcggtag

SEQ ID NO: 7093 - DNA, 462 bp, Myxococcus xanthus
gcgctcatggggcccctggccgcgctgggggacggtttcttctggctgtccctcaagcccgcgacggggcgggtgagcgccgcgctggttccgctgctgggcgtgtgggcggtaccgctgttcctggtgctctacaatctggtgcacctgctgctgcgggtgcgcctgtactggctgggcctgacgctgggcgacaggctggtggaagcagtggctcgcgccaacctccccgcgcggggggcctggctgcgggcggtggcggcggcgagcgcggacggtgtggccgcctggctcgcggtgtcattcggggccaacgcgggtgggctgtatgcgcccctgctggcggccggatgcctggccctgggggtggcgtcctacgtgctggtcagccgtcgggtgccgaactacgtggtgctctatgtcgcggcgggcctggcctgcgtggcgggagcattcctctaa

SEQ ID NO: 7094 - DNA, 279 bp, Myxococcus xanthus
atggcaagcgtggtcgaagggacatacgagatcatcaacgcgctggggctgcacgcccgggccgcggcgcagatggtcaaggtggccaaccggttcaagagcgaggtcaccatcgaagcccagggacagcgggccaatgccaaatccatcatgggcgtgctgatgctcgccgccgcccagggcacccaggtgaagctcacctgcaagggcgacgacgcggatgcctgtctccaggagctggcgaagctcattggtgaccgtttcggcgaggcgcagtga

SEQ ID NO: 7095 - DNA, 816 bp, Myxococcus xanthus
atgtcgttgaagggcattggacaggagacggtggacatcatcgagcggggccagtacctggctccctcggggcagtgtgtccaactgggcgaggccgtggagcgcgcggtctccggcacggagctgtaccggccgggtgacttctcgcgcctgtcattccccacggcggcgaacccgtcggcgcctcgaatcgaagtcaccgccgagaagacgggcgccgccgcgcgccggctggtggaggcgggcgcgtcccatgtggccgcgctcaacttcgcgtcggcgaagaatcccgggggtggtttcctgggcggcgcgaaggcgcaggaggaggacctggcacgctgctcggcgctgtacacgtgcctgctcacgcagcgcgagtactacgacgtcaaccgcgcggagccgtcgccgctctacacggaccatctcatttattcgccggacgtgccgttctttcgggatgagggcctgacgttgctggagcagcccttccatgtgtccatcctcactgcgcccgcgcccaacgcgggtgtggcgcagtcacgcgaccggggcatggggggacgtatccgcaaggtgctggatgagcgggccctgaaggtgctccgtgtcgccgcgcaccatgggcaccgcaccttggtgctcggcgcctggggatgcggcgtgttccgcaacaaccccgtggaagtcgcggaggccttcgcgctcgggctgggctcgctcccgggcgcctttgaccgggtcgtcttcgccgtctacgagcgcggtggggatggacccaatctgcgcgcgttccaggcgcgcttcggctga

SEQ ID NO: 7096 - DNA, 1827 bp, Myxococcus xanthus
aggttgttgggcatcggcgcctctcccggcgtggcggtggggcacgccttcatcctggaccgcaaacgcatccgcacacccaagctgcggctggcggaggcggaggtcgagcccgagcggatgcggatgaagacagccattgacctgtccgaccgccagctcgccgagctgaaagaacagattacgcgcaccgagggcagcgaccacgccctcatcctcgaggcgcaccggttgatgctccacgaccccatgctcgtggacgaggtgaaccggctcatcatcgaggaccgcatcaacgccgagtgggccgtccggcgcgtggcgcgcaaaatcaagcacctgttcgacaacatccccgacgagtacttccgcgagcgccgctcggacgtggactacgtcgcggaccgaatcatccgcaacctgatggggcaggtggtggatgaggaagtggaagtccccgcggaggccatcgtcgtcgcgcatgacttgtctccggcggacgcggcgctgatggcgcgcagcggccgggtgggcggcttcgtgacggacctgggcggccagacgagccacaccgccattgtcgcccgcgcgcgggagacgcccgcggtggtgggcgccgggcgggccagcgaacagatttcgccgggcgacctggtggccatggatggcatccggggcgtggtgctggtgaacccctcggacgagcagctcgccgtcttccgcgaggagcagcgccgctaccaggagagcgagcggctggccctggcgaccaaggacctgcccgccgtcagcaccgacggcttccagattcgcctcaacggcaacatcgaattcctggaggaaatcccctcgctgctggcgcacggcgcggagggcattggcctgtaccgcaccgagttcatgttcctggaccggaagacggcgcccaccgaggaggagcactaccgcgcctaccgccaggtgttggaggccatgggcgggcgccccgtcaccatccgcacgttggatttgggcggcgacaaggtgccgggcaagacgaagcacgagaaggaacccaatccggccatgggcctgcgggccatccggtactgcctgtccaaccgggagctgttccgcacgcagttgcgcgccctgttgcgcgccagcgtgcacggcaacttgcggctgatgttccccctcatctgcggggtgagtgagctgcgtgaggcccgcagcgagctggaggcctgccgcacggagctgggccgcgcgggtgtccccgtgggcaagcgcttccccgtgggcatcatggtggagacgcccagcgcggccaccatcgccgaccggctggcccaggaggcggacttcttctcggtggggaccaacgacctcatccagtactcgctggccatcgaccgccagaaccgtgaggtcgcctacctctaccggcctctccacctgtccgtgctccggcaactgcgcggcatcatcgacgcgggccgggcggccaacatccccgtgtccatgtgtggggaaatggcgggagatccgctctacacgctggtgctgctggcgctgggcttcgacgagctgtccatgacgtcggggcagattccggtggtgaagcgcttcctgcgccgggtgagccgcgtggacgccatggagttgctgcagaacgccatggagctgaccacggcggaggaaatcgagcgctacgtgcgcacggagatggaccgccgcttcagtgagacgatggagccgggcgcgccgggagtcggcaacgcggagcccgcggaccacgagccctccgagcatggggcttcgccctcggggcggaacacggcctga

SEQ ID NO: 7097 - DNA, 417 bp, Myxococcus xanthus
atgaccgcgagagaccgggacggtgagaaggtgggcaccatcatcgccgcggacgcggcgggtttctttatcggcagggggcgcctcttcatgcgcgactgccggctgtccttctcggatgtggcggacatcgacggggaggacgtctacctgcgtgaggagttgtctcacctgccggacctcaagccggaggccctggcacccgcgcggcggacctccaccacggcgggcctgccgctccagcacgatttgacgggcggactgggttgggcggacgacgacaccgacgaagaggcccaggtatcgtctccggcgcgggagtcctccggcatgcagcagtgggccagcggggagggagaagcggcgcctcgtcgcgaggcgccttccgcggatgcgcggcggtacacgcgccactga

SEQ ID NO: 7098 - DNA, 306 bp, Myxococcus xanthus
atggcgaagaagagcaaggtcgcgcgcaatgcgcagcgcaaggccctggtcgcgaagtacgcgaagcgccgcgcggcgctgaaggcgcgcatccgcgaccgcaccctgtcctatgaagaaaggcgcgcggcgcaggacgcgctggcgtcactgccccgcgactcgaaccccaaccgcgtgacgaaccgctgcgcgctgacgggaaggcctcggggcaatctgaggcgcttcggcctgtctcgcatcgcgttccgtgagaaggcgctccggggagagattcccggcgtcatcaagtcgagctggtga

SEQ ID NO: 7099 - DNA, 237 bp, Myxococcus xanthus
atgtcgaaggtctgtcaggtcaccgggaaacggccgctcgtcggcaacaccgtctcccacgccaacaaccggcacaagcggcgctcgctgccgaacctccagtggcaccgcttctgggtgcccagcatgaaccgcttcgtgaagctgcgggtgagcacgcacggcatccgcatcatcaaccagcgcggcatcgaccgcgtggtgcgggagctgctcgcggagggagtgaagctctga

SEQ ID NO: 7100 - DNA, 867 bp, Myxococcus xanthus
gcgcgccgacatcgagcgcgagtgcgtgggcccacacggcgaccggcggcaggaaatcgtcttcatcacccaggacgcggaccacgaggagatggcccggctgctggaggcctgtctgctcacgccagaggagctggcgcgcggaccccaacactgggcgcggctggaagacccattccccgaatggcaggtgcagcggacggacgcacccgacgaggacgaggagcacgcctgatgcagcctgccctccgcgccctcgctccgcccgcccatgccttcgtatggacgcccgaggcgctcgcgggcatctaccgcgaggacctcaacctctgcgtgtggcgccggggcctggacacgccgctggcgcactggctcagcgacgtggcggccacccgcgagctggacgtcatcgcccgcgtacggggcgacgcgccagatttgcggcgccggttggatgggctgccccaggggcccccgttcgaggcctggctcacggacgtgcacttcctgctgcacctctacgcggacctgttcggcgcggcggagctgggcgtacgccttcacatcctggccagcgacatgtgcccgcgcttccacgtggaccgcgtaggcgtccggctgctctgcacctacgcggggccggccaccgaatggctggagaacgcgcacgtcgcgcgcggcgcattgggcgcctcgggtgacgtcacgcggcccggcgcgcccgtccacgcgctggagcgcttcgacgtggcgctcctcaagggcgagtcctggcccggcaatcagggcaacggcgccgtgcaccgctcccccgccatcgccagcagtggccggcggcggctctttctctccatcgaagcactctag

SEQ ID NO: 7101 - DNA, 150 bp, Myxococcus xanthus
atggcgcgccccaccgcggagcccggggacacccgtacggcggcggcacggctgtacgcggccgcgcgcgagctgggcgtgggctcgctcatcctgacgccgctggtggcgcggcagcgcacgctgggggtgctcacccttagagcacgg

SEQ ID NO: 7102 - DNA, 474 bp, Myxococcus xanthus
atgtcgcgggccctggagcggctgtccgcagcaccgccggtggtggcggtgctggaggaattgctttgccaggcgtccgccacgctgggggcttcgggtgccttcctgtgctggtggggcgggacgggcgacgtgagcacgctcgccaaacacggtgtggatgcgcagctggccgccatctgggctcagcaactgctggcccaggcgcccgcgccgggtgagcctcggctgccccgggtggtggagcacgtgtcgcgagacgcgctgctggcctccgagccggacgccctgcggcgcctgggggccacggccttgctgtcccagccgctcttcttcgcctccggcatgggcgccgccggtgtgctgggcgtgctcttccgcgaggcgtggcagccacgggaggaggacctgcggcgcttcggcctatcggtgaagctgcagacgctgtcactgaagcgcgagcgcatggcgtaa

SEQ ID NO: 7103 - DNA, 1122 bp, Myxococcus xanthus
atggacgctgccgaaccgctgctcttcgataaggcgtacgtcctctgctaccgcaccttcgacatcgcggaggagctggacctggagcgcgcgcgccgggtgctcacggaggactcgcgccggctcaagctgtcacgggagaacagtcagtacatccaactgcccaacccgccgctggcctatgagctgggacgccggcccctggcactgcgggacgggcccgtcatggtggatgtcaccgcgcgcctgttcgaccatggcgccgtgtccatcatcctccaggtgcctgtcgttccgggcacctcgttgaaagcgctcacgcgcatggcggacgaactctatgacagccaggcgttggaggacctggcgttggaattggtggaaggtgtgcgccgcaccatcgcccccgccgcgcaggcgccgcacctgtgggagcagaacgagagctacaccgtcatcttcgccgagcacatccggggcaatcccaccgcggatgagctggtgacgcgcgcggacctggcccggctgctcctgggcgaaagcggcacggtgccgctgtctccgcgtgagagcgaatccgtgctccagtcgcgcttcagctacaccatccaggacctggtcgtcatcgactggaacagcgccttcgtctacgagccgtccggctcgcgagacatccccgacctgttggaaatcgccaacgcgcagttgttggagttccgctactacgacgagcggttggacgcgcacatcacccgcatccacgagaaggtgcaggccgcgcggcatgggtgggccacgttgttccgcagcccctaccgcagcctggcccggcagacgctctccacgctggtggacctcaacgagttcatcgagcgcgtggagaacagtctcaaaatcatcggcgacttctacctggccaaggtctacgagagcgccgtgcgccgcatgcgcatcccgccgtggcaggccgccgtcacccgcaagcagcagttgctggcccagacgtatggcctgctcaagggcgacgtggacatcgaccgctcccacacgttggaggccgtcatcgtcctgctcatcgtgctggaaatcttcttcgccttcttccgcgtcttcgagcactga

SEQ ID NO: 7104 - DNA, 828 bp, Myxococcus xanthus
gacctggccggaaggaccacgtacggtgattatctgcagctcgaccgggtcttgtcggcgcaggtgacgcgctcgcaaccccctcaccacgacgagctgttgttcatcatgcagcaccaaacaagcgagctgtggatgaagctgctcatccactagctgggcgcctgcatgcgttacgtgcaggcggaccggctggaggcgtagttcaagaaattcgcgcgcgtggcgcacatccaaccgatgctcttcaaacagtggagcgagttggagactctcacgccgaacgagtacctggagttccgcgacacgctgggcagtttctctggcttccagagctttcagtaccgtgcggtggagttcctgctgggcaacaaggacgcgcaggcgttgatgcccttccgccacgtccccgccatccatggcgagctggagcggctgttcgaatcccccagcctgtatgacgagttcctgcgccacctgtcgcgcatggggcatccggtgccgcagagccacgtgcagcgtgactggcgcaagccctacgagaagagcccggaggtggtggaggtgttccggcgcatctaccaggacgccgaggcgcactgggatgcgtatgagatgtgcgagaagctggtggacaccgaggagcgtttccagctctggcgctaccgccacatgatgacggtgatgcgcatcatcggcttcaagcaaggcacgggcggctcctcgggtgtgggcttcctgcgcaaggcgttggacctgcgcttcttcccggagctgtgggacgtgcgcacggagctgacgccgcctcctccgcgccaccggccctga

SEQ ID NO: 7105 - DNA, 393 bp, Myxococcus xanthus
atgggcaccttcttcgtgctgtccaacttcggcgcggactttggtggcttcgaactccaggtcatgcaggacagcggcttcgcgctggatgactggtccttccgcgaagggcagggatggaaccgccagcccgagcccgtccggctgggcatggaggcggggcgctgggtgtgcctggagtgggaggtccgccgcgacagcccgtcgagcacgcatggcaacacccgcgtctatgtggacggcacgctggcgcacgacttcaccaacatcggcatgcgcgccttcaacaacttctccgtgggctacggcttcgtccacccgctgggagcgtccggctccgagacgtggattgacaacgtcgtggtgagcacgcagcgcgtcggctgcgactga

SEQ ID NO: 7106 - DNA, 537 bp, Myxococcus xanthus
atgtccgtggataaagcgtttcgcgacatgatccgcaatgaaatcgaggtccagctcaagccgctgcgtgacgtggtcgcgcggctggaggagggcacggcggacttggacgcgctccgcaacgtggccgagcgcctggccccgctggccgaggtcgtcgggcccctgttcggcgcccagattcccgcggccgccaaggccggccgtcgtggcccgggtcgccctcccgcggctcgcagcgccgtgacggcggctcccgcggccgtgggtggcaagcgtcgtggccgcaagccggcggcggcgggtgctgacggctcgcgcgcgtgcgccatcatcggctgcggcaagcccagccgcaccaagggctactgcgcggcccactaccagaagctccgcatgctggagaagaccaaccgtcgcccgagcgactggaaggactacgccgatccggacagcgtggacgacatcaagctgccgcgtggacgcgccgcgtccaaggcgttggcggctgccgctcaggctgggcacgcaggctag

SEQ ID NO: 7107 - DNA, 1086 bp, Myxococcus xanthus
atggcggaggcggggctgaagcgcaccacgccgctggccaccgcgacgctcgtcatcggcgccaacctgccggatgtcgatggcctcgtcaccctggcgggctcggatgcgtcgctctactggcgccggggctggacgcacggcgtgctcgccctggccctgtggcccttcgtcctcaccgggttgatgctgctctgggaccggtacgtgcgcaggcgcaggcatccggacctgccgccggctcgcttcggaccgttgctgatgctgtccacgttgtcggtgctgagccaccccgcgctggactggctcaacacatatggcgtccggctgctgatgccctttgacgggacgtggttctacggcgacgcgctcttcatcatcgacccgtgggtgtggctgctcgcaggcgccgccgtcatcatggcggatgcgcgcacgcgcaggtccgccgcggggtgggtggtgctcggtgttgcctccaccgcgctcatcatggttcccgcgttcgtcccatggcccgcgaaggtgatgtgggccgtgggtgtggccgccatcgtctggttgcggctgcgtgggacccacgtcctctccgcgcagcgtgtggcccgggtctgcggcgtgggcttgttgctctacctgagcgccatcttcgtgggctctcaggtggccgcaccgggtgcgctggaatggcttcgctcgcagaacctccctgtggagcgcgccatcgcgggaccgctgccggccaaccccttcgtgcgggacatcatcgccttggggccggaccgctaccacttcgtccgagccgacttcctggcgggcgacgccggccgcttccgcatcagtgacgccagcgtgccgcgtgaagcccagcccgggcctgtcatccaggccgcattgtcggcgccgcagattcgagggctggccaactggctgcgcctgcccacgtaccaggtggatgagcgcgccgatggatggcgcgtcaccattcgggatgtccgttactcgcgaatgcagagcggcggcttgggcacggcggtggtggtgctggatggtgcgctgcgccccgtccgggtcgaacggccgtag

SEQ ID NO: 7108 - DNA, 912 bp, Myxococcus xanthus
atgaagcgtctgggggcggcggtgttggtgatggcggtggggtgcgcgccgctggacgtggagcggaggacggagcgcgggccgctcttgcggacctacgcccaggagaaggcgctgaacgagcgcatccccttcgccacgacgcaggtgcagtggccccagctcacgctggcgttctcctcgtcggacatctgccgcaccgagcagcatggggagtacgcggaggacatcatctccacgcacagcaacacgggcgcggcggcggccgtgagcaccggaggcattctcacggtgctgggcgggacgctgctggtggggcgcacgctgttctcggacacgccgaaccgctccgccatcgatgaaaagggccgttacggcgcctccagccgcgacgtcgccacggggtggggcttggggctgctcatcgccggtgtgcccgcggtggtggccggcatcgttcagctctcccgtagcggcgagacgcgggagacgcgaaagacggatgagctgctgtccttgcgcgaggtgccctgccagcccaagcccgtggacggcgtggtggagctggcgggaggaccgggcccgcagcctccgccccggctcaccctcaacggggcgctggtgctgacggcggacgagattcggcagctgtccttcgtcggactggcgctggatggtacgcccgtcacgctggaagaagaggacctggaccggctggagaccttccgcacctgcgcgacgctgctggccacgccggtggacccgcaggcgctggctggagaggcgcgctcacagccggaccgcctgcggatgaagcgggagctggcgcggggctgcacgacgcttccgggcgctccggcacagcccctgctcgaagccatcgaaggcgccctcgggagcaccgccctctag

SEQ ID NO: 7109 - DNA, 141 bp, Myxococcus xanthus
atgctcgcctacctgcgcgcgacggggcgcgacccgtcccctttggtggagcgcatcgggcttcccgccaacaagagcaggctggccgaagtcaccctcccggtggcccccctggccgccttccttggcgggggcggggct

SEQ ID NO: 7110 - DNA, 867 bp, Myxococcus xanthus
atgtcccagacctatctgtcactcacagtggagttgcccgaggaagcgtccgaggccgtacaggacctcctccacgagtcgggcgcgctgggcctcgaagtgcgggaccgcgaagcgcccctcatgccgggcgtgcgcggaccgaaccctggcgaggccatcatcatcggctacttcgacgagcgcgacacggccgagtccgcccgtgacgaggtggcgtcgtccttccccgaggcgaagctcacattggatgagcagccccagcaggactggagcaacgagtggaagtcgctcatcaagtccgtgcatgtgggcaggttgtgggtcggtcctccgtgggacaaggcgaacgcgcccgcgggcaccgtgcagctcgtgattgagccgaagatggcctttggcaccggcgaccacccgacgacgtccctgtgcctggccgcggtggacgcatacatggccgagcacccgggcgccgccgtcctggacgtaggcaccggcacgggcgtgctggccatcgccgcgaagaagctgggcgcgggccgcaccgtggccaccgacaacgaccccatctccgtggagctggcgcaggagaaccaagcggagaacggcacgccggacatcgaggtctccggcaaggagctgacccaggtggagggcaccttcgacctggtgctcgccaacatcctggccaacacgctcatcgagctggccccgctgattgtggcgaagaccaaggaccggctcgtgctggcgggtgtgctctcccaccagcgcgcggacgtggaagccgcctaccgcaacctgggcctcaccgtgctgaccggcgccacccagggcgaatgggtgcgcatcgacctgcagcgctga

SEQ ID NO: 7111 - DNA, 925 bp, Myxococcus xanthus
ctcttcgcggactgcctgctgaatccctcgttcccggaggccgaggtcgcccgcgagcgcacgctgctgctccaggacatcctcacgcgcgaggacaagccgtccagcgtggccttcgacctgttcagcaagaccatctaccgcacgcacccctaccggatgcccaccacaggtgagcaggcgtccgtggagaagctgacgccggagctgctgcgcgcgtggcacgcggcgcacatggacccgtcgcaactgacgctcagcgtggtgggcgacgtgaaggtggacgaggtgatggccctggcgcgcgagtacttcggcgcgtcgcgcggcaaggcggccccgccgccgaaggtgtcgctggaggcgcccctggaggggcctcgcgaggcgaagaaggtgctggcgcgggcccaggcgcacctggtgctcggcttcccgggcatccgcgtgggcgacccgcagcagcacgcgctggaggtgctcttcccggtgctgtctagacaggccgggcgggcttttcgtggagctgcgagacaagcgctccatggcgtacagcgtcagctcgttcgccatcgaaggcgtggatccgggctacttcgccacgtacatgggcaccagcccggagaaggtggacgcggcgctggccggcatccgggcggagctggagcgcgtgcgcgacgagcccatcccggccgaggagctggcgcgcgccaagcagcacctcattggcacgcacgagattggcctgcagcgcaacggctcgcgcgcggcgctgctggcgctggacacctgctacggcctgggcctggagaacttcctccactacgccgaccacgtcgccaaggtgtcggcggacgacgtgcgcgaggtggcgcgcaaaatcatcaacttcgaccgcagcgcgctggccgtcgtcgggccgtag

SEQ ID NO: 7112 - DNA, 186 bp, Myxococcus xanthus
atggccatcgcctggatttacggaggcgacctctccgacgccgtgcgcgcccgcaccgcggacgtgtccgctttcatgacggtgccctccctggagcggcccgccgtggtgctggccgtgcccccggtgcccgcgctcgcattcgtcgtggccctgctcaagcgcaagaagaaggcctccaagggc

SEQ ID NO: 7113 - DNA, 1284 bp, Myxococcus xanthus
atgaggctggacgcactgtcccggctggtccggctgagcctcgcccgcgagcgcaagggggcgttcttctccgccttcggtgttgccatgggcgtgggcgcgctggtgttcttcgtgggcctgggcctgggcgttggccgcgtcatccgggagaaggtcttccccacggacgcgcggctggtggacgtggtgcctccggcggtgtcgctgggctcgctgctgggcggtggcaagctggacgcgcccaccgtggagcgcctgcgcgagctgcccggcgtggaggccgcctaccggaagatgaacgtgcgcgtgcccgcggtgacgcgctacgacggcgtcttcttcggcacccggcttcgcatgggcatggaggtgctggccctgggcgtggagccggcgctggtgcagggcgacgtgcagatgggcgagttcaaggacgcgggggaggggcagccgattccggcgctcgtgtccacgcggctcctggagctgtacaacaagacgttcgccccggcgcgcaagctgccgcagctctccgccaacatgctggtgggcttcggcttcccggtggagttcaaccgctcctacgtggccgcggcgtccgcgtcggggcccacgcagtccgggcaggcgcaggtggtgggggcgtcggaccgggcactcctggccggtatcaccattccgttggacgcggccatccgcctcaaccgcgcgttcggcgtggactcggagaactactccggtgtcacgttggtcgccacggacccgtcgcaggtgcctgtcatcgtggacgcggtgaagggcatggggctggaaatcgacgaccaggagcgccggatggcggagaactcgggcgcggcggtggcgctcacgacctccgcgctggcgctgctgtccctgctcatctgcatcctcgcggcggtgaacatcgcccacgcgctgtctgcctccgtccgggcgcgcgccaaggagattggcgtcatgcaggcggtgggggcctctcgcgcggacatccgcgccatcgtcctggccgaggccgccgtggtggggctcgcgggcggcgccgcgggaaccatcgccgcgctgctgctggccctgggcgtcaaccgcctggcggcgggttacctgcccaacttccccttcaagcccgacagtttcttctccttcccctggccggtggtggccggaggcgtcgtcctgggcctcgtcgccgcgctcgtgggcgcgtacttccccagccgccgcgccgccgccaccgaccccgcacgcacgctcgccggatga

SEQ ID NO: 7114 - DNA, 96 bp, Myxococcus xanthus
atgagcgcggcggccgggcgcgtgctgcggctcaaggacgggcagctcgtggaggagcgcgcggggcttcaggtggccacgggaggtgcgccatga

SEQ ID NO: 7115 - DNA, 1011 bp, Myxococcus xanthus
atggcggcgtcgctgcaacggctcccggcccagcgtgacttccacgtctggctcccgggcggcgccgggctcgtgccgccgggcaccgtccagggcgtcacgctcacgggccgcatcgaggaccgcgcggtgacgctgaacgcggacgcgccctggccggatacccaggcgtccctggcggcgctggacgcggtggcgcccgccgcgagcacgctcctcaccgcgctgcccgccgacagcttcctggtggcccagttccgtggggacgcgtcgcacctcgacggtgtgtggccctatctggccggcggatacctgacccgggcggtgcagaacagcggcctcaacgtgaaaacggagctgctcgacaacctcaagccgggcacggtgctgggcctgtcactgtcgcccaccgtgaatctgggcgcgggcatgccggtgctggatttgcgccgcaccaaccccttccgcttcgtccacctggtggcgctcgcggacgccgaggacgctgcgaagatgcagtccacgctggagcagttgccgcgcatcgcggagaacttcggcgcgaaggtggaggcgtcggagctgagcggccagcgcgtgtacctcacgtcctaccgcgcgggcgaaggcgcgcacttcgcgctcgcgcccaacggccggctggtggtggcctcgcccaaggcgcggctggagtccacgctgacctcgctcgcgaagccctcgggcgacgggccggtggccgcggacctgaaggacgctggcaaggacgcggccttcagcgccgtgctggacttgcggcgcctgtcggacgcggtgaagaacctgccgtcggaggcctggggcattggcggcttcgccatcaaggccaccaccgtgcgctggctggaggccgtggatgacctgcgcgccgtgacgctggccgtgtcccgcaaggacaaggcgctccaggcggagctgtccctgcgcctggcgccctccgccgccacctccagcccgtcggccgcgccgtga

SEQ ID NO: 7116 - DNA, 366 bp, Myxococcus xanthus
gcggtgcggctggatgtggggtttggtttctaccatcagccccggggcacggcggggccgctgggactggatgtgatggagctcttccgggtgccgctggcggacatgccgctggtggcctcggtgaaccggcgggcgtgggacgcggacgcggacttcgaggtgacgtccgagcacgtctggctcagcaaggcggggcgggcgaaggccatcgagctgtacgagcggcgcaagcgggagacgtggaagaacaacgtgctggggtactcgctcagctatgcgcggctggtggagctggaggtgcggctgctggagaaggagtggaccggcaagccggggctgttcgcgacgttccgcttgaggtga

SEQ ID NO: 7117 - DNA, 276 bp, Myxococcus xanthus
gcgtggacatcctccgcaagcggctggcgcgcttcgaacttgtccggtgagagccgcgaggtggtgagccaccaactggcgggcatcgaggacctgatgcggctgacgcacgagcaatccgtggccatccgcgacccggaggtcgtcaaccgccagctcaccatgctgagcgcggaggcggaggccaccgaggaatccgtgcggcagatggagcagttcctcgagttctccgaggagacgcggggcccgctgccccacggcagccgggtgcgttga

SEQ ID NO: 7118 - DNA, 546 bp, Myxococcus xanthus
tgggccatggaagcgcggcaggtgtgctgggcccacctcttgaggaaggttttttcattctcggagcgtgacgggccagccggagcgattgggcgcgagctactcgactacatcggcatcctcttcgactattggggacgactgcgcagcggcgagttgcagcgggacacgctgcgtgagcgcatggcctcggtgcgcacgcaggtggaagccttgcttgagcgcgccgtggccgcgaggctgccgcacgtctctggctcctgtgaggacatcctccagcaccgggcggcgctgtggactttcgttgacagggagggcgtcgagcccaccaacaaccatgccgagcgcgagctgcgggccttcgtcctgtggcgcaagcgaagcttcggcacccagagccctcgggggaacctcttcgccgagagggtgatgacggtggcgcataccgcccgcaagcaggaaaagaatgtgctcgagttcctgacggcctgctgcaccgccgcccggacggggatgcccgcgccctcgctcttcgccgcgccctga

SEQ ID NO: 7119 - DNA, 4455 bp, Myxococcus xanthus
tgccgtgccgccttggtgtccggcaagctgcccatcgtgtggcacagcgggacgggtgtcatctcggggcccgcgtccctgcccgcgcccgctccggccatccagcccgcgctctcccaggaggaactggagacggcgctgcgtgaggaactggtggcggtgctcggcgccgaggccgttggacaggacgccagcacgccgctgacgttgctgggcctggactcgctgggggccgccgacctccaaggccgcgtggagaagcggctgggggtgcgcgtctccatcgccgcgctgttgcaggacctgagtctgcggtcgctggcggagtccgtgtccgcggagggcacggggcgccggttgcccccgctccagcgccgtcccgcgggtgacgcgcccacccccgcgtccttcacgcaggagcggctgtggtacctcctccaactggatccatcctggacgtcgaaccagattccggtggcgctgacgctgcgcgggacgctcgacgtggcggcgctggaacgggccctgtcggaggtgctgcgccggcacgaggtgctgcgcacccgcttcgcgtcccgcgatggcgcgctgcttcagcgcgtgcaggcggcgggccccgtctccctgccgtgcctggacttcatgggcgtgaggggtgacgcgcggcaggcgacgctcgaagcccaggcagtgctcgatgcgcaacaccccatggacctggaggcaggcccgctggtgcggtgctccctgctgcgcttcggcccggaggaccacgtcctgctgaccgtcctgcaccacctggtggtggacggcacgtccgtcgcgctgttcatgcgcgagctggcggccctttacggcgcgttcgtggagggacggccgtcgccgttggcggagccggagttccagtatggagacttcgccgcgtggcagcgcgcgtacttcacgccggatgcgctcaccacggagctgatgtggtggaaggagacgctggccggcgcgccccagttgctggccctgcccaccgaccggtctcggccgcagcggttgtccgtccacggtgctcgtcgcctgcgcctgctgcccgcgtctctcatggcccggctgcatgcgctgggacggcgccagggcgccacgccgttcatgagcgtgatgtccgcgctggccacggtgctgcaccgctggagcggccagtccgacttcgtcgtgggcaccgtcatctccggccgtgacgcggcgggcactcgcgagctgatgggcgactgcaccaacttcatcccgttgcgggtccgcctgtccgaagccgcgacgtccgcggacatgctctccgaggtgaagtcgcggatgctgggggcgctcgcgcatgggtacgtgccgttcgagcagattctcgcggccgtgcaactgcctggggcggagcggcgcgagctgtacaacgtggggttcatccttgacgactacgagctgccgcgcgcgttgtccgttcgcggcgggctgacgctcgacgtgtccctggtggacaaccacacggcagagctggacatgaccttcgaggcgacgcaccgtcctgaaggcctgctgattggctgcaagtactccgcggacctgttcgatgcggagacagcggaccggctcctgagccatctggagcacgtgattcgcggaatggtggatgcgccggaggcgccgctgaccaccctgccgttgatgagcgaggccgatcggcagcacgcgctccacggctggaatccccgcgttgaagcgcctccgttcggcacgctgacggacctcatcgaagcgcaagtcgagcgcacgccggacgcggtggcggtggcgttcgagtcggagcggctgacgtaccgggagctggacgcgaaggccaacaagttggcgcaccacctgcgtggcctgggcgtggccccagagtcgctggtgggcgtgtgcctggagcgctcggtggacatggtggtggcgctgctgggcgtgctgaaggcgggcgctgcctacgtgccggtggacccggcgtacccgaaggagcgtctggggtggatgctggaggacaccggggcatcggtgctgctgacgcacgagaagtggaagacggtgctgccgcccagcgccgcgcgagtcgtgtgcctggacagtgcagcgggagaagtggcgaagcagccggtgacgaagccggcggtgcaggtgggcccccaggcgctggcgtacgtcatcttcacctcaggaagcacggggcgtccgaagggggcgatgaatgcgcacgaaggcgtcgtcaaccggttgaagtggatgcaggaggagtacgggcttagcggcacggacgtggtgctgcagaagacgcccttcagcttcgacgtgtcggtgtgggagttcttctggccgctgctggcgggggcgaagctggtggtggcgcggcccggagggcaccaggagccggcgtacctggtgaagctgatgaaggcggagggcgtgacgacggtgcacttcgtgccgtccatgctgcgcgccttcgtggaggagcccgggctggagggactgggaagcctgcggcgggtggtgtgcagcggcgaggcgttgagcgcggagttggtgaagaaggcgtacgcgcggctgcccgccccggtgcgcgtgcacaacctctacggcccgacagaggcagcagtagacgtcacgtactggccctgcccgcgtggagaggacttccaccgggtgcccattggccggccggtggcgaacacagtgctgtacgtgctggacgtgcacgggcagccggcgccggtgggcattccgggcgagctgcacattggcggcgtgcaggtgggacgcgggtactggcagcggccgcagttgacggcggagcgattcatccccgacgccttcagcggcattccgggcgcgcgcctgtaccgaaccggagacgtggcgcggtggttgccggacggcacgctggagtatctgggccgggccgacttccaggtgaagctgcgcggcttccgcatcgagctgggtgaaatcgaggccgcgcttgccgcggacccggccgtccacgactccgtggtgctggctcgtgaggattcgacgggtgaccagcggctggtggcctacgtcgtcctggacgatgcggcggcagcgcaggaggtcgacgcgtcctcccagtggcaggccatctacgacgaggcctacgcacgcgagacgacggagagcgaagacccgaccttcaacatcgtcggctgggaggacagctacaccggcgagtcgcttccgcccgcgcagatgcgtgagtgggtggacaccaccgtggcgcagatcctcagcttccagcccaagcgggtgctggagctggggtgcggcaccggcctcctcctgtaccggctggcgcctcgctgcgaggcctactggggcgtcgatttcgcccggcccgccctggaccgcatcgagcgccagcgtgagcgcatgggcggcgctctggattccgtgcacctgctgcaccagagcgtggacgacttctcggccctggagccgggctcgttcgacacagtcgtcatcaactcagtcgtccagtacttctccagtcctgagttcctgctcgacgtgcttcgcggggccgtgcgcgtcctgaagccagggggccgggtgttcctgggcgacgtgcggagcctggagctgctcgaagccttccgtgcctcggtgcgcctccaccggaccgcgggccccggggccacgtcccagttcgcctaccgtgttcagcgcgacatcctggcggagaaggaactggtcctctcccctgccttcttcaccgctctgccagagcgcatcccgggcatccagcgcgtggaggtgctgccgaagcacgggcgctacgacaacgagctcagccgcttccgctacgaggtcatcctccacgtcggcgacgccgccaggactcccgcccggcgcacgaagccggactgggtggacggcgccggactcaccctggacggactgcgcgaacaactgagcgcccggcccggactgctggccgtgcgggggctccccaacgcgcgagtcctggaacccacccggctcgttgaactgctgtccgccacgcccccgcccacggtggcgaggcttcgcgaggccctgcatgactggtcggggccccgcggcgtggagccggaggacctgtacgttctgggctcggagctcggctacgaggtccgggtgagctgggcctccgcgcaccgggatggtgcgctggacgtggtgttcgcgcaccccgatgaggtgggcacgctcgacctgtcccccgaaccaaagcaggtcacctcctgggatggccttgccagcgatccgctgcgcggggctcggagtgcacaggcggtgagccgtctccgcgacgcgctggcggacaagctgccgccgcacatggtgccctccgccttcgtggtgctgcccgcccgccggtgtctc

SEQ ID NO: 7120 - DNA, 633 bp, Myxococcus xanthus
aacaccaaggtgcgcatgtccgtgttcacctccacgggatacagcgcgtccaagattccgacctacgaccgcgacgtgctggccagccggggctacatgcaggcggcgaacgactggcggaacatcgagatgactggcttcgtgaaggtcaactcggtgtccgacgtgtcggacaacttcgcgtggtacgcgcgaggcggcaagcacaacgacaaccactcggggtgcgagggcagcagctacaagggttcgctgcactatgacggccgcgtgcgctggcagaaggagacgtggcacgtctcctacaaccaggcgtcgtacaagtccggtacctcggcgctgcgcggccgctgggtgggcttcaagtcggtgatgcgcaacaccaaggtcaacggaaaggaggccgtgcgcctggagatgtacctcaacgagaacgccgacaagaagacctggaagaaggtctacgacatggtggactcgggcagttggggtggtgacgccagccactgcggcggcgcggtgaacgcaatgcccatcacttggggcggccccatcgcggtgttccgctgggacagcgccaacgacgtggacttcaagtggctgtccgtgcgcgaaatctcgccggagcagtga

SEQ ID NO: 7121 - DNA, 420 bp, Myxococcus xanthus
atgagtcggtcctccaccggttgcaagggagccaccaaggcgggagaccaggccctcttcttcgccacccggcagagcaccaatggctgcggcgcctgtgccaacgggacctcgacaggtccggagtgcgactccgagagctgcactcctggctgcctgcagaccgcccggacgtcgaacgacttcttcggctgcggcaacttcggaaccgaggccacgtgtggccccctcaaccggttctcggagaacctgtgctcggggcttgaaggctcaccatggtcatgtaacgccgcgacgaccgccgacgacaacggcctctgcgaggcctacacggccatcaagacgggctcccgctttggcgggtgtgctctgctgccgcgacacctgcaccgattccgacaaggacggcgtctgcgatag

SEQ ID NO: 7122 - DNA, 213 bp, Myxococcus xanthus
atgaaccgcttcgccgatactgacggcgatggcaccttcaacacgctgtcgtcgaacgacggcgagccggagcgccgctttaccctcgtggacaccgctggttgcaactgcgcgcagattgtcgatgcgctggggatgagccaggagcacgcccaatctggatgcagcctcagcaccctggagaactgggtgtcgcgcgtgaaagagaactag

SEQ ID NO: 7123 - DNA, 731 bp, Myxococcus xanthus; identical to SEQ ID NO: 3085

SEQ ID NO: 7124 - DNA, 534 bp, Myxococcus xanthus
gtggagagcatctatgcggtgggcgacatcaccgaccgcatcaacctcacgccggtggccatctcggaagggcgtgccctggcggagacgctcttcaacgacaacccgacgcagatggaccacaccaacgtaccgtcggctgtcttcagccagccgcccgtggcctccgtggggctgacggagcaggaggcacgggagcgtcatgggaagctggacatctatgtcaccagcttccgccccatgaagcacaccctgagcgggcgtaacgagcgcaccatgatgaaggtggtcgtggagcgcgagtccaaccgcgtgctcggctgtcacatggtggggacggacgcaccggaaatcatccagggactggcggtggcggtgaagtgtggcgtcaccaagaagcagctcgatgccaccgtgggcatccaccccaccgcggccgaggagttcgtcaccctgcgcgacaagcggccggaccccgacgagcggctggcggcggagctgggccgtgatgcggcggcgtctacccggcgctga

SEQ ID NO: 7125 - DNA, 1047 bp, Myxococcus xanthus
ccccggcgcccggggcaggtgcagttcgcccagcgccgcgaggcggcctggagcgcgctgacgccatgtgtggtgctggagacgcgcgtgggcagccatgcatgggggcttgccgacgagcgctcggacgtggatgtgcgcggcgtgttcgccttgccgctcccctggcggttcggactggtcgacgcgcccagggatttggtgagcgcggatggcagcaccatgtactgggaggtccacaaggcggtggagcaggcgctccgcgcggacccgaacacgctggagacgctcttcgtgccgggcgcgaaggcgttggacccggtgggcgagtggctcctggcggagcgcgacgccttcgtgtccaaggccctgttcggcagcttcgggcgttacgccatgagccagctcgacaagctcacccgcagccagcggctggcggagcatcgggacctgctgctcgaatggctgtgcgaggagcccgcgccggacctggacgaggtggcgcgccggctgtcggccgtgtcgccccgcgaggcgccgtcggcgcaggacgcgctgctggcggcgaagacgtacgtgaagcagctctaccgctcgctctgggaccaggggctgttggcggccaacgacttcaaggcgctcaccgcctatgcgcgaagcggcggtcagcggcctccctccgcgcgcgagctgcgcccgaagaacgcctacaacctgctgcggctggtggccacggcgacagggtggctgcgcgagggcgcgcccgtcttcgaggcctctggcgcactgaaggcgcggctgctggacatcaaggcgggccgcgtgccgctggaagacgtgctgcgggacgcggaggcccttgcgccggacctggaggccgcgcatcgggagagccgtctgccagagcatccggactacgaacgcgcggaccggttgctgcggcgcgtgggcgaggagttggcgcggcgctgggtgctgaaggaacccgggccgctgggacgtgacgcgccggaggccccggccatggggtggagggattcggaatga

SEQ ID NO: 7126 - DNA, 756 bp, Myxococcus xanthus
atggcggaccgggtgctggacgaggagtcccggcaccgcgcgcatctggtcgtctccctgtccggagcgcacgcctatggcttcccctcgccggacagcgacctggacctgaagtccatccacgtcgcgcataccgcggcgttgttgacgctgcagcccgtgcatgtccccacggagcgactggaggtgctggagggcgtggaggtggactactcgtccaacgaactgctgccggtgctccagggcatcctgcaaggcaatgggaactacctggagcgggtgttgggggccatccccctgcgcgtgtctccggagctggagtcgctgcgtccgctggtgcgcgcggtgctgtctcgcaagatgtaccggcactacaacggctttgcccagggacagcttcgcgagtgggagaagagcggtttccgttcggcgaagcggctgctctacgtgctgcgcaccacgttgacggggacccatgcgctgcggactggcgtggtggagacggacgtcacggagctgctgtcgcagtacggcttcgtggaggcccatgccctggtggagcagaagctgcgcggggagaagagcgagcttccggaggctctgagcgcgcggtggcgcggcgaggtgtcgcgtgcgttcgaggtgctcgaagccgcgcgggcggactcggtgctgcctgagtcgccgcccgacgaggccgtggccgcgctggaggcgtggatgctggacctgcggcggaggcgcttcgacggatag

SEQ ID NO: 7127 - DNA, 741 bp, Myxococcus xanthus
atgatgaagcccctgcacctcgccgtgctccggatgctgcccgcgctctgtctcgcgtgtgcccacccgccccaggcgccccgcgaggcgccggttgctgcacccgcgctcacctacgagacctacaccgtcggagcaggcgagcccgaggcgatgctcgtcgcgctgcactactccgggtccacacccgggttctggaggccgctgctcgaggactggcgcaccccgacccgcgtcgtgcttccgcgcggcccgcacccgcgcagggagggcttcacctggttcgccgccggccacgagcagaaggtgaccgcggagaagaccgccgatgtggcgcagatggccgcgcggctcgcagagctcatccgcgagctgcgcgccgcacacccccgcatccgccgcgtcgccgtgacgggcttctcctacggcggagacctcgcctgggcgctcgcgctgcgccacccggagcaggtggatgtcgcggtgcccatgggctcgcgcttgctcggagaccccacgcccggtgcaccggccacgcggcgcgtgtgggtgctgcaaggcgaagtcgaccccatcatcactgccccgcagaccgcggcgcgcgtggacgcactgaaggcagccggtgtccccatcgacgtgaaggtctaccctggcctcggccacgacttctcaccgcagctcatcgaagactggcgcaccttcctgcagcagcagctgcgcacggaggcgcagcgatga

SEQ ID NO: 7128 - DNA, 294 bp, Myxococcus xanthus
atggccgagccgaggcgttggtatttgattacctatgacatccgcgaccccaagcggtggcggaaggtgcatgccctgctgaagggatacggagagtggctgcagctctccgtgttccgctgctcgctgacggaccgggaccgggagaagctgcgctgggagctgtcgcggcggatggacgccgtggatacgttgctggtgattgggctgtgtggcgggtgcgtggagcgcgtgcgcgccatcaacgcgaaggaggactggccggaggagcccgcaccgttcaaggtgctgtga

SEQ ID NO: 7129 - DNA, 843 bp, Myxococcus xanthus
gtggcctccgcgtcgaagatggtgtccggcacccttctcttcgagctcatccgccaaggccgtctctcgttggactccaccacgggccaggtgctcggctggacggggaacaaggcgggaatcaccctgcgacacctgctctccttcacgtcgggactgcaaccctcgcacctctgcacgttccaatccggcatcaccctggcggactgtgtcgccagcatcgcccagaccccacaagtcgcggctcccggggcgcgcttcgactacggcagcacccacttgcaagtcgccgcgcgcatggcggaggtgagcacgggcaagacgtggaacgccctcttcaccgagacgctggcccagccgctgggcctgccttcaggcgtcacctacttcaccgcgcccaatcacccgctgggcaccaccaatcccctggtggcgggcgggctgcgcgcgtccatgaatgagtacgcgcccctgctggcgctcgtcttccaccggggcacgcatcccggcggtgtcatcggcacgccggagctcttcgacgcacaggccgtcgagcccttccctggcgtcgtcgtcggcaattcgccagcggcggacatgggcctggacctccgctatggcctgacggcgtggctggagtgccccacgcccgcgcagggctgcgccgtcatcagctcgccaggggcgttcggatggacgccctgggtggaccgggaggcgggctactacgccgtcctcgggatgcaccttcagcgggatgacccgggcgcgggcgtcgtcagcttcgcgatgcacctctccacggaggtgaagcccctcatccgggcggcgctggccccctga

SEQ ID NO: 7130 - DNA, 258 bp, Myxococcus xanthus
atgtccgacgaacgcttcacgaccagccgcgaggtctaccaccgcatccagtgggacccgcggttcgacccccgcgagttcaccatcggctacgacgcccatggtgagacgcgcgaggagatgccattcgcggccttcgttccggacggcgagattccctggcaccgcgtctggtacttcaagcggggccaccaggtggtctgggaccgcgagcagcgcttggacctgctgaattcgccgcaacctccgcccgggtag

SEQ ID NO: 7131 - DNA, 1224 bp, Myxococcus xanthus
  unsure (1)..(1224): unsure at all n locations
gcctatgcgcgtgtgggggaaggagacccgctcacgctcgaggacctggccaaggtcgagcggcggctggtcgccacgggcctcttccaggaggtgaaggtcagctacgagccttccgggccgggccgggtgcggctgattctgnaggtggaggacaaggcatcctgggtggtggcgcccaccttcgtgctgcaatccgacaacgtcggcggcggcgtgctgtacgcggagaacaacctctggggccgcagcaagaagttcgcgaccgcggcccaggtgagcacggcggagagcggcatcttcgcgggcttcctggacccgaacctcttcgggctgccccagctccgcttcagcctggaaggccagcttcgcagcgaccgggtagacgagtaccaggccggctccggccagcggcgcccagaggtggtgcgacggacgcggatgaactccgcgtccatcgccggagagctgggcttcctgctgttcgagcgcgtccgcgcggcggccaagtaccggctgatgtccatcgacgcgaagtcccccgacaccgccgaggaggtgacgacgcccgcgttctccctgggcccgtcgcagcaggatgcgtccctgcggctgatggtgggcatcgacacgcggcagaacctgcacgcggtgatggagggcctcaacctggaggcttcctacgagctctccaatcccggcgtcggcagtgacttccgctacgagcgcttcggactgctgtaccgccatggcctgcggctggtgggtgaacacaacctggtgctgcgcggcgaggccgtggcgggggtggacctgccgttccatcaggagttcgtgatgggcggcaattcactgcgcggcttcgtctaccgtcagttccggggcgacacgcgcctgtccttcaccgccgagtaccacttccccctcttcacggtgaacccgctgtccttccgcggcgtcgccttctccgacacggggatgatgatgtggcgcaagctgcccggggaccgggagttgcgggacgtcaatgggcgcgtggtgcgcagctacctaccggatacggaagacgggctggggaacgccacggtggcccagggcgtgggcgccggcctgcggctgtacctgcgcaacatcgtgctgcccctggtgggcgtggacgcggcctacagcgtcaactcgggcgagttccgcttctatctggtggcgggtgtgaatccgtcctag

SEQ ID NO: 7132 - DNA, 382 bp, Myxococcus xanthus
atgtcccaggagagcaccctcgaggcgcgagacctccgcctcatccaggccatcgtcgaggagggcagcgtgacgcgcgcggcgcggcggctgtacctgagccagtcggcgatcagccaccagctttcagggctcgaaacgcggctcggagtcaccctcttcgagcgcgtgcgcaagcgcatggtcatcacgcccgcgggccaacggctggcggcgctcgccgccgaggtgctgccgaggctcgcacgggaacaggccctgctgcgcgccgcgctgacgcccacgccgccacgtcccttgcgcctcgccgcccagtgctacacctgctaccagtggctgccgcggttgctgacggggctgtccacagcgcacccagaggtgg

SEQ ID NO: 7133 - DNA, 201 bp, Myxococcus xanthus
gtgagaaagagcaggtttaccgaggagcagatggtccgcatcctgcgggaggcggagacgcctggggccagcgtggtggaggtggcccggaagcacggcgtcgtcgagcagacgctctaccggtggcggcagaagttcggcggcatggaggcaggcgacgcgacgcggctcagggagttggagaaggagaacgcgcgtctg

SEQ ID NO: 7134 - DNA, 1170 bp, Myxococcus xanthus
atgcgggagaagttcgtcccggtcacgtatgccgaggtggacggtctggccatccaagagggcgacatggtcctggggacggtgcagcagatggaggcgcgcgtgcgcgaggtgaaggccctggggctggatgcctcgggcccccgagcccagggcctcgccaagaccgacctgaactcgcgctggcccaacgccgtggttccgtacaccatcgactcgggcgttgcgaaccagaatcgaatccaggacgccatcaatcactggcatgaccggacccacatctcgttcgtgctccgcacggcgaacaacgcggcgcaatatcctgactacgttcgcatccagtcgggcaccggatgctccgcccactatggccgtctgggtgggcaacaaggggtgtggctggatggcagttgcagcacgggcaccatcatccacgagctgggacacagcctgggactcaaccacgagcacaaccgccaggaccgcgacacctacgtcatcatccggtgggagaacatggtggcgggcgcggcgtcccagttccagcagaacaacaacgaggacgacgacttctttggctatgacttcggctccatcatgcactacggcccgatgcagggctcgaagaacgggcggccgaccatcgagggccggggtggacagaccatcgggcagcgcaacgcgctgagcacgctcgacgtcgtgacggtgacgcggctctattcgaggaccatcacgcttcgtgcttcaaacggcgactacctggtggccgagggcggcggtggcgccatggtggacgccaatcgcgtcgcagtggggccttgggagcggttccagttggtggacctggacggcaatgacctggtgacgggcgaccttgtccaactccagaccatcaacggcaacttcgtccaggcgacgaacggtggtggctcgacgctgaacgcctgggagatggctcccggcaactgggagaccttccgcatttggaagatggccggcacgggtctctccaccatcgccaccggcgacggcgtggtcctgggcacactcactccgggctatcccaagtactggcaggcggtgaacggcggcggcgctggagtgaccgtcaacaccgacaccatcaacctgggccccgcgaacatcttcaccgtcgcgttcccgtga

SEQ ID NO: 7135 - DNA, 174 bp, Myxococcus xanthus
atggtgggtgagcggaccctgtactgcgacggctcgaacgatgactggggtgtcacgacccggtattacaagcacatcatgatgtcgtgtgataacggggtctaccagcagttcaagtgctacgattgcaccaagttcccgtgcaaggtggttccctgtccatatcaaaactga

SEQ ID NO: 7136 - DNA, 201 bp, Myxococcus xanthus
atgccccacgacgacgcggccgcgctgcggcggcagaagacgctggagcgcgtgacgctgggccccgccgccgaggcacatgagcccaagagtcatcggcgacgcgcaacccccctcaagggccgcaagaaggcccccagcgagatgaacgtgaagcacctcggcgggccgaagaagcgcctgccccttcacggcggctag

SEQ ID NO: 7137 - DNA, 381 bp, Myxococcus xanthus
atgctgctcccggtgggactgttcttcctgcggcccctgctcctgcagtccgccatcttcatcgggatggggctgttgttccggcgcacgagctggccggtgtcgctgcggcgcgagcagcagcgtcagttgaaggcatgggtctggggcttgccggccgcggctgaactcacgcgggtggagcgtcaggtggcgcccacgctgcatgccggacgcgtggtgcaactcgattacgtcttcacggtgcatggccagcgcgtcgaagggagcgtgccttcaccgcatgcgtcggacctgctgcggcgcccgggagagcgcgtgtgggccgtctacgtggcggaggacccgggcgccagcgcgctgtggccaccgggcccttga

SEQ ID NO: 7138 - DNA, 552 bp, Myxococcus xanthus
atgcggattcgttaccgtttgattctgaccggtgcgggcgtgctcgccgtggcgctgggcgccgtggagttctggccccagccggagccggagccgctgcccgccgcgctgctcgccatggccgtgcctcctcctgctcctcccgcgccgcccccccgtgtggtgccggtgacggcccccgaggtggcgccgcccgcccccgtgcctcggcaagaggcgccccaggtcacggtggcccggatggcgcccgagcccgtggtgccctcgccagaggagtcctttcctccgcctgaggacaacgacgacatcgagcccgagctgccacaaacagcccagtgggagctggagaagacggcgcggctggcggcgctggtggagcgagacgtggtgcggctggcgcgcgagcgtgaggacgccgtggcacaaggcgacgtgcagcggggcgagcagattgacgcgctccttcagcgcaacctgggacagttgcgcgagctgcacgacgaggtccgcaggctggccgaggaggtgaacggcgtcgtccccgaggaatga

SEQ ID NO: 7139 - DNA, 177 bp, Myxococcus xanthus
atgggcccgaagcacccgggcatcaagctgtcggccctgattggcaatgagcggagcatgttgagtgtctcctcctcgctcaaggaggctatccagaagcactgcgcgaacgagattgaatccctcccattcacgctctacgaccactgcaatcgcccccaccgcgagggcaagtag

SEQ ID NO: 7140 - DNA, 894 bp, Myxococcus xanthus
cgcacgaagctgtggtggagcgtggtgctgccggcgtgtgcgtgtggcggcgccgcgaagacgggcgacgagctccgctcacggcaagcggggctgtcgctctccgccacgccaggagacgcccggggcaccttcgttcatgaggacgagacggtgacgttctcctctcgcgaggtggagccaggggtgtaccggctggaggtccggctgcgcgggttgacgctcaccgggttgatggagccggcccgcggcgtctccacgttggatggtttcgcggaggcgaatgccagggatgcgcagatgggcgtcgcggaccgcgcgctgctcaccgccctctatcgcgagctcaatgaggcgcttcccagcggagacgcggcggcccccgcggcgatgtacctgcgccgcgcggtgagcgtgtggtcccagtatccggacaccgtggggctgcggcgcgcggtgatgggcgagaaggggcgtggctacacgatgttgtgcagctatgcgcagtgcaacgggcgcaactcgggcagttgtgaggggcgctacaactggtacgcccacgcgacgcacgactgtgaccggggcggcttcgactggcccggcaaccagcagttggcccagctcggtgaccactactcctgcaacggggacgagttctttctggccggcgatacctggcactgcggttcgcccaaccactggcaccggccgaaggtggtgggtaactgcttcgggcgctgcggcagcacgtgcggcggcgacacccagtacacggtggatgccaccaaccacgacagttgcgtgcgcaatggccacatcctggtgagcggctggtgcaatgaccaattcaccgccgccgtggatgacgagctgttcgcccccaactgctactga

SEQ ID NO: 7141 - DNA, 390 bp, Myxococcus xanthus
atggcgcggccgggccgggccgaggaggtggtggaggaggggccgcggctggaattcagggaggcgctccagctccgaatcgaccaggggctgagcgccgcgggcgccgccgccgtgagcctgcgacgtgggcgggtggggctccacctgaccgggtcgccgtgggtgcggggcggactggaggtgtcgttcgaccggctcgtcctcctgcccggtccgctccaggggccgccgctggccctccatgaggccagcgtcaccttcaccgtgatgccccagcgtgcctggctgagcgtggggctgttccggccgcaggtaggccgggagagcctcaccagtggcttcgaggtggactcgctggacaaggccatcacacaaggcccctttaga

SEQ ID NO: 7142 - DNA, 462 bp, Myxococcus xanthus
atgaatcgcttcctgccgttgctcgtcatcgcgctcgtcaccgcgcccctggcctcgctcgccgcgccgccgtcccagcccgcgaagaaggaggtgcccgctcgccagggcaagctcgtcttcgtggccaccacgggcctggaggacctcggcaccctctccagctccctccggcacgtgaagaacgccaaggagtcgggctacctctcggacgtggtgtggctcacctacggccgcgcggtggtggcgctggacccgacggtgaaggccgtgccggcggaggtccgtgaggcggcccaggcggcgaaggccgctggcgtgcggctggtggcgtgcggcaccgcgctgcagaagtttggcatcgacccgaagaagctccagccccaggctgacgtggtggacgatggcgtggcggagctgtcgcgcctggtggccgagggctaccaggtcatccgctactag

SEQ ID NO: 7143 - DNA, 897 bp, Myxococcus xanthus
gtggggcccctcacggtggccctgctgattggcatctcactgcggacggccctggggctggcccccggcctgatggagggcacgcgctactcggcgcgcacggtgctgcggttgggcatcgtgttgatgggcgcgcggctcgacttcgggctggtggcgaaggtgggccctcgcgtgctgctgctggccctggccgtcatcgtcggcggcattctgggcatccgctgggtgacgaagcgcttcggcgtgccggagaagctgggcacgctgctggcggtggggacttccatttgtggcgccagcgcggtggtggccgccagctccgtcacccgcgcggaggaggaggacaccacgctggcggtggggctgtgcggaatcctgggcacggtgggcgtcctcttctacgtcttcgtggggccgctgctggggctgagcaccgcgcaactcgccatcctgtcgggcgccacgttgcatgaggtggcgcaggtgatggccgcggccttcacctggggcacctccgccggggacctgggcacgctggtcaagctcacccgcgtggtgctgctggcccccgcgctcgtggtgctggggctggtctccggcgcgggcgggcaggtgcgctattcgctgaaggagccacccattccgtggttcgtcatcggcttcctcgcggtgggcgtgctgggcacggtgggcgtgttgcccgccgccgccaaggcgtggctctccaccgccagcgtcttcctcatggtgatggccatggcggccatggggcttggcacccacctgagcatggtccgccgcgcgggcatgcgggtcgtctacgcgggcctcgttggcttcgccgccctcgcgctggccgcctgggggctcatccatgtgctgtccatccagtag

SEQ ID NO: 7144 - DNA, 1599 bp, Myxococcus xanthus
atgtcccgtctcctgtccgcgctcggcgcgctgctcgtcctggcctcaggctgtgcttcatcccggcctccggtcaccgccagcgctcccacgtctcagcgccagcagctcaccgtcatctacgtggcggacctgcacgcgcaactgcgcgcccacccggagctcttctggaacgatgggaaggagcgcatcgagatggcgggcggattcgcccgcgtcgccgccgccatccaacagattcgggccgagcgcggtggtgacgtgctggtgctcgacgccggcgacacgattcaaggttcgggcgcggctgctctcaccgagggcggcgtcctcatcgaaccgctcaatgcgctcgggctggacggcgcggtgcccggcaactgggaggtggtgtacggccccgcggtgctgcgccagcgcgcgcgtgagctgaagcatccgctcttcgctgccaacctgcgtgacgcggccagcggtgaacggctcttcccgccgtacctggtgaaggaggtgggcggggtgaaggtggccgtggtgggcttcacggacccggacgtcccgcgccgtcagcccccggggtacagcaaggggctgcgctacgacggcccggaggcgctgccggagctggtgcgcgaggtgcgcgagcgcgagggcgcccaggtggtgctcttgatgtcgcacgtggggctcgccaaggccgtggggatcgccgcccgggtgccgggcgtggacgcccacctgtccagcgacacgcatgagcgcacctatgtccccatcgagcagggcggaagctgggtggtggagcccggcgccttcggctccttcctcggccggatggacttgtggctggaggacgggaaggtggtggaccgccgctgggagctcatcgagctgaccgcgtcgcgcttccccgaggacccggagatggcgcggctcgtggacgccgcgctcgcgccttatgacgagcagctgtcctcgccggtggggcacaccgacgtgacgctcgcgcgctacgcggtggtggagaacccgctggacaacgtgctggctgacgccatccgcgccgctggcgggacggagattggcctctccaacggcttccgcttcggcacgccgctgctgcccgggcccgtgcgtgaggcggacctgtggaacttctttcccatcaccaacaagctgaagacgggcaaggtgagtggccgtcagcttcgcgccttctgggagcaggagctggagaacgttttcgcgaaggacccggagaagcgcttcggcgggtggctgccgcgcccctcggggatgacggtgcgcttccgctcggaggcccccaaggggcagcgcctcctcgccctggaggtcgctggcgagccggtggtggatgagcgcctctacaccgtgacggcctgcgagcgggagggggactcgccggacatgctctgccgcatccccggggtccaggatccgcaggtgctcgacatggacgcgcacgaggcggtgcgccgcttcctcgctggcaagccgcgactgcgcgagtcgctggagggccgcgcggtgggcctggacctgccggccgtgctccgcacccagcaggttcaaccgtga

SEQ ID NO: 7145 - DNA, 252 bp, Myxococcus xanthus
tgctctcaggcggcaggcgccacgctggtggatgtccgcacgcccgaggagttcgcctccggtcacctgcccggcgcggtgaacatcccggtggatgaactggcacggcggttcggagagcttggctcgctgcagacgcccctggttgtctactgccgcagtggcgcacgcagcggccgtgccgagcgcctgttgaaggagcaggggttccaggacgtcttcaatctcggccccatgtcgacgtggccgtga

SEQ ID NO: 7146 - DNA, 813 bp, Myxococcus xanthus
atggtgctcaacgcctacttcctacaggaagaggccacccgggacgcgcggcggggggcggcggagtccccggtgctggaagaggtgctcgccaaggcctccgcgctgggcgtgcgcgcgctgcgcaccaatggacacaacgacgcgctgtcgaaggtgggggacaccgccatccaggtggcgccgctggagtacgacgaggtggccctggtcggcctggattgggtgctcacccgcgcccgcttccatggcgttcgcctggtgctgacgctggggaactactgggatgcgtatgggggcgcgcaccaatacgtggagtggcgagggctcccccggcccgtggaaggggatgctcggttcttcaccgacccggtggtggtggcgcacttcaaggcgcatgtggcgcggttgctcaaccgggtgaacacggtggacggcatccgctatggcgaccacccgcccgtcctggcctgggagctgctcaacgagccgcgggaacgggggctggacaaggaaggggcgcggctgcgcgcatggattgatcacgtggcgcgcgaggtgaagacgcacgcgcccggccacctggtggggacgggggaggagggcttcgagccgtctcccgacgggtacgaccctggcttctggtcccgctccgggtcgccggtgcttcgcacgccgggggccagcttcacgcgcaacacggcgtccccgtacatcgacttcgcgtcggtgcacttctatccggagtcctggggcctgggcggcatcgacacggccgaggccggcgctcggtggattcctttagagcacagc

SEQ ID NO: 7147 - DNA, 1386 bp, Myxococcus xanthus
atgccccacccacgcatcgccgccgcgaaggtcaccttccacatccacccggaagagctgcgcctggaggccctgggcagctaccgcatccgcaacaagaccgacgcgcccatctccaaggtgatgctcaaccttccggacgacgcccgggtgcgcggcctgtccctcgccggcgtgacgaagcccgcgatgcatgacgccgagctcggcatcttcatctacgagctgcccacgccgctggcgcccggcgccgactccgccatcgtgttcgacctggagttcggcacgaagggcttcaagcacggcggggcgcgcacggacatcgtgggcaacggcaccttcttcgacaacatgaagctgccggtgctcggctaccagacgggcgccgagttggaggacgaccgggaccgcaaggactacggcctgccgcctcgcgagcgcctgccggaccgcgacgacccgaaggcgaagcaggacaactacatccgccaggactcggacttcatcgccttcgaggccacggtgagcacggcgaaggaccagattgccattgccccgggttacctggagaaggagtggaccgagggcaaccgccgcttcttccactaccggatggacaaacccatcctcaacttcttctccgtcctgtccgcgcgctacgaggtgatgcgcgacacgtggcgcgacgtgaagctggagatctaccaccaccccacgcacaccttcgcgctggaccggatgatgcgcggcatgaaggacacgctggagtactgcagcgagaacttcgggccgtatcagcaccggcaggcccgcatcctggagttcccccgctacgcgagcttcgcccagtccttccccaatacgattccgtattcggaggcactgggcttcatcgcccgcgtggaggacggacgcgccgacgacgtggactacccgtactacgtcaccgcgcacgagattgcccaccagtggtgggcgcaccaggtggtgggcgcgcgcgcgcagggcgccacgatgacgtcggagacgatgtcgcagtacgccgcgctgatggtgatgaagcaccgcttcgggccgatgaagatgaagcgcttcctcaagttcgagctggaccgctacctcgcggcccgcgcgttcgaatcgaagaaggaggtgccgctggcacgggtggaacagcagctgtacatccactaccagaagggcagcctcgtcatgtacgcgctgcaggacttcatcggcgaggagcgggtgaaccgcgccctgcgccgctacgtggagaaggtccgcttccagggcccgccgtacaccggctcctccgagctgctgggcttcctccgggaagagacgccgccggagtaccagtacctcatcgaggacctgttcgag

SEQ ID NO: 7148 - DNA, 1137 bp, Myxococcus xanthus
atgttcaccgccctcctgaccttcgaattgcggcgccgggtgaagatgatctccacctgggtctacgccctgatgctggccgccgccgccgcgctgatgacgctggcgattggcgccgtgttcaaggggttctcggtggcgtcgggcccggagctggtccgcgtcaacagcccgcacaccgtcttcagcttcaccatcagcctggcctacttcggcctcttcatggtggccgccgtcttcggccaggccgcctaccaggacttcggccacaacacgtggatgctcatcttcacgaagaacgtgaagaagggcccgtacctgctcggccggttcctgggtgcgtacctcttcagcgcggtgctgatgctggccatcatccccgggctgatggtgggcgccgcgtgcgtgtggctggtggatgccgatcggctcggtcggttccagctcacttcctacctctggccctacgtcatgggggtgtggcccacgctcttcttcgcgggcgcagtcttcttctcgctgaccgccctgacgcggcgcatggcccccgtgaacgtgggcgtcgtggtgctggtgatggggtacctgacgctcagcgccgccatgtccgacgtgcagcaccaggacctggcgtccctgctggacccgttcggcttcctcaccttcgagaacgcgacccgctactggacgggcggccgagcgcaaccaggaccacgtccccttcgccgggctgctgctcgccaaccggttgctgtggagtgtggtgggcgccgcgctcctgggactggccgtcctgcgcttccgcaccaccgtggaggagcagcggggacgcggcacgcgcaaggagaaggaggcccccgccccggtcgccatccccaccaccctggcgtcgcccacgacgggcagttggctgcgcacggccttcgccacctcctggctggcataccgcgacatcctccgctccccggtgttctggtccttcgtcgtggcagggctggccatgggcaccatgggcatctccatttcgaagcagatatacggcaccgccacctggccggtgacgtggcaggtgctggagacggccacgcgaacgttccagcccttcctgctcatcaccatcaccttctatgcgggtga

SEQ ID NO: 7149 - DNA, 882 bp, Myxococcus xanthus
atggagctcagactggaaggcgtgtcgaagacgtaccccaacggcacccgtgcgttgcagggtgtcaacctcacgattccgcgcggaatgttcgggctgctcgggcccaacggcgccggcaagtccacgctgatgcgcagcatcgccacactgcaggacgtggacgcgggcaccatgaccttcgacggcatcgacctgcgccgggacaaggaccggctgcgcgaggtactgggttacctcccacaggacttcggcgtgtaccccaaggtgacggcctgggacatgctggaccatctggcccagctcaagggcctggcccagcgcggcccgcgccatgacacggtgaaggcgctcctccagaagacgaacctctgggagcatcgcgaccggcggctcggtggattctccggcggcatgaagcagcgcttcggcatcgcccaggccctgctcggcaatcccaagctgctcatcgtggacgagcccaccgccgggctcgaccccgccgagcgcttccgcttccacaacctgctggcggagatcagcaccgacgtggtggtgctgttgtccacgcacatcgtctccgacgtggcggacctctgtcagaacatggccatcctcgcccaggggaacgtcgtggccagcggccacccgctgaagctggtggagtccctgcaccagcgcgtgtggaagcgcttcgtcacccaccaggaggaactggacgcgctcatgaaacagttggaggtcatcgccgtgcggcgcgtggccggtcagcgactggtccatgtctacgcggagtccccgccagagggcttcgagcccgccagccccgacctggaggacgtgtacttccacgcgctcgcccgggcatccaagcagccctga

SEQ ID NO: 7150 - DNA, 219 bp, Myxococcus xanthus
atgacgcgcaacctgcgcacgggcaccaactatctggagacgcacatagagcaactggggcccacccggtatgagctgacctgccggcccgtggtggtggcgggcttctacgtggggctcttcctggcggggctggaggccagcggggcgaaacacccctcggtccagattgtccggagggagggcgaggaggcggtgtacgacatcgcttggagctga

SEQ ID NO: 7151 - DNA, 144 bp, Myxococcus xanthus
atgcgacgcctgctcctcgcctccctcctgtccgccacgggggcctccgccgcacccaatgtcccgccaggctacgtccaggcctccgactggctcgaccgcacccgtcagccggagcgctacgggcctctcaacgtgctcgac

SEQ ID NO: 7152 - DNA, 1035 bp, Myxococcus xanthus
atgcacctgcgcgagcctgcccgtgtgctcgcgctgactgcccttgcgctcgcgacgcccgcgctagccgccgagggattcacctccgtcaccgccagtggggatgacggcaacgtcccctccaacgccatcgacggcgaccccaccacgcgctggtccagcgacggcgtgggagaatggctcaccggcgacctgggcgcggtgaagtcactcagcgccgtggacatctcctggcaccgtggcaacgagcgcgtcaatcgcttcgtcatctccatctccacggacggcacgaacttcacgcaggtgcactccggcagctcgtccggcaacaccgccgcgccggagcgttactcgttctccccggtgaacgcacgctacgtgcgcatcaccgtgaacggcagcacgatgaacacctgggccagcatcgcggagctggcggccgtcaccgacggctcgaacccgcccggcgctccccccgagcgtttcacctccgtcgccgccagcggagatgacggcaacgtccccgccaacgccatcgacggcgaccccgccacgcggtggtccagcgacggcgtggggcaatggattaccggcgacctgggcaccgtggcgcagttgggcgccatggacatcggctggcaccgtggcaacgagcgcgtcaacaacttcgtcatctccacctccacggacggcacgaccttcacgcaggtgcattccggcaggtcatccggcaacaccgccgcgctggagcgctactcgttctccccagtgagcgcgcgctacgtgcgcatcaccgtgaacggcagcacgatgaacacctgggccagcatcgcggaaatgcagcccggcaccggctcgaccccgcccaccaatccgcccaccgacccgcctggcgagcagggccaggacaagttcggcgtgacgatgatctatccgaccaggtcgggcggcgagcagtggttcctggcggacaacgctacgtccgacaagcgcttcgggccgcaggtgtgcgctcaactcctccaggcccttaga

SEQ ID NO: 7153 - DNA, 2157 bp, Myxococcus xanthus
atgctggccggctgcaaggaagacaaggcgccggaagctccggacgcgggtccggtggagacaggaccggccgctctcacggagaaggagcccaacgaccggcccgaccaggccttggatatcacccgcaacagcacggtgagcgcggaactcaccgcgcagccgaacaaggcggacgaggactggtaccggctggcgcccggcgcgccgcgcatcgcggacgtcaccgtgtccggcctgcccggcggagacatcacccttgaggtgtatgaccgcgaccgcaaccgcctggtgggcatcaacagcgagggtgagggcaagccggagcggttccccaacctctacgtggagaacgagcgcttcattcgcgtggtgcccacccgcaagggtgtgggcggcgcgtacacgctcgaagtccgcatgcgcgcgcccgaggacggcgaggagcgcgaacccaacgaccgcgccgtggacgcggtgagcctgcccttgggccagacggtgacggccttcctgggccatgccggcgacgaggactggtaccgcatcgagctgccggacccgacgcagccctcggctccggaaggcgcgggcccgggtgggtcggcggaggaccccgcgaccgcgccttccggcgattcgccgtcgcagggcacgccgtccccgggagatggcaccgcgccgcagggaatgggcggcacgctgcccggaactggcggcacaggcgcccctctggggcaggacgacgcgatgggcggcggtcgcgccggtcaacagggcacgaccggcgctggcgcccagcacggacagggcaaccctggcgcgaggcaggacctgaccggcaacggtttcgagaccgaggaaggcgcggccccccggggcgccgaagcagatggaacgcccggcctcacagcccaggagggcatgcggggcgcgtcgctcggccagggtggagtggatgacttcgcgcgtgacgaggcgccgccctcccctgccgtggagggcaccttcgcgggcagcgagccgccgcccgtgggcagccaggcggtgggcgaagccattgcccgtgcgctggacgcaggcacggcagtgcctcccgaaccgccctcggtggcgctgaaaatcgagctgaccggcgtggacggtgtgcgaccggagctgtccgtgctgtccgcggcggaggcgccgctcttcaccctgcgcggcaaggagggcgagacgctgtcgctgcgaaacatcggcgtgcgcgccatggaccgggtcgtctacgtggtggtgaagacgagctgggtgggcaccggcaaggaggcccgcaggccgttcaacgccaccatgccgtacacgctcaccgtgtcgcaggaggaggccggcgccagcgcggagctggagccgaacgacgagctccacaaggccaccccggtgacggccggcggctaccgccagggcttcctggctcccaagggcgacgtggaccacttcgtcctgaagacgtccgagccggtgctggcgaaggtggagttgaccggcgtcgagcggctggacctcgtgctctccatggtggagcccccggagggggaatccggaaaggagacggtgctgctgcgcgccaacgacggcgccatcaaggagcccgagcgcctcaacaacgtcgcctgcaacggcgcctgctacttccgagtggagggcgcgtcgcgcaaggtggacggcaagtgggtgaaggacttcgagaacgccgagcagccctaccgcatcaccgtcaccacggtgccggacaacggcggcgaggagcgcgagcccaacaacaccgcggaccgggcgcaggacctgatgctggggcagccggtgcggggcacggtgtatccagtgaaggacacggacttcttccggttggacctgtcggaccggccggtgcgcacgcccatccgggccacgctgctgggcatcctgaaggtcgatgtggggctgtacctgcaccgcgtgcagccggacgggaagctgtcgctcgtgcagacggctgaccgggccaagggcgaccagccggagagcatccgctacagcgccgagccaggcgtctacctcttcgaggtccgggacgcgcgcaaccgcgagtccaacttccaggactcgtaccagctcaccgtcgaggagacggagtag

SEQ ID NO: 7154 - DNA, 921 bp, Myxococcus xanthus
gtgctggtggaccgcgcctcgcgaggcgacagcgcctggacgtcccacctgctgacgtcgagcgcctggctcggtgcgagagtggacgcggcgacgggcgccctggagctgagcttcgaccacctggtgatggatggcaccgcgatggccgagctctcgcttgcggcctcggagggcttgccgcgcagggagggccgcgcggcgccgggcgaatggctcaccggtcccgaggagccgtcgccgctgctgcgagtggagctgccggaggggctcgacttccggaacctcgcctgcgcgatgctccaggcggtgcagcgggccggcgagggcgtgttccccgtcgacaatcccacgctgctggtgccggtgctgcccgcgtcgccgcacaccgtggcgcggaagtggcggcgcattggtatcgcggtggtgccctcgcggacgcgcacagggccgatgactcccgcgcacgtcgcgcacctgctggagcagacccggcggggcggcggcgtgctgaaggacatcttctccacgttgtactcaccggcgctgccgtggtggatgccctcgctcaccacgcacggcttcgccttcacgcccttgctgcggcaggtgcccgccgccctgggaggcaatgccctgctgtccaaaatcaccttggaggtcgacgatgatgaagcgctggcgcggcactcctcgctcttcttcaacacgatgcggccgctgtcggccgtggggggcggcgtggccctctgcgtgacggaggtcctccacgcgacgccctcgggcgtgcgcaagcgcttcttcgcggcgctcgcgggcagtggtgccctgggctcgcgcgagaagctgctggccttccgggatgtgctcgtcgcggaggccgtcagcagggcccggccgcggcgcccggcactcccttga

SEQ ID NO: 7155 - DNA, 828 bp, Myxococcus xanthus
atccggccgcgaccgcacctccagttccccttcgacgcgagcttcccgcgcatctggcaccgcaacggccctggcaccacgcacctgtggaacgggctcaacatgctcttcccccagggcgagcggttcttcgtgcgcagcgtcaaccactacatgccgcaactggcggacacgcccgcgctgcacgcgcaggtgaaggccttcttcgcgcaggaaggcaagcacgcgcgcgagcaccaggactacatcgagctgctggagtcccagggttacgacatccgccgcttcatgcggcggtacgagtcattcctctggggcgtcatcgacgcgaagtttccgccgtcgctgcggctgtccatcaccgccgcgctggagcactacacggcgctgatgggcgagaacacgctgacgctgggcgtgttcgcggacggccacccggcgatgcgcaacctcatcgagtggcacgccgccgaggagattgagcacaaggcggtggccttcgacgtgctgcggaaggtggcaccgggctatgggctgcgcgtgctgggcatggtgctgggcgtgttgtcgctcttcgccctgtggttcgccgccacggtgacgctgctgcgccaggagcgtgggctggggtggacggggctgctgcgcgagctgtggcgcgctcaccggaaggacccggtgctgttccaggtgctggggaggggcttgcggcagtacctgcgcccctccttccacccgctggacaatgacaacctggagttggccagggcccacctggcgacactggaggcgccgcctccggaggtcccggaacgcgaagcggcatag

SEQ ID NO: 7156 - DNA, 2297 bp, Myxococcus xanthus
  unsure (1)..(2297): unsure at all n locations
atgcacactctgcgtggggctccggccctttctgacttcaggctcgccaagctcctggcccagtgccgtgagcgggtgccctccgtctcatccatctatgcggagttcgtgcacctcatcgacgctccggcgcccctctccgaggcggacctggccaccctgggccgcctgctcgactacgggccccgcgtggccacgggcgcgcgcatcggcagcctgctgctcgtgctgcctcggccgggcaccatctccccctggtcctccaaggccacggacattgtccacaactgcggcctgggcgaacgggtgcggcgcatggagcgcggcaccgccttcttcatcgcgggccccgacgggcaggcgttgcaggatgcggagctggagcgcctgaagccggtgctgcatgaccggatgacgcaggcggtggtggggcgtctcgaagacgcggccatcctgttcgccgggcacacgccccggcccttcacgacggtggacgtgctgggcggaggccgcgcggcattggtgaccgccaaccgcgagctgggcctggccctggccgacgatgagatggactacctggtggcgcgcttcaccgagctgaagcgcaaccccaccgacgtcgagctgatgatgttcgcgcaggccaacagcgagcactgccggcacaagatcttcaacgcgagttggaccatcgacggcaagccgcaggagcgttcgctcttccaagccatcaagaacacctacgtccagcacaaggaaggcgtgctcggcgcgtacaaggacaacgcggccgtcatcgaaggcttcgaggtggaccgcttcttcccgtcccccgaatccggtgagtggggctccgtgcgcgagccggcccacatcatgatcaaggtggagacgcacaaccacccgacggccatctccccgtacccgggcgccgccaccggcgcgggcggcgagattcgcgatgaaggagccaccggccgtggcgcccggcccaaggccggcctcaccggcttcagcgtgagccacctgcgcatcccgggcttcgagcagccctgggagcagccctacggcaagccggaccgcatcgtctccgcgctggacatcatggtggacggccccctgggcggcgcggccttcaacaacgagttcggccggccgaacctcacgggctatttccgcagctacgaggtgcaggtccccacgcccggtggcgtggaggtgcgcggctaccacaaacccatcatgattgccggtggcctgggcaacatccgcgcgtcgcacgtgcagaagggacgcctgcagccgggcgacaagctcatcgtcctgggtgggcccgcgatgctcatcggcctgggcggtggcgcggcgtcctccatggcgcagggcgcgagcgcggcggacctcgacttcgcctccgtgcagcgggacaacgcggagatggagcgtcgctgtcaggaggtcatcgacagctgctgggcgctgggcgacaagaaccccatccgctccatccacgacgtgggcgccggcggtctgtccaacgcggtgccggagctggcccacgacaacgacctgggcgggcgcctggagctgcgcgcggtgcccaacgcagagccgggcatgtcgccagtggagatctggtgcaacgaggcacaggagcgctacgtgctgggcgtggcgccagaggacctggcccgcttcgccgcgctgtgcgagcgggagcgtgcgcccttctccgtgctgggtgacgccaccgccgagcagaccctgaagctgggggacacgcagttcggcaacgcgcccatcgacctgcccatggacgtgctgttcggcaagccgccgcgcatgcaccgtgacgtgacgtcgcgcccggtgtcgttcgcgccgctgacgctggatggctcgctggcgctgctggcggagcgcgtactgagtcaccccacggtggcggacaagagcttcctcatcaccattggcgaccgcaccgtgtccgggctcagcagccgggaccagatggtgggcccctggcaggtgccggtggcggactgcgcggtgacgctgtccaccgtgacgagcaccacgggcgaggccatggccatgggcgagcgcacgccgctggccctcatcgacgcggcggcctcggcgcgcatggcggtgggcgaggcgctcaccaacatcgccgcggcccgcatcggcaagctgtccgacgtgaagctgtccgccaactggatggccgcggcgggcagcccgggcgaggacgccagcctctacgccgncgtncacgcgggggggcatggagc

SEQ ID NO: 7157 - DNA, 291 bp, Myxococcus xanthus
atggtcgacaccagcccttcgcgctccgcgcccaccctggtcctcatcgacgcgtccggcttcatcttccgcgcctaccacgccatccctccgctcacgacgagcaagggtgtgcagaccaacgccgtgttgggcttcacgcgcatggtgctcaaggccctgcgtgagctgaagcccacgcacgtggcgctcgccttcgacaaggagagccgcaccgagcgccagaagattgatccaacgtacaaggccaaccgcgaggggcccccggaggacctggtcccccagtacgcc

SEQ ID NO: 7158 - DNA, 1338 bp, Myxococcus xanthus
atggtgccggccgggctggtgggcgtgctgctgatggtgggcatggtgtcctccatcctgaaccccaagccggtggacgttcaggggccgggcggggccgcgcagatggatccgacgcagaagatccaggacctgctgagcgagtgccgctcctacgcatccagcgagctgggcgcccccaactgggagaaggcccacgaggtctgcacccaggcattggacctggaccccatccacccggaggcgaacacgctcatccggcgcatcaagctggagaaggagtccttcgagtactactcgcagggcgagcggctcctgcagcgcctcaagccggaagaggccctggagtcgttccggaagatccagaaggagagcgagtacttccgccgcgcccgcgccaaggcgcgcgaggccgccgaggcggtgacgaagcgcgcacaggaggactgcaagctgtacctgcgtgactcgcagtggagcgccgccgtgtcacgctgcgaggtgtacatggcggtgtggtgccagtcgaagccgcgcgaggacctgcagccgcccctgggcttcacgctgaagctggagggccgcctgcgccgcgacgagtggcggccgaaggatccgatgttcgtgaagttcctcatcgcgcggcagaagatggacgccaacgcggcgccctgggtgtgcccggtggcggaggttctggccggtgacgagcgggtcgcggacccgcgcaccttcgtcatggaggcggcgaagaagcgcttccccaacaagctgatgcaggccgcgctcctggactactggggtggccgtggcagcgaggcgctggccaccatgcagaagctgcgcgccaactacgaggccgcgcagtaccacgccgaggcggacgagctgatgaagatcatgtccaccgtggatcagctcttcaaggtgggccagagctatctggccgccgaggatccggagaaggccgcggagcccttccgcgaggcgctggccacggacaaggcggtgatgctggagctcgcggagtccaagccgtccttctaccggcgcaacatcctccaggacatcgcggagaagtcgtaccagcgcggcaagcactgggccgaccgcgaggaccgccgccgcgcctgccgcgtgtggaagctggggttcagcttctacgcgggcaatccgaacctgaacaaggcggcggccttctgctcctcgagggcactggaggccttccgtgcggcgtcgggctgcggcgacatggcggtggcgctggactacgccgtcaagggcgacggtgtggaggagatggtcgtcgcgaagcaggcggagctgggctgcaagtag

SEQ ID NO: 7159 - DNA, 808 bp, Myxococcus xanthus
atggccaccctggtcgtccgtcaccccgacggcactgagaacgaattcgccatcacgggcgagctgaagattggccgccagcagggcagtgacatcctcatcaccgaagggggcgtgtcgcgtacgcacgcgcgcgtcttcgacgaaggcggcaccgtcttcatcgaggacgtgggcagcgccaacggcacgttcgtcgacggccagcgcatcatggagcccacggccctgacgccgcagtcggaggtcctcctcggggactacgtgctgcgtctcaaaccggccgcggtgcggggttctggggcccggcgctcggcggccaggcccgcggcggggggcgatgagcccatgccggtgggcgacgagggcggcggtgtacgcgccacccgggccatgcccagcatcaagaagggctccggcgcagcgaagagcgagcccggcgcggcgctggcgaagcggcccgcgcgtccggcacgtcccgccccgggtggcggcgcacgtccggcgccggcgggtggcccggtgcttcgcggcatggtcggtccctgggcccgccagacatatccgctcaaggggcaaggtgctggtggggcggcagccgcccgccggcatcatgctggatgacgactccgtgagccgccgccacgcggagctggaagcgaccagctcgggcgtgacggtgcgggacctgggcagcgccaacgggacgctgctcaacggcgagccgttggaccagacgccggtcccgctcgagccgggggatcagctccagttcggcgtggtggagatgaccttcgagcccgaaccg

SEQ ID NO: 7160 - DNA, 1845 bp, Myxococcus xanthus
atgcaacccggttctcacgctttgaggacgaaggggggcttgctagcatccgtccccatgtttctcatcaccctcgctgaaaagggcggcgggaccgagcagcgcgagtatcacaagaatgaagtcaccatcggccgtctgccgggcaatgacatcatcctcgcgaagggcaacgtctccaagtaccactcgcgaatcgttgccaaggacgggaagttcatcatcgtggacatgaagtccacgaatggcacgttcgtgaacggcaagaagattgccgcgccccaggttctcaagccgaccgaccaggtctacatcggcgactacatcctcaacgtcgaggcgctcgaggacgagggcccggtgatgacccgcgcgggtcagcccgaagaggagtactacgacgagcagggcgaggagccctacgaggacgaggaaggggcttacgaagaagacgagccctacgaggaggaggaagaagaagcgccgcctcccgcgcccgctcccaagggcatgccggcgtcgctggcgtccgccctggcgaagaacaagcgcaaggtggatccgcgtcaggagcgctacacccggctccagaaggaaatccatgaccggctcatcgagtacctcgatctgcgccgcatggacatggaccggctcggcgacgacgagctgtggcgccgcaccgagaaggccatccgcgacatcatcgaccagatggaagcggacggagagcttccggaggacgtggaccgcgaggagctgctcacggacgtcatcaacgaggcgctggggctcgggcccctcgaggcgttcctcgcgtcggatgacatcagcgagatcatggtgaaccacgccaaccagatctacatcgagcgcaagggcaagctgaccctgtcggagaagacgttctcctccaaccaggcggtgctcggcgtcatcgagcgcatcgtggcgcccattggccgccgcatcgacgagtccagcccgctggtggacgcgcgcctcaaggacggcagccgcgtcaacgccatcatccctccgctggcgctgaagggtccctgcatcaccatccgcaagttcaagaaggactcgctgaagatcgcggacctcatcaagtacaagaccgtcacggcgcagatggccgagttcctggagatgtgcgtcaaggcccggcgcaacatcgtcatctccggcggcaccggctccgggaagacgacgacgctgaacatcatcagctccttcatcccggagggtgagcgcatcatcaccgtggaggacgccgccgagctgcaactgccgcaggaccactgggtgcagctggagagccggccgcccaacctggaaggcaagggcgccatcaccatccgcgagctggtgaagaactgcctgcgcatgcggcccgaccgcatcgtcgtgggtgagtgccgctccggtgagacgctggacatgctccaggccatgaacaccggccacgacggttcgctcaccacgctccatgcgaatacgccgcgagacgccatcgcccgcttggagacgatggtgctcatgtccggcatggacctgccggtgaaggccatccgtgagcagatcgccagcgcggtgcacatgatcgtgcagcagacgcgcttctccgacggcacgcggaagatctgctacatcaccgaggtgtccggcatggaggtcgatatcgtgaccctccaggacatcttctatttcaaacaggatggcttcacggaggaccacaaggtccgtggccgctacgtcgcctccggcttcgtgccgaagttctacgacgagctgcagcgtaagggcatccccgtcaacatgagcatcttccgcgaggactga

SEQ ID NO: 7161 - DNA, 567 bp, Myxococcus xanthus
tctctgacggtgcgggagctgatgcaggcgtgtggtgagcagggcctgctgctcttctgttgcatcctgaccttccccttcctcctgcccgtgtcgattccgggcgtgtccacggtgttcggcctgctcatcgtcctcatcggcgtgggcgtgacgttcaaccggacgccctggctgccccggaagctgctggacaagccgctgctgcgcaccaacctggccccggcgttggacaagggcgcggacgtcttcaccaagtacgtggacaagatgagcaagccgcggctgctggcgctcacgcacggctccagcaccaaccgcttcaacggcttcatgctcttcttcgcgggcgtgctgctgatgatgccgttcggcctgattcccttcagcaacacgctgcccgcgctggccgcgctcttcttcgccatcggcatcctgcagcgcgacggctacttcatcctcatggggcacgggatgacggtggggtcgctcacctacttcaccgtcatcatctacggcgccgtgcaggggggccgcagcctggccagtgtcttcggcgggggctga

SEQ ID NO: 7162 - DNA, 693 bp, Myxococcus xanthus
acgaaaacgacgggccgcgtgcgcgtcttcgacttcggcctggtgcggggcgccaccacggagagcgcctcgcagcccagcgatgcctccacgcccagtgacgcgtctggcttcgccggcaccgcggagtacatggcccccgagcaatgtgcgggcaacgcggacatctccacgcgcacggacgtgtacgcgctgggcgtcctcctctacgagatgctcaccggacggccgcccttcttcggccccaccccggacgtgctccaggcccacctgtcgctgcgcccaccgcccccgtccgacttcgcgcccgtgccgcccgcggtggaggaggtggtgctgcgctgtctggcgaaggagcccgcccgccgtccggagaacgccgccgcgctgggcagcgcgctgcgcgaggccttcgagcacgcccaccgcgcaaccgagcccgcgacgcctcggcccgcggcgccgggcgaaccgcgccccgcgcaggtgcgccgctccgtcgccatcctgttcctcacctcgcgcgccaaccccgtgtcgctccagaaggccctggcctcctatggcggccacctggccttctccgacgcccagcgcatcgccgccgtcttcgacccggacgcgggagagaacccggtgcgccgcgccatgcgcgccgcggaaggactggcggagcggggcctttcccgcacc

SEQ ID NO: 7163 - DNA, 543 bp, Myxococcus xanthus
ttggagttgctggagaacattgagaaccagggcggtggcgcggggtcggagaaggccctggtcttcgttctgtcccgggcgatgcaggacctgttggcgcagctcatcgcggagcgattccgtctggggcgtgtcgacatcgtcaacggagagccagacagccggaaggcggcgcttcagaacatcgacgccttttcgcgggccaagggattccaggtcttgattctgagcccactagcggcgggagccggactcaacatcgtcgcggcgaatcacgtcatccactacgggcgttggtggaaccccgcgaaggaagaccaagcgacggaccgcgcccatcgcatcgggcaggtgcgtcccgtgcatgtgtactacccgctgctccaccgccagggtcgtcccgatatgggcttcgacctgcggcttcatgatctggtcgagcgcaagcgcgccatcgcgcgtgacttcctgtcgcccacgaacgacgacactcagcagtactcgggtgtcttccagagggctcatgaagagggggagggctga

SEQ ID NO: 7164 - DNA, 1770 bp, Myxococcus xanthus
atgccgcggcccgccctcatccgggcggagccctctcagggcttgcgcgagacgtgcagggcactgttccggcattcgtgggggcacgcgctgggaaagaacctgacgggcatcgcactcgtcatgacgttcggtctgctgggaaaggtactggtggggcccgtcagggaggcgctgatgggcggcggcgcggcgggggccacgcaggcggtgttgctctccgctgccatcgggcagatgggagccaagttctttgtctcagcgatgggcttggtggggtcgttcttcttccaggcgatcgcgtcggtccaggagagtcggttgctggcgaggctggatgccatgcgtcctcgtttcgagtccgctacccagacgctggatgcacacggcatcgtgttggcgaccgcgaggcgggacgcgctgagcgcgctgaagggtgagctggtccagacacgtcgcgagctctcggagcggctcctccatctggagagcgtcgaggtctcactccaggacattggcacccaggtccagacgagcttcggcaccatgatgaaggagcaggtcggtgacgtcatcacccggcagctctccgcggtggagaaggccgtgcgggagatagccaccgacctccagcgctccatcgcctccggattcgcggcgacgctccagcaggagatgtccacagtccgtgacagcctgggctccatccagcagtcgctctccgagcggcaggagcatgacctggggcgcatcctcgaacagctccgggacgccgtgtccggcggatttcattcccagtcccaggacatggcgaggcagatgcaggagctgctgggcgtgcttccccggcttgaacagcagttcgaggccatgtctcacatgatgggaacccaggcgcgtcagtggggcgcggagaaccagcgcgcaatcgacgtgctgggggctcgcgtcaccacggtcgtggagagcttcgactaggtgcgggatggactggaggtcgctgtctctcgcgttctcaaggcgtccacggagtcgtcacatcggctggggatggagaatcagcaggtgctcgggcagttggagcgcagcgtggagtccgtcgtggagcgcttccagcaggtgctagcgggcatggatgcgagcacccagcggctcgtgcaatccgcgtcgcattcagccgagcacatccatcagcaggcgggaactcagtcgatattgctgtcgcaacaggtggaggcgctccgctcggccgcgaacgtagacatgaacagcttccagagccggtccgaggaattctccaaggtcatggggacgacccaggatgggctccggcagctcacggagcaactgcgaaacacagccagccagcttgcttccgcgacccggggggccggtgaaacgcatgacaaggcgaagggggcagctgttcagttggagcaggtctctcgccagctcatcgagactgccaaggagttcaatcaggtcacccagggccgccgcgaagtcgtcaaggtggaggagaatctgctgaacgcgcagcgccaggcgattgaacgtattcagcccgtgctcaacggattgacgcgcagctacgaggagtccgtcgagaaacaggcacaggcgttgagtggccagtggaccaaggtcatgcaggacctgagaggcgtggtggagaagacgtcgggggaactggctcagggcgtcgatgacctcagcgagacggttcaggaactcagcaaggcgctgaagacgcaggtgcggcggacatga

SEQ ID NO: 7165 - DNA, 735 bp, Myxococcus xanthus
atgagcgcctctggagatgggagtgagaagtcgctggcggacctcatggcgggcgtcgcggtagtgttcctgctgttggcggtcatcttcattctcgaagcgcatgagcagcgtgaggccgccatccgcgacaaggaggccgccatcgagaaggtggattcgcagaaggagggcgtccaggaatcactcatcgcgctgcgggaggatttgatttcacttgatgccatgctcgatggcggcttcatcgcgctcagcgggctggatggtggcgtgaatgccttggagattgaattcaagaacatgcagttcggcctgggccagtgccggacgcctcttgcctatgtcgagcagttcgagcgcggcgctgttccccttattcatcgcgtctgccaggcggtggaggccatgcgggacgcgggcgcggagccctccatcatcctggaagggcacaccgatgaccgtccgttcctggggacgagttgggagtgcggtgtccgggaaggggtggcgcggtacagcttcgagaacaatgtgagggcgagtgccgcgcgcgcccaagaagtattcttcacggtgcgtaatcaactccgcgacgcgggctacgagcgggactgcttcgattcgaacttcgttgtctcagggcgtgggcagaccgcgccccggcctgggacggatggcagcgagcctgagaaccggcggctcgtcatccgcgtgcgcggcgacctgcgcttgtag

SEQ ID NO: 7166 - DNA, 867 bp, Myxococcus xanthus
atggtcggctatggcgcgtgggcactcagccaggttgagcgcttcccggggctacgcacgctggagcttgaacacctctactaccagacccggggacagcgccttgccgcgtccgtcgtcgcaacggtgcccgccgagcacgtcgagcgcgagtggcagacaaaggtcgagccccaggtcgaagcgatgaaagagcacgcgcaagccgcccgcgcttccgacgtgcccgcgaactacggccccccctgcggcaagtatggcggatgtccgttcatggcgaagtgcctcacaggagagaacaagacgatgtccctgcgtgacaagctgctcaacaaggcttccgaatccactccacttaccgttgccgcggttgagcgcgatgccccggagccgcccgccgttcttcccccggacgcgcccacacctacgcctgtgcagacggctccggaggtcgcccaggccactgagcagcccgcgccgaagcgtcgcggtcgccctcgcaaggcggccgagtccgagcagcccaccgacgcggccccgtcgcctccgagcgcgcttcgcgtgctcttcgtcgactgcatcccgacgaccatcgacggaccgacgcctgagtcgcttacgagctacgtcgacaccatgcatcgcaaggtggccgaagcgggcggcgtcgacgacgtgcgcttcgcgggctccgactcggcgctcgggttcggcaagtggcgcggggcgctggccatggcggcgcgcgccgagctgcccgcccccggcagctacgtcgcgctcggggtctcccagtcggagctgatgcaggtcatcgtcgaggcgctcgaaccggcgttcgacgtggtcgttcgaggtcttcgctag

SEQ ID NO: 7167 - DNA, 813 bp, Myxococcus xanthus
cgacgcaaggtggtcctcatcactggcgcatcctctggcatcggtcaggcctgcgcggagctcctgggggcacatggccacgccgtccatggtaccagccgccatccccgcgcggatggtgcccaccaccggatggccgtgttggacgtcacggatgaggattccgttcagcgcgcggtggcgtcggtgctcgcggccgagggccggctcgacgtggtggtgaactgcgcgggcttcgtgatggccggcgccgtggaggacgtgtccgtcgaagaagcccagcggcagatggacaccaacttcttcggcgcgctgcgcgtctgccgggcggtgcttcccacgatgcgcgcgcagcggtcgggcctcatcgtcaacatcagctccatgggcggcgccgcagggcttcccttccaggggctctatagcgccagcaagttcgccctggaggggatgacggagagcctccggcaggaagtcgcggccttcggcatcgaggccacgctgctgcagcccggggatgtcctcacgcgcgtgcgtgagtaccggcagcgcgcccggcagtccggtcccgggtccgcctaccaggaggccttcgagcgcgtcatgaacctggtggagtcaggagaaggcgcgggcgttcctcccgagcacgtcgcccggaagctcctggccctggtggagcggcagcgcgtggacgtgcgctactccgtgggtcgcctgtcgcagcgcatcggcctggtgtcgaagcgcctgctgcccgggcgcaccttcgagcacctcgtgatggcgctccacggcatgtcgcggcgctga

SEQ ID NO: 7168 - DNA, 1269 bp, Myxococcus xanthus
atgattcccttcttgatgatgttgccgatgctcgtccccgcgggtgtcaaacgtggacgctccagcaaggcacggagggaaggggggctgagtccagtgccttcacccacggaggaatcaggaagcgcgccgcctgtccgcgcctcctcgcggcggcggctgccggcccaggtcctggggcagcgggccctcaaccgggccctgctccagcgtcagtggctgttgcagcgttcccgggcgggcgtgatggaggcgcttgagcacctggtggggcttcaagcccaggccacccatcctccctacggcgcattgtggacgcggctgaacggcttccagcaagaggcgctgacccggctcatgaccgagcgccaggtggtgcgcgccgggatgatgcgcgggacgttgcacctggtgaccgcgcgtgactgcctcgcgctgcgtcccgtgctgcaacccgcgctggacagggggctgaagcactcctcccatggcaagcagttggcgggcgtggaggtccaggcgctggtggcggagggacgggcgctgctggaggcacgtcccagtccccggggcgagctgggccagcggctccaggagaggtggcccggccatgatgcgagcgccctgagcctgggcttctcgagcctggagccgctcgtgacggtgccaccctgtggaacgtggggccatggcgagcggatggtgtacgccaccgccgagtcctggctcggccagcgcttcgagcccgccgcgccgccagacgcgctggtgatgcgctacctcgccgcgtttggccccgcgagcgccaaggacctgcaggcctggtcgggcctgccacgcatgggcgctgtcctggagcggttgaggcctgagctgcgcgccttccgtgacgagcacggcgtcgagctgttcgacatcccgaatgcccggaggcccgacccggacacgcccgcgcccgtccgcttcctgtccgaattcgacagcgtgctgctggcccacgcggaccgcacgcgcatcatctccgatgccgcccgcaagcgcgtcttcaccatcaacggcatcgtgcgcgccaccatcctcgtcgatggcttcgttcgaggtacctggcgcattgaacgtgcgcgcggcaccgcgaccttgtgcatcacgcccttcgcgcggctgtcgcgtgaggaccgcgccgcgctgagcgacgagggcgggcggctgctcgccttcgccgcctcggatggccagcacgccgacattcgcttcgagcgggtggggtga

SEQ ID NO: 7169 - DNA, 1725 bp, Myxococcus xanthus
atgggcttcccatcgccgcgcgtgaagtcgctcctggcgttgatgctcctgtgcctggcccccgtcacctggggctgtggtggttcggagccgtcgccctcccccagacccgatgcgggcccccagcggccggacgcgggggcatcgacgaacgacgcgggcacggatgccgggacggaggaccccgacgcgggagagccgcctccgggcttcacgctccaaaccgcgtccgaagtgacactccggttcatcccggaggcaagcgcggggctgaacgtcaccatcacccgcgagcccacgttcaccgatgccgtgcacctctccatcgaggggcttcccgagcatgtgcacgtgaccaccgacgtcatcgccgccacggagtccgaagccacgctctcgctcgccgcccaggagttcgcccgctacggcagtgtgcccgtaacgctggtcgcgagcggcggaggggctcgcgtcgagcatcccctgaacctcgtcatccggcccggcccggcggcgctggacacctcgttcggcggcaatggcgtggcgatgcccgccttcggccacccggaggtgcgcatccacgccctggcggcgcagccggacggcaagtggatcctggcgggcgccacgggctccaccggcctgcgcgacgtcctggtggcacgtctgctcccgaacgggacgttggaccctgcctttggcacccagggcaccgtcaccctggacgtctgtggcggcgatgactacgtggacgccgtcaccgtgctgtccgacgggcgaatcctcgtcgcggggggcgccatcgcgggtcctgggagctgctcggggaggcagtaccagagcctgctcttcgcccggtacacctcggcgggcgacctggacaccacctttggcgacacgggggtgcgtaccttccagatttccgcgggcaacgccacgctgcatgccgtcacggtggattcgagggggcgcatcgtcggtgccggcactgtgcagcacgatgacctggacttcgtcatcatgcgcctgacgcccacgggcgccgccgatacgaccttcagctcggatggactggcctgggatgacctgggcgcagacgaggacggcctggccgttgtcaccctggccgacgaccgcatcgtggtggcgggaaccacgaatgccatccgcaatcgcatggccttgcggcgctacaacgtcaacggcacgcccgactcgagcttcacgtaccgaagcgcgtcggattggcctcgcctcaccccccggaccctgcacctgctggacgggggcaagttgctggtgggcggcagcgggcggtggaatgcgggcaccgattcccccaacagcggcgcggtgacacgggtccacgcaagcggcagccctgatacgagcttcggctgggatggcgatagcgtcacccactggtccgcgccaggagtccagcaggagcggctggtgggcacgggcatcctgcatggcggcgagctggtcctggcggtggccagcaccatcaatggcgccacggatggcatcggcctcatccacctgtccgccgatgggaagaccgccttgcggacgcaccgcaccaacctgccgggcgccgaggttgccctcgccgccgcgctagacaccgatggctcaatgtgcgtggcgggcctccgcgccgacgaaggctcgtccaccacggcgcccttcgcggcacgcttctggccccaccgctaa

SEQ ID NO: 7170 - DNA, 174 bp, Myxococcus xanthus
gagcagcgcgtcatgggtgacgcggagatgacgctcagcgagctgggcgagcacttcggattctcccgcgagcgcgcccgtcagttggagattcgggcgaaggacaagctcaagctcgcgctggtcacgctgatggccgaggccggcgtcgacgagagcaccctcaacgcctga

SEQ ID NO: 7171 - DNA, 658 bp, Myxococcus xanthus
atgcggcaatttcctcatgaaacccggcaccggccggaggatgcgacgcgtcgccacgcggaaggcgaggtcgtgggcgggcgctaccgcatcctcggcttcctgggccggggcggtgcgggcacggtgtggcgcgcgcaggatctgctggcgggccccgtcgcggtgaagcggctgcaccagacgctggaggacctggcgcggctgcctcggctgcccgagggcgagtacacgccgtcttccatcgcccggcatgagctggcgctgtcgctggcgcacgagttccagacgctcgcctcgctgcgccatccgaatgtcatcagcgtactggactacggcttcgacgccgagcaccggccctatctggccatggacctgctggaggacgctcggcacctggtgcaggcgggcacggggcagccactgcgtgtgcaggtggggctgctgatgcagacgctgatggcgctggcgtacctgcaccggcgcggcatcatccaccgcgacctcaagcccgccaacgtgctggtggcccacgggcaggtaaaggtgctggacttcggcctggcggtggggcgcgagcacgtccaccacgcgcagccgggcggcacgccgggctacctcgcgccagagctgttcgaggaccagccgccctcggagg

SEQ ID NO: 7172 - DNA, 177 bp, Myxococcus xanthus
atggccatccagaccgccgccctgcggaccctcaagcggccccccgagcagctcaagcgagaagacctcccgcagttgctcgaaggcctcaagcccatgctgaacaccttcatcggcgccctgcacgcgaaggtcatcctggcggagatttccgcctccttggagaagctgcgatga

SEQ ID NO: 7173 - DNA, 540 bp, Myxococcus xanthus
atgctcgtcgtcgtgctggcgaacgtcagcacgacgtacgcgctcatcctgctggcgatgacgtaccggcagtccggactccagccgccgtccagcgtccgctccaacgcgctgtgggtgggaacggccgtggccgcgctggccgtgggcgtgcccgtgctggccaccgaggtccgccacctgggcacggacgccatcagcaccatgtccgccgtcatcagcctggcgtcgacgctggccgacatgacgaccatcctgctggtggcccccatcctgggcgtcgcgtacatgctgcgcggcggacggctggcctgggtgtggtgggccatgggcgtctctggcgccatgtggctcttctacgacgcccgcgtgtggctggggcccctgctgcccggagacgcggcgcagaacgcggagttgctccgtacgctgcgcacgtcgggcctggtgctcctgggactcgcgggctggctgcagcgcaccgccctggcgccgcagcagtcccccgtcgctgcccaaacgcacgccggggtgtcctga

SEQ ID NO: 7174 - DNA, 1149 bp, Myxococcus xanthus
tacaagctcgacaacggcttgaaggtggtcctctcgcgcgacagctcggcgcccaaggccgtcgtcgccgtctattacaacatcggcttccgcatcgagccgaaggaccgcaccgggttcgcgcacctgttcgagcacatgatgttccagggctcgacgaacctcgggaagatggagttcatccgcctcatccagaagaacggcggcgtgctcaacggctccacccgcttcgacttcaccaactactttgaagtcatcccctccaacgcgctggagcccatcctctgggctgaggccgaccgcatgcgcgggctcgacgtgacggaggagaacctgaagaaccagcagggcgtggtgacgaacgaggtgaaggtcaacgtcctcaaccagccttatggcggcttcccgtggctggacatgccgcaggtggcgaacaccaactggtacaacgcccacaacttctacggcgacttgaaggacctggaggccgcctcgctggaggacgtgcgcgccttcttcaagacgtactacgcgcccagcaacgccgcgctggtcatcgtcggtgacttcgagccggagcaggtgaagggctggattcagaagtacttcgggccgctgcccaccgtggcgcagccgtcgaagccggacatctccgagccccgccagacgaaggagaagcgccacgacaagcaggacaagctggcgcagcgtccggcgctcgcggtgggctaccacatgcccgacgtgggcacgcccgagtacttcgccatggcgctggtcgacgaggtcctcctgcaaggcaacgatagcgcgctctaccagcagctcgtgcagaagaagggcctgacgggcgaggtctccggcggggtgaaccagctgggcaaccactggaactacaacggccccatgcagtggaccgcgtacctgttccatgacgcggacacgacgacggagaccctcctcgcggagatcgacggcgtggtggcgcagctgcagaatcagcccatcgacgcggcgacgctggagcgggcgcgggtgaaggcgcgctcggggctgtacgggcagttggagggcttcctcggcttcggccgcgcggacctgctggcgtccttcgcgctcttcttcgacgacccggcgcgcatctttaga

SEQ ID NO: 7175 - DNA, 516 bp, Myxococcus xanthus
atggggctgggggccctgctggccctgtggggggcgaacctcgtcttcgtcggcgcgctgggcgtgatggtgggcgccgtgcaaagcgtctctccggacgaggggaagacgacctcggatggcgtgggcatcctgctggtagcggcggtgttcgtcgccgtgggccgcttcgcgtggaagaaggggctgtctcccttccggaccgcgcgccgccacgagcagttgctgggcttcatccgcgcgcagacgcgcatccgcgtcagtgacgtggcctcgcagttccggctcccggaggaggaggtcgcggcgatgctcaccacgctcatcgcccgtcacgaggtggacctcgtctacctcgccgactcgcgtgtttaccttcaccgcgaagctttggagcgggggaagaacgtggccttgcgttgtccttcgtgtgatgcccccgtgagtgcggaggccgtccagccgggggacaaggtggattgctcctactgcgccgcgccattcctcgtgacgtag

SEQ ID NO: 7176 - DNA, 1650 bp, Myxococcus xanthus
aggggggccgcgctgggacggccggtgcccggcgggcctccgcatgcgatgcgccgtgcgcgctacaccgtgccgggccgtgagttcatcgacacgctggacgcggtgctgcggcatgacttctccacgagggatttgccgggccatggcctcaaggccgtcgcgaagcacctgggcctggcggggcccgagcgcgagcacatccccggtgcccgcgtatatgacgtcttccgcacggacccggcgcgcgtgcggcgctatgcgcgtgatgacgtgacggaggcgggcggcctcgcgaggctgctcgggggcgcggcctttgcgctcgcacgcatggcgccccgccgctacgagcggctggcggacgcggggccggccaccggcgtgttggacccgctgctcgtccgggcctatctccgggagggcgcggcgctgcccgcgcaccaggagggggatggcacgccgcacagcggcgcggcgctccacctgttcgccacgggcgtggcccggcgcatcgtgaaggcggacgtcgccagcctctatccctccctgatgcgccagtaccggattggccccaagcgggacaggctgggcgtgctgctggcgttggtggaccgcctggtggaccagcggctggcggcgaagggcagggcgcgtgccgcggcgcctggctcgcaggagcgcttcacgaacgaggcgctgtcggcggcgatgaaaatcgtcgtcaactccgcctacggctatctgggcgcggtggggctcacgcgcttctcggacgtgcacgcggccaacgaggtgacgcgccagggccgcgaggtgctgggcctcctctgccgggagctggctcgccggggcgtcacgctgctggaggcggacaccgacggcgtgtacttcgccgtcccggaggactggcgggaggccgacgagcgccgggtcgtctcggaggtcgccgcgctgctgccgccccgcgtgcaactggagttcgacgggcgctacgccgccatgctgtcgcacgaaccgaagaactacgcgctccagccgtatgacggaccgctggtgctccggggcgtggccttccgctccagccgcgcggagcccttcggagaggccttcctgcgccgcgcgttgcgctgtctcctggcggaagacatcccgggcgttcgtgaggtgtacgtcgcgacggtgatggccctgcgccgccgggagctgcccacgccggaggtctgcgcgcacgtccgcctgacgaagacgggcgcccagtacctcgccctccggccccgccggcgcgagctcccctacgaggccatgctggccagcggccggaaggaatggcctttgggtgagcaggtccgcgtctaccgcgccgtgggaggccgggcgggcctgctccccattccggaggcggatgacccgggcacggcgcggcccctgtcacgcgaggaggacccgcgcgactacgacgtggagtactacgtgcggctcctgcgtgagacgttcgccgcgcgactggtgcgcgcgctgacgccagaggacttccggaccgtgttcgacgaccctggccagccctccctcttcgcgccctcgctcgaggacgcgaagcccattctcacggtgctgacggagccggcggccgccctggaaggggcgtag

SEQ ID NO: 7177 - DNA, 1854 bp, Myxococcus xanthus
cggaaggatcgacaccggcgccggctgggcgggggagacggtgcgcttcccgggcggcggcggcgcgcagtggatgttaagctgcgcccccgtcccgtgcaggcggagctgcccgtgtggctcaccgccgcgggaaacccggagacgttcatcaccgcgggccggctggggtgcaacatcctcacgcacctgctggggcagacgtgggaggacctggagaagaagctgtcactttaccgtcaggcctggcgcgacgcgggccacgcgggcgagggccacgtcaccctcatgctgcacaccttcatcggcgaggacatggcgaaggtgcgcgaggtggtggagcagcccttccgcaactacctcaagagctcggccgacctgatgcgcggcctggggagcacgctgggcatcgacatggattcggccacggaggcggacctggaccggctcgccggccatgccttcgaccgctacttcgagacgagcggcctgttcggcacgccgcgttcggtgcgcgagcgcgtcgggcagctctactctctgggcgtggacgaggtggggtgcctcatcgacttcggtattcccgcagacacggtgctggccagcctgccgctgctggacgaagtgcggcagcgctgcgtgcgggacagccgccgcgcgggcacggcgaagacgattcccgagcagctccgcgagcacggcgtgacgcacctgcagtgcacgccgtccctggcgcgcgcgctgctgtccgagcccgagtccgtcgaggcgctgggcggcctgcaacggctgatggtgggcggcgaggcccttccgggcgcgttggccgcgtccctgcgcaaggcgctgccggagtccgccgagctgctcaacatgtacggccccacggagacgaccatctggtcctccacggcgcgcgtgaccccggaggagacggcggccgtcgtctccattggcacgccactgctgcgcacgtgcttgtacgtcctcgacgcacggatgcggccggcgccggtgggcgtggcgggtgagctgtacatcggcggcgcgggcgtggtgcgtggctatttgggccggcccgagctgacggcggagcgcttcattccggatgcctgggcccgtgagcccggggcccggctgtatcgcacgggggaccgcgcacggtggcggcccgacggcaccatggagttcctcggccgtgtggaccaccagctcaaggtgcgtggcttccgcatcgaggcgggggaaatcgaggcggcgctcaccgcccagccctcggtgcgcgaggcggtggtggtggcgcgcgaggatgtgcccggcgacgtgcggctcgtggcctacgtggtgcccgcgcagggcgccacggtggaggcgtccgcgctgcgcgacgccctggctcagcggttgccggagcacatggttccgtcgctcgtcatggagctaccggcgctcccgttgacgcccaatggcaaggtggaccgcagggccctgcccacgccgaacgtggtgcgctccgcgaaagcggccttcgtggcgccgcaggggcaactggaggagcagattgcccaggtgtggcgcagcgtcctccgtgtggagcaggtgggcgtgcacgacaacttcttcgacctgggcggccactcgctcctgatggtgcaggtgcacacccagctcaagtcggtgctgggccaggacctgcccctgctgaagctgctggagcaccccaccatcagcaccctggcgcgtttcgcgcggcaggggcccgcggcggcgcagtcccaggtggaagccgcgcaggaccgggccaagcggcagttggagagcctcaagcgtcagcgtcagcgcgccaggaagtag

SEQ ID NO: 7178 - DNA, 890 bp, Myxococcus xanthus
  unsure (1)..(890): unsure at all n locations
gtgtcgccacaaaatgggttgtcgaaggcgggtttggccgaagtgcgggctcgtttgaccgcggtccttgctcagcgattgggaatcgaggctcacacgctggatgtccgagagcgcttcagcctgtatgggcttgattcgctgaaggccaccggcttcatcgcggaagtgggggcgatgctggggcgttcattgtcgcccacgcttgcctgggaatatcccacgttggatgggttggcccgctacctcgcgggggagcgggatggcgcgtcgtcgcattccctggcacgtatcgcccgggcccatgagcctattgccattattggattggcctgtcgttatccccaggcggcggatccagaggccttctggcgcctgctcgtgggcgggacggatgccattacggaagtgccgccggaccggtgggacgtcaaccgcctttatgatcgagaccccgcggcgcccggcaaggtgatttcccgctggggcggctatctggatcgcgtggatggttttgacccgctcttcttcggcatctcaccgaaggaggcgctccacatggacccgcagcagcggctcatgctggagctgagctgggaggcgctggaggacgcgggcatcgcagcggaccggctgcagggctcacccacggcggtctgcttcggcgccgcgtggatggactacgagatgacgctgcagcgtttcggcatgaagcgcatctcctcgtacacgtccacgggttatcaccacagcgtcctggccaaccgggtctcctacgtcctgnggctgcgggggccgagcttctccatcgactcggcctgctcgtcctcgctcactgcggcgcacctggcctgtgagagcctgcgcangggcgagtcgacnctggccct

SEQ ID NO: 7179 - DNA, 369 bp, Myxococcus xanthus
atgctcttcctctgctccgacgtgggcgaggacgacgcccccacccgcatccgcgtgggctcccaccgggacgtcgcccgcgtgttggcccctgcgggggacgcggggttgacgttcatggagctcgccgggaagttggacgtgtcggcccaccggccgctcgcgctcgccacgggagaggccggcaccgtgtacctgtgccaccccttcctggtccatgccgcccagccgcaccagggaacccagccgcgcttcatggcccagccgccgctcctgtcccgcgcccccttctcggtacagggcccggaggacgacgcctcgccggtggcacgcgccatccggcaggcgctgaacgaaacgcgcgcgtag

SEQ ID NO: 7180 - DNA, 1275 bp, Myxococcus xanthus
cccggagcgctggtgggcgactgggtcatcgagtcacgcgtccacgcgggcgtgaccgcgtggctctatcgcgcgtcgcacctgtccacccgggctcccgccgcggtgaaggtggtgcgtgccgagttcaaccacgtcaccaacgtgctccgccgcttccagcaggaagcggacacgctccgggcgctgcgccatccccacatcgtggaggtgctcgagcacggcgaccttcgcgacggacgcccctggctggccatggaatggctggggggcgaaagcgtggaccagtggctcacgcaccgaggtcccttctccctcgcggaggcgctgacggtgatggaggaactgggcgccgcgctgcacttcgctcatggccgcggcatcctgcaccgggacctcaaggcccagaatgtgatggtcatccccctggcggagggcttcacggtgaagctggtggacttcggcatcgcccgcgtggagccaccggaggggctcgctggcctgacgtccggcggcgccgtgctcggcacgcccgtgtccatggcccccgagcagattcgtggacaggccctggacgcacgcaccgacctgtacgcgatgggtgtgcttctctaccaactcctcaccgggagcctgcctttcgagggcaccagcgtggtggaggtcgaggagcagcacctccatgcgccaccaccgcacctggatgaacgggtgcacgcaccgccagcactggacgccgtggttcaacggtgtctcgcgaaggccccaggggaccgctggccggacgtgcccgccttcctcgatgccttgcgcgcggcgctggcgcccaccccggatgcgacatgggccgtggctgtctatgtggacctccgcttcccggtggccctggatgagcccaccgacgcggacctggatgccagggacgccacgctggacgcgacgctcaccgaactggagacccgaggctggatgctcgccctggagagtggcaacgccgtgctcgcgtggaagtcactgcctcccgcctccgaggcccgtgtccctgccctggtggaagcgcgccaggtggcggattcgctgttgcggcaagcgtgtgaggccgcgggtgacagcgtggaagtccgcgtctatgcgcacgcggccctgtgtgagctgaacacggacgcccagggccttccgcggttggcgggtggtgagttgctgcgcctggagtcctgggcttcgggaggcacggcgggcgaggtcctgctgtcggatgcactcgccagccggtga

SEQ ID NO: 7181 - DNA, 945 bp, Myxococcus xanthus
acgttcggtgagctggtgggttcgtcgcccgtgacgcgcgccagcttcgccctcatggagcgagccgccgcgagcgacgcgacggtgttgctggagggggagacgggcacgggcaagagccgcgccgccttcgccatccatcaggccagcgcccgggcctcggggcccttcctcaccgtggactgcggcgccattcccggcaacctgctggagagcgagctgttcggccatgagaagggctccttcaccggcgccatccagcgccgcgttggcgccttcgaggaggcggatggcggcaccatcttcctggacgagattggcgagctgcccgcggagctgcagccgaagctgctgcgcgtcctggagaacaaggagattcgccggctgggcgccaacgggtaccagcccgtcaacgtgcgtgtcatcgccgccacgcaccgggacctgcgcgccgaggtgaacgcggcgcgcttccgctctgacctgttcttccgcctcgcggtggtgcgcatcatcatccccgcgctgcgggagcggcccgaggacatccccctcatcgcggagcgaatcctcatggccttcggggccggctccgagcagctcgcggcgctgagcacgccggagttcatcgcgcagctccagcacgccgcgtggccggggaacgtgcgcgagctgcgcaaccacctggagcgttgcctcgtcttccaggacgccatgccgccggacgccgaggaggtgagcgcgcaagcggtgctgcgcagcctggtggacccgaagcagccctacgcggaggcccgccgccgcgcgctggaggtcttcgagcgcgagtacctggatgcgctcctcaagctccacggaggcaaggtgtcgcaggccgccaccgccgcggacatggaccgcgtgtacctgtaccgcctgctgcgccggcaccggctgcggacgtag

SEQ ID NO: 7182 - DNA, 654 bp, Myxococcus xanthus
aacacgccctctcgtcatctcttcgtcgctggtgccacgggtgccacgggccgcacgctgatgcgacaggcgctgtcgcgcggtgcgccgcctgtcctcgcgcacgtgcgcccgaagagcgcggacagtgacctggtccgcccctggccccacaaggccgtggtggagctgtctgacggtgaggcgctggtggagatgatgcgcggctgcaccacggtgctccagttgataggcaccatgcgcaagcgcttcgggtcgggcgacacgtatgagacgagcgacatcggcaccacgcggcagttggtggaggccgccaggcgcgcgggggtggaccacctcgtgctgctcagctccgtgggcgcgggccggccggtgggcgcgtacctcaaggccaaggcggaggcggagcggctggtgcgagagagcggcatcccctggacggtggtgcgcccgcccgccttcgagggcgagtaccaccacatcaaccccgtgctgcgcgccctcacccgcctgcctccactgcggaacatgcggcccatccacctggaccaactcgccgccgtgctgctgcgtgtctccgagcaacgcgcgccactgaaccaggtgctggaaggcgacacgctctgggccgaggtcgctgccgcgggcgcctga

SEQ ID NO: 7183 - DNA, 1128 bp, Myxococcus xanthus
gtctctaaagagctggcggcgtggcgtcaggaagtcgccgaccgcgtggggcgcaagcccgtgctgcgcaaggcggccatcgagttcttcctctggtgcgcgccggatgccgcttcgtccgaagcggagctcacggtgctggcgctggtgcgcaccgcgaccgaccggagacaggtgaagcggctgaaggagcacccgtcgtcacgtgttcgcctccgcgtccggacgctccagtcctggttccagggcccgtcggcgaaggggaagccgggtgcccccgtggagccttcgcaggcttcaggccccgcgacgttgacggaggcgttgcggcacctgcatgtgacgcgcgcggtgccgctcggaggccggacgtggctgcgtgaccgggacctggaggagctgttgctgggcgccttcggtcgagtggaggcggagttctcttctcgctatccggagcgcttccgcgaggacaccgagacgctggcggcggacctgctcgaagcactgcgcgccgagctggcgcgggtgaaggcggacgtcgccgcgttgatggcccaggggcagccctcgccgtgggaactatcgatgacggtccggcgccgtgaaccggagcccgtgcccgagcctgtcccggtggacggcgaggtggctccggaggccgtgcctccgcctttggccgccgcgcggctgggggtggaggtggctttcgtcctcgacgtggcggtgggcgacttcctgcgcacgcggcgcgtggtgtccgtgcaggtggtgaagctcgaacagcgcggagaaggtcagtggctgcccgcattccggctgggccgggagcacctggacgcgcagttgctgcggaccgatgccgcgttctgcctgttcctggcgcctccgtttcctcgggccgagtgctgggtggttccgtcgcggacggtgcgcgcgatgatggaatcgcagcgctcgctgtcgggtgtgccgcgagacggggtgcagcgggtggcgcgctcactgtcccactggctgttgggcgacgtcgtcggtctgtggacgggggacgaacgcccggagtcgtttgcccggctgtctcgcgtggaggacgggccggacttcgtcgtcgaatggggcctccggtag

SEQ ID NO: 7184 - DNA, 525 bp, Myxococcus xanthus
ctggcggagtggaagaaggaccgcgtggtcatcacgaacgcggcgggcaagccggtgcccaaggaggaagcagacgaggtggcgaagcacctgccggagctcggcaagccccaccggatggaggccgcctttccgaagaatcctctggcggtgggcgccaccctggaaggcttctccgatacgctcgcgaagcaaatcgtggacgagcagggcgataacacccgtgtcacccaggcgcgcgcacggttggtcgaagtgcgtcaggacccgcgcggcgccgtgggcatcttcgacgtggcgatgacggtgttacgccaggaaaccaaggcaccgttcctgctgaccattccgctgcaagggcagatgtccgtcctcgcggagggcatccagttgctggagctcaccttgtccgggccggtgaaggtggagctgaccgacgacgccgtcgagcagggcttcgaggcgcgcggcgagggcgcgatgcggctgcggctcatgggccggaaggctgacgccgcgcgttag

SEQ ID NO: 7185 - DNA, 990 bp, Myxococcus xanthus
ctcggccacttccatcctcccaaccttctgaccaacgccttcttcgaggagctggggctggagaccagcgatgcgtggatagtggaccgcgtgggcatccgcacgcggcacacggtgctgccgctggactacctgcgggagacgcgcaatcgcgacgtgcgcgcggcgcaggaggcggcgctcttcagcaacgcggagacgggacgccgcgcggcgctgatggcgctggagcgcgcggggctgaagccgtccgacatcgggttggtggtggcgggcggatgcagtcccgacgagtgcattcccgccgagtccaaccgggtggcgcagttgctgaacatccatgcgccggcggtggacctgcagagcgcttgctcgtccttctgcatgcagctgcacttcctggcgggcatgcggccggagcggctgccggactacgtgctggtggtcaacatggacaactccacgcgtgtagtggactacacggaccgctccagcgcggtgctgtggggagacggcgcgtccgcggccatcctgtcgccgcgcgtgccgggacgctggcagctcacggagacgctgctggccggagacccctcgggcgcggacaaggtgcgcgtgccgcgcatggggcacttcacccagaacggcggcgaggtgcagaagttcgccatccgccgcgcgggggagacgttccaggccctgcgcacgcgcttcatggagcgtcacccggacaagggcgcgggggccgtctccttcatcgggcaccaggccaacctgcgcatgctggaggccgtgcagcggcggtgtgaggtgccggacgcgcggcacttcttcaacgtgcacacccgggggaacaccggcgccgcgggcgcgcccggcgtcctgagcgagcactgggacgaccccgccgtgggagacgcggtggtgctgagcgtcgtgggcagcggcctgacgtgggccggcgccttgctggagcgcaccccggcgcagtga

SEQ ID NO: 7186 - DNA, 507 bp, Myxococcus xanthus
atgctgctcgtcgcgggcgccgcgcaggcgggacagaagcaggttggcggcgtgcacatgccggtgtcgctgaacctcaaggggcgcaccgtcgaactcgcccacatggagctgcacaagcaactcttcttcaaggtctacgtctggagcctctacatggaggaccggccacgctccacgcacgaggccatcaactccaactccgtgaagcggctccacttccacttcctgcgcaacatctcccgggaccagctcgtgggcagcttccgggacgggttggagcacagccccgccctgcgccgggggccgctggcgaaccacctgcgcatcatgctcgcgtcgctgaaggacgtgcagaagggcgaggacctcgtcatcacctacaccccgggcgtcgggctcgaagtcggaggagatgcctccggtggcgtcttcatccccggcaagaacttcgcggacgcactcttctccgtctggctcgactctcatcctatttttccgcgctga

SEQ ID NO: 7187 - DNA, 435 bp, Myxococcus xanthus
gagtacgagaacctggcccagagcctcaagcaggagatttccgacggcaagattgagctgtccgagctcaagggcaagatgaccgtccagctcaaggacaagattctcttcgcctccggctccgcccgggtcggcaaggaaggcgaggaggcgctgaagaagatcgccgacgcgctcaagacggtgcaggggaagatcatccgcgtggaaggccacacggacgacgttccgaccggcggcggtcagttcccgtccaactgggagctgagccttgcacgcgccatggcggtggttcgttcactccagaacgctggcgtggacccgacgttcctctccgccgcgggctatgggcagtaccagcccatcgcggccaacgattcggcggagaatcgcagtctgaaccgccgcatcgaaatcgtgctcgcgccgaagtag

SEQ ID NO: 7188 - DNA, 2065 bp, Myxococcus xanthus
atgtccgccaccgcccaactgctcgaaaccgtccggaaggaagccaagccgggaatctggtccaacggcgtgaacctcgcccgctccggagccgtggtgctccagtcccagaaagggggcgagctggagctgagggtccgcgccaaggggcgcccggtcgccctcacggtcgtcctgtacccgaacgacgacgcctgggagtgcgactgccccagtcaggtggacccctgcgagcacgtggtggcggcggccatctccatccagcaggcggagaagcaggacacgcccatggagacggcggccacccgctgggcccgcgtcgtctaccacttcacccgcgtggacggcggcctggagctgcgccgctccatcgtccaggtggacggcgcggagacgccgctggagggcagcctgacgtcgttgatggcccggcccgcggaggccgcgaagctccaggtggagaacgcggacctgctggccgaccgcatcctggagcagcggcgcacacgtggcaccctggcgccggagacgctggaggcggtgctcaaggtgctggagtcggcgcgcaacgtgttgctcgacgggcgcccggtggcggtgtccgacgagcaggtgctgccacgcgcggtggtggaggaccgcagcggccagattgtggtgacggtgagcaaggacccgcgcgtccaggaggtggtcagtcccggggtggcgctcgcgagcgatacgctggtccgcctgggcgagacgaccatgtccggcccctggctgcagaacctgcccatcgtccgcacgtactcggcggaccacctgggtgacttgacctccaaaatcatgcccgagctgggccgccgcctgccggtggaggtccgcagcaagcggctgccgcgcctggaccgggagctgaagccgcgcatcctgctggagctgaaccagctcgacgccggcctgtccgtgctgcccacgctcgtctacggcgcgccgccggtggtgcgcatcgacaatgggcgcatggtgtacctgcgcggcgcggtgccgctgcgcgacgaggccgccgagcagcgcctcatccaccaactgcgcgacgagctgaacctggtgcccggccgccggctgacggtgcagggctcggagatggtgcgctgggcggacaagctgcggcgttggcgcggcgacctcgccggtgacgcggcggggctggtgagccccgacgtcaagctgcgcccgtcgctccacctggagtccagcgtcacggggcagggcgtccccgacgtgcgcttccagctctccttccaggtggagggggccaagggcgaggtcaaggccgtggacgccgccgccgtcatccgggcgtggacggaggggctggggctggtgcctctggacggtggtggctgggcgccgctgccccgggcctggctggacaagcacggtcagcgcgtggcagacctgctcaacgcgcggcaggaggatgggaaggtctccaaccacgcgctgccggagctcaccgcgctgtgcgagacgctggagcagccgcctccgccgggcctggaccggctggcgccgctcgtctccggcttcgagaagctgcccccgcccgagctgcccgcggagctcaacgccacgctgcgccagtaccagctccagggcgtcagctggctgggcttcctgcgcggcgcggggctgggcggcatcctggcggacgacatgggtctgggtaagacgctccagacgatttgcgccctggggcccgggtcgctcgtggtgtgccccaccagcgtgctgcccaactgggccgcggagctgaagcgcttccgcccgtcgctcaaggtgtgcgtgtaccacgggcccggccgcgcgctggagccgtccgccgacgtgacgctcaccacctacgccatcatgcgcctggacgcggcggtgctcggcgcgaagacgtgggactcgctggtgctggacgaggcgcaggccatcaagaatccggacagccaggtggcgcgcgcggccttcgggctcaaggcgaacttccgggtcgcggtcagcggcactccgataaagaggtttagag

SEQ ID NO: 7189 - DNA, 2193 bp, Myxococcus xanthus
ttcctgccgctggtggatccgctggtgtcgcgcgccgtgacgcagctcaccgccgcgctgaagcccatgaagcacgccgcgcctgggctcgacctggagccgagcgtcgtcgtctccacgatgctgggccacctgccccaggtgctggcaccagtgctgggccgtgccatggtggtggagctccatgccgcccagttggagggactgctcgcgggagacaccccggaagcgcgcttccaggacttcacgagacggctgcgccagccgcaggtcgccctggacatcctggagcgctacccggtgctggcccgctgcgtcgtcctgcgcatcggggagtgggagtccaactgcctggggctgatgaagcggttgacgcgggacgcgcccctgctctggcagcggttcaacgcgggccagtcccccggcgcgctggtggaggcacgcggcggcttctccgacccgcaccggggcggccaaggcgtcttcatcctccgcttcgagtccgggctgcggattgtctacaagccgcgctcactgggagcagaggccgggctccagcagctcctcacgtggctcaacgcgcgcggcgccacgcccatgatgaagggcgcggaggcgctggaccgaggcgaatacgggtggatggagtacgtggaccccgcgccgtgcgcgtcggcagaggaggtccggcgcttctacgaacgccagggcgcctacgtcgcgctgatgcacgcgctggacggcacggacctgcacttcgagaacctcatcgccgccggtgagcacccggtgctggtggacgtggagacgctcttccacccgctgtcgggcacgcgcacgcttcgagactccgagcacgcggtggaggcgccgccggtgtcggtgctccgcagcggactgctgccgcagcagttctggggcacgcgaaagaaggccggggtggacctgagcgggctgggcgctcgggcaggtcagctcacgccgcaggcctacttgatgacgacggagcgaggaacggaccggatgcgcttcgagcggcggccggtggagatgcccgggtccaacaacctgccccgcctggagggcgaaaccgcgcccgtgctggactaccgcgacgcgctggccgacggcttcacccgcatgtacggcctgctgttggagcaccgcgaggcgctgctcgccgaggacgggccgctggccgccttcgcgcacgtgcccatgcgcgtcctcttccgcaacacggcggtgtacggcgcgctcctcttcgagagctaccacccgcacgcgctgacggatgggctcgagcgccaacgcttcttcgaccacctgtggcgcgccgtggtgcctgccccggacttcgcggcgctcgtgcctctggaaacggagcagttggagcggggagacctgccgtacttcaccgcgcgcgccgactcgaaggacctggaggcgggctcgggccagcgcctgccggacttcttccaggagacgggcatggcgcgcgtgcgccgccggctggtgggcctgtcgccagaggaccagacgcggcagcgctgggtgctggagcgctcgctggatgtcctgctgctgagctcgcagacggtggcgcgtccgacatatcccttccgggagcacacccagcccggcctccgcgacgcgttgctcgtggaagcacgacgcgcgggtgaacggctgctgccattggccttcgaacgccgcgacgaagcgcattggcttggcctggacgcgggagacggcggctggcggctcggttctccggggccggacgtgttccaggggcgcgcgggcatcgcgctcgcgctgggctacctggcggacgtcacgcaagacgcgcgcttcacgcggctggcgcgggccacgctgcgcacccaggcgcgcctcctggcggaggagcccgccagcgtggtggggctgggcatcctcaatggctggggcggcatcctctacgcgctgacgcacctgggcgtgctgtggaaggacgatgcgctcctggacgaggccgcgggttacgtacgccggctgcggcccctggtggagaaggacacggtgctggacgtgggcgcgggcgccgcgggctgcctcctggcgctgctggtgctcggtgagcaccgcccgtcagacacgttgtgggccacggtggacgcctgcggccagcgcctggtgaacataagaaca

SEQ ID NO: 7190 - DNA, 261 bp, Myxococcus xanthus
atgaacagagacgacctgctcgatgtcctgacccgctatgtcgcgaatgaactcctggacggggacgcggaggacctcgattcctccacgcccctcttggagctcggcgtgctgaactcgctggagaccgcccggatgatgggcttcgtccagaagaagtacggcatcaccattccctcggagtcgctgaaggtcgaaaacctccagacgatctccgccatcgccgacctcgtctacgacgcgaggccccggcagccgtag

SEQ ID NO: 7191 - DNA, 4743 bp, Myxococcus xanthus
gctctaaggcgaaggtgcggcgtcctggtgctcaagcggctctcggatgcgcagcgggacaaggaccgcatcctcgccgtcatccgtggctccgcggtgaaccatgacgggctcagcggcggcctgacggtccccaacggacccgcgcaggagaagctgctgcgcaaggcgctggagtcggcgagcctggccccagcggacgtgaactacatcgaagcccatggcacggggacgccgctgggcgacccgattgagctgcgggcgctggacgcggtgctccggcatgggcgcggcgcggacgcaccgttgctcgtcggctccgcgaagacgaacctcggacacctggagtccgccgcgggtgccgcggggatgatcaaggtcgtgctgtcactgggacaggacgagattcctccgcacctgcacttccgtacgcccaacccggccgtggactggcagcagttgcagatcgccatccccacgcaggtgacgccgtggcccaagggcgacaagccccgcgtggccggtgtcagcggcttcgggctcagtggcgtcaacgcgcatgtcctcatcgaggaagctccgcccgcgcctgcccggacgccggatgcgacgccgcggccgatgcacgtcctgacgctgtccgcgcgcagtccccaggcgctgaacgagctggcgcagcggcatgcgcaggcgctcggcggcccggggctcgcgtcacagtcgctggaggacatctgcttcaccgcgaacaccgggcgggacgccttccgtcaccggctcgcggtgctggggagctcacaggaggccatgcaggcgcagttgacgtccttcctgtccgggcagacgtcatcgtcggtgctgcgcgggaaggcggacggggcgccccggctggccttcctgttcaccgggcagggcgcgcagtggttgggcatgggggaggagctcttccgcaccgagcccaccttccgcgagacgctcctgcgttgcgacgcggtgctgaagccgttgatgggccagtcgctcatcgacctgctgcaccccgccgagcgggacgcgcaggcgcgagcccggctggacgagacgggcttcacccagcccgcgttgttcgcgctcgagtacgccctggcgcaggtgtggatgcagtggggcctccgcccggactacgtgatggggcactccgtgggtgagttcgtggcggcctgcgtggccggcgtcttcaccctggaagaaggactggagctcatcgccacgcgcgcccggctgatgcagtccctgcctgcgggcgggacgatggccgccgtgtccgcggatgccgcggaggtggaggcgctgctctcccggtatgacgggcaggtgtccatcgcggccctcaatggtccccgcaacgtggtgatttcggggcgcgaggccgccgtcaatgaatgcgtggccgagctgacgcggaagggcaagcgcggcacgatgctgcgcgtctcgcacgcgttccactccgcgctgatggaccccatcctcgacgcgttctccaaggccgtggcgaaggtgaagctccagcccccgtccatcccgctgatttcgaacctgagcgggcacgaggcggggaaggaaatcctgacgcctgggtactgggtgcagcatcttcgtgagccggtgatgttcgcccggggcatgcagactatgcagcaggccggtgtgaaggccttcctggaggtcggcccgaagcccacgctggtgaccatgggccagtcctgcatcacgcaggaggacacgctctgggtggccagcttgaggccgtagcgctcggactggcagcagatgctggaggggctcgcggcccttcacgtagcgggcgtgcccgtggactggcggggcgtggaccaggggcgcgagcgccacaaggtcgcgttgcccgtctatcccttccagcggcgcaatcactggatggacctcaacgggtccacctgggacatcccgggcgtgagcaccgcgccggaggcaggggccacgcgaggacatcccctcttgggccatccgcacgcgtcgccttcacaggtgcggcagttcgagtcctccgtgggcgccgcgaagcccgccttcctgaaggaccatggcgtctacggacagatattgatgccgggagcggcctacgtggagatggggctcgccgcgggagcttcgctcttcggtgcggtgggcgggacggtggacgaaatcaccttctcgcaggccctcttcctccccgaggaaggggcgcgccgggtgcacctgctctactcgccggaaggcgagcgcgccgggcgcttcgaaatccacagccaggaggagcgcacgggagagggtgagcccgcgtggatcctccatgcccacggaaagctctccgcgacgacggccgcgccagcagagcgcgtcgacgtggagcgtctgcgggcctcgctgactcgcgaggtgccggtggagggctactacgcgaagctggggcaggcggggctcgcgtatggccccagcttccgaggcatccaggcgctctggcggggtgagaacgcggtgctggggcgcctggccctgtcaggcagcgctgcggcggacgcggggcagtaccagcttcagcccgcgctcctggatgcgtgcttccagatggtgggcgccgtgctcgacgaggaaggggatgccgcctacctccccgtgggtgtcggcaaggtgcaggtgcagcgcggcgggctgggtgaggtgtgggcccatgcgaccctggcgcggagcgatgacccgaagggcccgggctacgtgtgcgacatccagttgctcacggcggatggggagcgcgtggccacggtggagaagctgctgctccggcgcatcacgcgggagggactcctgggcgcgaagagcaagcgctaccagaactggctgtacgagctggagtggcaggcccggccgctggaggctccagcggcaggggcggaggcggcgcacgccgggacacagtgcctcatcctcgccgacgcggcggggctgggcgcgcgcctggccgagcgactgacgcagcaaggctgggcacgtggtgacggtcccctgctggagcgcgagccacggtcgatggccgcgattcagcgctcgcgctcctgggccagttgcgcccggaggcgctgcaagggcccctgcatgtcatcgacctgtggagcctggacggtggtggggacgacgtccccgcgcaggcccttgggcacggcacgcgggtgctcgtgctcgcccaggcgctcgtcgagggccaagggaaagagcacctcgctctggttggtgactcgcggtgcccaggcgacctcggagaaggagcgcatcacccacctggggagttcggtcctctggggcctgggcaagtccatcacgcgcgagcatccggacctccattgccggcgtgtggacctggatgccagtgcgtccgagcacgaagtcgcgcagcttcatgcggagttgctcggtggcagcggcgaggacgagctctcgctgagaggaacgacgcgccgcgtgccccggttggtgcgcagccggaagctccgtggggcgagcggcgaggccgcactgaagccggacgcgagctatctcgtcacgggaggccttggcggactggggctcatcgtcgcggagcggctggcggaacgcggagcgcgccacctggtcctgatggggcggcgtgagccggggcccgaggcgcgcactcgactggatgcgctggagcagcgcggcgtcaccatccactgcgtgcagggcgacgtggccgtggccgctgacgtggagcgcgtcctcgccgggctgtcgggacgcgtgccgcccctgcgtggcgtcatccactccgcgggcgtcatcgatgacggcctcttcgtgcagatgacgccggagcggctggccaaggccttcgcgcccaaggtctccggtgggtggaacctccatcgtgcgttgcaaggcacggcgctggacttcttcgtcgtgttctcctcggcggcgtcgctcatcggatcggcgggacaggccaactatgtggccgcgaacgccttcctggatgcgctggcccgctcccgccaggccgacgggctgcccgccctgagcctcaactggggcgcctgggccgaggtgggcgcggccgcggaggagcagatccgccgccgcatggagcaggtgggcttcggcgtgattcctccggaagacggcctccaggtgttcgagcagtccctggggctgagcggtcagctcggtgttcttcccgtggattgggcggtgctcgggcggcgcggacgttcgccgctgttcgaggccttcatcgagaaggccagccccgcggcgagcgaggggattcgtcagcggctggagcggctcgagcccaaggagcggcgcggtgccttgcgtgcgcacgtgggcgagctggtcaacggcgtgctggggcgtcccacgacggagccactggacccgaaccagggcttcttcgagttcggcatggactcgctgatgtccgtggagctgcgcaacgtcctgcagcggagcctgggcacctcgctgcccgcgacggtggccttcgacaaccccaccgtcaacgggctggtggactacctggcggccgaggtcctgggcctgaaggaagaggcagccgcgcccgtggaggaggctcccgaggacgcggagctggagtcgctcctggcggacgtcgacagcctggacgatgacaccgtccaggccatgctgcgtcgaggccgctga

SEQ ID NO: 7192 - DNA, 1488 bp, Myxococcus xanthus
cttgcccaacagctggtgatgacgccgcagctgcagcaagccatcaagctcctccaactgtctcgcatggaactgctcgagcaggtccgcgaggagatggagcagaacccgctgctggagcaaccagacgagcaagcgccgggggatgtgggagacaaggaacccggggaagcctccctggaagcagacaacatggaggtgccgcgggacgtggatctgcccgcggccaccagcgacaccgccacggagttcaaggcggacggggagggccccccggaaatcgactgggagcagtacctcaacagctaccagttcaatgagcccaccacggcctccaacaagggcaacgtggccacggacgacatgccgtcgttcgaggccaacctcgtcaagaaggcggacctggtcgaccacatccaggagcagctgggcacgctgcgcctgaatgacgccgagcgccgcatcgccatgctcatcctgggcaacctggatgacgacggctacctcaagctgccggaagtggacggggatccgctcatccgcctggccaacgaggcggacgtgcccatgcacgtcgcggagcgcacgctgcggcgcatccagatgttggatccgcgcggctgcggcgcccgtgacttgcaggagtgcctgctcatccagctccagggcatcagggagccgcacgcgccgctgttgggcctcatcatcaagcggcacatgaagtacctggagagcaagaacctgcccgccatcgccaaggacctgaaggtcaccttggaagaggtggtgggggcggtgcggctgctcccgaagctggacccgaagccgggccgcaacttcagcggggacgacgcgcagtacatctcccccgacgtgttcgtctacaagatgggggacgactacacggtggtgctcaacgatgacggcctgtccaagctgcgcatctccggcacctaccggaacgcgctgaagacgggcgcggtgggcccgggccagacgaaggacttcatccaggacaagctgcgcagcgcgatgtggctcatccgctccatccaccagcggcagcggaccatctacaaagtcaccgagagcatcgtgaagttccagcgggacttcctggacaagggcattgcctacctcaagccgctcatcctccgggacgtggccgaggacatcggcatgcacgagtccacggtgagccgcgtcaccaccagcaagtacgtgcacacaccgcagggcatcttcgagctgaagtacttcttcaactcgtccatcgcccgcgtctccggtgaggacaccgcgagcgaggcggtgaagcaccacatcaagcagttggtggcgcaggaagacgcccgcaacccgtactcggaccagaaaatcgtcgagctgctgcgctcgcagggcaccgagattgcccgccgcacggtggccaagtaccgcgaggtgctgggcatcctccccagcagcaagcgcaagcggtactactga

SEQ ID NO: 7193 - DNA, 225 bp, Myxococcus xanthus
ccgcccatgcggaagctcgacgacggcagctacgtcagagtcgcgtcggacggggaggagagcgccgtggaggtcgcggacatgaagaagctcatggaggacgtgcgcgagaccgatgcgcggcgtgtcgccgaggcgcatgccgcggaaatggcggcgtgggaggaggattatcgccggcgcaagcagggcggccggttgttcactcgggccgccgcggactga

SEQ ID NO: 7194 - DNA, 702 bp, Myxococcus xanthus
atgggcgcgtccgcggggctgggttacgccatcgcggaggcgttggtgaaggaaggcgccacggtggccatctgctcgcgcggtggcgagaagctggagcgcgcggcgaaggcgctgggcgcggcgctcgcggtcccgtgcgatttgacgcagccccaagccgcgaaggcgctggtggagactgtcaccgcgaagctgggcggcgttgatgtcctcgtggtgaacacgggcgggccaccgtcaggtggcttcgaatccctgacggcagagcagtggcagctcggcttccagagcctgtggatggcctcggtggatggcatccacccggtgctcccggggataaaggagcgccagtggggccgcatcgtcctggtgacgtcgctggcggcgcgcgaggcgatgaacaacctgaccatctccaacggcctgcgcgcgggcctgctcgggttggtgaagacggtgagcaacgaggtggcgcagcacggcgtcacgctgaacgcggtgctgccgggctaccacgccaccgagcgcatgcagcagctcgggctgacggacgagaaggtggcgccgcagattcccgcgcggcggctgggccgcccggaggagctggccgcgctcacggcgttcctcgcctccgagcaggcgtcctacatcaccgggcagtccatcgcggtggacggcggcgcgcagcgaggcttctga

SEQ ID NO: 7195 - DNA, 1275 bp, Myxococcus xanthus
atgcggcgcgaaacagtcgacgggggccgctccatcaacctggccatctccacgcgcgggctgcatgcgctccggcaggtgggcctggaaaacgaggcgctgaagcacgccatccccatgcgcgggcggatgattcacccgccgcaaggcgagctcgtctaccagccctacggcaaggacgactcgcagcacatcaacgcgatgtcgcgcgggtggctgaacgccttcctcatgacggcggcggaggccaccgggaaggtgcgcatccgcttcaagcagcgggtgacggatgtggacttcggctcgggcgcgctcacggtgcacgacgacgccaccggagaggcgcgccaggagcccggccgcgtggtgttcggcacggacggctccgcctccgccatccgccaggccttggagaagcggccggacttcaaggggacgcaggagcagctcggccacgggtacaaggaattgacgattccggcgggccccggcggcgcgttccagatggagaagcacgcgctccacatctggcctcgcggcacgttcatgttgatcgcgctgcccgacgaggaaggcagcttcacctgcacgctgttcctgccctggcaggggccggtgagcttcgcgtccctggacacgcccgcgaagctggaggcgttcttcggcgcgcagttcccagatgcgaaggcgctcatcccggacctggtggaggcgttcttctcgcgtcccacgggcagcatggtgacggtgaagggcgcgccctggcacgcgggtgggcagacgctgctgctgggcgacgccgcgcacgccatcgtccccttcttcggccaggggatgaactgcggcttcgaggactgcgtcgtcctggaccaactgctgggacagggcgccggctgggagcaggtcttcacggacttcgaacgcctgcgcaagacgaacgcggacgccatcgccgacatggcggtggagaacttcgtcgagatgcgcgacagcactggcgacccgcgcttcctgtttcggaaggccgtggagaaggtgctgctcaacgccttcccgggcgagttcgtcagccgctactccctggtgagcttcagccacgtgccttaccggctggcctatcagatgggtgcgctgacggacggcatcgtctccgagctgagcgagggcctgcctcgggcggaagacgtggacctgaagcgcgcggcggagctcatccggagccggctgacaccattcatgaaggagcacgctgatggatttcggactgaagggtag

SEQ ID NO: 7196 - DNA, 1281 bp, Myxococcus xanthus
atgacgacgccgtacctcttcgaggactccgagtccttcgcgcggaagttggacgcggaagacgcgctgcgcggctaccgcgacgcgttccacttcccgcccggcccggacggcaagccggtggtgtacctggcgggcaactcgctgggcctccagccgcgcaacgccgcgcgctacatccaggaggagctggaggactgggcgcggctgggcgtggagggacaccaccacggccgccacccgtggctgcactaccacgagctcgtcaccgagcatgccgcgcggctggtgggcgccaagccgttggaagtggtggtgatgaacaccctgtcggtgaacctgcacctgatgatggtgtcgttctaccggcccacgaagcagcgcttcaaaatcctggtggaggccggcgccttcccgtcggaccagtacgccgtcgcctcccaggtgcgcttccacggctacgacgcgcgcgaggccgtgctggagctgaagccgcgcgagggcgaggagacgctgcgcaccgaggacatcctcgaaaccattgagcgtcacggccacgaggtggcgctggtgatgctgggcagcgtgaactacctcaccgggcaggcgttcgacctggccgcgattacgaaggccgcgcacgccaagggctgcttcgtcggcttcgacctggcgcacggcgcgggcaacctgaggttgtcgctgcacgacgacggaccggacttcgcggtgtggtgctcgtacaagtacctcaacgccggcccgggcgcgctgggcggcgtgttcgtccatgagcggcacgcgcacacgaaggacctcccccgcttcgagggctggtggggccacgacaagcagacgcgcttccagatggggcccaccttcagcgcgcttccgggcgcggaggggtggcagctgtccaacccgcccatcttccagctcgcggcgctgcgcgcgtccctggagctgttcgaccaggctggcatgccggcgttgcgcgccaagagcgagcggctcaccggctacctggagttcctgctggaccggctgcccgagggattcgtgcgcatcaccacgccccggtacgtgaagcagcgcggggcccagctctccctgcgcttccgcggcgagccccagggcctgctgaagcgcctgggagacgcgggcatcatctgcgacttccgcaagccggacatcatccgcgccgcgcccgcgccgctctacaactccttcacggacgtgtaccgcttcgtgaagacgctggagggccacgcccgtgagtga

SEQ ID NO: 7197 - DNA, 1026 bp, Myxococcus xanthus
  unsure (1)..(1026): unsure at all n locations
tcccgcccgatgaaagtngacatccacacgcacctcctccccgcccacctgccgcgcttcgccgagcgctacggctacggcggcttcatcaccctggaccaccatgcgccctgccgcgcgcgcatgctccgggatgacggcaagttcttccgcgaaatcgaaagcaactgctgggacccggtgaagcgcatcgaggagtgcgacgcggccggcgtccacgtccaggtgctgtccacgattcccgtcatgttcggctactggacgaagcccgagcacggagcggacctggcgcgcttcctcaatgaccacctcgtctccgtggtgcacgcgcaccccaagcgcttcgtgggcctgggcacggtgccgctccagtccccggagctggcggtgcgcgagctggagcgctgcgtgaaggagttggggctggcgggcgtgcagattggctcgcacgtcaacgactggaacctgtccgacccggcgctgttccccttcttcgaggccgccagcgagctgggcgcgtccgtcttcgtccacccgtgggacatgatgggcgaggcgaagatgcagaagtactggctgccgtggctggtgggcatgccggccgaggtgtcgctggccatctgctccgtcatcttcggcggcgtgctggagcggctgcccaagctgcgcttcgccttcgcgcacggcggcggcgcgttcccacacacgctcggccggattcagcacggcttcgaggcccggcctgacctggtggccgtggacaacaaggtgccgccccgggactacctgggccgcttctgggtggactcgctggtccacgacccggaggcgctgcgctacatcgtccggctcttcgggcaggacaaggtggcgctcggcagtgactaccccttccccctgggcgaggaccgcccgggcacgctcatcgagtccctgaccgagctggaacccgccgcgcgggagcggctgctctggcgcaacgccttcgattggctgggacgcgcccccgaggacttcgcaccatga

SEQ ID NO: 7198 - DNA, 498 bp, Myxococcus xanthus
atgggccgcctgacccccatcaacttcaagaagtggattgatgagcaccgccacctgctcaagccccccgtgggcaaccagcaggtgtgggaggaccgggagttcatggtcaccgtcgtcggcgggcccaatgcgcgcacggacttccacatcaacgagggcgaggagttcttctaccagctcgagggcacgatgaacctgcgggtcatcgacgagggccaggtgcaggacatccccatccacgaaggggagatattcctgctgccgcccaacgtgccccactcgccccagcgtcccgcgggcacagtgggcctggtgctggagcgccgccgccagccgaaggagctggatggcttcatgggccagcgggtgcagaacggggataagctctgcacatagttcgtgcaggtcaccaacctggggacgcagcttccgcccatcttcgagcacttctacggcaaccccgacaactgcacctgcaagaagcgctcagatgaa

SEQ ID NO: 7199 - DNA, 405 bp, Myxococcus xanthus
tcgcagaaggcccccgaaccggtgggcctgtaccctcacgcccggcgcgtgggcaacctcctgttcctgtccggcgtgggcccgcgcgagcgcggcacgaagaagattcccggtgtggagctggacgcggagggcaacatcgtctcgtacgacatcgaggcgcagtgccactcggtgttccgcaacgtccgctacatcctggaggacgcgggcgcgtcctgggacaagctggtggacgtgacggtgtacctcaccgacatgaagaaggactttcccaccttcaaccggctgtgggcggagtacttcaaggacaacccgccgtgccgcaccacgctcgaaatcaaccggctgcccacgccgattgccatcgagctcaagtgcatcgccaccatcggaggtgaatga

SEQ ID NO: 7200 - DNA, 771 bp, Myxococcus xanthus
accggcagcacccgcaccggcgcggagattgcccgcgtggccgcgcccgccttcaagaagctgtcgctggagatgggcggaaagaatcccaacgtcatcttcgcggactgcgacttcgatgaggcgctggccaccacgctgcgctcgtccttcgccaaccaggggcaaatctgtctctgcggcccgcgcatcttcgtccagcggcccctctacgagcgcttcaaggaggcgctggtcacccgcacgcgcgcgctcaaggtgggagacccgctggaggcgggcacggaccagggcgcgctggtgtcgcagcagcacttcgacaaggtgctgggctacgtgagcctggcgaagcaggagggtggccgcatcctcaccggcggacagcgcgccaacgtgcccggacgctgccgcaacggctggttcgtggagcccaccctcatcgagggcctggacgcggggtgccgcaccaaccaggaagaaatcttcggcccggtggccagcatcatgcccttcgactcggaggacgaggtgctcgcgtgggccaactccacccggtacggcctggccgccagcgtgtggacccaggacgtgaagcgcgcgcaccgcttcgcctcgcggctgcacagcggcatcgtctgggtgaacacgtggatgctgcgcgatttgcgcacgcccttcggcggagtgaaggactccggtgtgggacgcgagggcggctgggacgcgctgcgcttcttcaccgagccgaagaacgtctgcatcaagctgtga

SEQ ID NO: 7201 - DNA, 627 bp, Myxococcus xanthus; identical to SEQ ID NO: 67

SEQ ID NO: 7202 - DNA, 1485 bp, Myxococcus xanthus
ctgctgtacatcaccgtcatcgtcatcgcgacgtgcgggctcatctatgagctcgtcgtcggggcgctcgcgagctacctgctcggcgactccatcacccagttctccaccgtcattggcggctacctgttcgccatgggcattggcagctacctgtcgcgctacatcgagcgcggggtggcgcagcgcttcgtggaggtggagctggcggtggcgctgctgggcggcatctgcgcgccggtgctgttcctcaccttcacgctgacggacctgttccaggtggcgctgtacggcagcgtgattgccattggcgcgctggtgggcatggagattcccctcctgctgcgcatcctgaaggaccaggtcaagttcaaggacctcatcagccaggtgctgtcgctggactacgtgggggcgctcgcggccagcgtggccttcccgttgctgctggtgccgaagctggggctggtgcgcacgtccctgctgttcggcgtgctgaacgcggcggtggcgctgtggagcacctggttgctggcgccgctgctgggcaacccgctgcggctgcgcatcaaggcggtgggcctgacggtgctgctgctggcgggcttcgtcatgggcgaccggctcaccaccttctacgaggaccagctctacgcggatgacgtggtccacgcgtccagttcgccgtatcagcgcatcatcctcacgcgcggcaagcggggcttctcgctgttcctcaacggcaacctccagttcgccagcctggacgagtaccgctaccacgagtccctggtgcacccggccatggtgcgcgcgggcaaggtggagaacgtgctcatcctgggcggtggagacggcctggccgcgcgggaagtgctgcgctacccggaggtccgctccgtcacgctggtggacctggacccggtgattacggggctggcgacgaactacggggagctggcgaagctgaaccgccacgcgatgacggacccgcggatgcgggtggtcaatggggacgcgatgcagttcctcaccgagggcggcgcgcagtacgacgtggtggtggtggacttcccggacccgaacaacttcgcgctggggaagctgtacaccacgggtttctacaagctgctcaagaagcgcatcgcgccggacggcgtggcggtggtgcagagcaccagcccgctgttcgcccggcgctccttctggtgcgtggagacgacgctcaaggccgcgggcttctggacggagccgtaccacgcgctggtgccgtcgttcggtgagtggggctacgtgttgattgcgcacgagccgcccgcccggcaccggccgctgcccgaagggctgctcttcctggacgacgcgacgatggcgtcactcacccagttccctccggacatggggcccttgcccgtggaggtgaaccggctgaacaaccaggtgctggtgcactactacgaggcggagtggcagcggtggaactga

SEQ ID NO: 7203 - DNA, 651 bp, Myxococcus xanthus
atgagcgccaccctccctcccgattccgccgtgcaccggcgtgactgcgtccccctcgtcgttccgcccgtcacgctcgaagggcacgacgtccgcctggagccgctgcgtccggagcatgcgccggccctggccgcgctgtgcgaggacgacatcttcacctggttctcgagcgtgctgcggaccgaagcggacgtcgcagccttcatcgacaacgcctgccaggcggccgagcgagggagcgagcgccccttcgtcatcatcgagcggcggacgggcgcgccggtgggcaccacgcgcttcctcgaaatccagcgcgaccaccggacgctggagattggctacacatggctgggccgccgcgtgtggcgcacgcgcatcaacacggagtgcaagtacctgctgctgcggcacgccttcgagtcgctcggcgtcatgcgggtgcagttcaagacggacaagcacaacgcgcgttcgcgggcggccatcgagcggttgggcgctcgcttcgagggggtgctgcgccaccacaaactggtgcgcggcggtgtggtgcgtgacagcgcgtactacagcgtcgtcgacacggagtggccggaagtgaaggttcgtctggaagggctgctcgcggacggcggtgcgcgggtatag

SEQ ID NO: 7204 - DNA, 1239 bp, Myxococcus xanthus
atgggggccgtcaccgacgtggatgacgcgggccggccgcgcttcgaggagtcgctgctcatccacgagccggaggagcgcttcttctaccggggccactggtacgaagggctttacctgcacgcgggcgccagcgtggaggacctggaggagctgcggcgcttcgaggcgcggatgaacggcttcgcctccgcgcgagacgcgaaggggcgccgggccttcgcggtgccttccggcctgtccagtgacgacgccgaatggacggcactggacgcgctgagcatggcggcctggatggagcgcgagggcttccgctccgcgcggctgaagtgggtggtggactacgcgtgccgcgacgacttcggcaccaccgccgagcatgtctccgcctgggccggcatctggtacttcaccgcgcggcaggacgggaatggggagcgcagcgagggctacctgagctggcccgaaggcaatggccggttggtgcggcagctcgtgtcggcgctgccgaacggggcggtggagcgcagcgtgctggtgcacaccgtggagcccgtggagggtggctgccgtgtggacgcgctggaggcgggctcgggcaagccccgggccttcctggcgcggcaggtggtgctggcgtgtccgcgcttcatcgccgcgcacgtggtggcgccgtggcgccgggagcgtccggcgtggctgaatggcttcacgtatgggccgtgggtggtggcgaacctgacgctgtcgtcgccgccgcgctcgcggggctttccgctggcctgggacaacgtcttctatgagagccgcagcctgggctacgtggtggccacgcaccagacgctgcgccaggacgagcagggccccacggtgctcacctggtacctgcccatggacggcgcggacgtgaaggccgagcgcgagaaggcgctgtcggccagctacgcggactgggaggccctggtgatggcggacatgcggcccgcgcaccctggcatctccgggcaggcgcagcggctggaggtccagcgctggggtcacgccatggtgcggcctacaccgggcttcatgtgggggcaggcgaagcagtccgcgggggagagcctggggagttcactgcacttcgcgcactcggacctgggcggcatgggtctcttcgaagaggcgaactggtttggcgtgcgggccgcggagcgcgtgctggcggagctgggccggcgtgaggtgagctggctgtag

SEQ ID NO: 7205 - DNA, 1593 bp, Myxococcus xanthus
ttccctggtgtcatcggccggacggatgaggagtcctcgcctgcctggcccgcgccgctgcgcgcgaagccgggggcacccaacgtcctcttcatcgtcctggacgacacgggcttcggtcagctcggttgctatggctcgcccatccgcacgcccaacctggaccggttggcgaagggcgggctgctctacaacaacatgcacaccaccgcgctctgctcgcccacgcgctcgtgcatcctcaccggccgcaaccaccactccaatggcatggcggccatcaccgaaatctccgtgggctaccccggccgcaacggcaccatccccttcgagaatggcttcctctccgagatgctggccgggcacggctacaacacctactgcgtgggcaagtggcacctcacacccgcggagcagacgagcgccgcggggccctactcacgctggcccctgggccgcggcttcgagcggtattacggcttcctcgggggcgacacgcaccagtactaccccgacctcgttcacgacaatcatcaggtccggccgccgaagacgcccgaggagggctatcacctgacggaggacctggtggaccgggccatcggcttcatcgccgacgccaagcaggtggcgcccgacaagcccttcttcctctacttctgcaccggcgccatgcatgcgccccaccatgtcccccgggaatgggcggaccgctacaagggccagttcgacgacggttgggatgcctaccgcgagaaggtcttccggcgtcagctcgagacaggcgtgctgccgccgggcacccggttgtcgcggcatgacccggacgtgcaggactgggacagcctgtctccggaggaacggcggctctacgcgcggatgatggaggtgttcgcgggcttcctggagcacacggaccaccacatcggccggctcatccagtcactggaggcgagcggggagttggagaacacgctcatcatggtcatctccgacaatggcgccagtccggagggcggcctgcatggctccgtcaatgagctgaagttcttcaacaacgcgccggagtcgctggagcagaacctggcggcgctggacgagctgggcggaccgcgccacttcaaccactatccctggggctgggcctgggcgggcaatacgcccttcaaacggtggaagcgcgagacgtaccggggaggtaccacggaccccttcatcgtccactggccccgaggcatccaggcgcggggcgagattcgctcgcagtactgccacgccatcgacatggtgcccacggtgctggactgcctgggcatcgatccgcccacggagcttcgcggcgtcacacagtcacccatcgaaggcgtcagcttcaagtactccttccaagacgcggacgcggagagccggcaccacacgcagtacttcgagatgttcagccaccgggccctgtaccacgacggatggcgggcggtgtgcccgttccccggaccgtccttcacggagtcgcacgagccgttcggcatgctgaagctcaccgaggccagactgcgcgagttcgatacggagggctgggagctgtaccacgtgggc

SEQ ID NO: 7206 - DNA, 224 bp, Myxococcus xanthus
atgccctggaggcagacctcgcggggggggggctacacgctggacggcgcgctccgggaggcgctgctcgcgctgcccaccgagatcatggcggcttccggccgcttcatctacgacaactgtgcggcgctccggggagccaaccggcccttcgttccattgttccggaacttccccgagagcgtgccgcacgacacccggcagttgtacgtgcagcggatgct

SEQ ID NO: 7207 - DNA, 426 bp, Myxococcus xanthus
atgggacgagcgctggcctcggtgggcgcgcggcggaagcggccccgccctgtggtgcgctgcccctggcccgagcgtcagcggcagcagcggctgtggcaactgaagtgccgggcggtctacgcccggcccgaggagcccgtctgctacgaggacgagatggacgtgcatctcaaccccaaggtggggcccgattggatgctgcctggagagcggcgagaggtcgtcactccgggcaacaaccagaagcgctacgtggccggagcgctcaactcacgtacgggcgagctgacgtgggtgaagggggagcggaaaacgagtgctctcttcatcgagttggtgcgcgcggtgagcgaggccaaccccatggccagacgcctgcacttcatcctggacaacgcggccacgcactccagcgagacttag

SEQ ID NO: 7208 - DNA, 1185 bp, Myxococcus xanthus
atgaaaaactccaccagaatttatctgctgtcatttatcagctttttgatcggaaccgccgaatacatcattgccggcattcttgatcagatcgcgcaagacctgaatttgcccgtgccggtcatcggccagatgatcaccgtgttctcgattgccttcgccgtcggcacgccactcgttatcaccctcacgtccagcgtcgaccgcaagaagttgctgatcttcttcatgctcgtcttcgccgccgccaatctggttaccttggcactaagcgattatggctggttgaacgcgtcgcgcgccgcctctggactgagcgcgggcgtcgtggaagtcatcgcgttgaccctggccgccacgctcgccgcacccggaaagaaggccggcgccattgcgatggtcgtcatcggtttcagcgcggccttggtcgttggcgtcccgctggggcgcgtaatttccggcatcatggactggcggtacatcttcgccggtctgggcgtactgacgctcgcgtcgctggtcctggtcgttcgtgccattcccagcacccggggcgaggccgccgtgccgctgaagcatcaactcaagctgctgaagaatggccagatatccatcgtctatgtcatgacgtttttctggatcagcgccttttccattatctattcctacatatcgccgtaccttgccaacgtcgcccgcatggctgacggcaccatcagcatcatgctgttgatctgtggcatcgcaagcatcatcggttccaggctgggcggttggttcaccgacaagtccggctacgcacccacgctgcttgccgggtttgccgtccactgcgcaacgctggggttgttcttcctcttcggacagtccgcctggatcatgtacgcgttgttgatcacgtggtccctatccgcctggtcttccggccccgccctgcaatttcgcctgatcagcctagctccggaatccaccagcatcatcttcagttgctatacctcgatgatccagttcggcatggccgcgggagcgattgcgggcggcgtggtgatccaaatcggttcgctggatcagctcccaagcgtcggcgcggccagtgtcctggtgtcgctggtactgttggcgacggtggcttcggaaaaagcaaggtcagggcacaaactcggtttgccaggaagaaaagcctga

SEQ ID NO: 7209 - DNA, 750 bp, Myxococcus xanthus
cggcgcgcggtgtcctccgaccccgcgtggcgcatggagagcggggagggcttcctccgggccctcgggccttcgccatccccttttgacaattccctgtgttgggcccacacggatgaagagaacgtggaggcggtcatcgcggcacagatggcgtatttccgctcattggggcgcgccttcatgtggaaggtctacacccaggacagccccagtgatttggagacgcgtctactccgagcagggttcgaggttcaggcgcacgtgacgctggtcgtgctcgacacggcccgctcgcagcccgcgaccgcgcttcctccgggcgtcgaaatccggcgcgtggacgacgccaccgggctcgcggcggccatgaaggtgcaagaggtcgtctggagtcaggactgccaatggttgcacgacgcattgaaggaggagctgcggacgcagccggacacgctgagcatcttcgtggggtggtcggaaggacggcccgtgtgctccagttggattcgcatcgaggagggggcgcccttcgccagtctttggggcggctcggtcctcccggacttccggggcaggggcttctaccgcgccatggtggcggcgcgggccgaggtggcgcgtcaacgcgacatcgcgcacctctatgtcgaggcgggcgacatgagtcggcccatcctcgagcgcctcggcttccaggcgctctcccaggtggccaagtgcatctaccgtccgcctggcgtcgcgtga

SEQ ID NO: 7210 - DNA, 636 bp, Myxococcus xanthus
atgaagcagatcatcgacgacttccatgcgttgtatttcggagcgcttgtcacgcgggagtaccacggcggaggcgagcggtggatgggagtccccatccggaaggtgccgcatgacctgtggatctaccaggagatcctccacgagacgcgcccggacctcatcatcgaaacgggaacgatgttcgggggctccgcgctctatttcgcgcacctgtgtgacctcctgggccacggtcaggtcatcagcatcgacctcgaccaacgggagagcgtgccccggcaccaccgcatcgaatacatgcaggggtcctcggtcgcgccggaaatcctcgagcgtgtccgcggccgcatcgctcccggaacccgaacgatggtggtgctcgactcggaccacagcgccgagcacgtgctccaggagctgcgcctatacagcccgctggtgtcgccagggcattacctcatcgtggaggacacgaacatcggccaccctctgcacacgttccaggtggagcgcgggcccatggaggccatcgaggcgttcctcccgacagcgcccgatttcgagcgggacagcagccgggagaaactcctcttcaccagcaaccccggcggtttcttgaaacgaatccgctag

SEQ ID NO: 7211 - DNA, 3936 bp, Myxococcus xanthus
ggcccgtgctggaaactctggtcacctactggaagcagcggctggctggccttcccttgctggatctgcccacggatcgttctcgttcctgccgtaccgaacttccgcgcggggacccatgcggtggcgctgccgcgtcccgtgtcagaagcggtggaatccatggcgcggcgccacggggccacgccctacatggtgttgctgacggccttcagcgcggtgctcggctgcttcagtggacaacgggagttcgcgattggcacgcccatcgcggggcggacccacgcgaagctggagggcctggtgggcctcctggtcaacaccgtggtgattcgaaccgacctcacgggaacccccaccggacaggagctgctcgcgagagtccgcgaggcggcgctgggtgcgtatgcgcatgcggacctccctttcgagaagctcgtggaggcgatcaaccccgagcgcgacgcgagccgcaccccgctcttccaggtgatgttctcgctccaagaggagacgggcggcgcgcacaccgtcgacaatctgggattggaacccatcgagcgaggcacccggaccactcagttcgacctgacgctctggctgaggcccacgcacgagggctactcgggcgcgctggagtacaacgcggaactcttcgagccaaccacggtggcgcggctcgcccacgccctggaacaggcgctggagcgcctgacggccacaccggaacgcgagttcaccgcgttgacgcggccccaaggcaggcagtggcaggcgttgctcgcggcgtccaccacgtcccccgcgcccgccgctccctttcctggcgtgcatcagttcatcgcacggcagtcacggatccacccggagcgcctcgcgttgatggcaccgggggaggtgctcggctacggagagctcgaccgccgggcgacccatgtggcgcgggtgctgcgcacggcgggtgtgggccccgagacgcgagtcgccctgtgtgcggagcgctccgtcgacgcgattgtcgccatgctcggcgtgctcaaggccggagcggcctacgttcccctggactccaccgcgccccgcgagcggctgctgtcgctcatcgaaggcgtcgaggcgccggtggtgctcgtccaaaccgggctcgcggcaggcgtatccggtacaccggcccgcgtcatccacctcgacgtcctgcgagcccaggccgcgctcgaaccggcggtccccctggacgtcgacgtgtgcccggagaacgcggcttacgtacttcacacctcgggctccaccggccgccccaagggcgtcgtcgtgccccatggcgccctgatgaatcatctgctggccgtgcagcagcgatacggcctgggtcccgaggaccgggtgttgcacttcgccacgctcagtgtcgacgtcgccgcggaggaactcttccccacgctggcagcaggcgcgacggtggtgctctcccctcccggagcagccccacccgtggccgagttcctggcgctgctcgagcaggccacggtcaccgtggtgaacatcccagcgccgtactggcatgaatgggtggaggagctgccccggcttccggtcgcgattccgccttcggtgcgcctgctggtgacgggaagccaggcaccgtcccccgagcggctggcgcgctggcgcgagcgtgttccctcccacatccgctggctcaacgcgtacggccccaccgaagccaccatcaccgccacggtgtgcgaacccacggcgcgtgtggaggccagccgggtccccattggccggccgctggcgggaggttgtctgtacatcctcgacgcatccgggcaccccgttcccgcgggcgcgccgggagaactgttcatcggcggcgcgggcctcgcgcgtggatatctggcccagcccgcgctcacggcggcggcgttcgtgcccgaccccttcagtggaagggaaggcgcacggatgtaccggaccggagacctcgcgcggctgttgcctgatggtgatgtggagttcctcggccgcagggaccaccaggtgaaggtccggggctttcgaatcgagctgggcgaagtggagtgcgcgctcgaacagctcgcggaggtccgagaagcggtggtgctgcatcggcaagcacccgcgggcgacggccacctggaagcgcacgtggtccccgccgtccagggattggcagaggcgacgttgcgcctgcgcctcggggcgacgctgccctccagccagattcccgcgcgcatcgtgatgcgggagtccttgccacgtcttcccagcggcaaggtggatcgccgcgcggtgtccggctggcaggcctccgaggcgctccacgcgccgcgtcccccgcctcgcaacgccaccgaggagacgctggtccgggtctggacggaggtgctcaagcggcgcgaggttggaatccacgacaacttcttcgaactcggcggtgactccctcctggccatccgggtcgtcgcgcgagcgaacgatgcgggattgcggctcaccgcgcgccagctcctcctccatcaaaccatcgcccagctctccgaggtcatcggcgaccaacccgaaccaccggcccccactgcagtgggagggcccatcccgttgacaccttcccagcggcgcttcctggagtcggacgtgcccgcgccgcaccattggaaccgctcgctgctcctcgatgtgcacgagccactccagacagaggcgttccaggaggcgcttcgcttgctgctcgcgcgtcacgatgcgctccggctccgcttcgtgcggcacgaaagcggctggaagcagttcgacgcgggaagcgccgcgacgccccccttctcgcgcgtggacctgtcctccgtccccgacaccgcgctacctccggccatcgaatccgccgcgcaggccctccaacgaagcctgacgctgacagacggcccgctgttccgcgtggcggccttcgacctcggtgcccaccgacctggaaggctgctgttcatcttccatttcctcatcgccgatggcgtgacctgggccctgctcaccgacgagcttcaggaggcctaccgtcaaatccttgaggggcagtcgatccagcggcctccagccccggtctcgttcagggcgtgggccgaacacctgcacgcgctcgcccacacgccccggttggagcaggaggcaacggcatggctgagtcagctcgaaggcgcgtgcgggcgactcccgcacgaccatccaggcaccaactcagagggttcgatgcgctccgtgcgcatgagcttgcgcgaggatgagacccagcggctgcttcagcacgcctccgcgacgcgaagcggtctggaagccgtcttgctgacaccgctggcgcacacgctctctcaatggatggggggcgccgccctgcgcgtcgacctggggcgacacggacgcgcggagctggaggggctcgaacccacgcgcaccgcgggctgcatggcggcggacgtccctgtccggctggatgtcgtcggcgccagcggactgtcccaggcgctcgagtgggtggccagctcactgcgccaactgcccggccagggcctgggccacggattgctgcgctacatgaacggcacggaggggctggcgcggaggctgggcgcactgccaggcgccgaggtgagcttcgattacatgagccaacgaatgctgacggagaaccctgcgttccggctcgcccgtgagtcgaccggcaccgaccgggacccatccgcccggcggagccatgtgtttcagctcatcgccgccgtggtggacggcctgctgcagttcgaatggcggtacagcaacgaattgcacgagccgtccaccgtggaacggctcgccgccacctacctggcgggagtgcgacacctcgccgaatcgcgcagtgaaaggaacacgacgccatga

SEQ ID NO: 7212 - DNA, 729 bp, Myxococcus xanthus
atgaagacgaacgcgtccgtgctggcggtgatgacgtgctccctgctgacggcgccgctggccatcgcggataacacggcccctgtgaagtccgcctcggtggatttgaacggtgatggcacgccggaagccgtgtccatccagttcgacgaaccgaagaacgagttcatcctcaaggcgggcagcgccaccatccggggccctggtgatgacaatgagcccgcgggcgtgttcatcgtggacctggacagccgggacaagcgcaaggagctcgtggtgcgcaccgggcagacggactacgaccagcgctcgtacatctacggcttcgacggcaaggcgctgaagctgctgggcaccgtgcccgcgctcaccgaggccaagggcaacggcatcatcctgtccgactcatggcagggcttctggaaccggcgcgacaagtacgtcgtggatgcgaagacgggcaaggtgtccgaggtgccgcaggacctgtacgccgttggcgtcgaggccacggtgaagcagtcgttcccgctggcgcgcagccgcacggacaagagcgccgtcgcgacgttggcccagggctcgaagattcaggtcctcgccgccgcgcccccgggccgcaagggtgagggctacctctacctggtgaagtcctccacggggctgctcgggtgggccaccgcgaaggatttgacgtggaagacggacggcctgccgatcgcgggttga

SEQ ID NO: 7213 - DNA, 492 bp, Myxococcus xanthus
atgctcggttaccggatggggacggaactgacggcggtggcgtcgttcggaaacctccaggcgccgtgtcggctggtgcagctgtcgttggagcacctgacgctgaacctcggtacgcaggcggcgccgaagccgggcgataccgcctccgtggtgttgggccatggcgagcgatgggccacggcgctggacgtggaggtcatggacgtgcgcggcgcgccggaggtgagcatgcgcttcctggcgccgcccctggacgcgggccgccgcatcgtctccgtgctggaggcgctgcgtgacaacggcctgctgctcccgccggagacgcggccggtgtggaaggagcgcatcgagcaccccgaccgcgtgcggcgcatctgcgacgcgctggtgggcaggcaggcgcgcggcatggcgcggaccgcggacgggcgcaaggtgccggtgacggccgcgtacttcgacccgcacgaaggccgcatgggctggcgc

SEQ ID NO: 7214 - DNA, 504 bp, Myxococcus xanthus
atggcactggagcggggcggggtggacggcaccgcgggccgcgacgtgtgcgtgcccacgcgggcctactacgacttcgaccccaacgtctgggtgcggcagcccatggaggacgcccgcatcgtcctccaggacgggacgcacaccatcaccctggtgatgaagaacggaaaggccaagcgcctcttctccttccagggccccggcgccgaggaccggctcacgcgcggccaggagtattcgttccggtggctgcccgagggcgaggtccccagccgcgccgcggccaccctgctgcgcgagggagggagcgccacggccaccatccccacggagcaggaagaggcggtcctccgcttcaccctgctgccgacgacgcctgtcgccgcccacctgctcacgctgagcgcgaccgcgcccggcgaggtgctggagtgcacgggcgtcgccacgtgcgaggcgacggtgttccactccgaggagcgggtcgtcaacgtgcagtga

SEQ ID NO: 7215 - DNA, 81 bp, Myxococcus xanthus
atggggagggcctgggaactcattggcatcatcaagccggagcacaagccattcggcatcgtcacggatgtgggcgactag

SEQ ID NO: 7216 - DNA, 1131 bp, Myxococcus xanthus
cgacactggctgagcctgatgccgggcgaggagcggctgtgcctcacggtagagctgcgcatcgacccgcagggccgggtgacggcggcggacgtgtacgagagtgtcatccgctcgtgggcgcggctgaactacgacgaggtggccgccttcctggaccggggtgaggtgtcggcgcccatggagccggtgcgcgaggtgatgccgtggttccggctggcggcggcccggctggcggtggcgcgggccgcgcgaggcggcatggagttcgcgcgggacgaggcgcgcttcaccttcgaccaggcgacgggcgagctgtccgggctggtgagtgagaagccgacgtcggcgcacgcgatgattgagcgcttcatggtggcggcgaacgaggccatcgccgggtggctgctggcgcgcggcctgcccggggtgtaccgcgtgcacgagcagccggacccgttgcgggtggcggacctgaatgccttcgcggagacgtctggtttcgcggcgggcttcggacgggagctgacgccgctcgcgctggcggcgttcgaccggcagatcgcgggcgcggtggcggagccggcgctgcgttcggtgctgcggcgctcactgggcccgtcgcgctacacggtgaagccggggccgcacttcggcctggcagcgccgctgtacctgcacttcacgtcaccgattcgccggtacgcggacctggcggtgcaccggacgttgaaggggtacctgcgtgggcgccgggacttcgtggatgaagacccggggatggaggcgctcgcggtgcacatcaacgcgaaggcgcgcgcgtcgacgcgggcggagaacgaccggcaccgcgagttggaggcgcggtggatggcggggcacgtgggcaagcagttccaggcgcgtgtgacgcgggtgcggcccttcggcctggtggtgcagttggacggcatgttggtggaaggtgtggtgcccgcggatgccctgtccggaggccccttccggccggacgcgcgcgaactgtccctggtgggcaaggagcggaccttcaccgtgggcatgccggtgacggtgaaggtgacctccaccgacgagcagcttggacgcattgagctgtcactggtcgagtaa

SEQ ID NO: 7217 - DNA, 2892 bp, Myxococcus xanthus
gagccgtttgccggccgtcacaatggtccggatgacaccgagctgaagcagctgctgtccgcgctgggcgtggactcgctcgatgctttcatcgaccaggccgtcccgcccgccatccgcgccaaggagccgctgaagctcgcgaccgcgcgcggcgagcacgaactgctggcggccttggagtccatcgccgcgaagaaccaggtgttccggtccttcatcggcatgggctaccacgacacgcacacgccgaacgtcatcctccgcaacgtcttccagaacccgggctggtacacccagtacacgccctatcaggcggagattgcgcagggccggctggaggcgctgctcaacttccagacgctggtcatggacctgacgggtctggaggtggccaacgcctcgctgctggatgaaggcaccgccgccgccgaggcaatggctctggccctggccgtgcaccagaagggcgaggagtccggcgcggccttcttcgtctccgacggctgccacccgcagacggtggaggtggtgcgcacccgcgcccagccgctgggcgtggaggtggtggtgggcgaccaccgcacggtggatttgagctcgaagaagttcgtgggcgcgctggtgcagtacccgaccaccgacggcgcggtgcatgactaccgggccttcggcgagcaggtgcacgccgcgggcggcctgttcgtggtggccgcggacctgctcagcctgacgctgctgacgccgccgggggagttcggcgcggacgtggcggtgggcagcgcccagcgcttcggcgtgcccatgggctacggcggcccgcacgcgggctacttcgccacgaagaacgcgtacacccgcgtcatgcccggccgcatcatcggcgtgtccgaggacgcgcagggacgccgcgcgctgcgcatggcgctccagacgcgtgagcagcacatccgccgcgagaaggcgacgagcaacatctgcaccgcgcaggtgctgctggccgtcatcgccagcatgtacgccgtctaccacggcccctccgggctgaaggccatcgccgagcgcgtgcacggcctgacggtgctgctggcgcgcgggctggcgaagctgggtctcaagctgaagaacgaccagtacttcgacacgctgcgcgtggagctgtcggccgcgcatgtgcgcgcggtgctgggggccgccgaggcggcgcggatgaacttccgccgcatcgacgagaagacgctgggcgtgtccctggatgagacgacgcggcccgcggacgtggaggacatcctggcggccttcgccaccggtaccggcaagtcctccgcgccggtgttggcggacctggtgggggacggcgtggagagcgccgtgtcgcaggcgctgcgccgctcgagcgcgtacctcacgcacccggtcttcaacagctaccactccgagacggagatgctgcgctacatccggcggctcgaggcgaaggacctgtccctcacgcactcgatgattccgctgggcagctgcaccatgaagctcaacgccaccgcggagatgattccggtgacgtggccccagttcgggcggctgcacccgttcgcgcccacctcgcaggcggctggctacaaggtcatcttcgagcagctggagcagatgctcacgcaggtgacgggcttcgcgggttgctcgctccagcccaacgccggaagccagggggagtacgcgggcctgctcgtcatccgcgcgtaccaccagagccgcggccaggggcaccgggacgtgtgcttgattccgtcctccgcgcacggcaccaacccggcttcggcggtgatggccggctacaaggtcgtcgtcaccaagtgcgatgagaacggcaacatcgacctggatgacctgcgcgcgaaggcggaggcgcacaaggacgcgctcgccgcgctgatggtgacctacccgtccacccacggcgtgttcgaggaggagattcgcgaaatctgcgccatcgtccacgagcgcggcggccaggtgtacatggacggcgccaacctcaacgcgcaggtgggcctcacctcgcccgggttggtgggcgcggacgtgtgccatatcaatctgcacaagacgttctgcatcccgcacggcggcggcggcccgggcatgggccccatctgcgtggccagccacctggtgaagttcctgccggggcaccccgtcatccagacgggcggctcggaggccattggcgccatctccgcggcgccgtggggcagcgcgagcatcctgctcatctcgtggatgtacatcgcgatgatgggcggcgagggcctcacccaggccaccaagctggccatcctcaacgccaactacgtcgccgagcggctcaacgcccactacccggtactgtaccggggcaagcgcggcaaggtggcgcacgagtgcatcgtcgacctgcgcccgctcaagaagacggcgggcgtggaggtggaggacgtggccaagcggctcatggactacggcttccacgcgcccaccgtgtccttcccggtggcgggcacgctcatgattgaaccgacggagagcgagtccaaggcggagctggaccgtttctgcgacgcgatgatcgccatccgtcaggagattcgggacatcgaggagggccgcatgcccaaggacaacaacgtcctcaagcacgctccgcacaccgcgcgtgtcgtcgccgcgccggagtggaaccgtccctactcgcgcgagcaggccgtgttccccacaccgtgggtccgcgacaacaagttctggccctccgtgggccggctcaacagcgtgctcggtgaccggaagctggtctgctcgtgcccgcccatcgaggactacatgacgccggagccgaaggccgccacggcctga

SEQ ID NO: 7218 - DNA, 390 bp, Myxococcus xanthus
atggccgacaacatccccggcgacctgaagtacacccgtgagcacgagtgggcccgcgtccagggcacctcggtggtggtgggcgtcacgcagcacgcgcaggagtccctgggcgacgtggtctacgtggagctgcccaaggtgggctccacggtgacggagggcaagcagttcggcgtcatcgagtccaccaaggcggtgtcggagctgtactcgccgctgacgggcaaggtggtgaaggtgaacgacgggctgtcggacaacccctccaccgtgaacaccgacccctacggtgcgggctggattgtggaaatcgagccctcggaccccaagcaggtggacggactcatggacgccgccgcgtacaccgccctgctccagaacagctga

SEQ ID NO: 7219 - DNA, 837 bp, Myxococcus xanthus
atgcaggtagtgcagttcgtggaccgggagggcgcgcggcgaacgctgctgttcaacccctccgactacgagcgcggcgtctccgcccccttctaccgcgcgctgcgcgagcgctacggcggcttcgtttcagacaaggtgatgtccacgcggcacggctcggtgcagagccacctggccgcgctcggcctcatcccgtcggatgtggactacctggccttcgaccacctccacatccaggacctgcgcggctggctgggcggtgacggcatgcccgcgtacttcccccgggcccggctgctggtgcagcgcgccgaatgggaggtggccctggagccgcaccccatgcaggcggtgtggctcgtcccgggcggcgccgacatcccccgcgagcgcgtggtgctgctggacggtgacgtgtggctgggacagggcgcggcgctgctgagcacgcccggccacacgcgcggcaacatgtcgctggcggtggccacctcgcgcgaggtgttcgtcaccagcgagaatggcgtggccacggagagctacacgcgctcccagtccgccatccccggcgtgcgccgcttcgccgagcacatgggctgggaggtcgtcctcaacggcaacacgcgcgaggactccctggaccagtactcctccatggtggtggagaagctgttcgcgggcacgtcctccgtggagggcgcgttcatcaacttctacccgtcctcgcagctcaccgcgcacgtcatggcgcccgggttgtcgcccaccatcgtcctgcccgcgcccaacttcggcgacgtgcggcccacccccgcgtcacggcgggccgcctag

SEQ ID NO: 7220 - DNA, 843 bp, Myxococcus xanthus
cagcgcactctctcgaagatcgcctccctgcagggcgtcgggctccactcgggtgcccgggtgacgctcaccctgcgcccggcgcccccggggcatggcatcgtcttcgtgcgcacggacctcgcccgcccggtgagcatccccgcgctggcggagtacgtggtggacacgtcgctggccacgacgctggggcgtgacggtgtccgcgtgggcacggtggagcacctgatggcggcgctggccggcatgggcatcgacaacctccgggtggagctggacggtccggaagtccccatcatggacggcagcgcggcgcccttcgcggcgctcatccagagcgcgggcgtgcgggagcaggaggcgcccaaggagctgctggtcatccgcaaggcggtgtcggtggtggacggcgacaagcaggcctcgctcacgccggcccggcacttccgcatcagctgcaccatcgacttcgagcaccccgtcatccagggccagtccttcgacctggacttcggtgaccgggacttcgcgcgtgagatttcccgcgcgcgcaccttcggcttcctgcgggacgtggagaagctgaagcagatgggcctggcccggggcggttcgctggagaacgccatcgtcgtggacgaggtctccatcctcaacccggacgggctgcgcttcccggacgagttcgttcgccacaagatcctggacgccatcggcgacgtgtcgctgttcggccggcccgtcatcggccacatgacggcgtacaagacgggccacgcgctcaaccacaagctggtgcgcaaggtgatgtccgacccgagctgctacgaaatcgataccgcc

SEQ ID NO: 7221 - DNA, 1416 bp, Myxococcus xanthus
atgcgcgcttcccagacgtcgcgcgccggcttcctcgccgaacgcgagcgctggctgcgcggcgtgcccgtggaggggcgggaggagctgctgttcgagttcgagatgctgctgcgcgcggtggagcgctacctcaacctcaacacggtggtggacgcgcgcgacaggccgctcgtcacgcgtgacttccgcgaggagctggcggacgtgcgcgacgccatggaccgcgccatccgtgtcgcgcgccacctgcaggacccggacagcgaccagaagatggtcttccgcaagtacgtggagacccagctcgcggacgaccgcgtccggcgcgcgctcatcgaagagcaactggaccaggagacgccgcccgaaagcctcttcgtgctgcgcgaggccttcgacgcgctgaagaacctgctggaccacctgctcaagctgccggcggcgaacctcggcctcttccaggacgtgggcaagctgtctctgcgggaaatcgtcctcaaccgctacttccgccccttccgcccgttggagttccgcgtcgaatacgaccggctccgttcggtgcggctgctggacacgctggtcaccctccaggaggagcagcgcaccgccttcaccaccgccttcctgggcctcttccggctgctgcactacctggcctacgtggacgcggaggagcagccgcccttctcccgtcgtgtgcgcgtgctgctggcgctggtgcgcagcgaggccaccgcgctggcgtcgtggatgcactcggagctgtctcccaatgctggctccaagtccctgcaggccgccacgctgcgcgccgcgcgcgacatcgcccgggagacggagcgcgtggcccgcgaggtgctggtcaacctggaccgcgacgcggaggcccccctgcgcgccgcgtccgccttcacggcggtgctgcgcacgcaggtggtggcgctggtggaggcgttggcgcccaacgggggcctggccgacggtgtcttcgacgaactgatgagcccgcaggaggctgcgctgcgcctgcgcaaggacctgtgggtatacgcccagctgtgccgcgccgcggagtcccacttgcgcgccgaggacgtccccgccgccgagcgcgtgctggacgccctcaagggcttcctgggctacttccacgacggcagctaccaactgctgcgctacggcgactacgacgccttcgaccgcttcacctcgctgctggtggagctgccctggcctccagaagggcctggcatccgcgcccggctcggcgaggacctgcggcgcttcatccagacgctggagtccaccttccactccgtcagccgtcgcacgcacctccagggccgtggctttgatcgccaggacgcagaagccctacgggacaggttcctcaccacccccgcacgctga

SEQ ID NO: 7222 - DNA, 990 bp, Myxococcus xanthus
ctgcccgaggacgtccggctcgaggcttccctgcgtccgcgctcgttcgacgagtacgtgggccaggggcccgtcgtcgaaaagctcaaggtctacgtgcaggccgcgcgcagccggggcgaagccctggaccactgcctgttctccggcccgccgggcctgggcaagacgtcgctggcgcacatcatcgcgaacgaactgggcgtgggaatccacgtcacgagcggccccgccctggagcgcaagggggacctcgcgggcctgctcaccaacctcgacgcgcgggacgtgctcttcatcgatgaaatccaccgcctcaacgccgccgtggaggaatacctctacccggccatggaggacttccggctggacatcaccatcgacaccgggcccgccgcccgggcgatgaagattgatttgccgcccttcacgttgattggcgccaccacgcgcaccggcctgctcacctcgccgctgcgcgaccgcttccagattcaggaacggctggagtactacgacgccaaggcgctggagagcatcctccaccgctccgcgcgcatcctgggcattcccctggacaaggacgccgcgcgcgaggtggccagccgttcgcggggcacgccgcgcatcaccaaccggctgctgcgccggctgcgtgatttcgcggaggtggaaggcaatggcagaatcaccctggagctggcgcagaagtcgctggacaggctcggggtggacgccagcggcctggactccatggaccgcaagattctgctgaccattctcgacaagttcggcggcggcccggtgggtgtggagaccatcgccgccagcgtgggcgagcagcgcgataccatcgaggacgtgtacgagcccttcctgatgcaggaaggcttcctccagcgtacgccgcggggccggatggccacgcaccgcacgtaccaatatttcaagaagcaaccaccgcccacgccccagggcagcctcttctga

SEQ ID NO: 7223 - DNA, 573 bp, Myxococcus xanthus
cctgtgttcgcggcaagggttctgcgcggcgtcgcctggcaggccacctcctcggaggcgcgggacatgctctccaccgtgctggggatcgcgctgacgtccttgagcatcgtcctgtccctctccatgctcgtggtgcagaacgccgctgggcagttctcgccgcgactgctgcgccacttcgtgcacggcgcgggtatccgcgtggtcatcccggtgttcgtcgccacgagcgtcttctgcctcgtggccacccacgagttcgggctcgtggcgggcgccgagcgcgcgccgcgcccggcgctcagtctggccatgttgctgctcgtcgtctgtgaaggcgcgctcgtcttccatgtgctccatacgctccagtccatgcgcgtggagaacatcgtccaacgggtgcgcgtggacacgctgcgcgtcgcgcgcaggctggagcgattgcgctcaggggacctcgaggcgccggccgaggtgccggcgcccacgggcgggcggtggccgcttcgggccgagcagaacggcttcgtcgtctccgtggatgcgcggcgcctgctggaggtggcg

SEQ ID NO: 7224 - DNA, 1416 bp, Myxococcus xanthus
gtgctgtcgcacagcgtccagtacctcgtcttcgtcatcgcggtgttcgccctgtattgggcggtgcaccggcactactggccgcgcatcggcgtgctgctggtggccagcctcttcttctacgcggccttcacgcccttccccatcctcatcttcctggtgggcgtcacggtggaccacctgtgcgtgaagggcatggcccgcgcgcagtcacagggggtccgcaaggcgctcgtcacggtgtcggtcgtctccaacctgagcctgctcgcgggcttcaagtacctggagatgctgcggcagtcgctgctgtcgcttctggcgccgtggggcatcgaggtccgcgccgagcccttcaacctgctgatgccggtgggcctgtccttcttcgtcttccaggccatcagctacacggtggacgtgtaccggcagaaggcgagcgcggagcactcgttcatcgagcacctgctgtacctgctcttcttcccgcgcgtcgtgagtggccccatcgtccgggcgtcggagctgatggtgcacttccgccagacgccgagcctcacgcccgaggccggtggccacgccctcttccgcatcgcggtgggcctggtgaagaagctggtcatcgcggacgtgctgggcgcggggctggtggaccctgtcttcgccgcgccggagaagtacgcctccgcggagtgcatcgtcgcggcggtggcctacaccttcgagctctactacgacttctcggggtactcggacatcgcgattggcgtggcggcgctgttcggcttcaagttcccggagaacttcaaccggccctacctggcgaagaacatcggcgagttctggaaccggtggcacctgagcctgtccacgtggctgcgcgactacctgtaccgcccgctgggcggcaaccgcgtgtcgaaaccgcgcgtgctgttcaacctgatgacggtgatggtgctgggcggcctgtggcacggggcggactggcgcttcgcggtctggggcgcggtgcacggcgtggcgctgtgtgtgtcgcgctgctgggagtggtcggtgggcaagcccgagtccccgggcatcccccgcgtggcgctgggcatgttgacgacgttcaccatcgtcgtgctgacgcgcgtggtgttccgggcagcggacatggcgcacgcgggcgagttctacgaaaggatgatggcgggcgtgcccggcatcgccaacgtgagcccactggtgtggggcatgctggccgcggccgtcttcttccatgccgtgccgatgaagctctacacggtgtcgtcggacctcttcgtccgcatgcccgtgccggtgcgcgccgcggtgctggtggtgctcggcctgggcatccgccacctgtccgccgtggaggcgcggccgtacgtgtacctgcagttctag

SEQ ID NO: 7225 - DNA, 306 bp, Myxococcus xanthus
tcgcccgccatcctccactacgccgtcaccaagagcgccatcgtcaacttcaccaagggcctggcgcgggagctcattgaacggggcatccgcgtcaacgccgtggcgccgggccccgtgtagacgccgctcatcccccagtcgtttgacgcggagaagacgtccaagttcggcaaggactcgcccatgggccgccccgcgcagcccgcggagctggcgccgtcctacgtgttcctcgcctcggatgagtcccgctacgtcaacgcggaggtgctgggcgtgacgggcgggcggctgctcgcgtga

SEQ ID NO: 7226 - DNA, 2028 bp, Myxococcus xanthus
tccaagtggcctcgcgaccgggtgggctggaccggcgtggccttcagctcggagaagggctcccagagcacgcgttatgacgtggagggctcgcgcgtggcggagctcttcttcctggcgcagcccgccagtggctccgtgcagttctccgtggacggcaagccgctccagcgcatccacacgcgaggcttctccaagaacaagtcggaggcggccttcgcccgcgtgaccctgccgcagggcgcgaagtcgctgacgctcaccacgtccggcaaggtggagctgcacggcatgacgctggagtcgggcgcgccgggcgtcgtctacgacacggtgggcctgctgggcggaatggcggaggtgtacctgcgcgcccagcccgccgccttccgcgcgcagttgcgccagcgcaagccgtccctggtggtgatgatggtgggcggcaacgaggccttcttctactcgcgagaccgcaccacgttggacgaggtgcgcgcgcagataaaggagttgatgtctcgcgtgcgcaccaacgtgccgaacgccgcgtgcctgctgatggcccccatcgacgcgggcgtgcgcaccatgagcggcgaggtggtgtcacgccggggcacccaggagattggcgccatctaccgcgaggaggcccgcgcggccggctgcgcgttctgggacgcctatgccgccatgggcggcgagggctccgcgctgcgctggctcgaggaagggctgatgctggacgaccttgtccacccgcgcgcccggggctcggatttgctgggccacctcttcgacctgtccctccagcgtgcgttcgcgaagagccgggcgccgctggtggccgtggtggacccggccggcctgcagaacgcggacaccgcgctggcgcgcacgttcgacaagctgaagcgccgcgaggcgggcgaggcccttcgcgtgggcgtcgcgcagttgggtggttcgcacaccgcgtcgcactacttcacggacgcggtgcgcgaggtgctgacgaagcgcttcggcgccgcgggccggggcttcatcgccgccggcaaggcctccccccgcctggagcccgcgggcgtgacgcgcgcgctggagggggactggaccatcgaggacgccgccaaggacgccccccccgggggcctgtgggggctgacgggcatccgcgccgtgggcggtccgggcgcgaagctgcgcatccagttctgcaaggactgcccggaggcgaaggagtcctcgggccggttggatttgtacgcgctggacgcgccggacgtgcgcgcgccggacatcgcgattgacggcgagctgctgccgccggacgcgcctccgccggagccgttgaccgagcccaccgtgcgcatccgctcgttccccgtcacggggtcctcgcacaccgtggaggtgacggcgccgaaggacggcaacgtcacggtgctgggggcgtccctggaatacgacacgccgggcgtcgtgtacgacgcgctgggccttcccggtgccacggcctcgacattgggggccatggacgcggcgtcggtggacgcgcagttggcgtcgcggcggccggacctgctcgtgttctggtacggcaccaacgaggcgggtcggacagacctggacgcctcggcgctgcgccgggactacacggagatgctgacgcgcctgcgcaaggccaccaacgcggagtgcctggtgatgggccccacggaccggctcacgcaggacgccaacggccggtggagcgaggcgccctcgctggcgtcggtgctgaacacgctgccgcaggtggcgaaagacgcggggtgcgcgtactggtcgactcgcgcggccatgggtggagagcgctccatgctgcgctggcagcgcacgcagcccgcgctgggccacgcggacggcgtccacctgacaccggaaggctacgcgcggctggcgggggccttctcccgggagctgctcacggcgtacgaggcccacaagaaggcgggccccacctcgcgcgtggaggacaactga

SEQ ID NO: 7227 - DNA, 330 bp, Myxococcus xanthus
taccgcgcggcgctgccggcctatgaagtgcccaccgaggccgaggcctacgagatggagtactacttcgaggtcgcggacgcggcgcagcgccggctcgcgggccggggagactccttccagccgctcatcttccaggtggcgccccgggccgtgcgcgccggcgccgccgccgacccgtcctcccgtccctggtacaagagcccctggctctgggtgggcgtgggcgcggtggccattggcgccaccgccggcatcgtggcgctgacctccggcgaagagcggggccgcgttcccatcaccatccgcgtggagccccccgccccatga

SEQ ID NO: 7228 - DNA, 408 bp, Myxococcus xanthus
atggagcgcgcggtggccaacgacgtccaggcgctacaggtggccgtggtgtcacggggctccagccgcagttgcaccgagattcagcgcacgtgcctgggcacccaggtgcggcgtgacgacctggtggtgctgaaggacgcccaggggcgcgagggcagggccctccgcttcccagtggacctggcgaccctccagtcgggaggaagcctggagctggcggtggacgtgccggtgggccgagattacgcgctcgtcatcgaggcgatcaccacggggaccccgcccggcttcctggggagttcgtgcaactacctccgtgaggtcaacgcgggcgacaacgccccggtgattgccgcgcccctgacgctgaccggtggagattgcaatccgtccatcgcgccctga

SEQ ID NO: 7229 - DNA, 681 bp, Myxococcus xanthus
atgtcgcgcatcctgattatcgaggacgagcaggacctggcaggtctcgtcgactacaacctgcgggccgcgggcttcgagacggagacggccagcaccggcgcgagcgggctcgccaaggcgcgcgcgcatccgccagacctggtgctgctggacctgatgctgccggacgtggcgggcagcgaggtgctgcgcatgctcaaggcggacaccgagctgcgcaaggcgtccgtcatcatcgtcagcgcgaagggccaggagtccgaccgggtgcagggcctggagctgggcgcggacgactacgtggtgaagcccttctccgtccgcgagctccttctgcgcgtcaaggccgtgctgcgccgcgcggacgcggaggacggcccctccgcggtgctcgcctccggcgacatcagcctggacaccacccgccaccaggtgcgtgtgaagggcgaggaagtgctcctcaccgcgctggagttccgcctgctgcgcacgctgctggagcgctcggaccgggtgcagacgcgcgaggtgctgctgtcggacgtctggggcatccaggcggagatccacacccgcaccgtggacacgcacatcaagcggctgcgcgagaagctgggccccgccggggacatcatcgagacggtgcgcggcgtgggctacaagctcagccctccgtga

SEQ ID NO: 7230 - DNA, 1293 bp, Myxococcus xanthus
gacgggccgaaggaggtcttcgccgcggcgctcgtcgcgctcgccggctccctcatgtccctgggcgtgagccgcggaacgatgcagcggcagctcgacctgctggcccgccacacccgggagcgcgccgagggcggcgcctccaccgccgcgcctggcgtccctgagcggctggacgaggtggccgggctcgaaggcgccatcgactcgctgcacgcccagctgtccgcgcgcaacgcggcgctcacccaggaggcgcgcaccctcaccgccgtgctcgacggcatgacagaaggcgtctgggtgacggacgcagagggcacggtggtgcgccacaacgacgcgctccgccccctgctggcgtccacgaacagcccgctcaccggccagcgccccctggccctcatccggaacgaggcgctgcacgacgccgtgatgcgcgcctgccgggagagcgcatccagccacctggagctcacgctggacggccacttcccgcgcacgctctccatccgggtgacgccgctggccaaggatttgccgggcagcgccgccgtcttccacgacgtcaccgagctgcgccggctggagaaggtgcgcaaggacttcgtggccaacgtgtcgcacgagctgcgcacgcccatcaccgccatccgcggctacgcggagacgctccagggcggcgccctcaatgaccccgtcatggcgccgaagatggtggaaatcatccaccgccagtccgaacgcctgtccgaactggtggaggacctgctggagctgtcccgcctggagtcgcgcgaggtgagcctgaagctcgcccgcgtcaccctggccgacgccgccgcccgcgccgccgacaccgtgcgccccaaggccgggggcaagggccaggtggtttcactccacgtccctcaagacctactcgcagtgggggacccccgtgccgtggagcaggtgctgctcaacctgctggacaacgcggtgaagtacacgcccgcgggtggccgggtggatgtttacggtgagtacgagcaaggccgctgcgtggtgcgggtgaaggacaccggggtgggcatcgaggccaagcaccagtcgcgcatcttcgagcgcttctaccgggtggacaagggccgcagccgggacatggggggtaccggactggggctcgccatcgtcaagcacctgctgcaggccatggacggcgaggtcaaggtggagagcgaacccaacggggggagcaccttcaccatttttctgcccctggcggcttcatcgagcgcggcgacagggtag

SEQ ID NO: 7231 - DNA, 945 bp, Myxococcus xanthus
atgcgggtcgccatcctcgcggacatccacggcaatcttcccgcctgcgaggccgtcctcgaggacatcgcccgctctgtatcgcccgactacatcgtcgcggccggagacctggcgctgcgtggcgcccatccccgggagacggtggacctgctcttcgaccggtgtgactccgtcctgatgggcaacaccgactgctacctggcgggcaactacctgggcggcgcctaccgggagaaggaccactggaagacggagctgctgcgctggacgcgggaccagttgggcggcgcgctgctggagaagctgggcgccctgcccttctccgtgcgctacacgccgcgcaagggacaggacctcttcgtctgccacgccaacccgcgcaacctcgaggagtcgctggaccccacgctggatgacgtcgcggtgcgccgcttcttcagccacctggacgcggcggcctgcgccttcgggcacctgcacttcccctaccgccgccgcgtgggccgcatgctcatcgcggacgtggccagcgcgggcatcccccgggacggagacctgcgccccgcctacggcgtcttcaccttcacgcccaagggttggcgggtgcagattcgccgggtgcgctacccggtgcgcaaggccacccaggccctcaccgcgcgccgcgtccccggcggaccgctcctggtccacaagctggtggaggcgcgctaccgccaccacaacgcgctgatggaggccgcgcggcgccactccggcctgccaccgccgggcccggtgctccgcccgccgccaggggccgcctcgcgcgccgcggccacgcccatggacagtcgtccctccccggaggtcgaccccgcctcgttgcccacggacctggacggaaccgtgacgggcgcggcgccgctgcccctggacgcgctcaacgatttcgaagggtag

SEQ ID NO: 7232 - DNA, 495 bp, Myxococcus xanthus
atgtctgcacgcgagctgccgctgctgttcatccgccacgccgtcgcggaggactctcacgtcctgggcgatgaggcgcgcgccctcaccccggaaggccgcgccgccttccgccaccatgcacgcaagctggcacgcctcacgccactgcgcggcatcatcaccagtccgctggtgcgtgccgtccagacggcggagctgctcgccgaggccttcggcgtgtccggcgtggaggtccaccccgccctgctgccccagcgcggcgcgcacaagcgcatcgtcgacctgggccgcgagcgcggagcgggctgggccctggtgggccacaacccctcgctggagcgcgcggccattcgcgccctggagcatgagctgccggacaagctgcgcaagggcgcggcgctggcgctccatcccctgaagaacggcggcttcacgctcgcgtggtgggccacgccgggcaagcccgtgaagcgccccggcgacctgcgctga

SEQ ID NO: 7233 - DNA, 831 bp, Myxococcus xanthus
atgacgctgcgcacgctcggcctgacgctgctggggaccgcggggctgctgaccctttctgcctgtaagaaggaggagccggccgccgcgccacccgccgccgcgcccgccgcgaagaaggagccccacgcggcctcgcccatccaggcgccggaaggtgccgccgcggcgcccgtggctccagcgggcaagggcgtggtgaagggcacggtgaagttcaccggtactccgcctgaggccgcggacatccccgcgagcaatgacccggcgtgcgagggcatggcgacgaaggatgcgtcggtcctggtgaaggacggcaacctccagaacgtggtggtgcgcgtgaagggcaaggtgcccggcgcgcctcccgcgcctgccacgccggtggtggtggaccagtcgaagtgcacctatgtcccgcgcgtgcagggcgcgatggcggggcagcaggtggcgttcaagaacagcgacggcacgctgcacaacgtgcgcggcatcgcgggcacgaagcccgtgttcaacgtcgcgcagcctccgtccggcgccccggtggagcggccgttgcccgcggacgcggacgtgctgaagctcaagtgtgacgtgcacccgtggatgtctgccttcgtcgtcagcaacgagaacccgtacttcgcgacgacgggcgcggacggtgctttcgcgctcgaaggactgcccgcgggcacgtacacggtggaggcctggcacgagacgctcggctcgaagacggccgaagtcacggtgacggacgacgcgccggccgaggccgcgttctccttctccgcggaggacgcgtccgcgcagaagtga

SEQ ID NO: 7234 - DNA, 201 bp, Myxococcus xanthus
atggcaatcggtaccgtgaagtggttcaacgacgccaaggggttcggattcatcgcgcaggacaacggtgaggacgtgttctgccaccacactgccatcaacatggatggcttccgcaccctccaggaagggcagcaggtggagttcgaggtcacgcgtggccccaagggcctgcaggcgcagaacgtccgcgccgtctga

SEQ ID NO: 7235 - DNA, 402 bp, Myxococcus xanthus
ccgccgccatccaacggagacgaaggcatgggcgacaccagcgtgaagaaggtggagagtcggcactctcccaagggcgaaatggggcagaagtacctggcgtccggcgtccgcctgtcgatgcggctgtgggaggacgaaccgcccggagaaccggcacccgccaccgcgagggactacgaaaccgtgggcttcgtcctgaagggccgcgcggagctgcacctcgagggacaggtcatcctgctcaaccctggagactcctggctggtgcctcgtggctccagtcacacgtacaaggtgctggagaccttctccgccgtggaagccaccagtccgcccgcggccgtgcacggccgggatgaaagcaaggacgcggggacgaagccgcccgcgaaggcgtga

SEQ ID NO: 7236 - DNA, 600 bp, Myxococcus xanthus
atgctgctcacgcccgaaggcccgctcatcgactccttccacatcgcccgctacgcggacgcgcacggcagcgcgcccacgctctttccggccgagcacgccgaggagatcgccgcctggaacgcccgcagcgaggccgcgctcggcgcggcgcgagtgcgctacctcgaccggctcgcgaacgaccgcgccgcgaagctggagcagcagccacccgccttccctggtttcgtgcgccagctctcggtgcccgcggtggacctcgccatgaccttcctgcgcaggaagtacgggatgccggacagcacggcggcggaggccacgctggtattcgagttggaggcgctgcagcgtgcgctcgcgggcggcaagcgccacctcgtcgcgaaccgcctcacctacgcggacctcgcgatggcggtgacgctgcagttcgtgtcacccgtggacggcgggcacatcgcggtaggccccgccacgcgcgcggcgggcatccacccacaactgtgcgcgcgctatccggacatcgtcgcctggcgcgacgcgctctacgcgcggcaccggcgcagcgagcagcccgccgagcccgtccaggagtag

SEQ ID NO: 7237 - DNA, 666 bp, Myxococcus xanthus
atgcagttcaacatcaccttccgtcagttcggagcgtccgattccctcaaggagtacgcacgcgagaaggtcgaaagggtgaaccggttgctggaccgagccggcgaggcccatgtggtcctgtcgttggaacgccacctccaccatgcggacatcaccatccactccggcgcgtgggtcctgcggggccgcgacaagagcgatgacatgtacgcgtccatcgacctggcgatggacaaaatcgagcgccagctgcggcgctaccgtgacaagctgaagtcgcaccatggccgtgagcgcgtccaccaccggcatgatttggtggagcagctccgggtccgccacgccgtgttcgagctcccggacgtggacgcgctgacgtcgctggccgaggcctccgcgagtgaagatgcgccgaaacccgccgtcgtgcccgcgcagcccgcggccccgtcgcaggctgcgcgcgaggtgcgtgccacccacctcaccgtcaagccactcaccgtggatgatgcggtgatgcagatgaacctgatgaacaacgacttctacgtcttccacaacgtggagtcggagtcgctgtgcattgtctaccggcgcaaggatggccagtacggcctcatcgagccgcacgccccggcgatcgccgccacggggacctga

SEQ ID NO: 7238 - DNA, 1293 bp, Myxococcus xanthus
atgggccgcctgggcggcttcgtgcgcgcccggctgcaccggcgcctgttcatgtggttcggcctgtccatcctcgccaccggcgccgtggtggccacggtgatgagcctggtgggcggaggcacctggaaacaggaaggcgaccgcgtgcgcgccttcgtgggccaccgcttcgaggaggtctgggacgagcccgcacggcgggacgcgctggtggcctccatcgagaaggacttgcaggtgggcgtggagttgcgggacgcgtccggcgcgatgctggcgcagagccaggtgccgtgccggcggcccgagctcaacctgcccgtggttcgcgatggcatcaccctgggctcggtgcgcgcttgctacgccagcttccgtccgaagaacccgctgcggatggtgctgccgctggcgctgtcgtgcatggtgctgtggctggcctcggggaagctcgcgcggcggctcgcacggcccatggatgcgctggtccgggccacgcgagagctgggctcgggccggctggactcgcgcgcggacgtcgcgccgcatgtcacgggagagttcgccgtgctggcggatgccttcaacgacatggcggggcgcatcgagaagcaggtggcggaccagcgcgagctgctcgccgccgtgtcccacgagctgcgcaccccgctggcccggctgcgcgtgctgacggagctgctccgcgacggaggcggcaacccgaagacgttggaccaggtggaccgcgaggtggtggagctggatgccctggtgggggagctgctggccagctcccggctggacttcggccagctcaccccgcgtgtcctcgatggccagacgctggccacgcaggccctggagcgcgcggggctggcgagctccctgttgggtatggacgtggagcgcgccgggctcgtgggagacgcgacgctgctgggccgcgccctggccaacctcctggagaatgcgcgcaagcacggcaccggcgccgaggcactgcgcatccaggagcgaggcgaacacctggccttctgcgtggaagaccggggccccgggctgcagcccggcgaggacgagcgcatcttccggcccttctaccggagggaccaaggcaccgaagcgcgcgaggcgggctccctgggcctgggtctggcgctggtccagcgcatcgcgcacgtccacggcggagacgtcttcgcggagaaccgccccggcggcggcgctcgggtgggcttcaccgtgcggaaaaacggccctccggcttcagagggccgccccaccgcgtag

SEQ ID NO: 7239 - DNA, 681 bp, Myxococcus xanthus
atgtccacgcgcgtcctgctcatcgacgacgacacccggatgtatgaactgctcgagcagtacctcgggcagaacggcctcagcgtcacccacgcggcggatggcggacgggggctggcggcgctggaggccagtgccttcgacgcggtgctgctcgacgtgatgatgcccggcatggacggcctggaggtctgcaagcgcatccgcgccaagagccgcatccccgtcatcatgctcaccgcgaagggcgacgagacggaccgcgtggtgggcttggagctgggcgcggacgactacctccccaagcccttcagtccccgagagctgctggcgcggctgcgggccgtactccgccgctcgcagccctcggcggtggcggaccggctagagtcgggcggcgtgtccatcgacgtggccgggcgcgaggtacgcgtggaggagcgcgccgtggagttgacgggcctggagttcgatttactcgtcgcgctggtgcgcagggccggacgcgtcgttccgcgcgacgccctgctgggcgaggcgggccgcagtgacacggtggtgggcgagcgcaccgtcgacgtgcacatctcccacctgcgacagaagctcggtgacgtgggcacccgcctcatcaagacggtgcgcggcgtgggctacgtgttcgccaaggagggtccgtga

SEQ ID NO: 7240 - DNA, 384 bp, Myxococcus xanthus
atggaggccttcgccaaggcccgtgatgaggtaggccccagccgcaccgccctgggcgccgcgctgcgcggtgagcacttcgacggcgccgcgctgcgtgagctcttcgctcgccacgatgtcgccatcgacaacgtgcgccgcacggtgcaggggtcgctcgcccaggtccacgaggcgctggacccgcggcagcgccgtgagctcgcggacctcctcgagcacggcttcggctccgcctacggctggcacggaggccatggcggctggcaccgccgctgtggcggccccggcggctggcgaggcggcggattcggccacggtggccatcgccacggggacggccacggcccgtggggacgcgatgacgcgcgtggggtgtga

SEQ ID NO: 7241 - DNA, 1278 bp, Myxococcus xanthus
atgaaggtccaggtcgaggagctttctcccattgagaagaagctctccatcgaggtcgacaatgcccgcgtggcggaggagctgtcccgcgcgtactccaacctgggccgccaggtgcggctgccggggttccgtcagggcaaggtgcctcgccgcatcctggagcagcgcttccgtgaccaggtagaggacgaggtcatccagcgcgtggtgcagagcgcgtacgtggaggccatccgcgagcacaacgtggaggtcgtcgccacgccgcaggtgaccaactccggcctcaagcccaacaccccgttcaccttcgaggctcgcgtcgaggtgaagcccaaggtggaggccaaggactacgtcgagctgccgctgacgaagtccgacaccgccgtcaccgacgagcaggtgaacgagcagctggagcgcatgcgccagtcgatggcccggctggagcccgtcaccgaccgcgacaccgccgcctccggcgactacgtcaccgtggacttcgacgccaccgtggacggccagccgttcgcgggcagcaaggcggagggcatcaccgtgcaggtgcagcccggtgagctggtggagtccaagattgccgccctggagggcgtgaaggtcggcgagtccaaggacatcgactacgccttcccgcaggagtaccgggtggaggaggtgccgggaaagacggcgcgcttccacatcacgctcaagggcgtgcagaaggaaatcgtccccgagctgaacgacgacttcgccaagcagtcgggcgtcgcccaatccattgacgagctgcgcaccaagctccgtgaggacatggagaaggcgcgcaagtcccaggtggagggcgaggagcgtgaggcgctgatgaaggcgctgctggagcgcaacaccttcgacgtgccccgcgccatggtggagcgggccatggactccatgctgcgcggcgcgctgcagcagctccagcgctccggtgtggacccccgccagctgaacctggacttcaaccgtctgcgcgaagacatgcgcgagaaggccctccaggaagtgaagggcacgctgctcttcgagtccatcgctcagaaggagggcatccaggcctccgacgcggacgtggacgcccgcatcgagcagctcgccaacgaggcgggccagccggtcgccgtggtgcagaagtacttcaagggcgccgacgagcggctcgggttgtctctccgactccgggaggaaaagacgattgaattcctgaggagccgggcgaagtattcgtaa

SEQ ID NO: 7242 - DNA, 621 bp, Myxococcus xanthus
atgcccttcatgcccgttccctacgtcatcgagcagacccaccggggtgagcgctcgtacgacatctacagccggctcctgaaggaccgcatcgtgatgctgggcacggagatcgacgatgacgtggccaacgtcatcgtcgcccagttgctgttcctggagtcggaagacccggacaaggacatcaacctctacatcaactcgccgggtggctcggtgacggcgggcctcgccatctacgacaccatgcagtacgtgaagtgtccggtgtccaccatctgcgtcgggcaggcggcctccatgggggccgtcctcctgctcgccggtgccaagggcaagcgttacgccctgccgtccagtcgcatcatgattcaccagcctctgggtggtgtgcgcggtcaggcaacggacattgaaatccaggcgaaggaaatcctccggatgaaggcgaagctcaacgagctcatcgtcaagcacaccggacagtccatcgagcgtgtcgagaaggacacggaccgcgactacttcatgggcgcgtccgaggcaaaggcctacggcatcatcgatgagatccagaatccccggaaggtcgtgggactgggtaaggaagagaagaagtag

SEQ ID NO: 7243 - DNA, 593 bp, Myxococcus xanthus
atggcgggcaagaacgtggagaagcgagacaaccagaccctctgctgctccttctgtggaaagtcacagaaggaggtcaagaagctcatcgcggggccgacggtctacatctgcgacgagtgcatcgggctgtgcaacgacatcatcgcggaggagatcgaccgcgaggagacgaaggacacgaagctgcgcatcccccggccctccgaaatcaaggcggtcctggacgagtacgtgattgggcaggagcgggcgaagaagacgctctccgtcgccgtgcacaaccactacaagcgcatcgagtccaaggtcgcgatggaggacgtggagctccagaagagcaacatccttctcctggggcctaccggtagcggcaagacgttgctggcgcagacgctggcgcgcatcctcaacgtgcccttcaccatcgccgacgcgacgtgcctcaccgaggccggctacgtgggcgaggacgtggagaacatcatcgtcaacctgctgcaggccgccgaccacgacatcgagcgggcccagcgcggcatcgtctacatcgacgaaatcgacaagattgcacgcaagtcggagaacccctc

SEQ ID NO: 7244 - DNA, 912 bp, Myxococcus xanthus
atggaagccaacccccaacagaaggcggaaggaacggcggccggccagggtggccagcacgccgggtggacacgggagcgcgtggagctcgtgaagcggaccatctgccctcgcggcatcagcgaggacgagttcgccctcttcatcgagcagtgcaagcgcagtggcctggacccgctcctcaaggaggccttctgcgtggcgcgtcggcagaatgccggcaaccgcgagcggcccaactgggtgacgaagtacgagttccagccctccgaggccggaatgctcgcacgcgccgagcgcttcccggacttcaagggcatccaggcgagcgcggtgttcaccgaggacgacatcgtcgtggaccagggccgaggcgaggtggtgcaccgcttcaaccccgccaagcgaaagggcgcgctggtgggtgcctggtcgcgtgtggtgcgcgaggacaagctgccggtggtggtgtggttggacttcagcggctacgtccagcagacgccgctgtggtccaagattcccaccaccatgattgagaagtgcgcccgcgtggccgccctgcgcaaggcgtacccggaggccttcggcggactctatgtgcgggaggaaatgcccgccgaggactacgagtcgcactcggacgaacacggcagcggcccctacgaggtactgggctccaagcccggccccctcaaggcgtccttcccgccgctggcgccccaggagccgcgcgcgtcccaggccgccgcggcgcagttggacatcgacgtgccgctccagcccaagcagccccgcgaatccaccctggaggcggtgcccgccgccaatccggagcccgcggcgccacgccccaagccgagcgccgtggtggtggcgttcggcccccacaaggggaagacggctggagag

SEQ ID NO: 7245 - DNA, 507 bp, Myxococcus xanthus
atgaagacgttcctcgtggtcaatccgcgcagcgccaacgggcagacgggaaagcgctgggcggagatttccgcgcaggtcggcagggcgctgggcgatttcggccacggcttcacccagggtggcatggatgcggcgcgcatcacccgtcaggcgctcctggacgggtacgagtgcatcgtcgcggtgggtggcgacggcacgctcaacgaagtcaccaacggcttcttcgaggacggcaaggcgctgaatccgaacgcggcgctggggctgattcctcggggcacgggtggcgacttccggcgcaccttcgggtgggacctggagctggcctcgtcgttggagcggctgcgctccggcacgacagagccgttcgacgtgggccaactggagttcatcgacaacgcgggccagcccgccacgcgctacttcgccaacatcgcctcgttcggtgtgagcgcggtggtggcccaggaggtcaaccagagcagcaaggcctttagagca

SEQ ID NO: 7246 - DNA, 744 bp, Myxococcus xanthus
cgcctgccctacggtgagaagacggtgccggtgaaggccttcaacttcaccgaagacgtcgtgggccaccacgagcgctacctgtggggtcacgcctccgtggcgctcaccagccgcgtggcggactcgttcgccaagttccgctggagcccgaacatcatcggtccccagtccggcggcgcggtggagaacctgccgctgcaccagtacgaggccatgggggagatccagaccaagattcccaccgaggtcatgctcaccgagcggcgcgagttcgagctctccgaggagggcttcatcggcctggtgttccgcaaggactccgacaacgcggccttcttcagcgccaactccacgcagaagccccggttcttcggcaacaccccggagggcaaggcggcggagaccaactatcgcctgggcacgcagctcccttacatgttcatcatgacccgcctggcgcactacatcaaagtgctccagcgcgagcagattggtagctggaaggagaagtcggacctggagcgcgagctcaatcactggctcagccagtacatctccgacatggacgaccctgctcccgccgtgcgctcgcgccgccccctgcgcgccgcgcgcgtggtggtggaggacgtggagggtcagccgggctggtaccgctgcagcctgcaggtgcgcccccacttcaagtacatgggtgcatcgttcaccttgtccctcgtgggcaagctggacaaggagtag

SEQ ID NO: 7247 - DNA, 492 bp, Myxococcus xanthus
atggctgaatcagtacacctgtacctgaaggcgaacggcagcgacatcaagggcgacagcacgcagaccagcctgggccgcgcggactccatcgagtgcgtcgcgtacagccagaaggtcttcaccgctcgcgaggccggttcgggtctggcgacgggccgccgccagtacgagggcatcgaaatcaccaagcgcatcgacaagtcgtcgccgctgctgatgaaggccctctgcgagaaccaggtcatcgacgcgaccttcaagttcttccgtccgaacccgacgggcgacggcaccaccgagcagttctacacggtgtccatcaagaaggcccgcatcaacgccatccaacagacggtgccgaactccttcgtgccggcgagcaccaacctgcccccgatggagaccctccagctggtgttccacaccatcaactggaccatcacccagggcggcgttacgcacgaggacacctgggacacccagcgttga

SEQ ID NO: 7248 - DNA, 462 bp, Myxococcus xanthus
gtgagaatcgccgagttcctcagcccccaagccgtcatcgccgacatgcagtcgcggacgaagcctgaagtcctgcgagaactgagtgccacgctggtgcgcgcccatccgctgctgaccgcggaccggctggtggaggtgctgcgcgagcgcgagaagcttggcagcacgggcatcggcgagggtgtggccatcccgcacggcaagctgccgggcatggggcaactccaggccgccttcggcgtgtcgcacgcgggcgtggacttcgaggccattgacggcaagcccacccacctgttcttcgccctggtggcgccagagaacagcgcgggggtccacctcaaggccctggcccgcatctcccgtctcttcaagaacccgcgtttccgggccgccatcctcgaggcgcccacggccgcggacatccacgccctcatcgtccaggaagacgcacggccttga

SEQ ID NO: 7249 - DNA, 396 bp, Myxococcus xanthus
atgggctcccgaggcttgttgtcgcgcatcgctgaaggcaacggcacgctcgccccgcctggcgacgtcgttgaatccatcgccgagcacctgcgcaacctcctcaacacgcgcaagggagagtccgtggcctcacccggctacggcatcctggacctgaacgacatcgtccactcctacccgtcggcgataccgcggatgacgcagtccatccggcaggccatccaggagttcgaaccgcgcctgaagagcgtggtggtgcactacaacgcggacccggtggacccgacggcgctgcgcttcgacatcaccgcccagttggccacgcgggatcgacgaggcatggtgcgtttccatacccaggtgcacccgggcggacgcgtggacctgtggtga

SEQ ID NO: 7250 - DNA, 1752 bp, Myxococcus xanthus
atgttcagcaagtattacctgagcgagctgtcgtacctgcgggagatgggacgggccttcgggctggccaacccctctgtcgcgggcctgttggtggagcgcggcgcggacccggacgtggagcggctgctggagggcttcgcgttcctcgcggcccgcatccgcgagcgcgtggacgacgacgtgccggagctggtgcacgggctcaccgagctgctgctaccgcactacctgcgcccgctgccggcctccaccatcgtcgagttcaccccgcacctgcgcgcgctgcgcggccgctcgcggctggccgccggggcggaggtggcgtcgcagccgattgacggcaccagttgcgtcttccgcaccaccacggacgtggacctgctgccggtgcagctcaccgacgcactcctggaccggtcgtccatcaccgcgccggtgctgcgcctctatttccagacgacggagcagggccgcgcggaggtgttgcgcgagcaaggcctgcgcctgttcatccacgccgacctgtccgctgcgtcggtggtgctgctgtggttgctccgctactgccgccaggtgcgcgtgcgcggcgcgtctggccagggagacggcatcaagctgccggtgaatgccatccaaccggtgggcttccaccgggacttcaagctgctgccctggccgcgcgccagcgagggctaccggcacctccaggagtacctgacgctgccggagaagttcctgttcttcgaggtgcgcgggctggacgccgccgccgggctgaaagaggaccgcttcgagattgccttccacctggagcggccgccgcccctggatgcgcgcatccaccgggagatgttccggctacattgcgcccccgtggtgaacctcttcagcgtgccggcggaccccatcctccaccgcacgctggaccgggagcacctgctgcgcgcgtccgacctgccccccaaccacgcggagatttactcggtggactcggtgacgggcctgaaggccggacgcaacgagcggcgcgtctaccggcccttctacgagttcacccacaccgcgggcggggacgccgagcagtccttctatcggctgcgccgggcgccttcgccgctggacgaaggaatcgacacgtacattacgctggagacgccgcggaacatcgcgccggaggtcaacgccgaggaagcgctgtccatggacctgacgtgcaccaaccgctcgctgccctcgcggctgcaggtgggtgacttgacggcatccacctccgccagccccacgcaggcgaagttcaagaacatctccccggtgagccggcccgcgcgcgcgccgctgggcaccgaactgcactggcggctcctgtcgcacctggccatcaaccagcactcgctggcggacgcggccgcactgcggcggctgatggacctgtacaacttccattcgctcaccgacaacctggcggcgcgcgccagccgcctgcgcatcaacgccatccgcgcggtggagacgaagccggtgacgcgcttcctggagggcgcgccgctgcggggtcaccgcacccgcgtggacctggacgaagagaacttcatgggcgtgggcgattcgttcctcttcggctccgtgctggaggaactgctcgcctcccacgtcaccatcaactccttcaacgagctgagcatccggcttcacccctcgcagacggagttcgcgtggcttccgaggaacggctcccagacgcttttgtag

SEQ ID NO: 7251 - DNA, 177 bp, Myxococcus xanthus
  unsure (1)..(177): unsure at all n locations
atgattcgcttccggcacgacccgtccctggggttcccctcgggcgacgtgtcgtccgtgacgctccaccaggtgccggtgcgggcggaggacccgtattcgaagcggccgctcttcgaggtggtgacacgctttctgggcctgacnggcgcggtgagtcccctgccccactacctg

SEQ ID NO: 7252 - DNA, 1191 bp, Myxococcus xanthus
gcgcagcgcgccacgcggctcgggcggctgaacctgctgctgccgggcagcagagtgccggcgcctcccggcatggagcaccccgcctccgccgtggaccgcacgacgtggcacggcgcggcccacctgttcggccttcaggatgtgtgcttcctctgccttccagacctgccggagctggtggcggatgcgcccgagccactccccatcccccgcctgccacccgcgggtgccacagggttcgtggaatgcgccacgcatggcgcggccaccgggtccgagtggaagacgccggagcgcgcggcgcctcgctgcggactcacagcctacctggactgggcggccttcctcgccgtagtggccgagctcctccgcgacaggcgcctgcgggagacgcacctggtcgcggcgctgccgctgccctcgacaagcctggtcttcgatacttccgcgggcaagcgcgccgcgacgcaggatttgggcgcgttcatccatgccagcggagtgctcaccccattccagagcgcgttcatccagctcgcctatccgtggctgaggaccgcgtcctcggagggacttccggagcggttggcggcccctgacggggcgctgacgggggtgctggcacgcaacgcactgcttcgcggcaccttccgaagcgccctgggactggggctcgcggaggtacgagaggtcttcccaatcccaacacgcctggaccaggaaccacgcgatccggggtcgccgctgcgcgcactgggcgagcgcgtcacgttgctggggcccacgccccgcggaatgcaggtgttgtccgacgtgacgtccagccagagggtcagccaccgccaggctccggtgagccggctcatctcctcggtgctgcgagcggcgaggcaactcggcgcggacctgacgttttcaccctccaacgaggacacctggttggcgctgcgctaccggatggagtccgtgctcggccggttcttcgcagagggcgctctgcgaggagcgacgccgcgcgaggctttctccgtgcggtgtgaccggacgaccatgacgcaggacgacctcgataacgggcggctcatcgcgctggtggaattggctcccgcggcggcaatcgaacgggtgcaggtccttctctccgcgttggagggtgacgtgtcactccagcaggaggaagccgcatga

SEQ ID NO: 7253 - DNA, 480 bp, Myxococcus xanthus
atgagcggagacctctggccactgcacaccttccgcttcgaactcaccttccagcccgagccgctgtcgggcagtggcccggaagaggcacccgtggacggggccttctccgagtgcacgggtctggaagccaccatggagccgaaggccattcgcgtgggcggccacaacctgggcgccgtgcagcgcgccgggccggtgagctttggcaccgtggtgctcaagcgaggcctctcgtcgggcgagcggctggctcgctggttcatgagggtgacggacggcgactacgggtaccggtgcaccgtgcgaatccgtctcaaggccccgtcggagaacggagggacccagacggtgctcacctacaagctggagcgcgccatgccggtgaagttcaaggcggccgacttcaacgcccgcgcgacggacgtcggtatcgaagagctgcacctcgtgcacgaaggactctccctcgaggactag

SEQ ID NO: 7254 - DNA, 1077 bp, Myxococcus xanthus
atgactgacgccacgtcacagccagaacatcaccgccccacggtgcgcatcttcggcaaggccgacgcacgcgtcaccggtctggtcagcagcatgcgactagaggaagccgaaggcggcctgtgctcgctcgagctgcgcttcgaggcaatcgcacgctacgccgacaccgtggccgagcaggtcttcgaggacgagcaactgctcaggctcggggcacccatcggcatctacaccggtcccgagagcgcccctcaggagatttttcgcggcgtcatcaccggaatcgaagccgtgttctcgcacgactccgcgccggagttcgtcgtgctcgcagaggacgcactgcagaaagcaaggctcgcgcggcgcacgcacgtccacagcgacctcaagctggccgagctggcggagaagctcgcccgggacctgggcctgacgcccatcatcccaggccttcgcgagtccctgggcctccaggtccagtggaacgaaagcgacctggccttcgtgcggcgattgctggccacgcgggatgcggacttgcaggtgacgggtgacgagctccacgtctccgcacggagcgcggtgcgccggggcatcctggagctgaccctctactctgaactccgccgggtgcgcgtcacggcggacctggcgcatcaggccacccaggtcacttgcaccgggtggaacgccatccagggcgccagggtctccggccagagctccggctcgcgacccggcccgggcgcggggcgtaccggcgcggagctgctccagcagacgctgggccctcggaccgagcacctcggctcgctgcccgtgtccaccagcgacgaggccaccgccatcgccagggccgccttcgatgcgcgcgcccggcgcttcgtccgcatcgacgccactgcggagggcacccccgcgctccgcgtggggacccacgtgaggctccgcggcctgagcgctcgcttcgacaacacctactacgtggtccgtgccagccatcgctacgacaccctccacggctacgagacggacttcgaggccgagtgcgccttcctgggagagccatga

SEQ ID NO: 7255 - DNA, 230 bp, Myxococcus xanthus
atgaccgacaccgcacacgctcaggagcgccgcctgctgggcgccatgctcggcacctatctggcgaaggtcgtgtccgtggaggaccccgaacacctggcgcgcgtcaaggtccgcctgctcaccgcgcccgagggcctggccgatgcggacgtggccttgtgggcgcgggtcgccgtgccgttctccggcagtggctggggcgcgctcttcctcccggacaaagatga

SEQ ID NO: 7256 - DNA, 1915 bp, Myxococcus xanthus
atgaaggacgctgagaagggttcgtgggtctccagaatcgccgcgctgcaggacgtgaagacctacgcggagctcaactgggaaggctcgttcgaggagtacctcgaaatcgtccggcagaaccccaaggtcacccgcaccgccttccagaggatctacgacatgatcctcagccacggaaagacggagtacatcgacaacaagaagaagctcatccgctaccacttcttcagtgacgagaagttcggcggccgtgacgccatcttcgggctcgatgtcccgctcatgaagctggtcaacgtcttcaagtccgccgcccagggctacggcaccgagaagcgcgtcatcctcctccacggccccgtgggctcgtccaagtccaccatcgcgcgcctgctgaagaagggcaccgaggactactccaagacgccggagggcgccgcgtacaccttctcctggctcaccgacaagaagggctcggacggcgccccggtgaaggagaagatgaagtgcccgatgaacgaggagccgctcaacctcatcccccgggagtggcgttccaagatctacgccgagctgtctgcgcccgagtccggctacaccattccggatggctccgagctgtgccccgcctgccgcttcgtcttcaaggacctgatgacgcagtaccagggcgacttcgccaaggtcatgagccacatccgcgtcaaccggctcgtcttcagcgagaaggaccgcgtgggcatcggcaccttccagcccaaggacgagaagaaccaggactccactgagctcaccggtgacatcaactaccggaagatcgccgagtacggctccgactccgacccgcgcgccttcaacttcgacggcgaattcaacatcgccaaccgcggcatcatcgagttcgtcgaggtgcttaagctggacgtcgcgttcctctacgacctgctcggcgcgtcgcaggagcacaaaatcaagccgaagaagttcccgcagacggacatcgacgaggtcatcctcggccacaccaacgagcccgagtacaagaagctcgagaacaacgagttcatggaggccctgagagatcgcacggtgaagattgacgtcccgtacatcaccaagctgtccgaagaggtgaagatctacgagaaggacttcaactcccgtgccatcaagggcaagcacatcgctccgcacacgctggagatggccgccatgtgggccgtgctcacgcgcctggaggagcccaagaagcacaacctgtcgctgctccagaagctcaagctctacaacggcaaaacgctcccgaacttcaccgaggacaacatcaaggagctgcgcaaggagagcaaccgcgagggcctggaaggcatctccccgcgctacatccaggacaagatctccaacgccctggtgagcgacaagggcgagggctgcatcaaccccttcatggtcctcaacgagctggaggccggcctcaagacgcactccctcatcaacaacgaggacacgcgcaaggggatgaaggagctgctcacgtccgtgaagcaggagtacgaggacatcgtcaagaacgaggtccagcgcgccatctccgcagacgaggacgccatcgccaagctgtgcggcaactacatcgacaacatcaaggcctacacccagaaggagaaggtcaagaacaagtacaccggcctctacgaggagcccgatgagcggctgatgcggtccatcgaggagaagatcgacatccccgatacccgcaaggacgacttccgccgcgaaatcatgaactacatcggcgcgctcgcggtggaggggaagaccttcaactaccggaccaacgagcggctccacaagtcgctggagctgaagctgttcgaggaccagaaggacagcatcaagctcaagaacctgg

SEQ ID NO: 7257 - DNA, 594 bp, Myxococcus xanthus
atgctcgacttcctcaaaggtgcggccaacctgctggctggccccatgtccaccgcggtggatttcgcgggcaacgcgctgggattgccgccgctcatcaccaactccatcaaggccgcggcgggggccgcgacgggcaacgtcatgctggcggccagtggcgccatgggcgtggcgcaggagttgtcgaagaacccgcccgcgaagacggagtaccacgcgtcctcctcgggcagctcgaaggccgacagcggctacgcgccctccgcgtcctcgtcgcccatcctgaatccgggcagcagtccgttggatccgaagatgctcgactactcggacgccctgaaggtgctggaggcgaacttccagcagttggacctgttggatggcaagaagaacggctcgctgtcgaagaaggacctgcagcgcatctccacggacgccagcctgtctccccaactgcgggacgcggcccgcttcatggtggagaacacggctctcttcgagcggctcgaccggcagggaccgctggcaaaaaaaagcatcatctcgccgctgtacaacctagacaccttcacggtgcagggcccccagcca

SEQ ID NO: 7258 - DNA, 1587 bp, Myxococcus xanthus
atggccaccgcccccgcccccttctccgtttcgcctccccatgcacctggcctgtcggcggtgcctgcccctcagcacgagccaggcacccggctgctcgtcgggctgttgctggtggcggcgctggtgccgcggctgggcgtgttcttcgtcaacgagaacctcttcggtgacgcggtggtgcgcacggagctggcggagcgctggttgcgggcgccgcacatcatcaccgcctatggggacggggcctaccagttcggtccgttgcacatgtacctggtgggcgcggcgctgtcggtgttcgaccgggaggtcgcgggccgtgtggtgagcctgctgttcggcgtgttgtcggtggtgccgctgttcgcgctgacgcgccggctcttcggctggcgcgcgggcgtggtggcgggcctgtccttcgcggcgtggggcatgcacatgcagttctccaccacggccagcagcgaggcggtgtccctcttcttcatgctggccaccttcgcgctgtacgcggaaggcgtggatgacaaccgcttcctgcccctgttccaggcggcgttgatgctcaacctggcgtgcgcgcttcgctacgacgcgtggatgtacatcccgctgctcacggtggcgctgtgcttcagcagccaggacaaggtggtgtcgctgacccgggccgtgggcttcggcctggtgtgcctgccgttccccctgttgtggatgcagggaaatgagctgatgcacggtaacccgttcttcccggtggtggcggtggaggacttccaccgtaactgggtgaagtcgtccctgggctcggggtcgaacgtgctctggcggttgcagcaactggggttctggcccggcatcgccttgctcacgctgtcgcctctcgtcgcgctgctgggcatggcgggcatggttcgcgcgtggcgctcgcgtccggacacgcgctggctggtggccgcggcggtgcttcccgctgcctacttcaccttccgggcggcggtgctgctgaccttcgttccgctgggccgcttcacggtgacgcaggtcgcgctgctccccgtcttcgtggccttcggcttcgccgggctggtggcaacgcgtggagggcccatgctgcgcaaggccctggcgggcgtgacggtgctggtcgccgtggccgtgccggtggcgatgggcgtctatacgttccgcgccgacgggccgctgcagtccacgatgcgccccatcagccccacgtccacgaatcccgtggcgctgatgcaggtggcgaagttcctgaaggcggaggtcgccgccaagggtggggccgccgcgctcgacgtcgacccgaactacatggacctgcaactggccttcttctccggcctccccgaggagcggctggcgcgcgtgcgctgggacaccttccgccagcgcatgcaggaggcccgtccggaggtgctggtccgcttcgacggtggagcgctggcgaaggccgagggcgtgaagctggaggagcgctcgctggtactggacggcgtggcctaccagaagctggatggcttcaccgcgccgcttcacgtgtaccggcgtcagccgtag

SEQ ID NO: 7259 - DNA, 846 bp, Myxococcus xanthus
atggacgtcgtcctgagacccatcagcgaccgcttcttccacgaacacctgctgcctttcttccagcgggccatgggggatgcccccggcgcgctggagtccctgcaggagcaactgggggacggtcaggcgcgcatgctctgcgagcggatgctcgccacggcgctgcccggcggcgtgggctccgtggacgcggacccctgggcggacctggtggaccggctcgtcttcctgcactggaccgaaggccccgcgggctgggaggtcggtgaggcggaggcgggctacgcggacggctgggacgaggccctgcacctggcgctgatggtggaggaggcggactatccctactgggacgcgcggggctcgcgcgacgtcagggatcgcttccgtttccggccgcgtgaggacgtgggcctggcctcgctgctcgctggcttgtgggagcccttcccggagttcccgccggaccaggtgttcaccacccagggccggggcgaatactcccccgtcacacgctacgccttcgcggactgggcctggcgcccggcgaagaaggtggcgcactggcaggtgaacctgccgcgcaagctggagcggctcctgacccgcgagcaggcgcggatgaagctgccgtcgctgccggagaaggaggaggtgctggcgtactggctgggcaagcagccgcagccgccgccgctcacggtggccttttccggcttggggccccgcgcggccaactggattcgcgagctgggtgccctcaccgcgcaccttcgcggcgcggcgctggcgaagcaggggctggcggcgctggtgacgaagggctccggcgtccgaatctag

SEQ ID NO: 7260 - DNA, 762 bp, Myxococcus xanthus
atggtggtgtcggtctcacccgaggttgagacggtgctgggcgtgggggccggccgcgagctgcgaacggagtatggccccgaggtcgcggtgccgctctacgtggaatggcaggcgggggcggggaggggacaggctcgttatcgcgtgcgggtggggcgtcccgaggtccgcgccgtggatgatgaggggatggagccagcgtggcggttggcggaggaactgggcgcggtgagtggccgggatggcgccgtggtgctctccgaccgaggggtgccggttcaggcatgggtgcaactggggcccggggcttccgcggcattgagcagcctggtgcgggcggcgctgtcctcggactggctcgtcaccccacggcttccggaagagccggtgggcgcgggagcgcgctgggtcgtggcgcgagcccaggaggaagggctggccgtcgtcacctatgagttggtggagctggaaggggcccgcggccgggtgcgtttcctcctccagtcccagggagcggaaggtccgctggctcccagggccgagggcgagctgcgcttcgacctgcgccgcccatttcccgagcggctggaggtcctttacacgtcgcgcgccgaactggggacgcagggcgcccggcggctggaggtggtccgccgcacgcgggtgacgctggagtccggcagccccttggccccggcgcaccctgaaatgattgcagccccctggatatcggaaggggagcaggttcgcgcaccgtga

SEQ ID NO: 7261 - DNA, 405 bp, Myxococcus xanthus
gcggacaagaagggcctgcgctacctctacctggacggtcgcaccaaggaccgcatgggcaaggtggacgagtacaacaacccggacggtccgccgctcttcttcatctccctcaaggcgggcggcaccggcttgaacctcaccgcggccgactacgtcatccacttcgacccgtggtggaaccccgccgtggaggaccaggccacggaccgtacgcaccgcatcgggcagacgcgcgccgtcatcagctacaagctcatcacccgcggcaccgtggaggagaagatcctcgccctccagcgccgcaagcgggagctggccgctggcgtgctcggtggggacggcgacgagatgggccggacgctcacggagcaggacatccaggagctcttcacggaaatctga

SEQ ID NO: 7262 - DNA, 1737 bp, Myxococcus xanthus
gtgctgctgggtctgcggatttcgaacgtggcggtgatcgaggaggtggaggtggcgttcggagccggcctcaccgtcctcacgggtgagacaggtgcgggcaagtccatcctcgtggatgcactgggccttttgctcggggggcgcgccgacgcggatgtcattcgcgccggttgtgaggaggcgtccgtggagggcgtcttcgcgcggactcccgcgttggagacccggctggaggagctgggcttgccggacctgggggaagaggtgctggtgcgccgggtgctgggacgcaccgggcgcggcaaggcctacgtcaacggctcgctggtgacagtgggcgtgctgggcaagctcacgcgtggggcggtggacatcgccggccagcacgagcacgtcagcctctttgattcggggctgcaccgggtgctgctcgaccggtacggcaacctggaggatgtgctcgcggccttcttccgggagtacaccggcctgcgcgagatggacgcgcgcatggaggcgctgggcggagacgaggcgaaggtgcgcgagcgcgccgagttccttcgcttccagctcgatgaaatcacgcgcctggacccggaggccgacgaggacgcgcggctggacgcggagcgcaagcggctgggcggcgcggagaagctcaagcgccacgcctcggaagcggagctgctggtgtccggcgaggagcagtccgctgtggagacggtgggccgcgcgctggggctggtgcacgaatcggtgaagtgtgacgccacgctggcgccggtggcgcaggcgctgagcaccgcgctgtcggagctggaggaggcgcagcggcggctcaaccggtacgtggaggggctggagtcggacccttcgcggctggcggacgtggaggagcggctggacgcgctcaagcgtctgtgccgtaagcacggcacgcacctggagggcctgctgaagaagcggggcgaaatcgaggtggagctgggcacgctggagaaccggaaggaaatcctggaagagctggccgccgaccgccgcaaggtggaggagcgggcccggaaggccgctgcggcactgacacgggcgcgtgcggccagtgcggtgacgttcgccgcgcaggtgcgcgagggcctggggcaactggccatgggcaaggcggccttcgaggtgcgggtgacaccatcggattcgctgcgcccggacggcatggatgacgtggagttcttcttcagcgcgaaccctggcgagccgccgcgagcgctggcgaaggtggcttctggcggtgaggcgagccggctgctgctggcactcaagaaggccctggctgacagtgacgggggcgggtgctacatcctggacgaagcggacgcgggcgtcagcggcgccatcgcggacgtggtggggcggatgatcaaggacgtgagcagccaccgtcaggtgctctgcatcacccacctgccgcaggtggccgcctatgcggatgcccacctgctcatccgcaagggcctcaagggcgagcgcactgtctcggaggtggtggtactggatgcaggggcagaacggacccgggagctggcgcggatgatgtcgggcgtcgaggtgacgcgtgaggccctgggagcagcggaggccctggtgcgttctgccaacagggcgctggggactcgggcccgcagggagtctggaccggagggggccccccggggtcggctccgacgcaccgcgtga

SEQ ID NO: 7263 - DNA, 762 bp, Myxococcus xanthus
ttgaagataatttccgccggcctgacggatgtcgggcgcaaacgtaatcacaacgaggacagcttcctcattgatgatgagctccagctctacgtcgtggccgacggaatgggcggccatgcgggtggcggcactgcgtcccgcatcgcggtggagaccatcgacaaagagatgcgccgggcgcgggaaggcaaggacaaccccttcctttccgtcccgaatctccaggactctccgattccggaggcgctgcgcaccgccgtggagcgggcctgtctggccatcttcacggccgcgcaggaagatgcgcggctgtccggcatgggcaccaccgtcatctccctggtggtgcgcgacgagcacgccttcttcgcccatgtgggtgacagccgcgcatacctcatccgcggtgacctcatccagcagatctccgaggaccactcgctggtcaacgagcagatcaaagcggggatgattaccccggaagaggcgaagcactcccgctacaagaacatcatcacccgctccgtcggcttcgaggaggaggtgcaggtggacgtcatggggctggtgtcagagcccggcgacgtctttctcctctgttcggacggcctcgcgaacatgatggaggaccgggagatccacgaaaccgtggtgaaggcgcggaccttcgaagaggtccccaagcgtctcatcgacttcgcgaacgaacgtggtggtgacgataacatcaccgtcatcgtcgtgcgagtggaagcctga

SEQ ID NO: 7264 - DNA, 293 bp, Myxococcus xanthus
atggtgattccggaccatgacgctccggtcaagcggtacaccatccagcggtcctttctcactcaggtggggatgggactgatgctcgtggtgggactgggcgtgggtgcgagcgtgcactacttccaggtggccgcggacgcctccgagaaccgcatccttcgcgaagagaacctgacgctgcgctcgcagctcaagtcggtgcgtgagcgcatcgagcacatcggctccacgttggaccgggtggagcgcttcgaccagaagctgcgcgcggtgacgctgctgtccgatcc

SEQ ID NO: 7265 - DNA, 1461 bp, Myxococcus xanthus
gtcccccggctacaacatgctgcggcgggtagcgctggggctggaaggcgccctggaccggctgctcgcgcggcgcgggctggcgctggcgtccgtgtacacctcgggtggcccggacgacttgaagcgaatctgcgagcagttggtggacatggacgaggccttccagggctggctccatgcgcacttccagctggtgcgccgcaccattggcgtggaccgcaccgtgaaagcgctggacggcctgcccacgcaggtgctcgcggggcggatgatgctgccgctgttccgccagctctgggacgtgcggctggagctgacgtccgggtggcagcgcgagggcggcatcgccccgggtgccaaccgggcccctccaggcggcggctgccccatggcgcacgcggccagaatgcaggtggaacagccatgaagggggaggccacggccctggcttccacccctcgcgcactgcttcacctgctgtacaacggcgcccgcgccgtggacgtcctggaggcctccctggacctggggctgctggacgccctggagccgggccccgtcaccctgggagagctggcgacgcggcaccggctggtgcccgtgcggctctacaagctgctcgactgtctggagagcctggggctggtgcggcgcgagcagcccaccgacgcgctggagtccgcgcgctaccaggccgtcccgggcctgcgcgccgctgcgcaggccgtgctgggcccgcagtccctggagaaggaccgggagcgctacgcctggcacgagttgcacgggcagcttccgcaggtgctgcgcggtgagcgctccatgccccccgccgccttcgactggcctccgcgcaccgccgagcaggtggcgggtttcgaggccagcatggccgcgggcctgccccccatcctggagacgttccgcgcccaccgcggccggctctgggagcgcggcggccgcgtgctcgatgtgggcgggggtgacggcacgctggccgcccatctggcgagcgaacacccgggccttcacgtggacgtgttcaacctgcccgccaccgagccactggtggcgcgcacccgcgagcgctttggactctcccccgagcgcctgggcttccagggcggagacttcctccgggaaccgctgcccggcggctacgacacgctctgcttcgtgcgggtgctgcatgactggcccgcggacacggcgcgcgcgctgctcgtggccgcgcgcgacgcgctcccacccggtggccgcgtcctcatctgcgaggagttccgcaccccggagcgcctggcggcccagttcttctggtcctacttcctcatgggcgtggacacctgcgtgagccgactgcgcgaggtggagcactacctgcgcgtcctggacgagacgggtttcaaggacgccgaagtcctgcccggccccttcgaactcatcctggcccaccggtaa

SEQ ID NO: 7266 - DNA, 789 bp, Myxococcus xanthus
atgaagaagcagggttcacgcaggtcggatgaaggctcggagaaggcggtccgcgggctggtgacacagccgcaaggcacgggaggctggacgccgcccgccgcggacggagaggtccgcatccccgtggaggaaggggtggagctgaggggtctgctccaagtccctccgggcgccaccggcgtggtggtgatggtccggggccacggcagcagccgccgcggcgccacggaccaggaagtcgcccggctgctccagcacgaggggctggccaccctggcggtggacctgctgacggcggcggaagaggaggcctgccgcgagcgggacctgcgcttcaacctgggcctcttcggcggacgcctggcgggcgtggcgcgctggctgcggcgcgcgcctcgcaccagcgccctgcgcatcggctacttcggggcgtacacgggcgcggccgcggccctggccgccgcggcgatgcggccggaggcggtggacgcggtggtgtgccggggcggacgcctggcgcagccgggggcggcgctggcccgggtgcgcgcgcccaccctgctcatcgtcggcgcggaggacacgtccgcgcaggagccccaccgccgcacctacgccgcgctgacgacggagaagcgcctggaggtcatccccggcgccacgcaccgcttcgaggagcccggcacgctgacgcagatggtggacctggcgtgcatctggttcctccagcacctgggcgcgccgcgctgggattccctgcccgcgccgcgcgccgccgggagctga

SEQ ID NO: 7267 - DNA, 408 bp, Myxococcus xanthus
atgccggagaccaagattcgcgtcctcatcgtggacgatgaccaggaccagctctccctcgtggagcgcaccctctccgccttcggcttcgacgtccgcacccaccgctcctccctgggcgtgtccaacctggtgcgcaccacccagccggacctggtgctgctggacgtgaacatccccgcgctcagcggagacaaggtgctcacgctcgcgcgcggtcaggcccccaagggcacgaagttcatcctctactccgcgtcggacgaatcccagttgcgcgccctggcgcgcgcctcgggcgcggacggctacatctgcaagagcgtgcagggcgaggagctggcccagcggctggaagcgctccacctcaagcccgcggcttcggaagccgtgcaggccgcgcgttag

SEQ ID NO: 7268 - DNA, 2091 bp, Myxococcus xanthus
ctgaaggccagtcgcatgggcgtgctcatgcagagcctggacgacggcgccgtggtgttcagccacaacgccgacgaactgctcaaccccgcctccaacgtgaagctggtgacgtccgccgccgcgctcgcgtcgctggggcccgagttccgctacgacaccgagttcctggtggagccggagctgggcgcggacggcaaggtgaagacgctctacgtgcgcggcaagggcgacccgtccatgacgacggagcgcctgtggggcatcgtcgcggaactgaagcacgccggcgtgcgtgacgtgggcgaaatcgtggtggacgactcgtggttcgacgccgagcgcacgccgcccggctatgaccaggaggacacggaccgcgcctacatggcgcccaccggcgcggtgagcctcaactggaacgcggtggccatctacctgcggcccggcaacgcgccgggcgccaagggcgtggtggagatggatccgcccagcgactacttcgtggtggagaaccagctcaccaccgggccgcggcgcgcgcgccgggtgtccgtcacgtcggacccctcgggcctccagcagaagattgtcgtgcgcggccagctcccgggggagcgcggcggcgccgtcagcgtctggaagaagatcgacaacccgcccatgtacttcggccagtcgctcaagcagatgctggtgacgcgcggcgtgaagatgaagggcaaggtgaagctgggcaagacgtccaccaaggcccgcatgctgcacgtgtcgcagtcggacacgttcgacgtgctcctcaagcgcctcaacaagctgtccagcaacttcgtcgccgagcagctcctcaagacgatgggcgccgagctgcgcggctcgccgggctccttcaccaagggcgtggacgtggtggagcagttcctggagcgcgacgtgggcatcccccgcggcacctacgtgatgaagaacggcagcgggctgaacgacgccaaccgcttctccgccacgcagctcaaccaactgctgcggcacatggtgcagcgcttccccttctcgccggagtacctgtcgtcggtgcccatcgcgggcaaggacggcacgctcaagtaccgcttcgagggcagtgacgcggtgggccggctgcgcgccaagacgggcaccctggagagcgtgtccgcgctgagcggctacgtgacgagcgcgggcggagagcgcttcaccttctccatcatggccaacgacttcgcgggccgcgccggtcccatcgtcgcgggcctggacgcgctgggcgcggcggtggccgccaccggctccagcctggggccgtccacggcggtggccgcgctggcggacagcgggcggccctcgggcgccgtggacgacgtggccgctcgcatcaagacgtacctggagctgggcgcgcagcgcgaccagcgcaacatcggcttcctgcgcaccgcgtggcgcagcgagagagacccggccgtgcgcgcggtgctggcggagagcctctaccagtccaacccgcacgactacctgggcgcgcgcacgctgctggacagctattcggccaccgccgaggtctacggccggctgaaggacgtggcgcgggtgctgtccgtggaggtgccgggcgtcagcagcatggtggagctggcggcgggcggaaacgccgaggcgctggcccgggtgctggagttggcgggcgcggcgggtacggacgcccaggcccaatcggagatggccgaggccctgagcgaggtggcccgcaccgcgccggaggagctggtggtggcgcttcgggccgccagcgccggtgaccgggacgcgtgcaccacgttgctggcgcgggggctggtgcaggcggggcaggcggaccaccccttctggaagtcgctgcgccgcacgctgggcgcttcggatccacggctggcgtccttcgccaagggactggactccacgctgtcgcagaaggtggcggaggccaaggccccggcgaagacgccggagggcttcacccccgtgcagatggtggcgcccgcgggcaacgcgcccgaatcctcctccgccgacaaccgcccgggggggtag

SEQ ID NO: 7269 - DNA, 663 bp, Myxococcus xanthus
atggaatcggaacgcatccgggtggccatcctggaggaccagcaggtcttccgggaggccctggtggctgtgctggaaggcgcgggcatggacgtggtggcggacttcggggagcccgcgccgttcttcgcgcgtgtgcgcgagacgctgccccatgtcgcgctggtggacctgcgcctggagctgccggggtgggaggcgtccaccagcgggatgtcggcgctccagtgtctgcatgacttcttcccggcggtgaagccgctggtgctgtcgggccaccgcgaggcggaggtggtggagcaatgcctccaggcgggcgcggccggctacctgtggaaacagaacgtgggctgcgcggaggtggtggaggcggtggagcgggtggtgcgtggcaagcggttgctgcccgcggggttggcgtggccccggccggaggcgtcgccgcggggcgagctgggccggctgacgcctcgtgagcgcgaggtgctgggctacatcgccgcgggcgcggacaacctgcggatcgccgcatgcctgggcatcaccgagcgcacggtgaaggcgcacatcaccgccatctacaagaaggtgggctcggagaaccgcacgcagttggcggtcctcgggtgccagttgggtgtgcagcgcccggcaagcctctga

SEQ ID NO: 7270 - DNA, 462 bp, Myxococcus xanthus
gacccgcacctggacaacttcatggcgatgccggacgggcggctgggcttgatggacttcggctccatcaagcgcttctccccgcgcttcgtggacgtcaaccagcgcatgctccggcagacgatgcgcatggagccgttggacatcctgagcctgagccgggaggtgggcttcaccgtggagcttccggacgacgaggccgaggacctcatcaccgaggtgctgcgcatcgccgggcggcccatgcgcctgccggactacgactacgcggtctgcgaaatcaaccgcgacatgcgccaccacttctcgcgcaacgcgccgcgcttcctgaaaatcaggccgccaccggaggcgatgatgttcttccgctccaccggtgggctggcgcagaacctgaggctcatcggcgcgcggggggacttccgcgcggtcttcctggaagtgacggacctgcccgcgtga

SEQ ID NO: 7271 - DNA, 1035 bp, Myxococcus xanthus
ctggcccgagcggcccgcaacatcgccctggcgcacgcgccgcagaagccgcaatgggtggaggtcgaaaccgagcccggtgtgctcgtgggccggcggccggatccgctgggccgcgtgggggtgtatgcaccgggaggccgcgcggtgtaccccagcagcgtactgatgggggtggtgcccgcgaaggtagcgggcgtgggcgaggtcatcgtgtgctcgccgccggggcccgatggattgccacaccccagcgtgctggcggcggcatctctggcgggcgcggaccgagtcttctcgctgggcggcgctggcgcggtggcggccatggcccatggcacggaaagcgtgccgcgcgtggaccgcatcgtggggccgggcaatgcctatgtggccgaggccaagctgcaggtggtgggcgcggtggcgattgaagcacccgcgggccccagtgaaatcctggtcgtggccgacgacacggcgaaccctgccgcggtggcgcgggagatgctggctcaggcggagcatgacccagaggcggcttgtgtcacgctggcgctgggggacgcgctggcggacgccatcgccgcggaggtggagcggcaggccgagcgcgcgaagcggtgggagatcgtcacgtcggccctgggctctcgcggcgcggtgctgacggtggcgtccctggaggaagcctggcccttcgtggcggactttgctccggagcatctgctcatcgccaccgcgtcgccgcgggaggacctggggcaggtgcgcaacgcgggcaccgtcttcctgggtgagcgctcgtcggtggcctacggcgattacatgaccggctccaaccacgtgttgcccacggcggggttggcgcgggcgtactcgggactcaacctgctcgacttctaccggtggaccacctaccagcgcgtcgcgcccacggcggcggcgtctcttgcggaggacgtggggcggctggccgacagtgaaggtctcttcgcgcacgcggacgccgcgcgcgcctgggggcggccatga

SEQ ID NO: 7272 - DNA, 171 bp, Myxococcus xanthus
atggtgccgctgccgggcgcgttggcggtcgcggagcggatgcgagagcgggacgtgaatgtgcgggcgttccaggcgctgacgggcgtgggcgacgcgctccgaatcggtgtggggccctggcccttgatggaggcggcgctggcggcgctgcgggaggcgctgcgatga

SEQ ID NO: 7273 - DNA, 594 bp, Myxococcus xanthus
  unsure (1)..(594): unsure at all n locations
atgagagtcaccttgttcgactacggcgcgggaaacctccactcgctggccaaggcgctggccacggtgccgggcgctgaggtgcgcgtccaggaggaccccttgcgtgcgctggacaccgacgtgctggtgctgccgggggtgggcgcattcggtgcggcggtggcgcggctcgagccggggcgcgaagccatgcgcgcggcactggagcagggcctgccgtgcctgggcatctgcctgggcatgcagttgctcttcgaaggcagtgacgaaggcgagggcgccggcctcggttacttcgcgggccgggtgaaacggctggcggcgaagcgagtgcccgagattggctggaaccaggttgaggacgaacgcacgctggcgggtgcgcggctggacaccgtgtactacgcgcacagcttcgtctgccgcgccgcggatgcttcggtggtgacggggtggacgacgcacgaggcggaccgcttcccgtcgncggtgcgcaggggaagggtggtgggtgtgcagttccacccggagaagtcctccacggcgggcgtgcgcttcgtgcaggccttcctgcgggaggtggcgccgtga

SEQ ID NO: 7274 - DNA, 114 bp, Myxococcus xanthus
atggaggacctgcgggccctcgcggcggcgggcgcatacggggccgtcattggcatggcgctgtacaccggaaggctggatgcgagcgcagtcgctcgggagttcgcgggatga

SEQ ID NO: 7275 - DNA, 537 bp, Myxococcus xanthus
atgaccactgtcattcgggagacgaaggagacgcaggtccgggtggagctggcgccgggcaagggcgtcacgaacgtggacacggggttgaagttcttcgaccacatgctggccaccttcgcgcgctacgcggggctggacctctcgctgcatgcgcggggggacctcacgcaccatgtgatggaggacgtggccatcacgctgggcacggcggtgcagcaggtgattccagccacggccgcgcgtttcgccgagcgcaccattcccatggacgacgcgctggtgcaggcctgtctggatgcaggggggcgcttttattaccagggcccgttgaagaaccggctctacgagcactggatgcgctcgttcagcgagcacgcccgggtgacgttgcacctgcgggtgctgcgcggaaaggacagccaccacgcgacagaggcgtccttcaaggcgctggggctggcgctgcgggatgccatggtggactccggctcggtgttcagcatgaagggctccgtgtccctggaggtgaagtga

SEQ ID NO: 7276 - DNA, 385 bp, Myxococcus xanthus
atgctcacgcggcggctcgtcgtctgtctggacgtgaagggcggacgcgtggtgaagggcgtccagttcgagggacttcgcgacgtgggtgacccggtggaattggcccggcgctacgaagcggagggggcggatgagctgacgttcctcgacatctccgccagcgccgaggagcgggacaccttgtgggagctggtgcggcgcaccgccgagcagctcttcattcccctggctgtcggcggcggggtgcgcacggtcgatgacgtgggccgggcgctgcgtgcgggcgcggacaaggtgagcatcaactccgcggcggtggccaacccggcgctgctcaccgcgtgcgcggagcgcttcggtgcgcagtgcgtggtggccagcc

SEQ ID NO: 7277 - DNA, 840 bp, Myxococcus xanthus
ctaaagtctggggccgactgccggggcgggcccttcggacgtgaacggacaggacgacgcgtgcaagaacttctcaccaacctcatcggcaactctcagggcgtcttcgcctatgccacggtgttcggcatcctggtggcctgcggactgggtgtccctctgccggaagacatctccctcatcgtcgggggcttcctggcccacaagggggccgccaacctatcggtcatgatggtggtcggcttcgcgggcatcatcgttggcgacagcctcatctacctcgccggccgccggctgggtgggcggctggggcgtgaaggcggcggtggcttcttcgcccgcatcgtcacacccgagaaacgcgcgaaggtggaaggcctcttcgtcaagcacggccagaagatcgtctgcatcgcccgcttcatgccgggcgtgcgcgccgtgacgtacttcaccgcgggctccgtgggcatgtcctactggcgcttcatcttctgggacggcctggccgcgctgctgtccgcgcccgtgttcatctggctcggcttccacttcggtggcgagctggacacgatgatctccaagttcaaggaagggcagttcgccgtgatgggcgtgctggccgtggccgccatcggctacttcgtgtggcgccgccggcaggccgcgcagcgcgcccaggccgccgccatcgtggagcccgtggcggttcccgcgctggtccacgagtccgtggccgcgccgctgcgtccccaggtgtccagcacgggcgacgccctgttcgtcgcggcgccggagcaggccgccgccgacagctcacacgagctgcagaagtcgtag

SEQ ID NO: 7278 - DNA, 669 bp, Myxococcus xanthus
atgcccaaaatccttcttcgtgcctgtgccgtggtcctgctcgcagccaccagcaccgcgcaggcgcaagccgtcccaccggccccctccgaggccgaggactcctccacgcccgccaaccccgtgccggtggacgccccacctgatgcgcaagcggcgccacccgaagccgaaccgggcgaggtgccggccagcgctgtcactgaagacgttccagcggtgagccccgaggtgccgcccgttccgccgaatggtggcgccttcgcgaaggacaacgcgctcgtccccgagggaacgccgttcctgccgctgcacatcgaagaccccgcacgggcccgtgccctggccgaggagacggagcgcagcgcgccggccctggtcgtcagcggcggcatcagcctgggcgcgtatcaggcggggttcctctccacgctggtccggttctggagcgtcgcgcagcgagaaggcgcacaggcagacctgggcaacccggcgccgcgagtgtggacgggcgcctcggcgggggcggtgaacgcgctgctcgggggactggcctcgtgtgacacggcgttcgcccagcccacgtggtcttcagagcagagcctcttctggaccgtgtggatcgaccagctcgacctggggcggttgctcccgctaagagcggaatga

SEQ ID NO: 7279 - DNA, 498 bp, Myxococcus xanthus
atggctggaggcgtgaacaaggtcatcctcatcggcaacctcggggcggacccggaggtccggttcactcccggcggtcaggcggtggcgaacttccgcatcgccaccagcgagagctgggtcgacaagaatggccagaagcaggagcggaccgagtggcaccgcatcgtcgtctggggaaagctcgcggagctctgcggcgagtacctgaagaagggacggcagtgctacgtcgagggccgcctgcagacgcgcgagtggacggacaaggagaaccggaagaactacaccaccgaggtggtggccaacgccgtgacgttcctcggcggtggtggccgtgacgccggagacggcatgggcggcgggggcgggggcggtggacgccggcagttctcccagcagcgtgggggagacaacaacgactacggtcagccgcctccggacgacatgggcggtggccatggcggcggcaacggcgacgacgacatccccttctag

SEQ ID NO: 7280 - DNA, 1857 bp, Myxococcus xanthus
atgcaggacaccctgcagctcatcctgaaaaaggcccacacgacccacttcaaggaggactggaccttcgcctacggcatcaccgtgacgaacctgcgcgggcgcgaagttcccttcggcgagggcggacccgacgcccagttcaagctgaagcgcgtgacggagaagctggtcgtccaagtgatgacgcagggcgaagggaagctcaccgcccggctgccattcatggagggcgcggcgagcgcgtcgttcccccacatcggggtgaagccgaaggagctcgcatactacccggcgctgggcgcccaaccaacgggcgacggcggacacgaggtgtccctgtcgaacctgctgctcacgccgcaggcctccggggcctttccgctcgcgttcccgcctgtccccgtcgaggtctccttcttcaaccagacgcaatgggggcccctggagtccctcaagctcattgacggcggcgtgctcaacaacaaccccgtggacctggcggtgcggctcggctcgcggtgggtggagcgcagcacctcgcgagagacgacgctcaatcgcgagcgcttccccgtcgtctacctggaccaggacgcggtcgcctgggactgggcatcaccgcccgaacggccggatcgctcccgcagccccttggacgaagcctacttccagcacctgggcaacgtgctgaacgccgcgcgcgacagcgccgtgctcaacacgctggagcacgacatcaatctgtcgggccgcatccagattcctcgccgcacgtccgtgctcccgtcggagttccagttcgcgatgatgggcttcttcgaccggcgcttccgcgagcacgacttctaccgtggcatgcaggacgccatccgcttcctgtcgacccagctcacctcgacgcgcgccgtcgacctgctggtgcctcgcgccggcaaggagcgcctgagggatcgtgagctccgcgtgctgaacgtcctgggcatcgactcggccggcttccgctgcgtcgtgggcaatgactgcacgacgacgccgcagttggggcggctgcgtcaggccaccaatgccctgacgcagaaggcggaagcgggacagctccggaagggacaggtcgacgaccttctcaccgtgctgggcgacgtgggctaccagtacagcgaaggcgtcatggaggggattgaagccacggggacccgagaggacctcatcccggtccgccaacgcgtgggcaccgccttccacagcctcgtcacgcagcagcggggcaacctcaagattccgctccgtcccgcgggcgccgcgctcctggacgagtggctgacgtattcgaaaccgcaccatgtctggacgctcagcgccatgcgccagcgcggtgtgggtgtgggcgtggagcttccgttcctggcgtccgagcagggacgcgaggactacgcctacagccgcaatgagtggcgcttcggcgccgtgctgtccgggctgggtgtgcgggacatggaccagctcgtgcccaacgacacccgcatccgttgggcctcgctgggcctctacatcgactgtgtctccgacatggacggcttctccggcgcgattccgttcctcgacctggggccgtacgtccggtggcgcgccggactgggcgtttccgcgggctacctcagcaagcccaatgaatgggcgctgacggtcccggaggcccgcctgggcgtggacctggcggagatggtgggcgtgcgcctcacgatgccggtctacctcctcaagaagacggagggagagcggcggctcatccgagggacgcccaagtacttcaaggagctaggcctgggcgtcgagttcctcctcacgcggtggtga

SEQ ID NO: 7281 - DNA, 123 bp, Myxococcus xanthus
ctcgtgggaaccggactggagcagcacgccgtgtccggcgaccactacagcgtgctgcgcgccccgggggtccgcgagctggcggaccggctccggagcgcgctgaaggtcaccaccgcgtga

SEQ ID NO: 7282 - DNA, 387 bp, Myxococcus xanthus
atggctccaccgaacccaaagcggccccctcggccgccccgcccgcccggtacgcaggcgccccaggattcagacgtggagctgcccttcgatgacgacgaggtggatccgctccaggctgacgacccacgtccccagcgggtcccccagtttcccgccggctcccgccgcagccggcgccagggccctggagggcgcgccaacagcgaccgcgagctcgcctcccgcttcgacaccgcgaatgagtactcggaccccgggtacgcgcctgccttcctgtacgtcgagcgaggccccggcgccgggcagttggtgcccgtcaaacaaggggcgctggtcatcgggcggtcctcctcgtccgacctccacctgcagcacgcgtccatc

SEQ ID NO: 7283 - DNA, 1242 bp, Myxococcus xanthus
ttccagctcgtcagcgaacacagtcccggaggcgaccagccgagggccattggcgaactcacgcagggccttctgcggggtgaccgctaccaaaccctcctgggcgtcaccgggtcaggcaagacgttcacgatggcgaacatcatcgccaacgtgcagcggcccacgctggtgatggcccataacaagacgctggccgcgcagctctacggcgaattcaaggcgctctttccgcacaacgccgtcgagtacttcgtctcgtactacgactactaccagcccgaggcctacgttccgtcgacggacaccttcatcgagaaggactcgtccatcaacgacaacatcgaacggatgcgccactcggccacccattcgctgcgcacgcgggacgacgtcatcatcgtcgccagcgtgtcctgcatctacggcctgggcgcggcccgcagctacgtggagttggcggtgcgcgcggcggtgggcgaggagatggggcgcgacaccttcatgcgcaagctggtggaggcccagtacaagcgcaacgacctggacttccaccgcggcaccttccgcgcgcgcggagacaccgtcgaggtgtttcccgcgtacgaggaggagcgggccgtgcgcgtcagcttctttggcgacgaggtggagcgcgtcaccgagttcgacccgctgcgcggcgtgacgttgggcgcgctggagaaaatcgtcatcttccccgccagccactacgtggccgaggaggacgtgcgtcggcgcgcgatccagaccattcgcgacgagctgtccgaacaactgcagacattcaagcgcgagggcaagctgctcgaggctcagcggctggagcagcgcgccatgttcgacctggagatgattgagcaggtcggctactgcagtggcatcgagaactactcccggcacttctccggccgcgcggcgggagagccgccgccgtgcctcatcgactacttcccacgcaacctgctggtgatgctcgatgagagccaccagacggtgccgcagattggcgccatgtaccgcggcgaccgcgcgcgcaaggagacgctggtgggcttcggcttccgcctgcccagcgcgctggacaaccgcccgctcaagctcggtgagttcgaggagctggtgccccaggccatcttcgtctccgcgacgccgtcggagtgctagctgcagaagtcgcagggtgtggtggtgcaccagctctcccgctccacgggccta

SEQ ID NO: 7284 - DNA, 1680 bp, Myxococcus xanthus
atgatgcgctcgctgcccctgcttctcgccctctgctccgctccggcgctcgcgcagcgcgtgcagttgacgacgcccgcggagaagtccgcgtccggtgtcatcgctccggaggtgctgcgtgcgcacgtgcgcttcctcgcgaatgacctgctggagggccgtggtcccggcacacgaggggacgcgctcgcgcaggcgtacatcgcttcgcagttcgaggcgctcgggttgcagccgttgggcacggacggctcgtacctgcagccttttgacctggtgggcgtcaccagcagccccaaggaattgtcgttccaggcgccccagggcgcggtgcacctggacttccacacggacttcatcgccgtgtccggcgtgcagtcccccgagtcgaagctggcggcgtccgagctcgtcttcgtgggctacggcatccaggcccccgagtacaagtgggacgatttcaaggggatggacctgcgcggcaagacgctgctcatcctcaacagcgacccggaggatgacccgcagctcttcgcggggaagacgcggctctggtacggccgctgggattacaagtacgagcaggccgcgaagatgggcgcggcgggcgccatcatcatccacaccacgccgagcgcgggctacccgtggcaggtggtgcagacgtcgtggacgggtgagcagttcgagttgcccgcggcggaggggccccgcctccaggtgaaggcctggacgaccgagcaggccacgcgccgggtgttgcaactggcgggcaaggacctgggcgcgctgtgggccgccgcgcagaagcgcgacttccagcccgtgccactcggggtgacggtgtcgtcgcgcctcaccaacacggtgcgccgcagtcccaccgccaacgtgttggcgctgctgcccggaagtgacccgaagctgtcccaagaggtggtgctctacaccgcgcaccatgaccacctgggccgcaaggaaggcggcaagccgggcgaggacaccatctacaacggcgcgctcgacaacgcgtccggtgtgtcggcgatgctcaacatcgccaaggcgttcaaggcccttcccaaggcgccgcgccgctccatcctcttcgccgccgtggccgccgaggagcaggggctgctgggctcgcagtacctggccgagcacccgcccgtgccccacggccgggtcgccgccaacatcaacatcgacggcgccaacatccatggccgcacccgcgacctcaccgtcattggcctgggcaaatccaacctggacgccacactggtcgccctggcgaagacgcagggccgggtggtgaaggcggaccagctgtcggaccgcggcttcttctaccggtcggaccagttcaacttcgccaagcggggcattcccgccgcgtacttcggcagtgggatggacttcatcggcaagccggagggctggggcaagcagcagcgggaagtctgggagtcgaagcactaccaccagccgtcggacgagctgcgtccggattgggacttttccggcgcggtggaggacatccgcctgttcttcctgctgggggcccacgttgcccggcaaccggagctgccgcgctggaacaagggggatgagttcgaggctgcccggctgcaatccctggaagcgctgaagcgacaggacacttcgaagtag

SEQ ID NO: 7285 - DNA, 1530 bp, Myxococcus xanthus
acccaagactctagagtgcgggacacacccacgcctatggacccgagaggattgccgcacgtgaccccgcccgccattcggctcttcaacacgatgaccatgcagaaggagctgctgcagcccgccattcctggcgaggtgggggtctacgtctgtggtcctaccgtctacagctacatccatatcgggaatgcccgcaccttcacctccttcgacgtggtggtccgctacctccgtcaccggggcctgaaggtccggtacgtccgcaacttcacggacgtggacgacaagatcatcaaggcggccgcggagacgggggaggcccccgtggagctggcggcgcgctacgtggagattttccgggaggacacccgggcgctccacctgctggagccggacttctcgccgcgggtgagcgaccacctccccgaaatcatcgccatcatccagaagctcgtggacaagggccacgcgtacgcctcccagggcgacgtgtacttctccgtgagcagcgacgaggactacgcgaagctgtccaagcgcaacctggacgagctgtgcgtgggcgagcgcgtgcagccgggtgagcagaagcgcgagccgctcgacttcgccctgtggaaggcggccaagccgggagagcccgcatgggagagcccctggggccccggccgtccgggctggcacatcgagtgctccgccatgagcgcgaagtacctgggtgagacgttcgacatccacggcggcgcgctggacctcatcttcccccaccacgagaacgaaatcgctcagagcgagtccgccaacggggtgacgttcgcccggtattggatgcactgcggcttcctggacctggaaggcgcgaagatgtccaagtcgctgggcaacgtggtgcgcctgcgcgacgcgctgaccaaggtggacccggaagcgctgcgcttcttcttcctcgccacgcactaccgtcacccgctgtcgttctccgacaaggcgctggcggatgcggagacgcgcatggagtacttctacgagacgctccgcaaggtggacgagcgaatctcggggaaggacttcggcaaggggcccctgcatggcgacccgcagcgcttcttcaccgagttcgagtccgccatggacgacgacttcaataccgcgggcggtctgggctcgctgtcggggctcttcgggatgatgaacgagctgaccgacaagccgcccgtgaaggacaaggccctggtgggccgcacactgcacgcgctgcgtgaggatgtgcgcagggtgtccagcgtcctgggcctcttcgaggacgcgcccgatgcgtggctgctgcgccgccgcgagcgcgctgtgcgcgagcggggcatcgacgtggcggaggtggagcgcctgctgggcgagcgcaccgctgcccgcgcggcgaaagacttcgccgccgcagaccgggtgcgaagcgagctgaaggagaagggcgtggaaatcatggacacgcccgctggcacgacgtggaaggtggcgccgctccagggctga

SEQ ID NO: 7286 - DNA, 900 bp, Myxococcus xanthus
atgacggagggggtgcccgaggcgggagaactggcggagcgactgcaccggctggcactcgaggccacggacattcgcgactacgagttggtcccgcgcgacttcctggacgcggagtcgcctgcgtccaccgtgaagcagatgctgacgtcgcactcgagtcacgtgggccacctgggcctgcggcagcgccctgtgtatgaggagcgcccactgcacgtctcgaacgaagaacagctccgccgcgcacagccccgggtgttggcccttcgcgacgagaccgcctgggtcgaacatcagctcacgcacctggcgagggggacggacgtcgtgacggtgttggtggaggggctcggcgacgcgacgccatccgcggtgtggaccgtggcccactccctccccagcgcgctcggggagtcggcgatgtacctggaagccgtccatgccgacgggcgcaccgagtggctccggtccggagacgagcggtccgaggacctggtgcttcggcgtgtcgccgtgcggatgtcggccatcggcctgcgcgaggtgctggcgccccttcgaggctatgcgctggtggacctcgtctatggcgatgggccacgccaggtcctggtccggctggagcacctgtccgaagacgtcgggagtctggaagacgtgccgcgcgtgatggccgcatgggatgaggcagtcgtccgcgaacgcgatgcccggaggagcggcgccgcgtcagtgggcgcggccagccacgtcatcctgcgtggccgcgaaggtgtcacgactgggcggccccacgactcgaccgaactcacgcacgtcgcgagcggacgccgcccccgggaggcgctcgcatgggccgcgagggtgctccgggaacccagccagggacacgactga

SEQ ID NO: 7287 - DNA, 2295 bp, Myxococcus xanthus
atggaaaagaacgtccacctcttcgtgcgcacctatcccgggctgggcgtggcggcgcacgtcctcacccacccgcacctggcggccttcgcgccgacgctgcacgccgcgaggctcgacatcgctgcggtggtggggcggctcctcaagcgaggagagctctgggacgaggagacccactggagcgatttgcgccagcggaagacgacgctgacggtgcgcgcgctcgaacacgggaagatgctgtccgtccccctgcgcctcaccgtgctcacgcacggggtgaaggcccgcaccgcacgcaagggagcaccagcgcgccagtccctacgcgtgtgggtgccccgcgtggacgtcaagggcacgctgcacgatgcggcggacctggagcccttcgtcgaggagatggtccgccacgagctctatctcgcgtcgctcgaccggctgcactctctggcctacgtgggcgaggagcaggtagagacgctgtcggtgccggtccgcttccgggacacgccgcgtgcccgtgcgctcgatgccgcgaagccgcagcggcgccaggcgccaccaccggggctcgcggaagccagccggtgtctcaatgaggaagcacgcgcgggtttgctggagcgcgcctgggaacgggacctggaggtgtcccggctcgcggaggccgtcacctcgcgcacccgtgccagcgtgctcctggtaggcccgtcgtccgtgggcaagacggccctggttcatgaactcgtgcaacgcgcggaggcggccaccacgggttcgccgcttcacgggttggaggtcttcagctcctccggaggccgcatcatggcgggcatgcgctacctggggcagtggcaggagcgcgtgaagcacatggtggaggccctgcgtgttcgccaggccgtgctgcacctcgacagcctgtcggagctgctgtccctgggtagcggcgacacggggctggatgtggcgcgtcagttgctccccgcattggaaagtggcgaggtctcactcgtcctggaggcaacaccggaggacgtggcccgcgcggagcggacccacgcagcgttcctgcaatcgctccggcacatcgccgtggcgcccctttcggcccaggccgcacgcaacgcgcttcagcaggcctcgcatcgggtgggccgcgctcgcaaggtgcgcttcacgcccgacgcgctggaccgcgctggcgaactcacggagcgcttcggctcgggcccttcgcccggaggcgcggtgtccctgctgcgcgccgccagcacggagcccggcgcggccggagaagtgaacgccgcttcggtgacgcgcgccttctgcactcggacggggtacccgctcgaactggtggactccgccatccggttggacccggatgccctgctccgccgcttccgcgagcgcgtggtgggccaggacgaggccaccctcctcctgcgcaatctggtcgtcacgctgaaaacaggcctggcggacccctcgcgtccgctgggcgccttcctgctgctgggtcccaccggcgtgggcaagacggagtcggcgctcgcgctggcggagtacctgtttggcgacgtggcccggctggcgcgcttcgacatggcggagtacgccgcgccaggcagcgccacccggctggtgggagaagcgggaggccaacaaggcagcctggcgcggcgcgtccgcgagcagcccttcggcgtggtgctgctggacgaaatcgagaaagcggacgcgggcgtccatgacctgctgttgcaggtgctcggcgaaggccggctcacggatgccaccggccgcaccgtcagcttccgcaacaccgtggtgctgctcaccagcaacctgggcgcggacagcgcggggcgctcgctgggtttcggggagcgcggccccctggagcgggcggcgcactacctgggggccgcggcggccttcttccggccggagttgctgaaccggttggaccgggtggtgccctaccgcgcgctcacggaggacgtcattcaatcactcgcccggcgcacgttggaggcggccctctctcgcgaggggctcagtcgccggggcgtgaaggtgaccttcgacgaggacgtggtgaagcacctggcgcgcaccggcttcgacgcacgctatggggccaggcctctcaagcgcgccgtggagcaacaggtggtcgcgcccctggcgcggtggttggcggctcaggccaccagcgctccgccccaggtggtgctccgcgtggaagctgaggggcggattgcgttgagcggcctcgaatga

SEQ ID NO: 7288 - DNA, 582 bp, Myxococcus xanthus
atgtcgttcacgttgcctgatctgccttacaagaaggacgccctcgcgccgcacatgagcgcggagacgctcgagttccaccacgacaagcaccacgccgcctacgtcaacaacctgaacaagctcctggacggcaagccggaggcgaacaagtcgctggaggaggtcatcctcagcagcgacggtggcgtgttcaacaacgccgcgcaggtgtggaaccacaccttcttctggcagtgcatgaagcccgctggcggcggcaagccgacgggtgagctcgcggcggccatcgaccgtgacttcggctccttcgagaagttcaaggaggagttctccacggccgcggccacgcagttcggctcgggctgggcctggctggtgctggagggcggcaagctcaaggtcaccaagacgggcaacgcggacctgccgatgaagcacggccagaaggccctgctgaccatcgacgtgtgggagcacgcgtattacatcgacttccggaacgcgcgtccgaagttcatcgagacgttcctgacgcacctggtgaactgggacttcgtggcccagaacttcaagggctag

SEQ ID NO: 7289 - DNA, 960 bp, Myxococcus xanthus
atgggtgagtacatctactacttcggctgggctgatgccgccgcccgcctcgaagtcgagtactacccgaagctcgtggtgagcgggccgctgtcccccgccaccgtcccccgcttcctcatcgccccgggcgaggacgtccccgcgctgcgccgggccctgcttgccgccgccgccgggagcgcccaggaggcgggctgctcctccgttcacgtcctgtatcccacgggggacgaggcggacttcctggaggccgaggggctcgcccggcgcatcacccttcagttccactggaagaacccgggctacggcagctacgacgactacctggcgcgctttgactccaagcgccgcaaccagctcaagcgcgagcgcggggccgcggccacccagggcatctccctgcgtacggtgcgcggcgaggggctctcccaggcgcacgcccggcgtgcctacggcttctacacctccacctgcgagcgtcacgcctgggggcagattcagctcacccccgacttcttcgcgcgggtctttcgcacgatgccgggctcggtggagttggtggaggcggtgcgcggccagcaggtcatcgccggcgccttcaacctggccaccccggagcgcctctatggccgctactggggcgccttcgaggagcaccccttcctccacttccacgtctgcctgtaccactccgtggaggactgcatccggaccggccgcaaggtgttcgagcccggcgctgggggtgaacacaaggtgtctcggggcttcgagcccaccgccgtacacagcgcccacctcatcttcgacaagacactggacggcgcggtacggggcttcctccgccgggagcacgcacggctggcgcccgccgtggaggaggccgagcgcatctgcgggctgaaaccctggcccctggccgcctccccgggcacccaaggggccaccggcacctga

SEQ ID NO: 7290 - DNA, 879 bp, Myxococcus xanthus
gacgagcttctcagtggaatgttgaagaacacggacctgcgcgtggtgctcgccaccacgacggagctgtcgcgccaggcgcgtggcacccatggcaccgcgcccgccgccgccgtgctcctgtcgcaggccctcaccgccgccgccctgatgggggccctgcagaagggcgacgcccgcatcaacatccaggtggagtgtgacggccccctgcgcggcctcttcgtggatggggacacgtccgggctcgtccgcgggtacgtgaagaacacctacgtggagtactccgggagcgacgggcagtaccattggcgccccgtgctggggaacaagggcttcctgtccgtgctgcgggatttgggcggcggcgagtactaccgctccgcggtggagctggaggccttcgacctggcggccgacctggagcgctacttccgtcagtcggatcagctcccgtcacatgtgctgctggcgcagctgccggaaggcggggccgcggagccgctgggccgcgtcgccggcctgctcgtccagccgcttcccagcgcggacatggaggccttcgcggcgctgggggagcggctgcgccgtgacttcgtgccctcgctccaggcgcacggcgaggcgggggcagcggccgtgctgcgcgcgctgctgccggagtctgacttcgaggtcatgtcgcgttacccgctgcgcttcggttgttcgtgcagcaaggaccgtgtgctgcgcgcgctcctggccatgggacgtgaggaattgacggaccttctggagaaggaagggcaggcggaggcgacgtgccagttctgcacgacgcgctatgtcattcctggagacgaaatccgcggcatgttggagcgcggcgccatttga

SEQ ID NO: 7291 - DNA, 687 bp, Myxococcus xanthus
atgaaagccccggagacggacgaagacttcatccagtggtacgaggactgctgggcggaccgcgacgaagtcgagtatccgaagatgttcggcgccattgacgaaggcgtcttcacgctcgaccagacagatgccatccaagcgtggatggagagtgagctggcccaggtccaggaagcggaccccaactggggtcccatgggcgtgcgcgtctccccgcccagcgagagctacccctactggacctatgtcaccagcggactgtccaaccccttcaccgtggcgcccggcgaggacatccccgacggcgcgcccagcgggctgggctacgagatggtcatccactcgcccgaagaggcgaagtggccggtgttccggctgctggacatgatggcctacaacctcgtgtccctgcgcgccttcgccatgggccaccgctacccggtggaaggctccctggacggtggcgagtccaagctgagcggcttcgtgttcgtccgggacccgtcccggcccgaccacttcgtgctccccagcggcaaggtgcaactgctcaccctggtgggcgccacccgcaacgagatggccttcgcccgctccaacggcatggacaagctgatggccaagctggtggcagcaggctccggctacatcacccagcccgaccgggaagaagtgaagttgtag

SEQ ID NO: 7292 - DNA, 887 bp, Myxococcus xanthus
atgacgcccaccctcatcaccgccgtccacttcgagccgctgcacctcccgctcaccgagcccttcgccatcgccaccggcgcgcagtacgccgcggagaacgtcctggtgcgactcaccctggcggacggctccgagggcctgggcgaggccgcccccttccccgccgtcagtggagaaacacaggccagtacgctggccgccctggaacaggtgcgcgcggggctggtgggacgagacgctcgcgcgtggcggcccgcctccgaggcgctgggggattcactcgcgctggcgccctccgcccggtgcgccgtggagacggcgctgctcgatgcgctggctcggcactacggcgttccgttgtacgtgatgctgggcggcgcgcagtccgcgctggacatcgacatgacggtcaccgcgggagacgtggcccatgcgcgaaaatccgcgcaggcaatcctggcgcggggcatcaccacgctgaaggtgaaggtcggggcgctgccgcccgtcgaggacgcggcacgactggtggccattcatgaagtcgcgccccaggcccggctcttcgcggatgccaacggtggctatgacgtggccgaggcgctcgccttcttgaaagaactggcgcgcgcggacgtccccctggccctcttcgaacaacccgtgcccgcgcatgatgtggccggtatggcggagctcacgcgccgctcgcgcgtgccggtgtgcgcggatgagtcggcgcgctcggcgaaggacgtgctgcgactcatccgggaaggcgccgcgcacgccatcaacatcaagacgatgaagtgcggcgtcgtcgaggcactgacgatgtggagcctcgctcgcgcagcgggcctggagctcatggtgggcgg

SEQ ID NO: 7293 - DNA, 1965 bp, Myxococcus xanthus
atggatgtgctgctggtggcgctcgaggaagcggagcggcaccagcctgagggctgcatggtgttgcacgccgtgcgggacgcggcgggagcgctcgtcgacttccagtgggcctgggcgaatcccgcgggtgcgcgcgcactggggcacgccgctccggagttgctgagaggccggcggctgcgcgagctgatgccgggctcgggtctggcctcccgggtggacctgctccggaacgtggtggaggcgggccggccggctgcggacagcttccaggaaggggacgtgtggcttcagggaacggcggtgccgctccgggacggtgtcctgctgcgcctgcgtgacatcaccagcgccctgcggttggaggagagcgtccgcgaaaccctggactgggtgcggagcatgctggaggccacacccgacgcgttcttcacgttggatgcggactggcgaatcaccttcgtgaaccacgaggccgcggccctcagcgggcgttcgcaggagcagctcttccggcagattctgtggcaggcgtgcccggagttgctgggcacgcggatggagcgggagctgcgccgggtcgcgagcggcgcgggccacaccatcttcgaatggcgcgccacgcctggacgctggcatgaggtgcacgcctggggcgccaacggcaacgtgtccattttcgggcgggacgtcaccgccaggaagcaggcggaggcggagcgggacgtgcttctgtcgcgcgagcactcgggccgcctggaagccgaggccctggtccacgagcgcacccgcgaactcatggccgcgcgtgagcgactggtgcagtcggagaagctggccatggcgggacagctcgcggcgggcgtggggcacgaaatcaacaacccgctctcctacgtcgtggggaacctgcagttcgcgctggagcagctcgagcccctcgcaacgcagggcgcggtgcgtgaatcattggcccgcgcgctgggcgaggcgatggaggccctgcgcgaggcgaaggaaggcgccgagcgcatccgcaccaccgtccgtgatttgcagatcttcgctcgagcggaggagccgcaactgtcgcccgtggacgtgcacgcggcgctggagttcggcctctccatggcgatgccgcacctgcgccaccgggcccgcgtcgagaagcgcctgggcccggtgcccacggtgatggcgcacgagacgcggctggggcaggtgttcctccaactgctcgtcaacgccgcgcaggccatcccggaaggggacgtggcgcgctaccaggtgacgctctccacctggagggacggcgcgacggtggtggtggaggtggcggacaacggccacggcatggcgcccgaggtcctggagcgcgccttcgagcccttcttcaccacccgtcccctgggggagggcgctggactcggcctgtccaccagcctgggcctggtgcgaggcatgggaggcgagctgtcggcatcgagcgcgccgggcctgggcagtgtcttccaggtgcggctgcccaccaccgacgcggacgcgccagccgtgcgggtggcggaggacacggaccttcccggacggaagcgggtgctggtggtggatgacgagccgctgctcgcctcggtgctgggccgcatcctcggcgtgcgtcacgaggtggtggtggtccacagcgggcgcgaggcgttggacacgctggcgcgcgacgcggacttcgaccgcatcttctgtgacttgatgatgggggacctgacggggatggacgtgtacgacgcgctgtcctcgcgtcagccggagctgctcgcgcgcttcgtcttcatgacgggcggaggcttctccgagcgagcacggaccttcctccagtcggtgccggtgccgcgcatcgaaaagccgttcgagctgggcgtcctgcacgcgctggtggaggacgccccgccgcgcgccggtccctga

SEQ ID NO: 7294 - DNA, 453 bp, Myxococcus xanthus
atggagccccgcgtgtcctacccgcccagactcgcccatctcgccacccgcgccgtggtggtggcgaagctcgtccccacctacgcgcaggcccaccacatcgacgaggaagaagcagcgcagcggctgtccagcgcgctctccggacggatgctgcccacgttgctggatgtcacgtggaccgccatgcgcggcaaggcgaagcggctcaccgacgacgggctggtggagaaggtggccgccaccttgagtgagcggcccctgcggccgggacgcatcgcccccgtgggtccggcgctcagcgccttcttcatcctggtggacctggaggtgggcaccgcgggtgacgccgcgcggcgggtcatggaatcggacgagggacgccgccggggggaggaaggactggcggaagccggacgcttcctcgccgcggagctgactcgcgggaagtag

SEQ ID NO: 7295 - DNA, 231 bp, Myxococcus xanthus
atgtcgacaccgctccccaccacgctgcgaatcctgcgctccctcaccgacatcccccgcgccacgtgggatgcgctggtggacgcccaggccacgccgttcctggagtggaccttcctcaccgcgatggaggagagcggctgcgcggtgccggcgcggggctggcacccccggcacctgacgctctggcgcggctcgcgcctggtggccgccgcgcccgcctatcgcaag

SEQ ID NO: 7296 - DNA, 546 bp, Myxococcus xanthus
acaggccaggacgtgttcctcgaagccgcggcgacgctgacgcgcctgtaccccgccctgcccgtgcgtttctacctggtgggcgcgccgctgtatcagacgcccggttcgcagttctccgaggatgaactgcgccggctcatcgcctcacgcggcctggcggagcgcgtgggcctggtgcccttccagccccacccggcctgcgtgtaccgggccctggacgtcttcgttcacgccagcacccgccgggagcccttgggcctcaccatcgcggaggcgctcgcctgcgggcggcccgccatcgtctccaacgcgagcggtgcggcggaggcactcacgaatggcacggacgcgctgctgatacctccgggcaatgtgcacgcgttggtccaggcgctgcgaacgctgttggaggatgcagccctgcgagcccggctgggcacggccgcgcgactcaccgcggaggcgagcttctcgcgcgaacgctacgcgagcgaggtgctcaccctttaccgcacgctggtgcggagcagtccccccatttga

SEQ ID NO: 7297 - DNA, 1074 bp, Myxococcus xanthus
atgcgcgtgggcgcgggcgcatgggatgtcaccacggtggcaccccgcttcttccacggcgacctgagcccgctcgccctgcaactcgaagcggacgagcccgccaggacggaaggcgtgcgcgccttcttcagtcgctcgctccacaccttcctttacggtccggaggtgcatgctcacctcgctcgcggcgcggacctggtgcacgtgtgggaagagccctatgtgctggccggcctggagctggcattgctcacaccgcgtcacgtcccgctcgtcttcagcaccgcgcagaacctgtccaagcgttacccgccgcccttcgcccaggcggagcgcttcgtcgtccagcgcgcttccggctgggtggcctggggtgaaaccgtgagggacaacctcctcacccgtcccggctatgcggagcgtcccgcgcgcgccattcccatgggcgtggacgcggacctgttccaaccggatcgcgccgcgggcgagtccttgcggcgcgagctcgggtgggagacatcaggcccacccgtggtggggtttctcggccgcttcgtcccggagaagggcgtgcccctgctgatggatgcgctcgacgcgctcgacactccgtggcgcgcgctcttcgtgggcggaggcccgatggaaggtgcgttgcgtgactgggcggcccggcacacccactcggtgcgagtcctcaccggcgtgccccacgcaggcgtgccacgtgcgctcaacgccatggacatgctgtgcgcccccagtcagacgacgcgccaatggcgggagcagttcggccgcatgttggcggagggcttcgcgtgtggcgtgcccgtgctcggcagtgactcgggcgaagtcccgcgcaccatgggcgacgcgggcatcgtgctgccggaggcgtctgtgtccgcctggacgcaggcgatcgccaacctgttggagagtccccagcgcagagaagaactggccacacggggccgagagcgcgccgtcacccgcttctcgtggccggtggtggcgaaggcacacctggacttcttcaccgaagtcctggagcagcgcggctga

SEQ ID NO: 7298 - DNA, 783 bp, Myxococcus xanthus
atgcgaagaccgtacaccctcatcgccggtgacttcgtggacaccggaggcatggaccgggccaacctggcgctggcgctctggctggcgaagcaggggtaccccgtccggttggtggcacaccgcgtggcggaggtcctcctgcgccatcccaaggtgcgcttcgtgcgagtgcccaagcccgccaatgcgtatctgctcggcgaaccgctgctgagcgcggtgggccgggcctgggcgctgcgtacccgcgccgagggaggccgcgtggtggccaatggtggcaactgcccggtggcgtccgccaactgggtccactacgtccacggcgcctatacctccgagcccagcggcggcgtgctgcgccaactcaagggccgcgtgagccaccggtactacgtgcgttcggagcggcaggccctgcggcgcgcgcgcgtcatcatcgccaactcggagcgcacgcgggatgatgtggtggctgccacgggcgttcctgcgtcccgggtgcgcgtcatctatctcggtggagatgcggagcgctttcgcccggtaacagccgaggcgcgccgtgaggtccgcgcgtccctggggtggccggagtctcggcccgtggcgctcttcgtgggcgcgttgggcgaccgccgcaagggcttcgacaccctcttccaggcgtggctgcggctgtgtgcacgtgcggattggggcgtggacctcaaggtcgtgggctccggcgcgtcttcggtatgcgtgggagcgcgaagccgcggacagaggcgtgggtga

SEQ ID NO: 7299 - DNA, 1332 bp, Myxococcus xanthus
atgggcggcggcctgctggcgtcgagccgcctggtgccgctcttcgtctgtctgctcatctgctgtcagctcgcgctgctggtggaagccatcgcgccgctccgcgtggcggtgcgcgtgctggccttcggcgtcagtctgctgctgctggcgctggtgcggggacggagtctgaagcacccggcgcttcccttcatcctggccgcgctgggcatcaccgcgctccagctcttcaatcctggcaccggtgccccgttggcggcgctggcgcagttgggcatccagcttgccatcgccgcgccactgctgtgggtgacccggctggccatcgacccgaagacgttccgtcgcacgctcgcgctgctcttcttcttcaacacggccagcgcgggcgtgggcgtgctgcaggtctacttccccggacgcttccagcccgcgctgtcagccgcggtgcagggccagggcgaaggttatgtgagcagcctcaagttcgagacctcggacggcgtgcgcgtgttccggcccatgggcctgacggacattccgggcggcgcgtccactggcggcttctatgcggtgctgctgggcggcgggttcctgctgtcatcccgtcgcgggctgacgcgcgtgttgagcgtgggcggcattctggtggggctcttcggtatctacctgtcgcaggtgcgcgccaccgccgtcatgctggtggtgtgtctggtggccctggcggcggtgctcctggtgagtggccgcgtgggacggttcctggccctgctggcggtgatgggcaccgcgggggtggccaccttcggttgggccgtggcggtgggcggcgacgcggtgatgagtcgctggtccacgctcttcgcggccagccccgacgaggtgtaccaccgcaaccgcggctacttcctgacggggaccttcgcggacgtgctgcctgagtatccgctgggcgcgggcctgggccgctacggcatgacgaatgcctacttcggcgacaacagcgaccgcgagcgcccgccgttgtgggcggaaatccagtggaccgcctgggtctacgacggcggcatcctgggcgtgctgttctacccgctgggcgtgctgatgtcgttgctgtgggcctttcaggtcgcgcgcagccgtgacggtccgcaggacgagttctggctgtggggcagcgtcctcttcgcgtacaacctgggcgccttcgcgctcaccttcagctatccgttcttcatgagccagacgggcatggagttctggttgctcaacgcggcgctcttcggcgccctggcccatgcgaagaccgtacaccctcatcgccggtga

SEQ ID NO: 7300 - DNA, 48 bp, Myxococcus xanthus
atggaggaggcgctgcgcgcgctgtccgagcaggaggtgccggtgtga

SEQ ID NO: 7301 - DNA, 703 bp, Myxococcus xanthus
atgagctacttcacgcagttgcttgagggcggctacgaagccgtccatttgttgagtgattcgaagtcaggcctgcgtgccattgtgggcatgcacaacacgcggctcggtccggggttgggcggcactcgtgcgctcgccacctatgccagcgaggaggaagccgtcgcggacgcgctccggctggcgcgcggaatgacatacaaggccgcgctcgcgggggtgccccacggcggcggcaaggcggtcatcatgctgccgcgcggcagcttcgaccgtgagaagattttcgagtccttcggccgcgcggtcgagtccctgggcgggcgctacatcaccaccgaggacagcggcaccagccccgacgacatggagcacgtgcgccggcacacgaagtatgtcgttggactgaaggagcgcagcggagacccgtcgccggtgacggcgtatggcgtggcgcgcgccatggaagccacggcgaagcacgtcttcggcagcccggacctgaagggcctgcgcgtcaccgtgctgggcgtggggcacgtgggcatgtacctggtgaaggaactgcaccagcgcggcgccaaggtgtgggtgagcgacatcaaccccgccagcgtgcagcacgcggtgacgcagtacggcgtcacggcggtggacgccgacgcactgcatcgcatggaggcggacatctacgccccat

SEQ ID NO: 7302 - DNA, 360 bp, Myxococcus xanthus
atgagccatccccttcgcgtgctgcacatctccagcggcaacctctacggtggcatcgagacgctgctgcacacgatggcgcgcgagcggaaccttcgcccgtcgctgtcacatgccttcgcgctctgcttcgagggccggctggctcgggagctgcgcgacgcgggcgtggaggtgcatgtgctggggcccgcgaagacaggccggttcctggtccgtgtggcgcgcgcggagcgtcctgcgcgagctgctgcgcggcgggcgctacgacgtcgtcatctgccacgccatctggcctcaggcgctgttcgggcccgtggtgcgcacggctggcgttcccctggccttcttccagcatga

SEQ ID NO: 7303 - DNA, 102 bp, Myxococcus xanthus
atggcctggcgcagcctgtccctgtactcggaggcgctggggcggcccgcgccggtgatggcgcccgacgtggcgctgctgcgcttgacggggagcgtatga

SEQ ID NO: 7304 - DNA, 111 bp, Myxococcus xanthus
atgcccccagcgaagctgggcatcgtctactccccggaggggctggcccgtgccgcgcggctggtgggcgtggcgcgcgccaagcagctcttcctcgcggcgcggaagctg

SEQ ID NO: 7305 - DNA, 213 bp, Myxococcus xanthus
atggcggacgtagcggcgcacatcaccggcacggtgtggaagattgaggttcaggtcggccagcaggtcaacgcgggcgacacgctcgtcatcctcgaatccatgaagatggagatgcccgtggaggcagaggatggcgggacggtgaaggagattcgggtgaaggaggcgcagtcggtcaacgagggcgatgtcctcgtggtgctcggctag

SEQ ID NO: 7306 - DNA, 1353 bp, Myxococcus xanthus
atgttccagaagctgctcatcgccaaccggggagagattgcccgccgcatcggcgtggtggcccggggcatggggctcaagacggtcgccgtctattcggacgcggacgctgagctgcccttcgtgaaggaggccgacgaggcggtgcgcatcggccccgcgccggccaaggacagctacctcaataccgccgccatcctggaagccgcgaagcagacgggtgcgcaggccatccacccgggctacggcttcctgtcggagaacggcgagttcgcccaggcctgcgcggacgcggggctcatcttcgtgggaccgccgccggaggccatggcgcggatgaaggacaagagccaggcccgaaagttggtgtccgccgcgggggtccccgtggtgcccggcagcgagggcgtggtgcccgacgtggccagcgcgctggcggaggccgagcgcatcggctacccggtgctcgtcaaggcggccagcggcggcggcggcattggcatggcggtggccaggaacgccgcggagatggagaaggtctaccgccagtgcacggaccgggcgaaggccgccttcggcaaggaaggcgtgtacgtggagcgctacttcccggcgccccggcacatcgaggtccagattctgggggaccagcacggccacctcatccactgtctggagcgggaatgttccatccagcggcgccaccagaaggtggtggaggaagccccctccgtgctgttcgcggacgggcgcaacccggagctggcgcagaagctcttcacggccgcggtggccgcggcgaaggcctttggttacgccaacgccggcacggtggagttcctctactcggacggtgaggtctacttcatcgagatgaacgcccgcctccaggtggagcacccggtgacggagctgaccacggggctggacctcatcggctggcagctgcgcatcgccgcgggcgagcgcctcacggtgaagcaggaggacgtgaagcggcgcggggcggcgctggagttccgcatctacgccgaggacccggtgaagttcttcccgtctcccgggccgctgaaggtgttccagccgcccacgggcgagggcgtccggctggacgcgggctacggcgagggcaacaccgtcacgccgaactacgacccgatgattgccaagctcatcgtcaccggtgagacgcgggcgcaggcgattgagcgctccgtgacggcgctccagtcgttccgcatcgaaggcatcaagacgaacatcccgctccacctgcgcatcgtgcaggatgcggccttccaggccggcgagctggacacgaacttcctggagcaccacgccaagccggcgtag

SEQ ID NO: 7307 - DNA, 1218 bp, Myxococcus xanthus
atggaccagttcgatcagaacaagcaggccgccaagattcgggtcgtcggggcgggtggggccggctgcaacgccgtcaatacgatgatcctgtccaagctggaccgggtggacttcatcgccgccaacaccgatgtccaggcgctcgccgcgagcaaggcgcccacccggcttcagctgggccagacgctgacgaagggcctgggcgcgggcgccaacccggagatgggccgcgaggccgccctggagtcgcgtgaccagattgccgcggtgctcgagggcgccgacatggtgttcgtcaccgccggcatgggcggcggcaccggcacgggcgccgcgcccatcatcgcggacatcgccaagagcctgggttgcctcacggtgggcgtcgtcaccaagcccttcctcttcgagggcaacaagcgccgcaagcaggccgagcagggcatcgtggagctcaaggccgcggtggacacgctcatcaccattccgaaccagcgcctgctgtcgctctccaacgagccgatgccgctgctggagaccttcaagcgcgcggacgaggtcctgctgaacgccgtgcagggcatcagcgacctcatccagtaccacggttacatcaacgtcgacttcgccgacgtgaagaccatcatgagcgacaagggcatcgcgctcatgggcacgggcaactcgaccggtgacaagcgcgcgctgattgccatgcagcaggccatcgccagcccgctgctggaggacgtcaccatcgacggcgccacgggcctgctcatcaacatcaccggtggccgcgacatgaccctgcaggaggtcaacgaggccctgacgctggtgcacgacgccgccgacagcgaggcggaaatcatcttcggctcgctcatcgacgagaacatctcggatgaggtgaagatcaccatcatcgccacgggcttcgtgcaccgcgacgcgcccaaggtccgcacggtggcgccggtggtgcaggtgccgctgtcgcgtccggcgccgtccgtgctcgcgaacgcgcgcgaggaagtcgccagcctggtgcccacgaagggcagcggctcgcggcccctgaccgtggagagcgccaagtcggtgagcgcccgcaccgcggtggtgaaggacgcgccgctgccgctggacgaggaccagttcgacatccccaccttcctgcggcggcagggccagacggaactgccgtaa

SEQ ID NO: 7308 - DNA, 582 bp, Myxococcus xanthus
atggatccggatgatcgctgccccaacgaccctgaggacaaggacggcttccaggacgaggacggctgcccggacccggataacgaccgggacggcatccccgacgccgaggacaagtgcccgaacgagccggagaccatcaatggcttccaggacgaggacggttgccccgacaagggcaaggtgaaggtgctcgtcgatggcgagcgcatcgtcatcctggagaaggtctacttcgccactggaaaggacgtcatcctggcccgttcgcacccgctgctgaagcaggtggccgcggtgctgcgggccaacccgcaggtggaactggtccgcatcgagggccacacggacgaccagggcaatgacgcgaagaacctggacctgtcgcagcgccgcgcgaacaacgtgcgcgccttcctggtgaaggagggcatcgccgagggccgcatggaggcggtgggttacggcgagacgaagccggtggacaccaacaagacggcgaagggccgtgagaacaaccgccgcgtggggttcaccatccttcgcgtggggaaggtggaagtggaacgcgaggcgcgctga

SEQ ID NO: 7309 - DNA, 1056 bp, Myxococcus xanthus
atccgccgcccggtggaagaagcgagcctcatggcgggggcggagatttcccacgtctacacgggcatcgccggaggccacatcaagggcttcaattcccagggcatcgtcgccgtcaaggacaaggaggtccgcgaggcggacatcgcccgggtcattgacgcggccaaggccgtggcgattccgctggaccgggaggtcatccatgtcctcccgcaggagttcatcatcgacgaccagggcggcatcaaggagcccctgggcatggcgggcgtccggctggaggccaaggtccatatcgtcaccggcgcggtgtccagcgcgcagaacatcgtcaagtgcgccaaccgcaccgggctcaatgtctccgacatcgtcctccagccgctggccagcgcggaggcggtgctgggcgaggacgagaaggagctgggcgtgtgcctcgtcgacatcggcggcggcaccacggacatcgccatcttctccggcggctccatcgtccacacggcggtgattgcgctgggcggcaacaacctcaccagcgacatcgccattggcctgcgcacccccgcgcacgaggccgagcgcatcaagcagaagtacggctgcgcgctgtcgtcgctcatcaacaaggacgacaccattgaagtgcccagcgttgggggccgtcatccccgcgtgctcgggcggcagattctctgcgaaatactggagccgcgcgtggaggagatcttccagctcgtgcaccgcgaaatccagaagtgcggctacgaggacctgctggcctcgggcgtggtgattacgggtggctctacgctgctggccggcatgccggagctggccgaggaagtgctgggcctgcccgtccgccgcggcatgccgcgcggcattggcggtctggtggatgtggtgaagagccccatgtacgccaccggcgtgggcctggttgtctacggcgcccgccacctggaccggcgcatgttccgcatccgcgaggagaacgtgtacaagaaggtgaagggccgcatgcgcgagtggctcgaggaaatcttctga

SEQ ID NO: 7310 - DNA, 2567 bp, Myxococcus xanthus
atgggcggcatcggagggcggacgtgggtgggtgaagcgcccccgtattcccgcgaggtgggtggtctcggcggggccccgctgatcttcgatgcggtttcctatgcggtgttcggcggcggtggcggtgcgggccatggcaacaacgacgcggctggcggggggagcgcgggtggcggtttggtgttcatccgcggggcctcgctctcgggggccggtcgcgtgtcggcggacgggttcgcgggtggtaacgccatcgggctagccaatgacgctgcgggcggcgccggcgctggcggcaccgtgtatgtgcgcgtcaccggagccctgtcttgctcggccaatgcagtgtcggcccgtggtggtgatggtggcagcaccacgcacgatcagcacggaacaggcggtggcggtggtcgtgcgctgattcagggcgtgacggtcgggtgcatcccggtcgtcacgggcggctttgcgggcacgcagccgacagccaacgcgccgggcgggctcacgtatggcgccgctcctggcaaccccggtatcgtcaccatcctcccgggtgccttcccggcgagtgtggcggcccccgtggtggtgacgcctgccaacggctccaccacgggctttcgtccggtcatcagcggtactgcccccgcgagctccacggtgatcatcttcgtggatggcgtcgaagtggcccgcgtgacggcggacccctcggggaacttcagcttcacgccgaccgcggatctgtccgtcggtgcgcacacggtgaatgcctacgccctgttccagggcgtctcgtccgtgctgagcaacaccaatagcttcaccgtggtctccgacaccacgcctccggataccaccatcgtgagtggaccgccggcggtgtcgaactccaccagcgcgacgttcgacttcgcctcgaacgagggcccggtgacgtacgagtgctcgctgaacggcgcgcctttcgcggcctgcacggccccgcagacgttcacgggtttcagcgagggcgagcacacgctggcggtgcgtgcggtggatgcagcgggcaacatggacccgacgcccgcgacgtatgcgtggacggtggacacgacggcgccggacacgacgattgtcagcggcccttcggggacgacgacgtcccccaacgccacgttcgatttcagctcgaatgagagcccggtgacgtaccagtgctcgctggacggcgcgcccttcgtggcctgcaccgacccgcagacgttcacgggcctggcggacggtgcgcacaccctggcggtgcgcgcggtggacgcggcgggcaatgaggacccgacgcccgcgacccggacgtggacggtggatgccaccgccccggacaccaccatcgtgagcggcccagcggcggtgacgaacgccaccagcgcgacgttcgacttcgcctcgaacgagagcccggtgacgtaccagtgctcgctggacggcgcgcctttcgcggcctgcacggatccgcagtcgtacacggccctgaccgagggcgagcacacgctggcggtgcgtgcggtggatgcagcgggcaacatggacccgacgcccgcgcagtacgcgtggacggtggacctcacgtccccggcactgccgaccatcgactcgcccgcggaccaggaggaggtcgccaccacgacgccgacgctgacgggaacgggtgagccgggcagcgacatctacctggaagtgggcggcgccacctacggccccgtcctggtcgatgaggacggcaactggaccttcaccgtgccggatccgctcgtcgagggtccgcacaccgtgtccatcaccagcgtcgacccggcgggcaactccgcgggcccggtgacgagcacgttcatcgtcgacctctcggcgcctgacacgttcatcgactccggcccgacgctgctgacgcgggactcgtccgccaccttcgaccttcgctcggaaggcggaggcgtggcctatgagtgcagcctggatgggggcgtctatgtggcttgcgccgaccccgcgaccttcacgggtctggcggatggggaccacctgctcctggtgcgcgcggtggacgcggcgggcaacgtggacccgacgcccgcgcagtacgcgtggacggtggacacgacggcacccgacacgctcgtcgtgagcggcccggcgacgccaacctcgtcgaattcggcctcgttcgagttcgcggcctccgagccgggctcctcctatgagtgcagcctggacggcgcggcctatgtgtcgtgcgaggagacggtgacgttcgacggcttcgcggaaggggagcacacgctcctggtgcgcgcggtagacgcggccggcaacgtggacccgacgcctgccgagcacacctggacggtggatttgacgccgccggtggcgccgctcatcaccacgcccgcgaacggcgcggtgctggatgacggggtggtgaccatcaccggcacagccgacggcgctgagtccgtgacgctggtgctggatggcgtgccctacggccccatcccggtcgatgccggtggcaactggac

SEQ ID NO: 7311 - DNA, 105 bp, Myxococcus xanthus
atgagcttcaccctgtacgtcatgggccgcggccgcctcgggttcgcctcgaagctcgccgtcgtgcgcagcgcgtactttccggcgggcaccggcgacaggtag

SEQ ID NO: 7312 - DNA, 462 bp, Myxococcus xanthus
atgagagcggtggtgcagcgcgtgctggaggcgtcggtgacggtggagggccagcgcgtgagcgacatcggcccgggcctgctggtgctgctgggcgtgggcaagggcgacacggaggcggacgtggcgtggatggtggagaagctggccacgctgcgcatcttcgaggacgccgccgggaagatgaacctgtcgctggaggagacgtcccggcagctcatcgtcgtcagccagttcacgctctacggcgacgcgcgcaaggggcgcaggcccagcttcatcgacgcgatggagcccgtgagcgccaaggccctctatgagcgcacctgtgagctgctgcgccagcgcggcctgagcgtgggcaccggcatcttcgccgcggacatgaaggtggcgctcgtcaacgacggccccgtcacgctgctgctggagagccccgggccggccgcgcccaaaggctag

SEQ ID NO: 7313 - DNA, 861 bp, Myxococcus xanthus
ggctgcgcgggcatggccggctggctgaagcgggcggcgcagtccctcccccccgaggacctcacgccccgcttccatgcgctgctcgcgcgcgtccgccaggggctgccggtgctgccgcaagaggcccagcgccaccagtacgtgctggtgcgcggcatgctgggagacgagctgcccggctacctgctggacaacgtgcagcggctggagcgccggggactgagcgtgcgcgaggccgcggtggacaccgaagggctgctcgcgaacaacgtggcggtgctccgcgaggtgctgcgcgacgcggagtacttcggccgcagcgtggtgatggtgggacacagcaagggcggcgtggagtgcaccgccacgctggcgctctacccggagctgcgccacgtggtgcgcgcggtggtgacgctccaggcgccgtatggcggctcatccatcgcgcacgacctggccaccacgccccagctccgacggctcatcgacttcgccttcccgctgctgttccacggcgtgtcccgctccgtggaggagctgtcctatccccagcggcaggccttcatccagcagcacccctaccccgccgacatccccaccgtgtcgctggccacctcgcggctgtcgcgcacgtccacgctgtacccgctccagcgctacctgcacgagcgctacgggtaccagtcggacggcatggtgacggcggtggacgcggaggtgcccggcgcgcgcgtggtgcggctgcacgacatggaccacgcggaggccgcgctgcgcggcctgccaggcctggtccgctaccacccgggcgacctcaccgaggtgatggtcgccctggccttggaagcgcgctga

SEQ ID NO: 7314 - DNA, 159 bp, Myxococcus xanthus
atgttgttacttggcgtggtggtcagcgttcagggtgtgctggcgagcatcatctactcgctcatcggattggcggtgttcgtgtcgggcttctacgtcatccgcctcatcatgccgttcgacgtgcacaaggagctggaggccgaacagcacacctga

SEQ ID NO: 7315 - DNA, 1863 bp, Myxococcus xanthus
atggtggagttcaccgccggctcggcgcaggtcgtggtgtgcggctactgccagacggtggtggctcgcaagggcctggacttcgagtcccacgggaagattggcagcatcgtccccaccgattcgccgttgcagctccgcgcggaggggcgctaccgcaaggcggcgtacaccatcgtcggccacctgcagaaggaccacggcgcgggaccgtgggacgagtggtacgtggagttcgcggacggccgcaccgggtggctcagcgagtccgagggcaccttccacctgatgttcgacatggggcccgaagagggcgtggtgctggaggacctgcacccgggagagcggctgcacctgcgcgaccgcgcgtgggtcatcgaggagcgtggccatggccgcgtggtggccgccgcgggtcagctccccagcgacgtggaccccacgcaggacgcctggtacgtggacgccacggggcccaagggcgccttcctcacgctcgacttcggcacgcgtgggcactcgcccgaggtcttcgttggcgaggcgctcaagctggagcagctgggcatcccggccgggcagctccggccccgcgtgcgcaaggtggagctgcagcaggcgcgctgcacgcagtgcaacggcaacctgtcactgcgcgcgccggacaagacgctgcgcgtggcgtgcccctactgcggcgcgctgctggacgctcgccagggcaagctgtccttcctgcgcatgctggagaagccgagccggccgctcatcatccccctgggaaccaaggggaagctggatggcgcggagtggatctgcatcggctacctggagcgctcgtgcaccgtggagggcgtgcgctacccgtgggaggagtttctcctctacaacgcgaggcgcggcttcgtctggctgatgaactccaacggccactgggtgttcctgaagccgctgcccgcgggtgacgtgtcgctgtcgcccgacgtcgccgccttctatgagcaccgccgctacaagtgcttccagcacgtcaccgcggtcacggacaaggtgttgggggagttctactggacggtgagagtgggcgagcgggcccaggcgtcggagtacgtctccgtgccgtactcggtgaacgtggacgccacggacgacgaggtgtcgtacacccacggcgagtacctggagcccgaggtggtgaaggaggccttcggcttgaaggagccgatgcctcaacgggagggcattgcccccagccagccgaacccgcaccagtcgggcctgcgctccgtcttcgtctggactggcctctggatactggcgttgttcgtgctgtcggccgtgctgtccttgaccgccgcgaagacggtcgtcctggagaaggcggtggtggtaccgccggatgccacgccaggcacgcccgcggccatgcacttcagcgagcccttcgaattgcccaagcgcggcaacatgcgcgtggagatcagcggcacgcccttcaacgagtggctgggcatccagggcgacctggtgaaccaggacacgaacgacgtggtcctcttctacgaagagctgagctactaccgtggcaacgacggcgacggcgagtggaccgaaagcaacatgtccaccagcacctacctgtcgccggtgcccgccggaaagtacgcgctgcgcacgacggcgagcttcgaggcgaacccgaggcggccgcggcccatgacgtacagggtgaagctcatccacgacacgcccaactcgagctggttctgcttcgcgctggggttgatggtggtggggccggtggtggcgttgtatcgctcgcacagcttcgagacgcggcgctgggcggagagcaacgtctag

SEQ ID NO: 7316 - DNA, 1023 bp, Myxococcus xanthus
atgaagaagatgccggcggcgctgcagctcgacagcaccgagccggtggagcttcccacggtggaggcgccttccctggagggggtgtcggtggcccaggtggcgcctgcgccattgacggagcaggaactcgtggaccgcttcgatgcgctccgtcgccagcacgcagacgtccgcgagcgtcagccgggcgaggatgtggcgctcgaggacgacgcgctcgtggacgtgctgggcttcgccaacaaccggctgatgcccttctctgtccgggagaactggtgggtgcgcgtcgcggcggacccggggctgcccggcttcttcgaatcactggcgggggcgaaggtgggccagtcggtcggcatcgagctgacgctgccggacacctatcccgtggaggcgctgcgggggcagccggcccgcttcctcgtgagcgtgaaggcggcgcgagagctgaagttgctggaagatgactcgccggagttgctgtcacggctgggcatgggctccatcacggacgtcatgcgcaagctgggggacgaactggcccaggcgcggctcgccgacgtcgaccggttgacccaggagcgcgtcatggacgtgctcgtggaccgcacgccggtggagctgtccgccgcgctggtggatgaggagattcgccagcgctgggcggaggccgagcggcccatcctccagcgcaaggatttccagcccgacgagcttcaggaagcgctggaggggtggctgcaggatccgctgacccgcatggatgcggcgtaccgcatcacgctggcgctggtcctgcgagccatcgccgaacgcgacggcatccagccggaccgcgcggcgacggaggccatgctggaggacctcgcgaacctcacgggcgtcaaccggcaggagctgggcgtggcggtgaaggaggacgaggcgctggctcgccgcctgtacgaaatggcgctgcgcttctccaccatcgaccacgtgatgaagaaggtgacgctgacgcccgccgcggcgtga

SEQ ID NO: 7317 - DNA, 861 bp, Myxococcus xanthus
gcccgtcccgggcagtccgaccggttcgaggacgcgcacaaccgcgtgacgcaggccgccactgggctccgctctgtctcggatgccgcggtcgccacgcaggtgcgtgacgccttcgggccccgccgcttcggccccgtcaacctgccgggtggcaatggccccgtcgtcgaaggggcgaacacccgcctcgcgcgcggcgccggtgccgtcagcctcgcggccaacgtggcgcagcttcccaccggagccgtcgagacgttccgtgacgtgcgcgatgcgcttcgcaacccgaccgaagcgaacgtccgtgaggcggtgggcaccgcctcgggcacgctctccacggggctgatggcggcgcgggatggcctgagcctcgcgggcaatgtcagcaactaccgcgctgccaccgacgcggctcgcaccgccttcaccgccgcggccccggatgcctcgcgtgccgccgccaaccgggtggccaccaccgccgccaacaccgcgctggaaggtgcgtcgcgtcaggtcgtgcgccgcgcggccgccgaggtcgccgagcgcggactcgagggcgccgcccgcaccgctggcaccgccgcgcgcgccgcggtgcagggcggtggcaccgcggtggcgcgtgccgcgggccgcttcaccccgggcctcaacgtcgccatcgccgcggcggacaccgtggcggtcgtgaacaccatcacggacccgaacgcttcggctggaaagaagattaccgctggagtgacggcgctggggtccatcgccgctgccaccaacatcccggtcgtgagccaggtgggtgcggccgtctccaccgtgtccggcttcatcggctccttcttctag

SEQ ID NO: 7318 - DNA, 3579 bp, Myxococcus xanthus
atgcgccgttcgcttctcgtctgcctcgtcctcctggccacggcctccgccgcccaggagaagaaagccccgcgcgatgccgatctcggccggaagtccgccaccgcggtggacaagtccctggctggcgacatcacccgtgaaaagaagaaagaagaggtcgcccccgcgctccagtacgaccagttccggctgggcgtcgagctgcaggtggcctccaagcggcgcgagcagatccagtcgctgaagaagatcatctccctgtcgccggatccgaaggaggcccccagcctcctgttccgcctgggcgagttctactgggaggagtccaagttcttcttcttcgaggccaaccggaaggatgacgacctcatccaggccatgaaccgcaacgacgccgcgggccagcagcgggccaaggcggagaaggcggagttcagcgcgaagcagaaggagtacggcaagctcgcggtggagcagtacacgaagatcgtccaggagtacccgaacttcgagcgcaccgacgaggtgctcttcttcctcggccagtacctcatggaggatggccaggaccgcaaggcgctggtggccttcaagcgcctggtggagaagcacccgcagtcgaagttcatcccggacgcctacttcgccttcggcgagtactacttcaacaactccaaggggaagcgcccggagctggagaaggcgctggtggcgtacaagaaggccgccgagttccccgagagccaggtgtacgccttcgccctctacaagcagggctggtgccactacaacatgggcgacttcgagtcggccaaggacaagttcaagacggtggtgctctacggtgaactcgccggcgccaacgctctggagaaggacggcggcaagggcggcggccgaagctcgctgctgcgcgaggcgcgcaccgactacgtgcgggcgttcgcgcaccacggtgacgtggcgcaggcccgggcggagttcggcaaggtggccaccaacccggaagaccgcttcacgatgctgaagcagttggccaacctgtactacggcgatggcaaggaccgcgaggcggccatcacctacaacggcctcatcaaggagaagccgctgtcccccgaggcgcctggtttccagggccgcatcgtcgactgcatcctccgcatgggcaacaaggagcgcaccgtggtccaggtgcgccggctcgtgaagatcatgaaggaggtcgagggctccggagtcatcaaggaggacaaggacaagaagctgctggcggaggcgaaggagctgtccgagcgcacgctgtccaacctcgccgtcacctggcacaacgagggcaagaagacgcgcaacgaggagacgttccgctacgcggacgcggtgtacagcgactacctcacgctcttcccggagaaccccaaggcgtacgacctgcgcttcttctgggccgaactgctgaacgacagcctgcagaacttcgacaaggccgccgccaactacacgctcgtcgtgctccaggacgccaaggtgctggaggccaaggacgacaagggcaagccgaagccgggcaagccgggcaagtggctgcagaacgccgcctacaacgcggtgctggcctacgacgaggtcgtcaaggcgggcgaggcgcggggcgagggcaagagcgaggcggtgggctcggacatcaccaagaaggccaccatccccacgctgaagaaggcgctgctcgacgcgtgtgagcgctacctcaagtacgtgcccaagggtgagaagcgggtggagatcgccttcaaggcggccaacatctactaccgccacaaccacttcgacgaggcggtgctgcgcttcagcgagatcgcgctcggctaccccgagtacaagttcgagaacggcgagcgcgcggcggagatctccgccaacctcatcctcgactcgtaccacctgctgcaggactacgcgaaggtgaacgagtgggcgcggcgcttctacgccaatgacaagctggcggtgggcaagttccgcgacgacctggcgaagctcatcgagcagtcgtccttcaagctcgtcagccagctggaggagaagaaggagttcgagaaggccgccgaggcgtacctcgccttcgtgaaggacttcccgcagacggagatcgccgacctggcgctctacaacgcgtccgtcgactactacaaggcgaagcgcctggataaggccatcgaggtgcgcaagcgcctgttcgccgagtacccgcgctccaagcacgtgccggactccatctacgcgaacgcggaggcgctggaggccattggcgacttcgaggacgcggcggcaacgtacgaggcctacgtgcgcggctacgagcgcagcctgggtgacaagggcaacgccaaggcgcgtggtggcggcaagaagaagcggggcgcggtggacgacaacaagcccgcggtggtgcagaagtgggacgagtccaaggcgcaggtggcgctcttcaacgccgccacctaccgagagggcctgggccaggtgaaggcggcgctgcgcaaccgcgagcactacctgacgctgtggccgcgcgcgaaggacgccgacgaaatccgcctctccatcatcgacctgacggccaagagcggcgccgcgttcaaggccatcaagatgctggaggagtacgagcgcgacaacatgcgctcccccagccggttcctggccgccgagggccgcatcgtcgacctgtacaagaagatgggcaagacgcgcgacgtggcccgcatgcagaagcgcatcttcgagcacttcgaccagctgccccgccgcgtgcagggctcgctggagaagccggcgctcgccacggccgcgcaggcgcagttcctgtcggtggacctggactggaacgagtaccggcgcctgaagctgtactggggtgctccgccgtcgccggaccgcttcaaggcgagcatccaggacaagagccgcgcgctccaggtggtggagaagaagtacgtgcagacggtgacgctgggcgcgcccgagcccgccatctgcgcgctgcaccgcattggcctggcgtatgaccacttcgccgaccgcctcatcaacgcgcccatgccgcgcggcctggatgaggagtcggagcaggcgctgcgcgacgagttcgccaaccaggcgcaaccgctcaaggacaaggcgaccgaggcgttctccgccacggtggccaagagccgcgagctggacgtctacaacgattgcgccgcggagagcctgaagctgctgcgcaccacgtaccagccggaccgctaccccgacatgcccgatgagaaggtggcgctgaagggccgcgtgcagctcatcggcggcgacctgctggccaacatccaggacgtgccgccgccggcgcccaaggcggcggacgcgcagcaggcccgggcggagacgctgcaggaggacctgacggacctcaccgcgcagctgcgctcgcagaccgagactcaggtggacgcccgcccggcggccaccaccaacggcgccactcccgcgaagcatggcgggaatgacgaggagccggaggactttcctctatga

SEQ ID NO: 7319 - DNA, 948 bp, Myxococcus xanthus
atggctccaaaggcgaatggcgaggcgtgtggtgtgtgcggcgggcggacctatgtcatcgagcgccgcggggaccaggcccaggcgcgcatctgcgcgtgctccgagcactgctcggtgtgcggggggcgcgggcacgtgctggtcgagcgcgagggcgagttcagccagaagatgggcccccggcgctatgaggtgatggagacgtgcacatgcaccaagctgcgaacgcgcattgctcgcttcgatgcgctggggctgcctgcctcagcagcgcatgcgaactttgagaactaccgctcctatgaggaggcacaagacaggggccggagtgtggcgatgcagttcgcctatcaatacgtccaaggcgggtcgtctaagggctacatcatcagcgggcctgtaggtaccgggaagacccacctcctggcggcgacgctggcgcacctggcgctggagctgggcgtgcgtgggcgctacgtcgaaatctccctcctctacgcgaccatccggcgtggctttcaggagggcaagagcggcggcgaaatcatcggacccctgtcggaggtggaggtgctggccatcgacgagctgggcaagggccgcggaagcccctttgagatggagaccctcgatgagctgattgcccgccgctacaacgcgggccgcaccacgctgttcgcgacgaactactccctggagccggagaggcgcgccatgcgaagcgcggcgccgtcgggctaccgcaccaccgacgactcgcgcagcgcggcccgagaggcggagctcctgcgagagcgcgtgggcgagcgcatctacagccggctgtgcgagctgtgcaccttcgtcgagtttccgaaggagacgccggaccggcgccgcccccgacaggaaatgaacgcgcccatgcaccatgcagcgggcaacgggcggccccagggacgatag

SEQ ID NO: 7320 - DNA, 657 bp, Myxococcus xanthus
atgagtctcctccccgaaagcgccagcttcgaagagctggtgcaggactacttcctcgctgtgcgtggtgcggggctgatgctctccgcgctggacaccgagcttttgacgacctgggcccgggaaggcgttcccttcgaggtggtggcgcgcggcatctcccgctcggcggagaaggccctctgggacgcgcggcccggagagccggtgctgcgctcgctgcgcgcgtgccgacggcaggtggagtcggagatcaagaagtaccgggagctggcggcgggcgcgggtgaggaaccctcctccagccccaagcgcaagcgggcccgttcctgggaagagacgcggcacgcgcggctgtgcgcggcgctcgaggacctggcggggcggaacgaagcgctgtcgcaccgtgtgcgcaacctgcgcatcaccgtcctggcgcatgtcccggaagagccggcggccatggatgcccaggaagcgctggcgttcctgctggtgctgcgcgccctgcccttcctggaccggtgcgccgtgtggcgtgaggccctggcggcgtccgcggaacaacaggtgatgtcgccgcgcgcccgcaaggtgtcccggcgcttccgggtgctggcgacggtgcgccggcggctgggcgtgaaggagatgtag

SEQ ID NO: 7321 - DNA, 801 bp, Myxococcus xanthus
atgtccaagcaccctcgctccaagggaggacggctgagcgcgggcctcaagctcatcgggccgctctgcatctccgtcggcttgctcgtggggctgcggctgctggggccgcaatacctggatcagcagacgctgtcgggctggctgaggcccctgggcgcgctggcgcccttggccttcatcctgctcctcgcggtgcgcccggtgacgctgctgcccgggcagctcttcacggcggtgggcggcatcctcttcggcatggccgcgggcacggtctacgcgctcgtcgggacgctgctggcctcgggcctcatccacttgctggcgcgcaggctgggccgcaagcccatgcggcggctggccggggacaagcacccggtgttcgagcgcgcggcgcgcgagcatggcttccagctcggcttcctggcctgcatcaattcagtgattccggcggatgtgatgctggcgacggcgtccgcgtcaggcgcccgctacgtcccgctggcgctgggcgcggtggtgggcaccctccccgggacgctgctgacggcgctcttcggtagctcgctgggacaggggaagacgtggatgacggctgtgtccgccaccggcatggtggtgagcctgctgctggggctcgtcctgggacgcaagctgatgcgggagttgctcgcgaaggaggcggccgttgcgagcggagggcctgggcgtgtgcacccaggccctggggacgtgcggcctacgggtagcaggcggcctggcgcagcgccgtgtcttccggcagccccagcgcgacgttga

SEQ ID NO: 7322 - DNA, 576 bp, Myxococcus xanthus
gccactgatttctcggaggcgagcacccacgcggtgggcagggctggacacctgccactcgcggacggcgcgaaggtgctggtgacacacgtcctccccagccgcatgcccgcggaggtgggctcccgagcgctccaggccaccgcgcgcgagttggagcgggtcgccgagcggctgcgcaacatgctgcgtgccgagggcagttccgccacggtcgacacgcacatcgctcgcggcaagcccgtcgaggccatcctgcgccgggcccgggcctttggcgcggagctcatcgtcctgggccggcatggcgacaagccgctgcgcaacatgttcctgggctccacggcggagaacgtcatccgcggcggagacctgcccgtgctcatcgccaaccggcgggctcctgggccctacctacggcccgtcgtggccgtggacgccgacgaaacgtccaagcgcgcggcgagcttcgttcccacgctgatgacgcccggctcggagctaacgctggtgcacgcgtatgacgtgccgctggagtacgcggtgttccccgggctgacggcgaaggagtacctt

SEQ ID NO: 7323 - DNA, 627 bp, Myxococcus xanthus
cgcctgggctcgttcctcgcggtggttcccctgtccatctgggtcatcaaccacctgtgggacaacctctccgccttcaacggcgcggacgcctggcagaagtcggtgacgacgtacgccaacccgttctcccaggtcttcaccttcctcatcgtcctgctgccgctgctgatgcacaccggctggggcttggtgcgcctgttcagcttccggccgaacaacgcccgctacaacaactacggcaacctcaagtacatcctccagcgcatcaccgcggtgggcgtgctggccttcctgggcgcccacatctggctggccttcctctacccgcggctggtgctgggtcacccggaggcgttcgacgacatcgcccgggagatgcaccaccacgcgcccaccctggtcgtctacctgctgggcaccctgggcacctcgtaccacctggccaacggcctccagggcttcgccatgggctggggtctgctctccagcgagcgctccatgcgcaagttcgagccggtggtcatcatcctcttcctggtcctgacggcgatgagctgggcggtcatctacgcgctctacaccgcgggcgccgccttcagccccgtgggtgccacccctccgtga

SEQ ID NO: 7324 - DNA, 1611 bp, Myxococcus xanthus
atgcatttcgagttggccttcgtactgattttcgccatcgcgaccgccgtggccatcgccgcgcggtacttcaaaatcccctatacggttgccctggtcgtcgcgggcctgctgttgggtacgttcaaggcgttcgagccgccgcacctcacgaaggagctgctcttcgccatcatcctcccaggtctgctcttcgaagcggccttccacgtcgagttccgcaagttctggaagaacaagatggccatccacgccctggccattccagggctcctggcctccgcggggctcacggccttcatcctcacgcgcgtggtggatgggttggacttcgtccatggcttcgggatgctgtccgcgctggtgttcgcgtccgtcatcgtgtccacggaccccatcgccgtggtggcgctcttcaagtcgctgggcgcgcccaagcggctgctcatcctggtggagggagagagcctgctgaacgacggttccgccgtcgtgctcttcacgctcatcgtcgcggtcgccacgggtggccagttcacggtgggcggcgccctgttcgacttcatcaaggtcttcggcatgggcgtgctgatgggcagcgcggtgggcttcgccgtcgcgcaggtcatcaagcgcgtagacgacgccatggtggaaatcaccctcacggtcatcgcggcgtacggctcgttcgtgctcgccgagcacttccactactcgggcgtcatcgcgtcggtggtggccggcatgctgtgcggcaactgggccacgcacgagggcatgagccccgccacccgcatcgcggtggagagcttctgggagtacctggcgttcgcgctcaactccgtggtgttcctcctcatcggcctggaggtgcagctctcctcgctgctggcctcgtggaagcccatcctcgccgcctatgtggcggtgatggtggcccgcgccgtggtcgtctacggcgtgtccgcgctgctccgcttcaccaaggagaagatgccgtggacctggagcgcggtgctcacctggagcggcctgcgtggcgccatctccatggtgctggtgctcggtcttcccacggacttcccgcaccgcgagctgctggtgaacatgacgttcggcgtggtggtcctctccatcatcttccagggcctcaccatggcgccgctgctgcgcaagctgcgcatcaccggcctcaaggacgcgttccaggagcagtacgagctggcccgcggccgcctgggcgccatccacgcagcgcaggccgcgctggagagcatgcgccgcgcccgggagattccgggggatgtggtgacgcagttggagaaggactaccaggagaaggaagtcgtcgcggagaaggagctgacggcgctgaagcagcagtcgatgcgcttccacgaggaggagcaccaggaagcggttcgccgcgtgctcatcgtggagaaggcggcgctgctcaaggcctaccagtccgccaccattggcaaggaggccttcgcacggctgacggcggatctggatgagcgcatcgccgccgcggacgccgcggagaaccacgtgccgccagagggtgagactccggccgtggccggcgccgcgagcgcctga

SEQ ID NO: 7325 - DNA, 945 bp, Myxococcus xanthus
gagcccatccacaaggtgcacccgcacttgcgcggactggtggagggccgcttcgagggcgagcccgactggaagtggctggcggactgcgagcagcccgtcgtcttcagcgcgctgggccacggcgacctggccaagcagttcgcgggcctggagaagcagtgggcggaggtcggcatcgccgagcgcctgctgctggtggacctgtcctccgacttccggctggaccacccgggccgctacgcgggcgcgtacggccggccccacccgtccccggagctgctgggcaccttcacctacggcctcaccgagtggaagcgcgacgcggtgaagacggcgaagcgcatcgccaacccgggctgcttcgccacggcggtgcagttggcgctcctgcccatcgcctccacgccgggcttggggctgctcgcggtgtccggcgtcacgggctcgtccggctccggctcgctgcccggtgagggcacgcaccacccgacgcgtgcgcaagacttccgcgcgtacaagccgctggagcaccagcacgaggccgaggtggaggtcatgctggtcgcccacggcgcgcagcggcaccggttggccttcgtcccgcactcggcgcccatggtgcgcggcatcttcgccaccgtgcagttcgagtggccggagcacggcggcgcggtggtgacggcgtcgctgatggagaagtaccgccgctactacgagggctcgaagttcgtgcgcatcgtcgagggtacgccgcgcatcgctgcggtggccggcagcaacttctgcgacatcgcggtggccaccaagggccgctcggtggccgtcatggcggcgctcgacaacctggtgaagggcatggccggccaggcggtgcagaacttcaacgtcgcgctggggctgccggaagacacggcgctgcgccaggccgcctgctacccgtag

SEQ ID NO: 7326 - DNA, 1059 bp, Myxococcus xanthus
atgggctggaagacgttctttctggcgctgaaggacgagtggacgcgcgacgaggtgggggacgtcgctggcgcgctcaccttccggatgattctggcgctgttcccattcctgctgttcctggtgtcgctggcgggtctcctcatcgagcccgcccaggcccaggtgctcatccaggaactggcgcgggtggcgccccgggaagtgacgtccatcctgagcgagcgcatcgaggcgctggcgaacagccggccggtggggctgctgacggtgggcggtgtcggtgccgtctgggcggcctccgcgggcgtggtggcgctgatgacggcgctcaacaaggtctacggtgtgacggagtcgcgtcccatctggaagctgcgcggcatcgcgctgctggtgacactgggcggagcggcggtggccatcctcgcggcgttcgcggtcatcgtcacgcccgtcatcgctggcaagcttcccggcgggttgggcaccgtgctcatgtggctgcggctcccggtagcgggcctgctgatgatgtttctgtgggcggtgctgtactacgtgctgccggacgtgaatcagaagttccgtttcatcaccccgggctcggtggtgggcgtgctcatctgggtgttcgcgtcgtggggcttctcccagtatgtggccaacttcggcaagtacgacgtcaactacggcgccatcggcggtgtcatcgtcatgctgctgtggatgtggatctccgcgcaggtcatcctgctgggcgcggaaatcaacgccatcctcgagcaccgttccccggacggaaaggcgccgggccagaaggtcccggagcagggcaaggcgctgaccgccaccaagacggaactggaggcgggaggtgcgtcgcttccgggcgctccgggcttccagcccgtggtggacccggtgacgggccggcccctggatgacccaccgtccgctccacccaggctgcgtgacacgccgctcgcggcggccttcaagtggaccgtgggcatgggcctggggttgttcctgctgcgcaagtcggactcccggtag

SEQ ID NO: 7327 - DNA, 504 bp, Myxococcus xanthus
atgtctcagaccccctcctggcccctgcgctgcggcgcggtgcttctcacggctcaactcgtccttgcgtgtggtggcggggagccgaagcctccacctcccaccgacctcacgccgcccacgacacgcgccacgcccgcgggaggcgacttcaccaccgccgtggtggtgacgctggcttgtgacgacggcggcggcagtggctgcgcggccacgtactacacgctggatggctccacgcccggcacgggctccacgcagtatcgcgagcccttcacactggggagcaccaccacggtgcgcttctactccgtggacgcggcaggcaacgcggaggcgccggggaccgcgacattgaccctggtgggtgcggcggacacggagccgcccagcacggtggccaaccccgcgagcggcgcgttcagcagtccccggagcgtggcgctgacgtgtgacgacggcgcgggcagcggctgcgcggccacgctctacactttagagcac

SEQ ID NO: 7328 - DNA, 417 bp, Myxococcus xanthus
atgcgttctgacctgcggcgcctgacgtgggcctgtgtgctgctgacgtgtggcctgtccctggccgagcccctggtggggccctccgtcggccgtggcgatgcgctgctggccgagggcacccgcctctacaacaagcgcaagcacaaggacgcggcggaggtgttgctccaggccacgcgcgccaacccgtccctgctgcccgcctacctgggcctggcccgcgcgcgcatgggggcgaaggacgtccccggggcctgcgccgcctaccgcgcctacgtgcgcagcgcgccggacatccaggaccgcaccaaggcgcagcgcgagctggccctgtgcgagcgcaagctgaaggccgcgcgccgcaagaagcgcaacaaggtgccgcccgacatgacggcccggcacgtggagctg

SEQ ID NO: 7329 - DNA, 1551 bp, Myxococcus xanthus
atgttcgtctcctgtctcctgagtgtcagcctggcgctgagcgccggcgccgcacccggaatgcccccggacacccaggcacccaccccttcgcacacgctgtggctcgtccaggccctgtacccaggacaggacgcgttgctgcaacgcaccgaggaagggattgccgcgctgataccgcaagacgtgcaggcggagcagctcatcggccggggcgccctggccatgcacctgaagggccagggcggcgacctgcgctgcgtgtccggcgaggcgcgctgccgggagccgctggaggcgtacctggaatcactgggtctggagcgcgtggtgctggtgcaggtgggccaggacgacgccggctaccgcttccgcgccgtcagcgtccggcccggcacgggcgcccggggtcaggcggagacggcgaacccggcgttcgagaaggccctggccggcgtgctggtgaagttcctgtcgctcaatgccacggtggtggcggagacgacgcccgcgggggccaccgtcttcatcgacggcgtgaaggtgggctccacgcccttcaccacggaggtgctgccgggtgagcacaccttccgcttcgaactggcttcgcaccttccgaaggaagagacgcgcgtgatgagctcgcgccagcaggtcaagctggacgccacgctggagaaggtgcccgcgcggctggtggtgaaggcgcagccggagggcgcggagattcgcgtggacggccagccggtggggaccaccgcggtggaccagggcatccagccgggcacgcgcagggtgtcgctgacgttggacggctacgagccccacgaggtgacggcggagatcgcgcccggcgggacctacacgctggagcacgcgctgacgcccacctccatgcagtccttcaagctggccatgcgccgccgcaaggaagccaccatggcgcggcaaagctacctggaggcctcgttcgagatgcagcgcctcacgggcacgtcgctggcgtcccagccgctgagcacctcggaggagctggagagcctgcgcactcgggacgtgcgcgcgccgggctcgcgcaacctgcgcggcgtgggcgtcgagtacggccgctatgggcagttcttcggcgtcatgctggtgggcgccacctacgcctccaccggcgacacatggacgctgggcatcgacgtaccgcctggcgtgggcggcgtggggccggacggcgtgtcgtcgctggacacgcgggtgcaggcggtgtcgctgcgcgcgctccagccgcaactgcgctacgtgctcgggcccgtgtccttcgccatccaggtgggactggagggccgagggctgctggtgaaggaacgcgcgggtgacgcggccatcttcaaggacggcctctacgcgctggacctgcacgcgtccggacaggccaccgcgcgcatcttcgtgtacgagggcctgtacgcctccgtcgcgtaccagcacagcttcacgctgctgaagaagattgccggaacgagcaacattcgcggagggctgggctatgcgttctga

SEQ ID NO: 7330 - DNA, 894 bp, Myxococcus xanthus
atgcgcgcggtgcgcggcggcgacttcacggccaccgtgacgcccggcagtgacgacgaggtgggcgaggtcgtccacgccttcaacggcatggtgaaggagctgggcgaggcgcggcagcggctgtcggccgaggccgagtcacggttggcactggaggcgggcctgcggcgcgtggacaagctggccgccgtgggacagttgtccgcggggctggcacacgaaatcggctcccccctgctcatcctcaatggacgggcccaggccctggccgcgcgcgccgacctgcccgacgacgtgcggcgcaacgcgcgcatcctggtggagcagtcggagcgcatcgagcgcatcgtccgccagctcctggacctggcccgccgcaaaccgtcgaagctggagtccctggacgcgctcgcctccgtgcgcgcggtggtggagctgctggagttcgacgcgcgcaagcgcgacgtccggttgacattccattccgaggagccgctccctcgcgtgctggcgaacggagacgggctgcagcaggtggcgctcaacctgctcaccaacgcgctgcgcgccacgccccgaggcggcgaggtgcgggtgacgctggcgccgtccaccttccagcccgcccccggcctgcgcgagcgccatggcgtgcgcctgtccgtggaggacaccggcgtgggcatggatgacgcggcgctggagcgcttcttcgagcccttcttcaccacctggagcgcccacggcggcacgggcctgggcctgccggtggtgaaggccattgtcgcggagcacggcggcgccgtgacggtgacgtcacgcccgggacagggcacgcacttcatcgtgcacattccttccgagaaggaagaaggaacgggggcggtatga

SEQ ID NO: 7331 - DNA, 1287 bp, Myxococcus xanthus
atgctgcgaacactcatcgcgttctgtgtccgaagccgcctgcccgtcctgttgctgacgctgggcatcggcctcttcggtgtgaaggcctatctcgaaacgcccgtggaggcgtttccggatgtcaccaacctccaagtgaatgtcatcgcgcagatgcctgggctggcgcccgaggaaatcgagcggcaggtgacggtgcccctggagcgtgtgctcaacggcacgccgggcatggtgcagatgcgcagcgagagcctcttcgggctgtcgctcatcttcctcaccttcgatgacggcgtggacccgttcaaggctcgcaccatcgtcggggagcgcatgtccaacgcggacatgccggacggcgcggacgtgcggctggcgcccgaggccacgccgctgggcaaaatctaccagttccgcgtgctgagcgaccggcacaccctcaccgagacgcgctcggagatggagtggaacatcgcgcggcacctgcgccaggtgcccggcgtggcggacgtgctcagcctgggcggcttcctcaaggagttccacgtccaggtggacccgtcgcggctgctcgcgcacgagctgacgctggcggacgtcaccgaggcgctggagcgctccaaccgcaacgtgggcggcggcttcttgcgccagggcgaccaggagttgctcatccgcggtgtcggctacctgcgcggcgcgcaggacgtgcagagcatcgtcctcaagagcgaggacggcacgccggtgacggtgggcgacgtggcgcgggtggtggcgtctcacacgccgcgtcgcggctcggtgagccacaacctggacatggacgtcaccgaaggcgtcgtcctgctgcgccggggagagaaccccagcacggtgctggagggcgtgcacgccaaggtggaggagctgaactcgcgggtgctgcccaggggcatgcgcatcgaggccttctatgaccggaacgacctggtggggcacacgctgtccacggtgcaccacaacctgctgcacggcgcgctgctggtggtggcggtggcatggctgttcttgcgcagcctgcgctgctcgctcatcgtcgcgtccgtcattcccctggcgctgctgacggccttcatcggcctgaagatggtgggcctgcccgcgaacctcatctccatgggcgccatcgacttcggcatcctggtggatggcgcggtggtgctggtggagaacgtgctgcacgaggcgggggtgcagcggccccggcggcgcaaggagatgtggggctcatcctgcgct

SEQ ID NO: 7332 - DNA, 1104 bp, Myxococcus xanthus
atgaacaggaccctgctccttggcctctgggccttctccgccgcctgctcgggcgcgggcaccccctccgcttccgctgagcgcgccgcgcccgcccccctgaaggaaggcgtggtgcagctcgccgaggcctcgcgggccttcatcaccgtcactccggtaaaggcggacgccagcagcgcggcgctccaggcccccgcgcgcgtggccttccgggacggggcgctgtcgcggctggtggcgcccctggcgggccgggtggtgagcgtccacgtgcgcacgggcgacacggtgaagccgggcgacgcgctggtgacgctggactgcccggaggccgcggcgtcgcgcacggcggtggccaccgcgacggcggcgctgcgcgaggcccagtccgccttcgagcgcgaggcgcgcatgttcgagcagggcgtcacgacggagcgtgagcgcctgtccgcggagacgcggctggcggaggcgcgggcggagctggcgcgggcgcaggcgtccgtgggcttcgtgggcacgggcagcggcaccaccgtggtgctgcgcgcgccgatggcgggcacggtgctgggccggagcgcggcggagggcatcgccgtgcagccgggcggggacgtgctggtggaggtgggggacccttcggcgctgtgggtgatggcggacgtgttcgagcgcgacctgccgctggtgcgtgagggcgcgcgggtaagggtgacgatgccgtcggtgcacgcgccgctggaggggaaggtggactcggtgggcgcggtggtggcgagcggctcgcggacggcgccggtgcgcatcaccctggacacgcaggagcagagcctgcggcccggcatgttcgggcgcgtgcgcatcgactcgccggacgccagcctgacgctgccggtggaggcggtgctgctgcgcaacggcaaggactcggtggtgtacgtgcagcaggacgcgggcaccttcgagcggcggcccgtcgtcgtggcgcagccggtggagggacgggtgcaggtcatcgcgggcctgtcaccgggggacccggtcgtcacccggggcgcgctgctgctggatggcgcggcggaccagctcctctag

SEQ ID NO: 7333 - DNA, 825 bp, Myxococcus xanthus
atgtccaatcccatcatcgaagcgctcgacgcggccatgattcccttccgtcgaacccatgcgggtgaggcgctcgcgcgtgtggaagaaaccctgctcatcaacacggggcgacagcccctcccaccgctgccggcgctgcaacgcccgtcattgttctacttcccgggtctgggcacgcgcggctggtactcggcctccgagtacccctcgctcgactccctggcccgcctcctgaaagaagccacgccgatgctgcgcgaggaattcctgacgcgcgcgcaccagggcgaactgctggcctacgaagagcagatgccgggccgcttccccaccctcgaccggcaggactgggggtcgctctatctgctcaaggagggcatgcggaacgagacgaattgcgaggcctgcccccgcagcgcggccttgatggagacgctctaccctcagttcagcccgagcggcgccttcttcttctccgtgatcggcccgggaacgaagattccgccgcaccacgacacgatgaacctgaagctcacgtgccacctgccgctcatcgttccgcccgactgccggatccgggtagacggtgagacgcgcgaatgggtggagggcgagtccctgttcttcgacgacaccttcctgcacgaggtgtggaacaacagcgaccggcctcgggtctgcctgctgctcgacatctggcaccccggcctcaccgccatcgagcgagaggccatcaccgcgctcggccgggtgatggggcagttcatcaaccagggatacacccctccctggtcgacgaatggccgaatcttcgagcactga

SEQ ID NO: 7334 - DNA, 357 bp, Myxococcus xanthus
cgagcgaagatggaagcgcgggagctctcccttcgctacggccccaagacggccatccacaaggtgtccctggccatcctcgaccggcgggtgacggcgctcatcggcccctccggctgtgggaagtccaccttcctgcgctccctcaaccggatgaacgacctcatctccggcaccacgcattcgggcaccatcctgctggacggcacggacatccatgaccgcggcgtggacgtggtggacctgcgccggcgcgtgggcatggtcttccagaagtccaaccccttccccaagagcatcttcgagaacgtggcctacggccctgcgcgtgggcgggatgaaggacaaaggcggagc

SEQ ID NO: 7335 - DNA, 420 bp, Myxococcus xanthus
atggcctgggcggggcaggtggcggatcgctacgaccggcggcggacggtcctgctgatggggccagggctggcggtgaccgcgcccaggtgggccggcatgcggctcgtgtgcgcccccttggtggtgggactggcgcaggtgggcctctcctattcgacctcgccgctgggggccgcggtcatgctggccatcagctccttcggcatcgccaccctggccgggctgacactgatgttcatccagctcacgtgtccccaggacctccaggggcggctgttgggccttcacaacatcctgttcgcggtcgtccctcccgcgggcatcgtcatgggcatgttgacccactatgtcgagctgcgcgtcagcatgcgcttcttcgggctgctgttcgccggggtttcgaccgcgtggttgctg

SEQ ID NO: 7336 - DNA, 312 bp, Myxococcus xanthus
atggccgggacggagggcgacgcgatgcccgagcccgtccacttccggctcaacgcgggcgtcagcctgatgctcatccccacgggcgggttcggctgggtggcgggcggcaaccgggtggcggagccgggcgtctccgagtgcatcctgggcctgtcgctggagacggaggcccaggtggacgcgctcattgcccgggcgcgggaggcgggggcggaggtcccggccccaccggggaagcagccctgggggtactcggggacgttcaaggacccggacggccacgtgtggatgctggacgtggcgggctga

SEQ ID NO: 7337 - DNA, 495 bp, Myxococcus xanthus
atgagcgccctcatgggcgtgggttgcaacggtgcccagccgcaggacccggcggccgaggccgaggtgattgccgagacggcggaagtgaagcagggcgctgtgggcgacgtggtgctgcgctgtgacgagttccagggcggcacgcacctggaggtcgtccagacggcgaccggcttcgaggccgcgtacgtctccgaggagtacgacccctgggattgtcgctgcacgtacacgaagcgcgagattctggggcagtacaaccagtgccgccggtccacggtggacccgcgcatcatgaactgctaccgcatcgagccgagcggcaccattggcaaggtggtgctgtccaccacgcgcgtgcagaagacgcagatggtcatcggcagcagcacgacggtgaactacagcgagctgagtgtcgcggccatcaaccaggatcccggccagacgccgcgccgtgactacgtcttcccgctgagcgactgccagtag

SEQ ID NO: 7338 - DNA, 570 bp, Myxococcus xanthus
ttggaagcgctcatgggttcgtttgtgttggtggccgccagtgagatgggggacaagacgcagttgctcgcgttctccctggccacgcggtttcgcaagccgtggcatgtgctggcgggcatcttcgtcgccaccgtcgccaatcacgcgctggcgtccagcgtgggcagttgggtgtccgcgcacgtgccggcgaagtggatggcgctgctcctggcggtgctcttcatcggcttcggtttgtggacgctcaagccggacacgctggatgaagacggaggcaagccgccgcgcttcggcgctttcctcaccacggtggtgctcttcttcctcgcggagatgggggacaagacgcagttggccaccatggccgtggccgcgcgttatcaggcgcccatcacggtgacgctgggcaccacggccgggatgatgctgtcggacggcctggctgtgttcctgggggaccggctcgccgggcgggtgcagatgagttgggtgcggtgggccgccgccagcctcttcttcatcttcggcgccctgtcgctgtggacggcgctccggatgtcctga

SEQ ID NO: 7339 - DNA, 5207 bp, Myxococcus xanthus; identical to SEQ ID NO: 699

SEQ ID NO: 7340 - DNA, 486 bp, Myxococcus xanthus
atgatcgcgaacgccgccttgaaagccaaccaggctgagttcgagttccaggcagggcccttcaccgccggagagctggccgtccttggctttgaagccgaggagacgctgtcccagccctacgcggtggaggtcgcactggccgcccggccggacgtggacgtggatgagaaggcgctgctgggccaggacgcgcggctcaccgtcatgctcggagacggcaccgcgcgcttcttccacggcatcgtgtcgcgcatgtcacggtgggatgaaggcaatggcccggagcgccgccgctaccgcgccaccgtggtgccgcggctgtggacgctgcgccaccgccgcaagagccgcatctaccaggagatgaccgtcccggacatcgtccacaaggtgctggatgaagccaaggtggagcaccggctggcgctcaccggcgagtaccccaagcgcgactactgcgtgcagtaccgcgagtccgacctc

SEQ ID NO: 7341 - DNA, 1005 bp, Myxococcus xanthus
gggagggcaactccctgtgcgcccttgctcgcgagatatgccgcgctgtgggcgcggcgcaatggccagcgggagctgtgggtgggagcaccggccgtgggccgcgagggcgccgagctggcggagacgatcgggtacttcgtcaacccgtcggtgctccggctggaactggatggtgggctctcgttccgcgcgttgatggcgcaagcgagccggaccgtccatgaggcgctcgagcacgcggccatgccgttcagcctcctcgtcgagcgtctggcccccctgcgccaggcgagccgctccccgctgttccagacgattttctccttccagcaatctccgccgcggagcgagaaaggactggcggccctggcccagggcacgggcggcgcgaggctctcgctcgcgggcgtggccatggagtccctggagttggagctcggaacggcccagctcgacctcgccctctccatcgctgaactcgacgggcgcttccacgtggcgctcgaatacaacgtggacctcttcgagcccgggacggccgagcggctgttgcggagatacgagtcgctgctgcgcagcgccgtggaccagcccgatgcgccgctggccgtgctgcaactcgaccccgcagaagaccgggcgcggttgctcgcctgggggcgggccctggagacgccgccgcccgcctgcatgcacacctggttcgaggcgagcgcgcggcactcgccggagacgggcaccatcctgtccggagagggctcgctgacgtatgggcagctggacgcccgggccaacgcgctggcctggcggttgcgccagctggtcttaagacccgacacccgcgtagtgctgtacctggaacgctcgatcgaccaactgataacggtgctagcgattctcacgcccggaggggcctacgtaccgctggaccctgaattcagcaacgcgcggtgcgcggacgttcttgtggagtctgaggcacggatcgccgtcacccgtgca

SEQ ID NO: 7342 - DNA, 561 bp, Myxococcus xanthus
gtgctctcagagggccgtttggagctgacaccactggtgagcctctcggtcaacgaccccttatattctaagggggggctgtatgtccggggcgcctactacctgggggacacgctggctgtgtgcgaccgggtctcgctgatgcaagtggtgccgtcggactacgggcgacaccgcaagcggaccttcaacaggaagatctactactcggtgccccagtgggacgggatgggcgacgcggagtggagacccatataccgaaaggtggcgttcctcaactccatcctccacttcgacggctacctgctagcgggcgcgggcgtggtgaatacggagacctcggcgctgccggggcgaggcctcaacccggccgctgacttgggcctgggcatgcgcttcgtggctcaggactacatcgccgtcaacgtggccctcatcaacacctcttatgtggatcagcccctgggtagcagcaagggcgccatccagaacgtcatgacgctcaacgcaggcatctcgctgttcctgccgttcaagtcgacggggagggactcggaatga

SEQ ID NO: 7343 - DNA, 771 bp, Myxococcus xanthus
atgaagcgtttcttccgtgtgctcctcgccctctgtctgacggcgcccgtgctgggcttcgcccagaccaccgaagaggcggaagccggcgacgtgtcggaggtcgacaaggaccggctcgggcccttgcgcgagcgcgtccggccggtctccggccacgtcttcctcaagaagggccgcttcgagttcagcccgtccgcgacgctgtcgctgcgcgacgcgttctacagcaagtacatcttcggcggcacgctgacgtaccaccccatggagacgttgggcgtcagcctgcgcgtgggctacgccatcaacacggtggccggcgcggcgcagaagtgcacgttcggggacggcggcgagggctccacgcgcggctgcgtgccgcccacgctcgacgagctggacgggaacgcgccggggcagatcaagctgctgggcggcgcggacgtccagtgggcgcccatctacggcaaggtgtcgctgctggctgagaccttcgtccacttcgacctgtacggcatcgcgggcgcctcggtggttcagtaccgcggccccggtgactcgctgggcgcggaggcgcagaactacctcacgccgggtgccaacctgggcgttggtgcgcgcttcttcctcaaccggtggatcacgctgcgcacggagctgcgtgacctcatctacgtggagaagggcaccgaggtctctggcaactacctgcgcaaccagctcctgttcgagctgggtgtctccttcttcttcgggtccgagtcatga

SEQ ID NO: 7344 - DNA, 1692 bp, Myxococcus xanthus
atgggcatgggcctggacctgacgcaggaggcgcccaagccggccgcgcccaccatgtccttcgacgcggtggacgtctccggcaagacggcggaccgccagcgcctggacgtggccgtcagcctcttcaagaacgacgagtacgaaaaggcctccatggcggcgcacgagctgctggaggatccgaagctggcgggcctgcacaccgaggcgcgctacgtgctggccaagtcgctctaccgcatgggcatgtaccactcgtccctgggcgagttctccaagatcctctccctgggcccgtccaccaagttcttcaagacgagcctggagtggctcttcttcatcagccgcaagacgaagaacgagacggtcatcctcgacgagattgcccgtcacgcgaaccaggagttccccgagaagtaccgcaacgagttccgctacctgctggcgcgctaccacttcgtgcgtggccgcgcgctggaccaggtggggcagcccgaggaagccgacaagagcttctcggaagtgaagcggctggcgctgaccattccgcgcaccgacccgttcttccctcgcgccaagtacctggagggcctgtccttcttccgtaacggcagccgtcagaaggacgcggcggccaagcgcgccaacggggagatgctggccgccatcgaggcgatgaaggaagtcgtccgcctcacgcgtccggcgccgggcaagacggcggaccaggcgaagctggacaagtcgctgcgtgagctggccttcatgcagctggcccgcacgcactacggcatgcagcagaaccgcttcgcgctcttctacctgggcaaggtcgagcgcggaaacacccagtggctggaggccctcttcgagtccagctgggccaactaccgcgtgggccagtacgagcaggcgctgggcagcctcatcaccctgtcgtcgcccttcttccgcgaggagtacttcccggaggcgctcatcctgaaggcggtcatctactacgagaactgccgctaccgggagtccaacatcatcctccaggacttcgagcgcacctacctgcccgtgcacgaccagttggaggcgctggtgaagaagaacatggaggccagcgagtactactcggtgctgtccgacgtgcagaagaagaacaaggacggcctggagaagaacgagacggacatcatcctggagcgcatcctccggctggccctgacggaccaggacctgcgcaagacgaacgactccatcctcgagctggaggcggagatggatgccttcgcgaaccgggcggacaccttcaagtactccgagctgagcaagtccctgctggaggggctcaaggtgcagcgcacggcgctcatctccaaggccggcatcatggccaagggcaagctggagacggagctggtggcgctcaaacagctcctggccaacggcctgcgcatcaagttcgagacgaccaccaaggagaaggagttcctggaggagcagctcaaggcgggcggccgcacggccatcgtcaagaagtacaagtactccgtcgccgtgcaggacgaccagctctactggccgtacgagggcgagtactggcgtgacgagctgggcacctaccagtacacgatgaccaagggctgcatcgagcgcgacaccgcgaaccggaaagtccagtccgccgaggcgatgtaa

SEQ ID NO: 7345 - DNA, 438 bp, Myxococcus xanthus
atgacgctcacgaccgccctgctcctgctcaccctcggcgccgcgccggcccagcccgccgcgaagaagttcgagttcgacaggcactacctcgtcctactcgagcgagtacctggcgccaagaagctgccggaggccgagctggcgcagctgcagaaagagcacctcgcgcacctcacgcgcatgggggagagcggcaagatggtgctcgcgggccccttcgatgagcaggacgacgtgggcatgcgcggcgcgtgcatctaccgcaccgccaccaaggcggaggcgaagcaactcgccgagcaggacccgatggtaaaggcgggccggctgaaggtgcaggtcatggcctggtacacggagaagggctacctggcgttccccaaggccccacccgtcgaggatgccaaggacgtggcaaaggacgcgggcaagtag

SEQ ID NO: 7346 - DNA, 1889 bp, Myxococcus xanthus
atggagcaaggtctcacgcgggtcgtggccgcgccgcgcctgtccgcggcggcgcggaagcgtcaactgcgggagaaggccgtcgcgggcttcatcaccctgatggcgttcacgggcatcgccgcgctcatcctcatcatcgtcttcgtggccaaggaggcgctgacgctcttcaccgacgcggacgcccgccacgaagccagcctggccaagatgttcctgccgcaggagggccgctacccgttccggtggcagcccgtgtcggacacgcccaaggtcagcatgattccgctgttcgtgggcacgctgaaaatcaccctggtctccatgctggtggcggtgcccatgggcgtcttcagcgcgctcttcgtcgcggagttcgccccgcgccgcctgcgcgagttgctcaagcccatcatcgaactgctggccggcatcccctcggtggtgctgggcttcttcgcgctgatggtgctgtccccggtggtgaaggacctgttccacctggaccggccgctcaacggcacgctggcggggctggcgctggcgctggccatcgtcccggtcatcttcaccgtatccgaggacgcgctcaccgcggtgccccgcagctaccgcgaggcctcgctggcgctgggcgccacgctctgggagacggcgtggaaggtggtgctgcccgcggcggcccccggcatcctcgccgcgtgcgtgctgggcttcggccgggccattggcgagacgatgattgtcctcatggcgtcaggcaacgcggacatcgtgtcctggaacctgggggactcggcgcgctcgctgtcggccaccatcgcggcggagatgggtgaagtggtggtgggcagcccgcactactccctgctcttcttcatcggcgtggagctgttcatcttcaccttcgtcctcaacatggtcgcctccacgtggacgaagaaggtcctccagcggctgaccgggagcgcctcgtgaagtacaccacgcgccgggcggtggggctgggcctcaccggactgacggccctcgcggccttcttcatcgtgggcatgttggccctcatcctgctgaacatcgcgcgcaacggcgcccgtcacctctcctggaccttcctcacccagccccccagcgacggcatgatgggcggcggcatcttccccgccatcttcggcaccgccgcgctcacgctcctgatgacgctggcggtgatgccggtaggtgtgctcaccgccgtgtacctccacgagtacgcgccgccggagtcacgcttcgcccgctgggtgcgcgtggcggtggtcaacctcgcgggcgtgccctccatcgtcttcggcctcttcgggctcggcttcttcatcctcttcgtcggcggcaacctggaccggatgctgggctatgaggagatgcactgggcccagccgggcatcctctgggcctcgctgacgctggcggtgctgacgctgccggtggtcatcgtctccacggaggaggcgctgcgcgcggtgccgctggagcagcgcaccgccagcctggcactgggcgccacccagtcgcagacgctggcgcgggtggtgctgcccggcgccctgcccggcatcctcaccggcgcggtgctggccatctcccgcggcgcgggcgaagtcgcccccatcctcttcaccggcgccgcctacttcctgccggacctgcccacgcacctggactcccagttcatgcacctgggctaccacacgtatgtcatggccacccagtcaccgaacgtgacggaggccagtggtccgctgtatgcgacggtgctggtgctgctggcgctcaccttcgccctcaacctcgtcgcggtcatcatccggacgcgcacgcgccgcaaggccgccagcgcccactga

SEQ ID NO: 7347 - DNA, 1068 bp, Myxococcus xanthus
ctggacctcatcgggttcggcatcctgattccccagttgggggtgtacggcgtgcggttcggtgcctcgcccttcacggtggggttgctcatctccgtcttctcgctgatgcagctggtgtcggccccgatactgggccggctcagcgaccggtacggccgccggccggtgctgctggtgagccaggtgggctcgctgctggcgtacctactgttcgccttcgcgcagtctctgccgctgctcttcctggcgcgtgtcatcgacggcatctccggtggcaacatctccaccgcacaggccgtggtggcggacatcaccacgccgaaggacagggcgcggggtatgggagtcattggcgcggccttcgggctgggcttcgtgctgggaccggcgctgggcggcttcctgggcgcctggggtggcaacctcgccatcggtctgttcgcggcggggctggtggccatcaacctgacgggcacgtacttctacctgccggagacgcgggtggaggggcgcccgggggaagggcacgcgcgcacgctgaagggcgccacgctggccatgagcctgcccgtggtggggcgctgcctggtgctgatgctggtgttcaccaccgccttcgcgcagatggaaggcaccttctccgtctacctgctgacgcgcttcctgtcgtccgggccggtgccgctccaggaaggcgggctgttcctccgggcggcggtgacggacctggacgtgctgcgcgaggccagcctgcgctccggttggctcttcgcggcgattggggtgatttccgcgggggtgcagggcggcctggttcgccggctgacgggtgggcccgggagcgcgccagggcgcgaggcgctgctggccacggtgggcttcggactgacggcggcggggctggccctgttgcccgtagcgccggattatgcgtggctgttcccggtgatggggttgttggcggtggggtcggcgctggtgacaccgtgtctgtccgccctggtatctctgcatgccccgccggagcggctgggggcggtgctgggggcgtaccaggccttcggc

SEQ ID NO: 7348 - DNA, 2661 bp, Myxococcus xanthus
ggaacggatgtggtgattcgtggccacgggttcgccatgggcgcgacggtgagcatcggggggacggccgcgacccacgtcaatcgcgtgtccgacaccgagcttcgcgcgaggacggcggcgcatggcgcgggcctcgtcgatgtcgtggtgacgaaccccaacacaccggcgatgacgctcgccaacgggttcacctacgccaccgtgacgagcattctccccgccgaaggccccgtcgctggcaacaccgtggtggtgatacgcggggacgccttcgcggacaccaccacggttgcgttcggagggacgcccgcggccgccgtcgcattccaatccgcgcaggagctccacgcgacaaccgccgcgggaatcgcgggcccggttgacgtggtggtgacgcgggcggtgggtggcgcggagcaggtcacccacgggttcgcgtttcgcgccgcgcccaccatcgcgagcgtggctccgccggccggccccgccgcgggagggacctccatcacgctcacggggaccggcttcgtcgacggcgcgaccgtcaccctcaacggcgtcaacgcgacccacgtccgggtgctgtcgccgacgacgctcaccgcgacgaccgcggcccagctccatggcacggtcaatgtgatggtgaccgtccacggcgtgcccagcgggacgctcgtcaacggcttcacctaccgtcaactgcccacgctcgccgccattacccccgcgcaaggagcgctcgaaggtggcagggcggtcgacatcaccggggcccggttcctggacggaatccaggtgcgcattggcggagtggactgcacggatgtcgccgtggtcaacgcgggtcttctccgggcgcgcgtacccgcgcacgtcgccggggcgtgtgacgtccaggtccagaacccgggcgaaccgctcagcctgcccttggcgaatgcgttcacctacgtggatgtccccactgagacgggagacaacgacgtcgtcttcctcatggacggagaggagtacttcgaggagttccgcctcaacctcgaagccgtgcgacaggcgccgcgacatgcgctcacgtacgttcgcctcgcgttctggatgattgaagcgtcagttaccatgggcgaccgggcccacttccgggtgcccaatcacaccctcctctcctatatcgaccgggtcatccgcgcggggcacgacttcgacatcatcgtctggcgcccggcgaaggtggaacgggtgagcgagggcaagggcgtcgccgaagtgaatgaggctttcgcgcaggccgtggcggaaatcgaccgcgccgcggccgccgcgggcccgggggtgggacgcgtccgcgtcttcctggagacctacgaaggggaaatcggggcctcgaaccaccagaagattgccatcttctccgtcgcggggcagcgaacggtgctcctcggaggcatcaacctttctccctcctacttcgcgcccaacgatcattcgaacaatcagacctggcacgacgccgccatccgtcttcgcggccccgcgacggatgacgttgaagccgagtggatgcgccggtggcggcgaacctcccaaatcgaggagcggtggatctggaacagctttggaggaggcggagacatcctggcgcgaggattcgcattcaacgcgagtcagacggttcgacgggaagccattcagattcaggagaaccggacgcttcaggccccccaggccgccaacatcaacgtgagcatcgccttgacgcgctcagagggaaagacgcgctatcgcaagctgcgcgacctgctcctggcgcgcatcgcggcggcggatcagtacatctacctggagaactaccacttcgcggatccagagattgttcgagccatctacacgcgccacgaagtccgccgacaggccggccaggagttgcgcgtcatcgtcatgatgcccacgggtggcggtgcccccggctatatgacgcgtcgctcgtggctccagattgtcctgcgactccgcagaccgaatgggacccactactgcagccgcgtctactacatggtgaacggcgtcgagcagcacatcgaccgggtcgactgtgtcacgtggaccgtggtggacacgtaccaggcgaacaacccgacggcctcgagctggttggaggccgacaccctcacgttccggagaaatggaggtgggggcatcgacaccgtggtcaagctcgaagacatctcgcgcgtggattgcgcgctccatatctacacgtgcatgaacgtcaccgccagggcgcgtatctacacgcactcgaaggtggcgatcatcgacaaccgttggctcatcgtgggctccgccaactggtcgtatcgcagcatgcaatacgacggggagatctccgcgttcatcgacaaccccgcgcttgcccagaacacgctccagcggctcctcggccactacgacacagccaccccgctcaccgtgaacaacatcgaggccgaggcctgcaccaacctggcgggggtattgggcacgaatctcgtgaggcaagccgccatcatcaatcactacgtcgtccttccactcgggcacaccacccaacccaacttcgggcttccacgcgtcaggcccggcctgatggaggtccccaactacacctggtattga

SEQ ID NO: 7349 - DNA, 1377 bp, Myxococcus xanthus
ctccagcaatggatggagctgtactcggtgcctgggctgagcatcgccgtcttcgacaagggcgcgctcgtctgggcgaagacctatggcgtgaagcagtccggcggcagcgagcccgtcgccatcgacacgctcttccaggcggcctccatcagcaagcccgtcacggcgctcgcggccatgcgccacgcggagaagcgcaagtggtcgctcgacgcggacatcaacgacacgctcatctcctggaaggtgccggagaacgacttcacgaaggagcagaaggtcaccctccgccggttgctcgcgcacaacgcgggcacgacggtgcacggcttcgcgggttacgcggagggagcggccgtgccgacgacgcagcagattctggacggcgccgctccggcgaacagcggcgccgtgagggtcgacaccgtgccggggacgcggacgcgctacagcggtggtggcacggtcgtcgtccagcagatgctcgtcgaccagctccagcagcccttcccgcgcatcatgaaggatgcggtcttcgccccgttgggcctcaaggacagcaccttcgagcagccgctccccaaggcgctggaagcccgcgccgccgtggggactcgttcaggtggcacgagcgtggagggacggtggcacacctacccggagatggcccccgcggggctgtggaccacgccttccgacctggcgcgcatcgccctggaggtctccaaggcccggaacggcaagtcccggcggattgtctccccggcgatggcgaggcagatgctcaccgctcagtcctcgaacttcggcattggcttcgcgcgcgaggagggcaaggcctggttcgggcacggcggcgccaacgcgggctaccgcgccttcctcatggccctggcggattcagggagcggaatcgccgtgatgacgaactcggacgacggctcgcgcctctttgacaggctgctcgccagcgcggtggcggagtatggctggaagggcatggaggaggcccggccggacagcccctccacgacggtggacctgctggtcaggctccagggcgtggactccgccctggcctggttcaaggaccgcaagcaggggcaggcgactgacgcccagttgtccccgggaatcctcaacgagattggctatgggttcttgcgccagaagaagctcgcggacgccgtgaaggtgttcgaggccaacgcggcgttctatcccgaggatgccaacgcccacgacagcctcggggaggcctacgccgaggcgggccgcaaggatgacgccgtcatgcgctacaagaaatcgctggaactcgaccccaagaacgccaacgcggtgaagatgctggagaagctgggcggccggtga

SEQ ID NO: 7350 - DNA, 1170 bp, Myxococcus xanthus
gcggtggagagtcccaaccagctcgaagaggtgctggtggacttctggttcaaccacttcaacgtgtcctcggacaaaggcgcggtgcggtggatggtgacggcctacgagcgcgatgccatccgcccgcatgtcttcggcaacttccgggagctgctgggcgccacggcccgccatccggcgatgctcttctacctggacaactggcgcagcgtccgtgacgggatgccggagcgcgtgtcacgcgagcccgaagcgccgaagcccggcctcaacgagaactacgcgcgcgaactgctggagttgcacacgttgggcgtggaggggggctacacgcagcaggacgtgcgcgaggtggcccgctgtttcacgggctggagcatccgcaagccgcgccaggagcctgcgttctacttccgtcgccgggcgcatgacccggacgacaagtgggtgctggggcagcgcatccccggtcagcggagcgtggcggatggggagcaggtgttggacctgctggcgcgacacccctccaccgcgcgccatgtcgcgagcaagctggcgcggcgcttcgtctcggacacgccgccgccggcgctggtggagcgggtggcgaaggtgttcctcgactcgggcggggacctgcccaccgtgtaccgcgcgctcttcctgtcgccggagttctgggccccggaggcgcgtgccgcgaaggtgaagacgcccttcgagttcgtggtgtcctcgctgcgggccaccgaagcggaggtgacggtgcgcccccggctggtgaagtccctggcgaagatgggcgagccgctcttccgggccccagcgcccacgggctttccggaaggggcagctccgtgggtgaacagcggctccctggtggcccggctcaacttcagcctggagctggtgtccgggcggatgccggggacgaaggtggcgttgaaggcgttggccacgccaaccgagcccaccgagcgcgcctgggtggactcgctgggccaggcgctgctgggcgcgcctccgtcggaggagacgcgagcgaccatcctcgacgcgctgtcgaagcgcgccgaggccgccagcgccgtgggagagacacgccccgtggacgtctcgctcatcgccgggttgttgctgggctcgccggagttccagaagcagtag

SEQ ID NO: 7351 - DNA, 5481 bp, Myxococcus xanthus
atggcaactgacggtggcaagggcgcggcgcccgcgggcgaggcggcgctggaaggcggcagctacgaggtcatccgttcgcggctcctgtcgcaggcggatgtgctgggcgcgaaggcgacggacctcaacgggcggcgcaaggcgctcttcggtgggaccgagctgacggtcatcggcaacgagcgggtgcgcaccgagaacaactgcgtcccgtgcgatatcgccagcgtcggcaagtacctgctcttcggctacaacgtcttcatcggcctgaagcgggagacgtcggtgtccgacgtgttctccctgcacaagttcgagaagacggccgacgggtacgacttctccgcggcgcccacctccgaggccggcgggttcctggcggacccgcgcttcgtgaaggacttcggcgagctctacaagtactacaaggacgcgaagctccttcagattcgcaagctggactcgcgcctgctggccgtcttccagacgggccagtcgctgcgcgacatcaaggtcttccgcttcagcctggacctggagggccgcgccacctacctggacaaccagggcgagcgcgaccacgtcttcccgccgtcgcacgacttcgagtggacggtggccacgcgggacaactacgtcaccggccagcacccgcacgtcaacgtgctggaccaggtgttcgtggagacggtgaagggcgacctcaccatcaaggtggaggacaacacctccaccggcatgggtatctacagcgagcccgtggacgacccggaccagtcgctggacgatgccgagttcgcctgggcccaggtgggcacgctcatcctgctgcgggtgctgccgttccgggagaagacgcaccgctacctcgtcttcaactcgcgcacgcagcacgtggtgcgcatcgatgccatggggcaggcgtgcgtgcggctgccggaggaccagggcatcgtcttcccgggcggctattacctccagacaggggacttcaaggtcttcgacggcgccgcggcgtcggaaggcatggagttcaagcgcgccatccgctcgcccaacggcgaggacgtgctctacatcttccaccggcggacggacggctgctacgtcctcttcccgtacaacctggtgcgcaaggaggtgcagaaccccctggtcgcgcacggcatgagcctgttctccgacgggcagctcgtcatcttccgctccgcgtcggatgagcccacgcgcgtccacccgatgcaggtgtggcagaccccgttcgtatccgccgagcacgcggcggggacgccgccggccccgggctacctgggcaaggtgggcaacgcggagctggtgcgcggcatctccgacgcgctgacgattcagcggatcgcgaagtcggagaagcccacccggcgcacgtatgaggacctggtgtcctcggccacccgcgcgctggacgcgtactactggctgggccatgaggagacgggcctccaggaaccggtggagaccctgcggcgcaccgccgagctcatcattgatgagttcgagaaggtggtcgcgatgcagaagcgcgccaccgagtcgctggcggccgcggaggtggagcaggagacgctgctgctgcgtgtccagccggagaacctcacgcacgcggaagccttcatgcaggcgctggcggacctgcgcaagcagcgcgggcacctgattacgttgaaggacatccgctacatggacctgggacgcgtggaagtcctggagaccccggtggtggaggggtccctccgggtcagatcggcctgcgtggagttcctccatacggttgaggagctgcctctcctggcctcgcgtgtggaccatctgctggcacaactggagccggtgcacacgtcggtgcagctggggccactgggtgaggaagtggagcggacggcccgcgccctgtaggtcctggtcgaggtcgtagccggtctccaggtcggtgacccgctggcccgtgcgcgaatcctggagggcatctccgagctgttcagccgcctcaaccgcgtgcgcgccagcctcgcggccaagcgcaaggagctgtccggccgggagaagcgcgcggagttcggcgcgcagttcaagctgctggggcagagcatcgaaagctcgctgtcgcaggcggacagcccggagcgctgcgacgaggcgatgtcccgcctcaccgtgcagttggaggagctggagggccgcttcggcgagttcgacgagttcctggagcagatcacccagaagcgcgaggagctgctggaggcctttggcgcgcgcaagcagtcactgttggacgagcggcagcgccgcgcgcagagcctcttcggggccgcggagcgcatcctccagggcgtgcagcgccgggccaagtccttcaagacggacgacgagctcaacggctactacgcctccgacgcgatgatcctcaagctgcgccagctggccgaccagctgatggagcttcaggacagcgtccgcgcggacgaggtgatgtcgcgcgtgaagtccgccaagcaggacgcgctgcgcgccctacgggaccggcaggacctgttcgcggatggcgacaacgtcatcaagctggggacgtaccgcttcaacgtcaacacgcagccgctggacctgacgctgcttccgcgcgacggtgagctgtacctccagctcaccggcacggactacgcgcagaaggtggatgatgcggagttgctgaagtaccgcgacctctgggagcagcacctggtctccgagtcaccggctgtctaccgcgccgagtacctcgcgggctgcctcttggcggacgcggaggatggcaagcgtggccagtcgctggatgcgctgcacgaggcgctcatcagcggcacgctgctggagaaggtgcgcgcgtacgcggccgaccgcttcgacgagggctacgagcgcggcgtccatgacgcggacgcggtctccatcctggagaagttgctgggcctgcaccagggcgccggcctgttgcgcttcgcgccggtgccgcgcgcctgggcggcgctgtactgggccttcgacgcggacgaggcggcccgcaccgtgttccagcggcgcgcgcgcagcctggcgcggctgcgcaccaccttcgcgtccggcggcagcatggccgaggtgggtgaggcactgggcgagcgcatcgctacgttcctcactgcgaacggcctggcgcactcaccggccgagccgcggcaggcgggccgttacctcgtcgaggagctgggcgcggagcgtccgcgcttcaccaccagcggcgaggcggtggcgctgcgggacgcgttcctgcatgagctcgaccggcacgggacgcggtccgcgttcgaggacgacctgcgcggcctggagaaggacctgggcgcccggctggatctcgcccgggtgtggctggacggctacctcgcgcagcgcgaggggggtccgggggattccgtccatgtggcgctggagacggcggtgctgctgctcaccggctccaagctggaccgcgagacggcgggcgcgctgacggccaccgaggtctccgcgctgctgggcaatcattcgcgcatccaggaccggaagctgccgctgcgcctggacgagttcctggcgcgcctgggcgagttccggcaggtgcgggtgccccagtaccaggcgtaccgtgcgctgctgagggacttgctggagcgcgagcgccgcaagctgcgcctggaggagctgacgccgaaggtgctgtcgtccttcgtgcgcaaccggctcatcgacgaggtgtacctgccgctcattggcgccaacctggcgaagcagctgggcgcggcgggcgagggcaagcgcacggaccgcatgggcatgctgctgctcatgtcgcccccgggctacggcaagacgacgctgatggagtacgtcgccagccgcctggggctcaccttcgtgaaggtgaacggcccggcgctgggtcactccgtgaagtcgctggacccggccgaggcgccgaacgccacgtcccggcaggaggtggagcgcatcaacctgtccttcgagatgggcaacaacgtgatgctctacctcgacgacatccagcacacggacccggagctgctccagaagttcatctccctgtgcgacggccagcgccgcgtggaaggcgtgtggaacggccggacgcgcacctatgacttgcgcggcaagaagttctgcgtggtcatggccggcaacccgtacacggagacgggtgagcgcttccgcatcccggacatgctcgccaaccgcgcggacacctacaacctgggtgacatcctcgacggcaaggagcacctgttcgcgctcagctacatcgagaacgcgctcacgtcgaacacggtgacggcgccgctggccacgcgcgacccggcggacacgcaccgcctcattcgcatggcgcagggcgaggaggtccagacgggcgagctgaagcacggctacgcggcggcggagctccaggaaatcatcgcggtgttccagcgcatgttccgggcccagtcggtgctgctgaaggtgaacctgcagtacatcgcctcggcggcgcaggacgagcgcttccgctccgagcccgcgttcaagttgcagggcagctaccgcaacatgaacaagctgacggagaagattgtctccgcgatgaccgacgacgaactcgagcggctcatcgacgaccactaccaaggcgagtcccagacgctgacgacggcggcggagcagaacctgctcaagctggcggagatgcgcgggcgcctgacgccggagaaggcgaagcgctgggaggacatcaagcagggcttcgcgcgcgtgaagcgcatgggcggcaaggacgacgaccccgtggcccgcgtcaccggtcagctcagtggcatcgaggagcaactgggcgcggtgcgggacgcggtggtgcaggcggccaaccacgtctccgccagccaggcgcgtgacgagcagccggggcccgtggtggaggtgctgcctcgcctggagtccctgcgcgaggccgtgctggaggtggcccaggtgggccgcgagtccgtgaaggccgcgaaggccatcccggcgcccgtggtcgccgcgcccgtggccgcggggccggacctgacgccgtacctcaagcacatggcgcacctgctcaaggcgctgacggagcgggtggcggcgcagtcggagcgtccgccggagcctccggcggagtccgcgcccaccgtgcggatggcggcactggcgccttcgcctgacttcggtgcgtacatggagcagctctctcgtgccatcaccgcgctggcggagccgtctgtgaacgtgttctccaacgagcccgttgtggccttgcagcgcaccgcgctcgcggggccgtcacccgccgagcttgaccgtcaaatcgagctggtggaaggcgtgctgcttcccctggatcgcgccttgcgcccggccattcagggc

SEQ ID NO: 7352 - DNA, 777 bp, Myxococcus xanthus
gcgcaggcgcaggagaagctcggcatggtcaacgtccgcgtgaaggaagccgaggcgggcgccatcgagaagcagggccacgcggaggcgaacatcgtccgcgagaagctgctggcggaggccgcgggtgcgcaggagaagggcctggctcaggcgcgcgtgctggaggcggaagccagcgccatccagaagcgcggcgaggcggaggccattgccacgcgcgagaagcagctggccgaggccgctgccatccaggagaagctgctggccgaggcccgcggtctggcggagaaggccgcgtccatgaagctgatggacggcgtcggccgcgagcacgaggagttccgcctcaagctcaacaaggagcgcgacgtggagctggaggccatccgcgcgaagaaggacatcgcgcacgcgcaggccgaggtgctggccaaggcgttcgccaacgcgaagttcaacatcgtcggtggcgacggccagttcttcgagcgcttcgtcaaggcggtgtcgttcggcacggcggtggacggcgcgctggaccacggcgaggcgctgaagacggcgctgggcggctacctcaacggcgagaaggacctgccggccgacctgaaggagattctctccaagccgggtctgagcaacgacgcgcagaacctggccgtggccgcgctgctgcacaagatggcggccagccccgtggccgcgacctcggccggcctcaaggcgctggtggaagacgtggcgcggccgggcacggtcgacaagcagggctga

SEQ ID NO: 7353 - DNA, 159 bp, Myxococcus xanthus
atgcgtcgcgaccgccgccgtgcggccaacaacaacctgcggagcgccgtgcaggtgaccaagtgcccgaactgcaaggagccggtgatgcctcaccgcgcctgcacgtcctgtggccagtacaagggccgtgaagtggtcgctcaggccgaggcctga

SEQ ID NO: 7354 - DNA, 327 bp, Myxococcus xanthus
atgcacgcacatggctggcggttgcgcgggtgggccctcatcctggtgctgggcctgggtgcccgaccgggctggagccggcccctcttccctgagcctgttctctcgcagctcggcccggccagcccggccatcaccgaggcccgcgagcagttcgaccagggcgaattcgaagacgcacgtcgcaccatcctggaaggcctggatgcgccggacctgacggatgatcagttggtggagatgtaccgcctgatgggcctcacggccctctacctgggggacgagccccaggcgcgcgacgcctgggagaagctgctccagacccgg

SEQ ID NO: 7355 - DNA, 243 bp, Myxococcus xanthus
atgtcgacgtcaaccattgaggccaaggtcaagtccatcatcgccgaccagctcggtgtcggagaggatgagatcaagccggagtcctccttcatcgaggacctcggcgcggacagcctcgacatcgtggagctcgtcatggcgatggaagaggagttcgaggtcgagattcccgacgaagaggcggagaacatcaagaccgtcaacgacgccgtcagctacatcaacacccacaagaagtag

SEQ ID NO: 7356 - DNA, 750 bp, Myxococcus xanthus
atgagcggcttcaaggacaaggtcgtgctcgtgacgggtggctcgcgcggcatcggccgggcgtgcgcggtggccttcgccaaggcgggggcctccaccgtggtcatcagctatgcgggcaacgaggcggcggcccaggagacggtggccctgctccaggcggagggcgccaaggcggaggccatccgcttcgacgtgtccgacagcgccgcctgcgccagcgccgtggacggcatcgtcaagggccacggccggctggacgtgctcgtcaacaacgcgggcgtcgcggtggacggcctggtgatgcgggtgaaggacgaggactgggacaagcagttggacaccaacctcaagggcgccttctcgctcatccgcgccgtcagccggcccatgatgaagcagaagggcggcgccatcatcaacatcacctccgtggtgggggagatgggcaacggcggtcaggcggcctactcggcgtccaaggcggggctcatcggcctgaccaagtccgtggcgcgcgagctgtccagccggaacatccgcgtcaacgccgtgtcccccggcttcatcgggacggacatgacgcatcagatcaatgacgagatgcgccagaagatgctggagggcatccccctgggtcggttgggcaatccggaggaggtcgccggcgccgtgctcttcctggcgggggacgccgcgtcctacatcaccggcgaggtcctgaaggtcaacggcggaatgtacatgtaa

SEQ ID NO: 7357 - DNA, 942 bp, Myxococcus xanthus
atgtcgaaggtcgcgttcgtgttccccgggcaaggcagccaggccgtggggatgggcaaggacctgtatgagaagttccccgaggcccgggccgtgttcgacgcggttgatgccgccctgggggagaagctctccaccctctgtttcgagggcccggacgaggcgctgaagctcacggccaacacccagccggccatcctcacggtgtcgctggcggcgcacgcggtgttcgcgaagcggggaccggcgccgtccttcgtggcggggcactcgctgggcgagtactcggcgctggtggcggcgggcgccatggacctgggcgacgcggtccgggtggtgcgcgcgcgcggcaccttcatgcaggaggcggtgcccgcgggcgtgggcgccatggccgcggtgctgggcctggttccggagaaggtgaaggcaccctgtgacgcggcggccgaggggcaggtggtgtcgccggcgaactacaactcgcccgagcagacggtcatcgccggtgacgcggcggccgtggagcgcgccggggtgaagtgcaaggaggccggcgccaagcgcgtgatgcccctgccggtatccgcccccttccactgcgcgctgatggcgccggtgcagccccggctggcggaggtgctgggcggcatccaggtgtccgcgccgtccgtgccggtggtgaccaacgtggaggcccgtcccaacgcggacgcgtcgcgggtggtgccgctgctcctggagcaggtgagctcgccggtgcgctggattgagtgcgtggaggcgctgaaggccgaaggcgtcacccgcatcatcgagctggggccgggcaaggtgctggtgggcctggtcaagcgcatcaccaaggacatcgagctgttcaacgtcgaggactccgcgagcctggacaaggcgctcgcggcactgggggtggcagcatga

SEQ ID NO: 7358 - DNA, 1062 bp, Myxococcus xanthus
atgaggctggtgctggatgccatgggcggcgatcacgcgcccgccgcccccgtggagggtggggtgctcttcgcgcgggcccaccccggccatgaggtgctcctggtgggggacgaggcgaaggtggcgcccctgctgggcaagctgcggcctccgtccaacctccaggtccaccacgcctctgaagtcgtggagatggacgagcacgcctcgaccgccttccgccgcaagcgggactcctccctccgggtgggcttcgaactggtgcgggacggccgggcggaggcgctcgtctcagcgggcaactctggcgccgtcatggccgggggcctgctcacgctgggacggctgccgggcgtggagcgtcccgccatcgccgcgctctttcccgcgctgaagggcggcggccggtgcctgctcctggatgcgggcgccaacgtggactgcaagccgacgcacctggcccagttcgccgtcatgggggaggcctacgtgcgcgcgcgcatgggcgtggcccggccccgggtggccgtgctctccaatggagaggagtcctccaaggggacgccgctcacccgggaggccagtgggctgctgcggcgctcggatctggacttcgtgggttacgtggagggcaaggacctcttctccggcgaggtgcaggtggtggtgacggacgggttcaccggaaacgtcgtcctgaagacatccgagggcgtgggcatgggcgtcattggcatgctgcgtcaggccatcgaacggcgcggcgggctggcggagaaggtgggggcgatgctgctccagcccgcgctggccgggcttcgccgggtggtggactacgccgagtacggcggggcgcccctgctgggcatccagggggtgggcatcgtcgcgcatgggcgctccacgccccgggccctcttcaacgcgctgggcgcggcgctggccatggcggaggggggcgtgcaggcggagttgacgcgttgcattgggcgcgcggcggcgtggcttccgacccatccgaagggaaaaagagcgacagacgcgggcgtttccgattag

SEQ ID NO: 7359 - DNA, 477 bp, Myxococcus xanthus
gccccggcgacgttgaaggcgtcgctgcgcaagctgagcggcggcgtgctgctggaggggcgcttcacggtggacgtcaccagcccctgtaagcgctgcctcgccgacgtggccatgaaggtccccgtggagttcacgctcaacctggtgccggagtccctggctcggggcgacgacttcaaggatgacgacgagaaggccatggagaagaaggagcgcagccagggtgagtctggcggctccttcgaactggacgacgtggatcaggagctcttcgacgggaagaccatcaacctggaccccatcgtccgggagcagctcctgctggccctgccgatgaacgccgtgtgccgggacgactgcaagggcctgtgctcgcagtgcggcgcgaaccgcaacgaggtcgcctgcacctgtgagacccggcccgtggacccgcggctggcgccgctgaagaacatcaagctcaacaactga

SEQ ID NO: 7360 - DNA, 378 bp, Myxococcus xanthus
atgggcctggtgcccttcgcgctgatgatggcgaccagcttcgtgaagatttcggtggtgctctccatcgtccgctcggcgctgggcacgcagcagattccgcccacccaggtcatcaccggcctggccatcatcctcaccgtctacatcatggccccggtgggccagcagatgtaccgcgcggccggcctggacatctgggccaagggccccggcgtgttctcctcggagacggtgggctcgatgctgggcgccgccaacaagtccaaggagccgctgcgcgagtggctcatcaagaaggtcaccaccaaggaccgggcgctcttcttcaacctcgccaagaagatgcgcaaggctttagagcacactggaagtcgt

SEQ ID NO: 7361 - DNA, 687 bp, Myxococcus xanthus
atgcgcctgttgcttggtgccgcgctggtgttcgcgccgcccgccgccatggcccaggctccgtccacgtccgcacccaccgtgaagccggtggtgccccccgcggagtctgccccgcctccggcacctgcggttgcttcgcccgcgacgccagcaccggccgctgagaaggcggaccccaaggccgacgtcgagttgttggaagcggaccgggccctggacgcggagttgtctgctcgcgagtccgcgaagtcggcccggagcggcgcgggcggggacaccctgtcggagtccgaggaaacggacagcctgggctggacgctggtgcgcacgctgctcgtgctgggcgtggtggttgcgtccatctacctcacgctgaatgtgggactgcgcaagctgatggggctccaggggacggccgcgggccgtcagcccctggtctccgtggtggagcggctgcccctggaccagcgccgcagcctcttcgtggtgaaggccgcggacgaatacctgctgttgggcggcggcgagggcggcttgcaactgttgtcgaagctggatgtggaggcggtggagcgcatccgcgcgcagcgcccgcagacgaatgcagttccactgagcccattcctccagaagctcctctcccgccgcagtggtggcccgccttcccagccccccggctcctga

SEQ ID NO: 7362 - DNA, 1404 bp, Myxococcus xanthus
atgagtctcgaatccgaggacgaaggatcgggcgtccacgagcgcacgatgctggtggacctgagccagctccggccttcgcgccaggcgcctccgcaggagtccccggcatcccaggagccacccgccagccaggagcaacgctggcggcccttcgctttccggaacctggagaaggtctcccgggcccagggactgctcgcggagcgcttgcggtggctgacgcccgcggacggcacggcggtggccgtggcggctcggctcacggagttgttcgacgcggaggtgcgcctgacggtggagtccgtccaggtgcggcccatggcggagctgcggcgcttcctgggcgacccgaccttcctggcggtgctcgcgcccggggcgctccagggccgggcggtgctggaggtggagctcgcgctggcgcacgtggcggtggacctgctgctgggcggcgccggtgagacggtgggcctgcggccgctgacggacatcgaggagggcgtgatggcctacgtcgtcctcgaggggctcaagctgctggtgccggggctgcaggcggcggtgccgcgcccccggttggacggcgtggcgcggggcgtggacgaggtctccgcgcggctgggggatgatggccccatgctggcggtccacctgcaagcgacgctggggccgcacagcggcatggtgcggctggtggtgcccgcggcggtgctggacgcggcagagccggcggtggagagcacgcagcggcgggcccgggggaaggcggacctggaggccttcgcgagccgcctgtcggcggtgcgcagttggcttcgcgcggagattggctcggcggagatttccggccaggacctggcgagcctgcgggtgaaggacgtgctgctggtggacgcgttgtcggcgcgcacggacaagggcgaggcgggcaccgcgcggctgcgggtggggaaggggacggcggggtgggccgaggcggaggtgttcgtcggcgaggacgggcgctaccaggcgcgcatcaccgatttcgttcaaggagagccgggccacccgggctccgcggacgaggcgagcgcggagcctggggatgaagaagaggacttcacgaacccggagctggacgtgcctccggaactggaaggggcggccttggacgatgtgagcaagccggacggaagcgacctgctcggagacgtgcccctgcagattgcggtggagctggcgcgcgtgcccgtcaccgcgcagcaggtggtggggctgcgcaccggtcaggtcctcgagctgaaccgggggccgggagagccggtggagctgtccgtcaacggcaaggtggtggcccggggtgagctggtggagttggaaggccagctcggcgtgcgcatcatcaccctggcgagctga

SEQ ID NO: 7363 - DNA, 333 bp, Myxococcus xanthus
atggcgccggtgcccgtggccaagcccaagggcaccgcgggctcggagcgcctgcgggccctggccaccgagattgcgcagaagattgtcgaccgcgtccgcgtgggcacgaacgccgcgggcaacgcggagttccagatcgacctgcggggcgacgtgctcagcggtctgtccatcaaggtcagcgcccggaacgggaagatttcggccaccttcagcggcagcaaccgcgaggtgctcaagcaactcgagggggccagcgagggactgcggtccgcgctcagtggccgtgggctccggcttgaagacgtccgcttcgaggcgaaggcatga

SEQ ID NO: 7364 - DNA, 489 bp, Myxococcus xanthus
atgcccccgtaccggttgcaggccctgcaggacatgcgcgcccgggccaaggaagaggcggagcaggccttttcctccgccatcaaggcgctggagaaggagaaggcggagctccagcgtctcatcgacgacctggagcagcgcaagcgcgagcgcaaggcgaaggtggccgcctacctgaaggaggtcatgttcaagggggccggcatcaacggcatgaacatgatgaaccgcttcgaggagcgcctgaaggacgaagaggcgcaggtggcgctggaggtggagcgccagcgggaggccgtcaaggtggccgaacggctggtggagcagcgccggcgggagatggccgaggcggcgaaggaactgaaggccatcgagaagcaccgagagaactggcagaagcaggtgaagtacgagcgacagcagcgtgaggaactgaaccaggaggagattggcaacgccttgttcctggcgcgccagcgcaagtag

SEQ ID NO: 7365 - DNA, 822 bp, Myxococcus xanthus
atgaaatcgctcctcaagcccctgctcgcggtgttcctcctggcgctccccgccgttgcccaggcgggcaccgtgaccatcaagggctccgacaccatggtcatcctcggccagcgctgggccgaggcgttcatgaagaagaaccccaacatcaaggtccaggtcaccggcggcggctccggcgtgggcctggcggcgctccagaacggcaccacggacatcgccatgtccagccgggagatgaagaaggcggaggccgacaagctccgcgcgcgctacaaggcgccgcccgcgcagcgctcggtggccaaggacggcgtcaccttctacgtccaccagggcaaccccgtgagcgcgctcaccaccgagcagctgatgaagatctacgtgggcgacatcacctcctggaagcaggtgggcggcgcggacgcgcccatcgtcgcgtactcccgggagaactcctccggcacctacgtcttcgtgaaggacatggtgctggacggcgaggacttcgcgcccgccatccagacactgcccggcaccgccgcggtggtgaacgcggtctccaaggagaagaacagcctgggctacggcggcgccgcgtacgcagagggcatcaaggagctgaaggtgaagaagggcaacgaggagatcgcccccagcgcggacaacatcaagagcggcaagtacccgctggcgcgcgacctcttcttctacctgcgcgccgagccgaccggcgacatcaaggccttcatcgacttcgcgctctcccccgaaggtcaggcgatcgtcacccaggtcggctacttccccgtgaagtag

SEQ ID NO: 7366 - DNA, 840 bp, Myxococcus xanthus
gctctacagcggggcctcttcgccggctccggcgtcggcaagtccacgctgatggggcagattgcccggaacaccaaagcggacctctgtgtggtggcgctcatcggcgagcgtggccgcgaagtccgtgagttcatcgaagacgccatgggcgaggagggcatgaagcgctccgtgctggtgtgcgccacctccgaccagcccagcctcgtgcgtctgcgcgcggcctatgtcgccaccgccatcgccgagtacttccgcgagcgcggcggcaacgtgctcttcatgctggatacggtgacgcgtctggcacgtgcccagcgtgagattggcctcgccgtgggtgagcccccggcccgtcaaggctacccgccgagcgtgttctccatgctgccgcgcatcctggagcgcacgggcaactcggagaagggcaagtgcaccgccatctacacctgcctcgtggccggcggtgacatggaagagcccatcgccgacgaggtccgcggtattctcgacggccacttcatcctcaaccgtgccctgggtgagcgcaaccagtggcccgcgatggacgtgctcgccagcctcagccgtgtgatgagcggcatcgtctccaaggaccacaagaaggcggcgggacggctccgagagctgctctccacgtatgagaagcagcgcgacctcatcctcctgggggcctaccagtacgggacggatccccgcacggatcaggccatcgacaagtacgacgccatcatcgacttcctcaagcaggacacccactccaactccgggttcgaggagacggtggagcagctgatcgccctgttcgacgagtaa

SEQ ID NO: 7367 - DNA, 1389 bp, Myxococcus xanthus
cgaaaccagttctggtgcaccgtcaaggtgagcgagtgcggccgcttcgccgtgctcgcgaagtgggactacgtccacgccaacgtcatcaccctgctgcgcctcgcggatgatgcgcgcatccctgtggcaacagccatgacctccctcaatcaggtgcaggtcatcggggagtccctgctcatccataccgacctcgacgcaccacgaggcaggctctgcaccgcgccgctgacggcgcccacccagtggcggacgctcatcccggaaagcgagcacacccttcagactgtcgcaggcgtcggcggccggctctacgccgtctattcacgcgcggcgtcgcaccacgtgcgcatccacgccgaggacggcacctggctgcgcgacctgaagctcccagccctgggcgccgtaaatcgcaacgaaggagagggaatcgtcagcggcgtcagtggcccatggcggggcgacgaggtgtgggtgaacttcatgtcgtacgtgcaggccccctctgtctatcgctacgactacgacgcagacctgctgacgccgtaccacgtccctgacgtcgggctcgatgcgtccgagtacgtgacggagcaggtctggtatccgtcgctcgacggcacccgggtctccatgttcctcgtccaccggaaggacctgccgcgcgacggacagtggcccgtgaggctgagtggctacggcggcttcaacatctccgtggagccgcgcttcacgtcgctccaagccgcctggctgaagtggggcggcgtgctggccttcgccaacgtccggggcggcggagagtacggccgcgcctggcacgaggcggccctcaagacacgccggcagaacgccttcgacgacttcatcgcggcggcgcgctggctcgtctcggagggctacacggtgcctgcccggctggcctcgcgaggaaacagcaatggtgggctgctggtcgccgtcaccgccatgcaggcccccgcgtcctttggtgccgtcttctgccgcgcgcccacgctcgacatgctgcgcttcccgagcttcggctacctgagctcggccaccgtcgaatacggctcacccgaggacccggttgagggtgcctacctcgcggggtactcgccctaccacaatgtcagagccgggctccgttacccccggatggccttcgtcgccgcgctgaacgaccggaccgccccaccccacgacccgctgaagatggtcgccagacttcaggcagaaggcacgcagggcgggccctttctcctgctcccgcttcgcgactccgggcatgggggcggcaccaccctgacggcgctcatcgagcaggacgtcgacgagctctgcttctactgtggggcgctcggcgtctcaccgggctga

SEQ ID NO: 7368 - DNA, 1026 bp, Myxococcus xanthus
acccaacggagcgtggtccagctcgtgggatgcgtgggcgcctatgtcctgctcgcgggggccagctatgtcttcttcgcccaaagcctggtgggcggcgtggcgctggcggtgctcgcgggcgtcgtgctcgtccgggtcttcatcctccagcacgactgtgcccaccgctcgctgttccagcgtccggtgacgaatgaccgggtgggcgtggtgctgggcatgctgacgctggcgccgcacgcgtactggcgggccatgcacctggtccaccacagcaccagcggagacctcgaccggcgcggcgtgggcgacatcgtgacgatgacggcccaggagtacctggcgctcaaaccctcccagcgccttcgctaccggctgtaccggcaccccgcggtcctcctgggcgtggggcccatcttccagttcctgctgcgcttccgcatgccgggcatcgtcgccaaggagcgcaggcccgagcgccgctccatcctggtgacgaacctggcgctggtggccgtccacctcgcgttcctggcgctgggtgactggccccggtggctggtggtgcacctcatcatcacccaggtggccgcgggcctgggcatctggctcttcttcgtgcagcaccaggtggagcggccctactgggttccgcgggcgcagtggtccctcaagggctcggcgctccagggcagcagtcacctggtgcttccacgcgccttcgagtggctctttggcgccatcaacctgcaccacgtccatcacctgaagccccagattcccaactacctgctgcgcggctacatggagcagcacggcctggccgaagagggcgtgaagctgggtctgcgcgactcggtgcgcgccttccgcctcaaggtgtacgacgaggccaccggcaggatgacgggctttccccctgtccacgcgggccaggccaggacaccgctggcctccccgccctccatcgagccgacaggtcagctgggccgagtgctgaccttctccggcgaggaacgctga

SEQ ID NO: 7369 - DNA, 723 bp, Myxococcus xanthus
atgcctgattacgtccatgtcctcctcggactcgtgctggggtacgtcatctcctcgtacgtcgagtccttcatgcacgagtacgtgtccgacgggcgtccgaagacggtgcgtttccgtcgccgcgctcccagggtgttccgcccgataatcaacaagcacttctcccaccacaccatccaccacgtgaggactttccggagcaaccacgtgacgcagttccggagcgaggaggagaagcagaagctcaccgaggagctgctccagcgaggcaagcacggccggaccatcatcaacggtgcctttgccacccggctgcacggagagggcgccttcgtcttcgtggccccgctggtcatcttcttcccggtgttctacttcacgctcaagcccatcgccttcctggccggctgcgtgacgctgctgctgccgcccttcatgagccacttcgtccacccgtacctgcacatgcccttcgaggaaggacagcgcacggcgccccggtggctggcgtggctgctgcggacccgctacatgcgcgccgtctatcgcaaccacttcctgcaccaccgctatggcggcgtgtccaacttcaatctggtgctgggggcggacatcgtgcggcggcgcacccgcgtgctgacggagaaggacctgagcgtcatggccgaggtgggcatgccgctgcccgaagaggccccgacgcggaccgtccatggctga

SEQ ID NO: 7370 - DNA, 1056 bp, Myxococcus xanthus
ttccacgtcccctggtggctgcgcttctcccacgtgcagaccgtggtcccccacctggaccggcgccgccacgacgtgctcaccgagcacatccgtcacgagctggcggacggtgacttcgtggacgtgtactggctgaaccggacgcggccagggcccttgctcatcctgctgcccggcatgcagggcacgcaggactccacctacgtccgcagcctgctgtcggagctgtccccgcgcggcctgcgcgcggcggtcttgtgccaccggggcggcgccgtgcccaaccggcgggcccccttctatcacgcgggattcaccgaccacctggcctggctggtgcgcttcgtccgtgagcaggagccccacacgccactctatggcgtgggcttctccctgggcggcagcatgctgattcgctacctggcggagacaggccacgccagccacctgtccgccgcggcggccgtgtccctgacgttctccctgggcagcacggcccggcgggcctgcgaaggcatcaaccagctctaccagctccgcgtgttgaactcgtacaagcgcgtcgcgcggctcaaggcccacctgccggagttcgcctcacgcgttgggacgctgaatgggatgcgcagcatccaggccttcgacgaggtcttcaccgcgccccttcacggcttcaaggacgcggaggactactacgagcggtgcagcagccagcaattcctgccgggcatcgaggtgcccttcctcgtcctcaacgccgaggacgacccgctcgtcgcccgggacacgctccccgacgcacgcgcgctgcgggagcacgtgcggctggagctgacgccgcatggcgggcacctgggtttcatgtatcagcgttcctccgggctgggttactacccgccggcccggctcatctcgttcttcctgcaggagccgtccgaagcacatgaatctctatctcaggatgttgtgggtcatgctctcctcgctctggaagccggagatgcgcgtggacgcgctgacgagcacgctggagcagcgcgtcctgcccaatga

SEQ ID NO: 7371 - DNA, 432 bp, Myxococcus xanthus
atgcgcgtggacgcgctgacgagcacgctggagcagcgcgtcctgcccaatgacctggacctgaacctgcacatgaacaacgggcggttcctcaccgtctgtgacttgagccgggtcgacctgttcatccggacgggcctgctggcgctcatgctcaagcagaagtgggcgcccatcatcgtgcgccacaccatggactacaaaaagccgcttcgcccgttccagaagtacacggtgtccatgtcgattacccgctgggacgagaagtacttctacgccacccaccagttcctctcgcgcgggaaggtggtggcggagggcgagtccaccgcggtgctgctcgggcgcgagggcgtcgtcccgccggagaaggtgattgagggcggtcacccgcccggcaaaaccggacggcggtggagaaccactgactga

SEQ ID NO: 7372 - DNA, 4089 bp, Myxococcus xanthus
aaggtccccgtgcagggcgagcagggggccttgggggccgcgccgcgccgggtgacccgatcgcgccagaagcctctgggcttcagcctcttctacttcgcggcggacgagggtgctccaggcgcggagcgttaccggctgttgctggaaggtgcgcggttcgcggaccgtcatggcttccaggcggtgtggacgccggagcgccaccttcatgcgtttggtgggctctatcccaatccatccgtgacgagcgcggccatcgccgccatcaccgagcgcgtagccatccgcgccggcagcgtcgtgctgcctctgcaccaccccgtgcgcgtggccgaggagtggtcgctcgtcgacaacctgtcgaagggccgcgtcggcatctccgttgcgccgggctggcacgcggatgacttcgtcctcgcgccagagcggtatgcggagcgccgggagcttgcgcggcgggacctggacacgttgcggcggctttggcgcggtgagtcgctgtcgttccccaatggcgcggggacgcccatcgatgtccgcatccgtccgagccccgtgcagcgcgagctccctgtgtggctgaccgccgctggcaatccggacaccttccgcgaagcgggccggctgggcgcgggcgtcctgacgcacctcttgggacagcggtgggaggagctggaatcacgcatcgcgctctaccgcgaggcctggcgcgaggcgggccacgagggcgagggccacgtgacgctgatgctccacacgttcgtggggcacgacgtggagcgcgtgcgtgagacagtcgaagcgccgctgcggcgctacctgagcaactccgcggacctgatgcgcgggttgggccggacgctgggcgtggacctggatcccgcatcggtgcgtccggaggacctggacgcgctcgtgggacgggccttcgggcgcttcttcgacggggcggggctcttcgggacgccgcgcacctgtcgggagcaggtggcgcgcatcgaggcgctgggcgtggatgaggtcgcgtgcctcatcgacttcggcgtggacacggatgccgtgctcgccagccttccggcgctggacgccgtgcggcagcgctgcgagcgggacttccggcttcagtcgcaggaggaaatcaccgtgcccgcgcagcttcgccggcacggcgtcacgcatctgcaatgcacgccctccctggcccaggcgctgctcttggagcccggtgcggccggggcgctcgtggggctggagcgcctgctcgtcggcggtgaggcgctatccgcggagctggcggaacggctgcggggcaccatgggcggagcgctgctcaacatgtacggccccacggagaccaccatctggtcttcgtcgcacgccgtggatggttcgccgggaccggtgcccattggtacgcccatcgccaacacgtcgttgtacgtgctggatgcggagctgcggcccttgcccgtgggtgtgcccggtgagctctacattggtggcatgggtgtcgctcggggctatcacgcgcggccggagctgaccgccgagcgattcctcccggacccggcgtcctccaacgctggtgcccggatgtaccgaacgggcgaccgggctcgatggcgagcggatggaacggtggagttcctgggccgcgtggaccaccagctcaaggtccgtggcttccgggtggagcctggtgaaatcgagtccgtgctggcgcggcactccgacgtggcgcaggccgtggtcgtggcgcgggaggcgtctgctggaggcgctcgcctcgtcgcgtacgtcgtcgccaggccgggcacggcgctttcggtggaggcgctgctggccttctcccggcgctccctgccggagcacatggtgccttcggcgttcgtgccactcgatgcgctcccgctgacgcccaacgggaaggtggaccggaaggcgttgcctgcgccggagggtgtccgtgacgtcgctcgggagtacgtggcgcctcggacggacactgaacgccgtttggccgagctgtgggcttcgctgctgggcgtggagcgggtaggcgcggaggacgacttcttcgcgctgggcgggcactcgctgctggccacgcgcgccgcctcccggattcgtgaggcgttcggggtggacctgcccctgcgtgagttgttcgagtcgtcctcgcccgcggccttgggggcgcgcatcgatgctcgcctcctgggggcgtccggggtgcctccattggtggcccggtctcacgaaggcgcgctgccgctgtccttcgcgcagcaacggctctggttcctggagcagctcgagcccggtggcgccgcgtacaacgatgcggtggctgtccgtgtggagggggcgctcgatgtggcgttgctggagcgctctctgagagaggtggtccggcggcacgaagtcctccgcgccaccttccacgatgacggcggcacgccttcctggcgcatccatcccgaggcccggcttgctctggaccgggtggacctgaccgcgctgtctggggctgatcaggcggaggccctatcgttgcgattggcggaggagtcgctgcgggcgttcgacctcggcgcgggaccgccgcttcgagccacgctgctccaggtgagcgcgcgtgagcacgtgctcttgttggtgctgcaccacctggtgacggatggcgcatccatgggtgtgctcgtgctcgaggtggcggcgctctatcgggccttctcccaggggcaggtttcgccgttgtcgccgctgccgctccagtacgtggactatgcggcgtggcagcgcgactggcttcgcggcgaggcgctggaggcgcaactcgcgtactggcggacccggttgggaggggcacctcgggcgctggacctgcccacggaccggcctcgaccggccgtgcgcagcagccgtggcgtgagccgaagcatgctcctgggcccggagttgtcgcatgcgctgaaaacgttggcccagcgtgagggcgccacgcccttcatggtgctgctggcgggcttctccgcgctgctgtcccgtcatggcgggcaggatgacctgtgcgtgggaacgccggtggagggccgtgaccggaccgagctggaagggctcatcggctgcttcgtcaacacgctggtcctgcgcgtgtcactggcgggcacgccgtccttcagggagttgattggccgcgcgcgggagactgtgctgggggcattcgcgcaccaggacgcacccttcgaggaactggtgaaggcgctccagcccgagcgcgacctgggccgcagcccgctgttccaggccatgctcgtgatgcaggaggacccgctgccggagttggtgattccggggctgcggctgaacgtccagccgcagccgagtctcacggcgaagttcgacctgcgactcatcatcacggacacggcggacggcttctccgcgaacctggagctgagcaccgacctgttcgagccggataccgcaacgcgcctgctggagcacctgcgcgtcctgttggaggcgggcgtccgtgagccggaacagcaggtgcacgcgcttcccctgatgacctcggcggagcggcaccgggtcctggtggcgtggaatgacacggaccgccctcggccaggagtgagcgtcctgcatcggctcatcgaagcgcgggtggaccgcacaccggatgtggtggcgctgagcttcgagagcgacaccctcacgtatcgggagctggaccggcgcgcgaatcagctcgcgcgctacctgcgggcccgaggcgtggggccggacacgcgggttgcgctgtgcgtggagcgttcgctggagatggtggtggggctcctcggcgtgctcaaggcggggggcgcctacgtgccgctcgacccggagtatccccgcgagcgactggagtacatgctcgcggatgcggcggcgccggtgctgctgacgcaggctcggttgtcggaacgcctgcctcgggacagcgccaccgtggtgtgtctggactcggagtgggacgcggtggcgcgcgagcgcgaggagcgtctcgacgtgaccgtggatgggagcgatagggca

SEQ ID NO: 7373 - DNA, 870 bp, Myxococcus xanthus
cacggcggaccgcgcccgcagcgacctggactgggcggacctggtgctggtgtgcggcaccacgaagctgcaccacaaggtcagcggccactacacgcacggtgggccggcctacagccacaaggtggtgcacgtcgtgaagcggggcgtggccgcgctgttggaagaaggcatcacccacctggagcggacgcgctgagtgctggactcaggcgacgcgccaaagcgacgcttgagtccatgacgaccgagttcatcctgctccgtcacggagagacggagtggaactccctggggcgcctccagggacatcaggacagcaccttgagccaggtgggcctgcgccaggcagacgccctggccgcgcgcctggagcccgtccgattctcggcgctctattgcagcgacctggggcgggcgcaggaaacggcgcggcgcatcgccatccgcacgggccacaccgtccagtccgacacccgcctgcgcgaacggggcctgggcatcctggaaggcctcacccgggacgaggcacgccagaagcacccggacgtcttcgccgcgtacgccggtggcgcgccggactacatcgtccccggcggggagagcacgtcccaacggctgcgccacgcggtggagtgcctggaggaactgggcgcgcgccaccggggcgaacggctggtggtggtgacccacggaggcgtgctcagcctcctgttccgtcacagcctggggattccgcacgcggcgccgcgcaccttctctgtgctcaacgccgggtggaaccaattcgactaccacgaaggtgcgtggcggctggtgacgtggggtgacgtcacccatctgcgtgcctccagcctcgacgacacctga

SEQ ID NO: 7374 - DNA, 690 bp, Myxococcus xanthus
atgccccatgtcctcatcatcgacgacgaacgcgacctcgcggagctcattgatttcaacctgcggggttccggcctcaccacgcacgtgtcccacactggcgaagaagcgctggtggcagcgcgggagcagaaccccgacctcgtgctgctggacctgatgctgccggacatgtccggcatcgatgtctgccggcagctgcgggccagcccccagtcccggggcgtcctcatcgtcatgctcaccgccaagggcgaggagtccgaccgcatccgcggcttcgaggtgggcgcggacgactacgtggtgaagcccttcagcgtgcgggagctggtgctgcggctgaaggccatcctccgccgcggcgcgcccacggctgggggcacggcgccgctggcgctggggcccctgcgcctggacgtggcgtcccaccgcttcttcgtggaggaccgcgaggtggccctcaccgcgctggagttccggctcctggagcacctgctcgcccgcctgggccgggtgcagacacgtgagcagttgctggaagaggtgtggggcctgtcatcctccctggagacgcgcaccatcgacacccacgtcatgcgcctgcgcgacaagctgggcccggcgcgcgcgctgctggagacggtccgcggtgtcggctaccggatgctggacccagccgcgggctga

SEQ ID NO: 7375 - DNA, 423 bp, Myxococcus xanthus
atgcccgaataccgcaaccccaagcccaccgtggactgcatcatcgagctgcccggtgaacgcatcgtcctcatccggcgtgcgaatccgcctgtcggctgggcgctaccgggtggcttcgtggatgagggcgagccgctcgacgtcgccgccgtgcgcgaggtgcaggaagagacgggacttcacgtgaagctgtcggagcagttcttcacgtactcggacccccggcgggatccgcggcagcacaacatctccaccgtctacatcggctcggccgagggcgaaccgcagggcgccgacgacgcggccgaggcccgcgccttccgcgtggatgacctgccgaaggacttgtgcttcgaccacgacaccatcctgtccgactacgtcacgtacaagcggaccggacagcggcggaagctctag

SEQ ID NO: 7376 - DNA, 808 bp, Myxococcus xanthus
  unsure (1)..(808): unsure at all n locations
atgcattacgcgctcgtcctgctcgccctgggaggcctgctgaccctccacgaattggggcacctcgtcgccgcgcggttgctcggcgtgcgggtgccccgcttcgtgtttggtttcggtccaccgctggtgtccttccgtctgtgggggacacagtacgtgctggcggcggtgccactgggcgccacggcgcacatgcaggggatgaacccgcaccgtgcggacgtcgacgaggccgcgggcttcgccgcgcgcgggccgctgctgcgcatcctcatcatcctggcggggccgctggccaactatgcgctcgcgttgggtgtcctgttcgcgctgtacacgtcgggcacgcacgtggtggtgccgctgaccgtggggacggtgcagccgggctcggaggcggcgcgcgcacaactgctgccgggggaccgcatcgtcaatgtcgcgggacagccgctgcggagctggtcggagttcgtggagaaggtgggcgcggcgccgggtgtcccgctggagttgggcgtggagcgcggcggcgatgcgcgctcggtggtggtgcggncccngncggatgagcgcggcacgggccgcatcggggtgagccagcagtacgtctacaaggcgcacggcgcgggtgaggcgctgagccattcgttcacgcacaccgtcaaggtggccgaagaaggcgtggcgctgttgaagcggatgatgcagcacggcctggagagcgcagacgcggcgagccccggagcgctggtgcgacaggagtccccggacgcgatgttgtccgggaaggatgccctgctgc

SEQ ID NO: 7377 - DNA, 1302 bp, Myxococcus xanthus
tacgcgcagccgacgggacctgacctgctgggtcggacggaacccttcttcgagtggcaggagtcgcggcggcaggcgggcctgtggccgtactcgcgaagcctggaggcggcaccgaaggcggagtgtggtgtccgcagtgagacgggggcggtgcgccaggggctgaacttcggttcgcaggattacttgtcgctgtccacgcacccggcggtggtggaggcggcccagcgggccatccaggactacgggttgcacagcgcgggctcggcgatgctggggggcaatacgacgccgtcgctgatgctggagaaggcgctcgcggagcacctgcagacgccgcacgtggcgttgttctccaccggctggggcgcgggcttcggcgtcatcgctgggctggtgcgtcccgatgaccacgtggtgctcgacgcgctgtcgcacgcgtgcctccagcagggcgccgccgccgcgacgacgaacgtgagccgcgtgccgcacctcaacaaccgcgccatgcggcgcaagcttcaggagattcgcgcccgcgacacgcagaacgcggtgctcgtcgtcaccgagggcctgttctccatggactcggacgtgccgcggatcgaagagctccagtccatctgccgtgagtacggcgcgacgctgctggtggacgtggcccatgacctgggcgcgatggggccccgggggacgggcagcctgggcgtgcagggcctgctggggaaggtggacctggtggtgggcgccttctccaagacgttcgcgagcaatggcggcttcgtggccacgcgctcgccggcggtgcgccagttcatccgcatcatgggcgggccccacatcttctccaacgcgctgctgcccatgcaggcggcggtggtgctggagtcgctgcgcatcgtccgctcggaagagggcgacgcgctgcgcgcgaaggcgcgggagaacatcctggcgctgcgcggagccttcgaggcgcggggcgtgacgtgcctgggcgagccgtccaacgtcgtccccgtgcaggtgggcgacgcgaaggtggcgcggctggcctcgaagaaggtgttcgaccgcgacatcttcgccaacctggtggagtacccggccgttcgcttgcgcgagacgcgcttccgcatgcaggtgatggcgtcccacacgctggagcaggtccagcgggccgccgacggggtgtgcgacgccatcgaggaggcccgcgccgagctggaggttcgtccggccgcgacgcgcgcgtcccgccgcgacgagcagcgtccgcaggtggagctgtag

SEQ ID NO: 7378 - DNA, 1935 bp, Myxococcus xanthus
attcactcggtcctgacagaagcacgcgtctttccgccgccagaggcgttcgcccggcgcgcgcacatccggagcatggagcagtaccagcagctctgggacgaagccgcgaaggaccctgacaagtattggggcgaccgcgcccgcgaggagctgtactggaaggcgcccttccagacggtgctcgactggaagccgccgcacgcgcggtggttcgtcgagggcaagacgaacctagcctacaactgtctggaccggcacctggccacccgcaaggacaagcccgccatcctcttcgagggggagcccggcgaccgccgcagcctcacgtacggcgagctgtccaccgaggtgaacaagctggccaacgcgctcaagtcgctgggcgttcggaagggtgaccgggtgggaatctacctgcccatggtgcccgaggccgcggtggccatgctggcgtgcgctcgcattggcgcggtgcactcggtggtgttcggcggcttctccgcggaggcgctccacgagcgcatgaacgacgcgggcgcgaaggtgctgctcaccgcggacggcggttggcgcaagggcgcggtggtgccgctcctgaagaacgtggaggcggcgctgccgcacatgcccaccatggagaaggtggtggtgctccgccgcacgggcagcacgctggcgctgtccgggcccaagctggtggcgtgggacacgctggtgagcgggcagtccgcggaatgtgaaccggagtgggtggagagcgagcacccgctgttcatcctctacacgtcgggctccactggaaagcccaagggcgtgctgcacaccacgggcggctacgcggtgaatacgtcgctcaccacgcgctgggtgttcgacctgcgcgaagacgacgtctactggtgcaccgccgacgtgggctgggtgacgggccactcctacgtcgtctacggcccgttgatgaacggcgtcaccaccatcctctacgaaggcgcgcccacccagccggggccggaccgcttctgggacatcatcgagcggtacaaggccaccatcctctacaccgcgcccaccgccatccgcgccttcatgcggctgggcgaggagcccgtgcgcaagcacgacttgtcctcgctgcgtctgttgggcagcgtgggcgagcccatcaaccccgaggcgtggatgtggtaccgcgacgtcatcggcggggggcgctgccccgtggtggacacgtggtggcagacagagacgggctgcatcatggtgtcgccgctcccgggcgccacgccgacgaagcccggctcggccacgctgccgctgcccggcatccacgcggagattctggaccgcgagggcaacacggttccgcgagggcagggcggactgctcttcgtcacgcgtccctggccctccatgttgcgcacggtgtacggcgacccggaccgctacgtgcgcacgtacttcaacgagctgcccggcatgtacttcaccggcgacggcgcgcgcacggatgcggaggggtacatctggctgatgggccgcgtggatgacgtggtcaacgtcgccggccaccgtctgggcaccgcggaggtggagagcgcgctggtggcgcatgaaaccgtcgcggaggccgccgtggtgggccgtccggacgacttgaagggcaccgcgctggtggccttcgtcaccctgaagcagggccacacgccgtccgacgcgctgaagaagacgctggccgcccacgtgggccgcgagattggcgccatcgcccgcccggatgaaatccgcttcgcggaggcgctgccgaagacgcgctcggggaagatcatgcgccggctgctgcgcgacgtggccgcgggcaatcaggcctccggggacaccaccaccctggaggacctcaacgtcctggccgcgctgaggcagaacgacgactga

SEQ ID NO: 7379 - DNA, 597 bp, Myxococcus xanthus
atgcagtccacggtgggcttggggttgcggtattcgggcatgacccccagtctacctgctgccgtcacgctcgcacttcctagatgcgtgccgtggagtattgtgcgcgccgtgtcgactccgagacgccatcgcctcgtcctctccggcctgctcctggcgtgcctggtgggctgtctgccccacgtccaggagccgggtgattacgtcttcgagcccgtcgaggtcctccgcgacgactgcggcctgctggagaccaaccgcagccagctctacggcaccctgcaaatcagcgggcgcgtcgtccgcctggacttcggtttcctggacagccacctcgtgggctatttcctggaggatggagaccacttctccatcgacgggagcgtggtcaaggccgctgccgaggtgaacggccaggagtgcctgttggaccagatcaacatccacatcgacggtacgacgcagtgcgaaacgcagttcaatggcgtgctgcgagtccgttacgacacgcgccgccccgacgaatgcgtgtgcgagatgtggctgcgctacgaggccgtcaaggaatcgaagcgctgcgacacggagggttga

SEQ ID NO: 7380 - DNA, 1497 bp, Myxococcus xanthus
atgcccgcctctgtcctcatcgtcgatgacgagaagaacatcctcctcaccctgagccagtcgctccaactggcggggtatcagacgcacctggcaaacagcgggcaggtggccctggatgtcgtcagcgcccgtcccgtggacgcggtgctgatggacgtgaagatgccggacatggacggcctcacggccctggcgaagctgaccgagctgaagccggagctgcccgtcatcatgatgtccgggcacggcaccatcgacaccgcggtgaaggctacccagttgggggccagggatttcctggaaaagccaatcgcccgggagcggctgctggtggcgctgcgcaacgtgctcaagcaccaggcggccatggcggagctccaggagctgcgggcgcagttgggccgctacgacatggtcggcagtggaccggccatgcagcgcatcttctcgctcatccagcgaacggcgccgtccgagggccgcgtgctgattacgggtgagaacggcacgggcaaggagctcatcgcgcgggcgctgcaccagcactcgaagcgcaaggggcagcccttcgtgaagctcaactgcgccgcggtgccgcacgagctcatcgagagcgagctgttcggccacgagaagggcgccttcaccggcgcggtgagcgtgcggcgaggcaagttcgagctggcccacgagggcacgctcttcctggacgagattggcgacatgccgcaggcgatgcaggccaagctgctgcgcgtgttgcaggaaggcgagttggagcgcgtgggcggcgcggagacgcacaaggtggacgtgcgcgtcgtcgcggcgacgaacaagaacctggaggcggagattgccgccgggcgcttccgcgaggacctctactaccgcatcaacgtggtgcagattcattcgcctccgctgcgtgagcggcgcgaagatttgccggacctcatcaagacgttcctcgacgaggcctgcgccaagaatggacgccggccgttgacgctgtcccccgacgcgctggcggtgatgagcgcctacgactatcccggcaacgtgcgcgagctgcgcaacctcgtggagcggctggccatcctgtgtgaaggccccatcgtcacccggacggatgcgctggagctgttgccccggggccggaacgtgccgccgcccgcaccggtggagacacccgcgagccccctaccccctccttctcccgaggcggccgtggtcctggcgtccagtacgcccgcgcccgccatcgccgccccggtggcgaccgagcctcccgcgcccgtgggcttccggcctcgcgcggaccggacgttccgcgagcaggtggaagacgccgagcgggaaatcatccagcacgtgctttcccatacacacgacaacgtgacggaagccgcgcgattgctcgacctggaacgcggtcacttctacaaaaaaatgaaggccctgggcttgcgccgcggcagctccgagtcgtaa

SEQ ID NO: 7381 - DNA, 87 bp, Myxococcus xanthus
atgctgcggcgtgtcgcgcaggtcatcatggtgcgcggctacgcggtgggcacctacaacctgacgctgacgtacagattcccgtag

SEQ ID NO: 7382 - DNA, 252 bp, Myxococcus xanthus
atgggcacggtgctggtgctgctgcactgccagcttaccggcacggtgcccgagggcacctgggggcccttcctgctgctggtgggcgtggcgttgtcgctggccctctggttcaccggcgttcatgggcggcgcgcgctgcgggtgctgtacgcgctgggcgaaggccggctgccgtccacgcacgaggccctgctcaaggcgctgctggaagcgcgctccttcccggagcggagcttcgccttctgtaga

SEQ ID NO: 7383 - DNA, 372 bp, Myxococcus xanthus
atggagccgccgggccacgtccggggaatgctcctgtgccatgccggtccccaccggctcgccttccatgcgcacgaggtggcctccatcgcgtcgccctccgggcacgcggcggcctccgcgcgccgggccttccatgagacggagggttccgcccgcgtgctggtgtccgcctcgggcggggcagtgggcgtggatgcgctggaaatcgacgcggagccgcaccgggtgctgcccgcgccgccggtgacggtgcgcgcgtcggggggcagcctccagggcttcgtgatggcgcgaggagcgctgtggcccctcgtgggactggcggacttcgagcgcttcctgcgcgggcatccaggggagggtgcatga

SEQ ID NO: 7384 - DNA, 435 bp, Myxococcus xanthus
atggccgtccaagagccggaagcgcgtcagtcctatcttgtcttcgcctgtggcagtagctggtatgcggtacccgcggagagcgcggcggaggtcgtgaccttccccgagctcacgcgggtgcccggcgctccagcccacctgctgggcgtgttcgcgcatcggggtgaagtcatccccgtcgtggacatgggcctgctggtgggcggcgtcagtcagggttcccgaagggcggtgctcgttcgcctgccgcgtgggaccctggccctcacggccagtacggtggccggcgtctccccggtgacgggcacgctggagcccctgggccccacgggcgtccacgtccacctgcgcggccccgccaagagcggcccccgggacgtggccgtcatcgacccggaagggctcttcgaccacctcagtcaggggacctga

SEQ ID NO: 7385 - DNA, 1173 bp, Myxococcus xanthus
atggtggagggccgccagccggaaatcgacctgctggaaggggagggggggcccatcgtggtcgccgtccccatgttccaggagggccgcttcaagggtgtgctgctgggagagctccgcgccagcgcgctgcccacgcggcccaccgcgcagacgtcactggtgctgatggatgaccagggtcagatcctgatgccagtggggttcaatctgggcgccggggacatcacgggggggctgcgcgcgctggcgaacatgccggggccgctgacgctggatgacaagcacatgatgggcgcgggcgcgtgggtggggaagagcgacctgctgttggtcgtcctggaggaggagacggccaccgcgggcctccgggcgcgcttcctgcggcagctggcgttccacatcgccctgctgagcagcacgctcatcatcttcatcctcctgctgcggcactcctaccgttcgctgctggcggccgaggagcggctgcgacgccaggagaccatggcggcgctggggaccgcggcctcgctcatcgcgcatgaggtgaagaacgccctcaacggcatccaggccgcgctgtccgtgctccggcatacccccgcgggcagcgagctgcccgtgggcgcgctgcgctcgcaggtggagcgcttgagccatctggcgcgctcgctgctgtccttcggggcgcctcgtgccgcgctgcgccgccgctgcgaggtgcacctgctggtgaaggacgcgctccagggcgtgaagctgctgccggagtcagaggccgtggcactgactacgtccctggaggagtccctgtgggtccagggggatgcggcgctgctggtgtccgccatcgacaacgtgttgcgcaacgcggtggaggcaggcgcggtggcgaaggacacagggatgcagttggcaccgtgggtcagcgtgagtctgacgcgggacgaacatgacgccgtgctcgtggtggaggacaatgcgggcggcgtggatccgcgtctcgagcccaggttgtgggaacctttcgccaccgggcgggcgaagggcgtggggctgggactgcccatggcgcgtgcctccgtggaggcccatggtggcagtctgaactatgtccggagtccgctgggaagccgcttcacgctgcgccttccgttggaggtggcccgatga

SEQ ID NO: 7386 - DNA, 702 bp, Myxococcus xanthus
atgggcggctgcaccccttcctatccgaagtgcaacgaggacgagcactgcgcggagaagggcgaagtttgcgtccagggccagtgccaggagtgcgccaccgacgccaactgccaggagggtttcacctgccaggcgaacaagtgcgcccccaagccgcctgagtgcaccacggacagcgcttgtggcagcggccgcatctgcgaggccggcaagtgcgccgaggcccagtgccagcaggacacccagtgccccggcggcggcaagtgcgagtccggccgttgccaggttcccgagaacacctgcgcgtccagctctgactgcggcgagggccaggagtgccaggctggccagtgcgtgacggcctccgcggagcgctgcgactggagccccgtcccgttaggcttcaacgagtccggcctgtccgcggacgcgcagcagcgcctgtccgacctggctcaatgcatgaagaccgctccgggccgcgtcaccctggcgggccatgccgacgagcgcggcaccgaggagtacaacctccagctctccaaccgccgcgcggcgtccgtcaagcgctacctgacggacctgggcgtgccggccagccagctgggcacggtgggttatggtgagacccgcccggtgaactccgcttcgtccgaagacgcgtggtccgagaaccgccgcgtcgagttccagcgctag

SEQ ID NO: 7387 - DNA, 1414 bp, Myxococcus xanthus
atgttcaaagcccccgactccgacggggccgccagcgcggccgagtccgtcgattgccgtcccctcatcacgtcactgtccgacgtggggctcctttccaaggagcgaggacgcgcgctgactgacaagctgaaccgcttctttgaggcggtccgtgccccatcaaagaagaccgacgaggcgttctggacggatttccagcaggagtttggcttcgcgacggtcgcgccctccgagcgcgtcacgccgatgaacgccgccaacctctgcccggagcccacggcgctcatcgagtcgctcaacgagctgcgcctcgaatacaacctcaacgtctcgcaacagatgcgcaccgtgcagggcgagcgggtgctccagttggagcggacgcgcaagagtctggccttcggcctgggcctgagcgacccgaccgacctcgccatcgtgcgtaatgccacggaggcgaacaacgccatcaactgcggcttccggggctggagcgcggacgggaatgacacagtggtgatgtgggcggagaaccatcccaccaaccgcgaggcctggaaaatgcgagccgagtggcccggcggcccgacgcccttcaaggtggaggaggtgtccttcccgacaaacgccccggaggcggacatcgcgacggccttcatcaatcgaatcaccgagcgcacgcgcttcgtgacgtacactgagaacggccaacagcaatggcttccgcatgcccgagtcggtgatgcgcgccatctgggcccacgtgaagacgaaccggccaaactgccatgtccacatcgatggcacgatggcgtggggcgcgcgcccgcttgacctggcgaacgcgtactgccacagcctcgtctccagcgcccacaagtggttcctggggcccaaggagacgggcatcctcttcatgcgcaaggagaaggcccggaacttcatgccgagcatcttcgggtacgactaccgcatcgtcatcgtgccgtaccgggagctgccggagaacgcgctgaggttcgagctcatcgggcagcgcgacgacgtgaacatcatcgcgctagacctcacccagaagatgtggacggcgctgcaaccgcgcagaccttacgagcggatcgcccaactcgcccagcacctcatgtcacggctccagcagacggggagccggtggaagctcgtcacgccgagcgacccggcgcgcagttggggcgtggtgcgcgtcgaggcgccaaaggagcaccgggagaagacgctgtacgactggctctacgaagacccgcgctaccacatcgcgggctccggggacgacaagacgttccgcctgtgccctcacatctacaacacgattgctgatgtggaccgggccgtcgatgggatgaatgcctggtacgatgacaagcgtttgtga

SEQ ID NO: 7388 - DNA, 417 bp, Myxococcus xanthus
gacgaagcctggagcccctacctgggcaagcagggccaggacgccgcggacttcctggcggagaacccgctgaacctgacggcggaagaggtcaaggagctggaccgggccgtgaagggtgaggcgctggacaacgtggtcaaggagtacaacaccgaggtcgagcgcctgaacgccgcggacggtggcagccggccgaagttcgcggagctgccgcgggagatgcagacggtgattgcctccgtgggcttccagtacggctcgctgaagacggccacgcccaacttcttcgcgcaggtgacggagcagcggtgggacgacgcgaaggccaacctggaggacttcggtgaccgctatccgtcgcgccgtggccgcgaggcggatctgctgggtgagggcatcgcgaccctgagctga

SEQ ID NO: 7389 - DNA, 1368 bp, Myxococcus xanthus
atggcgaaggcgaagacgcactacacctgtcaggcgtgtggatacaaaacggcgaagtggctcggaaagtgtccggactgtggcgcgtggagttccctgctggaggagacggacccgaaggcggatgaacgacgtccggcctggggtgcctcgggcggttcggcgcggcccatgctgctcaaggaagtgagcggcgagacggagacgcgccggcgcacgggcatcgccgaattcgaccgcgtgctgggcggcggcgtggtgagtggctccatcgtgctgctgggtggcgacccgggcatcggcaagtccacactgctgctggcggcgttggacaggttggcgcgccacggaccggtgctctacgtctccggtgaagagagcctgcgacagacgaagatgcgcgccgagcggctccgggtggagggagaggccatccacctgttcgcagagacggacgcggagcgggtgctgacggcgacggaggcgttgaagccccaggcgctggtggtggactccatccagaccatgtacctgccggagctgggcaacgcgcccggcagcatcacccaggtgcgcgaggtggcgggccggctgatggcctacgcgaagcgcacgggggtgcccacgttcctggtaggccacgtgacgaaggaaggttccatcgcgggcccgcgcgtgttggagcacatggtggacacggtcctctacttcgagggtgagcggggccacccgttccgaatcctgcgcgcgcacaagaaccgcttcggctccacgaacgagattggcgtcttcgagatgaagggcgcggggctggtggaggtgtccgacccctccgccctcttcctgtcggagcggccggtgggcaagtctggcagcgtggtgacgagcacgctgaacggtacgcgcccactgctggtggaggtgcaagcgctggtggcgcccacgggctacggcaccgcgcggcgcacggcgattggcgtggacggcaaccgcgtggcgctgctggcggcggtgctggagaagaaggaagagattccgctggtgggctgtgacttgttcgtcaacgtggcgggcggcatgcagctcaccgagcccgcgtgtgacctcgcggtgtgcgcggcgctggtgagcagcctccagaatcgtccgttggatccgaagacgctggtgctcggagaagtgggcctcgcgggagaggtgcgagcggtgggtcaggtggagccccgactggcggaggccgcgaagatgggcttccagcgcgtggtgatgcccgcgggcagcgcgcggcgcctggaggatgcaggcccgaagatgaagatcgtcggcgtggagacgctcggcgacgcgctcgtcgcgatgttcgactga

SEQ ID NO: 7390 - DNA, 1137 bp, Myxococcus xanthus
cgggaggacctggaggccctgtccgagcgcggcctgcgccgctacctggagcccctggactctccccaggggcccgtggtgcgcgtggggggcgagacgctcgtcaacttctcgtccaatgactacctggggctggccgcgtcacccaccgtgcgtgccgcggcgctggccgccgtggagcgctacggcgtgggcaccggtgccagccggttggtggtgggcgacaccgccgcgcatcaccggttggaaacgcggctggccgccttcgagcgcgcggaggccgtgcgcctgttcaacagcggctacgccgccaacaccggcatcatccccgcgctggtggggtcggaggacgccgtcttctccgatgccctcaaccacgcctcgctcgtggatggctgccggctgtcacgcgcccgcgtctgcgtctatccgcacgcggacgtggaggcgctcacgcgcgccctggcggagacgcccgcgcgccgcaagctggtggtgacggacaccgtcttctccatggacggagacgtggccccgctgcgcgacatcgtcgccgcgtgccgggcccacggcgccgcgctgatggtggacgaagcgcatgccaccggcgtgctaggcgcacgtggagcgggcctctgcgatgagctggggttggaaagcgaggtggacctgcgcatgggcacgctgagcaaggcgctgggcgtcatgggcgcgtacgtggcgacctcacgcgaggtggcggacctgctggtatcccgcgcgcggcccttcgtcttctccaccgcgctgcccgcgcacctgtgcgccgccgccgaggccgccgtggacgccgtggagggcgacccggacctgcgcgagcggctgtggcgcaacatccgtcgcttcgcggacggcctgcgcggcttgggcgtgcgcgccgagcctcgcagcgccgtgttccccctcatcctcggcgagcccgagcgggcgctggacgccgcgcgccgtctgcgcgaggcgggcgtgctggtgaaggccatccgtccgcccaccgtttacgagggcaccaaccgcctggggttttgcctgtccgcttcccactccgtgggccacgtggacctggcgctggaggctttgcgcagcgtggaagtcccttag

SEQ ID NO: 7391 - DNA, 954 bp, Myxococcus xanthus
cgccatgactggtcgctgtcggaggtgagggccctctacgaactcccgctgctggacctggtgcacaaggcccagacggtccaccgggccgtgttcgtggacaacaaggtccagctctgttcgctgctgtccatcaagacgggcggctgcccggaggactgctcgtactgcccgcaggcggctcgctacaagacgggcgtcaaggcggagaagctgatggccgtgccggacgtgctggatgccgcgtccaaggcccgcgccgccggagccacccgcttctgcatgggcgccgcgtggcgcgaggtgaaggacggtccgcagttcgacagcgtgctggagatggtgcgcggcgtgcgcgcgctgggcatggaggcgtgtgccaccctgggcatgctctccgagagccaggcgaagcgcctgcgcgaggccggcctgtccgcgtacaaccacaacctggacacgtcgcccgagcactacggcgacatcatctccacccgcacctatgaagaccgcctgcgcacgctcaaccgcgtgcgcgacgccggcatctccgtgtgctgcggcggcatcattggcatgggcgagtcggtggatgaccgctgcaacctgctgcgcaccctggccaaccaggagcaccacccggagtcggtgcccatcaacgcgctggtggccgtggagggcacgccgctgcaggagcagcagcgcgtggagacggtggacatggtgcgcaccatcgccaccgcgcgcatcctgatgccccagtccatggtgcgcctgtccgcgggccggcagcagatgaacgaagaggcgcaactgctgtgcatgatggcgggcgccaactcactcttcttcggcgagaagctgctcaccaccggcaaccccgagtacacccaggacatggccctgctggagaaggcgggaatccgccccctggagccgcgtcaggaaggctga

SEQ ID NO: 7392 - DNA, 210 bp, Myxococcus xanthus
atgccgggcaaccagtcgatggggctcctcgccaccacgctgctggggatcgccggctccttcgtgggcggtttcgtcgcttcgctcttccgcagtgatggccgcgtcttcgacctgcacccgacagggctcctgttctccgtcctgggcgcactcctggtgttgttcctggtgggcctggcaggcaggggccgccgcgtccacgtctag

SEQ ID NO: 7393 - DNA, 1101 bp, Myxococcus xanthus
gaccacctcaacagcttctccgcggaggtgacgcgcgtcgctcgcgaggttggcaccgagggcaagctgggcggtcaagccgaagtgcgcggcgtgtccggcgtgtggaaggacctcacggacaacgtgaacttcatggcccgcaacctcaccacgcaggtgcgcggcatcgtcaaggtcgtgacggcggtggccaacggcgacttgaagcagaagctggccgtggaggcgaagggcgaggtcgccgcgctggcggagaccatcaacaacatgacggacacgctgggcaccttcgccgagcaggtgtccacggtggcccgcgaggtgggcgtcgaagggaagctgggcggccaggcccgcgtgcccggggtcgcggggacgtggaaggacctcacggacaacgtgaacttcatggcctccaacctcaccacgcaggtgcgcggcatcgtcaaggtcgtgacggcggtggccaacggcgacctgacgcagaagctggccgtggaggcgaagggcgaagtcgccgcgctggcggagaccatcaacaacatgacggacacgctgggcaccttcgccgaccaggtgacgacggtggcccgcgaggtgggtatcgaagggaagctgggcggccaggcccgcgtgccgggtgcgcgcggcacgtggcggcagctgaccgacaacgtgaaccagctggccggcacgttgacgagccagctgcgcgccatctccgacgtggccaccgcggtgacgaagggtgacctcacgcgaagcatcaccgtcgtggccgagggcgaggtcgccgcgctgaaggacaacatcaaccagatgattgtcaacctgcgtgagacgacgcagaagaaccaggagcaggactggctcaagacgaacctggcgaagttcagcggcatgatgcagggccagaagagcctggacgccgtcagccgcctcatcatgagcgagctgacgccgctggtctccgcgcaccacggcgccttcttcctggtggacggcgccgaggccggcacgccgctgctcaagctcaccagcacctacgcgtaccgggagcgcaagcacatcgccaaccggttccgcttcggtgagggc

SEQ ID NO: 7394 - DNA, 1761 bp, Myxococcus xanthus
atggaacatgtgtcgctgcgtcccatccagaaggtcctctgcgccaaccgcggtgagattgccattcgcgtcttccgcgcgtgcaacgagttgggcatccgcaccgtcgccatctacagcgacgaggaccgcacccacgagcaccgccacaaggccgacgaggcgtacctcgtgggccggggcaagcggcccgtggaggcctacctgggcatcgacgaaatcctcgacgtggccgtgaaggcgggcgtggacgccatccaccccggctacggcttcctgtcggagaacgccgccttcgcggaggcgtgtgagcggcgtggcatccgcttcatcggcccgcgctcggacgtggtccgcaccatgggcgacaaggtcgccgccaagcacctggccgacgcgtgcggcgtcccggtggttcccggcatcaccctggagggcgacgacgcgcacgtgctggagcaggcccgtgccttcttcgcgaagcagggtggccccatcctggtgaaggcggcccatggcggcggcggccgaggcatgcgcgtggtgcgcgaggcgaaggcgctggaggatgcgctggcctccgcgcgttcggaggcgaagagcgccttcggttcgtcgtcggtgttcctggagcgcttcctggagcacgtgcgccacatcgaggtacagctactgggagatttgcacggcaacatcgtccacctgcacgaacgggactgctccgtgcagcggcgccatcagaaggtcattgagattgcccccgcgcccaatctggccccggcggtgaaggaggccatctgcgacgcggcggtgcggctggcgcgcaaggccggctacaccagcgctggcaccgccgagttcctggtggcgggtgacgccttctacttcatcgagtgcaatgcccgcctccaggtggagcacaccgtcaccgagcaggtgacgggcgtggacctggtgcagagccagcttcgcatcgcggagggcttccggctggacgcgccggaggtgggcatctcccggcaggaggacgtggtgccccggggctacgcggtgcaactgcgcgtcaccaccgaggaccctgccaaccagttcatgcccgacgcgggcgtcatcaccgcctggcgcgcggccacgggcttcggcatccggctggacggctccaacggctacaccaacgccgtcatctccccctactacgactccatgctggtgaaggtcatcgcctacgcgcccacgttccagggcgcggtgatgaagggccagcgcgcgctgcgcgagttccgcatccgcggcgtgaagacgaacctgcccttcctggagaacgtgctcgcccaccccgccttccagcagggagagacgtacacgcgcttcatcgacgagacgccggtgctgttccagttggagccccgcagggacagggccaccaagctgctccagtacctgggcgacgtcatcgtcaacgggcaccccaccatcaagaaggaccagcggctcaagcccacgcagttcctggagccgcggctgccgaagacgccttctggcccggtgcctcggggcaccgcgcacatcctggcggagaagggcccgcgcggactggcggactgtgtgctggcccagaaacgcgtgctgctgacggacaccaccatgcgggacgcgcaccagtccctgctggccacgcgcatgcgcacgcgagacatccctcgcgtggccccggccaccgcccacctggccctcgagctgttcagcctgaagagctggggc

SEQ ID NO: 7395 - DNA, 1344 bp, Myxococcus xanthus
atgagcacctatctgttgctggtcgatgacgaccggaccttcgcctcgctggcggcctccgtgctgcgacacgagggcttccgcgtcacgctggcgcattcactccacgacgcacgtggggccatgtcccgcgaggcgccggacctggtggtgttggaccggcgcctgccggacggggacggcatcgacttcctgccggagctgcgcgcccagcttccgaacacgcccgtgttgatggtgacggcgcacggcgacatcgccagcgcggtggaggccatccaggcgggcgcgcgcgactacctgtccaagccggtggagctggatgacctggtgctgcgcgcccgtcgcgccgtcgcggacctgcagctccaggagcggctgcgtctggcggagagcgagctgggcggacggcggcgcctgtcgcgtccgcactcgccgaagatgctcgccgcgctgcagatgctggagcgcatcgccaaggcgccgcgcagcccggtgctgctgctgggcgagacgggcgtgggcaaggaggtgattgcgcgccacctgcacgcgctgcaaggtgggcagggctccttcgtccacgtcaactgcgccgcgctgcccgccacgatggtggaaagcgaactcttcggccacgagcgcggcgccttcaccgacgcgcgaaccgcccgccgcggcctggtggaagtggccgcgggcggcgtgctcttcctggacgaggtgggcgagttgccgctgcagctccaggcgaagctgctcaccttcctggacaagggcgccttccgccgcctgggtggcaccgccgagctgagcagcagcgcgcgcgtggtgacggccaccaaccgcgacctgaccaaggaggtggccgagggccgcttccgcgaggacctctacttccgcctgagcgtcttccgggtggacattccgccgctgcgcgagcgccgcgaggacttgttgcctcttgcacagtccctggtggcggagctgggcgccgagctggggcgccggcccgtgagcttctccagcgccgcgcgcgcccggctggagcgctacccgttccccggcaacgtccgtgagctgcgcaacgtgctcgaacgggccctggtgctggaggccggacccgaactggagctcgccgccctggagccgcagggcaccagcggcccgcccgatgtggaccccgacgcgttcgtcgtctctggggctccgcgccccttgcaggacgtggagcggttgtacgtccggcacgtcctcgcccgcttggatgggcgccggatggaggccgcccgggtgctggggctctcctatcccaccttcctccgccggcttgaggaggagtag

SEQ ID NO: 7396 - DNA, 1266 bp, Myxococcus xanthus
atgaaattcctgagagagctccgctcggtcctcaacctgaccgtgctggtggccgggctcggctacttcgtcgacctcttcgacatcacgctgttcggcgtggtgcgtgtcgcatcgctcaaggacatcggcgtcaccgacccggccgacatcctccagagcggcctgctcatctacaacgcgcagatggtgggcatgatggtgggcggcctgctgtggggcgtgctcgccgacaagcgcggacgcctgtcggtgatgttcggctccatcctgctctactccttcgcgaacctggccaacgccttcgcctgggacgtcaccagctacgccgttctccgcttcctcggaggcgtggggctcgcgggtgagctgggcgcggccattaccctggtggcggagtccctgcccaaggagaagcgcggcctggggaccaccatcgtcgccacgctgggcatgctcggcatcgtcgccgcggccttcctgggccagcacatgcactggaagacggcctacctcaccggcggcttcatgggcctcgcgctgctcttcgcgcgcttcaaggtgtcggagtcggagctgttcagcaagaagatggaccccgcgcgcgccaacccgctgctgctcctcaccggcggccggttcatcaagtacatctgctgcatcctcatcggcgtgcccatctacttcaccacgggcatcctcttcaccttcgcgcccgagctgacggccggcctcaacgtccagggcaccgtgacggccggcaacgccatcctctatggctccatcggcctgacgctgggtgacttgctggcgggcgtcttcagccagtggctcaagagccgcaagcgcgcggtggcgatgaacctcaccgcgggcttcgtgctgatgctcgtctacggcctcaccccgggcctcaccagcaccatggtgtacgggctgagcttcctgattggcatcaccgtgggctactgggccgtgctggtgaccatggccgccgagcagttcggcaccaacatccgcggcaccgtggccaccaccgtccccaacttcgtgcgtggctcggcggcgctcgcggccagcggcttcgcctacctgaagggcgagatgtcggtgtccaccgcggcgctcatcgtcggtagcatctgcttcggcctggcgctgctggccctcacccggctggaagagacgttccaccgggacctggattacgaagagacggcgaacggcccgcagccggccgcccagccctcccagtccggcacctga

SEQ ID NO: 7397 - DNA, 2022 bp, Myxococcus xanthus
caggcgccgggcttcatgtgcttctttcgcggccagggccatgtcttcgagctggcgaacacggcctacatgcagctcgtcggacaccgggacatcctcggcaagcacatccgggacgccctgcccgaattggatggccaggggtatttcgagctgctggaccgtgtcttcaccacggggcagaccttcgtcggccggggcatgaaagtctcccttcagcaaacccccgatgacacgctggcggagagctacgtcgacctcgtgtatcagcccatcatcgagccggacgggtccatctccggcatcttcgtccagggccacgacatcacggagcagaagcgcgcccaggacgaactgcgccagtacaaggaccatctggaggagctcgtccgggagcgcacccgcgcattggaggagagcgaggccgaacggcgtcaagcagaggccgccctccggcaggcccagaagatggaagcagtgggcaagctcaccggcggcgtggcgcacgacttcaacaacctgctccaggtcatcagcggaaacctgcagctcctgttcctggatgtgggcgacaacgcccaggcgcagcgccggctgaccacggcggtgggcgcggtggagcgcggcgcccggctcgcgtcccagttgctggccttcgcccggcggcagccgctcaatcccacggtcatcaacctgggccgcatggtccgcgacatggacgacttgctgcggcgcgcgctcggcgaggacgtggcgctggagaccatcatcggcggcgggctttggagcacgttcgccgatccgaaccagctcgaaaacgtcattctcaacctggccatcaacgcgcgcgacgccatggcgagcgaaggcaagctgaccgtcgaggccggcaacgccatgctggatgaccactacgcccagttccacccggacgtcgtgccgggccagcacgtgttgctggcgatctccgacaccggctgcggcatgccgcccgaggtgctggagcgcgccttcgagccgttcttcaccaccaagcctgaaggccacggcacgggcctggggctcagcatggtgtatggcttcgtcaagcagacgggtggccacgtcaagatctacagcgaggtcggccacgggacgaccatcaagatctacctcccgcgttcgctccaggcggagatgccacgcgccgaggtcatccccgaacaggtcgaaggcggcaccgagacgctgctcgtcgtcgaggacgacgcggaggtgcgcgccaccgcggtggagatgctgacggagctgggctaccgcgtgctcaaggcctctgacgggcagagcgcgctcgcggtcatccagagcggcatccccatcgacctgctcttcaccgacgtggtgatgcccggcccggtccgcagccccgaactggctcggcaggccaaggccctctccccggacctggaggtgctcttcacgtccggctacacggagaacgccattgtccacggcggccggctggatccgggtgtccaactgctgagcaagccctaccgccgcgaggacctggcgcggaagatccgccagctcctggccgcccggcagcaacgcatcgcccagcgcgaggccccccagccgacccgaggcgccaccacgccggcacccgctcgcgtgaagcagaccgggctgcgcatcctcctggtggaggacgacgagaacatcctcctccccgtctgcgaactgctggagacgatgggccacacagtgacggccgtcgcctgcgcggaagaagccacgcccctcttgcgcacacaggagttcgacctcctgttcaccgacgtgagcctgcctggcaagtccggcatcgagctggcccaccaggccgtccaggacgtgcccggccttcgcgtcatcatcgcgtccggccacggcgccaacgtggacatcggtgccaaggggccgctcgacagcgccgtaatcctgcccaagccctacggcctgtcccagatcgagcaggcgctcgcccaggccatggcctga

SEQ ID NO: 7398 - DNA, 804 bp, Myxococcus xanthus
atgcacctcatcgccgccgcgcagatggtgtccaccgccgacaaggcccacaacctggaagccgcgacccggctcgtccggcgcgccgtcgcactgggtgcccggctggtgggcctccccgagaacttctcctggatggggccagagcccgagcggcaggacgccgccgaggggctcgacggtccgacgctgtcccagatggccagcctggcccgggagctgaaggtgacgctgctggccggcagcgtgctggagacgggcgcgccgggtgggcgcctctacaacaccagcgtcctcttcggccccggcggcgagcggctggccgtgtaccggaaaatccacctcttcgacgtcgaggtgggagatggtgcgacctatcaggagtccgcggcggtggcgccggggacggaggtggtctccgcggagacggaggtcggccggctggggctatccgtctgctacgacctgcgattccccgaactgtaccggcggctgtcccgcgaaggcgccacgctgctggcggtcccggcggccttcaccctcatgacgggcaaggaccactgggaagtgctcctgcgggcccgcgccatcgagaaccaggcgtacgtgctggcgcccgctcagggaggacggcactccgccaaccgcgtcacctatggccacgccctggtggtggacccgtggggcctggtgactgcgcgggcctccgagggagaggggctcgcgctggcgccggtggacccggagctgcaagcgcgcatccgacgcaacctcccctgcctggagcaccgccgtttgaactag

SEQ ID NO: 7399 - DNA, 333 bp, Myxococcus xanthus
atgaagggcggcgtccaaatcaagcgcgccacggccgacgagtggagccccgcccgggaaggccagccgctctacgagaatgacaaggtccgcaccgaggcgggcgccggcaccgacatcgtcttcgccgccaacggcagcacggtgcacctcaccggggactcgctcatcagcatcgcggagacgcgcacccgccccggccagcagcgcacggacctcaccgtgttgcggggccgcatcgacgcggagctggagaagcccgccacccagtccctgtccgtcaccacgccgtccgccaccatccaggcgggaagggagattgtcttccaatga

SEQ ID NO: 7400 - DNA, 348 bp, Myxococcus xanthus
atgaaggcggcgctcctcctcctcacatggctgggcacgacgcccccgggcaccgtggtggtgggccccaacgaatccctgcgccaggtggcccagcgcaccctgggcgacgcgcgcgccgcggaggaactgcgcgcactcaacggactttcctcggacgacgtggcggcggggacccggctgaaggtgcccggccacgagcgcgtgctggcgcacaaggccctggagacggcgcgcacgctggtggccagatctaagcatgcgagcgtccccccaccggcctcctgccggcttaaggtcacgaagtcccatgtccacgaggcgcaatacatgcagtgttcctcgtag

SEQ ID NO: 7401 - DNA, 1701 bp, Myxococcus xanthus
atgcccacgcagcaagccaacccgagtgtcaacctcaacctcgtcctggaccaggtcgccaaggacaagggcatcgaccgggctgtgctgattgccacgctcgaagacgcgatgaagaccgcggccaagaagcactttggccaggaccgcgagctcgaggcgaagtacgacccggacaagggcgtcgtggagctgttccaggccatcaccgtggtcgaggagattgtcgatccggtccaggcggtgaatcagatctccctggtcgaggcccacaagaagggcatggaagtggagccgggcgacgagctcgtgttccagatcttctaccgggacgaggacgccgccgaggccaaggcccaggacgaccagtacggtgacatcctccgcctgaagaccttccgtcgcggcttcggccgcatcgccgcgcagacggccaagcaggtcatcctgcagcgcacgcgcgacgcggagcgggagaacgtcttcaacgagtaccgcgaccggaagaacgaaatcgtcaccggcatcgcccgccggttcgagcgcggcaacatcatcgtggacctgggccgcgccgaggccgtgctgccggtgcgcgagcaggtcccgcgtgagacctaccgtcccggcgaccgcgtccaggcctacgtgctggacgtgctccgtgagtccaagggcccccagattgtcctcagccgcgcgtccgtcaacctgctcaccaagctgttcgagatggaggtgccggaaatcgccgaaggcatcgtcgtcatcgaggcggcggcgcgtgagccgggcggccgggcgaagattgccgtgtccagccgggactcggacgtggaccccgtgggcgcctgcgtcggtatgaagggcagccgtgttcaggcggtggtgcaggagctgcgcggcgagaagatcgacatcgtccccttcgacgaggatccggcccgcttcgtgtgctcggcgctggccccggcggaggtcagccgcgtcatcatcgacgaggccaaccacgccatggagctcatcgtcccggacgaccagctcagcctggccattggccgtcgcggtcagaacgtccgcttggcagcccagctgaccggctggaagctcgacatcaacagcgagagccgggtccgggagctgcgcgagttcgccaaccgctcgctgggctcgctgcccggcgtcaacgagatgctggtggagacgctctacgcgcacggcttccgtcaggcccgggacatcgccgaggccaacgcggagttgctggcgcagctgcccggcatcgacccggcccgcatcccctccatgcaggaagccgcccggacccggatggtcgaggatcaggcggaactgtcgcgcatggattatgaaagagagcaggcccgcatcgcggaggctcggcggcatccggacgagctcagccagcccgagcgcatggcgcgcgtgcgtggcgtcggtgagaagaccatcgagcagctcatcctcgcggggtaccgctcggtggaggacatcgccaacgagaaggacctggcgaagctgggcgatgttccgggtgtgggtatcaagaaggcccgccagctgaagagcgcggcggaaaactatctggtggaggaagccaagctgcgcgcggagctgaatgccgagcgcggcgccatgacggtggcacttgagggtggcgcagaagccaccaaggcgccgtaa

SEQ ID NO: 7402 - DNA, 486 bp, Myxococcus xanthus
atgtcggagaagaacctcaagcagacggtggaggagcgggccttggccctgctcgagcccattgtcgcgggtgaaggcctggagctcgtggacctggaattcctccgggagcgcgagggctgggtgctccggttgttcatcgacaagccgggtggccgcgtagggctggacgagtgcacccaggtgtcgcgcgcggtggatccgtcgctcgacgtggaggacttcatcccccacgagtacaacctggaggtttccagccccggggtggaccgtccgctgaggaagccgacgcacttcgagcgggtgaagggacagcaggtgaaggtgaagacgttcggcccggtgggagagcccccgcgcaagaacttcaccggcacgctgaccgaggtggcaggcgacggcatctcggtggaggtggaaggggccggaaccttccacatcctcttcaaggacatcgccaaggcgaacctggagttccagttctag

SEQ ID NO: 7403 - DNA, 1260 bp, Myxococcus xanthus
accagtggggtgccccagtccggcggtccgcaagacgaactggcacatgccgtgaccacctccggcgacgcggtctatacggcgggctacaccagtgggcagctcggcgcggagccctcggcggggggacaggacgcctacgtttcgaagtacgacgcctcgggcgcgctgctgtggacgcggcaactgggaacatccgcgaatgaccgtgcgctcgcggtgtccgcggatgaatccggcaacgtctacgtcgcgggctacacgtggggcagcttcagcttctacgagaacgccggcggcacggacttgttcgtggcgaagtacgacgcgaagggggccttccagtgggtccggcagttcggcaccgccacggatgactacgccacgggcatcgccgccacgcggctggcgtcgcatgacgtggtcttcgtcagtggctactcactggggcgcttcgatggctcggcgccgcaaggcaactacgacgtggtggtggccaagttcgacacgggcggcaatccctactggctgcgccagttcggctccgcgcgcagtgacgtggcgctgggcgtggccgtgagccccaacgaggacgtctatgtcacgggctacacctacggcagcttcgacggcgtgacgaacccgggcaacacggtggacctgttcctggcgaagtacagcgtcctgggcgagccgcagtggattcgccagctcggctcctcgcatgacgagttcggcaccggcgtcgcggtggcggacgacggcggcgtctacgtgtcgggctacacgtcgggcgcgctggaggggagcacccgcctgggctcctatgacgccgtgctggtgaagtacgacacccaaggcaactggcattggacgcggcagattggcacggcgaccaccgactacgcgcagtccgtggcggtgggcaaggagggccgtgtctacctggcgggattcacctccggcgccatgggcggcgaaccgttgctcgggagcaccgacatgttcctggccacctacgacagccgcggcacgtggctggatttccggcaggtgggctccacgtcggcggaccgtggccagggcgtggccaccgcggaggacggctccgtctatctggtgggctacaccttggggcagacgtccagcttccccagcgcggggggctacgacgcggtgctgtaccgcttcctggatggcgccgcgttgccggatgagccgggtccatgggggccccgaggggactccaagggcctctga

SEQ ID NO: 7404 - DNA, 729 bp, Myxococcus xanthus
ccgcgctacgcttccgccatgagccagcagggcgacggcgcggcgacggcccgctacaaacaagcggccgccgaatgggcggtggacggcttcctccagccgggcatggtggtgggcctgggcacgggcagcaccgcggccttcgccgtccagcggctgaccgcgctgcgcgcgcagggacggcttctggacatcgtgggcgtgcccacctcgcgcgccacggaggcgctggctcgctcgctgggcgtgcccgtgtcgacgttggacgcgcaccccgtgctggacgtcaccctcgacggcgcggacgaagtggcgccggacctgtcgctcatcaagggcggaggtggcgcgctgctgcgcgagaagatcgtcgcgcaagcaagccggcgcgtcgtcatcgtggtggacgcgggaaagctctcccccgtgctgggcacgcactggccggtgccggtggaggtgatgtccttcggttggcgctcccaggcgcggttcctcgaatcgcttggcgcgcgcgtcaccgtccggcagggcgctggcggcgagcccttcctcacggaccagggcaacctcgtgctcgactgcgccttcggccccatcgacgcgcccgcggcgctggccgcgagcctgggcgcgcgcgcgggaatcatgggccacggcttgttcctgaacctcgccacggacctggtggtggcggggccggagggcgtggagcaccgcgcgcgctga

SEQ ID NO: 7405 - DNA, 632 bp, Myxococcus xanthus
atggtgctccagggcatcttctcctcggcgtccttcctgtaccgcaccgagctgggcgcggagggtgccggcgccaatcaggtggtgcggatgacgccgaatgaagtcgccaccgcgctggccttcgccatcaccgccggccccgccgacgcggagctgatggccgcggccgaggcgggccaactcgactctccggacgagcgtgagaagcacgcccgccggctgctggccacgcccgcggcgcagcggcacctgtaccgcttcgtcgaggagtggctgggcatcaccggccaggccaacctcaccaagaacaaccaggtgttcccggtcttcagcgcggccttcaaggtctccagccaggcggagacgaaggccttcatcaaccacatcctgaaggagcgcaacggctccgtccgcgagttgctcaacgccgactacacctacgccgacgcgcgcatggcgtacttctacggcacccagccctccatgccggacggcacgctgggccggttgccgctgccggccgagcgcgcgggcattctcacccacgccagcgtgctggccacctacgcgctcttcgactccagctcgcccatccgccggggcaagttcatcatgcaccgcctgctgtg

SEQ ID NO: 7406 - DNA, 2237 bp, Myxococcus xanthus
ctggccacggacctgcctgcttccctggtggtgttcctggtggcgttgccgttgtgtatgggtatcgcgctggcttcaggcgcgcccatcgtcagcgggctcattgcgggtgtgattggcggcatcgtggtggggctctttggaggcgtgcccctccaggtgagcggtcccgcggccggcctcgcggtcatggtgtttggcttcatccagcagatgggcctggcgatgacgtgcgcggccgtggccgtcgcgggcgtggtgcagatgattctcggtgggttgaaggtggcgcgcggcgcgctggccatctctcccgccgtcatccacgggatgatggccggcatcggcatcctcatcgtcctggggcaggtccacatcgtgatgggcggcgcgccgcagtcgagcgcgtggcagaacgtgaaggagctgccggggcagattgcggaccttcatggctccgcgacgctgctgggcctgctgaccatcggcttgatggtggcgtggcagttcgttcccggaaagttgaagaaagtccccggtccgctcgtggccgtggtgagcgccaccgcggcggcgaccttcatgggcgccgacgtggcccgggtggacctgccggagaacatcttctccagcatccaactgcccaccttccccaagggcgactgggtcgccttcggcacggcggtgctgtcgctggcgttggtcgcgagcgcggagtcgctcttgagcgcggtggccacggacaagatgcacacgggcccccgcgcgaacctggaccgcgagctcttcggtcagggcctggcgaacacgatttcgggtctggcgggcggcctgcccatcaccggcgtcatcgttcgcagcgccaccaacatcaccgccggcgcgaagacgcggctgtcgggcacgctgcacggcgtatggctgctcctgttcatcacgttgctcggctcggtggcggggctcgttcccctcaccgtgctggcgggtctgctcgtcttcgtcggcgccaagctggtgaacgtgcaccacatccgtgagctccagaagcgtggggagctggccgtgtacctggtgacggtggccggcgtggtgggcgtcaacctgctggccggtatcggcatgggcctggcgttcgcggcgctgcgcctgctgtggcacctgggcagcgtcaaggtggacgtgcaccagcaggcgcatgcgtcctatcaggtgcgaatctcgggtgcgctgacgttcgtcggcgtccccaagctgtccaccgcgctggcgcaggttccgacgggctccaaggtggaactggacctggcggtgcagacgctggaccactccgggcacgaagccctggagagctggtgcgacacacattgcaagacgggcggctcggtgttcgccgagtcgctcgaagatgtctggagccgcaagggcacggtgaagccgagcagccccgtggtcgttgacggtcccaatcacaactcgcttgtctctggaggtgcgcagtgaggaagctcattcgcggtctgttggactttcaactcaacgcccgttccagctaccgggagaagttcgcgttgctggcgcaggagcagaagccggattgcctcttcatcgcctgcgcggacagccgcgtggtgcccaacctgctcgtgtccatggacccgggcgacctgttcgtggtccgcaacgtcggcaacatggtggcgccgtcggattcgaaggggcagtcgacgggcgaccagtccgaggcggccgcgctggagttctcgctccgcagcctgccggtggaggacatcgtcgtgtgcggccactcgaactgcggcgcgatgaaggccgtcctcgctggcggcgtggggcctgagaacccgaacctcaagagctggctcgagcacggcaaggccgcgctccagcggatggatgcgaacccgacgctgggggagggccggtcggattacgatcgcctgtcccagaacaacgtgctgctgcagttggagcacatctccacctatccgttggtgaaggagcgtctcgacgcgggcaccctgcggctgcacggctggtggttcgacatcgccaccgcgcaggtccacgcctggcgcccgttgctgggccgcttcatccccatggacgaactggtgggcgaggcactgctgcgcgagctgggcacggacacgcacgcccccggcgcgctcgccaacggcaacggcgctcagcgcatgtcggtggtggccagagctcagtag

SEQ ID NO: 7407 - DNA, 708 bp, Myxococcus xanthus
agcgcgcgcgacccgagcccggtgcaggagcccacacgcccttcgacgcccgcgctctcggctgtctcggtcgagcgcggagcccgcgtgccggagctgaccggcacggagagcacggcgcgcgccgcgactggcggcggacgaccgtcgccggaagagcgcgtcttcgagcggcccacgggcagtctctcctcgcgagacgtcgccgtggccttcgtcatcgggaagcactccgtggcgcctgctccggagccggagccagccaagcggcccgcgacgactgtggcggaagccgcgacggctggcagctcggaggacgacctggggcccgacgcggacttcgaccgcgtgctctccggcccagggcccaacgccaccaagcaccacaagccgaccgtctatgttccgcccgacccgacggcgccgcgcgagtcgctcgacctggccaccgtcttcgcggtggtgcatgcccggcgttcggagctggcggcgtgtgcccgggagcagtccgcgccgccgcaggagggggaccgggcagtcctgcgcttgagcgtccttccgagcgggaaggtggagtccatcaccaccgagacgccgtggctgcgaggcacgtcgctcgtgcgttgcatgcagcagaagataggcgcctggacgtttcccaggcatcgaacgcagggagcgcccgtcgtcttccgatacgagttctga

SEQ ID NO: 7408 - DNA, 330 bp, Myxococcus xanthus
atgcctgcttacgtcctggtcgaggtctcggtgcacgacgcgcagacctacgagcggtacaagcagctcgcgcctccgtcgctcaaggcctacgggggccgctaccttgtcaagggtggccccacccaggccctggaaggcacctggcagcctccgcgcttcgtcctgctggagttccccagcgtggagctcgccagggcctggtgggcatccccggaatacgccgccgccaaggcgctccgccacgaaagcgcgcactccatcatgttgctggtggagggcgtgccggccacgacgcccgttaccgaagtaggggagtcgccggcctga

SEQ ID NO: 7409 - DNA, 2178 bp, Myxococcus xanthus
atgacgattcgccgcaccgaaggtccgaagcccacgattcgctccactgctgcttccgaggctcagtcgaagacggccgcgaagcccgcgaccatcgccccgaacgtcatcaaggacgggttcggccccgcggccaagacgtcggacctggcgcgcgcggagaagacgctgaagccgctgccgcctcccgtgggccggctctccctggaaagccgcgaggcgcagaccgccatccagacgtcgctggcgcacctggccccctccacccagacctccatccgcaaccccggcatcatcggcggcgtgcagttcccggcgtacacgccgaagagcgtggagcgtgactcgctgggcatgacgcacgtgcgtctggaccgccagcacgagggcgtgaaggtcttcggcgagcaggtcgtcacgcacctcgacgccgagggcaaggtcaagagcaccaccggcgaccagtctgagatcccggccggcctgggcaaggagaagcccaaggtgtcgcacagccaggcgctggacatcgcgatgaaggcgttcgacggcaagccggaccgccagccgaactccgagcgcgtcatctacaaggacatctccggtgagtaccactccgcctaccgggtggaagtcaccaacgtggatggcaccgacaatccgcgcaagatgaactacctggtggacgccaacaccgggaagctcttcgagcagttcaacaccattgacggcttcgcccgccagcacggcgccgcgcatggccacacccacgccgaaggcgcggaccacgccgaccacgcccacggcgctgccgcgacggcttccgagatcaaggcctcggccacgccgaaggcggagatcgccgacctggccaccgtcacgtcgaagatcaacgtgacccaggacggcaccgtggaccagctgaagctggacctggacatcgaccacacgttcaagggcgacctgtcggtcacgctcaccagcccctccggcaagtcggagacggtgcacaaccgcaagggtggcagcgcggaccacatcaagggcagcttcgacctgagcggcttcgcgggcgagtccgcgaagggcgagtggacgctgtcggtgaaggacaacgcgcgccgcgacacgggcacgctgaacagctggggcctgaccatcaccccgaaggccgttgagcccaacgagcccggtcccggcgagaagatcgcggacgacacgtccatgtacagcggcaaggtcgcgctggaaacgaagaagcaggcggacggcacgtacacgctcgaggacggcacgcgcggcaagggcgtggcgacctacgacgcgatgaaccgcgagcgcgccagcggccagacgcagatcaaggacaacaacgacgtctggggcgaggccacggacccggagcgcaacaaggccgcggtggacgcgcactacggcggccagatgatgtacgactacatgaaggacatcctcggccgtgactccatcgacggcgcgggtgagaagctggtgtcctacgtccacgtcagcaacaactacgtgaacgcgtactgggacggcgagaagatgagctacggcgacggcgacggccgcaactccggtccgctcaccgcgctggacatcgcgggccatgagattgcccacggcctcaccgagcgcaccgccggcctcatctaccgcggcgagtccggtggtctgaacgaggcgatgagcgacatcatgggcgctggcctcgagtggtacgcgtcccagaagaaccccgacgtgaagttcaactggacggtgggcgagacggcctggacgccgaagaacggcgaccccaccgacggcctgcgctacatggacgatccgacgaaggacaactactcggtcgacaactacaagaactacccgaagcagaccgaggtgcacggctccagcggcatcgcgaacaacgccttctacctgctgaccaacggcggaaccaaccgcacgtccggcatcgaagtgaaggacgccatcggcatggagaagggcctgaagatctactaccgcgccctggctcactacatgacgccgagcaccacgttcgcccaggcccgcaccgcgaccatcaacgcggcgacggacctctacggcgcggactccgctgaagtggcgaaggtcaaggagagctggaccgccgtcggcgtgaactag

SEQ ID NO: 7410 - DNA, 369 bp, Myxococcus xanthus
atgggcgaggcccgcttccagccccgcctgcccccgcgcttcggcgagtggttcatcgaccagctcttcgtcgtcgcgctgccggaggagttcttctaccggggctacctccagacgcggctgcgcgacgcctggccccagggccgcaagttcctggggggccggctgggccccgccttctggctgacggcgctgctgttcgccctgggccacctggccatcttccaggcgtggcggctgtccgtgttcttcccagcgctgatcttcgggtggatgcgggagcgcaccggcaccgtcatcggcgccgccttgtttcacgcggcttgcaacctctatgtgcggtttctcgaggtttcttttttcggctga

SEQ ID NO: 7411 - DNA, 384 bp, Myxococcus xanthus
atggtggagcacgacggtaagacgctgcccgcccgcgtggtgatggccagccaggacctccaggtggcggtgctcgccgctccggatggcgcgtacccggcggcgcccgtgaaggtgcttcgggacggcgacagccttgacggccgctggctggtgggcgtcctccccgccaagaagggccagcccgcgcgccccgtgccggcgcgagcccgggcggcccagccccccttctatgatgtccccctggccctgcccgcgggcagccccgtcttcgacgcggaggggcggctggtggcggtggtggtgaagaagcaccgtcgcggctgccgggtgcttccgctgagcgccgtgaaggtggagctggcgtcggtggacatgccatga

SEQ ID NO: 7412 - DNA, 1209 bp, Myxococcus xanthus
gcccgcgcccgggcgtggtgcgcgccaagcctgggcggcagcgtgcgccgacaggcggagaccgtggcggacgtggacatcatcgcctccgcgccggaggcgggaccggtgctggatgccctggcgaacgcacccggcgtggccgcggtgctgggcaagggcgaaagcaaatgctccgtgcggttggaggccggcgacctccaggtggacctgcgcgtgctgcccgacgaggacttcgccaccgccctgcaccacttcaccggctccaaggcgcaccacatccgcctgcgcaacctggggcaggaacgcggcctcaagatttccgaatggggcgtccaccgggacgacggcaccaaggtgcccgtgacggacgagtccgggctctacgccctgctggacatgcagtacgtgccccccgagctgcgggaggacaacggcgaggtggaggccgcacgcgagggacagcttccccaggacctgctcacgctggaggacgtccagggtgcggtccacgcgcacagcacctggtccgacgggcgcaacagcctggaggagatggcgctcgcggcgcgggcgctgggtctgaagtacctgaccgtcaccgagcacagcgaggcagccatctacgcaggcggcttgaaggtggatgacctcaagcgccagtgggaggagatcgaccgcatcaacgcggcggtctccggcgtgcggctgctcaagggcatcgaggtcgacatcctggagtccggcgcgctcgactacgccgacagcgtcctggagcagctcgaggtcgtcatcggctccatccacgtccggcacggcatggacgaggaccagatgacgcgccggctgctggccgcgatggacaacccctgcctccagattctggggcaccccaccggccggctcatcaacagccgggaaccctaccccgtccgcatggacgaggtcctggagcgggccgccgaacgcggcgtggccgtggaggtcaacggcaagcccgcgcgcctggacatcaaggccgaatatgtccggcaggctgtgaagcggggcgtccgcctggtggtgagctgcgacgcgcaccagaaggaggacctgaggaacctggccttcgcggtggctaccgcgcgccggggctgggcccgaaagggggacgtgctcaacacgctcccgacggaccgttttgtcaccgcgctgcgcgagcgccggtga

SEQ ID NO: 7413 - DNA, 183 bp, Myxococcus xanthus
tgctctaaagttgcccagctccagcagaccctgcagcagctgacccagcgcaacgtccttctggagacgcgcgtggaccccagcctgttgggtggtgtctccgcccaggtgggcagcatcctctacgacggcagcatccggacccagctcgaagagatgcgccgcgaattgaagcagcgctga

SEQ ID NO: 7414 - DNA, 1479 bp, Myxococcus xanthus
atgtcgcagtccctactccaccggtattccgaaggtccgtccacgctggcggcgcccgaggaggctcggccctttctgggggccctcctgagcgcggcgggttgtggggtggccctgctggaccgggagctgcgtccggtgtgggtgaatgccacgctggcggcgctgtccggcctggagccgcgcgcgcacgtgggccgtcctctcgcggagctgtggccgcaggtggcgcaggcgctgtcaccgctgctggcccgggcactctccggagaggacgtcacggatacccctgtgcggggcgtgctggcccccgccgcgggtgagcggcacctgcgggtgggtctgtccccggcgctgcagggcggcgcgctggcgggggtggcattgtgggtgcgcgatgagacggagcgcttcctcgaggagcagcggctgcgcgcgcgggagtctcacatgcgcagcctggcggacgtggcctgcgacgggcacttcctgcatgacaacggcatcgtgatggacgccaaccgcgcgatgtcgcagctgctcggctacgcgtcaccctcagagatgatcggccggcacctggcggactacgtcgccccggagttccgctcgcaggtggggctggtgctcagccgcgggctggaggccccctacgaggtggtcgtcctccgccgggatggccagcggctgcccctggaggtgctggggcgctacgtgacgtgggaaggccggcaggtgcggttggtcgccgtctgggacatcagcagccgcaaggccgcggaggagctctccgcgaacaccgagcagttccggcaccagatgctgggcgccgtagacgcggagctgcgagcgcccctgcaatcactgcgggagggcacgcgctccctgcagcggctggacgggctggaggagccgcagcggaccctggtgagccaggtggcccggtccgcccggcgcatggagcggatgctccaggagttgatggacttcacccgcacgcggctggcgggcggactggcgctgcggccagagcccgccgtgctggacgcggtggtgacgcgcgtcgtggaggagcgccgccgtgagcatcccgggcgaaccctccacctggagacggaaggcgacctgcgcggacactgggatacccaccggctggcgcaactggccgacaacctcctgggcagcgtgctccatcaaggggccgaggattcgccggtcaccctgcgcgcggtgggcgcggtgggcggcgtcacgctgtgtgtgcagagtcccagactcacggtggcggcggaggagcgctcctccctcttcgagcccttccgcagggagcgcagcgccacgccagagggcctgggcctggggctctacatcgccaggcagatcgccgtggcccacggcgggaagctggcggtggagtcctgctccgggggcggcatgagtttcaccgcctggctgccccgcgaggggccggggcattga

SEQ ID NO: 7415 - DNA, 1548 bp, Myxococcus xanthus
atggaaatccgcgccgacgagatcagcagaatcatccgggagcagatcaaggactacgggaagaaggtcaccgtcgctgagacgggtaccgtgctgtccgtcggtgacggtatcgcgcgcatctacggcctcgagggcgcgctcgccggtgagctcgtggagttcgccaacggcgtgcagggcctcgtcctcaacctggaagaggacaacgtcggcgtcgccatcatgggtgacttccaggccatccgcgagggtgacacggtcaagcgcacccagcagattgcctccgtgccggtgggcaaggagctgctcggccgcgtggtggacccgctcggcaagccgctggacggcaagggccccatcgccgccaccgagacgcgccgcctggaagtgaaggcgcccggcatcgtgtcccgcaagagcgtgcacgagcccctgcagacgggcatcaaggcgctggacgcgctggtgccggtgggtcgtggtcagcgcgagctcatcatcggtgaccgtcagacgggcaagacggccgtcgccatcgacaccatcatcaaccagaagggcctgaacgtttactgcatctacgtggccatcggccagaagcagtcgacggtggcccaggtggtggagaagctgaaccgctacggcgccatggagtacaccacggtggtggcgtccaacgcctccgacccggcccccatgcagttcttcgcgccgtacgccggcgtggccatgggcgagtacttccgcgacaacaagatgcacgcgctcatcgtgtacgacgacctgtccaagcaggccgtggcgtaccgccagctgtcgctgctgctccgccgtccgccgggacgcgaggcctaccccggcgacgtgttctacgtgcacagccgcctgctggagcgcgccgccaagctgtccgacgaggagggcgccggttcgctcaccgcgctccccatcatcgagacgcaggccggtgacgtgtcggcgtacatcccgacgaacgtcatctccatcaccgacgggcagatcttcctcgagacggacctcttcttcgccggcgtccgcccggccatcaacgtgggcctctccgtgtcccgcgtcggttcggccgcgcagatcaaggccatgaagcaggtcgccggcaccatgaagctggagctcgcgcagtaccgcgagctggccgccttcgcccagttcggctccgacctcgacaaggccacccaggagacgctggcgcgcggcgcccgcatggtggagctgctcaagcagggccagtacgagcccatgcccgtcgagaagcaggtcatgcagatctacgccgccaccaaccgcgacgaccccaagaagcgcggctggattcgcgacatcccgacggccgacgtggtgcgctggatgcgtgagttcctggagttcgccgacggcaagcacccgaacgtcgccaaggacctggcgtcgaagcgtgagctgaccgccgacatcaagacggcgctgagcaaggccatcaccgagttcaacgaggtcttccagccgacgccgggcgccaaggtttaa

SEQ ID NO: 7416 - DNA, 336 bp, Myxococcus xanthus
atggaagcgatgcagcgaaacgagtcggcgcccccgcgccgggcgtggctgccctggggcctgctggtgagcgcggtgctgctcgccacgacaggggcctgggcgggttcgcgctccatctccgccctggtggagcgcaacgacgcgctgacacgcgaggcggccgagtccgaggcccgcgtggccgagctccaggccctgcgcgaggccatgtcgcgccggctgcgcacgctggagcagcagcaccacgccgcctatgccgccgcggtgacggccaccgccgcgtgcaccacggcgctccagccgccgcccgcgccgggcaagcccttagagcac

SEQ ID NO: 7417 - DNA, 849 bp, Myxococcus xanthus
atggcgattgcgtgcgtggtgctggacttcgacggaaccttcacggacgtggcggcggagagcgcccccttcctccggcatttccggcagggcctggcggcggcgttgggcgaggatttggaggccgcgtgggaggaggaggtcgccacgttgcgcgcgggcgcggacgcgctgggttgggatttgggcggccgggtggtggcgcccgccacggcggacccgtacctgacggccacctgcgcggcccaccgcctcatgcagcgcttcgggcagggccaggacgaggcccgccgctccgacgtggtgcagaagctctaccgcgaggcctacgcgcactcggccaccgccttcaagccggaggcgaaggaggtgctggaggcgctggtggccacgggcctgccggtgacggtggtgaccaacgcgcacaccgacctggtggagaagaagctggaccagttggcgcccaaggggcgcgagaagctgacggtgtccggggatgcgcgcaagttcctcctggacccgccggacgcgccggatgcccgcttcaccgcggtaccggagacgcagacgctggacggtgtgctgcgccgccccgtctacctgcgccggggccggtacttcgaggccctcaagcgcgtctgggcgtccacgggcaccacgccggaacagacgctggtggccggtgacatctacgagctggacctggcgctgcccgccgcgctgggcgcgcacgtgcaactggtggcccgcgacaacgtgctgccctacgagctgaaggccatggagctgctgggcgcgcgcggcggcgtggaccgcagcctgcacggcgtgctgccccgccttcgctga

SEQ ID NO: 7418 - DNA, 561 bp, Myxococcus xanthus
ctaaagggcgccatcttcaacctgcccattggcgacaatgccagcggtgatgacccgctgtccgggctggcgggcctcttcggaggcggcgcgggcggcaaggacggcgcgtcctccggcggccctcagcccgcgggcctgggcggcatgggcggcgcggccatgggcatggcccagcccatgttcacgcagatggtggaacagatcacccagacggtccgcgaggtgcacctcaccgtctactggcaggaaggcacgcaggtggagagcatcgacctggtgacacacgtcgtgtcgctcgggccgggctcggaccgcaacggcggcgccgccgcggcccagggcggaggctccgacaaccagtgggtgacgcaggacgggcggcccgtggccaaccccatccccggccccaacggcgtcatgttggatccgacgacgcgccagcccctgcgccgcctctccgacgcgcagcaggacctgggcggccgccgggggaacatgggcggcggcagcccgctgggcaacccgatgatgccgggcggcttccgagggactcgatga

SEQ ID NO: 7419 - DNA, 642 bp, Myxococcus xanthus
atggaagtcatggtggccgtcgccatcaccgccctcatgggcacggtggtggccatggccttccagacgggcctgacggcgaaggagacggtggaggtggacgcggaccgctaccggcaggtccgcgtggccatgaaccgcatggcgcgtgagattggctccgcctacgtcagcgaccgctacgactccacccgcttccgggaccagaacgaccggcccagcaacttcgtgggggagcgtggcaagctgctgttcaccaccttctcgcaccagcgcctctacacggacgtgaaggagtccgaccaggccatcgtcgggtacttcgtggaggcgtcggaggaccgggaggcccgcggccggcaggacctcaagcggcgcgtcaacgcaaacatcgacgagcgcatggagcagggcggccacgtggacgtgctcttcgaaggcgtgaaggagctggagttcgcctactgggattcggagaagaaggagtgggatgacgagtgggacacgcggcggacggagcgcaagtccatcctgcccacccgggtgcgcgtgacgctgacggcggtggacgaaacgggcaaggaagcccgttacgtcacccaggcccgaatcatgctcaacacggagctgccgaggtactga

SEQ ID NO: 7420 - DNA, 1368 bp, Myxococcus xanthus
atgcccctgcccttcttccagcagacgccccggcggcgacgcaagcccccgccccgcccggcgcggcgggagcggcgctcgcggggcgtggcgctcatcatcgccattgtctccatcgccctcctgacggtgattgccaccgacttcgcctacaacagccgggtggacctgcagctggcggccaaccagcgggacgaagtgcgcgcctactacatggcgcgctcgggcatcgcgctgtcgcggctgctgctgcgcttccagaagcaggtggaccagacgcccatccccaacccggcggccatcctggggcagttgggcatcggcggcacgccgcaggccgggcaggtgcagccctcctcgctcaacatccagctcttcaagatggcgcgtgtggactgccacatgctccgcgggctggtgaagagcgacggcgcgggtggagaagtctccgcgctggagcccaagcaggacgacaacttcaagctggatgaagaggacgcggacccggcggcgcgcgaggtcgcctcgcagatgaccatgcgctccttcggcggcttcgaaggctgcttcctggccaccatctccgacgaggaagagaagctcaacgtgcaccggctcatcgcgggcgcgggtgacgcgcggcccacggcgctgcggctcatggacatgatggcggacccgcgcttcgagttcctctgggagcgagacgacgccaacaaggtgcgcagcacgccccaggacgtcctcctggccctcaaggactgggcggacgacgaccggacaggctcggcgttcaacccggtggacccggtgaatccgctgccgggtgggttctcggatgaaggcgcggcctacagccgttatgagcccggctatcagcccaagaacgcgcgcttcgacagcgtggacgagctgtaccgggtccacggcgtcaacgaccagttcatggcggcgttccgggaccgcctcaccgtctatccggacatcaaccgccggcccaacatcaacaccgacgacccggtgatgatggggctggccatcatgtcggtggcggaccagacgcggccggacccgcggctgagggacccggtgttcctcaacgagctcatcgaacgcgtgcgcgccgcgcgcatgttcagcttcttcgggatgtccgtgcaggacttcgtcgcggtggtggaagccgcgggcatcctggtcgacccggccgtgaagtccaacgtcgcgggcaaccggctcgtgggcgacaagagtcagaccttcaccatcaaatctgtgggagaagcgggcagcgtgcagaagacgctgaccgccgtcatccggctcgacgacactctgggccggctcctgtactggagagaggaatag

SEQ ID NO: 7421 - DNA, 1602 bp, Myxococcus xanthus
atggcccgtatccttggcctggacctcggcagtcacgccgtgaagggcgtggtgctggaggcgaagacgaagacgcacaccacccatgggttcgccgaggtccggcgtgcccaggagggcgagcgtgccgacacgctgcgagccgcggtgcaggagctgctgggccagctcccgccgggcaacgtggaccagattgtcatcgccctgcccggccccgcgctcaccacgcactcgctgagcctgccgttctccgacgccaggcgcatcgaggcgacgctgcccttcgaggtcggcagccagcttcccttcgacatctccgacgtcgtctatgactaccaggtcgtgggcctgaaggacggcgaaggcaaggagaaggccagcgacctgctggtgggcgtggtgcgcaaggaagagctggcggagctgctggcgctgctgtccgagctgaaggtggacccgcgcatcgtcacgcacccgggcctgacctaccagaacctgttccagcagcacccgggcctcttccaaggaacgggtgaaggtggcgcggtggcggtggtagacatcggccacgagcgcacctccgtgtcggtgggcaagcccggtgagggcgtccagttcgcgcgcaccttctccggcggcggcaaggacttgagcaaggcgctggcgacggagttccagacgtcgctggcggaggcgcaccactggaaggagcagcacggcgcggtggccagcgcggcccagggcccggacgcggagcgcgcggcggcggccttcgtgcgcggcctgcagccgatgctgcgcgagctgcgccccactctcaaggccttcacggcccgcacccgtcagcaggtgggcgcggtggtgctgtgcggtggcaccgcgaagctgccgggtatcgccgagcaactctcccgggacttgaatctgccggtgcgggtgctggcgctgcccgcggacgcgaaggcgattcccgcggcggagcagcccgtggcggcccaggcgtattcgctgtccctgcgcggcaacgcggcgggcgtgcgcgcgccgcgcttcaacctgcgccggggcgagttcgccttcaagggcgacttcgactacatgaaggacaagctggggctcctggcgtccttcgcggccacgctcatcctgctgctcatcgcgttcggcgtggtgcgcaactccgtgctggcgcggcgcgaggcgcaggtggacgccgtgctgtgtgacaccacccagcgaatcctgggccggtgcgagaaggactacaaccgcgcgctcaacatgctcgcgggcgtggagagcccggcggcggcgctgccccggctgacggcggtcaacctcctggcggaggtgacggggcgcgttccggacgacatgccggtgaagttcacccgcatccagatcgacctgagccgcgtcatcctcgagggtgagacggactcctcgaagcagatcgacacgctgtccaacgccatcaagaaccacgtctgcttcaaggacgtccggcagggcaaggtggagaagacgcgggacggcagcaagatgtccttccgcctggacgtgcaggtgcaatgccctggtgagcagggaggagagagctga

SEQ ID NO: 7422 - DNA, 558 bp, Myxococcus xanthus
atggccaagcttcaggaagtcttcgcccccgtccagacgtggttcgagcggctcagcgaccgcgagcgccgcatggtgtccatcgccggcgcggcggtgctggtgttcgtcctgttcgccgtggtgatgacgttcaccaacagcgcgtccgggtaccgcaagcgcaccgaggacaatctgaccaagctgcaggaagtgaacacgctggccgccagcttccgcgaggcgcaggccaaccgtcagtcggtggagcagcagctcaggtccagcaacgtgcagctcatcagctacatcgaggacaaggcgacgctggccggcctccaggtgcccaacatgacgcccaagggcgaggtgggcatcggcgacgggaaaatcgtggagagcgccgtggagctgaccttcacggacgtggacctgcgcaagctgaccgacttcctgcagacggtggagagcggccccggcgtggtgaaggtgaagctgttgcgcatcgagccgcgtcccgcgtcggacacgctgacggcgtggaccactgtcgccacctaccggatgaagccctga

SEQ ID NO: 7423 - DNA, 969 bp, Myxococcus xanthus
atgtccactgactccaaagccgcccgctggaagattctcctcggctacgccgcgttcgcggtggtggccttcgtcgtgggcctgctcgtcaccttcccgtacgacgccatccgcaagcggctggtcagcgaagcggcccaggcggggctcgcggtgcgcatcggttcgctgcgccctggcctggcgggcatcaccgccaccaacgtgcgcgtgagcaagccgccccagccgctgagcgcggacacggtggcggccctcgcgcggggcgaaggcatgctgggcgccgcggagctgggcgagccgctggtgctggacagcgtggcgctgcgccccgccctcttcccgccgggcatcgcgctgcgcgccagcgtcatgggcggcacgctgagcgcctccgtgggcctgctgggtgacacgcgcgtcaaggtgacggcggacgggctccaggcctccggcggcaacctgccggccttcaccggcatggacctggacggcgagctgaacgcggccctgtcgctgacgatgcccaagagtggcgcgcaaccggacctgtcccaggccaacggtgagctgacgctggacacccggaacatggtcatcaagagcggcaaggtggccatccccatgggaggcggcacggcggtgcccatggacctgccgcaaatcgacctgggcgcgctcaccgggcgcatccagttcgtcaagggactgggcacggtggagtcgctgcgcctgaagagcaacgagctggaggcagtggccactggcacgctgaagctgggcaagcgcctggagtacagcgagcccggcatggatgtgaacatcaagctggacccggagttccagaagcggctgggcctggtgggcgcgggcgtcaccatcctcccgccggacaagacggaccccagcttccgcgccgcccggctcgccggcttcctcaaccggccgacgttcctcccgcggcgctga

SEQ ID NO: 7424 - DNA, 1472 bp, Myxococcus xanthus
  unsure (1)..(1472): unsure at all n locations
atgccggagctggtgttctttcgtcgtggcgaggaggtgttgcgggtgggggtggaccgggcacggctggtgctcggacgcggcgagcagagcgacgtcgccatcccagaccccgaggtgagccgcctccaggtcgcgttgctgtgggacggcgagcgctgccgggtggaggatttgtccggcaagggcaccaccgtcgccggccagtccatcacccacggcgagctgccagacggcgcggacctggcgctgggccaatggcgcgcggtgttccgcatcagcggcggcagcgaaggcgcggacgtcaccaccgaggtgggccacacgacgtccgtccagtcccgcgacacgcaggccccgcgctggcagcccgcgcaggtgcgggtgaagcagggcctcaatgagtccgtgcaccgcttcacgggtgaaggcttcaccgcgggcaaggacgccggctgcgacctggtgctccaggaccgcttcgcctccagccggcacctgaaggtgacccggcgcgacaacaccttccacgtcgtggacctgcgctccaccaacgggacgtggatgggcccggtgcgcgtcttcgaggcggaagtcccgctgcccaccgtgctgcgcgtgggtgagacggagctggtgctggagcctgccgcgcccaccacgcgcaaggagcccacgtccttccacggcatcatcggcggcgacccgtcggtgcggcagctctcggagttgattgagcgggtggccccgtcctccgcggcggtgacgattctgggcgagtccggcaccggcaaggagctggtggcccgcgccatccacgcctgctcgcagcgggcgaaccggccgctggtgcccgtcaactgcgcggccatctccaaggagctcatcgagagcgagctcttcggccatgagaagggttccttcaccggcgccatgggcgcgcgcaagggcgccttcgaggaggccgacggaggcaccctcttcctggacgagattggcgagctgccgctgtacttgcagacctagctgctgcgcacgctggaagcgtgttaaatcaagtgtgtgagaaccagccgacggcaccaggtggacctgtgggtggtgcagnccaccaacagggtcttgctgccggcggcgcgcgaggcccccttccccgagagacctgtacatactggatttgtgtcatccccctgcacctacggccgctgcgcagcagtaaggcggacctgggctcactgtcaaagcaattcgtgcgcacctacgcccggagtggccagtccgtgagcttcacacccgcggccttggacagtctccagcgccacgcgtggccgggcaacatccgcgagctgcgcaacgtggtgcaccgcgcgctgcttttgcgcaaggggcccctcatagacgcgggggacatctccttcgaccagtagatgacccgcgagacgggcatcgccgtgccggagctgccgccgggg

SEQ ID NO: 7425 - DNA, 516 bp, Myxococcus xanthus
gtgtcgcgcatctccgcggggcggctctcgctggagttggaggagctcgagctggggtcgctcgtccgggacgtcgtcacccggtatgaaccccaggccgcgcgcaccggctcccccttgcagttggaggcgggagacttcgacatcgtgggccggtgggaccggctgcgtctggagcaggtcatcaccaacctggtggacaacgccgtgaagtacggcaacggcaggcccatccacgtgcgcctggagccgcatgacggcggagcgcggctgacggtgcgggacgagggcatcggcatcgagccccagcatctgccccgcctcttcggccgcttcgaacgcgccgtgtccgagcgcaactacgggggcctgggcctgggcctgtacatcacccgcacgctggtggaggccatgggcggccgggtccacgtggagagcaggctggggcgaggctccaccttcaccgtggagctgcccagccacctgggcgcggagcaggcccgtcaagccccctga

SEQ ID NO: 7426 - DNA, 978 bp, Myxococcus xanthus
accgtttcggcgctgggcctgggctgcatggggatgtccgacttctacgcgggcagggatgacgcggagtcggaggccacgctgctgcacgcgctggagcggggcatcaccttcttcgacaccgccgacatgtacgggtcgggcgccaacgagacgttggtgggccgggtgctcaagccgcaccgggcgaacatcgtgctgccaacgaagttcggcatcgtccgcgacccccaggacccgcagaagcgcggcatcaacgggcggccggagtacgtgaggcaagcttgcgaggccagcctgcgccggctgggcgtggatgtcatcgacctgtactacctgcaccggctggacgtgcagacgcccatcgaggacacggtgggcgccatggcggagctggtgcgcgagggcaaggtgcgcttcctcggcctgtcggaggtggacgcggacacgctgcgccgggcctcgaaggtgcatcccatcaccgcgctccagagcgagtactccctgtggagccgtgagccggaagacggcgtgctccaggcgtgccgcgagctgggcgtgggcttcgttccctacagcccgctgggacgcggcttcctcacggggcaaatcaagcgcttcgaggacctggcgcaggacgactaccgccgcttctcgcctcgcttccagggggagaacttcacgcgcaacctggagctcgtcggccacatcgagcggctggcgaaggagaagggatgcactccggcgcagctcgcgctcgcgtgggtgctggcacaggggaaggacctggtgcccatccccggcaccaagcgccgcaagtacctggacgagaacctcggcgcgctggaggtgacgctcacggaccaggacgtggccgccatcaacgccgtcgcgcctccgggcgtcgccgcgggtgggcgctatcctccgtccatgcagtcctcgctgcccaaggcgtcccagccgcgcggccagtga

SEQ ID NO: 7427 - DNA, 825 bp, Myxococcus xanthus
atgctcgtcgtcctggggttttccgtgggtgcgggactgctgggctcgctgctgggtatcggcggcgggctcatcctgattcccgtgctcacgttgctcctgaaagtggacatccagtacgcggtgggggcgtccatcgtctccgtcatcgccacgtccagcggcgcggcggcggcctacgtgcgcgaccggatggccaacacccgcgtggccatgttcctggagctggcgaccaccgcgggcgcgctcagcggcgcattcatgtccgggctggtgggtgggcgcggcgtgtacctcgtctttggcggcgtcatggcgtggtcggcgctggtgatgctgcggcggatgcgggcgagcgccgagacgccagtgcccgcggacgcgctggcggaccggctggcgctgcacggcagctactgggatgagtcgcagggccgtgaggtgtcctaccgcgtcacgcggccgctgacgggactggggctgatgtacgtggcgggcacggtgagcggcatgctgggcatcggctcgggcgcgctcaaggtgccggccatggacctggccatgcggctgccgctgaaggtgtccacggccaccagcaacttcatgattggcgtgacggcggcggccagcgcgggcgtctacttcgcgcgcggcaacatcgacccgttcatcgcggggccggtgtgcgtgggcgtcacgctgggcgcgtggctgggctcgcgccacctgatggcccgggtgaacagcacatggctgcgcgcgctcttcgtgggcgtgctgctgtgggtggccttcgagatgctgcgcaaggggtgggcgtcatga

SEQ ID NO: 7428 - DNA, 1287 bp, Myxococcus xanthus
atgctcgccaccctgccccactaccagtcattggcgcgcctggcgccgtctgtgtggcggctgaatcccccggggctggcaccggaggccgtcgctgcattcctgcgccacgcgctgcctcccgacgaaagcgttttccagggcgtgcgccgggttccgggcgcattgcctcgcgtgcgtcggagcgaggggactccggagacacgtgaggatgaagacaggctggcggaacggctcgtggccgcgctggcggacagcgtgggcaaacacctggcggcgggcgcggtggacgtgagcctgagcggcggcgtggacagcgccgctttgtgcgccctggccgcgcggcaggcgcccgggcgcgtgcgcgcctggaccatggatgtccacttcgcggatgccacggagcgacggaatgcccggacggtggcgaacacagccggagtcgagttggtcgacgtgtccgtttcggacgcggtgctgccagagctgttcgagcccgccgtcctgagccaggagacggccatcctcaacgcccgcgccgtggccagccatgccttctacgcggaggcccgaaggcagggcgcctccacgttgctgagcggcgcgggcgcggatgaggtgctcatgggcaacccggcggcgttcgcgggtgcggcggcccgtgtgacggaggaccggcgcctcgtgcataaggtgctgcacccagggcctgtggacaacttgggggtggatctgcgggtacttcgccttccctgggacgcggagctggcttccggtgacgaggatcaccccgaagaggtccgctacgcggcctgggtgctgtgggagctggtgctgcctcccgagctccggggtgcgagcgcacatggcgtgaacgtgtgcacgccctacctggacgcggacttcgctgacgtggcgctgggactcccattgggcgtgctcgcgcggcacggggccggcaagtggctcttccggcatgcggtgcgcacgctggtaccggatgaggtccggttggcccggaagacaccgcgctatgcgcacaccgcgctctccagccccgttcgtgcgcgttggctggagctgtaccgggaatggctcacaccggcccggctggcgccgttggagtgcatcgacgcgggcgcgacccgggcgctactggagcgctacgcacgtctggccgccgacgctcccgaggcgagtgccatggaccggctgttgatgcggttgtgctccctcgccatgctccacgcccacgccagcgcccgccccccatgtcccgaatcctga

SEQ ID NO: 7429 - DNA, 1194 bp, Myxococcus xanthus
atgtcccgaatcctgattgccacctcccccgagaagggccacctcaaccccatggccggtgtcgcgcagtggatgcgccgcatgggccaccacgtgggctggctgtgcatccccgagcccgcgccgcagctcgaacggctgggcgtggaggtgctgacgttgccccacgccgaggcgcccgtgcccgccatcgagacgggaggcgaggcgctcgcgcggttggtgctcgatgaagcggcgctggggcaatggattcgcggcctgctgattgacgccgtgccctcgctgctggcgccggtgcgagaggccgtcgagcgcttccgtccggatgtcatggccctggacggcatgcagtacgccgccgtgctggccgcccatgcgttgcgaatcccctgggcgggcgtgtcctccgcgctgtcattgctggagccgcccatcgattacggcctgcgccgcaacgtgcgcgcgctggccgatgagcgacaggctctgttttcccgccacggcttcgatgcccgcttccgcaactgtgagtgcctgtcaccggacctcaacgtcatcttcgccaccgaggccttcctgggctccgacgcaggactgcctcccgccacacacctggtcgggccgtcacagcctccggaggcgcgcggtgacgaggtggacttcccgtgggagcggctgggctccaagcccgtggtgtacgtgtctttcggcagccagatttcgtggcaacccgatttgtttcagacgatgaccgaggccgccgcgcccctgggcgtcaccgtggtgctcagcgcgggtgagttggctgatacagattttgttcacagccttcccggggacgtggtcgccgtgccatacacacctcagcgacaactgttatcacgagtctccgtgctcgtgtctcacggcggcgccaactccgtcatggaggcgctgaccgaaggcgttccgatgctgctcctgcctgtctgcaacgaccagcccatccaggcgcacttcctggcgaagtcgggcgcggggctcgtgcgggcgccgcgctcgctctccgtggaggactgccgcgaagcgctgcgacaactgctggagccgggcacggtgctgcgacagcgggtggccggcatcgccgcgtcctaccaggcgcgtgacggcgcgaaggacgccgctgaacgcatcctccgactcgtggcgtga

SEQ ID NO: 7430 - DNA, 530 bp, Myxococcus xanthus
atgcgtgattgggacgtgtggcgtctggtgctaccgggtgtgtcgccgctggaggtgtggaacctgcccgtgatgggtcgcgagctgtgggagttgctcggggcgcctcgcgtggatgcggaccgtcgcgcgggggttcccgagccggcgctcgcgggccgactgggcccggcgctcgcggtggcgctgtccacgctggtgaagcggcacgcggtggatgccgtgtggctcagtggcggattggtgtgcctggagggcttcggtgccatgctctcgagtgtgtccaccgcgctcccctgccctgtgtacgtggcggagcatccactcttcgctccggccctggcgggactgcgcctgctggcgccgctcgcgcccgcgcatccggtggcgctcgacgtggggcagacgggcatcaagtgcgtgagccccacagcggccccgcgcatcttcgagcgcgacgccgcgctgttgccccggtacttcatcggcatggcgcggcctccggacaggcgacatgtgaaggcggcggg

SEQ ID NO: 7431 - DNA, 747 bp, Myxococcus xanthus
ctggagacgcatgtcgccacgcactgcaacctgcgctgcgtgcagtgctgcccgttgtcgccgcacctgcctgcctggtccgtggaccccgctgccctgggcaaggacttgcgccaactggcccgagccctccggcccaacgtcttcaagctcactggcggcgagcccttcctccaccccgacctgccagcggtgctggacgccgtgcgcgcctcgggcatctccccgcaggtgtccgtcaccaccaacggcttcctcgcgcagagcgcccccgatgcggtctacgagcgcctggatcggatgaccctgtccgtctacacctccgcgccgctgccggagcgctccatcgcccgcatcaccgagcgctgcgagcagcactgcgtcttcctcacggtgaagcgaatcgacgccttccagcaactcacgccggcggcgccgcacgactccgaagacgccgtgcgaggcatccacgcgcgttgttggttgaaggtccgctgtcacctggtccacgcggaccgcttctacgcctgcacgcgtccaccgcacgtggcgacggtgctcgggggcacgtacccggagatgcccgcgctgggcgaggtcgatggcgtgccgctcgacacgccggacttgctgggtcagatgctcggctacctcgaacgggagacgccattggccacctgccgttactgcctgggcggcgacggcgcatggcagccgcacgcccagcttcctcgtattcgaagctga

SEQ ID NO: 7432 - DNA, 804 bp, Myxococcus xanthus
tgctctacagcgattcccgtttcaacccggccggacaatgccaccgcaccaggtggggtgtccggcggtgggacacaggcacgcttgggagggctcgcggagatgccttgccggcttgccttgaaccggcctgtccgcggccccagcttcctggcggaacaaccccgtctgttggaggcgctcgaaatgaaacgaatccaggcactggccatcgcgggcgcgttgtgcggaggcacggcgctggccaaggacaagcccgacatgcgcgggctcaccgtcaccgtgggcggtggcgtggagggctacagcggtgggctggccccccgaatcgatccgggcgcggcgtacggcgccacggccacgctcaaaccgtccaccgtgctgggcatcgagctgggctacaccggcgccatcaacaagctcgaccggcgcggcctggaggacctggctcgaaacccggacatcgtccgcaacggaggccaggccgtggccaccatcggcctgacggcgacccccgtgcagccgtacctcctcggcggcctcggcatgaactggtacaacgtccgccgcggcgcggaagcgctgggctaccgcgacgacaccgctggcgccgtaccgctgggcgcggggctgcgcttctacaccggctccttcaccgcggacgtgcgggccaactacaacctcctcttcaaccaggagctcgtccccacgctgccgcccgcagagaaccaacccgtgaaagacgtcacgttcgcgggaggctccagctacaacgccacgctgaacgtcggcgccacgttctga

SEQ ID NO: 7433 - DNA, 1005 bp, Myxococcus xanthus
atgagcatcgacgtcatcgacgaagtcccggcccagggcggccggcccctcgaggacggcgcggggcaggaagcccgctcgctgccgggcatggtctacatccccggtgggacgttctggatgggctcggaccatcactatccggaggagcggccgacgcaccaggtgacggtgacggacttctggatggacagccaactggtgacgaacgcggacttcgcgcgcttcgtggaggccaccggctacgtcaccgtggccgagcgccccttgaaccccgacgactttcccggcgcgaatccagcgctgctcgtcccgggctcgctcgtcttcaagaagacgctcgctcgcgtggacctgcgcgacctgacgcagtggtggttctatacggcgggcgcctgctggaagtaccccgaaggcgcgggcagcacctggcaggggcgcgaacaatacccggtggttcacgtctgcttcgaggacgcgctcgcctatgcgctctgggcgggcaagacgctgcccaccgaggcggaatgggagtacgccgcgcgcggaggcctggaccggaaggtctacgtctggggcgacgagttcgcgccgggtggcaagctgatggccaacacctggcagggggagttcccctggcagaacctgaacacggatggcttcgagggcacgtccccggtgggcaacttcccaccgaacgcctacggcctcttcgacatggccggcaacgtgtgggagtggacctcggactggtaccaggagcggcacgaggggaatggcggaaagccctgctgcatccccgtcaatccacggggaccggccacgtcggatcgcagcctggacccgtgcctgccgaaggtgaagattccccggcgcgtcctcaagggcggcagccacctgtgcgcgccgaactactgcctgcgctaccgcccggcggcgcgctcaccgcaggccgtggacagcggcacgtcgcacatcgggttccgctgcgtcgtccgcccctga

SEQ ID NO: 7434 - DNA, 891 bp, Myxococcus xanthus
atgaagcagaaaatcacaggcttccacctcgaccgggaagaccactgggtggctgacctcaagtgtggccaccggcagcacatgcgccatgacccgccctggatggtgcgcccctgggtcctctccgaggacgggaggcgcagccgcctcggtgttgagctcgattgcaagcgttgtgacgaagcagggcacgcggtcgccgaggcggttcgcgaagcgctgcggacggtggccctgcgggcctatgacgacggcggcctgagcgggctctgcgccgagggccgatgggagcttgccctggacgcgctcggtgcggccgacctgcgccctgtcatccggcgcgcgctcgcccctgagcgcggggagggagccctcgtgagtgcccggatgattctccgtcccctcctccctgacgacgcccgcgccattcagcgcctggcgggtgaccgcgaggtggcggcgaacgcggcgggaatcccacatccgttcgaggacggcatggcggaagcctggattgcctcgctggatgcacgttcgcatgtcttcgcgctcggccattccgagtctggcgagttcatgggcctggccgggctggtggaggccgacgaggagcgccctcgcacggccgagctctcatactggctcggccgcgcgtactggggacagggctttgggacggaggcagcccagaccctggtccgctacggcttcgaaacgctcgggctggaatccctccatgccagttgtttctcccgcaaccccggctcccggcgtgtgctggagaaggccggctttcgccacgcgggccaccaggcgcgcgcgctccgccatctggggcaggacgaggacctcgagcgcttcatccaggagcggagccgctcgcgcccgtga

SEQ ID NO: 7435 - DNA, 1143 bp, Myxococcus xanthus
atggacccgcactcgacgattgccgaattctccctggtgaagggcgggctgctcttcgagaccgagcgccggctccggcggggtccgcgcaagcgttatgaccccgtgttgcgggcgctggccttctcggcgatcggctggctgcccttgctgatcttcacgctgccttcgggtgggccgaccgtgggctccctgttcatggaactccaggtccatgcgcagttgctggtggcgctgcccgtgctcctcgccgcggagccctacatcgacggccgcctggctttcgcggtccgccagttcctcaattcgaacctgggggcgacggacggcctccggacgttcgaagcggatgcccggcgcgccatgcactggcgggacagctatatcgtggaggcgctgctgctcatcctggcgtatgccctcacgttcatcaccccggccgacgccacccggtcgtggaccctcagcggcgatgggttctccatggcggggtggtggaacctcgccgtgagccaacccctgttccgtttcctggcgctccggtggctatggcgtggcgtcgtgtggagcgccttcctgctgcgtgtgtcacgtctgccgttgaccctggttccgacacatccggacatgatgggcgggctcgggttcctgcctgtctgccaggcctgtttttcgcccgtggtgttctccctggccgtggtggtggcggcatacacgtcccgggtggagcccaaggacctgtcggccaaccccgcggcctacgtgattccgctggtggtcatcgcggccggcgcggtggtgctggtgttcgcgccgatgagcttcttcgtgccccagctcgtgcgggcgaagcggatcggtgacgaggacttctcgaaggtcgcggccaagcactcgcggcagttcgaacacaagtggttccggggcggaccggagccggagctgctgggcgcgccggagatgtcctcgctggcggacatcggcacggccttcacgctggagcggaggatgcgcctgttgccctgggacaagatggccctgctggccgtggtgggggcggcgctggcgccactggtcatgttgctggtgatggaccggcagttcatctccgtcctcaagttcatccacgagggcttgaggtga

SEQ ID NO: 7436 - DNA, 552 bp, Myxococcus xanthus
ccggtgattgcgttccggggtgcggcggagttcgaggcctggctccatgcgcatgccgatgctccttctggcgtctggttgaagctcgcgaagaaggggacggacatcccgtcgctcaccgatgacgaggcggtcgacgtggggctctgctttggatggatttcggggcaacggaggtcgctcgatgcgcgcttctatctgcagaagtacgtcccgcgccggccgcgcagccgctggtcctgtgtgaatgtgaggaaggtcgaggcgctgctacgcgcgggcaggatgcggccctcggggctcgccgaggtcgaggccgccaaggccgatggacgctgggccgcggcctacgcttcccacaagaacgccacggtgccggaggacctgacggtggcgctgtctgcgagcccgcgtgccgcgcgggcgttcgaggcgcttggcaagacgcggcggtacgggctcatcctcaaggtgatgacagcgcgtaccgagaaagggcgcgcgagtcaggtccgccgtgtcgtcgcggagctggacgcggcggcggattga

SEQ ID NO: 7437 - DNA, 429 bp, Myxococcus xanthus
atgaacaccttgcgcggattgtgcaccttcaacctctgggcggatgaccttcgggcggcgacgcgctggtacgcggagcagctcggcgtggagccttacttcagcagcgaggccgccggacgtggtctcgggtatgtcgagttccgcatcggcgactaccagcatgagctgggtatcatcgaccggcgatttgctccgccggggctcgccacggctcggggcggtacggtcgcctactggcatgtcgacgacatcgccgccacgctcgatcagttgctctcactgggggcccagctcctcgagggcgtcaccgagcgtggccccggcttcgtcacggcgtcggtcatcgacccattcgggaacgtgctgggcgtcatgttcaaccgtcactacctggacgtcctgggaggtgcccgtggccagcgttag

SEQ ID NO: 7438 - DNA, 318 bp, Myxococcus xanthus
atgagcgaggcaccgaagctagagccgcgaagccttgaggccgtcaccgcggcggtgcaggacggcgaggacgcttcgctgctccatccggagctgctcatcagcgacttgctgcggtacggcgtggccgccagcctggcgttggtgacgctgggcaccgtggtgaccttcttccgccacccggactacctcgtttcatccgaggcgttgctgcgcctcacctcgccgcacccggtgccgcacaccctgggggacgtcgtggcgggggcgctggccgcccggggccaggcgttcgtcatggcgggactgctggtgatg

SEQ ID NO: 7439 - DNA, 363 bp, Myxococcus xanthus
atgaagaacggcgaaatcgtcctcggcttcctgcccgtggccggcttccaccgcatggccgtcaactccaccgcgggcaaggccgccgtggacaaggccctggccgagcacttcggccgcccggtgaagctcaccatccaggatgcgtctccggacgacccccggctgggccccagtctggccgatcaggacgcacagacgcgcgccgcccacgagaagaacacggacagcaaggtccgcagccaccccgccgtccgagcggtgctcaagttcctgggaggcgaaatcgaacacatccaggtctacgagcccgagcgccccggggccgtgccagcggacgacacctccgacgacagcgcctga

SEQ ID NO: 7440 - DNA, 318 bp, Myxococcus xanthus
atgcctggcgtcgacctgaactacttcatccggcaggcgaacaagctgacggagaagattgaagaacggaagcagcagctggcggaagagagcgtggaggccaaggccggtgacggccgggtcaccgtcgtcgccaacggcatccaggagatccgcagcatcaagatcgacaaggaagccatcgaccccaacgacacgtcgatgctcgaggacctcatcaccgccgcggtgaacgccgccctggcgagcagccgtcagcacatgcagcgcgagctcgcgaaaatctccggcggcgtcaagatccccggcattacctga

SEQ ID NO: 7441 - DNA, 594 bp, Myxococcus xanthus
atgacccccgatccgctgaatcgactcgtcgcccagctcgcgaagctgccgggcatcggcgagaagaccgcgcagcgcctcgcgttccacatcctgcgggcgccgggtgagtatgccgcggagctgtcgcaggccattcgcgaggtgaaggagaaggtgcacctgtgcgtgcgctgcttctccctcaccgacgcggagacctgcaacttctgccgggatgctcggcgcgacgagcgcgtgctgtgcgtcgtggagacgttcgcagacctgatggcgctggagcgcacccgtgagttcaagggccgctaccacgtcctgcacggcgttctgtctcccctggagggcgtgggccccgaccagctccgcatccgcgagctgctggagcgcctcaacgacagccgggtggaggaactcatcctcgccaccaacccggacgtcgagggcgaagccaccgccctctacctgacccgcctgctcaagcccatgggcctgcgtgtcacccgcatcgcccaggggctgcccatgggcggcgacctggagttcgccgaccaggccacgctcgccaaggcactctccgcccgccgcgacctctag

SEQ ID NO: 7442 - DNA, 1887 bp, Myxococcus xanthus
cttcagccttatggcccgtacgtgctcgtgcgaaagctggccgaaggcggcatggcggaaatcttcctcgccaagttgctgggcgcggacggcttcgagcgcaacgtcgtcatcaagcggatgctgccgcacctgacgaacaaccccgacttcgtggagatgttccgggacgaggcgcggctggcggcgaagctggcccatccgaacatcgtgcagattcaggagctgggcttcgcggagggctgttactacatctgcatggagtacctcgcgggcgaggacttctccacgacgttgcggctggccggacgcaagcgccactacgtgccgctccccgtcgtgctccgcgtcctcatcgacgcggcgcgcggcctgcacttcgcgcacgagttcaccaacgaggccgggcagccgctgaacgtcgtccaccgcgacatctctccgtcgaacctgtacctgacgtaccaggggcaggtgaaggtgctggacttcggcatcgccaaggccgagtcgcggctcgtcaacacgcgcactggcgtggtgaagggcaagtacatgtacatggcgccggagcaggcgcgcggcaaggaggtggaccgccgcgcggacatcttcgcgctgggcgtgagcctgtacgaggcgctcacccatgtgcggcccttctcccgggagaacgacctggcggtgctcaacgcgctgctgcagggcgagctcaagccgccgcgcgagctgcggccggacttgcccgaggaactggaggccatcctcctgaaggccatggccttcaagccggaggaccgctaccccaccgcggaggcgttcgcggacgcgctggagacgttcctctcggagcatctcagtggttcgggcgcgatgccgctcggcgccttcttgaaggggcactttggtgaggagcgcttcaccgagcgctcacgcattcccacgctggccacgctcaccgcgacgtacggaggcgccgcggcaggggcgcaggggcaggcgccgggggcggagccgcacgggacgaacctgtatggcgtgcttgctcgggagggcgatgccacgtccgcccagcgccccggcatgtccatgcggccttcctcgccaggcgtgcctgcccatggcgcggcctcacgtgggtcaacgtcgccggagtccgcccccacggccggaggccgacgctggcgtacgctggcggtgggattggcgggtggcctgatgctggcggcggcgggcatcgttggatatcggcagtggatgacgacgcccgcttcggtgtcgctggtgccggccacggtgcccgtcgtggaggccgtggcaccggaggctgctgccgctcaggtcggcgcgccgatggaggccgtggcacccgtgggtgccgccgctcaggccggttctctgacggacgccgtggccaatggggcgggtggcgatgtgggcgagacggattcggcgcagctctccgtggatgctgctggcgtgacggagacggacgaagccggacttgctggcgctgcgtccgatgtcgaggcggaggcggatgaagaaggggcggacgcggcacctgtgcggtcgaagaaggcctcgtcgcagaagcgggtgacgctgggcatcgacgacgtgcagcgtgtcgtctcgcgtggacgggcgcgcatcaccacgtgcttcgagcgctacaaggcggacctgccgtcgagcccaggcgaagtgcaagtgcaactcaccatcgtctcgtcaggcaaggggcgggcggggacgcggggaccgctggcttcgtcgggcgtgggccgctgcctggaagcccaggcggagcgcctgcgcttccctcctcaccgggaccaggaggtcacggtggtgatgcctttctcgtggcgggtgacgcagtag

SEQ ID NO: 7443 - DNA, 282 bp, Myxococcus xanthus
atgaacaagctggaactggtctacgacaactcggtgccggtgctcatggtgtccacaccgcgcaacgggcaggccgcgggcgcgaaggtgcgcgcggccggtgtcgcacctgtggacgcccgcctgtccatcaatggacgcccggtggcgctggatggcaaacaccggttcaacacctgggtggagccggtgggctcgccgcccgtattggtgtttaagatgacgcgtcctggtgccccggcggtccatacggtgcgcactctgaaacagcgagggccgtga

SEQ ID NO: 7444 - DNA, 627 bp, Myxococcus xanthus
ccgcccggaccggtgtccgcgcaggtgacggcggagggatacgcgtccgcggaggcgactgccaccgtggaggagggcatgcgcgcggagctggaggttcgagccgcgccactgccgccaccgacgggcgcgctgcgggtgacggtggtggatgcgcggacgggcgcgccgttgccggacattcgcgtgtcggtgggcacggcacaggtgcgcacggacctggcagggcaggtggtggtgaaggacctggctccggggcccgtggctgtcgcggtggcgtcttccggcttccagtccgcggatgaagccgcggtggtcatcgccgggcaggagtccacgctgtcggtgccactggcgccggaaaagaaggggactcgggccacgctggtgggacaggttcgcagtgtgcgagggggcaagccgttggcggcgaccctcctcgtcacgaaggcccgggtgcgcgcgcgcacggatgcgaagggggctttcaatgtccaggtgcggggtggcacctaccgcatcaccatctccgcgcgagggcatctgtcccagacgaaggtcatcaccctgcgcgagggggagcggaccatcctcaatgtcgacctcttcccgagggggaaacggtga

SEQ ID NO: 7445 - DNA, 1440 bp, Myxococcus xanthus
gcgcacatgaatgtcctcttcatctcctcggaggtggccccgttctccaagacggggggcctgggggacgtggccggggccctccccgccgcgcttgcctcgctgggccatgacgtcaaggtcatcaccccgcgctaccgcgacctgcgaggcgcggagcggctggagcccacaggccagtccctgctactgcgcttccccttcggcgagctgtcgggccccatcctctccgcccgcgtgtcggagcggctggaggtgctcttcctggagaacgcgttcctcttcggcaaccgccacggcctctacggagacgcggggggcgccttcgccgacaatcaccggcgcttcgcctatctcagcgtgggcgcgctccaggcggcgcagcggctgcgcttcatcccggacatcatccacgccaacgactggcagacggggctggtgccggtggcgctgcggcgcggcttccagacggggccgctggcgcacgcgaagagcgtcttcaccatccacaacctggcctaccaggggcagttccccaaggacgtgatgggggacctggcgctgccctgggacttgttcaccgcccatgacgggctggagttccacgacacggtgaacttcctgaaggcggggctcgtcttctccgacgcgctcaccaccgtgtcccccacctacgcacgggaaatccagacgccggagcagggctacgggctggacggcctgctgcgccaccgcgcgcaccggctccacggcatcctcaacggcgtggacacgcacgagtggaacccggaggacgacgccttcctcccggcccgctacggactgaaggacctgtccggcaaggccgtgtgcaagcgcgagctactggcccgcttcgggctggaggacggccccgcgccggtgttcggcttcgtcagccggctggcgtggcagaagggcatggacctgctgctggaggccctgccggccgcgctccacgcggacatccgcgtcgtcggcgtgggcagtggcgaagggcctctggaggaagggctgctcgcgttgcagtcccgttacccgaagcaggtgggcgtgcacatcggcttcgaccccgggctctcccacctggtggaggcgggggcggacttcttcctcatgcccagtcgctacgagccgtgcggcctgaaccagatgtattcgctgcgctacggcacggtgcccatcgtccgggccaccggcgggttggtggacacggtggagggagggctggacggaaacggcatcctcttcgaggccttccacaagtccgccctgctggcggccatccgccgcgccctggccctctatgcggacccgtcgcgcctggatgagttccgccgccggggcatggagaaggacttctcctggggggcatccggccgtcgctacgaagcgctcttccacgacctggtggcggaatag

SEQ ID NO: 7446 - DNA, 897 bp, Myxococcus xanthus
ctgggtggttacgaggtggtcggccggttggcggtgggcggcatggcggaggtgtaccaggcgcgagcccgggtcaccacgcagcgctcaccgggtgaaccggacgaaattgtcatcaagcggctgcacccgtcgtttcgcagcgacactgcctacgtcaaggccttcgtcgacgaggcgaagctgacggtccgcctgcgccatccgaacatcgtccgcacctaccgcctgttcaaggcggggccggactacctgatggtgcaggagctcgtgagcggccggacgctgggctacatgcaggagctgctggtgaaggccggtgcggccatgccgcccgagtccgcctgctacatcgcctggtgtctgctcaaggcgctggactacatccaccgggccaaggtgggggagaacggcgccaccatcgtccaccgtgacgtgaatccggccaacctgctgctgggcatcaacggcgacgtgaagctcaccgacttcggcgtggcggaggtggaggggctgatgcgcggcgactccggcgcgctgcgcggcacgctgccctacatgagcccggagcaggtgctgggcctgccggtggacgcgcgcacggacctgtacgcggtgggcatcatcctctgggagctgtggtccggccgccgcctcttcgtcggcgagcacgaggcggagctgatgcacaaggtgcgcgacgcacgggtgccgctgctgacgtcctctccggagctgccggactacgcggtgcaggtggcgcgcaaggcgctgttcgcggaccgggcgcggcgcttccagacggcggcggagttcatcaaggcgctggagtccctgtcccggcgcgcgggctggccgctgacggtggaggcgctccagccgctgctggggggctga

SEQ ID NO: 7447 - DNA, 483 bp, Myxococcus xanthus
atgcgctcacgccgcgccgtcatcctggggctgctgggaggcgggctcgccgtgtccgggtgtctgggctcggtgcccttccggccgcgggcctatgaagacgcggtgcgcgtggtgggcttccaggtggacttccggcaggacggcaccggcgtcctggacctggacctggcggtgacgaaccccgcttcagacgcggccacgctggccgcggtggacttcacgttgcgggtggacgggcgccgcgtggcggtgggcacccagcaggtggcggcgcccctggcggcggatgggagtgccccgctgcgcgtgctcttcccgctggccagcgcgcgcgccacgggcgggccggagcccgtgccccggcgggtgcaggtggagggcggggtggtgctgcgcttcggcggcaccgagcggcgcgcgcccttcaggtccgaacgcgtgctcccgctggcctgggtgccgccgctggacggggactga

SEQ ID NO: 7448 - DNA, 573 bp, Myxococcus xanthus
atgtcgcttttccgacaatgtgtgtttcccatctccttggcggtgctgggctccaccagcgtgctggccgcggagaagtcgcctccccctgagcctccggctccttcgcgcaaggtcgacccaacgaaggcgcagacggaggcgtggctgcgcgagcacatcgaggcgtggaacgactcggaggtgcacgtcacggtgaaggactgccgcatcatggtgttggacaagccccgtgagcggacggagatcgtcgacctgcgcggcttgctgctgcccatcgaggtcatccggctcaacggcggaaacgatgcgacgctccggcttcgtgtgaaggagaagcacaccgggacgtactccatgttccgcaagtgcagcgcggagaaccgctactgcgcggagcccaccggcaagttccagagcctgccctatgtggacctctccgtgacgtcggtgcgggacttcgtccccgggcggcagacggacgtcgacaagagcctgcggctggagcgggcgctcgaacactactcgcggctttgtggggcgatggaagatgcgcgcaaccggctcttctag

SEQ ID NO: 7449 - DNA, 804 bp, Myxococcus xanthus
atggcgcgcatgcacatgagcgccctgttgatggtggcactgctcgcggctcctgcccagccgctcacgtggaaggtgacaggagcggacgtcacgttcgagatgtccgcgaaggacctacgcgccctgcgcgatggcaaggaggtgttcggcctgcagtcacgccaggcagacttcctctccaacttcaaggccgaggagggcaccaacaccttcggctgggagggctcccagtccttgaaggtgctgtcggtggtgggcccctgggtgagctacgagaattcggactcgggcttcaccgggggcgcgcacccgtacgcgagcacgtcctacgtcaccgaggacgtgacgaagcccaagggcgccttctcgctgctgagcgtgtttcccgagaaagacgtggtcgcggcgctcaaggcggaccgcttcatccgcaagcacatccatgatgaggcggcgttcaaggacgccaggacggtggatgcgctgatgcagagcctggagcccggcgaggactgcgtgggcttcgactcaggtgggctcgagtccgtgaagcgctcggtcgcgttccaccacatcgagggtaacaaggtcgccgtgcgcatctcgttcggctacgccgccgaggcgtgccgggggcggagcttcgtggtgggcgtgctgttgaccatctccgcggaactgcggccagcgctcaagcgcgcggcccggcgggaagagggcttcctgatgaaggatgcgaaggcggtgaaggccccttccgtgcacttcacgtgggagtcgcccgaaccgaagcaggagtga

SEQ ID NO: 7450 - DNA, 549 bp, Myxococcus xanthus
atggtcatcaagggatacgtggacatgatgctgaagggaacggcgggcgggctgacggcccccatccagcgctacctggagcgcctgcgccgctcggcggacgaccagagcgccatcatcgagcgccggctggcgaaggtgcaggacgagggcgtggaggacctgcgccctctgctgcgcacggccttcatccccgccgcgcgcggccagcgcatcatggacacgacgatgacgctcccggaccggcccgtggccattccgggcccccgcgatgacgtggagctgctggtgcgcgtgctggcccgcacggtggcggcgtcgggcgcgcccacggcggtgcgcgtggaagctgcgggggacgcgagcgtgtggcagctgcgcatcaacatccgcggcggcaagccgctgccggagaaaacggtcacgctgctgcggcacctgacgcagcggctgcggggtggcctctcgttgccggaggagaccggcaacggctgggtggtccacctgccggtggatgacaccgtgcccgtggcgcctcgcgacgcgtga

SEQ ID NO: 7451 - DNA, 546 bp, Myxococcus xanthus
atgtccgacggctcgtccgatgacgacgtcgacatcaccatgacgctcggcgtggtgctggcgctcgcctccatctacccgttggtgacggcgctcaccgacgaggacgtcagccaggaggaggtcgtcaccggcgaggtcgaagaggagcgctcccagcgctgtgatgagcggaccttctcgctcaagggcccgctgcactggagcgtctccctgggcgccgcgcggcgcaccgggcgcaccggagaggacggcgccgtgtcgctggggcagccgctcaacgagctggtggagcaggccatcaccgacgaggccagcgtccgccggctcgtcgccgggcggggcattgccttccggttggagctcgagcgcgccccaccggcggacttccggctcgattccaaggcgcttccggatgcctacttccggcgcttcgcggaccgctacgggcagcagctcggaggcagcgagcgcgcccgcttcgagaactgcgagctgattggcaagtccgcgcgagagacgctggagtgctactggtcccagtag

SEQ ID NO: 7452 - DNA, 558 bp, Myxococcus xanthus
  unsure (1)..(558): unsure at all n locations
cagcacccggagctcatcgtcntgcaggacatcatccgcccggcgcacttcgtaccgtggatgaagcccattggcgacntgctccgggacatgcagaagcagaagatccacatggccatcgtcgtcgacgagtacggcggcttcatgggtgtggtgacgctggaggacatcctccgcgaaatcgtcggcgacatcggcgacgagttcgaggtggaggagaagcaggtggagaagctggcggacggcagcttcctggtggacgccgcgctggaggtggacgccttcacgcagacgttcggcttccccctgcccgaaggcgacttcgacacgctgggcggcttcctctcctccatggcgggccacctgcccgacgtgggcgagcgcttcgcctacagcggctggcagttcgtcgtggcgtccaaggaaggcccccgcatcgaccgcgtgcggatgtcgcgcgtgaagtctggcctcaccaaggacggcaaggccgcggagtcccgcgacgggctggggcgcgagcacggccgcgaggaacaggcctccgcgaagagctga

SEQ ID NO: 7453 - DNA, 756 bp, Myxococcus xanthus
atgcgcggaaagaaccagtccaacccgctgtcgggcggacagtccatgggcgcggagagcgtcgccgcggcgctgcgcaaggccaccgaggactcgcgcgtgaaggccattgtcttccgcgtggacagcccgggcggcagctacgtggccagtgacaccgtccgccgcgaggtgcagcgcgcgaaggaggcgggcaagcccgtcatcgtcaccatgggcagctacgccgccagcggtggctacttcgtcgccatggaggcggaccgcatcgtcgcgcatccgggcacgctcaccggcagcatcggcgtgtacgcgggcaagttcgtcacggcgggcttctgggagaagctgggggtgaatttcgacagcgtggccgcggggaagaacgcggagatgttcggctcggacgcggactacacgccggagcagcaggcccgcatggacgcgtcgctggaccgcatctacgcggacttcacgacgcgcgcggcggccagccggaagctcccgctggagaagctgcagtcgctggccaagggccgcgtgtggacgggcgaggacgccctggcgcatgggctggtggatgcactgggcggctacccgaaggcgctcgagctggcgaaggaggccgcgaagctgccggccgacgcccgcgtcaacgtggaggtgtacccgcgcaagaagcccgcgtccgcgctcctctccgaactgctgggccagacgggtgacaacagcgaggacgacgccacctcgatcagt

SEQ ID NO: 7454 - DNA, 642 bp, Myxococcus xanthus
ggcaccacgtcggcgggcgtggtggtgctgggcatcgtcggcatccaggtggcgcgcaacgccgccgtccacggctggttcggcggcggcgaggtccagacggacgacttcgagatgggcgaaatcaccatccgcgtggcccaggcccgggtggatgacgaggagctcttcgagtaccccggacatggcgcgcgccgtccgggctcgggcgagccgggggtgaagcccgccaccggcagcagcggtccgggcaaggtggccatggcctccaccacccgggcgccggcggaccggaagccccgccccgggggcagcgtgaccacggacccggatggcatggagacgacgcagcagttcgaccagtccgccatcaaccaggtggtggccagcaacaagtccacgctcttccgctgcttcaaggaagaggcggagcgcacgccaggcatctacgccaaggtccccatggagttcgtcatcgggaacaatggccgggtcagcaagctgtgggtggacaaccatcagttcaagaagggtccactctacgagtgcctgctgtcggagatgcagaagtggccgttccgcgcctacgaaggcgagcaggcgacggtgggcctgtcgttcaccatcggcaagcgggggtag

SEQ ID NO: 7455 - DNA, 639 bp, Myxococcus xanthus
atgtccgccgcatctgttgctgagaccgaaattgcgaagaaggcgctgagcgtcccgccgggaaccttccgtcacaccgtgctgacggccgccaagcgcttcaagtccacctgggccgagctggggaagctcctggtccaggtccgggacgaggccaagttcgaggagtggggctacccctccttcgagacctattgcctcaaggaactgcacatcaagaagcagaccgccttgaagctcacccgctcgttcagcttcctgaccaagcacgagcccgaggaggagctcaccgcacaggagttcccccagcgcgcacccgcattcgaggtcatcgaagtcctcgcggacgcggaggagcggggccagttgtcgcccactgaatacaagtccctgcgcgacagcatctggagcccggagaagaacccggccgagctgaagaaggagttcgccgagcgcttcccccgtcccccgccggagccgcctccggagagcgcccaggtgcggaaactggcgcagatggcccgcaagctcgcgagcgagctgtctgggagccgtcggattccgaacgccgtcgccgagcgggcagccgccctggcggaagatctcgaggacatcgcctcgggcgtgacggacgcctga

SEQ ID NO: 7456 - DNA, 1278 bp, Myxococcus xanthus
gtgaagaaggagcaccacgtcaacctgtcttgttcgttctgcggcaagtcgcagcgcgaggtccgcaagctcatcgcgggcccgacggtctacatctgcgacgaatgcatcaagctgtgtaacgacatcatcgcggacgagaacgagcgcgaggagggcaagccccaggtcagcttgcagacgccggcggagatcaaggcgttcctcgacgactacgtcatcggacaggaccaggcgaagaaggtcctcgcggtggcggtgtacaaccactacaagcgcatctatcaaaagaagccgaactcccggccgcgtccaggcgtgaagggccccaccggcgaggaagtggagctgagcaagagcaacatcctgctcatcggtcccacgggaagtggcaagacgctgctggcccagtcgctggcgcgcttcctcaacgtgcccttcaccatcgccgacgccaccagcctcaccgaggccggctacgtgggcgaggacgtggagaacatcatccagaacctcctccacaacgccgactacgacgtggagaaggcctcgcgcggcatcgtctacatcgacgagatcgacaagatcgcccgcaagggtgacatgcccagcgccacccgcgacgtgggcggcgagggtgtgcagcaggccctgctgaagatcatcgaaggcacccgggccaacgtcacgccgcgcggcgggaagaagtacaaccagcaggagtacgtccaggtcgacacgacgaacatcctgttcatctgcggcggcgccttccacggcatcgacggcgtcatcaagcgccgcgtgggcgagaagggcctcggctttggcgcgaagatcacccaccgcgaggagcgcagcgtgggtgagctgctggcgctgaccgagccggaagacctcatgcgcttcggcatgattccggagttcatcggccgcctgccgatgatcgccacgctgaacgatctgaaggaagaggacctggtcatcatcctctcccagccgaagaacgcgctggtgaagcagtaccagaagctcttcgagttcgagaaggtgaagctgaccttcaccaaggaggcgctgcgcgccatcgcccgcgaggcgatgcgccgccactccggagcgcgcggtcttcgcgccatcctggaggatgccatgctggagatcatgtacgacgtgccgttccgcgagggcgtcaaggagtgcaagatcaccgagcaggtcatcaccaggcacgaggcgccccagctcgtcatggagaaggagaagaagacggcctag

SEQ ID NO: 7457 - DNA, 1734 bp, Myxococcus xanthus
cgcccggagctgctggacgcggagcgggccctcctggacggtcagggggactcggccgcggatgcctatgaccgggccatccggctggcgcgccagtacggcctgtcgctcgacgaaggcgtggcctgcgaggccgcggcacggttccacctgacgcaagcccgcgagcgcgtggcccgcacctacctggaggaagcccgcgccgcctacctgcgctggggggcccgcgccgtcgtggctcggctggagcgggagcacccccggctcttgccgtccgcccccacgcccacgcgcacggatgcccccaccgaagcgtcactggccgcgctggacctggcgtccgtcatcaagacggcgcgcgcgctgtccggcgaaatcgtcctgggcaagctgctgcgcaagctgatgacgctggtcatcgagaacgcgggcgcgcgccggggcctgctgctgctgaaacggacagagggcctggtcatcgcggcggaaggctccgtggacggcgatggcgtggtgctcgaggcgcccatccccatggagtcctccgcgtcgctgccgacctccatcatccactacgtggtgcgcaccggagagacagtgctcctccacgacgcctcagcggaagagccgttctccgaggacccctacgtccgcagcgcccagcccaagtccctgctgtgcagcccgctcttgaagcagggctcgctcacgggtgtgctctacctggagaacgacgccacgcggggcgccttcaccccggagcggctggaggtgctgcgcctgctgtcgttccaggcggccatctccctggagaacgccgacctctacgccagcctggaggagtacagccgcacgctggagcgccgcgtggaggagcgcaccgccgaaatccagcacaagaacgccgagctggcggagacgctcacccggcttcaggagatgcagcgccagctcgtggcgcaggagaagctcgcgtccctgggcgcgctcaccgcgggcatcgcccatgagctccagaatccgctcaacttcgtgaacaacttctcgaacctgtcctcacggctggccggcgagttggaggagacgctgaagggcctggcggaccggctcgacagcgaggcccgcgaggacgtgctggagacgctccaggacttgaagcagaacgcccagcgcatccacagccacggcacacgtgcctcggacatcatcaagacgatgctccggcactcgcgcaagtcggagggcacccgctccaagtcggacctcaacctgctggtgcgcgacagtatgaatctggcggtgcagggcctgcgcagccgtcccggcggggccagcgtgaaggtggagaccacgttagaccccaccgtgggcgtcgtggagctggtggccagcgacatcagccggatgctcaccaacatcctcgacaacgcgttctacgccgcggcgcaacatcaacagcaggccggcgcgggcttcatgccccaggtgcacctgagcacccgccgcgtcggaagcaaggtggagctgcgcatccgagacaacgggccgggcatccccgaggacctccgcgagaagctcttccaccccttcttcaccaccaagcccgcgggcgtgggcacggggctggggctctcgctgtgccacgacatcgtccaggagcaccagggcgacctccgcgtggagagcgcgcccggcgccggggccgagttcatcgtcacgctgcccgcgccctga

SEQ ID NO: 7458 - DNA, 1674 bp, Myxococcus xanthus
gtcgtgggcggcgtggccaacgcgacgcagaacgtcgtcgagggtgccaaggacaaggccggtgacgtcgtgggcggcgtggccaacgtcacgcagaacgtcgtcgaaggaaccaaggaccgggtgcaggacgcggcgggcaacgtgcgcaacgccgccggcgacgtgttcgaggcaggccgcaccgcgacccagcgcaccctgagcgccaccggcaccgcggccgccgtcaccgcgaatggcctgggcaatgtcctcaaggatgcggcggagcgggcgggcccggtgctcgacaaggcgaccgacatcgccgcggacggcctggacgtggcgggccgggccatccaggacgcgcccacgctcaaccccctgcagggcatcaccaacgacatcatcggcggggcgctccagggcaccgcggacgtggtgcgcgacccggtggacacggcccgggccattggcgacgcggtcaacctcaaccggcaggtggaccagctcaagccgggtgagagcacctccatcagcctctacgccgaggccaacggcgccacgctggccggcaaggtgaagggcaccctgggcgtcagccgcagtgaggaagagggcggcggctacacggtgtccgtcaccggcgaggtgggcgcgggcgtcgcggccaagctgggcgccaagggcgcggcggacgcgggcgcggaggccttcggcaccgccggggccacggtggagttcaagttcgacacggccgaggaggccaagaacgccacccgcatcatcgcggcctccaccgccaccgcgggcgccgccgcgagcaaccccgtgctgggcgccggcgtgaatcacgtccttggggatccgctgtcggacctggcgggcctgacgaagaacatgagcgccgtggagttcaagctgggcgccgaggccagcgtcaacgccgagctgggcatgaagggcctgccggaggccatcagcgcgggcgccggcgcgagtgccggaatcaaccagagcaccacggcccgcatcgagatggagggcggcaagccccagaagctgaccctcaagcagagcctcgaaatcaacggcaacgccagcgcgtccgcgggcgtgggcatccccaccggtggcggggactccgtgtcgctgcccaccaacgcgtccgcgggggtgtccggttcgctcggggtggagctggagcagagcgtggagctgcccgagggcttcaacccgaccgacttcatcaaggacccgaagggcaccgctcgcgagattggcgccagcgtgcgtgacacccatgaggccaagctgacgctgaccgactcgcgtcaggccaacgcgtccgcgctgggcctgggcggcgcgacgggccgcgaggtgaaggcggaaatcagcggcaacatcaacgacatcgccaccagcggcgccttcggcagcatcgcccggggcgacgtgggccaggcgctggaccagctcaaggacaaggtcgaaatcaaggccaccgtccaggacaagcacaaggtcaccggcgactttggcgtgggcgttcacgcgggcgtgggcggcggcgaggtgggcctgtccaccgagcgcacctacgtgggcgaggagcaggacctcaacgcggcgcagctcgccgagctgtacctcacgcagcgctggtcggccggcatcccgggctga

SEQ ID NO: 7459 - DNA, 501 bp, Myxococcus xanthus
atgttcaccggcacgggggctgcgctgaagaaggaccggaacgccacggcgcgcacctacctgtggatgcaccccatctacggaggcacggcgctggcgctggaagaggtctccgcccggctcaagcccctgccccggccgctgcgagccctggtctacacggggctcatcttcggcgcggagtacggcacgggctggttgctcaagcgcctgctcggccgctgcccgtgggactacgcgccgcacaggtggagcgtacacggcctcatccggttggattacgccccggcctggtaccttaccgccctgctgttcgagcccgtgcgtgacacgctgctccacgtcaccagcgaggccctgcggcagacgccggagtaccgcgacgccgaggcccgggggacgctgccgcccacggcgctccccgaggagaagccgctggaggcggggctggcggcggcgcgcttcgagtcagcgcaggccgagcccgcgcccatcccctga

SEQ ID NO: 7460 - DNA, 1035 bp, Myxococcus xanthus
atgtttgactggcttcacaccctcttctcgcgtgacctcgccatcgacctcggcacggcgaacacgctcatctacatccgcggccagggcatcgtctccaacgagccctcggtggtggccgtccagcaggacgcgcgcgggggcaagaaggtcctcgcggtgggcaaggaagccaaggaaatgctcgggcgcaccccgggtaacatcgtggccatccgcccgatgaaggacggcgtcatcgcggacttcgaaatcacggccgcgatgctgcgctacttcatccagagcgcgcacaaccgcaagacgctcgtcaatccgcgcatcatcatcggcatcccctccggcatcaccgaggtggagcgccgcgcggtgcgcgaggcggcggccaacgcgggcgcccgcgaggtctacctcatcgagcagcccatggcggcggccattggcgcgggccttccggtgacggagcccagcggcaacatgatagtggacatcggcggtggcacgtccgacgtcgcggtcatcagcctcgccggcatcgtgttcgccaagagcgtgcgcatcggcggcgacaagctggacgaggccatcatccagtacgtcaagcgcaagtacaacctgctcatcggtgagcgcacggcggagctcatcaagatgggcatcggcaccgcgtacccgacggacgaggtcatgaccatggagatcaagggtcgcgacctggtggccggcgtgccgcgcacgctcacggtgtccagcgacgaagtgcgtgacgcgctggcggagcccgtcaacggcatcgtcgaggcggtgaagctgacgctggagcgcactccccccgagctcgccggcgacatcgccgaccgcggcatcgtcctggccggtggcggcgcgctcctgaagaacctggacacgctgctgcgcgaggagacgggcctgcccgtgttcctcgccgaggacccgctctccgccgtcgtgattggcgcgggcaaggcgctggagtcgctcgacatcctccggcaggtctgccagccgggctga

SEQ ID NO: 7461 - DNA, 506 bp, Myxococcus xanthus
atgatcaagggcgactcgccgaatcccgaggcacccactggaacgggcgcggatcctctcatcgggcggaatctgaacggccgcttcagcatcctggaaccgttgggcatcgggggcatgggcaaggtctaccgggccctacaggcgccgctcgagcgcgtggtggcgctcaaggtactcaaccccagcttccccagcagccgggaccctggcttccagaagcgcttcctgcgtgaggcgtcgctgacgtccaagctgcgccatcccaacaccgtcaccgtcatcgactacgggcagacggacgacggcatcttctacatcgccatggagtacctggacggccggacgctggcccaggtgctggggcaggtcggcccgctggcgtggtctcgcgccatcgccatcacccagcagatctgccgctcgctgcgcgaggcgcacagccagggcatcgtccaccgcgacctgaagccggccaacatcatgctcctcaacgagcaggatca

SEQ ID NO: 7462 - DNA, 678 bp, Myxococcus xanthus
  unsure (1)..(678): unsure at all n locations
ctgggtacttccatgcacgccatgtcgttccgngaacacctgccgttcatcggcaagccgttgttgcgctggcgtacgccgcgtggtgtgcggcccgccgtgccgctgctcatcgacgagggcgaggcctttcccggctcgttcgtcatcgcgcggcgcgcggaggagctgggacagggggagccgctcttccccgcaacggacctcccggtgattcagcgctgggacgatgacagtgagcaggtgcactccgcggcgcgcgccaaggtggtggcggcgttgttggagaatcggcaggcgcaggcggagagcctccccgccttcctgcccatgggactccggtctctgctggccccgtccgcgaggctgggcgcgcgcttcgtggcccgcaaacaccaggcgcccacggacatcggcgcggccgtccaggagaaggtcatccccacgctggagcgcctgcgtgagtcactgggcggccggccctacctgctggcgcgcttcagcttcgcggacatcgcggccgcgctgatgctccagttcgtgcggccggtggacgacagctacctccccctgggccccggcacgcgagcggtgtggagtgacgcggagctcgcctcccgcttcccggacctgctcgagtggcgggacggcctgtatgcgaagcaccgccgtccctga

SEQ ID NO: 7463 - DNA, 324 bp, Myxococcus xanthus
atgattcagatgacgagcgtgctcgacgtggcggacaactcgggcgcgaagaaggtgttctgcatcaaggtgctcggtggttcgaagcgcaagtatgcgtccatcggcgacgtgattgtcgtctcggtgcgcgaggcgcttcccaactcgaaggtgaagaagggtgacgtggccaaggccgtcatcgttcgcaccaagcgcgaggtgggtcgtccggacggcagctacatcaagttcgacggcaactccgcggtcctcatcaacaaggacatggagcccattggtacgcgtatcttcgggccggtggcccgtgagctcctttag

SEQ ID NO: 7464 - DNA, 261 bp, Myxococcus xanthus
aagacgcgcgtggggattgtcactttcaacaagatgcagaagacggtggtcgtcaccgtccagcgccgggctccgcacccgaagtacgggaagatcatgagcctgcgcgagaagtacaaggcgcacgtggaggaccacgactaccccaagaagatcaccatcaacgagggtgatcgggtccggatcgccgagaccaagcccgcttcgaaggacaagcgttggcgcgtggtcgaggtgctggagaagagcaagaacgtctag

SEQ ID NO: 7465 - DNA, 195 bp, Myxococcus xanthus
atggcgactccgaagcaattgaaggaactgtcggcggacgacctgaagcagcgcgcggccgacctgcgcgagaggctgttccaggaccagctgaagcggcggaccggtttgctggacaacccggccgagcgcacccagcacctacgggacctggcgcgggttctgaccgtgctgacccagaagacgaaggcttaa

SEQ ID NO: 7466 - DNA, 420 bp, Myxococcus xanthus
atgcttcagcctgctcgtacgaagtaccgcaagatgcacaagggccgcatgcctggcagtgcccaccggggtagcgacatgacctacggtgagtacggcctgatgagcctccagccggggtggatcacctcccggcagatcgaggcggctcgtatcgcgatgacgcgtcacgtgaagcgtggcggcaagatctggatccgtatcttcccggataagcccatcaccaagaagcccgttgagacccgtatgggtaccggtaagggtggcgtggagtactacgtcgcggtggtgaagcccgcccgcatcctctacgagatggagggtatgacgccggaagtggccaccggggcgctgaagctggcgcaggcgaagctgccggtgctcacgaagattgtgaagcgggcggacctgagcctctaa

SEQ ID NO: 7467 - DNA, 663 bp, Myxococcus xanthus
ttgggacagaaagttcatccgatcgggttccggcttggtgtcatcaagacctgggactccaagtggttcgagcacaagaactacgcgcagtggctccacgaggacatccgcatccgcgagttcgtgaagaagtcgctgaaccacgcgggcgtgtcgaaggtggaaatcgagcgcgcggccaacaaggtcaaggtcaacgtccacactgcgcggccgggcatcgtcatcggcaagcgcggcgcgggcattgagacggtgaagaaggacctccagcagttcacgaagaacgaggtcttcctcaacatcgtcgaggtccgcaaggctgagaccgacgcgcagttggtggcggagaacatcgccacgcagctcgagcgccgcatcgcgttccgccgggccatgaagaaggccctgcagacggcgatgaagttcggtgccaagggcatccgcgtggcctgctcgggccgcctcggtggcgcggagatggcgcgctacgagtggtaccgcgagggtcgcgtgcccctgcacaccctgcgcgcggacattgactacggtttcgccgaggcgaagacgacctacggcaagatcggctgcaaggtctgggtctgcaagggcgaggtcctcccgggcaagggtggccaggcccccatgccctccaaccggtaa

SEQ ID NO: 7468 - DNA, 345 bp, Myxococcus xanthus
atggagtcgactgcacatctgcgtttcctgcgcatgagcccccgcaagatttccaccgttgcggagctcatccggggcaagcctgttgaggcggccctcaacatcctgaagttcaccaagcgcgccgcggccaagccggtggagaagctcatcaagagcgccgtggccaacgcgactgacaagtccaagggccaggtcgacgtggacacgctctacgtgaagaccatctccgtggaccagggtcccacccagcgtcggttcatgccgcgcgccatgggacgggccacccccatcaagaagaagacggcccacgtccacgtggtgctcgccgaggcgaagaagtag

SEQ ID NO: 7469 - DNA, 288 bp, Myxococcus xanthus
atggctcgttcgatcaagaagggtccgttcgtcgacgacttcctcgtgaagaagatcgaggacatgatcaagacgaacaagaaggccgtcgtaaagacgtggtcccgccgctccacgattcttccggagttcgtgggtcacaccttcgcggtgcacaacgggaagaagttcatcccggtgttcgtcacggagaacatggttggccacaagctcggcgagttcgccccgacgcgtacgttcggcggtcactcggcggagaagaaggtcgccaaggccccgggcaagtag

SEQ ID NO: 7470 - DNA, 846 bp, Myxococcus xanthus
atgggcatcaagaagtacaagccgactagcgccgcccgccgtctgatgacggtgtccgacttcgcggacatcaccaaggactcgcccgagaagagcctcaccgagccgctcaagcgctccggtggtcgcaacgtccacgggcacatcacccgccggcaccagggcggcggccacaagcgccgctaccgcgtcatcgacttcaagcgccgggacaaggatggcgtccccgcgaaggtcgtggccgtcgagtacgaccccaaccgcaccgccaacatcgccctgctgcactacgcggacggcgagaagcgctacatcctcgctccggtgggtctgagcgtgggtgacacggtgttcgccggcgaaggcgcggacatccggcctggcaacagcctgccgctgcagaacatcccggtgggtacggtcatccacaacgtggagctgaagccgggccgtggcgcccaggtcatccgctccgccggcacgtccggacagctgatggcgaaggaggaccgttacgcgcaggtgcgtatgccctccggcaccgtccgcaaggtcctcatcgagtgccgcgccaccgtgggccaggtcggcaacatcgagcatgaaatcatccgtatcggcaaggcgggtaagagccgctggctgggcattcgccccaccgtccgcggtctggcgatgaacccggtcgaccacccgcacggcggtggtgaaggcaagtccggtcagggtaacccgcaccctgtgtccccctggggcaagaagaccaagggtctcaccacgcgcaccaacaagcgcactgacaagttcatcgtgtccggccgccgccagggcgcgcgcagccagtaa

SEQ ID NO: 7471 - DNA, 294 bp, Myxococcus xanthus
atgaatctgaacgacgtcatcaagggcccgctcatcaccgagaagctggacaaggcccgcgagaagttccgtcagtactcgttcatcgtcgaccgcaaggcgacgaagcacgacgtcgcccgtgcggtggagacgctcttcaaggtcaccgtcgagggcgtgaacaccaacatcgtccgcggcaagatcaagcgggtgggtcgtagcatcggcaagcggcccaacttcaagaaggcggttgtgacgctgaagcagggcgactcgatcgaactcttcgagggaggggcggcctga

SEQ ID NO: 7472 - DNA, 1521 bp, Myxococcus xanthus
atgagctaccagctcaaggactacgagcagcacgcgatctccgcgcgctacggggcgctgttcatggacgacggctaccgtgagcggaagctgtacgtcgacgtgcgcgtcggtgactacgacttcgacagctcggtggcggaggggttggagttcagcttctcgaccaagggcaccagctatgtgtcacgcaaggaaggcccgctggacgactcgccgttggcgctgcgcacctcgctgtggctcatcaccgatgagaagtacaagtccgcgctgttccagtacctgaagaagaagggcgaggacgtctacgcggtggaggacccgaagcgtccgccgtccttcacgcgcgagaagccggtgaagcacgtggaaccgccggtggaggctccgttcgaccgcgagcgctgggtgaaggtcgcccgcgacgtgtcggcgcgcttcaacgcgcacccggagctgttcgactcggaggtgcgcgtcaccaaggacaaggtgacgcggctgttcgtgtcctcggaaggcagccgcatcatcaccgaggagacgctgtacggcctgcatgtctccgccgtcacccgggcgccggacgggcaactgctggacaactcgcgcaacttctatgtgcccgccgaagcggagctgccggacgtggcgcgcctgaacaaggcggcggatgacgtcatccaggagctgctggccctgcgcgccgcgcccgccatcgacccgtacacggggcccgccatccttgcgccagaagcggccggggtgctcttccacgaagcggtggggcaccggctggagggagaccggcaggaaggtgacaacgagggcaagacgttcaagggccaggtgggcaagcaggtgctgccgtcgttcatctccatccacgacgacccgacgcggcgcgtgctccagaacgagccgctcaacggctactacctcttcgacgaggagggcgtgcgcggccagcgggtgacgctggtggagaagggcgtgctgcgcaactaccttcaggggcgccgaccggtggagggcttcctccagtcgaacggccacggccgcagccagggcaacctgaagccggtggcgcgcatggcgaacctgatggtggagagcacgaacggcgtgagcgacgcggagttgaagaagcgtctgattgccgaggcgaagcgccagggcaagccgtttggcctcatcatccgcgacatcaccgggggcaacaccaacacgtccggctacggttaccaggccttcaagggcgtgccgcgcatggtgtaccgggtggatgtgaagacggggaaggagacgctggtgcgcggcgtggaaatcgtgggcacgccgctgtcggcggtgaaccgcatcctcgcctcggggcagaagcccggcgtcttcaacggcttcttcggcgcggagagcggcaacgtcccggtgtccaccgtggcgccggccatgctgctgcaggagaagagagctcacagcgctcccatggaggggaaggaccgcccgccgattctcacc

SEQ ID NO: 7473 - DNA, 357 bp, Myxococcus xanthus
atggctcccaaggcgcgcgactacttctaccgcccgccccgcaaggtgcgccgcggcgccctgaagtccgcgctgtccctgcgggcccaggagaagacgctcatcatcctggatggcttctccctggatgctccgaagagcaagcaggccttcgaggtcctcaccaagcgtctgaagctccagaacgccctggtgattgacgacaagggcaacaccaacctgcaccgcagcgtgcgcaacctggcgaagttcgacgtgctgccgcccgagggcctgaacctcgaggccgttctccggcactcgcacctcgtcctcacgtccgcggccgcgaagaccctcgagggggcgctgtcatga

SEQ ID NO: 7474 - DNA, 309 bp, Myxococcus xanthus
atggcgacacagaagatccgcatccggctgaaggcgtacgactcgaagctcctggaccagagcgcgggtgagatcgtcgagacggccaagcgcacaggcgcgaaggtggccggtccgatcccccttcccacgcgcatcaacaagttcacggtgctgcggtctccgcacgtggacaagaagagccgtgagcagttcgagatccgcacgcacaagcgcctgctcgatatcctcgagcccacgcagcagacgctggatgcgctgatgaagctggatctgtcggctggcgttgacgtcgagatcaagtcctag

SEQ ID NO: 7475 - DNA, 498 bp, Myxococcus xanthus
gcccgcgtcgagcccggtatcatcaaggtcggcgagaaagtggaagtcgttggtctgcgcccgacgcagaagacggtcgtcacgggcgtggagatgttccgcaagctgctggaccagggcatggcgggcgacaacatcggcgcgctggtgcgcggcctgaagcgcgaggacatggagcgcggccaggtgctggccaagccgggcagcatcaccccgcacaccaagttcaaggcgcagatctacgtgctgtcgaaggaagagggcggtcgtcacaccccgttcttcaagggctaccgcccgcagttctacttccgcaccacggacgtgacgggctcggtgaagctgccggagaacgtcgaaatggtgatgccgggcgacaacatcgccattgaggtggagctcatcacccccgtggccatggagaaggagctgcgcttcgctgtccgcgagggtggccgcacggtgggtgccggcgtcgtggcggaaatcgtcgagtag

SEQ ID NO: 7476 - DNA, 561 bp, Myxococcus xanthus
tgctctaagtggctgcgcaagaaggtgaagcgacgctggcgggccttcctgctgctcatggtgggcgtgccggcgctggtgctgatcaccctcccgttcatgtgcgcctcccgcttcgtcttcaccgccctgttcaccgcatggggcgcgtggtggtgggtggtcttcaccgccgccaagagcgcgcgggcctgggagccatccgcgggggccacgcggccgccctggttcctgcgggtgtggacggtgctcaccacgcgcgtgccgggctttcggtggggctcgctacagcggtacggcgcgtcctggggacggcgcacggaggaggtcttcgcccccatctccagcacggagcgccacccctgggtgttcgccgggctggcggtggtccgattcctgggttcatttcctccgatgaagttcttcgtccggccgctcatccccgtcgcctccgcgcacctgctggaggaggacgtgcccgcggccaggaaggcgctcgccgccggtgcgaacgcctcgccgcccgaagccgaggtaccccgccccgccgacgtgtggtga

SEQ ID NO: 7477 - DNA, 351 bp, Myxococcus xanthus
atgctggcgggaacgctggtggtgcgcgagcggcgcctgaaggtgccctccgccctgggcatgcccggcgacgaagggctgctggcggatccgctcttcgtgtcgcgcgtgaagcgcctgtccagcgaggagcgggaagtggtgctgacagcggccctgcgccgtgaggaactgcgcatggaggcgcggctccgcctgttcgcggcactgggagcaaggctgcaggacgcgctggccatggagaagccgccccacctctccgacgagaagtgggcgctgctggtggccgcggccctgctaccgccgaaggggcagcctagaagtacgccgcagcgccggcagacagcgtga

SEQ ID NO: 7478 - DNA, 196 bp, Myxococcus xanthus
atgcgtgtccgccgacttgttgctgcgctgtccctggtctccgccctgcccttcgtcgcctgcgtccggaccccgccgccgcatgagcgggcgctcatcaacaacgagctatgcacgcaagagatggccaagggcgacctgacccgcgcggagacgttctgcgacctgggcctggagttctccccccagtgcgcgg

SEQ ID NO: 7479 - DNA, 2862 bp, Myxococcus xanthus
atgggcggcgtggtggcgctggtgctggcggtggccctgtccgcggggcagcgcatgcccgcgctggcgctgtacctcttcgcggacaccttctccacgttcgtgtccttccgcttctggggccgcatggcggccgccttcgacgcgcgtgaggcgcgccgggccttcaccgcgctcaacggcttcgccatgggcggaggcatcgccggaggtctgctggtgcagggcctggcggtgaagctgggcacgccggccatcgtggtgagcggcgccgtgggcctgctggccgcgggcgccatcttccaccacctgtacaagggcctgccgcccacgccgccgcgcggccgccccgcgtccttcctggggctgcgctatctggcggagagcccctacgcccaggtgctggcggcgctgggcatcgcgttcgcggtgctgtcgtcgttcgtggactacctcttccggctgcgcctggagggcacgctgagcgaggacgcgctgacggcgctcttcggttcgctccagctctggattggcctgttctgcgtggccttccaactgctggtggcgcagcgcctgctgaagcggctggggctcttgcgctacgtggcgatggtgccgctggtcctggcgccgctggcgggcgcggcgctcgtcacccccagcttgtggccggtgcacttgctgcgcctggtggagacggcggtgagctactccatcctcccggtgggcatccagttgctctacaccgcggtgccggacgaccagcgagagggcctgcgcgccacggtggatgggctgctgcgcaagggcggcgtcgtgctggccggtctgttgctcatcggcgcgggacgcgcggccaacggcgtcaccatggcggtggcggtggtgggcatgtgcgcggcgctgggcctgctgctggtgcggctgaagtccgcgtacgtggccgcgctgggcgagcaggtgggagcgcccgaagaagaggacgtggcgctggagggcgaggaggagcagcggctgctggccgaggccctggcggccccttctccggagcgggtgctgcgcgcggtggcgatgatggagcaggcggaggtgccgctgcgtccgcacctgcccgcgctgctgcgtcacccgcacgagcgcgtgctggagcgcggcgtctccctggccctggagttggaggcgcacgaactggcgccggtgctggagcggttggtggaggaagggccacgtcggcctcgagaccaggccgtgtgggccctggcgcggttgtcaccggagcgggcggagcgcctgctgcccgcgctgctgaaccacccggacgtgggcctgcgctgcgcggccattggcgcgctggtgaagtcgacggggagcgccgtggcgctggacgcgctgcgggcgatgttgtcgcgcggcgagggcgcaccggtgcccgagcgccgcgaggtggcgcggctgctggggcgcatccagaactcacgcttcgcggagccgctggcgcgctatctggaggacgcggacggctccgtgcggcacgtggccctggtcgcggtgggcaggggcggctacgcggagctggcgccccggctgctgccgttcctcacctggcgggaggagcgcaaggcggcgcgcgaggcgctggtggcgctgggcgacgaggtgacgccgttggtggaggagcagctcaacaagcacatggcgccgctggcgatgcggctgcaactgccccgcgtgctgcgcggcatcggaacaccggcggcgctggacgcgctgctgttctccaacgtgcgcgacgacgcgtccctgcacttccggattggcgcgcagatgtcgcgcctgcgcgacgagcaccccgagcatcccgtggacgtggagcgcgtgcgcgaggccctgggccggcggcgggaggtctaccgcaacctggtgggcgccttccgcgacctgcgcgcggcgttgggggatggctcgctgctcacgcgcgcggtgggcgaccggatggaccaggcgttggaattgtccttcttcctcctggggctgctccatccgtcacacgtgatgcgcggcatccactacaacctggtggggccggacctgcgccgtcgcgcgttggcgctggagttgttggagaacctggtcgacgaagaggaccgggaactggtgatggagcaggtggaggcgcaccaccgcgagcttccacccggcgcgccgggccggttgtggcggcggctggcggcgctggtccagagcgaagacggcgtgctgcgcgcatgtgcccgccatgtggcgtgggtgaacgggctgcacgtgctcccacaggaaggtgacatgagcgacaggacagtccagcggatgttcgcgctggaaggggtgagtgtcttctcccagtgcgacgtggatgacatcgccgccatcgccgccgtggcccgcgaggcgtcgttccgcacgggagagcgcatctacgcccagggcgacccgggcgacgcgctctacgtcatcgtcgacggcgccgtggatgccttccacgacggcgagcacgtgctgcgcttccagggcaagcaggccttcggcgaggtgagcctgctcgacggcgcaccgcgtcccacggacatggtggccgcggtggacacgcgggtgctcatcatcgaccggcgtgacttcttggatttgctcgcggaccggccggagctgctgacaggcttcttccgcgcggtgagcctgcagctccaggcgctcatcgacctgccggactcgcgcgagacgggcgagcggctggagatgacggcgccgctgggccccctggcgccgccgctgccggatgggccggcgccggatggaaacgacgaccgctcgcgcgacgactcctga

SEQ ID NO: 7480 - DNA, 519 bp, Myxococcus xanthus
atgcgtaccctgctctgcaccctcggctttaccctggccctgctgtcggccagccccgcgcatgcccagttcgccaatcgcagcctgggcctgtcactgggctacatggacttcaaccggacgaacggcctggatgacgcgttcttcgtgggcgtcgacgccagcctctacatcgagaacggcttcgaggtggtctccctgtcgaagattgcgttcccacgcgacaccacggaccgcaacgagaagcgcgtggtgggcctggcgccgtccatcggcatccggtacctgctgatggaggagtccatccgcccctatgtgggctcggacctgagctacctcgtcgtcttcaagaacagcgtcagcaacttcgtgggcattggccccaacgtcggcatcgacttcttcatgtcggactcggtgagcgtgggcgcgcgcgcgcagtacaacttctacatcgcgctcaacgagaagacgcagcgcacgctcacgctgtctgccggcgctgcggcgtacttctag

SEQ ID NO: 7481 - DNA, 285 bp, Myxococcus xanthus
tgctctaaagtggattacgcggtgcgtagcccgaagcagcagttcatcgtggtgacggaggcgggcatcatccaccagatgaagcgggccgcgccgaacaagacgttcattcccgcgccgccggacaacggctgcgcgtgcaatgagtgcccgtacatgcggctgaacacgctggagaagctctggcggtgcatgaaggagcgcacgcccgagctgaccatgcccgaggacctgcgcgagcgtgctcgcgcgccgctgcaacgcatgctggactggtctcagtag

SEQ ID NO: 7482 - DNA, 456 bp, Myxococcus xanthus
atgcgagccaaggacaggctgcgcatcctgctacagggggaccgtcccccgtcgctgggcgcgcccgagacgggcttcggcccgtccgccatcttcgcgcatcccccccaggacctcccggcgctgctgcggctggcggacgagttggagaacctggcgcgccgcgaggcgggtgagcgcgccctggtgtggaagtgcggagattgtggcgcccggtacgcggtgccggtggccctggtgcgccaggtgtccatccgctgcgagcgctgcggcacgccggtggagctggcggccacgcgcagcctgggtgaggagtccctcatcgacccgttcctgggcgcggtgaatcacagccgccgggagctggccgccttcttccgcgaggccatggcccgcggctggccggtgctggtggccgaggacaagcgcgtgccacgcacgcagccctcggcctga

SEQ ID NO: 7483 - DNA, 1320 bp, Myxococcus xanthus
atggtgagcagcccgcttctggatcgcatcaagaagcgggacgcgagggtgggtgtggtcgggcttggctatgtcggtcttccgctagggatggcgttcgcggaggcgggcttccccgtcatggggctcgacgtcgacaagcggaagatcgacaaaatcgagaagggggagagctacatcaagcacatccccggcgctccgctggcggagctgagcaagtcgggcaagctgaaggccaccacggacttcgccaaggcgaaggatatggactgcgtcatcatctgcgtgcccacgccgctcacggcgtcgcgtgagccggacatgagctacatcatccagacgggtgaggcgctcgcgccgcacgtgcgtcctggacagctcttcatcctggagtccaccacgtacccggggacgacagaggaggtgctcaaaccgctgctggagaagaacggcctcaaggccggcaaggacttctacctggccttcagccccgagcgcgaggacccgggcaacaagagcttcaacaccaagacgattccgaagattgtcggtggctactcacccgaatgctccgagatggccgcggccctctacggcagcgcgctgaaggaagtggtgccggtgtcctccacccgcgtggcggagctgaccaagctgctggagaacatcttccgctgcgtcaacatcgccatggtcaacgagatgaagatgctctgcgaccgcatgggcgtggacgtgtgggaggccatccaggccgcgagcaccaagcccttcggctacatgcccttctacccaggcccgggcctcggtgggcattgcatccccatcgacccgttctacctgacgtggaaggcgcgcgagtacgagttccacaccaagttcatcgagctggccggcgaggtgaactggcagatgccgtactacgtggtgcagcgcacgatggaggcgctgaacaagaacaagcagacgctcaacggcgcgaaggtcctctgcctgggggcggcgtacaaaaaggacatcgacgacatgcgtgagagtccatcgctgcgcgtcatgacgctgctggcggagaagggcgccgagctgtcgtaccacgacccgtacgtccccgagctgcacaagggccacggcttcaacttggagatgaagtccgtgccgctgaagccggagacgctgggccagtacgacgcggtcctcatcctcacggaccactcggacatcgactacgccatgttggtggaccgcgcgaaggtcgtcgtcgacacgcgcaacgccaccaagggtgtcagcaagggtcgtgagaaagtgacgaaggcctga

SEQ ID NO: 7484 - DNA, 507 bp, Myxococcus xanthus
ctcctgggcaaacccgaaggcaccgtgttggacgtgggctgcggcacggggctgctcgcgcggcggctggcgcatgagcccgacgcgccgcccgtggccgcgctcgacgtgtcccgcgccatgctggaagagggcctggcccaggtgcgcgaggccggcgtcgccgtggacttcctgcgcgccgaagccccctacctccccttccacgacggtgtgctgggcgcggtgttgatgagtgacgcgctgccctacgtcgcggacctgtcccggatgatgatggaggtccaccgcgtgctgcgtcccggaggccgctgggtggccagtacctacgcttcggtgggagcgcctcgggcgctgctccaccgcggcgtgggcctgcatccacgaggggaggccgaattgcgccgggaggccgcggcggcgggcttcgtgcgcttcgagcgcgtgtccctaccgtcgctgctggtggtgaaggcggagaagggctccgcccagacgcctagatga

SEQ ID NO: 7485 - DNA, 615 bp, Myxococcus xanthus
atggggctgggcctgctggccctggcgctctactttctgctgcccttcgacatccgcggctacgtctactacctcaacacgcgctacgcgcacctggccgccgcgctcctggtggccaccgtcccggcggccattcccgcgtggcggaggcccctgcgcgtcgccgccctggcgtgcgcggtggtgctggctttcgtcatggcgcgcggctaccgcgccttctctcgggaggcgcaggccgaatgggggccactggtggccgccaccgccccgcgccctcgtgtcatggggttgatgttcgaccccggctcccgggtggtgcgtcagcccgtcttcatccacagcgcggcggtgctggcccgggcgcgcggtggcgtgcccaacttcaccttcgcgtccacgccgcactccccgctgcgctacaccggcgaggagccccccaccttcccctccgagtggcggccgcagcagatggactacgagcggcagggcgtctggtacgaccacttcctcgtccgcggtgcgtcgccgtcgcgagtgttcggtccgcagctccaatccgagctggccgtggtggcggagccgggcaagagcgcgctggtgcgccggcgctga

SEQ ID NO: 7486 - DNA, 1206 bp, Myxococcus xanthus
atgagttcctcctcttcggaccctcgctccctgctggacgccctgcgctccggcgcgccgctgcccgcctttcccgccgaagcggtggagtccgcccgcgccatggcgcgcgacgtgtcccaagccgccctcgcccgcgtggaggcccttccggagcctctggccctggccgtgcttgaggccgccgtgtcggacgggaacgccgtcctgccggaggccctggcatcctcgtcggtgaagcccctggccaaggccgcgaagaaggcgctgtaccagcttcgctcacggggcgtcgccgtggccgggcccgcgcgtgccgccccggccgagccgcccgccgctgcccccgaggccctcaacgcgctcgccagcgccgtcaccggtggcggcgagcgagcgctcgtgctggcacgggtgctgcgcggcgcgggcgtggaggtggtgcaaatgcagttgtcccacgagcgcggagtggtggcgctccagttgggcgacaggaatcgcgccacctggcggaagctggtgaaggacgggctggcccacggcggcatcgtggagctgccgcccgaagaagccgcggccctgctggccgaggccgccggcaccaacctgcgcacccgcacgcccttccccaaaggactggacgtggtgctgcgccactttggtgtccagccgcagcagtcgcccacggagctgcctccgcccgagcccgaggacatccgccgcgcgcaggaagccgacgtcctccacgacaccgtggagctggcttcgtggctgcctccggagctcgacatgcaggccctggtgcagaagatggacgaagtgatgcacagcccgctgtcgctgagcgacgtgcagcgccaggagcagctccaggcggcggtgctcggcgtggcccgggacttcttcacccccgaggtacgccagcgctacgcgctgcggctgtggcggatggcggactacttcgagcggagcagccgcccacgcgaggcggatatcgcccgggccgaagcccgccggctcttccatggggcccaggagcccttctcccgcttcgccgagcggctcttcgagaaggtgctggccctggtagccgccgccggggcgcgggccggtgcacggcccggcgcggacaccggccccgcggaggccgcgcctgcccccacgctggagcggcgcagccccggcgggctcatcatcccctga

SEQ ID NO: 7487 - DNA, 369 bp, Myxococcus xanthus
atgacgcgcatcggaatgtgggtggccggagggctgatggcgagcggcctgctcctggcaccgggcgcggcggaggcctgcgaggcccaccggcgtccggccccggaaacgaaggccgccgaggccacgccgaaggctgtcgagccttccgccagcggcgtggagcgcccgttggatgtgctggactcgctcatggccgccaagtgccagtgcggcagcaaggcggactgcacgtgcaagaagggctcgtgcgactgcagcaagtgcaagaagcccaagcgccaggtgatggacgcgctgcgcggccagcccgcgaacctgcagtttgacgaggcgcgctacgacgcgtccgcgggcatcttcatctag

SEQ ID NO: 7488 - DNA, 564 bp, Myxococcus xanthus
atgttcctggtcgctccggacgacgtggtgcaggcgctcgccagcttcgtgcgcaagggtgacccggacgccagcgtgctgctggacaagttcatcgagcgcaaccgcgtctacatccggcgcctgtctccggcgcagatgcgcaagcgcatccggctggagcccgtggggcagcaccacgatttggagcgcatctacgcccggctgaacgagcgctacttcgaaggccgcatcgacgcggccatcacctacggcccggcgccgcgggtgaaggggcctcgcaagagcatcaagatgggctcctactccgcggactcgaaggtcatccgcatccacccggcgttggaccagccggtggtgccccgctacttcgtggagtggattgtcttccacgagatgctccaccacgtgtaccggacgcggaagggcgaggacgggcggcgctgcatccacccgcccgagttgatggagcacgagaagcagttccacgactacgcccgtgccctcgcgtgggagcgggagaacctggacctgctcctgcgtgcccgcgtgacgccggcctga

SEQ ID NO: 7489 - DNA, 1815 bp, Myxococcus xanthus
atgcgaatcccccacgcgctgtctctgggcgccgccgctctcctggcgctgtcggcacaagctgccgcccccggccgtccttcccccaccctgccttcgggctactggccagaggagaaggtggccgaagtcctcgccaagacgcaggaggtccgcctgtcgccggacctctcccgcctcacgctcgacgagcaggcggcggtgaaggacctgctggaggtgggcgccatcttccaggggctctacgagtcctcacgccaccaccaggcgctcccggctcacgcgaagctggaggcgctggacaagaagctgggcagccccaagcgcacgcaggacctgctcacgctgtaccgcctgtaccagggccccatcgccagcaccctgagcaacgcgcgggaggcgttcctcccggtggacgcgcaggtgtccgcgcgcaacgtgtacccggtggacgtcacgatggaccatgtggacccctccctggtccctaacccaggggagcgccagtccctgctgagcgagaagacggtggttcgccgcgccacggccgccaacctgcgccaggacgtgaaggtcctccagacgcacccggtgctggacacgctgcatccgggcctgcgccaggccctgcaagcgaaggcgaagcggcccgacgccaaggcgctctacgcggtgccctatgccgtggcctatgggccggagctggtgaaggcctacgggctggtgatgcgcgcggcgcagcggctggaggccagcgacgtggagctggcgcgctacctgcgctaccgcgcgcgcgacctgctcaccaacgactacgagagcggcgacgcggcctgggtgacgggccgcttccagaagctcaacgtgcagttgggcgcgtatgagacgtatgacgacgcgctcttcggcgtgaaggcgttccacagcctgtcggtgctgctgagcaacgaggcggccacgcaggaactgcgcaagcgcctgggcgggctccaggcggtggaggacgcgctgccctacgccgcgaagaagcgcgtgcgcgaggacatccccgtgggcgtctacgacgtcatcgccgacttcggccagtcgcgcggcaccaacaccgcgagcatcctccccaacgacgcgctcgcggcgcgccgctatggccgcaccatcctcctgcgggagaacatcatgcgaaaccctgacctcttcgcgtccgacgagcgcatctggcgcgccgcggtggtggacgcccacgcccgggagctggtctccgaaggcaacttccagcgcaccctctggcacgaggtgggccactacctggggccggaccgagaccagaaggggcgcacgctggacgacgcgctggaggactacgcgggcgccgtggaggagatgaaggcggacctggtgagcctcttctcgctgcatgacttccacaagaagggcgcgctcgacgccgccgggctgcgcgcggtgcaggcctccggcatccgccgcacgctccagaacgtgcgtccgcgcgaggaccagccctaccagcgcatgcagttggtgcagttcaactggttcctggagcacggcctgctccaggcggacccgcagacggcgcgcctgagcattcagtacgacaagtacccggcggtcgtgacctcgctgctggagaaggtgctcgcgctccagcacggcggcgacaaggccgccaccgcggccttcttccagcggtggagcgcctggacgccggagctgcacgagaagctggcggcccgcatccgggacgcgcagggcgcccgcttccggctggtccggtacgacgcgctgggcgactga

SEQ ID NO: 7490 - DNA, 672 bp, Myxococcus xanthus
atgttgacggaggaggagtacacggggctggacgaagccgtgtccgccctggggcaccggctgacgaccacgcccgagcaatacgcggcggcgctctacctgcccaactggtacccccggctctcccgctacaccgcccgcagcgtctggacggagggcatggacgcggcggaagcctggcacgcggcccaggcgctcggcccgcagccctggctggtgaaggaccacgtgaagtctgccaaggagcgttgggatgaagcctgcttcatccccgagggcacgacgcaggcgcgcttcgaacagatttgcgccaacctggtcgacgagcgcggagaccgcttcgagcggggcctcgtcgtccggaagttcctccccttcaagacgtacggccggacacccgcgggcccggcccacctcgagttccggctcttcttcggaggcggccggctcctcgccgccgagccgtaccacgagttcgacgtcgacgtgccggacttcaccggcttcgagcccctggcccggcgcatcgactcgcccttcatcaccctggacgtggccatgctccaggacggaggctgggcggtggtcgaggtgaacgacggcggcgtctccggactgccacccgggctggacccgcgcacgctcttcgaggccctgttcgccccccgctag

SEQ ID NO: 7491 - DNA, 672 bp, Myxococcus xanthus
atgtacctggggatggccggcacggccgtgatgctgttgggaggctgtgcctcccatcgctccagcgcgaaggtggacaagcaatgggtggcgcgcgtcccacccggcgagctgggaaacgtgcgcgaggcgcagctcacggaggaccatgcccgggagcagatcccccgcacccaggtggccagacaggacgccgaggcggagcgagaagtcgcccaacgcaacgaggacgccacgaagtcccgccacgaagcagctgaggcagcgctcgaggccgcgcaggcaacgggtgacgtcgcggccatcgagcgggcccagaatgccgcctgcacgacccagcacgccctcaccctggccgaggcggagacggcttggcgcgacgacgcggtgacgacgttgaagtcgctggaggtcatgcgccagcgggagctggacgtggccgacgcccagctcgaacaggcgaagtacgaagccgtcaacgccaacgcggacgtccgggcgaaagagttgtccccaggggacttctccagcgccgtcgccgacgcccggcgaaaggcggcggatcagcagcgccaggtggacgccaacctccagcgcgaacatcaggccaaggcgcgctggcaacagttgcaggaccagggctacggaggcagcggctcgcagcagccctga

SEQ ID NO: 7492 - DNA, 642 bp, Myxococcus xanthus
atgggtgacgtcctgtgcgccgggcaagtcttgcgctacatggtgcgcatgaaactcaaacttcccttgtttctttcgctatccacggttctcccggcattgatcagctgtggagccccgacgtccacggacaccgcgcacgaggccgtcgtgctcggaacgcaggcccaggcgctggccaccggtacgcccgccgcggagggtgtgctgtccttcctcaacgactactccatctcctacaccgtgctggacctggaggtgccgctggactcccaggcggcgcaggcgctgattgacttccgcgaggggccggatggcgtgcttcacacgggggatgaccgccgcttcgtgagcatcgagcaggtggacgcggcgccgtacgtgggccccgctgcgctcgcggcgctacaggcgtacgccaagggcacgggccgcgtggagctgccggtcgacggacacgtggggaccctgcacggcgtggccttcaacgtggcggaggcccgccgcgccatcctcgccgtgaacacggagagcgcgtcgaacctggagactgtcttcggcatccccgcggcggcggtgcagagcctggtcgcggcgcgtcccatcctccacatggtgcagttgtcgcggctggcgaacgtg

SEQ ID NO: 7493 - DNA, 3381 bp, Myxococcus xanthus
atgccgtccgcgcccgaggcctcgccctacgcgatgcctccgcccgccgcgggagcgccgtccttcgacttcgccgaactgcccgtccctgcgaacgccgatccgttcgcgctgccccctccgggagcggacttctccgacctgcccgcgcccgccgcgccccaggccctggagttcgcggacctgccggcccccgccgcaccggacctgtcgttcgacttcaacgagccgcccgcgcccggtgcggaccccttcgccgtcgacttcagcgccccaccggcccccgccctcgcggcggctcctttcgccgccgatttcggctccgcgccagcgccgggtgcggacccgttcgccatcgacttctcggagcccccggcccccgcgccagccgtcgccgtcaacccggccgtggacttcggtgacgtggacttcggcgcgccttcctcgcccggcatcccggactcgctcgagttcgaccccaccgcacggccggatgacgacctggaagcggacctctccgacccgctgccgccgccgcccaacgcgggccccgcggacggcctggagatgctgtccttcatcgacgacgccgcgggcaaggacggcggcgcccaggcgggcgccaaggtgcgccgtttccacgtccgccggcgctcgggcaaggtgttcggcccgttcgacgagggcgtcatcgtcaagatgctcgaggacgggcagctcctcgggaacgaggatgtgtcgctggactcggagacctggtccgccatcggcacggtgcccaccttcgccgccgccatccagcggctcatggaaggccccgccaagctggtgacgcccaccgcggcgcccgctgcggccgtcgtcgacgcgccccgcgtggacggcgccagcccgcaggccaacatgaagcggctggagcagctctatgaaggccgcatggccgcggtgtccgtggtggaccgcagcggcaacacggagaagtggaagaagcgcgtcccgctgatgattgccgcgggcgtcgccgtggtggtggcgggcatcggcgcgggcacggagttcggcacgcgctacggtgccttcggccgccgtgccctcttccccgcccgcctctccgacggctcggccgaggcgaagcaggtggcggacgcgaagcaggcgctgctcacggacaccttcgccagctacaagcaggcccgcgagctcagcgccaaggtgctcgctcagaaggagtacccggaggtgcgctcgctgtggtgccagtccgtctactacctccagcgccgctacgccgcgggcaatccgaacgagatgagccgctgccgtcaggacatggcggacatcgagttcctgggagagaaggacgtggacgtcatcaaggcgtccgcggcgatcgcgctcacctcccggcaggcggactcagtcatccccaccctgagcggcgcctacggccgcgaggatacccagggcgacgtggagctggccttcctgctggccgaggcctactcgcagaagcgcgacgagaagcgcgccctggacacgctgaacaaggtgctggcgaagaacccgaagtccgccaaggcccaccacgccgtgggcaacctgcaccaggccgccgaccgcgccgacgaagccgccgccgcctatgccgcggccctggaagcggacccgaagcacgtggcctccgcggtggaactggccgcggtggagctgctggtacgcaaggacgtggcgaagggcacggaggccgttgagcgggcgctggccgaggacgtccagtccgcgctgggccccgcggagctggcgcgcgcccgcggcctcaagggcgtggcgatgttccagaagcaccagccgaaggaggctgaggccgagctcaaggccgccctggaaatggacgcgaagtccaccttcctccggggccagctggcgcgggtgctgcgcgcccagcgcaacttcgagggcgctctgcccatctacaaggcgctggcgaccgaggagcccaacaacctggagttcgcggacggccacatcaccgcgctggtgatgaccgggaagatgcaggacgcgctggaggccgtgaagaaggccaacggcgtgttccccaacgaggcgcgcatcgcctacctctacggacgcatcgaggacgcgctcgacaacctctccgacacggagggccactacaagcgcgccatcgccgcggacgacaccctggtcgaggcccgcctctacctgggccgcttctacctggcccagcgccgcaacgcggaggcgcggcctcaactcgaggaggcggcgaagaaggcaccggagaacgcgggcgtgcgcgcgggcctcggcgagctggccctggcggagaacaacacgctgctggcccagcaggaattcgagcgctccgtgaagctcgaccccatcctggcggacgcccacctgggcctgtcccgcgtggccctgctgacggacgacctggagacggcgaaggcggaggccaaccgcgccctggagctggacccgcacctgttgaaggacggccggctgcagcgcgggctcgtgctgtggcgtctggggcagttggaagaagccgtggcggagctggagaaggccaaggcggaggacccgcgctccaccaccatcccgattacgctgggcgccgtgctgctggagcgaggcgatttgccgggcgcggagagcaacctgggcctcgcgctgagcaacgagccctccaaccacgaggcgctctattacctggcgctggtgaaggcgaggcggctggagttcacccaggcgctggacaacatgcgcaaggccgtggagcgggcccccaaccgccccgactaccactacgcctacggcgtcatcctgcgggacgcgaagaacctgccggacgccatgagcgcatggcgcaagacggtggagctggatggctcccacgcggacgcccacgaggcgctcggtcatgcgctgctggagggcggccagttcgacgaggccatcgcctcgttcgaggccagcctcaaggccgacccccgccgcacgcgggtgctgggctccatcggtgatgcgtacttcgccgccgcgcgctggaacgacgccatcaagcggtaccagtcggccctgaaggcggaccccaagctcacctacgtctattacaaggtggcccgcgccttcaccgagcaggcccagcacgccaaggccatcgactggtaccgcaaggccaccagcctcgattcggagaaccccatggcctactactacctgggcttcgcctataaggagcgcaacaagcgccgggaggccgtgcaggccttcaaggactacctctcccgcaagcctgacgcgaccgacaggaaggacatcgaggacgaaatctacgacctgcagaactga

SEQ ID NO: 7494 - DNA, 1713 bp, Myxococcus xanthus
gactggttcctggatccggtgagtggtcaccgctatccggtggagcccgtggagcgcctgtcgctcgccgtggcggggagcgacccgaagtacccgtgggtgatgggccggctcgacagcgtcgtggcgctgggccaggggtactgggtggagacggccgctgacgtacgcgcgcggctggcggatgccttcgtggcgcaggtgttggacttcctccaggcgaaccccgtggggcagggcgtgcactggacatgcgccatggaggtggcgctgcgcgccgcgaacctggcgcaggcgctggccatgttctccgccgcgcccgctgtggcccggccggacttcctggtgccggtgctgagcgcgctggccgagcacaccgcctgggtggaggcccacctggaggaccgcggcgcggtgcccaacaaccacctggtctccaattacgtgggcctgttggtggtgggcctgctcttcccggagctgccgggcgcgccgcagcaggtgtcgctggcggtgggtgggctgcccgaacagatggagaagcaggtgcatctcgagggtacgtccttcgagggctccattccctatcatcgcctgtcggtggagctgttcacgctggggtacctcgccgcgcgcggtgcgggtgtgccactggggcccaggtacgagtcccggctgcgtcgcatgttccacgccgtgcgcgcgtggtgttccgagcagggcctggcgccacagattggcgacaacgactccggccgcgtcttcccgctgcgtgatcgcgaggacaacgcgcacggctatctggtgggcctgggcgcggcgctcttcggcgatgcgggcctgggcggcggcgagttcgtggacgaggccgcgtggctgctgggccgcgccgggcaggcgcgtttcgccgcgctcgcgcccgcgccggagcccgtgtcggtgagctttccggagggtggttttcacatcttgcgcggcgcgggtgtcgttatcactgtcagcgccggcaagcagggacaaggcggtgtcgggggacacagccacaacgacaaactctctttcgaactccacgtcgacgggcgtcccgtcatcgtggatccgggcaccggcacctatacgcgagagcccgcgttgcggaactggttccgcggaacggccgcgcacaacacggtgcaggtggatggcgcggagcaggcgcccctggatgaggcgcggttgttcgcgctgccggaggaggctcgggcgcgggtggtggccttcctgccggggaagtcggtggacaggctgttggtgcggcatgacggctaccgccggctgcccgcgcccgtgggaatcgagcgcacgttccggctggaccggggcgagcgcgctctggccggacgtgaccgcttcgtgggcacgggccggcatgacgtggtgggcagattccatctgccagatgaacaggcgcgagtggtgtcgcctcaagtgcaggtcctgtcacgcgcgggtcgtgtgatggaagagccggtgtcgttcgagccgctcgtggtggaactggggccggaaggggccccgctcgcctgggtggtgctggagaagggactgacggcgcggttggtgccgtcgaagtattcgccagggtacgggcgggtggtgccgtcgctggcggtggagatccgggggcaggtgacgcctccggcgtggttgaggtggggggtcgttttccgctga

SEQ ID NO: 7495 - DNA, 1281 bp, Myxococcus xanthus
atgctggacctccggaacgttgcgcagaacttcgatgcggtggtcgcccggctcaagacgcggggcggcaacctggatttgggccccttccagcggctcttcgccgagcgccgcgagctgtatgtctccgtggagtcgctggccgcgcgccgcaatgccgccaacgaggagatgaagcgcaaggcgaaggaggacccgaaggcgctcgacgcgctccgcggtgacctccgcgccgtctcccaggaaatcaaggagaaggaagcgcgcctcaaggacgtggaggaggagctcaaccgcatcctcctgctcatccccaacgtgccccatgagtccgtccccgagggcggcggcgccgaggacaacgtccaggtgagcatctggggacagaagcccgacctgctcttcgcccccaagcagcacttcgagctgggtgagaagctgggcatgctcgacttcgagcgcgccgccaaggtgtctggcagccgcttcaccttctacaagggcgcactggcccggctggagcgggcgctcgtcaccttcatgatcgacgtgcacaccagcaagggctacacggagctgctcccgccctacttggtgctgcgcgagacgatgatgggcaccggtcagctccccaagttcgaggacgacgccttcaagacgttgggcgagccggagcgcttcctcatccccaccgcggaagtgcccgtcaccaactaccacgcggacgaaatcctcgagggcgagtccctgcccatccgctactgcgccttcagccccagcttccgggccgaggcgggcgccgccggcaaggacacccgcggcctcatccgtcagcaccagttccacaaggtggagctggtgaagttcgcccaccaggagaagagcctggacgaactcgaggccatgacggacgacgcctgcgacatcctccgccgcctgggcatccaccaccgcgtcatgctcctgtgcaccggagacatgggcttcgccgcccggaagacgtacgacatcgaggtctggctccccggacagaacagctaccgggagatttcgtcctgctctgactgcggcgacttccaggcccgccgggcgaagattcgctaccgggcccagaggggggacaagccccagctcgcccacacgctcaacggcagcggcctggcggtaggccggacgaccatcgccatcctggagaactaccagcgcgaggacggaagcgtggccattccggaggcgttggtgccgtacatgggcggcttgaaggaactgaaaccgatttga

SEQ ID NO: 7496 - DNA, 792 bp, Myxococcus xanthus
tacgcctccagcctgctgctgggctgcgcggcgctgtacctgcgcgagcgccgcccctggcgcgtggagattgacgggcccctcaccagcgcgggatacctggagctgaccctcacgtggctgagccgcttcggcttcgacatcctgcgctccccgtcgagctacaccgtggccgggtacgcggcgcccccggccgtccccacgcttccgggggattggtcgtccctgggctacctgctgctggtggcgtggaagacgggcggcaccgtggtgcgcgcggacacaggcagtgcccacccggacgacgccattgtccggttgattgagcaggtgggcctgcgcgcggtgcccgcgggccctcccttcacgctcaaggtggagggccagctttcagggggccttcgcgcctccggcgaggaatgcccggacctgctccccacgctggccgccctcgcctgcgtgcttcccgcgccctccacgctcacggaggtgggtatcctccgcgtcaaggagagcgaccgtctcgagggcatccggacgctcgtgaaggcgttcggcggaaccacggagctccaaggagaacagctgctgatccagccaccccgcacgccacctgcgggcttcgagatgagcagcgagggggaccatcgtctcgcgatgaccgctgcgacactgtgtgtcctgtccggcacgccgctgacactcaccggtccagagtgcgtggaaaagagctttcctgggttctggcgccagttgtccagggtgggtgttcggataactgatgcaggatga

SEQ ID NO: 7497 - DNA, 1290 bp, Myxococcus xanthus
acgctgacgatcaccgacaatcggaccgggaagacctacgaggtcccgatcgagaacggctgtattcgcaccaatgctctccgccagatcaaaacgggcgacgatgactttgggttgatgggctacgatccggcgttcctcaataccgccaactgcaagagcgccatcaccttcatcgacggagacaagggcatcctggagtaccggggctaccccatcgagcagctcgcggagaagtcgagcttcctcgaggtcgcctacctcctgctgaacggtgagcttccctccgagaaggagctgcagcagttcaaccacctcgtcacgcaccacacctacgtgcacgagaacgtgaagagcttcatggacgggttccgctacgacgcgcaccccatgtccatggtgagctccacggtggcggcgctgtccagcttctaccccgacgcgaagaacatcaaggacccgctgagccgccgcatccagatcacgcggctcatcgcgaagatgcccaccatcgccgcgttctcctaccggcacacgatgggcctgccgtacatctacccggacaacgacctgtcctacgtcgccaacttcctggcgatgatcaagcgcatcggcacgtcgacctacaaggtccacccggtgctcgagcgcgcgctcgacatcctcttcatcctgcacgcggaccacgagcagaactgctccaccacgtccgtgcgcacggtgggctcgtccgaggtggatccgtactcggcggtcagcgcgggcatcggcgccctctacggcccgctgcacggcggcgccaacgaggcggtgctccgcatgctccgcgacatcggccacgtctccaagatcccggagttcatcaagtcggtgaagagcggcgagggtgagaagaagctgatgggcttcggtcaccgcgtctacaagtcctacgatccgcgcgccaaggtcatcaagcgcgtggccgacgaggtcttcgaggtgacgggcaagaacccgctgctggagatcgccgtcgagctggagcgcatcgcgctcgaggacgagtacttcgtgaagcggaagctgtacccgaacgtcgacttctactcgggcctcatctacgaggcgatgggcttccaggtcgagatgttcccggtgctcttcgccatcccccgcacggtgggctggtgcgcgcagtgggaggagatggtgacggacaacgagcagaagattgcccgtccgcgccaggtgttcacgggcgccccgcgccgcgactacgtccccatggacaagcgcgccgtcaagtag

SEQ ID NO: 7498 - DNA, 360 bp, Myxococcus xanthus
atgagcatcgacttcacctgccagaagtgcgaggcgagcttcgagctggacgctcaggacctcatcgaagggactgaaaaaatcgtctgcccgcattgcgacgccaaggcgcccgccaacctcacggaggacttcgtcgcagcgctcacggagatgcgcgcgcagattgccgcgctcgacaagcggttcgccgtgtccatgacgttggagtccgaagacctggaggacatgctcgacgacgacgacgaggaagacgacgaggacgaatcggaggacgacgacctcgatgaggacgaggacgaggacgtcgacgacgaggaggactacgacgaggacgaggacgacgacgaccgtcgttga

SEQ ID NO: 7499 - DNA, 309 bp, Myxococcus xanthus
atgtttcccgcgttcactccacccgtagcgctggcggccctgggaaaggctcagggtcagccctgcatcaccgaaggtgaagacgaccccaaggcctgctccgagctcgtcgagctcgaggtgcaggatgtcgtcccgctggaggaggcccaagaccacgccgtggtcctggccaccaaggacaagggcatcgcgctcccgcactacggggacgacgctctacccatatgcatcgccttcctgctggtggagcgccacccaccccagccggtcgcacaggacctcctgtacgacttggtgacacgacct

SEQ ID NO: 7500 - DNA, 1821 bp, Myxococcus xanthus
atggaccttcccaagtcggtggtgcatgcgctccatgaccgggccgcgcaacaggagcagcgcccagccctgtggacgcgccgtgggggcgcctatgcgcccacctcgtggtttgaatatgcgcaacgggtgcggcgcttcgccctggggttgcacgcgctgggggtcggtgcgggccagccggtgggcatcctgagcttcaaccgcgaggagtggcacgtcgccgatctggcggccatcgccatggggggcgtccctgtcggtctctacaccaccagcgccccggagcagctggagtacatcctggggcactgcgaggccacgctcctggtggtggagaacgagaggcacctgcgcaccgccctggccctgcgcgagcggttgcccaagctgcgccacgtggtcgtcatcgacgcgcccacggtgctcccggagggcgtgctgcgttacgcggacgtcatggccctgggcaccggcgccgacgagaagccctactgggacagcgtccacgccctgaagccggaggccatgggcacgctcatctacacctccggcaccaccggccaccccaagggggtgatgctcagccaccacaacctggtgtggacggcgaagcagctcacggactcggtgacgttcggccagcccgccgcgtcctcgctcgtgtcgtatctgccgctgtcgcacatcgccgagcagatcatctccctctacagccccttgctgaacggggtgcaggtgtacttcgcggcgtcggtggacacgatgccgcagagcctgcgggaggtgcgcccctcgttctttttcggcgtgccgcgcgtgtgggagaagttcaaggcgaaggcggaggaggggctggcctcgcagccgccctcgaagcgccgggtggtggcctgggcgcgccgggtggcctcggagcggcatgagcgggtgatgcgccaccagagcgtcccgatgacgctggaggcccagtatctgctcgccaggcggctcgtgtttgccccgctgaaggagcgcatcggcatggagcgggtgtccttcttcgccacggcggcggcgcctgtcggccgggaggtgctggacttcttcgcctccatcgacatggtcatccacgaggtgtggggcatgacggaggtgacgggccccggcacggtgagcaccgagtcccacacgcggctggggtccgtgggccgggcaatgatgggggtggagctgcgcatcgcggacgacggcgagctgctggtgcgcggcggcaacgtctgcatggggtactacaagaacccggaggccaccgccgagctgctggcggacgggtggctgcactctggtgacgtgggccaactggacgcggacggctacgtccagatcaccggccgcaagaaggacatcatcgtcacctcgggcgggaagaagacgtctccctccaacatcgaggagctgctgacggccctgcccggtgtggggcatgcggtggtgctgggcgagcgccgcaacttcctggtggccttgctgaccttggacgtggagaaggcgcgggccctggccaaggcgcaggggtggccggaggacgcggctcggctcgcggaggacgcccgtctgcgccagttcctccaggagcgcgtggagcgcgacgtgaatccgaagctgtcccgcttcgagaccatcaagcgcttcgcggtgctgccgaaggacttctccgtggagggcggtgagctgacgccgaagctgagcgtgcgccgcaacgtggtggcggagaagtacgccggcctcgtggagtcgctctacgacgagtccccgcagggcggttctcagacgggctga

SEQ ID NO: 7501 - DNA, 720 bp, Myxococcus xanthus
aagtccatgcgggtggagggcgtagacgtcgccatctgtgacgcgtgcgtgccgcagggcacccagggcgtgctgggcgcgcccttctccgaacgggtggacgtggccttcgacgaagtcacgcaggaggccgtgctgtcgctgaagggcggcccgcccgagggcgcggtgacggtggacgcgctggtgctcgcgcggcgctcggagtttcccttcccggcctacgtgagcgacgtcaccgtggacgcgcgcggccagaggctgggggtggggctgtcggagcagaagccggagcgcgaccgcggcgtgtacgagcgcgagcgcaagggcgtggaggagccgcagggccccttcaacgcgggcgcgctggtggacgcgcagtccggtcaggtgctggcgaagtggccggtgcaccggggcgtggtggccaccgcggccatctccccggacgggcgctcgctggccagcggcggctgggacaagcgcgtgtacctgttcaccgaaggggacgtggacgcgcgcggcgagcaccgcttcgactggtccgtgcggcgcgtgcgcttcagcccggatgggcgctggctgggcgtggccgcgtggacgccccaggtggccagccgcgacggggacagcgacccggcggcggtgctgctggacgtgggctatgaatcgcccactgtgcaggggccgggcacggccggcgcgtccgtcgctccgtag

SEQ ID NO: 7502 - DNA, 384 bp, Myxococcus xanthus
atgcgcatcgccgccgcgctgggcatcgagggcacgcgtgagcggtcggtggccgcacaccgcatccacaccttcatgcagaaggaccagctcatcgcgtacgacctgtccatcatctacttcgagcgcggcatcgtcggcgtggaggacgcggccctggcgctctttggccgtgagctgagcgagttgaagctggaggagctcgccgagctgcaactggccctgccgccgtactccgactactacggcatcaagatttgcaagaaccccacggtgctccggcaggaccgcaaccggctgctggaggacctggcggcgtggcggttggtgagcgaggaccgcgcgcgcaacgccatggcccagccgctggcctgcgcgcgctga

SEQ ID NO: 7503 - DNA, 684 bp, Myxococcus xanthus
tggcacccggccaccgtcactgacagtgcacccgccgcagatggcctcaccgacctcgtgctggacgtccagggcacgcccctggccggaacccatgagcggcccggccaatacgtccacctccgcctgcctggtgtgggacaggggctctttgccatcgcctccccgcccggccgcccggggacgcaatgggagttcctcctcaaggtgggcagcccgctgcccgacgccctcatccaccttccccggggcgcccacgtcgacgtgtcacggccagaaggacggggcttccccctggagcgcgcccgcggccaggacgtgctcctgttcgccaccggctccggcatctccgccatccgctccgtcatcaccagcatccagttggagcgcggcgcctacggccaggtgacgctctacttcggcgcgcgaacaccgggcgccttcgcctacacggacgaactccacgagtgggaagccggcggggtgcgtgtggtgcgcaccgtcagccagcccggcgccagcggctggcagggcctcactggctatgtgcaggcccacctggctgaagaacccgtgcaggccgcggtggccttcctctgcgggcagaaggagatggtgcggggcgtgatgacgacgctccaggcccgcggcatgcccgcgggtgacatccacctcaacttctga

SEQ ID NO: 7504 - DNA, 1770 bp, Myxococcus xanthus
atggcttccgagttgatctgcgatacctgcggcctggccgtacctgccgacaccaccgtgtgcccacgcgatgggacggtggtgctgtcgtcgttcgacgtgcccccgcgcgaggagccgaacgtggtggtacaggcctcagagcctcccccgcccgcggccgtgcagagggacccgctcatcggcttgaagctgggcgagtacgagctgcgctcgcgcatcggcgtgggcggcatggggctggtgtacgagggcatccagccgctcatcggcaagcgcgtggcggtgaaggtgctgcgtccggagctggcccactccaccgagcaggtggagcggctgctggcggaggcccgcgccgtcaacgccatccgtcaccggggcatcatcgacatcttcggcttcggccaggtgccggacggccggcagtacatcgtcatggagtacctggagggccaggcgctcgacgcggtgctgacggagaagaaccggcttccggtgcaggaggcgctggcgctgctcgacgaggtgctggccgcgctggccgccgcgcatggcgcgggcgtggtgcaccgcgacctcaagccgagcaacatcttcctggtgcagcagccggacggctcgcgctacgtgaaggtgctggacttcgggctcgccaagcgaggccagggccccaccggccgcaccgcgcagacgcgcacggacatggtggtgggcacgccggagtacatggcgccggagcaggcgcgcggccaggaagtggggccgatgacggacctctacgccctgggtgtcgtcaccttcgaaatcgtcaccggccgcctgcccttcgtgggcagctcgccggtggacctgctgatgaagcacgtggaggcgcggccgcctcgcccgtcggagttcgtctccgatttgccgcccgcgctggatgccttcatcttgcagatgctcaccaaggacccggagacgcgccccaactccgcggacgcgctgcggcagcagctccacaagctgcgccgcaccctgcgggcctccacgcgctccaaccccagcgcgctcgcgcccggcttcgagaaggccgccgcggtggcggaagcggactcgcgccgtcccaccacgccggtgccggtgcccccggagctgaacaccccgctgacctcgcaggagctgcgcgccgcgggcgtccgcagtccgctgcgcaagcacctgccgctgctgggtgccgtgagcttcgcactgctgctgctcgcgggcgccgccgcggtcgtcatccgcggcgcgaaggcccccgcgctcgtgccgccgtccatcatgccgcagcaagccgcggcgccggagcagaccgctgcggtcacgccgcagcaagccgcggcgccggagcaggccgcggcggtcccctcgcctccccccgagtcagagcaggcccccgtggaggaagtgccgcttcagcccctggtcgtcgccgccgtcgcgccggctccgccggacagcgtggaacgtccgccgccggccccgcgcgccgaggacacccgagtcgcgccgccccgccccctgaaagcctccgcccccacgctggaggacatcctccagagcatcaaccggctggagcgccgggtggaccgactggagacgagcgggaagattgatgcccccaaggccaacgccgcgcgcaacctgctggcgaagtaccgcgacgacgcgcgggccgacaccagcgcccacgcccgcatcgacctgctcaagaaggtaacgggcgtggcggggatgattcgctga

SEQ ID NO: 7505 - DNA, 2547 bp, Myxococcus xanthus
atggatcctcagctcttgcgcagcatctggccggtgttctccgcggagacgcgcgagcagattcaagccatcgggtcgaaggtgttggggctggagggcccggcgcaggggcgtgagccggacctgctcccgtcgctcaagcggctggtccacagcctcaagggctccgcggccagcctgggcctggacgacatcgagcaggtggtgcacgccatcgaggacgggctggccaccttcaatcaggaggagcggctgccccgcgacacggtggaggccatgctgcgcggcctctccgccatcgaaggcgccatggcccgtggcgacgccggacagtcgcccgtggtggaaggactgtcctcgctgctggcggccctgggccacgagtccgcggaggccgtcccccagacggcggcctcgggcgcggccgcgcaggcgttggaggtgctggacctcctcgaagcggggttgagcgcgctgtgctcgccggatgtgccggaccgggcggccgtggtgcgcacggcggtggagcgggcccgcacgttgaaggcgtccgccgagtccgccggggcgcagaaggtggccacgctggcggaagccgcggcgctgggcttcacgcgcatggagccgggcggtgactccgcggggctggccgcatcggacgtggctggcacgctggtggacctgcggacggcgttggaggccgagggtggcgcaggggcggtggcccgcgccgtccattcgctgcgcgcgtcgccgtctcccgcgcccgtggaaggcgcggcggcacaggggcccgcgggagctgcggccacgacggagtcccgcggaccggcggaccagacggtgcgcgtgtcggtgaagacgctggagtccatcgcgctccaggtggagctgctcctggccggacgcgcgcagcagacgcggcgtggcgcggcgcaccgcgtgttgatggacggcatgcgcgaggtgctcatgcacctggagcgcgcgtcgtcgcagctcgcgatggcgggcggcggtcctgcgctggagccactccgcgcgggcgtgacgcagatgcgcggactgcagaagcagctcctggagctgacgaaggagtcgcaccgcgacggtgagcagctcacgctggtggcccaggtggcgcgcgatgatttgcgcgacctgcgcatggtgccggcctcgcaggtgctggagcccctgcggcgcaccgtgcgcgagacgtccgcgcggctgaacaagcaggtgacgctggagctgtcgggcggcgaggtccggttggaccggcgcatcctcgacgcgctgaaggacccgctgctgcacctggtgcgcaacgccatcgaccacggcctggagtccaccgaggagcggcgggtcgcgggcaagtccgaagcggggcggctgacggtgcgggtggagcctcggggctcgcgcatcgcggtggtggtggaggatgacggctccggcttgtcacccagccgggtgcgcgccacggcggtgcggcgggggctgctgccggccgatgaggcggagaagctgtcggacgcgcaggcggcgcggctcatcttccagccaggcttctccacacgggagcaggtgtccgcgacgtccgggcggggcgtgggtctggatgtggtgcaggcgacggcgcaacggctccagggctcggtggacgtggccttcacggcgggccggggcacgcgcttcaccgtggacctgccgctgacgctggccgcggcgttggggttgctcgtgcgcacgggcaccacggtgtccgccattccctccgacagcgtgaatcgcatcctccggttgaacccggacgacgtgggcaccgtcgcgggccgcgtggtggcgcggctggatggggagcagctcacgttcctgccgctggcggaggccattggcctgccccggctgccgctggcgctggactccgggaacgtgcaggccgccgcgctgctgacggtgggcgaggacaaagtactgttcgccatcgacgaggtggtggggcagcaggagattgtcgtccgctcgctggggcgccacctcaagggcgtgcggcacctggcgggcgcggcggtgctggacgacggccgcgtggtgccggtgctcaacgccgcggagttggtgcgcgcggcgcggccggagacgcgctcggtggctcgcgagacggcgcggcctcgcatcctcgtgtgtgacgacgcgctcaccacgcgcttcgccatgaagtcgctgctggagattgccggctacccggtggtgaccgcggcggacggtgaagaggcgtggggcatcctggagcgcacgccctgccaactggtggtcagcgactggcagatgccccggctggacggcgtggggctggcgcggcgaatcaagtcgcacccgcagctgcaccgcacgcccatcatcctggtgacgtcgctcgacagtcccgaggaccgcgccgctggtctggaggcgggcgcggacgggtacctcgtcaagcgcgaggtggagcgaggccgcctgctggagctggtgcgccaactgctgcccgtgtcctga

SEQ ID NO: 7506 - DNA, 1449 bp, Myxococcus xanthus
ggcgcggggctcttcatcgaccccatggacggggatgacgacgcgggcgtgggcacccggcaggcgccgctgcgcaccgtgggccgcgcgctggcgatgctgcgcgaactggatggcggcccgcgccacctgttcctcgcgggcggcgcctacgacgaggcggacctggtgctggacgtccccgtctcgctgcacggcggatatgccggacgcagtggcggttggcgtcgcgccgcgaaccgcgtggccatgttcgacgccggcacgctggggttgacggtgcagggactccaggacgccggtgtgctgatggagtacgtgcagatcagcgccgccaccgcggccggccccggtgagccctccatcgccgtgcgcatggtggactcctccggggtccgtctgcgtcacgtcaccctggccgcgggcgcgggtggccagggcgcccccggcgaggcgggggacgcgggcctgggcggcccggacggaggtgaaggaggggacggcctcagcggctactccgatccgggacagggcgggacggccccccccatcacctgcccggatggcatccagcccacgggcggcgcgggggtgattggcagcagcggcggcaatccaggacgggatggcggcacgggtgggcccggcgaaatgggcggcgcaggcggcgcgggcggcgaggcaccggacgccgcgtgctccaggttcgagtgcgtctgcaacccctaccccggcgagcgaggccagggcggcgcggaaggaggcctcgggactccgggcggcggcggcgcgggcacgggggtgctgcgcgacgggacctgggtcgccggacagcaaggcgagcccggcggcggcggcacggcgggctccggcggtggcggcggcgggtctggcggaatctgcaaactcgaaaacacgattgtcgctggcggcggcggaagtggcgcgggcggcgccggcggctgtggcggtgaagtcgcccccggcggcggcggtggcggcgcgtccatctccctgctgctcatcggttcccaggcggccatggaggaaggcagcgtgctgcgcacgctcggcggaggcccgggtggcgagggtggcgaaggcggtaccggaggccccggaggcgaaggcggacacggcggcaacggcggccaggtcgtgcgggacggaggcgtcgtcgacggaggcatcatcatccaccggacgaccggcggtcccggcggcgagggtggtcccggcggcgcgggcggcgcgggcggcggaggcggtggtggtggcggtgggccctcggtgggcgtgtggtgtggcccgggcgcgacggtccgctacacggatggcggcgtcaccttccaggtcggtccgggcggtccgggcggcgccggccccgggctcgacgggagcacgggcgagcaactgccggacttcaactgcgtcagcgccaacccgtag

SEQ ID NO: 7507 - DNA, 540 bp, Myxococcus xanthus
gtgtccatcgaaacctatggcaggtatcagctcctgagtcgtctcgccacgggcgggatggcgcagatctatcttgcgcggcctcagggcgcggagcctgacaagcgggtggtggtcaagcggatccttccgcacctcgcggagaacgacgacttcgtcaagatgttcctggacgaggcgcgcatcgccgcccggctgaaccaccccaacgtggtgcagattttcgacctgggcgcccaggacgactccttcttcatcgccatggagtacatccacggcgacgacctgcgccggctgtggaggcagtcggagctgatgggccagccgctgccggtgccgctggtgtgccgcatcctcatcgaggcctgcgccggcctggactacgcgcacaagcgcacggacccgacgacgggccggccgctgggcatcgtccaccgtgacgtgtccccccagaatatcctggtgacgttcgagagcggggtgaaggtggtggacttcggcatcgccaaggcggcggaccaggccacggtgaccaactcc

SEQ ID NO: 7508 - DNA, 201 bp, Myxococcus xanthus
atggaggccggggcggacctgctgctgcggcgaatcagcccggcgcgggcgggggagattgagcggaaggtggaccgggtcctggacctgttcgaccgggtggacgtggcgccggtgctgatgccggtgctgaagcggcacctggacgagctggaggccctgatgcgagagactcgcgaggtgcgggccgcccggaggtag

SEQ ID NO: 7509 - DNA, 1638 bp, Myxococcus xanthus
atggtacagatggacttccgcggcacgccggaggcgcacgcgccctgcgagctcacgctcacgccgcaggccctggacttcggcaccattccgcccggccagggcgcggtgctgggactcaagctggagaaccgcggcaccgacttgtgcccggtgaagaacctccgcctgcgagatgacggcggcggtgtcttcacgctgccgggcggcggcctccacggcgtcatcatgtaccccggcgactggttcagcttccaggtggccttcagggcgcctgtggcgggcggccacttcaccggcaccgtgcagattgaacagatgcagccggccaacccggtgctgctggtgccgctggtggccaacacgcaggcggtgtgcctggtggcctcgcgccgctacatggattggggcgtcgcccggccggactgccccgccgagcccatggaggtgaacttcctcaatgcctgcgccgcgccggtgacggtgaacgacgtgtggattgggccgggaaccacggattcggagttcgggttttcggcggtgccggcctccattcccttcgtgctgccgcccaacgaggccttcacggtgggcgtggagtacttcggcctggtgtcgggcatgaacctgtcgccgctgtacgtgggctccagcgacttgccggcgccgctgatggttccgctggtgggcgagtcgtcgatgcgcgtggagaagacggacaacttcatccagcaggatgtcagcaaggtggacgtgctgctggtggtggacaacaccgcctccatggcggtggagcatccacgactggtggaggccattccgaccttcgtgcagaccgcgctggaccggggcgtgagcgtcaacgtggcggtgacgacgacgggcatccatccggtgacgccgacggacccggccaacgcgtgcccgggcggcgcggaggggggcgaggcgggccgcttcttcccggtggacaactcgctgccgcgcatcctcacgagcgcgacgccgaacctggcccagcagctccagcagaacgtgcaggtgggccggtgcgcggaggtggagcagggcttcgaggcgatgcgccgcgcgttgtcccggccgctggtgaacagcgcggatgacccgcgtacgccgctgcccaacgacggcaacgtgggcttcctgcgcgaggaggccgcgctggtggtgctgttcgtcagcgacgaggacgaccactcgcccgacgcggtggacacctacgtggactgggcccagctgctcaaggggcagaaccagccgcagcgcgcgaccttctacgccatcgctccgccggctgaaggctgcgcgacggcgggcggcgccggtacccgctacgcgcaggccacctcccgcacaggaggcgaggtggtgagagtaagcgcggaagactaccggccgctgctgcaggcggtgggtgacaaggccttctccgcgcaggagcgcttcccgctgagcgacctgccggagcccggcaccgtgacggtgacggtgaatggcacgccgtccacgtccggctggacctacgacgcggccaccaacagcgtggtgttcgacgtcgtgccaccggcgggcacccgcatctccatcaactaccgccgttcgtgcgacgcgatgtaa

SEQ ID NO: 7510 - DNA, 609 bp, Myxococcus xanthus
cgtcacttttcgatgattcgcacgttcgtgctcgctgacttcgtgacgctgggcaacggcttcgcgggcgcgggcgccatcctctccgccatgcagtacctggcttccggggacgtgggctggctgtgggtggccttcggcctgatgccggtggcgttggtgatggacgtcatggacgggcgcatcgcgcgctggcgcttcaagaagtcgccgctgggcgcggacctggactcactggcggacgtcatctccttcggcatggcgccggcggcgctggccttcgcggtggggatgcgcggctccctggacgtggcggcgctcctctacttcgtggcgtgcggcatcagccggctggcgcgcttcaacgtcacgtcggcggacctgtcggacgagacagggaaggtgaagtacttcgagggcacccccattcccaccagcctggcgctggtgatggtgatggccgcggcgacgtgggcggggcgcatcggtccggacctgtggggtggtgagtggcgcctgggaccgttggtccttcacccgttggcgctgatgtatgtggccagcggaagtgcgatgatcagcaagacattgcgcattccgaagatttga

SEQ ID NO: 7511 - DNA, 573 bp, Myxococcus xanthus
cccccccccccgtttgatcttcgatgttcaatcgcagagctgccgcgctcggacgccgacacgctgcacacgctggtgtccgagggctacctgggcacggacctgggagacatggccgcgcggctgagcgcggcctcccaggccaccaccaacgaactgcaccagcgggccctggccggtgaagcgctccccacggcgcgcctgcgggagtccggcgcgctcttcgacctggctcgagacacgggggagccgtccgccaaggccgctgcccaggcgcctttcctggaagggctcgcggcgctccagagtggagactccaccggggcgcagcgcctgttcgcgaaggccgcatcagcggcgcccgagcgcaccgagtaccgcgtgtggcgcgccgccgcgctccagcgcgccggagatttggacggcgcgctgacggtgctggagacggacctgccgcaagatgcgcgcacggacgtgctccgcgcggcctccgcccagcgaaagtcccccgaggcgggggctcgcgagttggagcgcatactcttccagcgctacgccccggccacgcgctga

SEQ ID NO: 7512 - DNA, 421 bp, Myxococcus xanthus
atgtcgctcttcatctgccagcgatgcgaggcccagcatgagaagtgggacggcgcctgtccggcctgtggtggcaccgagctgctgacggtggcgccggccgtggaccggatgctcggccgtgtcgtggcgagccgcttccgcatcctccggcggctgggccagggcggcatgggttcggtgtacctggccgaacaggtgggcatcggccagcaggtggcgatgaagttcctcaacagcggcctgtccatggacccggacgtggcccgccgcttcctcaacgaagccaagagctacgcgcgagtggcccaccccaacgcagtgacgctgcacgacttcgggcaggacgaggaaggcagcctctacatctccatggagtacgtggagggggatgacctcaagagcctgctcgcggcgtgtg

SEQ ID NO: 7513 - DNA, 894 bp, Myxococcus xanthus
atggtctcggacatcttcaatccggcgcgctggaaggccgtcgagggcttcaagttcaaggacatcaccttccaccgcgcggtggaccagggcacggtccgcatcgcgttcaaccgcccggaggtccgcaacgccttccggccccgcaccgtggatgagctgtcccgcgcgctggaggccacgcgcttcatgacggacgtggggtgcgtgctcatcacgggcaacgggccgtcgcccaaggatggcggctgggccttctgctccggtggtgaccagcgcatccgcggcaaggacggctacaagtacaagggcgaggagggtgagtccgaccccgcgcgcctgggccggctccacatcctggaggttcagcggcagattcgtttcctgcccaaggccgtcatcgccgtggtgcccggctgggccgtgggcggtgggcacagccttcacgtcgtctgtgacatgaccatcgcaagcaaggagcacgcggtgttcaagcagacggacgcggacgtggcgtcgttcgacgcgggctacggttctgcgctgctggcgcggcagattggtcagaagcgggcgcgggagatcttcttcgtgggcgccaactactcggcggaggaggccttccagatgggcatggtcaacgccgtggtgccccatgcgcagttggaggagttcgcgctggagtgggcggcggagatcaacacgaagagccctacggccatcaagatgttgaagtacgcgttcaacctgcccgacgacggactggtgggccagcagctcttcgcgggcgaggccacccgcctggcctacggcaccgacgaggcgcaggaaggccgcgacgccttcgtccagaagcgcaagcgcgacttcaagcgcttcccctggtcgtactga

SEQ ID NO: 7514 - DNA, 498 bp, Myxococcus xanthus
atggagcgcatccgcgcggacggctaccgggtggatgcctaccagttccccatcatcgtggacgagcgggagtcgcgctccacgctggtacagcggctggcgggagtgctcgacctgccggcggaccgtgaggtcctcatgctctacaccagcttcctgcggccccatggcccctccgtgctctggagctacgggcccggaagtcagtccctggcggtgggcatcacgggcgggggcgtggagctacccggcgccttcgccgcgaagcccctggattggacggagttctcgcgcgacctgcgtctggcggtgcgctggacgcatgacctccacgtcttcagcctggagggctgcgtccaacagggcttcctgaaccggctccgcaccttcgactgggatgcgcccgtcaccccgccagcgaccgcggcgcgccgcgtggacaccgtgcggcgcgcggcccggctgctgctccgcacgagcgcctgggtccttcgctga

SEQ ID NO: 7515 - DNA, 858 bp, Myxococcus xanthus
aagcaggtgctgggcgcggccaataccttcaaggaaggcgacgcgctcgtgggcgtcgccgccgcggatgagaactcgcgtgcgaatgcgcgcaggctcttggggcacacgcggctggaggacgtgcggcgacaccctttgcaccaggatgcgttgcacgcactgagcctggaggccgaggactcgcaggcggcgacgcttacggcggactggacgttgggacggttgaggaagttcctgctggagtccgacgaggcggccattcatgccatcggccccgggctgggcagcgataccattggctgcgtcgtcaaactgatgagtgacgcggagctcatcgcgctgggaagcaaggtgttcaacccactaccaggcagcaaggtgggcgcgcggggctacatgggggcgcgcatccagcccaactcgcccactgacaacgtggacgacatccgctggcaggtgttcgacggtttctcatacgcggtgggtgacgtggtgctgggatgcaacccggtgtcctccacgccggagtccgtggccgccatcgagtccgccctgctcgaggtgctggtgaccttcggactgacggacgtgcttccccactgcgtgctgtcccatatcgacgtgcaggcggaggtggagcggcggcagcccggcaccacgggcgtctggttccagagcatcgctggcagcgacagcgccaacgcgaccttcgacatctccgtggagaagatgctcggctacgcggacgggcgcacggggccttacgggctctacttcgagacgggccaaggcgcggacttcaccaacggccatggccacggctacgacatggtcctccacgagtcgcgcaagtac

SEQ ID NO: 7516 - DNA, 585 bp, Myxococcus xanthus
atgtcgaaagacgacgccaagattgattacaccgggctgcgacgccagctcaccgaggcgcactcgctgctggacggcaagcagggtgtgagccccgagaagcgtcgcgaggtgctcagcgcccgtgcccgggccctggctgaatcccgccacgaggagcgccaggaggtgctctccgtgctggccttccaggtgggcggcgaacgctatgcggtgcgaatcgagcacgtggaccacgtgatcgaagcgcgcggcatcgcctcgctgcccggtgctccccggcacgtgctgggtgcgctggtgagccgctcgcgcgtggtgccggtgttggacctgcgccagctcctggggctggaggggggcggcatgtcggacctcagcaaggtggtggtggtcgaggcggatgacagtgaagaggggttcgggctggcggcggagtccgtcgaaggacgcaaggaactgccgaaggcggagctgtctcagcctccgcccgggcccttcttgttcctcacgccggaccggctgacggtgttggacctggagcagctcgggggcccgtccgccacgcggcccgaaggggagtag

SEQ ID NO: 7517 - DNA, 675 bp, Myxococcus xanthus
atggcgtccccagatggcaccgacaccctgctcctcatcgagagcgtcaagccccggctccgaggtgtctcccacgccgtggccttcgtggcggcgctgctcgggtgcatccaactggcgctgatgccagtgcgcggcccccagtacctggccgacctcgtgttcggtggcagcatggtgctgatgttcggcgtgagcgccacctaccaccgcttcacctggggcatggacgcgtaccggcgcatccagcgcttcgaccacgcggccatctacatcctcatcgcgggctcattcacgcccatggccacgctggacaccacgggtgacaccagcctgtacctactctggttgatgtggatcgccgcgctgacgggcgcgggcctcacgctcctgggcgtgcacacctcgcgagggctgcgctccgccctctacgtcgcgctgggcgccgtggccacgccggtgatgctgcggctacccgaggtgattggctccgggcgcgtcgcgtggctcgtgctgggcggagtgctctacgccgtgggcgcggtcatctatgcgcgccgctggcccgacccgattcccaccgtcttcggctaccacgaaatcttccacctgctcgtcgtggccgcggcgggcgtgcattacgccgtcatcctggacatcgtgggcggcgcctga

SEQ ID NO: 7518 - DNA, 246 bp, Myxococcus xanthus
atggagttccacaagggccggctgttcgatcacgtccatctgcgcgtccaggacctcgatgccagcaagcgattctaccgcgcggtgctggacgtgttgggcgtgcccttcttcagcgagagtccacaccaccccggctactacggcgcgttcgtcctggacccggatgggaacaacatcgaggccgtgttccatggcccggtgacgcgctcggcggagtccgtggtgatgaaaccaacgttctga

SEQ ID NO: 7519 - DNA, 874 bp, Myxococcus xanthus
atgtcgcgcgtactggtcattgatgacagcccgatgctggtggagctcaccgtccggggcgctcaccgccgccggctaccaggcgagcggcgcgcaggaccttgccagcctcgagctgaagctcgccgaggggccgttttcgctcatcctcatggacgtcaacatgccggagatgttcggcgacgacgtcgtggagtacctccgccggcagaagaaggtcaccgcgaagctggtcctctattccgacatctccgaggcggagctggacggaaagacgaaggcgtcgggggcggacgggtacatcctgaagagcggtgggctcgaagccgtgctcggcggggtcatgggtctcattggcccccccgccctgagcatccccaccgccgtgcccgccccggctgcggcccccgcggcggcgcccaccccgccgccggctcccgcggcccctgcccccgcggcgacgggcggcctcaaacccgcgcccaccacgggcgggcgcaagccgcgcatcctcatcgtggatgacagcgagatgacggcccgcatcatcgaagcggaccttgtgaccaagggcttcgaggtccatgtcgcggacaccgccgacaaggccacgaagatcatcctcaagaagcagacgcgcccggacctggtgctgctggatgtgcgcatgcccaacgtgaacggcgagcagttctgccgcttcatcaagagcaacagcctcttcaagggcatcaaggtgctgctgtgctcgggtgagaacgtcgaggagttgcagcgcatctgccgcgaggcgggcgccgacggctacatccccaaggacgcggtgatgggcaacctggtggccaaggagctgatgcccaccggtaacgagtag

SEQ ID NO: 7520 - DNA, 1125 bp, Myxococcus xanthus
gtgatcgtcggagttcccaaggagatcaaaacccgcgagtaccgcgtcggcatggtgcctgctggcgccgccgccctcatcgccgcgggtcacacggtcctgatcgagacgaacgccggcgttggctccggcatccccgattcggagtaccagcgcgtcggcgcacagatcatctccaccgcggacgaggtctggaagcgctcggagatgatcatcaaggtcaaggagccgatcgcgcccgaatacgcgcgcatccagcccggccagatcatctatacgtacttccacctggccggtgtggacccggagctgaccaagacgctgctccagaagaaggccgcggccgtggcctatgaaacgctgcagccggacgacggcagcctgccgctgctcaagcccatgagcgaggtggccggaaagatggccatccaggtgggcgccaagtgcctggagcgggcccacggcggcaagggcatcctcctgggcggcgtgcccggcgtgcgccggggccgcgtcaccgtcatcggcggcggcgtggtgggcctgtgtgccgccaaggtggcggtgggcatgggcgccgaggtcaccatcatcgacgtcaacatggagcgcctcacctacctggatgacgtgttcctcggccgcgtcggcgtgctggcctccgactcggagagcatctcccgctccgtgcgcgaggccgacctcgtcgtgggcgcggtgctcatccccggtcgcaaggccccgaagctcgtctccgaggccctcatctcggagatgagcccgggctccgtggtggtcgacgtggcggtggaccagggtggctgcatcgagacgtgcaagcccaccacccacgacaaccccacgttcgaggtccacggcgtcgtccactactgcgtcgccaacatgcccggcgccgtgccgcagacgtccacctacgccctcaccaacgtcacccgcccctattcgctccggatcgccaacgtgggcctggcggcggccgtgaaggaggaccgcgccctcgcgcgtgcgatgaacacctacaacggccacgtcacctacgaggccgtcgcgaaagacatgggctacgcctacatgcccatcgcggacgcgctcgccggcaagtaa

SEQ ID NO: 7521 - DNA, 642 bp, Myxococcus xanthus
atgttggatttcaggcaacccaaccggacgaagcaggaattcgaagagctggcgctagcccatctggacccgctctattcggcggcgctgcgcctgacgaagaacgagcgcgacgccgaggacctggtgcaggacacctgcatgcgggcgtaccgcttcttcgacaagttcgagcgcgggacgaacatcaaggcctggctcttcaagattctcaccaacaccttcatcaaccgctaccggcggaaggtgaaggagcgcacggtggtcgaaggcgtggagcgcgaggccgtccacgagcgcttcgtgagccgggacgcgacggacttcgcggccaaccccgagcagtacttcttcgaccggctcctgtcggacgacgtgctgcgggccattgacgcgctgcccatcgacttccggctggtggtcatcctcgcggacctccaggagttctcctacaaggagatcgcggagattctcgagtgccccgtgggcacggtcatgagccgcctgttccgcggacgcaagctcctgcagaagaacctgcgtgagtacgccgagggccagggcgtcttccggcacgacggggagccggtgaacgcccccgcggacctggaagagtatcgccacaggaagaagacagggtag

SEQ ID NO: 7522 - DNA, 564 bp, Myxococcus xanthus
atgaactgccaggacctcgaacggctgctctatccgtacctcgacggcgaattccagcccgaggaacgagtggacctcgaaacccacctctccgggtgcgctgattgccggcgccgcgcggaggaagagaagcagatgcagcaggcgctgcggcgagccgcgcgccactccgtttcaggcatgcgggcccccgcctcgctccgggccggcatccaagtgggcctcaagcaggagcagcgccgcgtccagttcggcgtctggctgcgcgcgggggccatggcgttggtggtggtgacggtgggcggcggctgggccgcgttccacgccgagcagcggctgagcgcggccaggacggaagcggtgcagcgccacagcaagagcaaggcgctccccttcgagattgcctccaacacgccggagcaggtggaggagtggttcaaggacaagggggatccgcgcatcaccgtcccgcagatccccaatgcgaagccgctgggcgggcgcatctccatcctcaacggccgggaagtcgcgtacatcagctacgaaacccttccggacaac

SEQ ID NO: 7523 - DNA, 1353 bp, Myxococcus xanthus
atgcgatgcgtgatgaagcgtgcgccgctcgtgttagttaccagcgacatgacgtttgctccgaagctcctattcgcggaccccaagggacgggtgatggaacatccgtacctgctcgccacgctgcgcagcggcgaagagctcgttcctccgcaggacaagcccattccgctgccgtccaccgggcggctcgtccacctgccagggcgcctcccggtgggcctgcatccggagacgggggagctggagctcgtccgcgagatgaaggtgggggggaagacgtttgtccccaacgcagtgggcgcgttgctgccccccggctacacgcgcaccttcctccccggcgaggtgaagggcagtggccccgtgctgccgcagtgggcgtataccgccgcggcctgggtgggagaggggccggtggcgtgggccatccataccgaccgtcgctcccattgggacccggagcggttctccacgccggacatgaaggacctggtggcgaagcacatggcgcgcttcccggacaaccgggtgctgaagcaactcaagacgtgcgcgatgctctacaggtgcttcacgtcgcagaacaccttctacgtgcgtgacgagggggccatccccgcgtccgtcatgtgcaacgcgcgctgcgtgggctgcatctccgaccagccggcggacggccccccggcatcgcacgagcgcatggatgacgggcccacgggagaggagatgggccagattggcctcttccacctggagcacgcgccgggccgcaccatggtgagcttcggccagggctgtgagggcgagccgctcacgcgctggaagcagattgccgaggccatccgctacatgcgggcgcgcacgcaggcgggctccatcaacatcaacaccaacgccagcctcacgcgcggcctggaggccctcttcgacgcggggctggacgccatccgcgtgtcgctcaactcggcggtgaaggacctctacgaggcctactacaagccggtgaagtacggctgggaggacgtggaggcctccatcgccctggcgcgtgagcgcggcgcgtacctggcgctgaacctgctgctgttccccggcgtcaccgaccgcgagggcgaggtgcgggcactggagcggctggtgaagaagtaccgcgtggaccaggttcagacgcgctcactgtgcatcgacccgctgcagtacctggaagtggcgcgcgagcgcggcgcgggaggcgagccggtgggcatccgcacgctgcttcagcggctgaaggcggcgcgcccggggctcatcgtgggcaacttcgcgcgcgggctggacgagcgcgagaacgcggccgggcaccggtag

SEQ ID NO: 7524 - DNA, 819 bp, Myxococcus xanthus
cggcgccaggacatcgtgttggacggaacggccttcctgttcctcctcgcaatcaccagcgtcagcggcctggccttcgggctgcttccggccctccaggtctcccggctggacgtccgtggtgggctcgccgccgcgggcgatggcagcacggtgccgggtttcggccgtcgcctgggggcctcgctggtggttgtggagatcgccctatcgctggtgctgctcgtcggcgcgggcctgctcggacgcggctttctgcacctgctggggacttccaccggacttgcccctggccaggtcctcacgctgcacctgtccatcccagacgaccggttcttcaaggatggcgccctggacgcggagctgccgggacggctcttggagccggtgctggaggcggttcgcgcgctcccgggcgtcaccgcggcgggcatgacgtccgtgctccccatccaacgggcctggaacaacgctcggtatcagctcgaaggagcgcctctgccagagcccggcgacgaacctcgcgccgagcgccgcgcctccagtccgggctacttcgccgccatgggcatcccccttcgccaggggcgcgatttcacgtccctggacgccgcgccggaccagcccggcgtcgtcatcgtcaatgaaaccctggcccgccggcactttccggcaggaggtgccctgggccaccagctgcgcatcgggggcgacgccgtacaccatcgtcggcgtcgtgggcgatgtccgccaggcgggactggagcgcgaaccgctcgccgagttccacgtcccccatggcaggccctggggcgatga

SEQ ID NO: 7525 - DNA, 714 bp, Myxococcus xanthus
atgaaaccctggcccgccggcactttccggcaggaggtgccctgggccaccagctgcgcatcgggggcgacgccgtacaccatcgtcggcgtcgtgggcgatgtccgccaggcgggactggagcgcgaaccgctcgccgagttccacgtcccccatggcaggccctggggcgatgacgggctcgtcctggtcacgcgcacctcggtgcagccggagacgctgctgccggccatccaggaggccatccgccgcgtggatggcaccgtgcccgtctaccgggcgctcaccctggaacaggtcatctcgcaatccctggcgatgcgcagactcgtcctggggctgctcggcggttttgcggtcctcgccgtcctgctcgccgcctacggcctctacggggtcatctcgctccgggtcgtccagcgcacgcgggagctgggcgtccggatggcgctcggtgcccggcccgcggacgtgctccggctcgtcctgggccagggcgcgggcatgacagccgtgggcctcggggtgggacttggggccgcgtgggccctgtcccaggtactcgcaagccagcttcacggcgtcagcgcgcgggatccgtggacgttcggggccgtggcggcgctgctggcggccgtggcgttgctcgcctgttggattccggcccggcgggcgatacggatggacccgcttcaggcgctccggaaggaatga

SEQ ID NO: 7526 - DNA, 2094 bp, Myxococcus xanthus
atgaagcgtttgttcgtgattgccaccctcctcggcgcggctcccgcgatggccgacgagggcatgtggacctacaacaactttccctccgcgaaggtgaaggagaagtacggcttcgagccttcccagcagtggctggacaacgtgcgcctgtcctcggcgcgtctggcgggtggatgctcggccagcttcgtgtccgccaacggcctggtgatgacgaatcaccactgcgcgcgcggctgcatcgaccagctctccacggcgaagaaggactacatcgccaacggtttctacgcgaaggcgcagggcgaggagacccagtgtccggcgatggagatcaaccagctggtcaagatcaccgacgtcacggagacgctgaacaaggccacccagggcctgaccggtaagaagtacgctgacacgctgaaggcgaagatgtccgagctggagcaggcctgctccgccggcaacgccaaggcgcgctgtgacgtggtcaccctgtaccagggcggccagtacaacctctacgagtacaagcgcttccaggacgtccgcctggtgatggcgcccgagcacgccatcgcgttcttcggcggcgacccggacaacttcgagttcccccgctacgacctcgacgtgacgttcctgcgcgtctacgaggacggcaagccggcgacgacgaacaatttcttcaagtggtccgacaagggcgctcaggaaggcgagctgaccttcatctccggccacccgggccgcacctcgcgtggcctcaccatcgcggagctggagttccagcgtgacgtggtgctgcccaagacgctgatgacgctctccgagatgcgcggcatgctgacggagttcggccgccgtggcgccgagcagcgccgcatctccaccaacctgctgttcggcgtggagaactcggtgaaggcgctcaagggccgtcacgaggccctgctggacaagacgttcttcgcgcagaaggtcgccgcggagcaggatctgcgcaagaaggtcgaagccaacccggagatgaagaagaagtacgccgcggcgtgggatgagatcgccaaggcccaggcgcagctgcgcaacatccgtcaggacctgacgttcatggagaacggcggcggcctgtcctccacgctcttccaggtggcccgcacgctggtgcgcggcgccgaggagttcccgaaggcgaacggcgagcgtctgcgtgagttcaaccaggccaacgtcccggcgctggaggcccagctgttcagcccggcgcctgtctacccggagctggagattgcccgcctgacgttcagcctcaccaagatgcgcgaggagctgggctccgaccaccccttcgtgaagaaggtgctgggcaaggagtccccggagaagctggccgcccggttggtgaagggcaccaagctgcgcgacgtgaaggcccgccaggcgctctacaagggcggcaaggcggccatcgcggcctccaaggacccgatgatccagctggccgtcgcgctggacccggacatgcgcgccgtccgcaagtcgtacgaggagaacgtggagtccgtcatccgcaagaacagcgagctggtggccaagtccaagttcgaaatctacggcaccaaccagtacccggacgcgacgttcagcctgcgcctgtcctacggcgcggtgaagggctactcggagaacggcaagcaggtcagccccatcacccagatggcgggcaccttcgagcacgccacgggtgaggagcccttcgcgctgccgaagtcctggctgaagaacgagaaggcgctggacggcaccacgccgatgaacttcgtctccaccaacgacatcatcggtggcaactccggctcgccggtcatcaacaaggacgcggagatcgtcggcatcgtgttcgacggcaacatccagtccctgggcggcgagtacggcttcgacgagagcgtcaaccgctcggtcagcgtccacagccaggccatcatcgagtcgctgacgaagatctacggcgccacgcggctgctcgaggagctgcgtcccggcagcaccaaggtcccgcccgtgaaggccagcccggcgaagtaa

SEQ ID NO: 7527 - DNA, 384 bp, Myxococcus xanthus
atgaacgcaaaggtgctcatcgtcgaagacacgaagaccatcaccaaccttcttcaggtgtacctgatggggtgggggttggagttcttcgacgctccgaatggagcgattggattgaccaaggcgcgggagctcaagccggacctcatcatctccgatgtgcagatgccggagatggatggcttcgcgctgtgcgcggcgatccgtgcggaccggcaacttcacgacacccctttcatgatgctcacgtcgctgaaggacgacgcgagccggcagaagggcaagctggtgggtgccagcgccttcctcaacaagccggtgtccgtggacgaccttcgttcgaaggtgcgcgatatcctgaagctccctgcgacccggtactga

SEQ ID NO: 7528 - DNA, 504 bp, Myxococcus xanthus
atgccgggtgcggccgagctggagaagctcacctgtgaggactccaccgaggcgctcatcaaggcacgcaatgtgaaccggccggagacggaccggctggtggactacatcgagctgtactcctccctccgcaagcggaccgccacgttcgaggatgcgatgaaccgcaacccggacctgagctaccgcgagggcacccagcacctggtcaacgccaaggacaactgcatccagcagacggccgacgtccgggtggagttcgagacctacatgcgggagctggtgggcgtgcccaccgtccaggaaatcaagggcggcaacaccgtcaccatcgcccggctcgacttcaacaccctgcgccaggccatcgagacgctggagccggacgacaaggacacgctgctcaaccaggtgaacgccgcggagaagcgcgtggccccgtcgacccccgcgggcgatgagtccgcccccgcgtcgggtggtggccgcaagcgcggccggtaa

SEQ ID NO: 7529 - DNA, 1533 bp, Myxococcus xanthus
atcctgatcctcgatttcgggagccagtacacccagctcatcgcccggcgcgtccgcgagctgggcgtctattgcgaaatccaccgcccggacctcccggcggaggacatccgcaagtacgctccccgcggcatcatcctctctggcggaccggcgtccgtggaggccccggactccccccggtgcgacccgttcgtcttcgaagccggcgtccccgtgctgggcatctgctacggcctccagctcaccgccaagctgctgggcggcaagattgaccggagcgcccaccgcgagttcggcaacgcggaggtggaggtgctggcccgccgcggccccttcgccgaattcacccccggggacagggtccaggtctggatgagccacggcgaccgggtggaggcgctgccccccggcttcgaggccattggccgcagcggcaattcgcccttcgccgccaccgcccacgcgacgaagccctggttcggcgtccagttccacccggaggtggtccacacgccgcagggcaaggccatgctgcgcgccttcgtcttcaacgagtgcaaggtcagcggctcgtggacgatgaagggcttcatcgacgaggccgtgggcaccatccgccgccaggtgggtgagcacggccgggtcatctgcgcgctgtcgggcggcgtggacagctccgtggccgcgctgctgctgcaccgggccattggcccccggctccagtgcatcttcgtggacaacggggtgctgcggcagaacgagcgcgcccaggtggaggcgctcttcgtggaccgcttccacgtcccgctgaagacggtggatgcccgccagcgcttcctggacaagctggccggagtgacggacccggagaagaagcggaagatcatcggccgcgagttcatcgccgtgttcgaggaggccgcgcgcgacgtgcaggacgcggagttcctggcccagggcacgctgtacccggacgtcatcgagtccgtgtcgtacaagggcccctccgtcaccatcaagagccaccacaacgtgggcggcctgccggagacgatgaagctcaagctggtggagccactgcgcgagctcttcaaggacgaggtccgcgccctgggccgcgagctggggctgccggatgagatggtgtcccgccagccgttccccggcccgggtctggccatccgcgtcctgggcgaagtcaccgagcagcgcctggagctggtgcggcgcgcggatgccatcgtccaggaggagattcgcagcgccggcctctacaaggaggtctggcaggccttcccggcgctgctgccggtgcagagcgtgggcgtcatgggcgacgagcgcacctacgagtccacgtgcgtgctgcgcgccgtcaccagcgtggacggcatgacggcggactgggcccggctgccgttccccgtgctggagcgcatctccacgcgcatcacgaacgaggtgcgcggcatcaaccgcgtcgcctacgacatctcgtccaagccccccgcgaccatcgaatgggagtag

SEQ ID NO: 7530 - DNA, 279 bp, Myxococcus xanthus
cagggcgccaaggaccgctacttcaaggcggacgtggagtccgtgaagctggtgcccgagggcatcgaggtccgcgtgccgtacaagggcaccctggcgatgaacgtccaccagatgatgggcggcatccgcagcggcatgggctacgtgggctcctgcaccatcgacgagctgcgcacccagtccaccttcgtccgcatcacctcggccgggctcaaggagagccacgtgcacgacgtcatcatcaccgaggaagcaccgaactaccgcgtcgggtag

SEQ ID NO: 7531 - DNA, 498 bp, Myxococcus xanthus
atgacccacttcgcctcacgccggggcagcgccctggccatcaccctgattgccctgacggtgctgctgctgctcgtggtgggcgccatcaccttcaccggccgcaaccagtccgccgccgtggccaagacgcgcagcgaccgcgtggaggcctgcgcggagacggcgcggcgctacctgctttcgcggctgaaggtgttcggcaccggcgccgtgcccgtcaccagcatcagcctggagcaggtgctgcaagacgaccaggtcgtcgccgacagcagcgtcatgcgcaccgcccacctgggtgacaccgcgtcggcgcccacggccgcggagctcgcctcgtcctcgttcagcagcggcaaggaccaggtgagcgacgcgggccacacccttcgagaaggcacggccggcggcagctactaccgcgtggtcgtcatgtgtgacgaacccggaggccggcaggccgagaccgagttcgtcttccgcttcggcatctga

SEQ ID NO: 7532 - DNA, 4494 bp, Myxococcus xanthus
atgaaggcactcttctccaccctgacagccctgtccgtgctgctggccgcccctggcgcgctcgcgcaggacccggcgtcttgcagcctccagtccacctcccgcctggacgcgctgctcaaccccgcgcgcggcagcgacgagcgcttcttcaccagccccagcggcccgcccaacatcctgctcatcctggatacgtcgggctccatggcgtactggcccatcgcctggagcaacaacgactcccacagctattccaaaaacagctccggcaccttccccggctgccgtcaggccaacatcgacgagctgaactacgacgccaacgtcgcgtacccgcggatgtggctgtcgctgaccaaccaggactcgccctggttcgtgcccaccagctactaccgcttcgatggcagcggcagcacctcgcagtccagcttcgggatgacccgcaacccggtgaaattcaacgagccgccgcccaacactgtcatcagtggcaccgcggcagaggcgtgcgcccaggtggtggactccggcaacaacaacacccaggccgccgcccgcgccgcgtgcgcgcagtgcctcgcgacgaagggctacttccaatacacgcaagagaagcgcgtggcttccggtaacttcctcaacttctattcgccgcgcggccactccgccgtcaacgtcatcagccaggtgctcaaggactcggagcgcacgcgcttcggtgtggtgacgttctccgcgagcagcgaagccaccgacacggcgaagtggagcggccaggacgtggtgcgcttcgagcgctttggccccagctgcggcgactcgctcagcggcgcgaagcgtgaagatcaccgcaacaacctgctcagcaagatgcggaacgggctgcgcttcaacacgggcacgcccctgacacaggccatgtggggggccagcacctacttccgctccgccggcagcgacccattccccgactggttcggcagcgactacctgcgcgactcgggcttcaacgacgaggccgcgcccggacgagccgccacctgcttcacctgcggcttcaacgccatgattctgctcacggacggggagcccaacgagcccggcggtgactccgcccaggtcccggcccaggtgcgcaacctggacgtcccctgctccaactgcgccgcggccagccagggcagcaacagcggcggctccagcagccacatccaccgcatcgccaagtggatgtggacgaacgacctgcggccggagctgtcagggtcgcaggcggtggccacctacaccgtgggcttcgcgctgacgaacacgcaggccatcaacctgctgcgcgtcaccgcggacgcgggcggcgggcgattctacgcggccaccaactccagccagctgaagacggcgctccaggccatcgtcgacgacgtgcagaaccggaacatcgcgttcgccgccgcggccatctcttcgttccagacgggcagctccacgctcagcgcgctgatgccgcgcatgtcgcccgcctccggtgacagcgcctggcgcggcgacttgtggcgcttcaaccagttcaacgagttcgtggaaggtgtcgacaagaacggcgacggtgacatggacgacatcttcgtcgtggaccgggacggggacatcgtcgtcgaggacacctctggcaacttcgtcaaggacggaggcagcaccccggccgcccagttctgggaggcgcgccgcgcgctgatggcccgggcgctgaccagccggaagatctacacggtgacggacagcaaccaggacgggcgcctcaccgccgcggacaacgcggcgacgcccatcgagttcaccgtggagaaccgcgaggtgctgaagagctacttcggcatcctcggcacccccgtctgcccgacggtgcagtcgctcagccccctggacatcgacccgggcacgttgatgacgggcctccggctgacgccccagcaggccgccgcggccatgagcgtcgcggtgcccggcttcggcaacctggcgcaggcgcagacctgggtgaacgacatctgcgtgcgcacgctcatccaatacgtgcgcggccaggacctggcggacgaggacggcaacggcaaccgcaccgaggtgcgccgctccgtgctgggcgacatcttccactccgcgccggtgctggtggacccgcccatggacaagttcctgtgcaacctgggcatgagcaaccagtgcacgcgcacgctctacagccagcaactgggcgtgtcgcccacgccgctcgccacggagagcatcagccgctgcggcaacaccgtggaggtggacgcgtatgacgcgtacctgcaccgctacctccgccgcgacaagctggtgctggtgggcgccaacgacggcatgctgcacgccttccgcgacagcaccgcgagcaccgacaactgcgagggcggcctgcccatgattgagtactcgcccagcaacggcgaggaggagtgggccttcatcccgcccgacctgctgtcgcgcctgcacgagatggcgggcggccaccagtactacgtggacggcgacatcatggtgcgcgacgtgtgggcggacggctcggacggctcgcagccggacggcatcaagcagtccaccgagtaccacacgatggcggtgatttcggagggacgcggcggcgtgcactacgtggcgctggagctgcgcgcggactcgggcaccggccgcttcggcgcgccccggatgcagtggatgtacccgcagccggactccccggaggccgccctcttcggcaagacgctcttctcgctcagccccaagccgccgcccattggccccgtgctggtggaggcgggcaccgcggccggtcccgtgtcccgctacaacgtggagacccaggagcggtggatggtggccctgtcgggcggctggtcccccggccaggagaagggccgcggcatctacatggtggacgcgtggtcccccgaggtgaatggccgcaccgacaacctgtggtggaagttcgaatacgacccgaacgccagcggcgagcagcacggccccgcccagcacctcacgcatagcgtggcggcgccggtggccctggtggactacggcgtggggggcaacgtgcagcaggacggcttcttcgatacggccgtcttcggtgacatgcgcggccagctgtgggtggcgcgcatgtccgtgcccggcgcgctggacccgagcacgggcctcatccgcaactggagcgccgcgcgcgccttccagatggaccgggacgccgtgggtccgtcgggcggccagggcgacagcctcacgcgcacgtggcccttctattacgtgccctccattggcatccagccgggcacgggcgccatgcgcgcgctcgtcggcacgggtgaccgctacgcgctgctggatgaccaggccggcatctgccgcttcgacaacccgcaggcctgcgcgcgctacgggtgcggcaacgtggaggtggactaccgcgtggaccgcatcggcgagaacatcacccagtcgcggcaccagtggacgcagcggggactggcacagtccacgctgacgcgtgggacggcctcgcagcccgcctgtggcgacccgggccagacggtggtgtcggcccggttcacccgacacgaggcccgctcctgcccgggagcaccccaggactacacctccatgagccccgcgcgtgtggagtgtggcaaggacgccgagggcaacttccgctgcctcgacgtgagcaacgtggcgcccaacttcgcggacctggagctgacccgcaccgtcaacgccattgggaagaatcgcttctacggcgtgcgcgtgtacggtgtggccgggcagacgttcgccgaggatgccaccgctgtttccgcggagggccccatgacggcgagccagttcgacgcggaacgcctgagcgaccgcaccaacgacaacgacaccagcggtgacctggtggacgtgacaaacatcacctgcgacgcgtccggcgcctgctccgcgacgggcgccctgcccgatggcaagggatggatgctggagtacacggacaaccacacccacaagacggcgggcggcgcggccacggtggccagctgcacgctgtggaacgtcatctacccgtcgcaggacggcgaggtgtgcagcagcaccgccgcccgggcccgcttctaccaggcggacttcctcagcggcctgcccaactgcgccgcgtccttcgagaacgcgcgctaccaggagcgcgcggtgctgtcaccgccgcccgagccccgccaccgcggtgatgatttcgcccacgggcagcgtgaaatacagcgccgtcatgcaggagcccggacagcgccaggccacctcggtggacgtgtcggagaacagcgaggtgctccagaacgtgtacgagctacccctcacccaggagcagcacgcctgccgccacgagaacgcggccagttgcctgccgtgatgacgtga

SEQ ID NO: 7533 - DNA, 423 bp, Myxococcus xanthus
atgcccgcactcgaagacgccatcgcgctcgcggtggccgcgcatcagggccagcgagacaaggccggccagacgtacatcctccacccgctgcgggtgatgatgcggctggacacggacgaagagcgcaccgtggccatcctccacgacgtggtggaggacacgccctacacgctcgagcgcctgcgcgagctgggctacgcggaaaacgtcctgggcgcgctggacgcgctcacccgccgccaggacgagacgtacgaggccttcatcgaacggctgcgcccgctggcgctcgcccgccgcgtgaagctggcggaccttgaggacaacatggacgtgcggcggctggcagcggtgacgcccaaggacgccgagcgcctggcccgctaccgcgccgcctgggcccgcctgcgcgagccctag

SEQ ID NO: 7534 - DNA, 1293 bp, Myxococcus xanthus
tgggtgaagacgtccttggccccgggcagccgcgtcgtcagcgagtacctgcgcgacgccggcctgctgccctacctggaggcggtgggcttccacatcgtgggctacggctgcacgacgtgcatcggcaactccggtccgctgacggagcccgtggccaacgccgtcaccgagggggacctggtcgtcgccgcggtgctgtccggcaaccgcaacttcgaaggccgcatcaacccgcacgtgcgcatgaactacctggccagcccgccgctggtggtggcctacgcgctggcgggcgaagtgggcatggacctggacaacgagccgctgggcaccgaccccaacggacgtcccgtgttcctcaaggacatctggcccaccaacgaggagattcaggaggtcatccgcacctccgtgaagccggagcagttccgcagccagtacgccaacgccatggagggcgacgcgctctggcagcagctgccggtgggcaagggctccacgttccagtgggacgacacgtccacctacgtgcgcaagccgcccttcttcgacaacctgccgaaggagcccaaggcgacgcaggacatccatggcgcgcacgtgatggcgctgctgggtgactccgtcaccacggaccacatctcccccgcgggcaacatcgccaagacgagcccggcggccaagtacctcatggccaacggcgtggagcccaaggacttcaactcctacggcgcgcgccgcggcaaccacgaggtgatggtgcgcggcaccttcgccaacatccgcctgaagaacctgctggtcccgggcgtggagggcggcgtcaccgtccacatccccacgcgcgagcggatgagcatctacgacgcgtccatgaagtaccaggcggagggcacgccgctggtggtgctggcgggcgcggagtacggcaccggctccagccgtgactgggcggccaagggcaccatgctgctgggcgtgaaggccgtcatcgccaagagcttcgagcgcatccaccgctccaacctggtgggcatgggcgtgctgccgctccagttcgaggcgggccaggacgcgcagtcgctgggcctcaccggccacgagaagttcgacatcaccggcgtggcgcaggacctggcgccgcagaagaagctcaccgtgaaggccacgggcgagagcggcaccaaggagttcacggtggtgtgccgcatcgacacgccgaacgagctcgactactaccgccacggcggcatcttgcagtacgtgctccgccaactggccaagggctag

SEQ ID NO: 7535 - DNA, 834 bp, Myxococcus xanthus
ggcgtggccgccgccggactgctgggactgggcggctggaaggcccgccacgcgaacgacgccgaagccaccaccccgcccgacgccaccacgcctggacaggtcgcggccacgctgcctccgaccccgccctccgagccgctcgccaccgtcgcgcctcccgacaccaccccggccccgaaggagagcgccgggcgccccggccctggcacgtcgcaaccgccccgcccggcttcgcgcggggtcaagggcgcgacggcaccgggaggcctgtcgccgcggacggatggcacgccggccgtgggcggcaccgttcgcggcatgggcacacgccccgcgggcgaggacgaggaagcaccgcgcaagccgctggtgcgcaagctgcctgtgtccatcctggtgcgcccctatggcagcatccgcgtcgatgacggcgtgcccagcgcccagccgctccagaagcatgacgtggaggtgacgccgggccggcacaccgtcaccatctcctgcgactactgcgaggacgtggtggacaccatcgacgtgcagccggacggcgacaacgtcttccacctgcgcgcccagccgaaggcgtcccgcctgtcggtcgacttcgagcccgcgggcgcgctggtgcgcgtgggcgacgagttccgctccgcggaggacagcctgaagacgcccttcgaggtccgctccccgcgaggccccgcgggcttccagcacaccgtggtggtggaggtctcccacccgggctacgtgccggagcgccgggtggtccatctgcggccgggcgaacccaccaccctgcgcgggagcctccgcccagaatga

SEQ ID NO: 7536 - DNA, 972 bp, Myxococcus xanthus
atgctgctcgctccgggcgccacgctcgcccaggacgccggtgacccggaggtcgccgcgctgcgtgccagcttcgagtacggcaagtacgccgaggtgatggaccgcgcggcctcgcgcatcgaccggggcggcctggacgaggacgacctggcggagctgcacaagctcgcgggcctggcggccttcaacctgggccgcaccgacgacgcccgccgtcacctgcgcgcgctgctccggttggatccggacttcagcctggaccccttcgtcgtcccgccgcccgcggtggccttcttcgacacgctcaaggaggacatggacacggagctggacttcctgcgccaggagcggcggctgcgtcaggagcgcgagaaggcggaggccgagcgccgcgagcgcgagcgcctggaagccgaagtgcagcgccgccgcgccgaggagctggcgtcccaggtgacggtgcgcacggtggagaagcgcaacttcctggtcaacttcgtccccttcggtgccggccagttccagcagggccgcaccagtctgggcatcgtcttcgccgccaccgaaggggtgctggcggtgacgagcatcatctccttcttcgcctacgaagggctcttcgaagagcgcaccatcgatctggacaacgtgctggacccggacggccgggcctccgtcaccgtgcgctacatccccaccagccgggccaggcagcgcgacgcgtggcagttgctcaagctgtcgtcggccgcgggcttctacgccatctacgccgtgggcgtggtggacgcgctgttccaccacgaggaccaggtggtccgcagcacggtggagcctcgcgccgaacaacccgcggagccgtcccctcgctccacttccgcccgcgcgacggcaccgaagacgtacacgcgcgtgggcctctacccgacccgcggcggactcggcgccggtctcaccctctccttctga

SEQ ID NO: 7537 - DNA, 1464 bp, Myxococcus xanthus
atgggcgacgcgcttcgcaacgacctgtcccgccgcgccaactcggtgagtgtggagctggcgaagacgctggcgcccatgctgagcgtgaagcgcgacccggagcggctgcaggagttggtgcagggcgcgctgagcctggggcccgaggtcgcctatgtccgcgtccatgacgcggacggcgtcctcctgggcgaggccgccgcggagcgctacgtcggcgaggcgcaggctccggcctccgtcgaaggcgatgcctcggtgctccgccgcaggtccgtgaagggcacgggcctggtggagacgacgacgcccgtgctcgcggccggctccaccgcgcagctgggtaccctccaactggcgctccacgaggaggggctgagtcagacgctgcgggaggccacgcgcttcacggccatcatcagcctgctcgtgctggtggcctgcatggtggcggcatggctggtgtccgggatgctcgtggtgccgctggagcggctggcgcgcgcggaggcgggcatcgcggcgggggacctgcggcagcaggtggacctccagggctcggacgagattggcgacgtggcgcgcagcttcgcggtgatgacggacgcgctctcccacctgctgcaggatctgcgcagcgcggcggcggagatggagcgcgaggcggcgggcgtgctggccacctccacgcagcagtcggccatggcccaccagcaggcctccgccatcaatgagacgagcaccacggtggcggagattgcccagacgtccaagcaggccacggcctacgcggactcggtcatctcccagacgcagaagtccgaagccctcagcgcggaggggcagcaggtcgtcagcgagagcgtctccggcatggagaagctgggcgaacaggtgaaggccattgccctgtccatcaccgacctcagcgagcgcacgatgcagattggcgacatcatcggcacggtgaaggacgtggccgagcagtccaacctgctggcgctcaatgcctccattgaagcggccaaggccggggagcatggccggggcttcgcggtggtggccacggagatgcgcacgctggcggagcagtcccgcatcgccgcggagcaggtgcgcggcctgctcaacgaagtgcagaaggggacgaggcaggccgtcagcgccacggaggaaggcagccgccgggcgcaggcggccatggaactggctcgcgaagcggggacgaccatcctgggcctgtcggaggtcatccgcgagtcgtcgggcgcggcgcggcagattgccggcaacacgcgtcagcagaccattggcgtggagcagatttccacggcgatgagcgagctgacatccgccatgggagactcggtggagagcacccggcgcatcgaacaggtgtcaggcaatctgaccaatctctcgaaacggttctcggacctggtgggtaggtaccagttatga

SEQ ID NO: 7538 - DNA, 1956 bp, Myxococcus xanthus
atggccagcctcaccgtccgcacccccgatggcaagatccgcgcagtctccctgcacaagcgcctcaccagcattggccggggcccggacaacgacatcccgctggaggacacctccgtgcccgccagcgccctgcacgtcaccttcgacggcacgcgctacgaggtaggcagcctgggcgccaccttccacgtcaacggcaagaagcgcgacgcccatgcgctctccaccggcgacgtggtccgcgtgggccacaccgagctgatcttcgcccgggacgacgcgccccgtgcaccgccgctacccgcgtcccctccgcgcgagctgattcacacgtccaaccccgactcgcacacctcggagctgcccggcgtccccggccgcgagctgctgctgctgcgccggctcaccgcgttcagcgagcggctgctggggctctacgacttggagcgcctcctggagggcctgatggacgaggccatcgaggtgacgcgcgccgacaagggcttcctcatcctgatggagaacggggacccgcgcgtgaaggtggcgcgcaacgtgtcccgggagaacatcgaggacgcggtggagaaggataaaatctccgactccatcatcgccaaggtggtgaaggagcagaaggcgctcatcgtcgcggacgcgctggactcgccggagttcaacaagagcgagtcggtggtgaacctgcgcgtccactccgtcatgtgcgtgccgctgatgcagaagggcgacctcttcggtgtcctctacgtgggcaatgaccggctggtgaaccggttcgagcccaagagcgcggacatgctcaccatcttcgcggcgcaggcgtcgctcattctccagaacgcgatgctggtgagcgacctcaagctcgacaacaccgagctgcgccgcaagctggaggaccagcgctatggcgacatcgtcggcgcgtgccagggcatgcgggacgtgtacaagcgcatcgacaagatcgcgcccacggacatctccgtgctcattaccggtgagacgggcaccggcaaggagctcatcgcgcgggaaatccaccgccgctcgacgcgcgcgaagggccccttcatcaccatcaactgcggcgcgattccggagaacctgctggagagcgagctgttcggccacgtgaagggcgccttcaccggcgcggtggccaccaaggccggcaagttccaggcggccattggcggcacgctcttcctggacgaaatcggtgagatgccgctgcagctccaggtgaagctcttgcgcgcgctccaggagaaggtcgtctacaaggtcggcgacaaccgcggcgagccggtggacatccgcgtggtggcggccaccaacaaggtgctcgaggacgaggtgaagaagaacaccttccgcgaggacctctactaccgtctcaacgtcgtcacgctgaagctgccgcccctgcgagagcgcggcgaggacgtggtggtgctcggccgcttcttcctccagaagtacgcccgcgagttcagctccaaggcccgcggcttcaccccctccgccaccgtgtccatgcgcaagtacggctggccgggcaacatccgcgagctggagaacctcatcgagcgcgtgctcctgttcgcggacgggcctctcatcaccgcccgcgacctgccggagccggtccgccagggaacgggcgtccaggcgggtgccaacctggccagcgcggtggcctccatcgacgttccgacgggggaagtcggcctgaaggacatcgtccggatgaaggccgccgagctcgagcgggacctcatcgtgaagaagctcgaggagacgggtggcaacgtcacccgggccgctcggttgcttcaaatcagccgcaagtcactccagacgaagatgaaggagtttggcttgcgcgacaccacaccagacgggcaggaagacggtccggacgaatag

SEQ ID NO: 7539 - DNA, 918 bp, Myxococcus xanthus
atggttcaggcgacggaagaggccgcggcgcagatgcccaacgcagttcccgacgcaggcgccgtcgccgcggcgcccacgccggcgcccgtggccacggacccggtgaaggccgcgggcctggagcgcatatcggtgagcatcaacggccccctggagaccgcgctcgtcaacgccgctggctcggacgtgggtccggcgctggcgcaggtggtgacgcgcaccctggtgtggtgggtctccgtgcccggggagattctccgcggtgacacgctggaggtgctctaccagcgccgcaccaacgaggagcccctggtgcaggcggtgcgcttcaccagcgccaagctgggcaagacaatgagcgcgtaccgctaccatgccaacggcgagcccaatgcccggtactacctgtccggcggcgacgagctggagctgaggctggagcgctcccccatcgacgactacgagcaggtgacgtccctgcttcgcgatggccgcaagcacaagggcgtggacttccgcaccccggtcggcacgcccatcaaggcccccttcaacggcgtggtgaagcggaagaactggaacttcagcagcaacggcaactgcatcgagttggtggagtcgggcggcaaggggcgccgcgcgctcttcctccacctggacgaggtggacaagagcgtcaagccgggcacccggttctccgtggggcaagtcatcgccaagagcggcaacacaggccgcagcttcgccccccacctccactaccagctcatgacgcaggatgaccgggtgctggacccctacgaccagcacaagacctaccgccgctcactggccgcgcagcaccggtcgggtttcgaggcggaggtgcgccgcatggacgggttgctgagcgcgtccgtggtggccggcaagtaa

SEQ ID NO: 7540 - DNA, 429 bp, Myxococcus xanthus
atgctcttcggcgtagagctggtgcccttcaaccggccggcgaagtcgcagcgcttcgccctggacgtccggggtatcggcaactacgtgggcagcggccgctactacaacgagctgagcgccgccctgcgcaagctgctcacctccgaggactacttccaggtgggtggcatgctgggcgtcacggcgaacgcgtcgcaggccttccagattcgcgcgtccggcatgttcctctacaacaccaaccacgccctcaccgccgaggatccggggcgtgacgtgaacaacgacggcggcgtggacacacagcccggctcgcccgacctcaaccccaacttcgactggcgctacgacctggtgtctcgccgcttcctcgcggtggagagcaccacgttccgcttcgacctgagcgccacgttcagcttctag

SEQ ID NO: 7541 - DNA, 192 bp, Myxococcus xanthus
cgcggcgaggtggtggtgctggtggagggccgcaccggcgagacgcgctggtccgaggaggaattgcgccgggccctggaggaggggctgtcgcgcggcgagaagctcaaggcgctgagcaccgagctggcccgccgcgcgggttgggccggtcaggacgtctaccggctggggctctcgctgaagcgctga

SEQ ID NO: 7542 - DNA, 615 bp, Myxococcus xanthus
atggcccttacacacctcctccagcccactcccgccccacagcgtccgcctggcgtgacgtgcgaagcctatgtccgcggcgagggcaagcactgcctgcactaccggcctggcggtggctgcaccctgcccggcgtgggcggcacctgcaccgagtggctgaaggtgaatcggcaggcccggcctcatcgtgacgtgaccgctcaacctgtccctgcgcctccggtgaaggccgctccagccgctgtggatctcttcggccatccgctgaccgaggcaggctcgaagaagctcgccccggctcccgcctccaggcccgcgccgccagctccgtctcccgatgtgaaggggctggacgcggagaccccgctctccggcctgcgcggcctcaccgacgaggacatcgccagcttcagggccctcaacgccgaggtgtgcttcgcctccgagacctacggcgaggtgtggctcgtcccggcctacaccggccaggcccgaaaggagctcacccccgagcacgccgccaccctggtgcgcgtcctgtctgccttcccgggctcacgcgtcatgtccttcgagaagcggcaagcctccgcggacgaggtgtcgccatga

SEQ ID NO: 7543 - DNA, 618 bp, Myxococcus xanthus
atgtggatgctgcgccacggcgtgctgcaggagacgacgcgcaccgaggagcagttggaagccgccctcgcctacgtcgagacgctgggccagcagatggagacggcggagtccttccccgcccgcctcaaccccaactgcgtgtactgcgaccaccggcgcgactgccccgcctacgcccaggcgctggagggccggcgtggcgtcgtctgcgaggacacgtctgacttggagtccgtcgcccgggagcgccaggaagtcgcccacctcgcgaagattctcggcgcgcgcaaggcggagctggagggcgtcctccgcgcccaccttgccgagcaggacgaactcgtcctcgccggcacgcgctaccgcatgttcaacaccaccagcctcgactacccgctggagcccaccgtcgcggtgctggcccccgccaccggcctcccccgtgaggatttggtgcagcgcctcgccagcgtcgagaagaaggccctcgacgcgctcctgaaggacgcgggcaagcgcctgggcaccgcgcgcgtcgcgctgctgaaggccgagctggactccctcgccgccaaacaccactcgcccaggttctgggccaaagaggttgcatag

SEQ ID NO: 7544 - DNA, 267 bp, Myxococcus xanthus
atgccggaggcgctcatccgccgcggcctccagtaccgcaccgggcaggagatgtccgacgtcgaggtgccgtgcttctgggtcgaagcgaaggcccaccaacgcaccaacgtccgggaggccatgcgccaagcggtggagacgtgcccgccgggccgctggccgctggccgtgtgcaaggacgacgggcagccacccctcgtcgccatgcagttggatgacttccttgagctggtgcgcgagtggtgggaggcccgtcctcggtga

SEQ ID NO: 7545 - DNA, 189 bp, Myxococcus xanthus
atgctgacgcgtctgcgccgccgcatcatcggcaacgcggtgcccaaagaggacctcgaccagctcgtcctcgccacctttctgtccgtcgcgcgcgccttccccctctcgcgctggggtgactggactgccgcccgcctgcgccagcagacagcgcgcgaggtattccgctacctccgcaaggagcgc

SEQ ID NO: 7546 - DNA, 144 bp, Myxococcus xanthus
atggcggagctgcgtgcatggcttcgccctcttgttggagacgacacggagctgctggtgtccgtccttctctatgaggagggctatgtcgaggtgggggcgagctggggctgcgccgcggcagtgcgcagcgcgccacgggcc

SEQ ID NO: 7547 - DNA, 1860 bp, Myxococcus xanthus
ctaaaccgcaccggggctaagctcgacccggagtggctcgcggcggcggccccccacctgctcaagcgcagctactccgaaccgcactggtcggagaagtccgcgcgcgccatggtgaaggagaacgcgaccctcttcgggcttcaggtcttcaaggagcgccccgtggccctggccagcatggaccccgcccgggcacggctgatgttcctcgagcatgccctggtgcgcggcgaataccgcacccggggggcgttccaggagaagaaccgccaggtgctcgagcgcgtggcgcgcctgcgggacaaggcccggcgcagcgagctgctcgacagcgaggcgctgctgacgttcttcgaccagcgcgccccggcggacgtgacggacggagcgggcttcgaggtctggcgccgcaaggccgaggcggccgaccccggcgtgctcgtcctctcgatggaggacgccctctcacacgacccggacctgtccccggcgcactacccggacgcgatcaccctgcacggcgcgtccgtgccggtgacgtacaccttcgacccctcggccgaggacgacggcatcaccctgagcgtgccgctgctgctgctcgcccagttggtcccgggtgagctcgactggaccatccccgggtggcagcgggagaaactcaccgccctgctcgagcagctcccccgcgcccagcgcaagcagctggggccgttgccggaaatggtcgaccgtctcgagaaggaactggtgcccttccgcgggccgatgattccagcgctcgcgcgtgcggtgtcccgcctgtgcggcatggacgtgacggaggagtccctccgggcggatgccgtggtgccgtacctgcgcctcacgctccgggtgctcgacgagcggggaaaggagctcgcgcggagccgcgacgccgatgcgctgctcaagcagcacgggggacatgcacgggcggcgctgcgcagcgcggcaccgccttcagactgggagcgcaaggggctgacggcctggaccttcggcgagctgccccccgtggtcccccggcgggtcggcgggctcgaggtccgcagctatcccgcgctcgtcgaccggggcgctgccgtggacctggtgctgctcgagacatcctccgccgccgaggcggccacgcgcacgggggtccgccggctcctgatgctcgccgcgcgcggacacgtggccgtcagcgccgcgcgcatgccgctgcccttcccgtccctggacggcgcgccgcccgcgcggggccaggccgacgccttccgggcactcgtcctcgcacgaagcgtcgacgatgcgttcaagctcgcaccgggtgcgccgctgccccgaacgaaggcggccttcgaggcgctggtccgtgagggctcaccgcgcatcgagagtgcggcccgggactgggcgaacgccattgttgtcacctccgcggagctcgccgcgacgctcgcggcactcaaggcggcatcaaagggaccgagcggcgcggcggccgtgcgggacatccgctcgcagctcgggcacctgttccccgcgaacctcatcgagtggattcccttcgtgcgcctgctgcactacccgcgctacctccgcgcggcccaggcacggctgtcgcgtgcggtggcgaaccccagcaaagacgcagggaaggccgcgcccttcactcccctgtgggagaccttcctcgccaggcgcgccaccgtgcgtgaccaggaggcggcgcaggagctgcggtgggccttcgaggaactccgcgtggccatcttcgctccggaggtgacgacgcccgtgtcggtgacggtggcgaaggtcggcgcggccctcacggcgctgcgctag

SEQ ID NO: 7548 - DNA, 1422 bp, Myxococcus xanthus
cgggtcgaggacgtcctccagtcggcctgtggggtgacgttggcgcgcagcctgcgccgctcgctggagacggcgctgggccgggccgcgcgttcgcgaggcctggagcccgacgccttcctgcgcaagctgctggtgcgcgaggccgcggcggtggagtgcttcatcgagcacgccgtcattggcgagacgtacttcttccgtcacccggagcaccttcgcaccctggcgcgtctggcgcagacgcacccggccccgtgcttccaggtgtggagcgcgggctgcgccagcggcgaggagccctacagcatcgccatggccttgatggcggaggggctgcccgaaggccgcttccgcatactggcgacggacgtgtcgggccgggcgctccagcgcgcgagggagggcgtgtacggcccgtggtccctgcgccgcatcgagccggagcaggagaagcgcttcctggtcgccaacggcgacgactactccgtcatcccccaggtccggcacgccgtggagttccggcgccacaacctggccgtggacccgccgcccttcatgggcctgggcgccatcttctgccgaaacgtgctcatctacttcccgacggagctcgcgcaggaggtgctgaagcgcttcatctccgcgctggcccccggcgggctgctcttcgtctctccggcggaggttccgctgaccaacggtctggggctggagactgtggacgccgagggcagcgtggtgcttcgggtccccgtgccgggcgcgcctcgcgcggtgacgccggagtcgcggcttcctcgcctggggatgggccgcaatcaggtggcctcgccggtgcctccaaccgggtggcctcaggcgctggacgattcaagggcgcgccgcgcgcgcgtgccggaggggcgtctatctctgaacgagcccgggacgtcgcgccctgcgtgggccgcgtcaacgccagacgccgccactccggccgtgccgcggtcggtggccgtggatgcgctcgctgccgaggaggttcctcccctggagcgcgccatcatcgcggcgcgcgcgggacacttcgaggaggcggaggcgctggcgcgcgaggccgcgaaggcgctcgtccccgaggcgtacctgctgctctccatggtggccgaggttcgtggcgacctgaacggggccgtggaagcggttcgcaaggcgctgtacctggagccccggttggcgctggggcacgccacgctggtggccctctatgggcgcatggatcggcccgaggacgcggagcgtgcgcggcagaacgccctgcgcgcgctggatggactggatgatgaacacccgctgcgtggggtggagacgatgacggccggcggcctgaggcaggccctggcgccagtcgagcaggctggctggcttggagtgcgctga

SEQ ID NO: 7549 - DNA, 561 bp, Myxococcus xanthus
atgacgaggaacgtgaagcgtttcctggctggctcgctgctgtctctcaccccgtcgatcgctttcgccggacagatcgaactcgacttccccgacttcctcacccagcgcagcgagtacgtcagcctccgtgagggggcggtgcaggtacccgtgcggaagggcccctcggtggaggccatcggccctgccgttgaagacttcttcgtctccaaccaggccggcgtcgacctccacctgggcatccagatcctgacgggctcgttcaatggcacctggaacacccaccccgtccccccaagcacctatggtgggtttcaggtcggcgcccccgcccccgccccaacggttatccagcagtactactacacggtcgacccggcgaacccggctggctcgaagacctgtgtctggcgcgtggaagtcacggacaacgccggcgcctgcaacgcgcaggtcttcttcggaacctatggcggcgccatctgcaccgtcgacgcggcccagtcgtccatcgacccggtcacgtgtcagacgcaggtcgtcaccaacatgcagtga

SEQ ID NO: 7550 - DNA, 573 bp, Myxococcus xanthus
atggacgccgcgtccgtcgaccgcatcgcaagtgagctggggttggcctacgtctactaccctgcctccgtgcaggtggacgacgacgacttcgggaacgcgcttttgagccggtggcccatcgtcgcggaccggaaagtccaccttccacatgacgacccgtaccatcagcgccgccgcatcgcggtcctcgcgacgttggacatcggtgggaccctggttcaaacggcctccgtgcacaacgccacgcccatcgtcgggctcggcgggcggctggaccaggcggagaccatcatcgacgcgatggaggggacgggacccgtgcaggtcatcgccggtgacttcaatacctcggacccgggaagcctgaggcagatggtgaagctgttttccgagcgggacttccaatgggcctcggaaggcgtgggggacacggtggactccgtgattggcggcctcccgctcgacttcgtcttcgcccaggggctcgctccgctggagcgcggcgtggaccggcgtcccgcggggagcgaccaccatcccgtttgggtgcggttcgcatggccccgatga

SEQ ID NO: 7551 - DNA, 873 bp, Myxococcus xanthus
tacaccctgagcgagcacgagcaggccgtcatcacgcggttcggcgagccgaagggcgcgtccgtcgtagacccggggctccacttcaagatgccctttgtcgacacggtgaaccgcttcgacaagcggtggctggactggcgcggtgacccgaaccagatacccaccaaggacaagaagtacatctgggtggacacctttggtcgctggcgcatcgtggacccgctgcgcttctttcagcgcctgcgggacgagcgcaacgcgcagtcccggctcgacgacatcatcgacggtgagacgcgcaacaccatcgcgtcgttcgcgctgattgaggcggtccgctccacgaaccgtcccttcgaggacgacgagtacaccgccgagacggagcgggcggagtcgctggagcaggtcgcccaggggcgggacaagctcactcgccagattcggctgcgggccgcggagatcgtcaaggagttcggggtggagctggtcgacgtgcagatccgccgcatcaactacgtggacgaggtccaggtgaaggtgttcgagcggatgatctccgagcgcaagcgcatcgccgagcgctcccgctcggagggcatgggccgcgcggcggaggtccggggccagcgtgagcgtgacttgaaggagatccgctcggcggcctaccgcaaggcccaggacgtcaccggcgccgcggacgccgaggcgacgaagatctacgcggaggccttcggccgggacccggagttctaccagttcatgcggacgctggaggcctacccggacgtcgtggacagctccacgtcgctgttcctgggcggcgagtccgagttctaccggtacctgcgcagcagctccaagaagtag

SEQ ID NO: 7552 - DNA, 339 bp, Myxococcus xanthus
  unsure (1)..(339): unsure at all n locations
gtcatcancgaggcctatgccgagctgaaccggttcatcccccgcgcgaagggcgaggccgagaaggcgctgcgcagcgccgagggctatgccattgagcgtgtgaaccgcgccaagggggaggcggaccgcttcgctcgcgtctacgaggagtaccgcaaggcgccggacgtcacccgccgccgcatgtacctggagaccgtgagccaggtgctccggagcgccgggcagaaggtcgtcttggatgagtccgtcaaggggctcacgccgctgttgaacatgcaggcgaccgaccccgcggtgtccgggagcgcgagccagacggagggccgccgatga

SEQ ID NO: 7553 - DNA, 666 bp, Myxococcus xanthus
gagctctcaggcggttcggagctggccaccacctggcgcagcagcgacccggcgctgggcatccactcctccgccgcgctgtccatgctgccctacaacctggagcaggagggtgacgagcgcgccctcttcccccagggccggctggacgcggacctgcagcaggtggacctgcgggacatgaactcgtggcgactgcggctcgccgatgtccagacggcggagatgctggaggtccacctcatcaacgcggtggcgcccttcatcctcgtcgggaagctgaagccgctgatgctcagggaccgctcgtcccccggccacgtggtgaacgtctccgcgatggagggcagcttctcgcgcgggacgaagacggacaaacacccgcacaccaacatggcgaaggcggcgctcaacatgatgacgctgacctccgcgccggactacgcccgcgacaacatctacatgaacgccgtggacaccggctgggtcaccgacgaggaccccgcgcagcacgcggagcgcaaggtgcaggagctggacttccagccaccgctggacatcgtcgacggggcggcgcgggtggtggaccccatcatcgcctcggagaacagcggcgagtacgtctggggcaacttcttcaaggactaccgtcacaccgcgtggtga

SEQ ID NO: 7554 - DNA, 480 bp, Myxococcus xanthus
agtctccgcttcgaatcgtacgtggaggtcacccccgctgaagcctgggcgtgggtgacgtcgatgaagggcatctccacggagatgcacccgtatctgcggatgacggcgcctccgggcgtggcgaggctcgaggacgtgcccttcgagcctggccaaccgctgttccgcagcaagctgctgctgggcggcgtgctgccggtgggctggtccgacgtgacgctgcgcgagctggagccgggacgccgcttcgtcgaggagtcccccatgagcacgatgcgtcagtggcggcacgagcgccgcatcatcgaagcgcacgccggcgtcgacatcatcgaccagctcgacttcgagccccgcttcggcggccggctggcggaggccttcatccggcgcctcttcgagcaccgccactcggtgctccgccgcgcgctgacgccgtcaataggtggacgggcgtcccaggaaaagccagcctag

SEQ ID NO: 7555 - DNA, 324 bp, Myxococcus xanthus
atgagccccgaacagttccacgtcgaagtcctcaagctgctgctccaggtcgccaccgtcgatggccgcgtcgcgcactccgagattcggcacatcctggacaccgcgcgaggcatgagcgtgcccctgcaggagctggccgcgctgacgcgctgtctgcagaacaacgagcccctgcctccgccgaacatgggcatcctgcgcgccaaccccgccgccgtcatccaggaggcgaaggcgctcatcgccagcgacggcagcgtgcacgcggccgaaatcgagatgctgcggcagattcgggagctgctcggcgtcagcaactga

SEQ ID NO: 7556 - DNA, 243 bp, Myxococcus xanthus
atgaagaccgtgttcgccgccgccctcctcgccgccgccaccgcgttcgccaacaccccggcccccgccgagcccgctgccgaagccaagcccgccgctgtcgaagccaagctcgaggccgccgaggcgccccaggccgaagaggcgaaggccgaggcggcccccgaggccaagcccgccaagaaggccacgaagccggcgaagaaggccaccaaggccacctccgcttccgaagcaaagtaa

SEQ ID NO: 7557 - DNA, 520 bp, Myxococcus xanthus
atgatcgaagccttctcgaaggtgtcggaagcctcgaagctgctgctggagaagggcctgggcccgagcaccggcatggaggcgctgcgcatggtgggccacgcgctgggcgtggaccgcgcgtacatcctggagaaccgcgtgcagggcacgtacggccggttcatcacggacatgcgccacgcctgggcggagccgcccacgccgtcgccgctggccaacccggtgatgcgggccttctccttccgcgagttcgcgccgggctgggtggacatgctggaggccggcatggtggtggcgtgccccacccgtgacgcgcccccgacgataaaggatttgctggagcgccagggaacgcagtccatcctcctatgccccatcaacccctcccggcagcagtggtggggcatggtggccttcgaggactgccgccgtccccgcgcctggaagccggaggaagtgacgctgctcaagtccctggcgcgcgcggtggcggcgtccgtccgacatgggcagatgc

SEQ ID NO: 7558 - DNA, 1344 bp, Myxococcus xanthus
atgagctcagcccgcatcctcgtcgtggatgatgacccgcaggcccgcgatttgctccagcgcttgctggggccgctgggggcggtgacgcaggctccggacccgcgccgcgccaccgagcgcatcgcggagggcgcctttgacctggtcctcacggacatggccatgcccgagccgggcgacgggctgaaggtgctccatgaggtgaaggcgcaactgccggacacgcccgtggtggtggtgacagccttcggcaacatcgagggcgcgctggacagcatccagcagggcgccttcgactacctggcgaagcccttcgacgtggacgcgattctgcgcgtggcgcgccgggcgctggagcagaagcggctggtggaggagaaccgctcgctgcgccagcaggtggagcgcggttcgctgatgctggtgggccgcagcccggcgctgctggaggtgtacaagcacgtggcgcgcgcggcggccagcaacgtgccagtgctgattacgggcgagacgggcacggggaaggagatggtggcccgcgcgctgcacaagcgctcgccgcgcatgaacgggcccttcatccccgtggactgcggcgcgattacggagtcgctgatggagagcgaactgttcggccacgcgaagggcagcttcaccggcgcgtccggcgcgcggcgaggcgtcttcgaggaggccagcggcggcacgctcttcctggatgagattggcgacgtcggcatgaaggtacagtcgcagctcctgcgcgtgttgcaggagggcgaaatccgccgcgtgggtgagagcgtccccgtcaaggtggacgtgcgcgtggtggcggcgacgaacaaggacctcaagacgcgggtggcggaaggcctcttccgcgaggacctgctgtaccgcctggacgtggtgcacctgcacctgccaccgctgcgggagcggagcgaggacatccccgcgctggtggagcacttcgccgggcgacatgcgcgcggcggcgtgcggccggtggtgacgtcggaggcgaacgcgcgcctggcggcctacgactggccgggcaacgtgcggcagttggagaacgtggtggcgcgggcgctggcgctcaacgtgacgggcgtcctggggccccaggacttcccggagcccatcggggatgcgtccaccccgaagatggcgggcctggcgggcgacatgccgagtctggccgagctgtcccgccgctacgccgcgcaggtgctccagcacgtgggcggcaacaagagcgaggcggcgcgcctgctcgatgtggaccgcaagacgctctacaagctgctggaggccccggaggccgagtcgtag

SEQ ID NO: 7559 - DNA, 354 bp, Myxococcus xanthus
atgcacctggcaacggccagcacggcgttcgccgcgccttcggtcgcgaacaagagccccgccaaggtcgatatccagacggtcgaagtcaagatgaagagcatcaccaagaagttcgagaggtcggactggaaggaccccaatactctcgatgagatcgcgaaattgctcgatgacgtcgagacccgcatcgctcgcatcaaggagaaggacaaggactgggccacctcgagcgtggagaccttcttctgggagtcccccccgaagtggaagaaggcgagcgaggaggtggaccggccccgcggagatgcaagtccacatggagcgccgcgcgcggttcccgaccatcggtga

SEQ ID NO: 7560 - DNA, 387 bp, Myxococcus xanthus
  unsure (1)..(387): unsure at all n locations
atggacgcggagacggtgcangaggtggtgcggctggtggagctggagccgctgcccggggcgcccgcgcacgtggcggggaccttcgtctaccggggcagcccggccatcgtcgtggacctggcggcgctcctgggggtgaagcgagaggcctccctggatgcgcacctggtcgtctgcggcggcggtgcgcggacggtggccgtgctggtggaccgcgtgcgcgacttggtggagtccccggtgctggtggacgggacgccggatgggacgtcgccgctgccgtgggatgccagcgggctgatggcggggctgtgccggacgcccgaaggcgtgcgcccgttgcttcggacggccgcggtgctcgtggggccggaggcgccgtga

SEQ ID NO: 7561 - DNA, 888 bp, Myxococcus xanthus
atgcgcgtgcgcaacaccgccctgggcgcgggtgccacgctgctggccatcctcctgtcgtcgctggtgggctggcgcgtcacctcgctgctcaagcgccaggaggccatcatccaagggcagttggaggagctgggccggcacaaccaggaactggacgccttcactcggcgcgtggcgcacgacctcatctccccgctggcgccgctcaagggctacctgacgctcatccgccgcaccggcgcggtgaacgacgcgggcgcgctggagatgctggcgcagtgtgagtccagcgctgttcgcatgggcgagctcatcgaggcgctgctgcgcttctgccgcgccggtacgcgcggcgagagtacggtgggtgagctggacacggccgtcaccaccgtgttgctggaggtggcgcagacggcggcggcgcagggcgtggcgctggagcgggagctggagcccggcgtggcggtggactgccccggacagttgttgcaggtgagtgcgcgcaacctgctcaccaacgcggtgaagtactcggcgggccggcccgacccccgggtgaaggtgcgcgtggccaccgaggacggcatggccgtgctggaggtcgtggacaacggcatcggcatggcgccgggcacccaggcctcactgttccagcccttcttccgcgcgcctgaggtgcgcgggctgccgggccacggactggggctggtcaccaccaagcgcgtggtggaggcgcacggcggcacgctggtggtgcgctcggaagaaggaaagggaacgcacgtggtggtgcgcttcccccgcgtggtgcgcccggcggcgggcaccagcggttctcagacaacgactgcttccgccggaatgcgcaaggtcggaacatga

SEQ ID NO: 7562 - DNA, 468 bp, Myxococcus xanthus
atgcggttcctctgtttcgcgacagcgttggccgtcctgggtacgggttgcgcgacgggtattccgctcgagcgactggaggcccaggtcctcgaggcggaccggtggcgtcgcgagtacgaggcggagcgggagcggaccgaggcgttcgcgctgcgcatggcccaactggagtccgcgctggagcgggtgctgctggagcgcgcggaagcggagcaggcgcgcgcggcgctgctggaagagttggtgcgcaccgaggcggaccggcacgcgctggaggagcacaacacccagttgctggcgctggagcgcgaggtcaacgaactgaaggagctgaaggagatgcacgaggagctgtcggacgtctggtacgagtccgcgctggagcgtgcacggcggcggttgaacaatccgccccagccggctgcccccccggcggccgggaacgtcgccccgacggcgccctga

SEQ ID NO: 7563 - DNA, 5244 bp, Myxococcus xanthus
atgagcgcagtgtccaatattgagcacgaccccatcgcaatcattggcatcggctgccgctttccagggggcgcgaagtcaccacgccacctctgggagctgctcacccagggccgctgcgccatcgtagaagtcccgaaggagcgctgggaccaccgccggtactacgacccggacccagacaagccaggcaagacgtacgtgcgggcgggaggcttcctgcaggaggccatcgacacgttcgacgcggccttcttctccatttcgccccgggaggcggcgacgctcgatccgcagcagcgtctgctcgcggaggtggcgtgggagagcctggaggacgcgggccttccggcggacaagctcgcgggcagccccacgggggtctacgtcggcgggttcatgctcgacagcatgctcacgcacatggggccgatgaaccgcgagctcatcggaccgcacacggcggtgggctcgacgatgacggtgctctccggccgcctgtcctatctcttcaatttccagggcccgagcctggtggtggacacggcgtgctcatcctcgctcgtgtcgctccacctggcttgccagagcctgcgggcgcgcgagtgcaacatggcgctcgctggtggcgtgaacctgattctctcgccgcagtccgtgcagctcgtggccaagctccaggcactcgcaccggacggccggagcaaggcgttcgatgcctccgccaacggcttcacccgtggcgagggctgcggcatcgtcgtgctgaagcggctgtcggatgcgctcgcggacggcgaccacatcctggcgacgattcgcggctcggccatcaaccaggatggcaagtcgacagggctcaccacgcccaacgtgctctcgcagcaggccctcatccgccaggcgttggacagcgcggggctgaagccggagcaggtgagctatgtggaggcgcatggcaccgggacgcccatcggtgaccccatcgaggtggaggcgctgcgcgagacgtacggtgcgcctcgcgcggatggtggcgtgtgtggcatcggttcggtgaagacgaacctgggacacctggagtccgcggcgggcgtggcgggcatcatgaaggtcgtcctcgcgatgcgtcaccagcgcatcccggcgcatttgcatctcaagcaggtgaacccgcgcatccagatggagggcagcgcgctcaccatccccacgcggctcaccctctgggagacggccgccggacagccccgccgcgcgggcgtcagctcgttcggcatcagcggcaccaacgcccacgtcatcctcgaagaggcgcccgctccggcggcgaaggaggcgctgccacagcggccggagctgttgcccctgtccgcgcgcagccgtgaagccctccagtccctcgctgagcgtcatgcggagcgcctgggccgcggtggggcggcgagcctctctgacgtctgctacacggcgtcgtcccaccgcacgcatcacacccaccggctcacggtgctggcggacgcccccgagcgcacggtggagcggctccgggccttcgcgcgaggcgagctgcccgagggcacctggacggggcgcaaggcgttcggcgctcgccggaaggtcgtcttcgtctacccggggcagggcgcgcagcgggcaggcatgggccgggcactgatggagcaggagccggtgttccgggacgcgctcgtccaggtggacctggcgctgcggccccatctgggctggagcgtgctcgacgaaatcgccgcggacgagcagcgctcgcgcctggcggagatcgacatcaaccagccggtcctcttcgccgtcgaggtagcgctgacagccctgtggcgctcgtggggcatcgagcccgacgcggtgatggggcacagcatgggcgaggtcgtcgccgcgcacgtcgctggcgcgctgagcctggaggatgcctgcctcatcatctgccaccgcagtaagctgatgcggagcctgggcggccgaggcgcgaccatggcgctggtcgagctgtcggtggaggaggcagaggaggccatccgtccctggagcggcaagctctggctgggcggactgaatgccccccggtcgcaggtgctgtcgggggcgccggaagcgctccaggaggcagtcgcggcgctggggcagcgcggtgtcttcacccgctgggtgaagatggacgtgccttcgcatacgccgttggtggaggtcatcagccgcgaactggagggccgcgtggcgcgcatctccccgcgtgccgcgcaggtgcccgtctgctccactgtgacgggtgagttcctggatggtacgaagctggacgccgcccactggggcaacaatctccgcctcccggtgcgcttcgaggcggcgacacggcggctcctggcgagcgagcactccgtgttcatcgaggtgagtccgcaccccgtgctgctcccggccgtcgagcagaccctgggcgccgcggacgcggagggcgtggtgctggcgtcccttcgccgtggagaggacgaacggcacacgatgctgtcctcgctcggcgccctctacgcgacgggccaccgcgttgcgtggaaccggctgtacccgagcaagggccagctcgtgccgctgcccacgtatccctggcagcgcgagcgcttctggatggagtccgtgtctcgtgcagcgcggacgtcgaggtccacctcggggcatccgctcatcggtgagcgcatcgacctgtccgcgcagggggatgtctcccggctgtggcaggtgcaactgggcccgaagcacttcccgctgctgtcggagcatcgcgtccagggtgtgcccgccttgcccgcggcggccatggccgacatggcgctgagcgcggccagacagacgctgggggcgcccgtatccctggaggaggtgagcttcagcgcgctcatggcgttcccggaggacgaggaacgggtgctccagttgtggctctccacggagcgttcaggtccgcacgcgttccggctcttcagcgcgcccgtgcttcgggagacgccgtcggatgagttgaactggacgctccacgcggaaggcacccttcgccagggcgactcggccatcgcggagcccgctggactggaggcgttgcgtgcgcggctgagtaccccggtgtcggtggatgcgcactaccagggccttcgcgacatcggcctggactatggccccagctaccgcgttatcacggagctctaccgcgcggagggtgaggcgctgggccgcgtgcagctcgcgggcgagcggacggcagaggacgcccggtacagcctgcaccccgcgttgctcgacggttgcttccaggtcctggcggcggcgttgggaggcgtggacggcgaaggcggcgtgtatgtcccttcgtccttctcccggctgcgcgccctggctccggcggaggccgcgctctggagtcacgtccgcatcgtcaatggggccgcttcgggggcgagcgccatcgagtgcgacgtcaccctcctggatgaccagggacgggtggtggcggaggtgcagcggctggtctgcaagaaggtctccgcgggcagccagcccgtcgatgacgtggaccgctggacgtactccgtccagtggcagccgcagcctcgcgtggctcgggaggatgccgtggctgggcggggtgcgggccggtggctcgtcttcgcggatgcgcgtggcgtcggacagtccttggcccggcagctcgcggagcacgccgaggtcagcgtcgtggtggaggcgggggctgcctacgcgcggctctccgaagaccactatcgcgtcaacccgtcgcgcctggaggacttccaggcgctcctccgagacgccttcagcgagcagtcgccgtgcaagggcatggtgcacctgtacgggctcgacgtggcgtccagcgtggcggagccagagaccttcgagcaggccgtgacgctgagcgggaccagcgtcgtgtccctgctccaggcgtgggcccagcggggctggcgcgacgcaccgcgcctgtggctggtgacgtcgggtctgcacgtcctcgcccgggattcggcgccgggtgctccggcggctgctcctctcgcgggcctcgcgtcagtcatcacccatgagcacccggagcttcgctgcgctcatgtggacctgagcgcgcagccgtcccccgaggaagtcacgtcgctggccgcggaactcctcgcggacagcgcggaggaccggattgcgctgcgcggcggtcagcgccacgtcgcccggttgggtcggggtgtcgctggtgggaaggcggcggagccccgtgaactctcggcggaggggacgtacctcatcaccggcggcctgggcgggctcgggctggaagtggcgaagtggctcattcaacggggcgcccggcacctggcgctcaccggccggagcgcgcctaccgacgaggcgaaccggacgctgggcgaactccggacgagcggcgccgatgtgcgcgtctacgcggcggacgtcacccgcgccgacgacgtgacgcgcctgctggcttcgatggatgcggagctgccgccgctgcgcggcatcgtccacgcggcgggtgtcatcgccgacggtgtgctcgcgcagctcgacgcggagcggttccgcacggtgctggcgccgaaggtccagggcgcgtggaatctgcatgcccagacgctgggccgtccgttggacttcttcgtgatgttctcttccgccgcgtcgatgctcggctcgccgggacagggcaactacgcggcggccaacgccttcatggatgtgctcgcgcaccaccggcgtgcggcgggactcccagcgttgagcgtcaactggggcccttgggccgacgtgggcctggccgcggtggcgacgaaccggggcgaccgcctggccttgcgcggcgtgggcaacatgccgccagcgcaagccctggatgcgttggggcgcctgctggcgaaggaggccgcgcaggtggccgtggtgccgctcgacctgcggcagtggcgcgagttctacctgagcgcggcgcagtcgcccttcctctccgcgctgatgcaggagcgggtgagcacgccggcttcgcgcaaggggaccgcgcgggagatgctcgcggcggcggagccttcccagcggcggggattgctggagggctacctgcgtgagcaactgggacgcatcctccgcatggagccggcgcgcatcgaccccgagcagctttag

SEQ ID NO: 7564 - DNA, 300 bp, Myxococcus xanthus
atggacaagccccgcgccacctatccggcggccgtgttcgtgggttgtcaggacgcgacggtgcgctaccgctacaagggcatggaccgtaagtcggcctaccggaccctggggcgggagctggtgcgcagctacttcgacaccctggtgggcaaggtggtgggaattgccctcaaggtggccggacccgagcgcgccatgaagcgcgtgtcgctgagcttcagctccgtcttctccccggtggacatccaggtggaatccctggggccggcggattggcgcgtccttagagcacacgaa

SEQ ID NO: 7565 - DNA, 1194 bp, Myxococcus xanthus
gaggtgagcacccgccacgccgaggagcatcaggccttcgccgtgcgcaaggagcaggagcgcggcgagctgacccgcgcacgcgcggccctgttgcacggccgtcccacggtggaggtccgcgccgagctccaggcacggctggaggccacggagtcggccttcgagcaggcacgtgagcgcgcggaagcggcgcgtcaggcggcgcaggtcgccaccgcgcgtgccgaggatgccgtgcgcgccaggacggaggcgctggccctgcgtgagtcggaaggcgccgcgctgacaacgctgctcgccgcgcatgggaccacgctggaggccgtgcggacgctgctggcattcgacgcggcctggcgcgaagcagaggctcgcgcactgtcggccctgcgcgaggcgctcgcccaggcgaccgccgtgctggcggagcgaagcgagcgtcgcgcgcggcacgaggactccggtcctccgtcactctccgagcaggacgcgggcgccgaatgcgagcggctgcgcgcggaggtcgaggcccgtcgtcatgccgaggccgcgctgcacgcgcgcctggtggccgacgacacggcgcgggcgcggcatggcgccgaggccgcggccctggaggagggccgccgcgcggcggaggtgtggaaggtgctgggcgacctcatcggctcgcacgacggcaagcgcttcaaggtcttcgcccagagcctcacgctggacgccttgctgctgcacgccaacgcgcacttgcgggagctcgcgcggcgctaccggctgatgcgcgttcccggacacgacctggacctccaaatcgtggacggggacatgggcgacgaggtccgcagcgtggccagcctgtccggcggtgagagtttcctggtgtccctggcgctcgcgttggggctggcgtccctttcgtcggagacgacgcaagtggagacgctcttcatcgacgagggcttcggcacgctggacccggagacgctggaggtggccctggccacgctggacgcgctccaggccacgggccggcaggtgggcatcatctcgcacgtcagcggcatggcggagcgcatcggcgtgcaggtgcgcgtggtgaagcagggcggcgggcgcagccggctggtggtggagggcgacccgggcatggtgcctccttccatgggacagcaggaggtggcgtag

SEQ ID NO: 7566 - DNA, 644 bp, Myxococcus xanthus
atgcgcaactccctgatgcggtatttcacctgcgcgttgctggcagcgtcgttgctgactggctgcggcggtgggaaagaccctgaccccaatccacaaccggacaccgatgctggccccggcggcaacggggacggcggtacggatgccggcccaattgaagaagacgcgggcgtgattccggatccggacccagacccgggtttggtgcccacggatatcgatgaccctgacaactcgacgaaggactccgactgtgacggcctgacggacgcggaggagttcgcgaccatctatcccggcggcgcgaagacgaaccccggcctgcgcgacacggatggcgacggcatccgcgacggcgtggaggtgggccgcacctcgagccccgacccccgctgcaacttccccggtgaccaggacacgaccacgcgcacctcgccggtgttggcggacacggacggcgacggcatcccggatggcctggaggacctcaaccgcaacggccggagggaccctggcgagactgacccaaacgccatcgactcggatggtgaccgcctgtcagacggtgcggatgacgccaaccgcaacggtgtggtgagccctggtgagacggacccgcgcaagcgcgacacggatggcga

SEQ ID NO: 7567 - DNA, 924 bp, Myxococcus xanthus
atggagaacgtgcgggaaatctggcctcgcgaccatggccgcttccagctgctgtcccggctgggacgcggcggcatggcggaggtgtttctcgcgcggatgcagcagggcccacatgccggagcgcaggtggccctcaagcgcgtgcgtcccgagcgcctgagagacgcggaggcccacgagcagctcctgcacgaagccgagctcgctcgctgcctgcgccacccgtacatcgtcggcttcgtggagtacggcgagctgccggacggtggctacctggcgctggagctggtggaaggccccgacctgggccgcgtgctggcgcggtgccgccgccgccgcatcgagctgcccatcgacatctccgtgctcatcgtccggcaggtgctggaggccctgtcgcacgcgcaccatgccgtcagcaccacgggccgccccctgggcgtggtgcactgcgacgtgtccccgcacaacgtgctgctgtcccgcaccggtgaggtgaagctggcggacttcggcgtggcgcgctcccgcgcgggcgcggtgcaggacatccggcggctgggcaagcagcactaccgctccccggaactgctcgcgggcgacgtgtccgtggcggtggacctgtgggcgacggcggtgctgctctacgaactgctggcgctggagtcgcccttcccttccggcccggaggagcaggtggagtcctccatccgcggcggccgggtgactcccgtgcgcatgcgtgtgcccggcgtccccgacgcgctggcgctggtgctggaccgcgcgctggcgcccgtcccttcgcagcgcttcggctccgcggagcagttcgcccgggccctggcgccgctgagcgatgaccgcgtggccacgcccctggccgtggccgcggtggtgcgcgggctgatggagacctga

SEQ ID NO: 7568 - DNA, 282 bp, Myxococcus xanthus
atggagttccggaccgagttggacttcgtgcgtgagcacgccctcaacatctccaacggcggcctcttcgtgcgcaccgcgcaccggcccctgcccgacagcgtcgtcaccgtggacgtgaagctgcccaacggcgaacgcctgcagggcgacgcggtggtggtccacgtggtggacgacccgtacacgggcggcgtgggcctggcgttcctcaatgacgacgccaccttctcccagacgctggacgactacctggcgagcctcgcgggtggcgtgggctga

SEQ ID NO: 7569 - DNA, 717 bp, Myxococcus xanthus
atgcttgagagcgctgcgccggatgacgcgcttcggcgcgcccaaaccgctcaccgaccaggagacatcacgatgatgaccgtcagcgcgttcaagtgggttccgccgttcgcacagggcctggtgcgggacctccgggtgcggtgggcgctcgaggaggcggggttgccgtatcaggtgaagctcatcgacaacacagtccaggcctcgcccgactaccgcaagctccagcctttcggccaggtgccggtgctggaggaggacggcctcgtcctctttgaatcaggcgccatcgtgctccacatcgccaacaagtgtgaggcgctgctgccggcggactcggcgggcagggctcgcgcggtgacgtggctcttcgcggcgctcaactccatcgaaatcgtgattcagccgctcgccgaggtggaccttttcttcgcccaggaggagtgggcgaagctgcgcaggccgggcgtggtggagtcgctgaaggagcgcctgggagaactcgcggcgcatctgggtgagcgcgagtacctggaagactgcttcacggcgggcgacctgatgatggcgacggtgctccgcatcctccggcacacggacgtgctcgacggctttcccacgctgaaggcgtacaaggaacgctgtgaggcccggcccgccttccagcgcgccctggcggcccagatggcgccgttccagcagcctcgcgcttga

SEQ ID NO: 7570 - DNA, 834 bp, Myxococcus xanthus
cgcggcttttgttccgggggctggcccctggcgctgccccgggggccccaccgggggctcgtgggggaggtccgtgccacgtccgcgggcagcgcgctggagctgcatgacttccgtgcgtaccagcccggggatgacctgcggcaggtggactggaacgcggtggcacgcacgggggagctcgtgctgcgtatccgccaggacgaggtgtcgccgcgcgtggaggtcgtgctggatggctcgcgctccatggcgctgtcctcgcgcaaggccgcttgcgcgcgggaagtggcgctgctgacggcggaggtggcggcgcggcagggactgacaccgacgttgctggtggccggtgcccggccggagcgtgctcagggacaggcgtgccgggcggccttggaagcggcggacttcgacgcgcgggacgggctgccggagtcgctggggcgcctgccgccgctgcggccgtgtgggctgcgcgtggtggtgagtgacttcctcttcgaagcggacctgccggcgatgtgcgcgcggctggcgcgtggcgcgtcgggcctcttcctggcgcaggtgctggacgccgaggacctggaccccgcgggtggagatggcgcccggctggtggattcagagagcggcgcggcgctggaggaattgctgacggatgaggtgctggccgtgtacacgcgccgcttcgcggagcatcagcgcggcttgaggggcgcggccttgcgtgctcgcggggcgctgctcaccgctcgggctcaggacgggctgggcgcgttggtggcggggccgctgcggcctctgttcctcgcggcgggtgcgtcgtga

SEQ ID NO: 7571 - DNA, 732 bp, Myxococcus xanthus
atgacgtgggaggagttccgggcctcggtgtacgaggatcccgagggtaagctgattttcgacggcgacatggcgctggacagcgaggaggagctgcgcgccttcttcgacaaccacgtcgcggcggagacgggcaccagccggggcggcctggccgtctacaatacgagccccaccaaggccctcagcggggacgtgaagtggagcgccacccaggcgcgtaacctcacgtactgcgtcagcagcaccttctccggcaacaaggcgcgcgtggtgacggcgatgaacagcgccacggcggcctgggaggccaccgcgaacgtcaacttcacccacgtgaccgcgcaggatggggcctgcaccgcttcgaacaacaacgtgctcttcgacgtgcgtccggtgaactcgggcggccagtacctggcgcgcgccttcttcccgaactcggggcgctcgggccgcaacgtgctggtggacaacaccgccttcggccccatctcgccctggacgctggagggcatcatgcgccacgagctgggccacgtgctgggcttccgtcacgagcacacccgctccacgggcagctgcttcgaggacaacgcgtggcgcgccctgacgtcgacgtatgaccgcgcgtccgtcatgcactacccgcagtgcgctggcacccagacgggggacctggtgctcaccaccctggacaagcagggcgctcgcgcgctgtacccgtag

SEQ ID NO: 7572 - DNA, 1491 bp, Myxococcus xanthus
atgtccgcgcgtgggccggacggtgtgacggtgttggagcaggtgcggcgcgaggcggcggcgcgggtggagtcggaggaggcgacgcaggtgacgctgctggccagtggcggcacgccgcgcatgctcgcggggccagaggcggagccttctcgggcgttggccgcgctggagtccttccaggcgcagggcgcggaccatgacccgatgcccacgctcatctgggcgcaggaattggcgggggcgggacggcgcgtggccttcttcacggatgttcctccagtgaacgcggccctggtgcccgcgtccgtgcggtggacggcgctgggggccgcgcgaggcaacgtggcgctggtctccgcacagcggcgcgatgaggggcccacggccacggtgacgctgagggtggcgcgtttcggggaggcgccggaggaggtggatgttcgggtccgcgcgttgccaggggccggtgcgaaggccggcacggagcgggtggaacgcgtgcagctgccggaggagggcaccgcgacggtccggctgacgttccaggaagcgggcgatgtggaggtgtcgcttcctgacgacgcgttgcccgaggacggccaggtgcggctgccgcccgcgcccatgcggcccatcgcggtggcgttggcgcagggactgggcgctcccgagcagaccgcgctggagcggttcctcgcggtatcgccggaggtggcgcgcggagtggagggctcggcgatggacgtggtgttggtgctgggcccgccggggacggatgcgcgggtgacggtgggggcgggcggctcgccgcgcacgttcgtggggccgttcttctccgagaaggggcacccgctgctggatgacgtgcagttggcgggcgtgcggtggacggcgggggacaatccgcctggaaagccactggtgagcgccggggacgcggtgctggtgtccgaggaggcggacggccgggttcacgtcaacgtggacctgtcgcgttcgaacgtgcagcgcgtgtccgcgtggccggtgctgctgagcaatctggtgcgcgaggcccgccgcacgcgggagggttttcctcggcggcagttgatgctgggcgagccgctgccagtggtgactctcgcgggtgcgcgttacgcgctcgtggggccgggtggcagccggccggtgtttggcgcgggcgaggtgacgctgtcacctcccaccgggcctggggcctattcgctggagcgtgacggcgacgtggtggacacggcgcaggtgctggcactggacgcccgggagtcggacctgcgtgagcgcgggcgcgcggaggtgccggcacgtgaggccggcgacgacgacgcgggaggcaacgcgccgggccgggcccgatggcctctggttcttctgctcgccgcgctggtggcggacttctacctcacgcggcgagagccgccgggcgcttcaggggcgagtgcgccaagtaccgggggcgcgtcatga

SEQ ID NO: 7573 - DNA, 2355 bp, Myxococcus xanthus
atgaccttctccctcccgcaggcgtgggtgctgctgctgccgctgggcctcttcctctggaagtacggccgccggccgggcccgcccatgtggctgcgcgccgcgctgctggtgctcgtcgtcggcgcgctctcgggccccgagctgcgatgggccgatgctggcagtgacgtcgtcgtggtggtggaccgctccgcgtccatgcctcgcgacgtggaccgcacggcccaggaactcattaccctcctggagtcgcagcgccgtcccggggaccgcgtgggggtcatcaccttcggccgggaagcgcgcgtggagcagcccctcgccaccctcggaggctttggcggtttcacgcgccccgtggacgcggaggcttccgacctgtccgccgcgttggatgtcgcgagcgccctcatccccgacgagcgcactggccgcgtgctggtgctgtccgatggccgcgccacgggcgtggatgcgcgcggcgccgcgcggcgactggcggcccggggcctctccgtggactggcgccacatcgctcgccccgaaccgccgcttgatgtggccgtcgtctccgtggacgtccccgccgccgtctccgagcgcgagcccttccagttctccgccgtggtgcatgcctccgccgccgtcaccggcaccgtccgcctggagcgcaatggccgcgtgctcctccaggggcccttcgacttccagccgggccccaacgtgctgccgctgcgcgacctggtcgaggagcccggcctggtccgttaccggctctccgtggctgctcccggcgacggcgttgtggagaacgaccagggcgtcgccgtgctgcgcgtggaaggcccgccccgggtgttgctgctcacgaaccagtcccggggcacgctcgcgcagtcgctcgccgcttcggggttgcaactcgacgtgcgcacgccgttccgcctcacgttggatgacctggatggcgtgggcaccgtggtgttggagaacgtggacgccaatgcgctcggcgagccggggctcaacgcgctggcggcctacgtcgagcaggccggaggcgggctggtgatgaccggcggacgcaacagcttcggcgagggcggcttccgtcgctcgcccgtggagccgctgctcccggtgtccctggagatgcgcgaggagcagcgccgcgcgtccctggcgctgagcgtgttgatggatgcttcctgctccatggggatgaccgtcccggatgggcggacgaagatggagctggccgccgagggcgtcgtggccgcgctgacgctgctcaaccccaaggacgaggtctccgtgcacatggtggacacggcggcccatgaaatcttcccgctcagcccggtggaggcggggttgcccctggatgccgtcgcgcgcggattcagcggtgggggtggcatctacgtgggcgaggcgctccgcgccggccgcacggaaatcctccgcagcgagaagcccacgcgccacgtcctcctgttctccgacgcagcggactccgaggagcccgatgactaccagcgcacgctggcccacttgcgcgagcaggaagtgacagtgtccgtcatcgggctgggcgtgccctcggacccggacgcggacctgctccgggaagtggcccaccggggcggcgggcgcgtctacttcgccgaggacgcgatgagcctgccgcgcatcttcagccaggagacgctcaccgtggcgcgcgccaccttcgtggatgagcccgcgtcgctggaaggggcgccggacctgccgctgctcggccggctgtccgcggacgggctgccccaggtgggcggctacaacctcacctacctcaagccccgcgccaacgtggcgctgcgcaccctggacacgaatggcgcgcccatcctggcgatgtggccgcgaggcgcgggacgcacggtggccttcaccgcggaggtggacgggccgtacaccggcgagctgcgaacgtggtcctccctgcgcgcggccctggaggggatggtgcgctggacgctggcgggcgcggcgcccgtcggggacgcggtggtgcggaccgagcggagggggcacctgctgcgcgtgacgctggacctgcctccgggcgaggcgctgcccggcgtggtaccgacgatggtgctcctgcccggcgacggacgcgccgcgccggtggagcgtccgatgcggtgggaggatgaagaccggctcgtcgccgagtacccgctggagggcagtggaacgtggcacccggtggtacggttgggcgcgaaggtgctccgcgcgccgcccgtcacgctgccctatgcgccggagttcgagcccggctccgcgaaggcgggactggag

SEQ ID NO: 7574 - DNA, 729 bp, Myxococcus xanthus
atggatgactcggaggacagcccgtttgacggcaccttcggcctggaggccttcgcggaggaggcacccagcgaggacctcgagagcttcgcctccagtgccagcccgcacgtgggcatcggctcggatgattcgctggagggcttcgacctgccgccccccatgccgcgccccgcggagcccgaggaggagccggggcgcgtggtccgcgaagaggacctcaaccggcccgaacgcatgggacgtctcaaggacgccatgctccagatttgcgaagccctggcctacatccacggccacggcctggttcaccgcgacctcaagccgtccaacatcatggtggacgatgaccggcaggtccggctgatggacttcgggctcgccaagttcctggcggacgacgcggccatcaccgaggccggcaagctggtgggcacctaccggtacatggcgccggagcagattctgggcgagcccctggatggacgcgccgacctgtacagcctgggggtcatcctctatgagctgctcagcgggcggccccccttcgacgcgaagacgccgcacgagctctggcgccaggtgctggagacggagccgccccccgtgctggcgctgaaccttcatggggacccgcagctcgcgcgcgtcgcccaccgcctcatccgcaaggagccggacgaccggttccagacggccgaggaagtctacgaggccctgtccgagtga

SEQ ID NO: 7575 - DNA, 1209 bp, Myxococcus xanthus
atgcgagccatcatccatgtggacatggatgccttctatgcatccgtggagcagcgggacaacccggccctgcggggcaagccgctcatcgtgggcgggcatgcccagcgcggtgtcgtggtcgccgcctcctacgaggtgcgcccgttcggcgtgcgcagcgccatgcccatggcccgtgcgacgaaggccgcgccccatgcgctcgtcgtgaagccccgcttcgccgcctatgccgaggccagtgagcaggtgttcgccatcttcgaacgctacacgccgctcatcgagccgctgtcgctcgacgaggccttcctggacgtgacggcgtcggtgggcctcttcggcacgcccgcggacatcgcccggcgcatccgcaaggagattgccgacgagttgaacctccccgcctccgcgggcgtggccacggcgaagttcgtggcgaagattgcctccgacctcgccaagcccaatggccagcgggaggtgcgcgccgaggagacggtggccttcctcgcgggcctgccggtgtcgcgcctgtggggcgtggggccgaagacggaggaggcgctccggctcgccgggttgaagacgattggcgacgtggcgtcccgggatttggagtggctggaagacaggctgggctccagcggacggcacctgtgggagctgtcccagggcatcgacacgcgcgaggtggtgccggaccgggccgccaagagcgtgggcgcggaggacaccttcgacgaagacctcgtgggggtggacgcgctcaagccgcacgtccacgcccaggccctgcgcgtggcccggcggctgcggcgggcggcgctgaagggccgcgtggtgcagctcaaattgaagttcgcggacttcacactcatcacccgtcgaaccacgctgcgcgaggccacggatgacgggcagacgctctaccgcgcggcgctggagctgctggacaagtcgcaccagggcaagccgctgcggctcaccggcgtcagcgtgcagttggacgaggagccgccccagttgggcctcttccccgccgccgcgccgcgcaccgcgaagctgaacgcggcgctggacaagattgccgagcggtttggcagcaaggccatcaccaccgcggacatcgccggcagcgaggccaccgacagcgccgaacaccgctccgagcgcccggtggacaagggcgggcccaaggactga

SEQ ID NO: 7576 - DNA, 792 bp, Myxococcus xanthus
atggcggaggtcttcctggcgaaggccgcggggccacgcggcttcgagaagacgcttgtgctcaagcgcatccttccgcacctggcggaggacgcggcctttgtagagatgttcctgggcgaggcgcggctggcggcgcagctcgagcacccgaacatcgtgcaaattttcgacttcggtgaggccgagggcagcttcttcctggccatggagttcattgacggcccgaacctgcgcaagctggtgaagcgggccgcagaggaagcgctgccccccgccttctgcgcgaaggtggtggcggccgcggcggaggggttggcgtacgcgcacgagttccgtgacgtggagacgggcgagccgctgggcttgattcatcgcgacgtgagcccggacaacatcctggtgtcgcggcagggcgcggtgaaggtggtggacttcggcatcgcgaaggtggcggggcaggggcaccggacgctgacgggcgtggtgaagggcaaggtggcgtacatgccgcccgagcagctccaggcgaaggccatggatcggcgggtggatgtctacgcgctcggggtggtgctgtacgaactgctcacggggaagcggccgttcgatgcgacgacggacgtgagcgtgatgcaggcgattctgttcgagtcgttcatcccggtgtcggcgcggcggccggatgtgcccgtggcgttgcagcaggtgctcgacaaggcgctcgcgaaggaccgggagcggcggtacgcggactgccgggcgttgcaggacgacctggagcggttcgtg

SEQ ID NO: 7577 - DNA, 414 bp, Myxococcus xanthus
atgaagagcctgacggagtacctgtggttcgagacacctcggcggcgggagttggtccgtctcaccgacaccgtgacggccctggtgcgcaagagtggcatccaggagggaatggtcctcgtctccgccatgcacatcaccgcgggcgtcttcgtcaatgacgacgagcccggtctccatgaagacatctgggagtggctccagcacctggcgcccgccggtcccgactaccgccaccaccgcacgggcgaggacaacggcgacgcccacctcaagtcactgctggtccaccaccaggtcatcatccccgtcacgggcgggaagctggacctggggccctggcagcaggtgttctacgccgagttcgacggccagcgccgaaagcgcgtcatcgtcaaggtgatgggcgaatag

SEQ ID NO: 7578 - DNA, 1500 bp, Myxococcus xanthus
ggcctggacgacgccgtcctgggcgccgccgaggccgcgctggccgccgccgaggccgaggacgccgccgaggcccggggcgaggacgccgaggaagtccccatcgtcctggagcccgaaccggagccgacgcccgatgagcgcgcgctgcacgcgccccatgtccggcccagcggcgagccggcggaaatcgaccccgatgagctggacccggacgccctcaaggtggtgctccgcctgcaccagcacggccatcaggcgtacatggtgggcggctgcgtgcgtgacctgctgctggggcgcaagccgaaggacttcgacatcgccaccagcgcgacgccgaacgaggtgcgcggcatcttccgcaactgccgcctgattggccggcgcttccggctggcgcacgtctacttcaaaggcgggaagatcatcgaggtctccaccttccgtgcgaatccgacggagctggagcacgcggccaacggcggtgaggatgagggggacggtgaggacctgctcatcacccacgacaacgtcttcggcaccgcgcagcaggacgcgcgccgccgtgacttcaccatcaacggcctgttctacgacgtggccgaagggcgggtcatcgattacgtccggggccgccgtgacctggatgagcgcttcatccgcaccattggcgacccggaagtgcgcatgcgcgaggacccggtgcgcatcctgcgcgcggtgcgcttcgcggcgaagctgggcctggacatcgagtcgcggacgtacgcggccatggaaggcgcggtggaggacctgccccgctgcgcgcccgcgcgcctgctggaggagacgttccgcctcatccgcggcggtgtgtccgcgccggcgctgaagctgctggacgcgctggacgcgctcaaaatcctcctgccgcccgtcaacgcgtacctcaagcagcacggcaaggaaggggagaagacgttctacgccttcgcggagtcgctggaccggcgcgtgtccgcgggcgaggcgctggacgacgccatcctcctggcgatgttgctgattcccatcagccgctcgacggggcccgaggagtcgcaggagggccgcccgtccgtgtcgcaggtggtggaagacctgctcgcgggcttcgtccagtccgcgcgtctaccgcgccgcatcgccgagcgttgccgcatgctgctgctggcccagcgcaccctgtccggtgagcgccgtcgtcgcagcgcggccttcaagcggcacccgctcttcagcgaggccctcaccgtgttcgagatgacggtggaggccacgggcgagaatcgcgagcagttggaggcgtggaaggccggcgaggtgccgcagccgcgtgccgccgccgcggacggcgaggagtccgacgcgggaggccagcgcaagcgccgccgccgccgccgccgccgccgtccctcggcgaacggctcgtccggtgagagcgccgattcgtcctccgagtcgggcgacgcctga

SEQ ID NO: 7579 - DNA, 1023 bp, Myxococcus xanthus
cccgagacgatgcgagcgctggtcctcaccgcctatgacggacggccggagtccctgcgcgtggaatcacggccggtgcctcggcccaccacgggccaggtcctggtgcgcgtggcggcggcacccatcaacccggcggacctgatgttcgtgcgtgggcagtacggcatccgcaagccgctgcccgtggtgccgggcctggaggccagcgggacggtggtggcctcgggcggcgtcgcgggccgactcctggtggggcgccgcgtggcgtgtgtggcgcccggcgagggggacggcttatgggcggagtacgcggcggtgcccctggggcagtgcctgccgctgcggggccaggtctccgacgagcagggcgccagcctcttcatcaatcccttcaccgcgtgggtgttgatggagcgtgcgaaggagggggggcacaccgcgctggcgcagacggccgccgcgggcaccatgggacggatgctgctggcgctcgcgaagcgacgcggcgtggccatggtgaacgtggtgcggcgcccggagcaggtgtccctgcttcaggacctgggcgcggagtatgtgctgagcacccacgagcccgaattcgaggagcggctgctccgcgtttgtcacgagctgaaggtgtcgctcgccttcgacccggtgggcggacggctcaccgggcagttgctccacgcgctgccggagggcggcaccgtcatcgtgtatggctcgctctccgaacaggagtgccgcatcgcgcccagcgacctcatcttcgggcgcaagcgggtggagggcttctggctgtcggagtggcaccgccagggctttggcgccgcgcaaatcaaggcgctgatgggcgtgccgtcgctggtggggcagacgctggagacgcccgtgcgcgcccggctcccgctggagtcagcgggcgaggcgctgcgcatcgcctccgcggacatgacgtccggcaaggtgctcttcgttcccgcgcagggacaggcaccgggcgaatcactgtga

SEQ ID NO: 7580 - DNA, 324 bp, Myxococcus xanthus
atgacgcgcgtcggggtacccctgccgttggcgtggctcgtccccgctgccgtcgtgctcgggtgtgcacgaggcgacaagtgggaccgcgtgctgctcgggggtctgggagtactcctcaccgcgctgccctatgccctgggcatggcccctggatggacggtggcgttcagcgcggcggcggcgggggcgctgctggtgcgctcgcgactcagtgagcgcggagagaatggccaggtggcggaagcgcgccccaccctcttccacttcggactgggcgcggcgctgtgcgcgggattgacgctgggcggcatggaggtgtcc

SEQ ID NO: 7581 - DNA, 474 bp, Myxococcus xanthus
aagacgaacagcgcccgactcctggactcgctcggcgtgaagtacgcgctgcgcgactacgacgtggacctggaggatttgtccgcggagtcggtggcggccaaggtgggcatgcccgccgagcaggtcttcaagacgctggtggcgcgcggcgaccgcaccggcgtgttgatggcggtggtgcccggcaacgcggagctggacctgaaggccctggcccggctcagcggagaccgcaaggtggacaccgtgccgctcaaggagctccagccgctcaccggattcatccggggcggctgcacggccatcggcggcaagaaggactatcccgtgtacgtcgacgagacgatggagttgttcgacgccatcgccgtgtccgcgggtgtgcgtggcacgcagctcgtgctcgcgcccgcggactacctgcgcgtgacgaaggcgaagacgggccccatctcccgcgacaaggcctga

SEQ ID NO: 7582 - DNA, 1863 bp, Myxococcus xanthus
cccatgggtccagcggatgagtctcgggcagcgcggtcgaaggcccctctcttgggggcgtgggtggaggcgggtgagcgggtgcggtggcgtgtctgggcgcccggccaccagcgcgtggaggtggtgctgcacgacgcgcaaggcaatccgggccgcgtcttgccgatgacgccggagcccggcgactgcttcggtgcggtgctggaagggcagggcgcggggcttcgctacaagctgcgcgtggatggcgaaggccccttcccggacccgtggtcgcgttcgcagccccagggcgtgcatgggccgtccgaagtggtggtgcccgacttcgcctggacggacgcgggctggaagggcgtggcgccgcaggcgctggtcatctacgaggtgcacgtgggcacggccacgcccgaaggcaccttcgagtcgctcatcccgcgtctggccggcctcaaggagctgggcatcaccgcgctggagctgatgccggtggcgtccttcccgggacgccgcaactggggctacgacggcgtgagcctgttcgcgccccagcaggcctacggcggtccggaggggctgcgccggttggtggacgccgcgcacgcgcacgggctcgcggtgctgatggacgccgtctacaaccacttcggaccggatgggaattacctgcgggtgtattcgccgcactacttcaccggccgccaccacacgccgtggggcgacgcggtgaactacgacggcgaaggcagcgcccacgcgcggacccaggtgctggccaacgtggagatgtggattgctgactaccacctggacggcctgcgcctggacgccgcgcacgccatcatcgacgacggcacgccgcacctgctcaccgaggtcgccgagcgggcgcgggcctgcgcgccgggccggaaggtgcatgtcatcgccgaggacgagcgcaacgagcggcgcctgatgcgccccgcgtcggagggcggcctggggctggacggcgtgtgggcggatgacttccaccaccaactgcgccgcgccttcgcgggggacagcgacggctactaccaggactacacgggcaacacggaggacctggcgcgcacgctgaaccagggctggttctacgaagggcaggtgtcgaagaacctgggccatgcgcgaggcacgaaggcggatgggctggagccctggcgcttcgtccactgcatccagaaccatgaccaggtgggcaaccgtgccttcggcgagcggctggggcacgacgtgagccccgcggccttccgcgccatgagtggactgctgctgctgtctccctacacgcccatgctcttcatggggcaggagtggaacgccagcacgcccttcctctacttcaccgagcaccacgcggagctgggcaagctcgtcacggagggccggcgaaaggagttcgccgggttcgcgcgcttcgcgggcgcggaggtgccggacccgcaagcggacgacaccttcacccgctctcaactggactgggcggaggcggagcagccagggcatgcgggcgtgcgagcgctctaccgggagctgctccgtctgcgcgcatcggagcccgccctgcgcgagacggggcggggctcctatgcggcccgggccctggggccggacgcactggtgctcgaacggcgtgggggcggccagcgactgcaggtgttgctcagcctgcgcggcgcgctggattatccggtgcccgccggctcggcgctggtgctgtggactgaagacgcttgcttcggcggctccgaaaaattgcagccattgaagcaagacacggtgcggttgaagggttcggctctggctgtgataagacttcccgccaaagactga

SEQ ID NO: 7583 - DNA, 1143 bp, Myxococcus xanthus
atgagcccccgcgtggtgctgcccggcggcacgattggcatgctcggcggtggccagctggggcggatgatggccctggccgcgcgcacgctcggcttccaggttcaggcgttggacccggacgcggactgcccggcccactccgtggtggacctgtgtgttaccgcgtccttcggtgacacggcggccgcggagacgctggcgcgcgcgtgcgacaccgtgacgctcgaaatcgagaagattcccctccccacgctggaagcggtggcgcggcacacccccatgcgcccgggtgcggacgtgctccgcgtgattcagcaccggggccggcagaagggctggctcgccaaggggggctttcccctgggcccgtggcgcgaggcgcactccgccgcggagctggccgaagccatccaggcgctgggtggacgctgcttcgtgaagtccagtgagggcggctacgacgggcgcgggcaggtggaggtgacctccgcggacgaggccgcccaggcgtggcgcgagctgggtgagcgctccgtggtggtggaggccgcgctggcgctccagtccgagctgtccgtgctggtggcccgcagccccaatggagaagtggcggtgtatccgccagccttcaatcaccacgaggagcgcatcctcgcgtggtcgctgctgccggggccgctgccgcccgcggtgctggacacggccacggagctggcgcgcggcatcaccgagtcgctccaggtcgaaggcctgctcgtcatcgagctgttcctgctgaaggacggcagcgtgctcgtcaacgagctggcgccgcgcccgcacaacagcttccactccaccgaggtggcgtgcctcacctcccagttcgagcaggcggtgcgcgcggtgtgcaacctgccgctgggctccgtggaggtggtgcgtccagcggccatcgtcaacctgctgggcgacttgtggctgaaggacggcggccctcgcttccaggaggtgctggccatgcccggcgtccgcctgcacctgtacggcaagcgggaggcgcgcaagggccggaagatggggcacctgtccgcggtgggcagctcgcccgaggacgcgctcgctcgcgtgcaggccgccgccaccgcgctggggatgtga

SEQ ID NO: 7584 - DNA, 462 bp, Myxococcus xanthus
atgggcggtaggagcgacctggagcacctgcagcccgcggtcgacattctcaaggaactgggcatcccgcacgaggtgcgcgtggtgtccgctcaccgcaccccggactggatgatggagtacgcgtccaccgcggagtcgcgggggctgtccgtcatcatcgccgccgcgggcggcgcggcgcacctgccgggcatggtgtcgagcaagacgctgctgcccgtcattggcgtgcccatgcccaccacgctgctcagcggcctggacgcgctgctgtccatcgtccagatgcccaagggcgtgccggtgggaacgcaggccattggcaagccgggcgccgccaacgcggccctgcacgccgcggccatcctctgcctcaagtaccccgagctgcgcgagcggctcgcggcctggcgcaaggcgcgtacggacgaagtgctggcgcaccgggagctgtcatga

SEQ ID NO: 7585 - DNA, 546 bp, Myxococcus xanthus
aagcccgatgagaacgagaaggtgttcaccgggaacggcggcttccgcaccggtgacatgggctacctggatccggacgggtacctctacatcaccggccgcatcaaggagcagtacaagctggagaacggcaagtacgtggtgcccagccccatcgagcagtcgctggcgctctccacctacatcgccaacgcgttggtccacggcatgaacaagccgtacaacgtggccatcatcgtcgtggacgtggacacgctgaagaagtgggccacggagaagggcctggacacgacgtccatgccggagctgctcaaacgtcccgaggtgctccagctctaccgtgagcagttgaacgagttcacccgcgacgtgaagggctacgagcgcccgcagcgcttcctgctcatcagcgaggacttcaccgtcgccaacgacatgctcacccccaagatgagcgtgaagcgccgcaacgtcgtggcccgctacaacgacgccatcgaagccctctaccgcgagggcagcgaccgcaacgtctccgcggcctag

SEQ ID NO: 7586 - DNA, 2124 bp, Myxococcus xanthus
atgttcttcacgctggaggatgaccccagcccggcgctgcgccgcgccgtccaggaattgctggaactgcgcgagtccgagcgccgcgagccgcacggcgtcctggaggcctgcttcacggcggatggcacgacgttccgggcgcggcttctcgacgtggccacgggaggcctgggcctgcgcctggagtccagcgtgcgcatcgagcggctcacgccgggcacggagctgggagggctccaggtgctgcgcggcgacacgctggtgctgcgcgccggccatgccacggtgcgcatggtgcgcccgctgcgcgcgcacgaaggccagggcttccacctgggcgtgtcgctggagcgccccgtggagcacgcgcgctcgtccgccgcgccgctgctcaacgactcggtgcgcatccgcggcttgctgcgccgcgccgtgcgcgcgggggtgggcttcgggctgcgaacgcacgaaggcaaccggttggtggacttctcccgcgcggaggtgctgccggaggagtcccgcctggtgctgcgagagcagtcgcagccgggcacgctcttccatccaggagacgtggtgcggctgtgcctggacttcggtggcgtgtgccatgtgggcaccacggcggtgctggcctcggagccgaaccaggtggaggtggccctgccgcgcacgctgagcctgcaccaccgccgcaacagcctgcgcttccgctcctccgcggagcggcccttcgcggtgtccttcaattcgccgctgacgggggaggccatcgtccgcccgctgttggacctgcacaccggcggcttcgcctttcccttcgacgcgggccgggaggccttcccgccggggctggtgctggacgacgtgatgctgcagttgccagacggcacgcgctcgcgctgccgcgcccaggtgcaggacaccgggcagctcacggtgacggaggagggcgccagcatgagccgcccgcgccgctgcggcctgcgcatcctggagctggcgccggaggcccgcgccgccatcctggacgccttcatcaaggcacggtgtcccgatgcgcgtgatgcgtccgagctgcccttctccgacgtgtgggacttgttccgctccgcggacgtccgctttcccgactaccccttccacgagacggcgacgcccgagccgctggtggtcgcgcaccagcggctgggcaatggcatccacggcctgtccaaggccatcgtctatcagcgcgagggccggctctacggccacatctccgggctgcgcatctactcgcgcacctggctgtcgcagcacctggtggtgcggccgggctaccaccggcacgaatccatctcccaggaactggtggcgctcgcggccgactacgcggagagcctggacgacgtggagtacctgcgcgcgctgtggcgctgccgcaaccggtggacgtcgcgaatctacggcgccatcgccagccggttggagcgcccaggcctgagctgcctgcatgccttcacgccgtgccggctccccgtggacgccgcgttgccgccgcctcggagcgatttgcgcgtgcgccccgcggagacgtccgacctgcgctggctggaacagcacctgcgggagacgcaggacgtggtgcggctgcgcagctcggacctggtggagggcgagatgaccatggggacactgggcgggcgctactcggacgcgcggctgcggcgctcgcgcagcatctccgtggtcgagggcaaggacgggccccaggggttcgtcctcatggaggactcgtcgcccggtctcttctgggcggagtggtacaacgccttctcgctcgtcatggtggagccggatgcacgggaagcggatgccgtgcgccaggcgctggtgacacacgcggtggcgaactcggcccggcgcggccgctccaccgcggagtgcctggcctcggacgcggacctgcccgccctggaggcactgggtttccacaacctggtcaaggtgatggagttcacggcccacccccggctcgtgcgtgactggaatgcctacctgctcgccgtcttcgagcggctggcggcccatggccggggtggtagccggatggatgacaaggacatcgcggcatga

SEQ ID NO: 7587 - DNA, 789 bp, Myxococcus xanthus
atgacctacctgatggagtcggcccaggaggtgcaccgcctgcaagcgcaggcgagcgccacctcctacgcggagcggctgaggctcaccgggttgaggcccggggacgccgcactggatgtgggctgcggtcccggcgtcatcacctcggagatgctggacgtggtggggccgcacggccgcgtggtgggtatcgagccgcaggccgaacacctggcggcggcccggggactgctggcgggcaggcccaatgtggagctgcgtcagggcgcgctgccggatacacagctgcccgccgaccacttcgactacgtctggtgccagtacgtcttcgagtacctgggagagccgggccccgcgctggcggagctggtgcgcgtggtccgccctggtgggcgcgtggtggtggcggacatcgacggggtggggctgtggaactggccctttccggaggacctccaggaggcgagccagaagctgctcgccgccctgcgcgcagcgcgcttcgacctgcacgcgggccgcaagctgttccacctgttccgcaaggccgggttggtggacgtgcgcgtgcacatctccccgttctatgtggcggcgggtgcggtggacgcgcggctccgcgaggactgggtcatccgcttccggacgctgcgcccgctcgccgagcccttcttcgggggcgccggcccctatgacgctttctgtgaacgcttcctcgcactcctggacgacgccgacaccctcaaatatgcgatggtgttgacgaccgaaggagtgaagcgttga

SEQ ID NO: 7588 - DNA, 2847 bp, Myxococcus xanthus
atgctgcgcagcgtgatgttgtactacgagcggacctacggccgggaccggctggtgcgggtgtggcagcgcgaggagctgccgctgacgttggcgtacgtggagacgctcaccaacttcgtctccgtggggttcaccgagcggctcttcgacgtgctcgacaaggactccggtgatccggacttcatgacgaaggcggggcgcagcatcgccagtccggaggcggtgggcttcctctattacatgatgaaggcgctggccacgccgcgcagcgtctacgagcgcgcgctggagctggaccacacgtacaaccgcgtgggcggcttccacatcgacacgctcaccgactcgcgggtgcaggtgcgctacgtcagccgcatccgcgaaagagatcgcaacttctgccgcgcgcgccagggcaacctgtccgcgttccccgccatctggaacctgcccctggcggaggtgaaggagctgcgctgccaggtggatggggcggactgctgcgagtacgacatccgctggcagagtctgccgcccctggcgtggcgctacatcgtgggcggcatggcgggcatggtggccggcctggtgtcgggcacgttgaacctggcgccccccgtcttcgcggtcagctccctgggcatggtgggcgtggcggcgggggcgtggctgcacacgcgggcggccctgctgcgcaaggacgagaagctgtcggagcagcaccagggcctgcagacgtccctggaggacctgcagcggcgcaacgatgagatcttcgccgccaacaaggcgctcgaggaccgcgtggccgagcggacgcaggagctgtccgaggccaatacgaagttggaggcgtcgctcgcccggcagcaggagctggaccggctcaagagcgagttcttcgacaacgtcagccacgagctgcgcacgccgctcacgctcatcctgctgacgctggaggcgctggcgaaggaggcggagtcactgccgcccgaattgcctccgctggtgacgaacatggagcgcagcgcgcagcgcctgctgcggctcatcaacaacctgctggacctggcgcagttggagtcgggcaaggcgcggctgcgctaccagccgctggagctgttcggcttcctgagcacggtggtgccgccgttccacaccatggcggagcggcagggcgtgacgctgcggctggagggcgccacggtgacgcccgtccatgtggaccacgagcgcatcgaaatcgtcttccagaacctgctcggcaacgcgctgaagttcacccagaagggtggggtgacggtgcgcgtgcgcgaggacgactcggaggtgcacgtcgaggtggaggactccggccagggcatcgccccgcaggacatccccgtcatcttcgaccgcttctcccaggcggataacagcggcacccggcgctttggtggctcgggcatcggtctggcgctggtgaaggagacgctggagctgcacgccggcggcatctccgtgacgagcgagctggggcagggctccgtcttccacgtgcggctgcccaagggcaccgcgcacatccgcgaggatttgcgcgagcgccgtcaggccgtcatgcccgtgcggcgcgagcgccgcatctccggggccttcccctcgctggagccgacggggacggatgtcctgggcgcgtcgcctccgccggccagggaccacgcggggccagggcccgagtcgccccgcatcatggtggtggaggatgatccggagattcgaagcttcctcgcccggctgctggcccagcactaccgggtgatggaggccatcaacggcgacgacgggcgccagcgcgcgctgcgcgagcggccggacctcatcctgtcggacgtgatgatgcccgtcatgtccggcctgcagatgctgaccgccctgcgcaatgacccgcagacggtggacatccccgtcatcctcctcaccgcgcgccaggaggtgacggccaaggtggagggcctgggcaccggggccaatgactacctgggcaagcccttcagcccgaacgagctgctggcgcgcatcgaaacccagctgcgcctgcgcgaggcggccgtgcgcgccgcggagaacgagcggctggcggccatcggcctgctcacgtccggcttcgcgcatgaggtgcgcaatccgctcaacgggctgatgaacgcgctgctgccgctcaaggacatgctgacgggtggctctgccgacgtggagctgagcaaggccatgctggaggtggtggaggagtgtggccagcgcatccgccacctggccgaatccctgctctccttcacgcgcaccagcgagtccccggtggtgctgtccctggactcgtcgctggactccaccctgagcgtgctggcgtggaaggtgccgccgggcgtcaaggtggagcgcgcgtaccactgcagcgagcccatccggggcaatccaggcgccctgaaccaggtgtggctcaacctcctggacaacgccctgcgcgcggtgggcgacaagggccgcgtgcgcatctccacggccaacacggcggaggaggccatcgtcaccatcggtgatgacggggtgggcatccgcccggaggacatggagcggctcttccagcccttcttctccacccgcgcggcgggcgaggggacggggttggggttggcgctcagccgccgcatcatcatccagcacggtgggagcatcgccctgagcagtgttccaggggagggtacgcaggtggaggtccgcctgccgctgcgccccgtggcgccccgtgtcacgggaggcctgcccgacctcgcgtccgagccgcgtgtcggccgcctgggctga

SEQ ID NO: 7589 - DNA, 782 bp, Myxococcus xanthus
gggcacccgcgagggctctacctcctgttcttcactgagatgtgggaacgcatgtcgtattacggcatgcgtggcctgctcgtgctcttcctcacgagcaaggtcaacggaggatttggctggtccaccgcggacgcactcagcctctacggcacctatacgggcctggtgtacctgacgcccatcgccggcggcttcatcgcggaccgctacatggggcagcgccgggcggtggtgctcggtggcgtgttgatgatgataggccacctcatcctggccttgcccagcgtgacgatgttctacgcgggcctgggcttcctcatcatcggcaacggcttcttcaagccgaacatctccaccatggtgggcgggctgtacgcgcccggtgacggccgtcgcgacagcgccttcaccatcttctacatgggcatcaacctgggcgcggtgctcggcaacttcatctgcggcacgctgggtgagcgcgtgggctggcactggggcttcggcgccgccggcgtgggcatgctcctgggcctgatcgccttcgtgtcgatgcagaacaagctgctggggcaggtgggcctggtgccggagcggatggtggccgccgccgaggcgaagccgggcaccccggagaagtcgggcttcggccgcgatgaaatcgaccgcatcctcgtcatcttcatcatggcgctgttcgtcgtcgccttctggacggggttcgagcaggccggtggtttgatgaacctctacacgaacgcgaaggtggaccgcggcatcct

SEQ ID NO: 7590 - DNA, 264 bp, Myxococcus xanthus
atgcgcgccgaagtcgactacgcgaaggaaatccaggagttcaagcgttccatgaacgcagtcatcctggcgcactattaccaggagagcgaagttcaggacctcgcggatttcgtgggagacagcctggcgctggcgcaagccgcggcgagcacgaaggcagacgtcatcgtcttctgtggcgtccatttcatggcggagacggcgaagattctcaatccgtcccggcaggtgctgttgccggacctcaaggcgggctgttag

SEQ ID NO: 7591 - DNA, 408 bp, Myxococcus xanthus
atggacgcgcagggcaccgcggccatggccgtgggcgcgcgcgacctcgggttcggcgtgggcttcctcaagaagcagacgcggcaggcgaagctgaagctcctgtccgcgaacctcgcggacgcgcagggcaagctgctgttccccgcctcgttggtgacgacggtgggcggcgtgaaggtgggcgtggtgggcgtctctcccgccatggccaaacccaccccggtggggctcgccgttccgggccaggcccatgagcaggtgcagggcctgccggtgcagcccgcagtggccgccgaggcgaagcgcctgcgtgagaagtcgaaggtggaccctgtggtggtgctcgccgcggtgcctcacgcggaggcgctccagctggctgaccaagtggagggcgtggacttc

SEQ ID NO: 7592 - DNA, 135 bp, Myxococcus xanthus
atgaaggaggagtcgcggctggcgctggaggaactcatcaagagctacccgaagtccgtcgaggcgaagacggccaaggagcgcatcgccgagctggacaagaaggcggcgcccgccaagaagggcaagaagtga

SEQ ID NO: 7593 - DNA, 1221 bp, Myxococcus xanthus
gccagctcctatgacgctcccacccctccctcgatggcggtggacggcaacaaggccacgcgctggtcggcctcgggcgcgggccagtggattcgcggcgacatggggtcggtgaagccgctgaacggcctggacatcgcctggttccgtggcaacgagcgcatcaacctcttcgacatcgccacgtcgacggacgggaccacgttcacccgcgtcttcgtgggcatctcctccgggaagtcggctgacttcgagcgcgtcaccttccccacggtgaacgcccgctacgtgcgcgtcaccttctacggcagcacccagacgacctggggcagcatcacggacatggcggccctctccggcgccaccatcccggacccggagccggagaatccggacccggagaatccggacccggagaatccggaccccggcccgggctccacgcaggacaagttcggcgtgacgatgctctacccgaccaagtcgggcggtgagcagtggttcctggcggacaacgcgacgtcggacaagcgctttgacccgcagaacaccatcacccgcaactcggacggctcctggaagatgaagaacagcaaggtgcgcatgtccgtgttcacctccacgggctacagcgcgtccaagattccgacctatgaccgtgacgtgctggccagccgaggctacatgcaggcggcgaacgactggcggaacgtggagatgacgggcttcatcaaggtcaactccacgtccgacgtctcggacaacttcgcctggtacgcgcgtggcggaaagcacaacgacaacaactcgggctgcgagggcagcagctacaagggctcgctgcactatgacggccgcgtgcgctggcagaaggagacgtggcacgtctcgtacgaacaggcggcgtacaagtccggaacgtccgcgctccgcggccgctgggtgggcttcaagtcggtgatgcggaacaccaaggtcaacggcaaggacgccgtgcgcctggagatgtacctcaacgagaacgccgacaagaagacctggaagaaggtctacgacatggtggactcgggtagctggggtggcgacgccagtcactgtggcggcgcggtgaacgccatgccgattacctggggcggccccatcgcggtcttccgctgggacagtgccaccgacgtggacttcaagtggatgtccgtgcgcgaaatccccgcggagcagtga

SEQ ID NO: 7594 - DNA, 1266 bp, Myxococcus xanthus
atggccctgagtggccctcaggtccgccggctggatgagcggctggcggcgcgcagccagggcctcacgccgcaccagtacctgatgttcctccagtccccgtcgggcgtgacggacctggaggacctcatcgccgcggtggtggtgaacaagacggacctgttccgcgacgaggtgcagctcgccgcgtttcgagcgcaggtcctctccccactggtggcgaggaatcggcggcccctgcgcgtctggagcgcgggctgcgccacgggcgaggaggtggccacgctgctcgtcctgctcgcggaggcaggggccaactcggacagcacggtgttggggacggacatcgccggggacacgctgcgccgtgcgcggtggctggcgtacggccgggagcagctgcgccgcgtcccaccggagctgcgctcgcggtacttcgtccggtccggcgcgaaagaagccctgacgcccgcgctgcgggagcgcgcgagcttccagtgccacaacctgatggagtcgccgtatccggtggcgcccggcggaggcggcttcgacgtcatcttctgccgcaacgtcctcatctacttcaccgcggaggccttccagcgcaccgtggaggcgctcgcggggagcctggcgcccggcggcgcgctggtgctgtccgcgtccgagccgctgctccgggtgccgccaacgctccgtgtgcggcgcggcgagcaggcgttcttctacgtccggccggaggaaggggagtccgaggcgccgccagccccgctctcctggaacggcgctgcgccaccttcaaggaagcgtggcacggccctgcccccaggccgagcccccgcgcgcgctcgcaccgaggctcaccatgggttttctgtcccggctcccaccgaggtggagggcgtccgggggcccgtggccaccgcgcccgagcccagcccggaggcctgcgcggaagcggacctcctcttcgcctgcgtgctggatggcgccgcctcgggtgtctccgacgccgtggcggagcgggacctgcgtcgctgcctgacgctggacccggaccacgccgccgcccggtacctgctcgggctgctcctggagcagtgccggcgcaccgccgaggctaccgccgagtaccgccgggccctccaggccctggagtcgggccgctctcgccccgtggccttcttcctcaaccccgaccgcctccgggtggcctgcgcgcatgctgccgagcggctggagttttccatccagaagcggtga

SEQ ID NO: 7595 - DNA, 1059 bp, Myxococcus xanthus
atgggcaagaaagtgtcggtgctggtggtcgatgactccctcatctgccgacagctcatctgcgaggcgctgagcaaggaccccgatatcgaagtcgtgggcacctgcgcggacggcaagcaggccgtggagatgaccaaggagctgcgtccccacgtcatcaccatggacgtggacatgcccgtcatggacgggctcacggccaccgagcacatcatggccgagtgccccacgcccatcctggtgctcacggcggacccgcgctcacaggcgccggagctgacgtaccgcgcgctggagctgggcgcgctcgctctgcaaatcaagcccgcgatcgacgccgggccggacgcgtggaacctggttcgcgaaatccggctgctgtcctcggtgcgtgtcatccgccacctgcgccggccccagcgcggcccgctgttgccgccccgggtggccacgtcggtgctgccggcggtgtccatgggcgtggtggtggtggcggcgagcacgggcgggccccaggtgctcttcaagatgctgtcggagctgcctgcggactttccggcgcccatcgtcatcgtccagcacatcaacgccgccttcgcggagtccctggcggggtggctggccggggccagcaagttgaaggtccggctggcgcaggacggagagccgctgatgccggggcacgtcctcatcgctccgccggggcagcacaccgtcatccccttccggggacgcgtggggatcaagctgggcgtggagcgggatgggcacatgccgtccggcacggtgctgctggagagcgccgcccgcacctatggccggcgcgcggtgggcctggtgctgacgggcatgggggcggatggcgcggatggcctgctggccatcaagcaggcgggcggactggcggtggcgcagaacgaggagtcctgcgtggtgttcggcatgccgggcgcggcggtggagcgcaaggcggtggaccacctcatccacggtgacgaagtcgcggcgacgttggtgcgactggcgcggggagagtccctctcggtggggcgctga

SEQ ID NO: 7596 - DNA, 636 bp, Myxococcus xanthus
cacgacttgcgctcgcccctttgggcgctgacgctgtccttgtcgtggatggagcaggaggtgccccagcagggcatcctcggcgagtccgtccgcacagggctggccgtcaccgcgcggttggaccggatgatttccgacctcatggacgtgccccgcctggaggaaggccggctggagccgcagcgggccaccttccccgccacgcgcatcgtggaagacgtgcgccgctccctggagagcgtggcccgcgcgcgcaagctcaccctggacgcggaggtccccgtccaactggagctggagggcgacgccgacctgctggtccgcgtcctggagaacctcaccaccaatgccctgcgctacgccccgtcgggcgggagggtgcgcctggaagccggcgcggatgtgaacggccgctggctcgcggtgcgcaacgacggcccgcccatctccgaagaggcgcgcgggcgcatcttcgacaagtatgagcaggccgacgcggagcgggacagccgccgtggctacggcctggggctctacttctgccggctcgccgcggaggcccacggcgggcggttggcggtggaggacgcgcccggatggtccacgtccttcgtgctgcggctgccggcctga

SEQ ID NO: 7597 - DNA, 246 bp, Myxococcus xanthus
atgctcacggcctggtgggcgacgtggatcctcagcaacatcatcagcaacgtcggcaacgccttcgccagggcggataccgcgaaccccacttcgctgtccgtgtcgctcctcgccgggattctttcagagggcctctccatcgcggcggcggtgctgtgcatccgcgtcatcggggacatcgagtcgctgctcgtggcccgcagggcggaggcagaggcgaccatgaccggcgccaccctctga

SEQ ID NO: 7598 - DNA, 1341 bp, Myxococcus xanthus
ttgctcctgactggtggcacggttgtaacgatgaaccgcgagcgcgaggtgctcgtggatgcggacgtcctcgtccaggatggccgcatcgccaaggtgggccggggcctcaagcctcgcggcacccggcgggtggtggacgtgacgggaaaggtggtgctgccgggcctcatccacggccacctccacgcttgtcagacgctctttcgtggccgcgcggacgggctggagttgctggactggctccgcgagcgcatctggcccttcgaggcctcgcacgacgccgcgtccatgcgggcctcggcggacctgaccttcgcggagctcatccgctcgggcgccacggcggcgctcgatatgggcagcgtgtaccactacgacgccgtcttcgagtcggcgcgggactccggcttccggctggtgggcggcaaggcgatgatggacgcgggcgcgggcgtccccgcgggcctgcgtgagagcaccgaggactccctgaaggagagcctcgccctgaaggagcgctggcacggcacgcacggcggccggctgcgctacgccttcgccccgcgcttcgtgctgtcctgcaccccggagctgctgcgcgaggtggcgcggctggccaaggagcacgggctgcgcatccacacccacgccagtgagaacgcgaaggagacggacgcggtccgccagtacaccggtggcgaggacaacgtggccttcttccacacggtggggatgtccggcccgcacgtgacgatggcccactgcgtgtggctgtcccaggaggagcaggacatcctgcgcgacacccgcacggtggtgtgccactgccccggctccaacctcaagctggcgtcgggcatcgccaaggtgccggagttgctggaggccggcgtggcggtggcgctgggcgcggacggtgcgccctgcaacaacacgctcgacatcttctacgagatgaagctcgccgcggtgatgcacaacccgcgcgtggggccgtgcgcgatgacgcccatgcgcgtgctggagatggccacgctgcacggcgcccgggcgctgggcctggaggacgaggtgggctcgctggagcccggcaagcgcgccgacatcaccgtggtggacgtcagcggcctgcacgcgggccccacgcccgaggacgtgctggtgccgctggtgcactccgcgcggggcagcgacgtggcgcacgtcttcatcgacggccagccggtgctgcgcgatggggtgctcaccacgttggacgcgccctccgtcctggcgaacgcgaacgcgcaggtggcgcgcatcctcaagcgccgccagaagaaggcgcgcagcggctga

SEQ ID NO: 7599 - DNA, 405 bp, Myxococcus xanthus
atggcggacgagattccctgggagcgcctgtttgaggaagccgcgcgcgtgcgagcgcgcgcccacgtgccctattcgcggttccccgtaggggccgccgtcctctttgcggacggcgccgtggtggccggctgcaacgtggagaacgccacctacgggctcaccgtctgcgcggagcgcaatgccttcgcggcggccgtggcccaggggcacacccagccggtggccgtggccatcgtcgtggacacccccgagccctgtcctccgtgcggcatgtgccgccaggtcatggccgagtttggcgggcaggagctgcccgtacgcagccggacgccccagggcggcgaggcgcgctacaccctgggaggcctgctgccgcatgccttcaccaaagacttcttctag

SEQ ID NO: 7600 - DNA, 300 bp, Myxococcus xanthus
atgcgcctgaaggtgcgccgggaaggcagctcggaggacttcgagcagcatgagggagacctgtccctgggcggttgcgcctggcagggctccggttgggctcaggggacgcgcgtggaagtgcgcttccggctgcccatccttcccgatgaggtggaagcgaagggcgaggtgctccaggccgcgccgggcgccaacggtccggcggcgcgggtccgcttcgtggacctgccggtggagtccgagctggccatcgcgcgccacctggatgatgtgcagagcggcacggcccgctcgtaa

SEQ ID NO: 7601 - DNA, 411 bp, Myxococcus xanthus
atgaaccagggcgcggcgctgtacatccatccgggcgtgaaggtccgtccatgcgagtggggctacggcgtcttcacggacgccttcatcaaggcgggcgacctcatcgaggaatgccactacctcaaactgccccgcgccctctcgcagaacccccagctccaggactacgtcttcctgctccaatgggccaggcacgaggtgccccgagagggggagtgggtggcgctcgtgctggggtatgggatgatctacaaccacgcccgagagcccaacacgtcctatcaccgcgaggcgacccgggacgtcttctgctaccacgcgctgcgggacatccaccccggcgagcagctctgcatcagctacggcgaggactggtgggcgtcccgggatcagggcgtcccagcctga

SEQ ID NO: 7602 - DNA, 471 bp, Myxococcus xanthus
atgctggggctgcgcaagaaggccgccgccgcggacgaggcgcgcgagaagctgcgcaaggtggtggaggacggcagcacggtgcgcaagctgaaggagatcgtccaggtgcagggcggagacccgcgctccatcgacgactactccctgttgccccaggcgaaggccaccgtggacgtggtggcgccccgggacggcttcgtcaccggcatcgacacggagggcgtgggcatggcggcggtggcgctgggcgcgggccggcagcggacggatagcaagatcgacccggccgtgggcttcacgctgctgaagaagtcgggcgagtccgtgaagcagggcgagcccgtggtgcgcgtgcactacaacgacgcggcccagttggagaacgtgaaggcgcgcctcttggccgcgtaccggttcggcgacgtggcccccgtggcccggccgctcatccgcgagcgggtggagtag

SEQ ID NO: 7603 - DNA, 1725 bp, Myxococcus xanthus
gtcatcacccacgcgggcgcggcgtacatcgcgccccacttcgagcggctcgacctggaggatggcgacttcgtcgtggtgcgctcgccggacaactcccggtcgtggcgctacgacaactcgcacccgggtgcgcgcagtggcttctgggccatccacattgccggtgagacggccatcatcgagctgcacagccgcgacagcgtcaaccgccgcggcatcctcaacaagcacggctactccatcgaccggtacgcccggggctacaccaacgaggagatgggcgtgtcgaacgacaaggcgctgtgcggcccggacgacacgcagtgggcgccctgctacgcctccagcgaccccaccctctacggccgcgctcgtccagtcgcgcgtctgctcatcaacggctccggtgcgtgcacgggctggctcgtgggcagccagggccatctgatgaccaaccagcactgcgtcggtacggcgagcgaagcgcagaacacccagtacgagttcatggcggaaggcgcgagctgttcgacgagctgcgcgagctggttcggttgtccgggcaacgtcatcccgggcggcacgttggtgaaggtggacgcgccgcgtgactacgcgctcatccagttgtcccagaacccggtgaacacctacggctacctccaactgcgctcgtccggcgccgtggtgaacgagcgcatctacctgccgcagcacccggccggccacggcaagaagatcgccgtgcgctccacggatgcccgggacgagtccggcttcgcggagatctacagccgcaacgaggcctcctgccagtccggtggccccaacgacatcggctactacgcggacacgcagggcggctcctccggctcgcccgtcatcggccattcggacaacctggtggtggccctgcaccactgcgccaactgccccaaccgcggcgtgcccatcgaagcggtcatcagccacctgggcaccagcctgccccagtgcgcgctgcccgccgccgactgccccaaccccggcggcaacggtgagccgccgcctcctcccccgccgccgcccccgccgccggagaactcgttcgactacaccgccagcaacaccaacagcgcgcagcagaacaccaccaatcacaccatcgcgctgacggcgggccagacgctcaccgtcgcgacgtgcggcctcacggggacgcagttcaccggtgacacgtggctgcgcctgcgcaaccccgccggcaccgaggtggccaccaacgacgattcctgcggcggccgcggctccagcatcaccttcaccgccaccaccgccggcaaccacgaggtccgcgccggctgctactccaccgggagctgcaccggccgcgtcgtgtgggaaatctccggcggctccggcggccccaccagcgggagcttcaacttcagcggcagcaacaccaacagcgcgcagcagaacaccaccaaccacgacgtcgccatcgccgcgggcaagagcatcaccgtggccacctgcggcgtgacgggtgcgaccttcacgggcgacacctacctgcgcctcttcaacggcgccacgcaggcagcggtcaacgacgacgcgtgcggcggccgtggctccagcctgacgtacacctcgtccacggccaccaccctgcagattcgcgcgggctgctactccagcgggagctgcaccggcaccgtggtgtggaacatccagtag

SEQ ID NO: 7604 - DNA, 1431 bp, Myxococcus xanthus
atgaacgtccagaccgccaccgactcgtccgaccgcatctgggagcaggaaatcctccccgcgctcgagcgctacattcgtatccccaacaagtcgcccgccttcgacccggactgggtccgctccggccacatggaggccgccgtccagctcgtcgcggactggtgcctcgcgcaggcccagcacctgcccggcctggtgctggaggtggtgcgcctcaaggacgagaagggccgcgagcgcacgccggtcatctacatggaggtgcccgggacgaagggcgacgacaccatcctcttgtacggccacctggacaagcagccggagatgacgggttggcgcgagggcctgacgccgtggacgccggtgcgcgagggcgacaagctctacgggcgcggcggcgcggatgacggctactccgccttcgcgtcgctcaccgccatccgcctgctgcgcgagcagggcctgccgcacgcgcgctgcgtggtgctcatcgaggcgtgcgaggagagcggcagctacgacttgccggcctacatcgaggcgctggcgccgcgcatcggccagccgtcgctggtggtgtgtctggattccggctgcgccaactacgagcaactgtggatgaccacgtcgctgcgcggcatggtggccggcaacctgcgggtggacgtactcacggagggcgtgcactccggggacgcgagcggaatcgtcccgtcgtccttccgcgtgctccggcaggtgctgtctcgcgtggaggaggagggcacgggcaaggtgctggtggaggccctgcacacgcagattccggaggcgcggcgcgaccaggcccgcgcggcggccaaggtgctgggggaggaggtcttcaccaagttcccctgggtgcccggcatccgccccatgtcggacgacggcgcggagctggtgctcaaccggacgtggcgtccggcgctgtccgtgacgggcgtggacggcatgccggcgctcaacagcgcgggcaacgtgctgcggcccttcaccacggtgaagctgtccatgcgcatcccgccgcgcgtggaccccaaggcggccatggatgcgctgactcagacgctggtgaaggacccgccttacggcgcgacggtgacgttcgagggtgagaagtccagcaccggctgggacgcgccgccgctggcctcctggctgtcgaacgcggtggagtccgcgtccgccacctacttcggccggccggccatggccatgggcgagggcggcaccatccccttcatgggcatgctgggcgagcgcttcccggaggcgcagttcctcatcaccggcctgctgggcccgggcagcaatgcccacggtcccaacgagttcctccacattcccacgggcaagaagctcacctgctgcgtggccagcgtcatcgccgaccacttcaagcggtag

SEQ ID NO: 7605 - DNA, 1311 bp, Myxococcus xanthus
gaggggcgtctcagtcgctgagaaggcgtctagaatcggccggacatggccgaaaagctcggagcgatcctggtccgcaagggcctcatcacacaggcgcagctcgacgaagccctccgggcccagctcatctacggcggaaggttgggctccaaccttgtcgagctggacatcctcgacatcgacaccctggccatggtgctgggggagatgtgccgctacccggtggcgcaggaagcggacttcgtggcggcaccggacgcggtgctgcaactgcttcccgcggcgatggcggagaagcaccaggccttcccgctggagcaggaaggccggcggctcaaggtggcgatggccagcccgctggaaatcgagcacgcggatgcgctggggttcatcacgggtctgcgcatcgttccgtacgtcacgccggagctgcggctgttccagttccaggagcttcgctacggcatcaagcgcgagacgcgtttcatccagatgacctcgacgaagcgtccgaatcggaccgcggccgtggcgccgcccgtggcgctcccttcgatgccctccgcgctgagcatgacgcctccacctcccgcgcccgtgagagcggagcccgaggcggaagggatgttcggtgggctcgcgcccgggcagtacttgagcggcgatgacccggacacggagcccgaggattccggctcggtccggtgggaatcggccatgtcggggagctcgcatccgttggacccgctggcgtcgtccgcgcctccggtggcgaggattgatttcggggaggacggcgggaggcggggggggacgcccgaggtgcccgtgcctccgacgctgacgccagcgggtgggggggcgcggcctgcctcgccgccgcgactcacgccgacggagacgccgcgtgccgtggcgccgcctccgttcgcgctggagccggcgcccgcggaggagattgacctcctggaggaaggggaggtgctggaggagggcgaggtcgtcgaggacgtggcggctgtgcccgaggactttgatggtggtgttcccgcgccaggagttgctgtggcctcgggtatgccggtggctctgcagggggccggtggagggacgccgccgcctgggttggcgtcgcggcagggtgtgccgactcggcctccgttttctccgatgggcgccgcttcttcggagcccggggcgtcggatcggggggcttcgggggcgggcgaggggatgggtgttcctcctgggatgctctctcggccatcagcgcatccgagagctccaggccgaactccgcccttaggc

SEQ ID NO: 7606 - DNA, 1344 bp, Myxococcus xanthus
atggtgatgctcgcgctggcattcgtcctcgcgtacgccacgcgtttctccggcatcgtgcccgtcacggaggggatacctccctggacggactcgttcttttcgctgctgatggtgctcgtcatcttcccggtgacattccaccagtcacgcctgtacggcaccaatcgttcccggacgaatacgggcgaggtgttcgaggtattcaagtcgaccatcaccgcggcgctcatcctcgtggcggtgacgtacttcgttcgcgagcgctattcgcgcctcacgctggtcatcttcatcgtctatgcgttcgcgctggtgacctgcagccggctggtgactcgctatctggtgagtgaaatccggcgccggggccacaacctcaagtccatcctcgtcatcggcgcgggggacctgggacagcgggtcatcgagacagtggagcaccaccgcgagctgggcttccgggtgatgggcgtgctgacgctgcacccggagaaggtgggccagtacgtgaatgacgtgcgcgtcatcggggtcgtggaccaggtgaacgaggtgctggattcgcacccggtggaccaggtcatcctcgcgctgccgctggcgggccacgcccacgtcaaggcgctgatggacaagctggccctgcgcaccgtggatgtgcgcgtggtgccggacctgtaccagtacatcaccctctatggtggcctggaggagttcggcgggttgcccatcatccgtctccagggcgacccgatggagggctggagccgggtggccaagcgggccttcgacatcctcttctcgttgctggccatcctcatcaccgcgccgctcatggccgccaccgcgctggcggtgcggctcaccagccgtgggcccatgctctaccgtcaggagcgcatgggcatggatgggcgcaccttccccatcctcaagttccgcaccatgtgcatcgacgccgagcacggcggcgcgatgatgacctgcccggacgacccgcggcgcacggtgattggcacgttcctgcggaagtactccctggacgagctccctcagtttttcaacgtcctgcgcggtgacatgagcctggtagggccgcgcccggagcgccccgtcttcatcgaggagttcaagcggcagattccgcgctaccacctgcggcacaaggtgaaggcgggcatcaccggctgggcgcaaatcaacggcctgcgcggccagacgtgcatcgagaagcgcatcgagtacgacctgtactacatcgagaactggtcgctgctgatggacctgaagattctcgtgcgcacggcgctgggcggcttcctgtcgaagaacgcctactga

SEQ ID NO: 7607 - DNA, 1593 bp, Myxococcus xanthus
atgacgctcaccctgcgcgtgcatggcgggacgggcggcaacaacgcggtggtgctgacccgggccgtggtgaatggcgccttcacgcctggcaccgagctggggccgtactgcaccggaggccgcatccgcgccaacacctgggtgacgtgcaccgttcccatctccctcctggcgccacagggagcacggctgacgggcctggttctccaggaaggcctgggactgagcctgcccacgctctacttcgacgagctgggcgtgcgtggcatggccacgccgcctccgcccgtggaggtggccatcacccccacctccgccacggttccggccggggggacgcaggccttcactgccacggtgacgggcagcaccaacacggcggtgacgtggtccgtgcaggagggcgcggcgggaggcaccgtcacgccggcgggcctgtacaccgctccggccatcgcgggcacctaccacgtggtcgcgacgagccaggcggatcccacgaaatcggcggtggccaccgtcaccgtcccgaacacgcccccgccgccgagcggcacgtgggtgtcgggctactacaccggctggaacgccgacatgtacccgccggagaaggtggacttctccgcgctcacgcacatcctcgttggccgcgtcactcccaatccggatgggaccgtgaacacccagttcgacaactcgaatggcccggccatcgcgcggacactgtccacgcgggcgcacgcagccggacgcaaggccatcatcatggtgggcggcgcgggtgagcacgacggctgggtgggcgcggcgtccaacgcgaaccgcgcccagttcgtccagaacctgctcaacgcgatggatacctttggctatgacggcctggatatcgactgggagccggtggaacaggtggacaagccggcgttgctcgcgctgatacaggcgctgcgcgcggcccggccgcagatgctgctcaccatgcccatcggctgggtcaacagcaacttccccgaggatgcggacccgtggttcaccaacctggtcccctacctggaccagatgaacgtgatgacctacgagatgacgggcccctggggcggctggctgtcctggtacacctccgcgctcacgggcgaggcgggcaaccaccccacgtccgtctcctccagcctcagcgcctgggccaacgcgggcatccccaagaacaagctgggcatgggcatcccgttctatggcatggcgtggcggaacatcaccggcccgtatcagccgtacacggactggtctgactacgtgggcagcgacaattccttcacatacagcaagattctccagttgtcggcgacgggcgtctaccactgggacgaggcggcgaaggccagctacgtcaccttcgacgtccccgtggaggacggcacggtgcggtggatttcgtatgactcaccgcaaaccattgccgccaagggcgccttcgcccatgacaacggatacggtggcaccatcatctggaccatcaaccagggatgcaccgacccacagactggcgccaatccgctgctcgacgcggtgaagaacgccttcctgccatga

SEQ ID NO: 7608 - DNA, 105 bp, Myxococcus xanthus
atgaatgacggcgttcgcacgctggtgagcggcaagaaggcgctcgacgtcggcaccgcgaacccgatgaatctccatccggacggcggctgggagctcctctag

SEQ ID NO: 7609 - DNA, 438 bp, Myxococcus xanthus
atgtctgccctggcgtccggggacaccatcgccaactcgtatgtggacgtctccgcctacctgacgtcgaaggcggacatcgaggcgtggtaccagctccgggcctcgctgaagcagaacttcgatgacatctgcggcgacacgttctgcgagggcgaatacagcaacatcgagtcgctgcgcttccgctgctccgtgaatgccctgacgggccggatgggccagtgcgtctgggtcttcgccgccagcaacgaggaagtcgacccggcgacgggttcggtgacggtggatgcgcggacctgggcctgccaggtgcctgtcgccccgcgcaccacgattcaggagttcctgacagcgctcgcgggcacgtctccgctctacgccacgctgccgcgcacccagacccccctctacgaaggtctgggcaactgcctctga

SEQ ID NO: 7610 - DNA, 654 bp, Myxococcus xanthus
atgcacgagcaggcgctgcaatcgcgttaccgggagctactggagagcgtggaggcctgggcgaagggatttggaggaaggctcgtcctgggccctcccgtaccggacgaagacatcgacctggtgccggagctgctcggcatcccgtcgtccaacggaaggcccgtgctgcccgcggggctccgcgaattctggcggcgctgcgccttcgcgcgcgtcgagttccgcgactgggatgatggcggcgcctggacgcccctgcccgccaacttccgggtgtactcaccggacgaggtgctggaagaaacgcgctgggtccgcattcccacggacgtgacgctgggcaatcgccccctgtccaccacgcacctctacgccctcgcgacgtgtgacgtgctgccccgggacgctcagtggtgtgtcgcggcgagcggaggtgcgttgacggcccccgtcatcgtcctcaaccacatgggagacctgacgtgggcccagctccaggactcggggcagttcgtctgggccgaacagcagacggcgcacggcgccaccttcacgacgttcctggattggctcgagcactacgtccggcacacgtgccagctcgcccccgagtcgctctacccggacggcgtcacagcccgccccgagtag

SEQ ID NO: 7611 - DNA, 549 bp, Myxococcus xanthus
atggccaatacgtcgaatgagaatgcggtggcggaagcagtgaagcggctcaagtccctggcggaggagatcgaggacatgagcatcgagttctccacgcccgtgactgccgacgaggtggcgcagctggagaagaagttcaagctgaagctgcctcccagctacgtgcacttcatcagcacctacggcaccttcaaggtgctgcacggtgggcgggagctcatcggcatggaggagccgggcttcctgcgtgcggcggcgccggacccgtcggacgcggtcaacggtgacgacccggaggtggaggaggccatcaaccaggccctgttcttccagcgcgcggatgacgacgcggtggacaacttctggtgcttcaacccgcgcgacgtcacgccggaaggcgagctgggcgtcgtgggctactaccacgacgaggccttcgacctttccccgcgcctgggaacggaggacgccgagcacttccgggatttctcggcgcacatcgtcagggtcatcgacgcgctcatcgagaacttcgcggaagcgtaa

SEQ ID NO: 7612 - DNA, 612 bp, Myxococcus xanthus
atgtccctgctcgatgacttgctcaagaaaggctcgctccacacgccctgcggcacggcggcgcggcgggccgcgctcaaggcgaagctgacgaactccggcgccacggaggtggtgtccggagacttgaagctctccgagggggatgaccgcgtcctggaagcgtcacgcgtcgtggtgaaggggaacctggtcctggaggaccagtcccggctgctcgtcgcgggtgacctggaggtggagggcagcatcatccacgagggcttcgactacgcgctgctcttcacgggcggcgcgctctccgcgaagaacctgctcttccacggtgaactggtgtcgctgggccccatcaccgtgcagcaggtggcgtggacctactacaacgactactcgacctactcggattccctgaaggcgagaatcgtcgtggcggctgaccgcttcgacgcggtggatgacgtgcaggcggaccaccacttcaatggacaccccagtgacattcgtgaggcgctggcgaagcagctgagcgcggacgtggtggacgccgacggcgactggtcctacgaagaaatcgcgaagcaccttcttcgcgggcgagccctgcttcgctga

SEQ ID NO: 7613 - DNA, 261 bp, Myxococcus xanthus
atgacgggcggcgtcttccagacgctggccctggcgtcggacgtgcacgacgaatgcgcggaagaggcatccgacgagtgcgaggactgctcgcccaactgcgtgctgtgcgtgtgctgcccgctgagagccgcccccgctcccgcgttgcccaacgcgcgtctcatcccgccgccccggccgctgcccatcccctcgcgcgtggaggagcccacgctctccggcgtagggaccgacatcttccagccgcccagagcctga

SEQ ID NO: 7614 - DNA, 270 bp, Myxococcus xanthus
atgcactcgctgcgtacgctgtccgtcgtcctgtccctgttcgccgcccccgtcctggccgacgagagcaagcccgcccagcagccccagacggccgggtccgagaagccgcgctgcgagcacggcgtccagaagagcctctgtgcccgctgcaacccgaagctggctcccgtcttcaaggccaagggtgactggtgccccgagcacgcgcggcccgaatcccagtgcgtcctctgcaacccggaactctccaagaagggcgtgaagtag

SEQ ID NO: 7615 - DNA, 468 bp, Myxococcus xanthus
atgaaggcggagacggtgagtggcccccaccccgaggccgcccccctggcacccctggtgcggctgggggacgcggtggtgggacggccgctgctgccgggcaaccgcttcaccgtgctggagtcccgccgggacgcctaccccgcaatgctggaggcgattgacgcggcgcgcacgacgctgtcgctgtgcagctacatcttcgacaatgacatggcgggccggcgcttcgtggaggcgctgagtgcagcggtgaagcggggcgtggaggtgcgggtgctggtggacgcggtgggctcgcgctacacgtggccgcccatcctgggccggctgcggcgagccggcgtccgcgccgcgcgcttcctgccgtcgctgatgccctaccggctgcccttcgccaacctgcgcaaccaccgcaagctgatggtggtggacgggcgcgtgggcttcacgggaggcatgaacatc

SEQ ID NO: 7616 - DNA, 1563 bp, Myxococcus xanthus
atgcgtgcctcccgagtcggccccagcgtcctggcggtgctgctggcactgagcgccgccagttgcagccaacaagcgagtccccccacggcgaaggcgccttcaccgccgccagtcgcctcgggaggcacgtccaccccgtccgaggtcgcactctgtgagcaccgcgtccccgcggagctgtgcacccggtgcaaccccgacctcatcgacgtcttcaaggaccaggacgactggtgcggtgagcacggcgtccccgaatcccagtgcttccaatgcaacccgggcctcaccttcaccgcgcgggacaccacccccaaggattggtgcaaggagcacgcggtccccgagtcccgctgcaccaaatgcaacccgtcgctggtcgcgaagttcatcgaggccggtgactactgccgggagcacggcttcccggagtccgtctgcccgtactgccacccggagttggtgaaggccgcgggtgcccagccccccaccttccccgagccgggcacacgcgtccgtctcgcgtccgccgagacggcccgcgaggctggcatccagacacgtcgcgcggtgaagcggccctttgcccggaccctggacgtcgtcgggcagctcgacttcaaccagaaccggctggcgcagctgtccgcccgcagcgaggcgctgataacggacgtccgcgtggacgtcggcgacgaggtgaaggcgggccagccactggtgctggtcacctcgggggccgtgggcgcggaccagggacggctgtcggcggcacagacgcggctgacggtggcgcgctcggcgctcgagcgcgagcagcagttggccacgagcggaatccgcgcacgaaaacacgtggagaccgcccaggcggaggtcgcggcggccgaggccgagcgcaatgccgcccgcgcagcgctctccgccgcgggcgccaacggccagggcccgcaggggacctatgccctgtcggcgcccttcgcggggacggtggtggcgcgagacgccgtcgccggacgccatgcatccgctggacagccgctcatccaggtggcggacctgagcaccatgtgggccctgctggagattccggaggcggacgcgttccaggttcgcgcgggacagcgcgtcaccctcaccttcgaaagcatgcccggacagacgcgtgacgccaccctcacccgcgtgagcgcgtcggtggaccgggcctcccgcacggtgcgcgcccgggtcgaactgcccaaccccgacggcgccctcaaggccgggctcttcctcagggcaagggtccaggtcgccccggaacatgaggcggtgctggttccccacgcggccatccagcgcgcggaaggccagacgctggtcttcgtgcgcaagcagccggggctctacgagcccgtcgcggtggagctgggcgccagcacgcgcgaggaggtggaaatcgtcaagggcctctcggcgggggtggaggtcgtcaccaccggtgccttcctgctcaagacggagatcctcaaggactccatcggcgcgggctgctgcgagacggcgggaggcgagtag

SEQ ID NO: 7617 - DNA, 2560 bp, Myxococcus xanthus
atgctcacccggctcatcgaatggtcgttgtcccaccgctgggccgtcctcctgggaacgggggccctcgtcatttcgggtctgctcgccttccgggcgctgcccatcgacgccatcccggacacgacgcccacgcaagtgcaggtcaacaccgtcgcaccggcgctcacgcccaacgaagtggagcgccagctcaccgtccccgtggagcaggcgctcgcgggcctgcctcgcgtcagcgagctgcgctccatctccaagttcggcctctcccaggtcaccctccagttcgaagacggaaccgacctgtggttcgcgcggcagcaggtgtccgaacggctgagccgagtgcagctacccgcgggcatcgcgcccccgacgctcgggcccgtcgccaccggcctgggcgaggttttccactacctcgtcaagagccggacgaagagcctcgaggagctgcgcaccctgcatgactgggtcatcgcgccccaactgcgcagcgtgccgggcgtggcggaggtgaatgcctggggcggcgaggagaagcagtggcacgtcatcgtcgaccccctccgaatgcagcagttcaacctgtccctcggagacatctaccgggcgctggaggagaacaacgccaacgtcgggggcggcgtgctcgagcggggcggcgcggcgacgctcgtgctcggggtgggagtgctcacggacggcaacgccatcgaggacgtggtcatcgcggcgcaccacggcgttcccgtgcgaatccgggacgtggcgcgcgtcgaggtgggccatgaaatccggcgcggcgccaccaccgcggatggcgagggcgaggccgtgctgggcctgggcttcatgctggtaggcgaaaactcccacacggtgacgaaggcgctcgcccagcggctggaggacatccagcggacgctgccggaggacgtgcgcgtggagcccgtctatgagcgcaccgagctggtggaccacgtgctgcgcaccgtgcggaccaatctgctggaaggcgcgttgctcgtcatcgcggtgctcttcatcttcctgggcaactggcgcgccggcctcatcgtggcggcggccattccgctgtcgctcctgttcgccttcaacgcgatgctgcgcttcggcatcgccggcacgctcatgtcgctgggcgccatcgacttcgggctcgtcgtcgactcctccgtcatcatggtggagaacgcggagcggcgactctccgaggcccgggacggacgctccctgctggaggtggtgcgggatgccgccgtcgaggtccgcaagcccacgctcttcggcgagctcatcatcatggtggtctacctgcccatcctcgccctcgaaggcgtggaggggaagttgttccgccccatggcgctcacggtcatcttcgcgctcctgggcagtgcgctgctctccatgacgctgatgccggtactggcctccttcgcgctgaagcgaggcggcggcagccctcaccatgagccacggctcatgcgctggctccaacgaatctaccggcccgtcctcgaatgggcgctggcccatgcgcgtgtcaccctgaccgccgccgcgctcctcatcgtgggagccaccctcgccgccacgcgcctcggcagcgagttcgtcccccgcctgtccgaaggcacgctcgtcatcaacaccgtgcgcctggcggaggtctccctctccgaatccatccgctacggcagccagatagagcggctgctgctgtcccggttcccagacgaggtgcgacgcgtctggacccggaccggcaccgcggaggtggccacggaccccatgggcgtcgagctctccgacgtcttcatcaccctcaagcctcgggagcagtggaagcgggccaccacccaggaggagctggtgaacgagatgaaggccgaactggcggacctcccaggcatgcgcatggccttccttcagcccattgaaatgcgcgtcaacgagatgatcgcgggcgtgcgaagcgacgtcggcatcaagctcttcggggatgacctcgacgtgctcaaggccaaggcccgtgagctggagaccctggtgagggccatccccggcgcggccgacgtcaccgtggagcaggtgacgggccagcccgtgttggaaatcacggtggaccgggcggcggtggcccgttacgggattcccgctcgctccgtcctcgacgtcgtggaagcagtgggcacgcgcatcgtcggggaggtgcgcgaaggcgagcgccgcttcgacctggccgtgcgcctgtccgaggagtaccgcgaggaacccacgaagctcgtcaccatccccgtggcctcgcccggcggcgagcgcgttcccctcggacggctgacgaccatgaacgagacatccggccccaccaccatccagcgcgagtggggcaaacggcggctggtggtccaggccaacgtgcgagaacgcgacctcggcggcttcgtcgcggaggtccgccgaacactcgatgagaagctggagctgcccgcgggctactacgttcgctacggcgggtcagtttcgaaca

SEQ ID NO: 7618 - DNA, 453 bp, Myxococcus xanthus
atgctgctggccattgccctgggcacggcgcttgcgtccgtgccggggatcaacgcgctggaacggatggtggccgccgaggtccacgccgtgtacgggccctctgatgagagaaacggcgcgcgggtggaccggggcggcgtggccttcgtgggcaagcgcacgcgccagttgcgctgtgggcgactggccggggtggggagcgacacctgggccgcggtgatgagcgccacggctggggtgaagacgaaaccgaccctgggccgggaactcgagtcctttcagccgggcttccatgaagcccaccgtcaggctcgagaacgtcggcgggccgttgccaccgacactgtccggctgctgcgctccgcggcccggatggtgcggggaggcaacgccggtgaccggccgacgctcgtcacccagtcgttgcgcgggcctcccgggcgcggctga

SEQ ID NO: 7619 - DNA, 2028 bp, Myxococcus xanthus
ttccagaagcttcgccagcccgtggtgctgggctacatcctggccggcctcgtcgtcggcccgtacctgccgattccgctggtcgccaacccggaggtggtgacgacgctctcggagctgggcgtcatcctcctgatgttctcgttggggttggagttcagcctccgcaagctgttcgccgtgggccccacggcgggtgtcaccgccgtcatccagtgcagcatcatgatttggctgggcttcgtggtggggcgcgccttcgggtggaccaccctggagagcctcttcactggcgcgctcatctccgtgtccagcaccaccatcatcgccaaggccttcgacgagcagaacatccggggccggctgcgggaactggtggtgggcgtcctcatcgtcgaggacctcatcgccgtcctcctgatggcgacgctgacggccatctcctccggcactggcctgtccgtgggggagctgtcgttgacgacgggccgcctggtggcgttcctcgtcgggctggtggtggtggggctgttcatcatcccccgcgcggtgcgctacgtggtgaagctcaacaagccagagacgaccctggtggccagcgtgggcatctgcttcgcggtggcgctgctggcgcaggccttcgggtattcggtggcgctgggggccttcctggcgggctcgctggtggcggagtccggcgaggagaaggtggtggagcacctggtgcagccggtgaaggacatcttcgcggccatcttcttcgtgtccgtgggcatgctcatcaacccggcgctcatcgcggagcactgggcggccatcctggtgctcacggtcgtggtcatcgttggcaagctcttcagcgtgacgctgggcgcgttcctcacggggcacagcacccggacctccgtgcaggcgggcatgagcctggcgcagattggcgagttctccttcatcatcgcgggcctgggcctgtcgctgaaggccacgggcaacttcatctacccggtggcggtggccgtctccgcgattacgacgctcacgacgcccctgctgattcgcgtgtcagggccggtggccagctatgtggaccgcaagctgcccaagccgctgcagacgttcgtgacgttgtacggcacctgggttgagcggctgcgcgacgcgccccggcgccagacgttcggggcctcggtgcggcggctggcgcggttgatggtgctggacgccgtgttgctgattgtcctggtgattggcacgtcgttgacagcgggcaagctgggctccctcatcgagcagcggctgggcatcgatgagaacctgtcccgctacatcatcctgggcggcgcggtgctgctctccatcccgttcctggtgggcgtggtgcaggtggcgcgccggttgggcgaggagctggcggaggcggcgctacccgggcggaaggatgggcgggtggacctagcggcggcgccccggcgcgtgctgctggtgacgctgcaactgggcatcatcctgctggtgagcgtgcccgtggtggcgattacccagcccttcgtccggggcgccatgggccccctcatcttgctggccctgattggcgcgctgggcgtgacgttctggcgaggcgccaccaacctgcacggccacgtccgcgcgggcgcgcaggtcatcgtggaggcgctggcggcgcagtcccactcgcgagagccgggcgcggatgagcacgcgctcgaccacgtctccaaggtgctcccgggcctgggcgagcccgtgcccgtgcggctggagacctccagtcccgcggcggggaagacgctggccgaggtgaacctccgcggcctcacgggggccacggtgctggccatccggcgcggggactcgagcgtgtccgtgccgtccgcgcaggaggtgctgcagccgggtgacgtgctggcgctgacgggtacgcaggacgcggtggaggcggccaagagcctgctcaccggtgcaccggcgcccacctcggagccggagccgacgggcgcccaggtgtga

SEQ ID NO: 7620 - DNA, 102 bp, Myxococcus xanthus
atgccggggcgggtggtagcggccgacaagggcgcacacgcggagattcccacgcagaccctgcccctggcggaactggacgaggcgtccactcccgcctga

SEQ ID NO: 7621 - DNA, 606 bp, Myxococcus xanthus
  unsure (1)..(606): unsure at all n locations
atggcccctatcgatgagctgtcccagagggtgtccgccgcgttcgcggatcggacgttgttgaaggacgcggcccacgtggccgccgtgcgcgagacgctggcgcggctggactcgggtgagctccgcgtggcggagaagggcgtggacggctggaaggtgaacgcctgggtgaaggaggccatcctcctcttcttcgcggtgtcggagatgaaggtgatggaggtggggcccttcgagttctacgacaaggtaccgctgaagaagggcctggaggcggcgggcgtgcgcgtggtgcccccgggtacggtgcgctacggcgccttcgtggagaagggcgcggtggtgatgccgggctatgtgaacatcggcgcgcgcgtgggcgcgggcaccatggtggacacgtgggccacggtgggcagctgcgcccaggtgggcaagcacgtccacctgtccggcggcgtagggctgggcggggtgctggagccgccttccgcgtcgcccgtcattatcgaggacggtgccttcctgggcagccgctccatcgtcgtggagggcgtcntggtggaagaggaagcggtgcttggcgccaacgtggtgctcacc

SEQ ID NO: 7622 - DNA, 210 bp, Myxococcus xanthus
atgggaatcggaaaactgattggcggagcggcggacgcggcgaagcgggccgccgaggccgcggcgaagcgtgcggcggaggcggcccggcgcgcggcggaggcggcggcgcgcaaggccgcggaagccgcggagcaggcggcggccaaggcgcaggagggccaaggagaagatctccaacgtggcccaggagcggacccgggacgtctt

SEQ ID NO: 7623 - DNA, 723 bp, Myxococcus xanthus
gccatgctcgtctcactcgtcatccccgtctacaacgagattcccaccctcgccgaactgctgcgccgctgcgtcgccgtcgacttcccgaaggagctcgtcctcatcgacgactgctccaaggacggcagccgcgaattcctgcgccagcttcaggagcagggtgtgggcctgttgggcggtacaccgcgcaaccgcaacgaggtgcgcgtcctcttccaggagaagaaccagggcaagggagcggcgctgcggcgaggcttcaccgaatccacgggtgacatcatcatcgtccaggacgcggacctggaatacgacccgcgcgacatccccaacgtcatccagcccatcatcgacggggtcgcggacgtcgtcttcggcagccgcttcaccggcacgccccggcgcgtcctctattactggcacaccgtgctgaacaacgtgctcaccacgctgtccaacatgaccagcggcctgaacctcaccgacatggagacctgctacaaggccttccgcgccgaggtgctgcgctccgtgcaggtggaggaggaccgcttcggcttcgagccggaaatcaccgccaaggtggcccgtggccgctggcgcgtcttcgaggtgcccatcagctaccacgggcgcacctacgaagagggcaagaagattggctggaaggacggggtacgcgccctctacgccatcgccaagtacagcgtgaagcggtag

SEQ ID NO: 7624 - DNA, 1439 bp, Myxococcus xanthus
tcccaccggctgatggacacgctctccgactacctcgcgcgcgccacccgcgccgaaggccccgtgctcccctgggccgcccccgcggtgaacgtggaccgcttcgccgcagccttccccgaagcgcccacgggcgacttcgcagacctcatcacccgcgtgctctccgggtccaaccacctgcaccacccacgctacgtgggccaccaggtgacggcccccgtgccgctggccgccctgtgcgacgcggtgtcttccctgctcaacaacggcatggccgtgtacgagatgggccccgtctccaccgccatggagcgcaacgtcctgcgctggatggccgcgcggctcggcctgcccgaaacaaccgacggcgtgctcacctccggcggttccctgggcaacctgaccgccctgctcgccgcgcggcaggccaaggccggctacgacgcgtggaacggcggcgcccacgccgggccccgcccctcaccgtgctgaccgcccagacgacgcactacagcctcgcccgcgccacccgcgtcatgggctttggcgaaggcggcgtgacgcccgtcccggtggacgaacacttccgcctgcgccccgaggcactcgacgccgcgctcgagtccgccacgcgcgctgggcgcaagcccatcgccgtggtggccaacgccggctccaccgccaccggcgccttcgacccactggaacccgtggccgacttctgcgagcgccatgacctgtggttccacgtcgacggcgcacacggcgcctccgccgtcctcagccccgcccaccggcacctcgtgcgcggcatcgaccgggcggactccgtggtgtgggacgcccacaaggggctgctgatgcccgcgctggtaacggccgtcctcttccgcgacggcgcccgctccttcgagtccttctcacaggaggccagctacatcttccacggcgacgcggagcgcccctggagcgacgtggccctgcgcaccctggagtgcaccaaggagatgatggccctcaaggtgtacgcctgcctcgccgtgctgggcacccggctcttctccgacgcggtgacggagtcctacgagcaggcccaccgcttcgcccagcgcctctcagccgccagcgacttcgaggtggccgtgccgcccgagtgcaacatcctctgctcgcgccacacgcccgcgcacgtccccggcgagcagtgggacaccctccacacgaagctgagcgagcgactggggactcgcggagatttctacctggtgcatgacaaagctgcacccgtgacgtctatctccgtgtcaccctcatcaacccgctcaccaccgacgcggacctggacgccctcatggacgcgctccgggccgcagcgctccgctgaacgccgcgccccacccggcccgcaccttccgtgccagaaggtcgccccatga

SEQ ID NO: 7625 - DNA, 381 bp, Myxococcus xanthus
atgcatcacactcgggagatacccagggaaggctggggggactacctcgccttgctgagcaacctggagcgcgaccactgggtgcgcatcgagacggagagcgtcgacttcggcgaccagccgctcgccggcaggctgccgctggtggagattgccctcgagtcgaaggggagcgaccagggctccgtggaaatcatcgtgggccggccgggcggagaggtcacccaccgcatcctcaagcccgaccacatctacgcggacgagagcgagagcggcgagctggagtgcctggacatcgaggacgcggaccaggtgaagacgctcatcttcttcgagccgcaacgcgcgggcgacgagctgggcatcggcgcgccgtcctga

SEQ ID NO: 7626 - DNA, 471 bp, Myxococcus xanthus
gttgtgaccactacaggttacgtcgaccggcccaagccgcttttggccggcatgcagatggtgcaggaccagtccacgtccaacgcctcctccattggccagaaggccgcgctggcggcgttgcaggggccgccggacaccatcgccgccatggtgaaggagtaccgcgagcgccgtgacttcttcatcgcgggactgaacgcgctggatggcgtgcgctgccggatgcccgagggcgccttctacgccttcgcggacgtgcggggcctgctgggccggtcgtacaagggcaagccggtgacgtccgcgatgcagctgtcggaaatcctcctcgacgacttccgcgtcgccgccgtgcccggcgagccgttcggcgcggagggctacgtgcgcatgagcttcgtcacctcgcgcgaggtgctgcagaagggccttgcccggctgggtgagctggtcaaggccctgagctga

SEQ ID NO: 7627 - DNA, 159 bp, Myxococcus xanthus
atggagaagaagtacggcaaggcgcccgcgcggctgggcttggacctgcgcaaccccaaggacgtgtggacggccgtgggtaacatctccggccgccccgctgtcctcgtctaccgcaagtaccgcgacgagttccgcgccttcgcctacacggactga

SEQ ID NO: 7628 - DNA, 309 bp, Myxococcus xanthus
gctctaaagccggggcaggccatcggtgccgccgtcacgctgcgcggcgaccgcatgtacgagttcatggaccgcctcatcaccgtggcgctgccgcgcgtgcgtgacttcaagggcgtgtcccccaaggcgttcgacgggaagggcaactacacgctcggcgtgcgcgagcagatcatcttccctgagatcaactacgaccagatcgagaaggtgaaggggctcaacatcagcttcgtcaccactgctgccaacgacgagcaggggctggcgctgatgcgtcacttcggcatgccgttccgtcagtaa

SEQ ID NO: 7629 - DNA, 186 bp, Myxococcus xanthus
atggccaagctctccaagatcgcccaggcaaagcgcaagccgaagttctcggtgcgccagtacaaccgctgcccgctgtgtggccggccgcgcgcgttcctgcgcaagttcaagatgtgccgtatctgcctccgcaaccgcgccctccgcggcgaagtcaccggcgttaccaagtcgtcctggtag

SEQ ID NO: 7630 - DNA, 417 bp, Myxococcus xanthus
atgccggtcaatgatcccgtcggcgacatgctgacccgcctgcgcaacgcttcgcgcgcgcgtcacgacaaggtcgtcatcccccactcgaagctcaagctcgagatcatcaaggtcctcaaggatgagggctacatcggcgagttcgtggtgcacgagcagaccgtgcagaacaagcgcacggtgttcccggagatctccgtgcagctgaagtacggtccggaccgtgcgccggccatcaccggtatccgccgcgtgtcgaagccgggcctgcgtcgctatgccgcggcgcgtgagattccgcaggtgctgggtggcctgggtatctccatcctgtccacctcgcgcggcatcatggtggattccgaggcccgcaagcagaaggtcggcggcgagctgctctgcaccgtctactag

SEQ ID NO: 7631 - DNA, 567 bp, Myxococcus xanthus
atgagtcggattggaaaactggcgatcaagctcggcgacaagacgaaggccgtcatcgccggcgagcaggtgaacttcgagggccccaagggcaagctgtcggtgaagctgcctggcaaggtcaaggtcgagatcaaggacggccagatgaccgtgcagcgcgaggatgactcgcgcgaggcgcgcagcctgcacggcctgacccggaccatcctcgcgaacgccgcgaagggtgtgagcacgggcttcgagaagaagctggacatccgcggcgttggtttccgcgccgaggtgaagggcaaggccattcacttctcgctggggttctcgcacccggtggtgttcaacctgcccgagggcgtgaccgccgaagtcgacaaggcgccgcgcaacgaggacagcttgcccaccgtgggcctgacgctccgttcttcggacaatgaagcgctgggcgcgacggcggtgaacatccgctcgctgcgtccccccgagccctacaagggcaagggcatcaagtacgccgaggagcgcatccgccgcaaggagggcaagaccggtacgacctag

SEQ ID NO: 7632 - DNA, 357 bp, Myxococcus xanthus
atgcctacgaagattgaagcccgtctcaagaggaagaaccgcatccgcaagaagctgtcgggtacgacagagcggccgcggctcaccgtgtacaagagcctcaagcacatctacgcgcaggtggtggacgacaccacgggcaagacgctcgcgtttgcctcgtcgctgtccaaggacctgaagggtcaggacgagggcgacaagaaggcggatgcgaagcgtgttggtgctctgattgcgcagaagtgcaaggccgccaacgtcgaagcggtggtgttcgaccgcaacggcttcccttatcacgggcgcatcgccgccgtggccgacgccgcgcgcgaggccgggctgaagttctaa

SEQ ID NO: 7633 - DNA, 270 bp, Myxococcus xanthus
atggcgctcaaggtgaagctggtgaagagctttgcgggtgcgtccagcgacatgctggacaccatccgtgggctgggcctgaagaagttcggtgacgagcggctcctcaaggacacgcctgcggttcgcgggatggcgttcaaggtgaagcacctggtcaccctggaaaccgtttccggcgacgcgccggcgcccaagcgccgcaagcccgccaagattgccctgcgggagcgggcgatcgcgtatcaggccaagcagaacaaggcctga

SEQ ID NO: 7634 - DNA, 528 bp, Myxococcus xanthus
atgagcactctgaacaaactgcagcgtccggcgcgctcgtggcaccgcaagaagcgcgtaggccgcggccagggtagtggtcttggcaagacggccggccgtggtggcaagggccagaaggcccgcaccggcaacatgcggttcgaaggcttcgagggcggccagagccccctgcagcggcgcctgccgaagtttggcttcacgccgccgaaccggacggtctacgcggtcgtcaacctgtcggacctcgagcagcacttcgatgccggcgccacggcggacgtggagacgttgcgcaaggtgggcctggtcaagggccgctaccacggcgtgaagctgctggcccgcggcgagctgaccaagaaggtcaccgtggtcgtgcacaaggcgtctgaggcggcgaaggcggccatccagaaggcgggcggcgcggtggaagagattccgctggtggcccacaagccggagtccgcggccaaggcgcacgctggcaagggcgtcaaggctcctcggcagcccaaggcctga

SEQ ID NO: 7635 - DNA, 1314 bp, Myxococcus xanthus
atcgctgagctgcgcagtcggctcgcgtatacgctcgcgctgctcgccgtctatcgcatcggcatcttcatcaacacgccaggcgtggaccgttcggcgatgaacgcgttcatggacgcccagaagcagtcgggcggcctcgtctcgctgttcaacctcttctccggcggcgcgctggagcagatgtccatcttcggattgggcatcatgccgtacgtcagcgcctccatcatcatgcagctgctcgccgtggtcgtacccagcctggagcggctgcagaaggaaggcgccggcggccggcagaagatcaaccagtacacccgctacggcacgatcgcgctctccgtcgtgcagggcatcggcatctcgcggtggctggcgtcgctgggccgctccgacggtggccagagcggcttcaaccaggtggtcgtccccgatgacagcgtctggttcaccttcatgacggtggtcagcctcacggccggaacggccttcatcatgtggctgggtgagcgcatcaccgagcgtggcatcggcaacggcatctcgctcatcatcttcgccggtatcgtggcgggcctgctcccgggcgcgaagcagttgctggacctgacccgtcaggacgtcatctcgatggccgaggtgctcgcgctggtcgtcttcatgctcatcatcatcgccgcggtcgtctacgtggagcgaggcatgcggcgcatccccatccagtacgccaagcggatggcgggacggcggatgttcgccggccaggcgacgtacttcccgatgaaggtgaacacctcgggcgtgattcctcccatcttcgcgggcgccgtgctgtccttcccggccacgctgggaacctggttcccgttcctgcagggattccagcgcgccatcgaaggcaacctgtggatctacaacgggctgttcgtcgtgatggtcatcttcttcgcctacttctatacggcgctgacgttccggccggacgacgtggcggacaacatcaagaagcagggtggctacatcccgggcatccgtccgggccgtcagacggcggagttcatcgagcgcgtgctcaaccggctcacgttcggtggtgccatctacctgtcgattgtctgcgtgattccgtcggtcatcagtggcttgctgggggtgcggttcaccttcggcggcacggcgctgctgatcgtcgtgggcgtagcgctggatacggtgcagcagattgagggccacctcatcagtcgtaactacgagggcttcgccggccctcgcggcccgcgcatccggggccgggtgcgcgtggcggcctga

SEQ ID NO: 7636 - DNA, 1161 bp, Myxococcus xanthus
ttggagtcccctggaatgagcatcacccaccctggcctggagccgctgcccgaatcgcctgacgaggacgtgcgcgcgcgcgtcgccgccatcgaggtcctctctccccgcgaaatcgacgagcggttgtcggacctcggctaccgggggcagacggaggcgcgccgcgcggcatccgtgctggcgtaccggcacctgcgccgcatccgtcacctgttcctggaggggctcgcccccgaaccgggcatgcgggagaactgcctcttcctggggcccaccggctcagggaagacgttcctcgtggagctgctgttccgcgaaatcctcgccgttcccaccgtgctggcggacgccacgcagttctccgaaacgggctacgtgggcgacgacgtgagcacgctgctgtcgcgcctgtacgaagccgcggaccggaacgcggcctgggccggctgcggcgtggtgtgcatggacgagttcgacaagctcgccaccagccgctccgacagccgcttcgccggccagcagaccacgaaggacgtcagcggcttcggcgtgcagcgcagcctgctgcacatgctgtccgcccccagcgcggacttcccgcccgacttcggcttcaccagccgccagcggcccgacaccatggagctggcctgcgtcaccttcatcgcgtgcggcgccttcagtggcctgagcgccaccgcggaggggctggcccggagcgaacacctgggcttcggccgcgaaccgctcccggcgcgggtggagagcatcgccacgcgagtgacggaggagcagttggaacagaccaccgccttcgcgcgctacggcttcatcccggagctcattggccgcttcaaccggctggtctccttttcgcccctggacgcgggcaccctggacgacatccttcaacacaacgtgctgcgtgcctacgagcgcgagttcgagcaggaagggctgcgcctgcaggtggacaccgaggtgcgggagttcgtggtggcccgcgcgctcaagcgggagacgggcgcacgagggctgcgcaccacgctcgcccccttgctggagcgggccgcctacgagcactttggccaccgagacaacgacggcacgctccggctgacgctggaggccggcgaggtccaggcgcggcgggtgtag

SEQ ID NO: 7637 - DNA, 100 bp, Myxococcus xanthus
atgaacctgatcctgttggggccgccgaacgcggggaagggcacgcaggcgaagcgactgttcgccgacttccagatcccccagatctccaccggagaca

SEQ ID NO: 7638 - DNA, 585 bp, Myxococcus xanthus
ctcaagtccatggtgatggcggacatcctggacatggtgacgcacgaggcaccgctcatcctcggcggcaccacgctggcggtattgctggccatgtggctgacgctgggcggcctgcgcatcgccctgctgtgcatggcgcccaccgtggtgtcactggtggcgctgctggggctgatgccgctgctggggctggagttcaactacctcaacatcctcgtcatcccgattctcatcggaacgacggtggacgcgggggtgcacctgctgacgcgattgtcgtcaccaggccatgacttcgtgtcggtgtattcggagacggggaaggccatctgcggcggcttgctgaccagcgcgatgggcttcggtgcgctcttcctcgctgaccacccgggcctcaactccattggcgcacttgccaatctgggcttcgccaccaacctcctcgtcatgctggtggccttcccggccctgctgctggtgctgtcggagcgcaggctgaagcgccattccgcccgaaaggaatcgcagaaaccggagccaccgcgccagtcggggcgcggcgagcccacgcacgcaagctga

SEQ ID NO: 7639 - DNA, 522 bp, Myxococcus xanthus
atggcgaagcagatgaagcggggttggatgtgggccggagcactggcgggtaccctggcgttgggaaccgcgtatagcgcgacggaggctccggtgcaggtggcgcaggtggacccgtccaccggacagacggtgacgccgggcaccgcgccgagcaacaccacgtcgggcacgggccccggcacgacgccgcagacgggctcgacgaacacgaaccccaacaccctacccccggcgacgaaccccaacaccctgcccccgggaacgtccacgacgacgccgggcacgggcggctccggtgctacgggcaccacgccctacaacacgggagcggagggcgccacgtccaccgttccgggcaccacgccctacaacacggacgcgggcacgggtggctccggggtgctccccacgccaggcatcggcaccacgcccggactcgacgccccgacgggcaccgggacgtccaacaccgtccccgcgccctccggcgtcgtgaacgacggcggcaccggcttctag

SEQ ID NO: 7640 - DNA, 714 bp, Myxococcus xanthus
atggagaccctcgtgacgcgcttgttgtcgctgcgagtgggcatgccccgggagctgggcgtcaccggtgccgcctcgccactggagcggccctggaccagcgccatcttcaaggagccggtgacagggccggtgtggctgtcacgcacggggctcgccggagatggccaggcggaccgcaaggtccacggcggaccggagaaggcggtcctcgcctatcccatcacgcactacgacttctggcgcgaacgcatggcgcgagacgacgtcggcgcgggcgcattcggtgagaactgggtgctctcccagggcacggaagcggacgtctgcatcggagacgtgctgcgcgtgggcggcgcacgcgtgcaggtatcccaacctcgccagccctgctggaagcccgcgcgccgctggggacagcgcgacctgtcgctactgctccagcagaccggccgcaccggctggtactaccgcgtgctggaggaagggcccgtccaggaaggcgacgtggtggcgttgctcgagcggcccttccccaccttcaccatcgccttcgccaaccacgccatgcacggccacgcgccggaggacgccgcgctgctggcggagtgtcccttgctgacgccgaactggcgtgactcgctccgcaggcgcgcgcagggtagtcggggagatgaccgcccgcggctggtgggacccaacagcgccgactga

SEQ ID NO: 7641 - DNA, 291 bp, Myxococcus xanthus
atggatgacccggccctgtcgcccgagtcggagaccgtggacccgacgctgaacccgggcaccggcggcgcgggtacggaggtggacccgaacctggacccggacatgagcagcgagccaggcaccggcggcgcgggtgacgtggagccgctcgacaacacggacaccgatgagatggatgccaatgacgactccacgctggagccgggcaccggcggcagcggcatgacggacccggacacccgggtgacgccgcccacgccgctcccggagacgggctcgacgcgctaa

SEQ ID NO: 7642 - DNA, 1182 bp, Myxococcus xanthus
atgtcgtcgtggttccacgagcgccatggcgagctgctcgaaagcgccgtactgggcaccggccccctgggcgctcccacgctccgactgcggctgcacccggcggcgggcgaggtcgcgctggtggccacctcgggcgcccacgtctccgtgtccgcggagacgtccaccgtgggccccggctaccaccgcttcctctgcgacacgctgagggccatgggtgacgcgctcggcatcgtctgggcggagggccgcgcgtcctcgaaggggggcgaccccaccggctacttccacacgggagacgccgggcccgtggatgtgcacatgctggcgtcgctccaggaagccgtggggtgggtgctgcgcatgctcccccagggcgagtccggcttcgcgctgtccatgcgcttcggccacaccttcgaatatcccggtgcgctgctgacgccgctggggcctcgcgacacgcgctggctggtggacgtgtacgaggacccgcgcaggggcatcgacgtgttcccctggtggacgccgggcatcgacgcgcgcatgcggctcaatcgcgcgcggtgccgcctgtggacggacgtggtctggcgcccaccgctgctggacgacgagcgccacctgatgcgcgacgtggcccgcctgctggagcaggcctggcgcgagaacccgtccctgccctatccgtggcgggagtggcaggaggtgctcggcttcctgggcgtgggaggcaccctggccgaggaagtccaccagcgcgcctcccaggcacctggcggcccgcccatgggctatcggcgcggcgaggtccaggtggcgctgccagcgggctgggagattcgcatcccggggtcgctcgcggaggcgcacctgcaggatggaacatgggtggcccgggaccatcggcgcagcgtgcgcttcgtccccctggaggacggcggcgccgacagcctcatgccctccctcatggagcgccgcgcgatggacctggagcaccacggcaagcgggtcagcggacgggcctcactccacatggagccgggcgagtgccggctgaccgccctgtgtacctcgggcaagcgccgcgccctgtgcgtggtgagcttcgacgacccggacgagcaggactgggcgctggggacctggcgctcactggaccacgctgtcgccgcgtga

SEQ ID NO: 7643 - DNA, 964 bp, Myxococcus xanthus
cagaatcgagagcctgcaatgagtcgggaagtctggccaggcaagccctggcctcgcggcgccaccttcgatggttcaggggtcaacttcgccatctactcccaggtcgcgacccgcgtggaggtctgcctgttcgaccccgcggacccggcgcgcgaaatcgaacggttcggcctgccggagtccacggacttcgtgcaccacggctacgtgccgggcctggagccaggcacgctctacggtctgcgcgttcatggcccgtacgagcccaccaagggccaccgctgcaatccgcacaagctgctggtggacccctacgccaaggcgctctacggcgacgtggactggcgccagccggtgttcggctatccactggggcacgagcagcaggacctggcgcgagacgaacgcgacagcgcggcgggcgtgcccaagtccgtggtggtgagcgactacttcgactggggcaatgaccggcgcccggacatcaactggcgtgagacggtgctgtacgaggctcacgtgcgcggcctcaccatgcgccaccccggcgtgcccgaacacctgcgtggcacctacgcgggcctggcctgcccgcccgtcatcgagcatttgctgaagctgggcgtgacgtcggtggagttgctgccggtgcatgccttcgcggacgactcgttcctcgacgacaagaagctgtccaacttctggggctacaacacgctgggctacttcgcgccggagcagtactacgccagtcgcaagacgcccggcgccgccgtcgccgagttcaaggcgatggtgagggacctgcacgccgcgggcatcgaggtcatcctcgacgtcgtctacaaccacacctgcgagggcaaccacctggggcccacgctgtcgctcaagggtatagaccacgcgagctactactggctgaagcggcggggggggctgacaagtgtctcaagggggc

SEQ ID NO: 7644 - DNA, 633 bp, Myxococcus xanthus
atggacctgctgatggtggacgggcagcgcgcgcccttcgccgggctgggcgtggatggcaaggtgctcaacgactacatctgggtgaaggagaacctgggcaagggcttcttcaagagcgtcctcagcggcagcggcgggtacttctccgcggtggcctgcaagacggtgcctcactatctcacccactcccactgggtggagtgtgaggtcgtcaatggcgcctccgaggcctaccggctggggccggatggcggcgcgatgggcgagccgctggccccgggtgccactctcttccgcggccggctgatgatggcggcggcgggcaccatgcccttctacggctacggcttccgcatgttccccttcgcgggccagcgcccgggattcatgcagttgcgactggggcaggtgacgcccacgcaggtgctcacccacctgcccaagctatggaacggccgctggttccccgaaagcctgatggacttccacgcccgcgaggtcaccatccgcttcgccaaccccatgcccttccaggtgggtggcgacgcggccggctaccgcgagcaggtcaccttgtccgtggctccggagtccgtcgagttggtggacttcaccggcgcgctgaactga

SEQ ID NO: 7645 - DNA, 549 bp, Myxococcus xanthus
gtgggcaagattatcgggatcgacctgggcaccacgaacagtgtggtcgcgatcatggagggtcgcgagcccaaggtgatcgtcaacgaggaaggcagccgcatcacgccctcggtggtcgcgttcacgaaggacggggagcgtctggttggtcaggtggcgaagcgccagtccatcaccaacccggagcggaccatctactccagcaagcgcttcatgggccggcggcacgacgaggtgtccgaggaggccacgctggtcccctacaaggtcgcccgggggcccaacggcgatgcgcgcgtggacatcgacggcaagcagtacagcgcgccggagatcagcgcgcaggtgctgctgaagctgaagcgcgcggcggagaactacctgggtgagaaggtgacggaggcggtcatcaccgtccccgcgtacttcaacgacgcccagcgccaggccaccaaggacgcgggtgaaatcgcgggcctcacagtgcgccgcatcgtgaacgagccgaccgccgcggcgctcgctttagagctcactaggagtagt

SEQ ID NO: 7646 - DNA, 762 bp, Myxococcus xanthus
atgagcccgcatgagcccttcccgctgtatcaccccgcggatgtccggcgcgccttcagctcggatgatgcaacgcggcgcttcgcgaaggtggcccagctggagcccggctcgcgcgtgctggtgctcggctgtggccccgatggaagcgccgcgctgctgttggcccgggagatgggctgtaccgtcgtcgcggccgacaccgacgacgccctcctcaacccggtgcgtgagcgcgtgcgggcacaggggctggcggagcagattgaagtccgccgcgtgtcgctggacgcgctgggcctgtccgatggggagttcaacggcatcctcatccagggccgtgtgctctacgcgttgaaggccacgctggcgaacatgcgcagtctgctgtcgaagcgcgggcggctgggcttcacgttccccgcgcgggtggggcgctttgctcccaaggcctcgctcgacttctgggagcgccgcatcgccgggccgctgctgctgccgcgcgagttgctgcaggtggtggagggcgccggctacgagcccgagtccgccgagtcgctccatgacgcggagctggacgcgcactaccgggacatcgagacgttcctgtcgtccgtccctggctcgcagcccgccgcgctccgcgaggagctggcgctgcaccgcgagagcaacggcaaggccagcgtcagctacgccttcgtcgtgggccgccgcaaggagcagggcgagaagcccccagcgtcccgcgaccgcgggtaa

SEQ ID NO: 7647 - DNA, 654 bp, Myxococcus xanthus
atgttcgacgtgtggaccaagctgctcatggagcacgaacgcgtgacggccttcctcgcgcgcgcggcgcggcggcaccatgtccgcgtgctcgtcaaaccctcggacgcgtatgacgcgccgctggagcacatgatgctggcctcctcagggcaggtgcccggcgccagcgaccggggccgcgtgcgcttcagccccgaggagcgcgagcaactgggccgctacgacgtgccgtacttcttccgcaaggcggacggcggtcccctgctgatgatggatgcgccgcccacgtccgcggccttccggcccgtgggcgagcaacagttcctggggtccacaccgccccctgccccgcacatcctgaacggcgaacagctcggcctgatgaacctgggcgtggccctgcgggatgcggtggacgccgtcgcccaggacctgcgccaccgcgtccaggaggcgccccagtggggcgtgcgtctgtcattggcgaaggaccgccgcacgggcgcggtgtccttcgactggccggagacgggcaagcgcctgacgttctcctggaaccgccgcaccgtgcgcctcaccgacgaagcgctggacgaggcgcccgccccccagcctgggaggcgggcccggcggaagccgcctaccgcttga

SEQ ID NO: 7648 - DNA, 306 bp, Myxococcus xanthus
atgacgaaggaagacgcaggaagccctcccgccggcgaaggggagaagacgcccctcatcgagtacccctccgtctacaccttcaaggtgatgggcgcgcagggggccggcttcgtggagcatgtccgtgagctgttcaagcggttcctgggcacggagctctcgccggattccattcgcgagcaacccagcagcaagggcaagtacgtctccctgagcgtgtccgtgtacctgctgtccgaggagcagcggcgcgccatctacgatgggctccacaaggacgagcgggtcatctactacttgtag

SEQ ID NO: 7649 - DNA, 1320 bp, Myxococcus xanthus
atgcgtaagaacttcattctcgacaccaacgtccttcttcacgatccccgcagcatctacggcttcaaagacaacaacgtcatcatccccatctacgtcatcgaggagatcgaccagttcaagcgcgatctctccgagctgggccgcaacgcgcgcctggtggcgcgctacctggattcgttccgcgccgagggctccctgaaggaaggggtgcctctgccgcacggtggcttgttgcgcgtgagctttaccgaacgtgcgctgcctccgtccatggcggacagcaacctgatggacaaccgcatcctcggggtggcgctcgacctgatggaggcggagccgggcacgcaggccgtcttcatcaccaaggacaccaacctccgcatccgcgccgacgccctgggccttatcgcccaggactacgacaccgagcgggtggaaatcacggagctgtacaccggcttcgccgagcggctggtccccaaggacctggtggaccagatgtaccgccagggcgccgaggtggagccgccggacgccgagtccctgttcgccaatcaggtggtgctcctcaaggacgagacgaacccgtcccacaccgccatgggccgcttcaacgggtccaagggccgcctggtgcccctggtgcggcagatcaaggacgggacgtggggtgtccgcccgcgcaacatggagcaggccttctgcctggacctgctgctcaacgacgacgtcaagctggtcaccattgtcggcaaggcgggcacgggcaagacgctgctcgccatcgccgcgggcctgcagaaggtgacggaggaggggctctaccagaagctgctggtcagccgtcccatcttcccgttgggccgggacatcgggtatctgcccggcagcgtcgaggagaagctgaatccctggatgcagcccatcttcgacaacgtggagttcctgatgaacctcagccgcgcggacaagaaggccgggcgcggctaccacgaactgctggacctggggctgatggagatcgagccgctcacgtacatccgtggccgcagcctgcccaaccagttcatcatcgtggacgaggctcagaacctcacgccgcacgaggtgaagaccatcatcacccgcgtgggcgacaacacgaagatcatcctcacgggagacccgttccagatcgacaacccgtacgtggacgcgacgaacaatggcctggtccacgtggtcaaccgcttcaagagcgagaagatcgcggcgcacatcaccatgtccaagggtgagcgcagcgccctggccgagctcgccgccaacctgctgtag

SEQ ID NO: 7650 - DNA, 948 bp, Myxococcus xanthus
atgcctcggattcagcccatcaacccccgctaccgtcgcatctatcaggcgctgagcgggccggacctggccgtttccgagagcgcggggatgaccctggaagacctggggctgggcagcgccgaagcctcccgcggggacctcgtctttggcacctacagcccccagggcctggagcgggccctacgtgcctatgggctgttccagcgcgtcgaggagcgggtggggccgctggagcttcgcgtcgtgtgcacggacccgtaccggccacgcatcatcctgtggagcaggcggttctacgtccccgtggcggacctggacctgcggcggacgaccggggcggaggtggggctcggtgacgcgctcgccgccacgccgctgctgtacctggactcgctgttgctccagaacccggggcgcgccttcgactggaaccggcctccgctgcccgggcagaaccaccccgggctcaagctcgccggccacatcctggacgtgctcctgctgatggcccgccgtatcggcaccgaggccttggccctcacgccgtccaccttcgccgccgcctgcgtctatgaccgccgcttcctcttcgtggatggcgccgcgcagggccgcttcctcgcgcttcgtcaggcggggcggcacctgccgcgctggctccatgcgtgggcggtggagctgcactgcatgcgggacgagcacggagaggccgtggccttcaagccttcgcccatggtgtctccgctgagctcgcggctggggctgcacttcgatgcgaacacgtgggatgacgcgctccaactggatgcccggcggcagctcacgctcgatgaggagacactccagcggcgctttccctgggagcggatgcccccggggccgccgcccgagcgggtggcggagctgcttggatatgatccgctcgcgcctgtcgtggcgcactga

SEQ ID NO: 7651 - DNA, 531 bp, Myxococcus xanthus
atgtcccaggacgtacatccggatgaacaggagaccgaggacgacgccgagcgggccccgttccgccgctacctcacccgggcgggcgccgagcgcctgcaccgcgagctcgtccaccttctcaacgaggagcgccccaaggtgacggccgaggtctccgctgccgccgctcagggcgaccgctccgagaacgccgagtacatctacgggaagaagcgcctgcgcgaaatcgaccgccgcctccgtttcctccagaagcgcctggacaccgccaccatcgtcacgcccgccgagcagaccgaccgctcccgcgtcttcttcggggcgacggtgagcctggaggacgaggacggcggccgcagcacctaccagatcgtgggttccgacgagattgacgcctcgggcgggcgcatcagcgtcgaatcccccatggggcgggcgctccttcgcaaggccgtgggagactcggtcgaggtgcggcggccgcgcggggacatcgaactcacggtggtggacatccgctacgaatag

SEQ ID NO: 7652 - DNA, 3909 bp, Myxococcus xanthus
cgcgacggctacctctggctgggcacgtgggaggggctggcccgtttcgatggcgcgcgcttcacggtgttcgacaagcgcaacgcgccggagctgcgcaaccacaccatcaaggcgctcgcggaggatgcgtcgggcacgctgtgggtgggcacgggccaggggctggtggcgtaccgcaagggccacttcgagcgcgcgccgggcgccgccgcgtcgctggactccgcgcgggtggagacgctggtggccgcggatggcgtgctctgggtggggacgacgacgggcctctggcaggtgccgctgggcgagggcgtggcgcgccagtacacggaggcggatggcctgcctgcctcccacatcacggcgctgacgcccggtgagggcacgtcgctctgggtgggcacgccggaggggctggcccggtgggtggatgggcgcgtggagccggcgccgttccccttccccgggccggagtcccggccctatgtgatggcgctgcgtcgcgatgcgacgggcgtgctctggctggggacgaaagcgggcctctattcgtggaatggcctggtggcctcgcgcttcacgaccgacgaaggcctgccgtccctgtccgtcaacgcgctgtacgccgacggtgacggcaacctctgggtgggcacgcatcgcggcggcctgacgcggcacaactcgaagggcttcagcgagccggtgcccggcatggagtggatggcggagtccgcggtgttgtcgctgctggaggaccgggacggccacctctgggtgggcacctattcgggcctgatgcgcctgcgtgacggtcccttcgccacatatggcatccccgagggcctggccgacgagacggtcagcgccgtgctggaggaccgccgcggcacgctgtgggtggggaccaccagcggcctgttccggtacgagaaccgcacgttccaccacgtgggcaccgagcaagggcttccggagagcgtcatccccgcgatgcacgaggcgcatgacgggacgctctgggtgggcaccctcaccggtgcataccggtatgacggccagcgcttcacgcgggtgtcgcgcgcgcaggggctgccgcacgacgtggtgacggccatcctggtcgactcgcggggggacacgtggctgggcacgcaagcgggcctggcgcggatgcatggcggcggcgtgacggtgtacggcccgaagcacggcttcaccaaccccatcatcgtcatggtggaggactcgcgcggccgggtgtggttcggctcggacacggggctggtgcgctgggacggcgagcagaagggcttccagcgcttcacgcagcaggacgggttgccgggcgacctggtgctggcgctgcacgcggaccctgacggtacggtgtgggtgggcacggagacggggctgggccggtggcgcgaggacacctgggcgcgcttcaccgtcgcgcagggcctgtacgacgacgcggtgttcagcctggtgccggacggggacggctcgctgtggatgagcagcaacaagggcgtgtcccgcgtgtcccggcgcgacctggaggacgtggcggctggcgtgcgtccgcgtttgacgacgatggacttcgacacgcgcgacggcatgcgcagcgcggagtgcaacggcaacacccagccgtcggcgtggcggggggaggacgggcggctgtggttcaccaacctgcgcggcgccatcgtggtggacccggtgcgggtgcgcgagagccggcagccgcccgaggtgcggattgaagaggtgcgcgtccagggcacgccggtgccgatggaggggccggtggagctggagcccggggcctcgcggctggagattcgcttcacggccttcacgccggtggacgcggcgcggctgcccttccgctaccggctggcgggccatgacgacacctgggtgcacgcggagtcgcggcgggccctgtacaacggcctgcggcccggcagctaccgcttcgaggtccaggcgaagggccgggacggcgggtggaccgagccggtgtccctggacgtcgtgttggagccgaagctgtggcagcgcacgggcttctggctgctgtgcgtactgggcgtggggattctgggcgtcagcgtgtacctgctgcgcgtggggcagttgaaggaccgcgagcggtggctggcggagcgcgtgaaggaccgcacgcaggcgctggcgcgggccaacgcggagctggaggcgaacatgcacacgctccggcaggcgcaggcgcagctcgtgcagacggggcggctggcggcggtgggacagctcgcggcgggcgtggggcacgaaatcaacaacccgctggcgtacatcgtgtcgaacctggagcacgccagcgaggaggcggacgcgctcgcgcgggagttggacgggacgcgcgacgtgggcgctcgcttgaaggatgtgaatcaggcgctgcgtgacgcgctgctgggcgcggaccgcgtgcggcgcatcgtccaggacttgaagatgttctcccggccggatgacgagaagcaggggccggtggagttgcacgcggtgctcgactcggcggtgaagattgccatgggcgagctgcgcccacgcgcgaagctggtgcgcgactacggcgacgtgccgcgcgtggagggcaacgaggcgcgcctggcacaggtgttcctcaacctgctcatcaacgcggcgcaggcgctgccggagggacaggcggggacgaacgaggtgcggctcgtcacgcgcaggggcccggatgggcgggtggtgacggaggtgcgcgacacgggcagcgggatttcgctggagctgctcggccgcatcttcgaccccttctacacgacgaagccggtgggcgtgggcacggggctggggctgtcgctgtgccacgcctacctgacggccatgggcggcaccatcgccgtggacagcgaggccgggcggggctcggtgttccgcgtgacgctgagggccgcggcggaggcgcagcgggttggcggggacggtgcctcggtggagcctcccgcgacgtcggaccgaggcgtgccgggggccgccgtgcctgtgactccagcgtcttcgggagacatcgcaacggtgcccgatgtgtctgtcgagcacggtgtggcggcgagcgacgcgaccacgatgcgcctgcgtggcgaggccgccccgcgtgccgaactggactcgacgccgcaggcctctgctccggagcggacgcaaggcgctgggtggggcatcactcctccacaggcgaagtccacggacggccgggcagcggattccgccgccctggcggcgagccaggagaacggagggcggatggccgcacagaacgccagtgtcacgtccggcatgtcacggtcatcggaggcgggcaccgtgggctcgcaccagggagagccgtcgtccacccatgcgagcgcggaggggtcgcctccagaccgcatgggcgaggatggacggttctccgctaccgaggcggcaacgcgaggccgcgtgctggtggtggacgacgatgccctggtgagtggcgccatccgccgcactctcgcgcgagagaacgacgtggatgtgttggtgagcgcgcggcgagccctggagaagctgaccgggacagaggcccgttacgacgtggtgctctgcgacctgatgatgccggagatgaccgggatggacctgtacgacgcgctcgcgcaggtggactcgcgagcggcggagcgcatcgtgttcatcaccggcggtgccttcacggccaccgcgcggacgttcctggagcgcgtggcgaatccgcgcgtggagaagcccttcgacccggaagccttgcgccagctcgtccggtccgaagtggcgcgtgctcgccgggaggcgtcgggccgggcggcatag

SEQ ID NO: 7653 - DNA, 645 bp, Myxococcus xanthus
ggtgagtccatggatgccatcgcgttgctgaaggcggaccacaagacggcggagcagttgtttcgaaagttcgagaaggcgggccccaatgcacacaagttgaagcgtcggctggtggaccagatggtcaccgaactggccgtgcacgccgtcatcgaggagcaggtgttctaccccgcggttcgttcacgctcggaggagttggggccggacgtgctgcgctcgttggaggagcaccacgtggtgaagtggctgctggcggagctggacggaatgtctccggaagccgagcgtttcgacgcgaaggtgcaggtgttgatggagaacgtgcgcgcgcacgtcctgcaggaggagagcgacctcttcccggcgctgaagaaggtcttccgtccgcaggaacttcggacgatgggcgacgtgctggagatgtcgcggaaggcggcgcccacgcggccgcacccgatggcgccggacacgccgcccggcaacctggtcgtgggcgcggtgtcggcggtgatggacatgggccgggatgcgctgagggccgcgcggcggaaggccaccacgaaggtgcgctcggtggcgagccggggccccggtcaggtggtgcgggagatggccggcgccgaagccagcggtccgtga

SEQ ID NO: 7654 - DNA, 137 bp, Myxococcus xanthus
atgttgctcactggcctgacggccttcgcgcagccccagcccgtctccgcgccgcgtgcgcaggccccggcgggcatgcggacgattcgcgtggaaggcaccggtgaggtgaaggcgcagcccgacgaggcctgtag

SEQ ID NO: 7655 - DNA, 972 bp, Myxococcus xanthus
atgaatgacatcctgcgcgtccgggtcgcgcgcgtgactcgcgaggccgaggacatcctgtcgtacgagctggtcgcgacggagggaggccccctgccccctttcgaggccggcgcccacctggaggtccgcgtcccaggtccgggagacttcctgcgcgcgtattcactctgcaacgacccggaggagacccaccactacgtcatcgccgtggcccgcgatgccaagggccgcgggggctcgaacgccatgcacgaacgggtgcacgagggggacgtgctggaggtgaagcctcctcgcaacaacttccccctgctgttcgcgcgcagctacgtgctggtggcgggaggcatcggaatcacccccatactgtccatggcgcgcgtgcttcagcgcaccggcgcggactacacgctgcactactgcgcgcgcgcgcccggccgcaccgccttccacgaactgctctcccaggcgcccttcgccgagcacgtgcgcttctccttcgacggaggggacccggcccggggcctggacgtgaagggactgctggccacgcgacagccgggggcccggctgtactgctgcggtcccacggggttgatgaaagccgtgcgcgacgcggccaccctgcaccgctggccttgggagaaggtgcacttcgagtccttcaccgccgagggcaccagcgccgccacgggccgggaggagcagggtttcgaggtgaccatccgcagcacgggccaggtgctgcaggtacccgtcggccagtcggtgctcaacgtgctgcgtcgcaacggtgtgcgcatccccagtgactgcgaggccgggacgtgcggcacctgcgtcacacgggtctgcgatggccagcccgaccaccgcgacaccttcttccaggcggagcccgcgggtgaccagcgcatgctcgtctgcgtgtcacgcgcccgctccaagcggctggtgctggacctctga

SEQ ID NO: 7656 - DNA, 1968 bp, Myxococcus xanthus
atgacgaagctgctcacgttgattagccggcgctcgttcctggaagggctgaatctgtccgtgggagggctcgccctgggggtcttctccggaggcctggccgcggcggccagtgacgcctccacggcgaagggcgctccggggttgaacccgaacgtgttcgtccacgtggctccggacggagcggtcaccatcgtctgtgcccgctcggagatggggcagggcgtgcgcagctcgctgccggtgctcgtcgccgatgagctgggcgcggacatggcgcgggtgacggtggcccagcccgacggtgacaaggtctacggcgaccagaacacggacggctccagcagcgtgcggggcgtgtacgacgacatccgccgcatgggggccaccgctcgggtgatgctggtggccgccgccgcccgccgctggaaggtgaagccggaggcgtgcgaggcccgcgaccacgcggtgttcctccgcgatggcaagcgctcgctgggctttggcgaactggtggccgatgcgtcgaggctgcccatcccgaaggcgaaggacgtcaagctgcggccgaagagtgagctgcggatggccggccggcccatgccgctgctggatggcccggcctatgtgacgggaaccgcggtgttcggcgccgacatccgtctgccgggcatgctcatcgcggtggtggcgcgcccgcctgtcgtgggcggcaaggtcgttcgctttgacgccacccgcgcgctcgcggtgcccggggtgaagaaggttctcgaactgcccgcgccgaagccgccctacacgttccagttctggggcggcgtcgcggtgctcgcggagaacacctgggcggcgatgcgcgggcgcgatgccctggacatcacctgggaggacgggccgaacgcctcctatgactcgacgacgtaccgggagcagttgacggcgtcgattcgcgagccgggaacggtggcgcgcaacgtcggtgacatcgacgcggcgctcgcttccgccgcccgcatcatccaggccgagtaccacatcccccaccagtcccacgtgcccatggagcctcccgtggccctggcgcgggtggagaacgggacgtgtgaggtctgggcgcccacgcagcatccgcaggctgcgcgcggcgtggcggcggcgacggcggagctgccagaggagaaggtccaggtccacgtcacgttcctgggcggaggtttcggccgcaagtccaaggcggacttcatcgccgaggtggtgtggctggcgaaggaagcgggcgttccggtgcgcgtgcaatggacgcgcgaggacgacgtccggcacgactactaccaccccgtcagcgcgcagcagctcaccgctgggctggatgcatccggcaaggtcatcgcgtggcggcaccgcaccgcgttcccgcccatcgcgtccaccttcgggcaggccacgcggcccagcccgtcggacctccagcagggtgtgctcgacctggcgctctccgtgcccaacgtccgggcggagacctgcgaggcgcctccgcacgtgcgcatcggctggctccggtccgtctacaacatcttccacgccttctccgtgaacgcgttcgtggacgagctggcgcaccttcgcggcacggattcgcgcgacatgctcctggaggtgctggggccgccgcgcaaggcgtcgctccaggaactgggcatcaccgcgctgcggaactatggcgcgtcggtggaggaccaccccgtggacgcggggcgcttgcgcggcgtcatcgagcgcgtgacggcgatgtccggctgggacgcgcgcaaggcgaatggccgggcgctggggctcgccgcgcaccgcagcttcctcagctacgtggccgtggtggcttctgtggtcaaggatgaccaggggcgtatccgcgtcgacaaggcgtgggtgtcggtggatgcccggacgatttctaatccggagcgc

SEQ ID NO: 7657 - DNA, 447 bp, Myxococcus xanthus
cgcatcaacggtgaggagaaggagctggacgtcgacccggagatgccgctgctgtgggcggtacgggacgtgctcgggctcactggcacgaagtacggctgcggccaggcgctgtgtggctcgtgcaccgtccacctcgacgggcagccggtccgcgcatgcgtgacacccatccgccgcgcggaggggcactcggtgacgaccatcgaagggctgtcgcccgacggcaaccacccgctgcagaaggcctgggtggagctgggggtgccgcagtgtggcttctgccagacggggcagatcatgtgcgcggcggcgctgctggcgaagaagccgcagccgtccgacaaggagatcgaccagtcgctcgcaggcaacctctgccggtgtgggacgtacacgcgaatccgctcggccgtgaagaaggccgcgggcatgtccgaggagtga

SEQ ID NO: 7658 - DNA, 144 bp, Myxococcus xanthus
atggtgaaggcgaagacgaagacgaaggcgtccaagcagaccaagaagctgacccaggcgcttcgggagctgaacaagacgacgaagcccgcgggttccgccaacgtgttcaatacctgctcgcgcttcatgtactgcgtctag

SEQ ID NO: 7659 - DNA, 633 bp, Myxococcus xanthus
atggcctcgctctccgccctcctgctggcgggagggtgcaagcgggagcccgatgccgcggcggcgcagattcccgcgctgcccgaggttgcccccaacgcgttgcgacccgtggaagccttcgcggccatcctggaccggaaggagcgctcccgcgcgctcttcctggaggccagtcgcgtcttcttccacccgcggtgcgcgaactgtcacccggcgggtgacagcccgctgcaaggtgacgacggccagcttcatgacccgcccgtggtgcgcggccccgaggaccagggcgtggtgggcatggagtgcatcagctgccatcaggacaagaatcaggacctggcacgcgtgcccggcgcgccgaagtggcatgtcgcccccatcgaaatggcgtgggtggggaagagccctcgtgaggtgtgcgagcagctcaaggacacgaagcgcaacggcggcaagacgcccgagcagatgattgaacacaacgcccacgacgcattggtggcctggggatggaacccgggctcggggcgtaagcccgctccggggacgcaggcgcagttcggcgccatcgtcgcggcctgggtggagacgggctcggagtgcccgagcgaggaggcacggccgtga

SEQ ID NO: 7660 - DNA, 2437 bp, Myxococcus xanthus
atggacctgaagcttcccttcgtggtggccccgcacagcggccggctcgtcgaggcctgggtgcccgccttcttcccggcgctgcacaaggtggggcccagcctctccatgctgcgagacgaactcgcgctcgccgtcatggagcgcttcgagcgcgaatcgccctcccaggtggcgcagtaccaacttccaccccacttcgccctcaagcgcgtcaccgtcgatgcggaaggaagggaccgggagaagaaccggcgcgtcgtcctccagggcaccatgtccgtgctgctggagaagtggccccgtgacaccttctgggtcgtcacccccacccggctccccgccgcgcgcttcgcgctgaaccagcccgcggacctgccccaggcgctcgcgcgacggctgatggcctggtgtctggaacacaacctggactccctggacacgcactgggcccagggccgggagcaactggagctcctggaggtggatgcctatgccccctccgtcctcccgcgcacgccgccgcgaccggcccagcccgcgcgacgccgccggaccaagaatccggagaaggaagacaccgcgcccgaaacgccagagcagcgggagcaacgccgcaaccggcggcgcctcaccctggtggagctccgggccgtggcgcgcaacctgagccacggtgcgcgagacggcacgctggaacgttgcttcggccgggaggcgctggttcgcgagctcgtagaggcgctcgaaggccgcgaaggctccgcgctggtgctggtgggtccacctggcgcgggcaagacggccctgattcatgaagcggtgagccggctcaccgcccggcaggacgccgcgggcgtgcgtcgcgacgtgtggcgcgtggacggcaaccagttcatcgccgggatgatgtacgtgggccagtgggaggcccgcgcgcggggcgtggtgaaggagctgatggaggtcggcgacctgctctacgtggacgacctggcctcgctcgtctacgcgggccgcacgcgcaatgagcgcaccaacgtcgcgcagttcctggagccccacatggcccggggcgagctcaccgtgctcgccgagtccacgcccgagcgcttcgagcgcgtgcgggaagaagcccccaccctcgcctcgctcttccgggtcatccatgtccccgcgctggatgcgcgtgccacgctgcccgcgctcctcggcaccgtgcgcgacctggaggcggaaggcacggacagcgcggtccagctctcgccgctggcgctggagaccctgctctcattgcaggagcgcttcgtgtcgcacgaggcgttcccgggcaaggccgtccgtctgctccgccgcgtcatggcccgacagggcgtcagcacctcgggcacccggcgcttttcgtcgggggacgtcatcgacgcgatgcgggagcagacgggcctaccggatttcatcctgggaagcgcccagccgaagaagcgcgaagcgctgacgtgggagatgcagcggcaggtagcgggccagcccgaagccgtggaagccgtggtggacgccatcctcacgttgcagtccgcgctccagccgtccgacaagcccctggccacctacctcttcgtgggccccacgggcgtgggcaagacggagacggcgaaggcgctcgcgcggacgctcttcggcggagagcagcggctcatccgtttcgacatgagtgagtacatggagaagcacaccgtgagccggctggtgggcgcgccgccgggctatgtcggctacgaggagggcgggcagctcaccgaggccgtgcggcggcggccctactccgtggtgctgtttgacgaggtggagaaggcccatccccgacgtgttcgacgccctcctccagttccttggtgagggacggctcacggacgcgcagggcacggtggtgaacttcaagaacaccgtcatcatcggcaccagcaacctgggctcgcacctcatccaggagtccaccgcgcgcaaggaaccgcaggagcgcatgcgggagcgcgtcatgggcgtgctcaaggggcacttcccgcccgagttcctcaaccgcatcgacgagacggtggtcttcgagccgctcaaccgcgcgcagctgcgcgccatcgtggacctgatgctggagaagacgcgccgcctgctgcacggccagggcattgacctggaggtgacgcccgcggcgctggaagcgctggtggacaagggatgggacccaaccttcggcgcgcgtccgctgcggcgtgaaatccagcgcgccatcgaggcgccactcgcggagaagctcatctcgggcgacatccatgagaacagccgcgtgagagcggacttcaaggacggaaaattccggttcgacgaagtggaggccgctgaggcggaagtcgcgcaggctgaagcgagtgccgttcactga

SEQ ID NO: 7661 - DNA, 519 bp, Myxococcus xanthus
atgctcgccgcggcctatgaggggtgggcccagaaggcgtccatggagaagcggcgaggcctgctcgccgtccccgagcgcaagtccggcgagaaggcccatcgcacccctccgccgccgcaatggcggtgggccgacgatgagaccttcgacaagctcgtcgtgcagccggtcgcctatgcgattcaggtcaagggcggcccccacgccctgctgctcgctggcgagcacggcctgcatcgcttcatcgaaggcagtcagatttcgatggtgcatgcgtacttcgagccgcggcccctctcgctgttcgacctctcctcccgggaggcgttgcagaagcagttgccgaaaaacgaggtccgtcaggtgcgcctgtcgggcagcggttccggccaggggacgctgacggaccttcgcaccggggtgcagcagcgcttcggtctggaggggcctgacctggagcccctgctggagccctggatgcagtggcgcgtcttcaacagccgggacgaggactga

SEQ ID NO: 7662 - DNA, 787 bp, Myxococcus xanthus
gtcgagatcaacgatgagacgctccgggatgggatgcaggcgacggccgtcaccagccccacggtggaagagaagcgcggcctgctcgagttgatgcaacacatcggggtgagcgcggtgagcctcggtatgcccgcggcggggccgtgggcgctcgaggaggtcgtgacgctggcgcgccacatccgggaggaggcgctgcggctcgagcccaactgtgcggcgcggacgctgcacagcgacatcgtccccattgtcgaggcggtgcagcgggcggggcagcccatcgtggtgcatacgttcattggctcgtcccccctacgccagtgcgctgaggcatgggacctggacttcattctgcgttcctcgacggcggccatcgacttcgccgtgcgtcaggggctggaggtcgcgttcatcaccgaggacaccacccgctccacgccggagacgctcgagctcctcttccgcgccgcggtggagcatggcgcttcccggctggtgctctgcgacaccgtggggcatgcgacgccagccggaacccgcgccctggtgcggtggacacgggacctggtggagcggctcggcagtccggtgaaggtcgagtggcatggtcacaacgaccgagggttggcgttgatcaacgcgctcgtggccctggaggcgggagcgacgcgagtccatggttgtgggctgggaatcggcgagcgcacgggcaatgcccccgtggagttgctgctgctcaatctcaagctcctggggtggattgaccaggacctcacgcggc

SEQ ID NO: 7663 - DNA, 639 bp, Myxococcus xanthus
atgctggaaacaacggaaggctccatcgtccgcgccaccctgcgggccctcgtggagccccgacggctgctgcccatcctcgtcatctccgtcgcgctgattaccgcgcaggtgcgcttcagccacgcccccctctgggccgcgttcgggctgggcctcttgatgtgcctgctcttcatcgcggtggccccagtctcctaccgcgtcctcttcccggagggcctggacctcagccatggcggcatccggctcctgctctacgccaccgtgggcagcggcgtggtgctcacctccggcttcgtgctgccgaagctcctgggcatgggccccaccttcctcacgcagcccaccaacctcgcggtgtgcggcgcgctcttcctcgtggggggctggggcctgggccgtgacatcggcttcgaggagagcctcacccgcgagcgcgcccgcgccgcccgcttcgcgctggaggccgagcaggcccagctcctcgcgctgcgcagccacctggacccgcacttcctcttcaacacgctcaacgccatcgcggagtggtgccgtgaggacggcgccgtcgcggagaccgccgtgctgcggctgtccaccatgctccgctccgtgctcgcgggcgtctttagagca

SEQ ID NO: 7664 - DNA, 123 bp, Myxococcus xanthus
atgttcgccctcccctcccccgtcctcgtcgtcgccgccatcgtcctcttccccgtcgtcctcgccggcagcatgctgctggacgccttcgagacggagctggaggagcgcccggcgcagtga

SEQ ID NO: 7665 - DNA, 1956 bp, Myxococcus xanthus
atgaccctgacgcagaaaatcctggcccaccatgcccggcgcctcgatcgcccctgggtccaggcgggagacgtcctgcagctccgggtggactggacgatggcgagcgagctggcctggaacggcatggaccgcacctaccaggccctgggacgcccggagctccacgaccgggagcgcgtcttcctcgccgtggaccacacggtggacgcagtgacccttgccaaggacgtgcgcgtccagcggctggtacagcgctcgcgtgacttcgcccgcgaacggaggctgcgccacttctacgatgccaacgagaccatccttcacacgaagttctatcgagagctggtccagccaggacagttggtgctgggagccgattcacacaccacctcccatggagggatgggcgccttcgccatcggactgggtggagcggacatcgttgccgcgatggtactcggggagacatggctcgaggttcccgaggccatcaccgtggagtaccagggcacgcctgcctttggcatcggcggcaaggacatcatcctgaagaccttggggctccttggaaggaacaccgccgcgctggagcggacggtggagtaccgcggagaagccgcgcgcggcttcaccacggacatgcgcttcaccatcgcgaacatgacggcggagctcggcgggctgaatggcatcttcgagcccgacgcgagggtcaccgagtggctcgccatgcgcccgtcgaacaaggacgaggccctgtacttccgcgccgatgaggatgcgccctacgtacagcgcttcagcatcgcgctggagaagctcgggccgcagctcgcccggccctacgctccggacaacgtgctggaggtccaggacgcggtagggatggcggtggacggctgcttcatcggtgcgtgcaccaccaccgaggaggagctcgtgctggcggcgctcctgttggagcaggcgctccgaggcaaggcggcgcgccccgcctcacccaagcggctcgtggtgcccggggacctcgccatccacgaacgaatgcggcaagccggcctgtggcggcactacgagcaggcgggcttccgaatcggcccgccaggctgctccatgtgtctgggcgtggcctcagaaaaggcccttcccggcgaggtgtggctcacatcacagaaccgcaactacgagaaccggatggggcccggatcacacgcttggctcgcctcggcggccactgtagcggcctcctccctggagatgcgcgtggaggacccccgcgccgcgctgaagaggatcgacccgtccgtcctcgagcgaatcctcgcccgcaagccagcgggccgccccatcgagttccggtcctccgagccacgactgcccatgacgccccagccacatgacggcggcacgcgcgcgggcacggcctccggaggacgcatcgctggacgcattcagcgcttcgggaaccatgtcgacacggacgccatcatcccgggcgagttctgccaccttgatgagccctcggagctggctcgccatgcattcaggtatgtccgccccgagtttctggaacgcgtgcagcaggggcggacgctcatcgtcgcaggggagggctggggcacgggcagctcccgagagcaggccgtctgggcgctggccggggccggcatcaaggccgtcatcgccagcagctatgccttcatccaccggcgcaacctggtgaacgaggcgctgccccacctcgtcgtgacgagccctgcgttccacgccctggtccaggaagacgaggagctcgtcgtcgacctggagacgggcctggtggagcatgtggcgagcggccaacggttccaggccgagcggcccagccccatcgcccgcgcgctcatgcaagagggcggactcgttcccgccatccggcgcctcggcgcccgggcgctccacctcggagccccctga

SEQ ID NO: 7666 - DNA, 1065 bp, Myxococcus xanthus
agaattgcggtcatccctggtgatggcattggaatcgaagtaacccgagaggtcatgcgcatcctgcaagtgctcgacgcggaaatgcggctcgggctctcactggaggcgtttgactttggcgcggagcgcttcctgaggacaggggtggggctgcccccgggccagatggatgtcttccgcaccgagttcgatgccatcctcctgggcgcgatgggggacccgcgcgtgccagacaatgcgcatgcgagggaaatcctgctgggcctgcgcttcgggctcgacctctacgtcaatttccggccctgctctccgctggcggagcgcctctccccgctcaagggcaagggaccgcaagagattgacatgacaatcttccgcgagaacacggagggcatctacggcgccatcggcgggagcttcaagcggggcacactcgacgaggtcgccattgccgaggaaatccatacccgcaagggggtggagcgaatcatccgcgccgcgttcaagtgggccagcgcccatggcaagcggcacgtagcgctgggggacaagtccaatgccattgccgcccacggcctctggctgcggacctttcgtgaggtcgccgccgaatacccgcagattgaggcgcggcactactacgtggatgccttggcgctccagatggtgacacggccggagtccctccaggtcatcgtgacgaccaatctcttcggcgacattctgacggacctgggcgcggccctgagcggtgggcttggcgttgcgccctccgccaacctcaatccggactccacgccgctcttcgaacccgtgcatggctcggcacccgagctcaccggcaaggggctggccaaccccgcggccatggtgctgagcgcggccctgatgctcgagcacctcggtcaggctggggccgcccggcgtctgagcacggccgttcagcagacggtggcggagggccagtgcacgcgcgacgtggggggaacgctctccacgacggaggcggccgacgccatcctggaccggatgctccagggactccggcggacccgcacgtag

SEQ ID NO: 7667 - DNA, 555 bp, Myxococcus xanthus
atgcacccgcccgtcccgagcctgaccgacaccaccctcgtcgccgacctgaatgcccggctccgggacgtaccggacttccccaagcccggcatcgtcttcaaggacatcacccccgtgctggcggacccgcgcctgttcggccgcgtcatcgacgccatgtcggcgcccttccggggccagcacgtcacgaaggtggtgggcgtggaggcccgaggcttcctgctgggcgcccccatcgcgctggcgctcaacgcgggcttcgtgccggcgcgcaagcctgggaagctgcctcaccgctcggtggtggagcgctactcgctggagtacggctctgacggcgtggagatgcacgaggacgccatcctccagggggagcgggtgctcgtcgtggatgacgtgctggccacgggaggcacggcggaggccaccgtgaggctcgtgtcccggctcggcggcgagttggtgggcttctgcttcctcctcagcctggacttcctcgaaggccccaaccgcctcgggcgcgagcgcgtgacgacgctgctgaccttctga

SEQ ID NO: 7668 - DNA, 129 bp, Myxococcus xanthus
atgtccttccgctacacggggtgcggcggcctgtaccggaacccggtggtccccgtggattgcgcggacccgggcgtcatctattacaggaagcgggtggtggccgagtgtacgtcggcggggtcatag

SEQ ID NO: 7669 - DNA, 906 bp, Myxococcus xanthus
ctgcccctgtcaggcggcatcaccacgctgttccatgggaactacgagcacagtccggtgggcgtccacctggaccgcttcaccacgttcctcttcgccatccggggccgcaagcggatgcgcttctgggccaagcgtccctggagcatgcccgtcaccaccctggtggactacgcgccctatctggcgaagtccttcaccgcggaggtggggcccggcgacatcctctactggcccgccagctactaccacgtcggagagagcgcgagccgggacgtcgccaccagcgtcaacgtgggcatccccgtcaccggacaccaggcccgctatgacgtggaggacctcgtgggcccaggccacagcaacgcaccacgcactcgcgacacggtgcgtggccgtgcgctggtaccgggcgtgctcgacggcgacggcgtgctgccgcgtgagctgcccgccgccctgcggcaggccgcaaacaccttgcgcgaaaacagccgtgacgcacgaacgcaggcccacatccgcaccctgtggctcaaccggcgctccgcgggcggcctcgagcccccaccacctcccgcgagacggcggcccctcaaggacacagacattcttcacgggaataaaagtttccccatcctgctggagaaaacaggaacgggttggtgttgctcagccaatggcaacgcattgcatgtttcaggccttcggcagccggtgaataaacttgtcgcgacattgaacacggcgcgcacggtaagcgtgggtgaactcttgcaccccttcccctcgcgaggcgacctgccgctccgcgccttgaaaccgctgcccgcgacgcgggcgggcatgcgtcggatgctggaaattctactgacatttcgagccatccaactggcaggccgatga

SEQ ID NO: 7670 - DNA, 807 bp, Myxococcus xanthus
ggcgcccgcatccgctacgacgacacgggccaaggtgagcccgcgcttctcttcatcccagggtggtgcaccacccgagcgagcttccagaagctgattccccgctgctccgccttccgccgtgccctgtccgtggacatccgggggcacggcgagtccgaaggtggaggcaccgacttcgacagcaccacggtgctggaggacctgctcgcggtcgtggaggccagcggcgcgcggcacatcgtccccgtggccatgtcccacgcgggctggtgggcgctcgacttgcgacgggcgttgggcccagcgcgtgtgccacggatggtgctgctggactggattgccaccgagcccaccccggccttcctccgcgccgtgcgcgggctccagacggagcgctggagcaaggtgcgagacagcctgctccagggctggctggaggggctcgacgacgacgccatccaccgcttcgtgcgcgacgacatgggcgcgttcgacgaagccatgtgggcccgggccgggcgggagattgaagcggcctacgcccgcgagggctctccgctgcgagcgctcgccgcgctggagcccatgccgcttacgatgcacctgtacgcgcggccggagtcacacgactacctggcggcgcaggtggacttcggcgcggagcatccaggttttcacgtgctgaagctccccgccaccagccacttcccggcgctggaggtgccggcgatggtggccgcgggcatcgaggcgctcgtctccgcgcgagaggtccccgtccacgcggacgccgttccggcctga

SEQ ID NO: 7671 - DNA, 609 bp, Myxococcus xanthus
atgccccgtccatccaacaccgaggagcgccgtcagcagattgtcgcgggcctgctgaaggtcatgtcggagcgcggttacgagcgcgcttccgtgagcgaaatcgcgaaggcggcggggttgagcgcggggctggtgcactaccacttcagcggcaagcaggagattctcctcacgctggtggagcagctcgcggcgcaggcgcggcagcgggtggcgacgcggctggaacgggtgaagagcccggacgcccgagcccgcgtggatgccttcgtggaggccttcctcgccacgggcgacgacgcggccccggcggccgtcgcgagctgggtcaccatcagcgcggaggccatccggcagcccgaggtgcgagccatctacgagcaggtggtgcgcgccgacctggagcacctgacgtcgctcgtcgccgccgtggtgggacggcgcaaggcgcccgcgctggcggccgggctgttcgccgccgtgcagggctacttcgtgctcgccgccagcgtcccgggactggtccctgcgggctccgccgccagcacggtgaagcgcatggccgcggggctgctggacccggccggcgcgaaggaggacgcatga

SEQ ID NO: 7672 - DNA, 132 bp, Myxococcus xanthus
  unsure (1)..(132): unsure at all n locations
atgaggacggccacgaagctggggctcctctccagcctctacctgtcacaggggcttcccttcggtttcttcacccaggccctgcccgtgctgctgcgccatcagggcctgtncgttgccttccattcggac

SEQ ID NO: 7673 - DNA, 1954 bp, Myxococcus xanthus
atgcagctgtctcgccacgagcaccgctatgactcgcgcctggtcctgtccgacgaggagctgagcgaggcgctggagctcttgcgccaccgccgcgtcatctaccgtggcacggcgctcatcgacaccgaggtgccggtgcggccccagattcatctggagtcccgcccggacggcgccaccgcgcgcatcgaactgctcttcccggacaacgcgagctacgcgctcaaggacgtcatcctcttgtcgggccggcgcacctgggtcatccaggggcagaacctgcacccggtggagccggacttcccgccgcggctgctgcgcaagtggctgctcgagcccagcatgtccttccccacggggcaactggaccgggtgctgaccttcttcgccgcgcacctgccgcgcttccgcatggcgctgaaggcggacgacatcgacgtggacgaggccgtggagcctcgtttcatgctcatgctggaaggcaaccccgagcgcgtgaaggtgcaactggccgccaagtacggccagacgacggtgccggtgtcccccactgccacgcacctgggctacgccagcggcgtgggcggggacagccgcaagctgtaccggcgtcgcgaggagctggagcgcggcgcggggaagctgctgctggatctgggtctgcgcttcgagccgcaggcgcaggtgttcgacgccacggccgacaccgcgcttgagttctgggcccggggcctggcttcgctccccgaggactgggagcgctttggcgtgcaggccccgaaggtgcgcctacgtcccaagctcaagccgcgcatccgcgtgggcatgagcggcgtgcagtggttcgacctggatgcggagttcgtcaccgacgaccaggccgtggacctgggcgcggtgcgcatgtggctggactccgggccgccgcttcgtccccctgaaggacggtaccttcgcggaggcggaccccgtcgaaatcaagcgcgtggcggacctgctcgaggaagccggcgcgctgccgggccgctcgcgcacgcggctgccgctgcaccaggccgtcgcgttggacctgctggcggacctgggggagttcaccgaggtggaggccaaggcgcggcaggccatgatggagctgcgcgagtcggcgggcgtgccgaaggtgggcgtccccgagggactccaggccacgctgcgccactaccaggaggcgggcctgtcctggctctggttcctgcgccgccatggcctgtccggcatcctcgcggacgacatgggtctggggaagaccatccagtcgctcagcctgatgcagaaggtggccaacgacgaggggcgcaagccgtcgctcgtggtggcgcccaccagcgtgctggccaactgggagcgcgaggccgagcgcttcacgccgggcctcaagacgatggtgtggcacggtcaggaccgcaaggagcgggcagaggacctgaagggcatggacctggtcctcacgtcctacgcgctggtccgccgtgatttggaccagctgtcccaggttggcttccgttacatcattttggacgaggcccagaacatcaagaacgcgggcagcgccaccgcgcaggcgtgcaaggcgctccccagcgagacgcgtctggcgctcactggtacgccgctggagaaccgcctgtcggagctttggagcatcttcgacttcctgatgccgggcttcctcggcagctcggatggcttcggggaccgctacgagcagcccatccaggtggccaacgacagcaccgcgaaggaccggctgcgccgccgtatccagcccttcatcctgcgtcgcctgaagacggaagtggccaaggacctgccgccgaagacggagagcgtcgcctggtgcgagatggagcccggtcaggccgcgctctatcgcgaggtgctggaggagagccgccgcaaggtgcccctgaga

SEQ ID NO: 7674 - DNA, 96 bp, Myxococcus xanthus
atgccgctgcccgtggaccccgagctcaaccgcatcgccatgcggcgcgcccgggagcgcaccgatggcatgaaggaagccctgggactgcggtag

SEQ ID NO: 7675 - DNA, 135 bp, Myxococcus xanthus
atgctgactggcgtcatggtggggctctgcctgggcgtgcagggggcggcgctcacgcttgttcccggcaagggcgtgcccgaggactgttgcggcgcggcggggcgccccgtgaagttcatcctcgatgaatga

SEQ ID NO: 7676 - DNA, 561 bp, Myxococcus xanthus
atggcgcgggcccacgcgctgctccacgtcgaccgtgaagccgacgcggcccaggcggcggacaaggccctggccatggtggagaccacgcagcggctgtccaggttcctcccgctggccctggaccgcgccgcgctctacaacctcgccgcgggccgcttcgaacgggcgctgacgctctatgaccgggagctgccgctcgtggaagcgagcccccaggacgaagagggcctgcgcaaccggatggtggtgcggctggcgcgcggcgcagcggcgctgggtgctggtcagccgcagcggaccttggaggacctggagcaggtcgagcgagacctggcgacgcccggtgtccggagcgcgttgaagtgggcccactccacgccggagcatgtcctgcgctcctaccgcctcatcgcctcgggcctgcgcgcgaacgcggagacccggctgggacgcctggacgccgcggcgcgggcgctcgaaacgcggcgcaagctgtacctaacacagttagaccagttggtccgcgatgagcacatccgcgccgtggcgctgggggag

SEQ ID NO: 7677 - DNA, 1806 bp, Myxococcus xanthus
atggacgcgtcgcacatcgcgctggtgagccggaccaccatccagggcgacctccacctgtcgcgcgtcgagctgggcggcgagtggcgcgtgacgcccctgctcgagcggaacctgaccagcccgaccctctcccccgatgggcgctggctggtgtacgtccccatcgagcgctccgtgcggcaggtgggccccggcttcgccgcgcgcgccgcgccccatctggaggcgctgcgcctggatgcccccggcgcgaagcccgtcccgctgtcgctcgacatcccggggcagacgggacagccgacgttctcccgggatgggcgctacctgtacgtggtgcagttcttcacggactcgaatgcggatggcgtcatcgatgccagcgacagcggcgtgctgttccgggtgccattcgcgacggagcgtgacgacgccgccgagcaagccgccgccgccaatccggaccagctcaccagtgcctcctggaactgccagtacccggcgcccgcggccacggctctggcggcgacctgttcacgcgcgcagtccctggacgtgtaccagatgccgctggatggccaggtccccagtgcctgggatgcacgccggctcagcgaagagctgaggatggtgggccgccgcgccgatgagctgctgctctatcgccaccggctgctgctcgagacgcggcccagacttcgccgcctgctgatgatgcgcatgagcatgctgcacctggcctacgaggacttcagcgcggcggagttctacgcccgccacctgggctcggtgagcgaccccgccaccgcgggcctggaggaaccgctccgcgtcctcatcgaacaccggcgagccatgaaggagcgcgagcggggccgcatggtggaggagctgagtgtcgcggagcagaagcgcatggccgcgctggatcccgcgaacgcgcccagccccgcggccgctgtcttccagcgcgtggtgcgcagtgagctggcggatgacgcgggtgacttcacgcgggcccggaaggagctggaggcggccgaaatcgccgacaccacgccgcgcgcggtgctggaggcgtaccacgcgcgagcagacgcgctgtaccggaagctccatgagcgcgagcccttgattgaagcgggccggcggctctccgagcaccgcatcttcccggccgacgaccagctcgacttcgctcgcgccgcggtccgcgccctgtaccggggacgcccctacgacgaggcggacgcggcgatggcgcaggcactcacgacagcgcccgttggttcggcctacgcgtacgcgctggagctgggccgccacatcaatgcgctccgaagcgagcggcctcctcgtgccgtgcgggaggcgctgctcggattctaccggcagcagaaggacccgctgcgcagacgggtcctggttcaggacgccgtggagcgggcggcggggctcggcgccgatggcatcatggaatcgctggcgatggtctacgtcgacgacacgccaccggggagcgaggagcgacgccgcgccgagcggctctttcgccgcgcaataatgggccgcgcctaccggcggctggcgcggcaacgccaggacatggcgcgtgcggacttcgacctggtgacgcagcggacgggctcgctggagagcgccgtcgaagccatgaacctgcgcttgcgagccggcgtcagtccggatgtggtggagaaggaagtcaccaccaccgctccgaacatgccgaaaccgctcgcgcacttcgtaaaggcctacgtcgccgtgcgccagctctccaagtag

SEQ ID NO: 7678 - DNA, 468 bp, Myxococcus xanthus
atggtggaccgcgcgacggcgctcgaggaacaggcctcgggctcgttcaaggacgtggagcagcggctggctcgcgcgggcatgaatcccacgccggtgccattcacacccaatcaactggaagagctgggcatccagcccacgccgctggtggagaacatcggcaggacgcccgcggaccgcgttgacgacctgctccgtcgccactgcgtgggcgaagggcgggacgggctgctggtgaatacccggcgccgctgccaggccgggcgaatgacagccgacgacgtggccctggtcgagcgggtgaatcgctcccgtcagttgctctggaagtggatgcggtcggcccgccccgacgtcccggaagagacgctgcgccggaactggcacaaggtgcacgcggagggtgtcgtctgcggcggttgggtcgaggccgaggatgggacctggggagagaagcagtgctga

SEQ ID NO: 7679 - DNA, 705 bp, Myxococcus xanthus
gtgattgacgaggcgcaccggcagggactgcgggtcgccgcgcacatccatgatctggaggacgccaagcgcctggtcgcggcgggggtggatgtgctcgcgcacggcgttcgtgacatggaggtggacgcggaactcgtggacgcgatgaaggcgcggggcacctggtacatccccacgctgggcctcaatgagtcgttctacatctacgccgagggaccggcgtggatggccgaccccttcttccgccgcgcgctgtcacctgacctggcgcgccagttggatgacccggcgtggcgcgccagcgtgctggaggatgggaagacagctccggtgaacaagaaggcgctgaccatcaacctgaagaacgtgaagacgctccatgacgcgggcgtccggattggcttcggcacggactccggcgccacgccggtgcgcatcccgggcttcgcggagcaccgcgagctgaagctgctcacggaggcgggcctcacgccgttgcaggccatccggctggccacggcgaacgcggcggagttgctggggttgaaggaccggggcgtcatcgaagccgggcggcgggcggacctggtggtggtgcaaggggacccgtcgacgagcatcgacgacctctcccgcatcgagtcggtgtggcaccgaggcaagcaggtgccggggcccacctcggcccccgcccaggagtga

SEQ ID NO: 7680 - DNA, 2700 bp, Myxococcus xanthus
tgctgtcaagcggcggacatcgagctcggaaggctgctggcggtaatccctgccgaatggcgtccgttcacgctcgagcgcggaaaggtcaagctggacacacaagacgtcaccctgagcgcgatgcctcaactggggcctcgcggcagactgggcctggacgtggacgtcgcgtcgctccgggtgacgggtgagccagtccggctggcgctcggcggaggacgcgtcaccctggtggcgacacctgatccgcggcaagggctctccgcgcagctgacgttcggaatcgatggcctcgacgtgggaggccccacggccctgcggattccaaaggcccacggtgaagtgaagggacatcagctccgcccagagccctcatccccgctccaggtcgccgggaacgcgagcctgtcgggcatggtggagtccctggacctccggactcccgacctccgagcgcaggccgaacggatgggcttccagctcagcgcgccgctggcggcagcacctcccctcgcactgagcgcgaacgtgcccgtcggggcgctccatgtgtcgtcgccggatgggcgcacgctgctgaaaggccccgtgcgcgtgaagctcgatgcgtcgaacgcgttcccacagctcgacgagccccagctcagccgaggccgcgcgcagctcgtgctcgacatcggcgacattcaggcgtccctggatgccaccaaggacaccgacgcggtgtcttacaccctggccgctcggaccccggacctcgccgccgcccgccccttcattcccgactcggtcgcggcgcgcattccgtggcggcacctgggcgtgagcctggactccaagggcagcgtgaaggcgctcttctcatccgcgccccggctggagcaccgcacggagctgaagctgcaacggcccgcgtgggacaacgtgacggccagcgacgtcgccgtcgtgatgcgctcgcggggtgacgcctggcgccaccagggcgatgtggacctgcgaatcgaagggctccggactggtgagaaggacatggggctccagcatcagacgctgaccctggacctcaaccgccggaagcccgcgttccggttgggcctcaccagtcatgaagggccgaaggtcatgctggacgccgcggcggcgttcgaccggaaggcccgcgcccttcgcatcgacgtgaagggcgacattcccccactgggccccctggcgcccttgctggccatggcgcaggtgcccccggagctggatgccgggcggctcgcggtgggcatcgagctgcacggcacgcttcgcggcgtgctcacgggtgtcacagccgatggcaccccgcgactcgccccggacccggcgcgtaccgccagcttcgatggaacagcggtggtgagcgcgcggggcctgcgctggaggcaggacgccctttcgctcaacgttcccgcgctgcattggcagctggcgtctcgcgtcgaaggtcccaagcgaaccgttcacagtgacctgcgcgtggagaagctcacggtcggattgagcgatcggcggctgtccttctcggagctgaccagcgacaccaccgccagcttcgccgaggcgctggaagcggatgacatcgagctgaagcagcacttgaagcttcgcgcgctcgaacagaacccggcgctgccctatccggtccaggacgtggaagcgacgttctccgcgcggcgcaagcccacgggcgtcatccatgttccccagctccaactgaccaacgcggggaccagcacccatttaaaggtccgggggcggctcgacctcagcgaggaccggcgccgcctggggctccggggcgagctgtcgcaggacatggccaggctcgcgcgccccgggatgctggagggaagcggcaaggtcaccgtcgacttccgcgtgggctcacccgacctcgtcgtcttccggaccgtctccaacctgctcctccaggacttgaacctgcgcctgcccgagcaggggttcgagattgaagggatggacggcaacgtcccgctcaccgagaacctcgagttcagcgagggacaactgcggctgctgagcgacatcgacgtgaacccgtacccgatgcttcgtttcgccgaccagcatcccctgctctcccgcagcgggtatgtgtccgccaaacgcatcagcacgccgctcgtcgccgtcgcgcccctggcggggaacctgtccatcgaccagcacgtcgtctccatgacgcagttggagatgggggttcgcggtgggcgcatcaccggacagtggctcctggactggcaaggcaagcactccaccctggaggcccgcgtgcgagccaccggggtccagtcctcccgaggcgagcccttcgacggcaatgccgccgtggtcatctccgcgaaggaccgcagcatcaatggccgcgcggagattctgcgcattggcaaccgccacctgctggacctgctcgacatcgaagacccccgccatgtcaaccccgccaccaaccgggtccgctatgccttgcggctgggctacccggagcacgtgcgggtgagcttcaaccacggcttcggcagcctgcgcatcaccatgggcggcctggcgaagctgctcagcatcgacgaaatccgaggcatccccatgggccccatcgtcgaccagctcatcaaatccatgactcctccggagaccacgccatga

SEQ ID NO: 7681 - DNA, 717 bp, Myxococcus xanthus
cgggtaatgcggctgctggacttcctgcggggacgggatgggacgacggtggcggagatctccgaggcgctcgaagtgagcgcacgcactgtccaccgggacctggcgacgctgcgggaacagggcattcccctgagcagcgacacaggccctgggggcggcgtccggctggaacgggaccggggcgtggcggccgtccacctgtcgcaggaggaagtagtggcgctctggctggccgccaacctgtccgcgacgggcagcacgttgccctggggcggcgcggcgcgctcggggctccagaagctcttcgccagtgtccccaaggagcgggcccggggaatgcgcgagctctgccgccgcgtggtcgtgggacgacccgcgagcgcccgcgtgctgaaggacgtcggcacaccgcccgaggagctgctcgccgtcttcgagcgggccttccgcgagcaggtctgcctctccttcgagtaccgcgaccggcacggcaaggcgactcgccgcatcgtggagccgcacgggctgctggtggagtcgcccgtctggtacgtgctggcccgggacgtggagaaggccgcggcgcgcatgttccgcatggatcgcatccgccgggcccgcctcgtccccgaccgccccttcacgcccgacatggagggcttgcgagcccaggccgatgcccagcgcgcgaacggtacgcgagccccaggctga

SEQ ID NO: 7682 - DNA, 753 bp, Myxococcus xanthus
atgtcgctcccggcgcccttcctgttccggcgcgatgccctgcgcgaccgccgggccaccctggcgatgctcgtcgtggcgctggcggacgctgcgaacacggccctcttcttcgccgccatggagcgcgggccggtgtccatcgccgtgctgacgcactacctggcgcccttgctgctggcgctgctggccccctgggtgctgggcgaggagcgctccacccgggccctgataggcggccccgtgacgctggtgggcctggccctgctcatcggccggcccgacggcgacttctcagggctgacggcgctgctgggcgcgggcagcgcctgcttctacgccatcatcgtcctggccgcgaaacaggcggcgcgggcctattcacccatggccgtgacatcactgcatgcccccatctccgcgggcgtgctgctgctctgtttcggagaccgggtactgccacccacggtggatggaggcacgctcctcgtgctcgtgggcggcatcgtttgcggcctcattggaaacatcctcttccataccggtctgcggcacgttcccacggcggccacggcggcgctcacgtacctggaaccgctcaccgcttcactggtgggctgggccttcttctcggagacgctgacgcccgttgccctgggcggaggcctgttggtgctggtggccggcgcatgggtggcggccgagcgacgcgccaccctccaggccgtgccgctgcgcgccgcggcacgttga

SEQ ID NO: 7683 - DNA, 474 bp, Myxococcus xanthus
atggaagtgcccgtgcgacggctgctcacgcgcatccacgcgccgcccgcggagctggcgccgctccaggaagccggcgcgattaccgaagccggctggcaggtgttcctggtccgctcgctgacggagcgctccgcggcgcaggccatggccgcctacgtcagcgaggccacgtgcgcgctggccgcggagctggacgcggaggtgctggggctctacgtggacgtgtccggtgacacggcgcgcatctgccgctgcggccccgaagacgggccggagacattcgcgggccgccgtcaggccgcgctcaaccgcaccgccgaatggttggaagtgacgcccgtcagcctctccgccctcttccacctcgacctgcccgacgcggagtacgagccggacgcggatgaccgcttcgtcgaggagaagctgcgcgaggcccggaccctcatggagcgataccgccagggcaaatga

SEQ ID NO: 7684 - DNA, 1185 bp, Myxococcus xanthus
atggggcccttgttcgcctacagcctcgtgcctgtcctctccgtgtcgctgctgctgttcttcacggccgtgcttcgggggcacaacgcgcgaggcctgacgctctactgtctggcgaccgcagggtggacgggcgcgctgctgctgctctgcatcccgtccatggcgtgggtgggggagcgcttcgtggcgggtggggccttcgtcgcggcggcatacctgcactccgcctatgacgtgacccggcagcgctcctatcggctggtggtgctcgcgtactgcgtggcggtggtggtgacgggcattggcgcgttccttcccaacgtcctgcacgggccgctggcgatggggcgaggccccctgttctggcccaccatgatgctcgccgtggcggcggcgggcgtgccgctggtgcatctgtcgcgcgcgtaccggggcgaagctcccgagcgacggcccatcctcctcagtctgggcatcgccgggctgctcgcgtacctgggcagtatcggcaacgccctgttgctgtcgggcgggtacgcgttgccgttcgggatgtacctggtgctggcggcgctgctggtgctggtgcatgtcatcaatgcccatcagccagccgcggaccgacggctgctcgaacgcagcctcgtctactccgcggtggcggcggtgttgtccgcgggcttcctctttggcgtattgacgctgctgtcgggcagcgggcagccgttcctcaccgagtaccgcgtaggtgccttcttcctcctggccctggccgcgctcgcgttcgagcccgtgcgtcaggcgcttcaggcctggctggggcgccggctcctcaagggccgggccaccagtgacgaactggccgtggcgctcgctcgcgaggaggcgcgcgcggaccaatccgcgcggttggcggagttgggacaattcacgtccgcagtggcccacgaggtccgcaatccgttgggcgtgctcgccgcgcacctcaagctgctggagcgaaggggcggggacccggacacggtggcggccatgcgggagcagatcgaccgcgccagtcacttcgtggacgaactgctgcgctatggacgcccgcgcccgctggacctgcgccgcgtggatgtctcagccaccgtcgcgctggcgtactccaccgcgcggcagggacttggctcgctcgcg

SEQ ID NO: 7685 - DNA, 873 bp, Myxococcus xanthus
atgtccgagcgcatcatcgaatcgggcgacattcggctctgtaccgagggcttcgggcgtgagggcgacgcccccgtgctgatgttgatgggggcggccagctcgatgctggggtggcctgatgggctcatggagcagctcgcgagggcggggcgcttcgtcatccgctacgaccaccgcgacacggggcgctcctcgcacggtgtgccaggagccacgccctacacgctggacgacctcgccgccgatgtcatctccgtgctggatggatacggcatcgagcgcgcgcacctcgtggggatgtcattggggggcctgctctgccagctcgtggcgttgaagtacccggagcgcgtcctctcgctgacgctcatcagcgcccagattttctcggagcctgatttcgaggacccgggtatggacccggcggtgctcgcgcacttccagcgggccgccacgctgaactggtccgacgaggccgaggccatcggtttccaggtcgaactctcacggttgtgcgtgggccgtgcgcgaaggtcgttcgacgaggctcgggtgcgggcgcgagcagtacaggactaccggcgcgcgctcgcgcctcaatgcgcgttgaaccacgcggggctgtccggtggcctggagtggtacggccggacgcgtgagattgaagcgccgctgctggtcatccacggctcggtggacccggtcatcgaccatgcgcatggcgtggccttgagccgtgccgtcaagggcgcgtgcctggtgacactgcacgacgcggggcatgacctgcacccggatgactgggagacgatgacccgggccatcaccgcccatacctcggcggcgagtccgcctcacggcgctcgctga

SEQ ID NO: 7686 - DNA, 567 bp, Myxococcus xanthus
gtgccccggcccaagctgcacagcgacgaagccatcctcgacgccgccatgttcgtgttgcttcggaacgggccgggcgcattcacgctgaatgacgtggccgtcgcggtgggcatgtcccgcgcggcgctcatccagcgcttcaagaacaaggagcacctctacttccggctcatggagcggaccgccgagcagaagcgcgagtatttcgccggtctgcccgtggaagtcggagcacagggtctctggcgtttcctgaagaccctggtctcggtgatgggggagggcgaggcgctcgacgcacacctgctcctggcctgggaggacgtgagagaccccacgttgaggcggatggcacatgagcggaatctgctcgtgcgcgacgccatcgccgtccggcttcctcccagcgtcgaccgtggcgcggtgtccgccctgcttcaagacgtcatcgcgggtgcgacgatgcagtggttggtggagcggacgccgccgttgacggagtacgtcctcgctcgcttgcgcacgttgctcgggtgcgtgttcccacgagagtccttcgactga

SEQ ID NO: 7687 - DNA, 363 bp, Myxococcus xanthus
atggcggtgctggcgaccgaggcctggagcgcggtggtggaggaggcctggtcccccatgttggcgccgtcccggccggaggtgcgcgagcgcattctctccgagatgcgcgccacgtcccaagagggcgtccggggcggactgggggccctgctggacttcgaccccgtgacgccgctgcggcgctactcggggccgcgtctgtcggtcgtgacggccttcaatgaggaaccgggctcgtatcaccacctggtgccggagctgccgcacgcgaaggtggagggcacggggcactgggtgcagctcgacgctccggacgaggtgaaccggctgctggacggctttctcgccacggtgcgctga

SEQ ID NO: 7688 - DNA, 615 bp, Myxococcus xanthus
atgtctgcctatgctgctgtcgcccgagccccgcgcaccctcacggagaaggaggtggcgctgctgctgcgcgccacggggctgcacaaggatggattcagggaccactgcctctacagcctcgcactggcctcgggcctgcgtgagcacgagctggtggccctcaacatcggcgacgtcttcgacgagcgcgggcgcgcacgccggcacgtgacgctgaccgtcttcaagggcagccgccggcacccgggcccccaggaggttgtcctctcggacacggtgcgcgcgaagctggagaagctgctgcgcctgaagcgcgcgcaggggcatgacgtgagcccccaggcgccgctcttcctgagccgcaagggcctgcgcctgtccacgcggcaggtgcgccacggcttcgcggtgtggcaggtgcgcgcgggcctggagcggcacctgaacttccacgccgtgcgccacaccgcatgcaccggggtgtaccgaaggacgaaggacatccgcctcacccagaagttcgcgaggcagcgaagcgtcgactccaccgccatctacacgcactcctcggaggacgagctggtgcgcgtgacgaacgacttgccctgctga

SEQ ID NO: 7689 - DNA, 564 bp, Myxococcus xanthus
ttggcccaggatgcgtccgacgtgcccgtgccccagggccgcctggtggcgggcttcgacgtgggccgcacgcgagaccgctccgagctggccgtcttcgaagaggtggagggccgcttcacgtgccgcctgctgaagagcttcgagggcgtgcccttcgcggagcaggaggctcacctgcgccgcatcctctccgtccttcccgtggcgcgcctcagcgtggacaggagcggcatcggcatgaatctcgctgaaaacctcgcccgcgacttcccccaggtcgtggaggagaacttcaccaacgaggccaaggagcgctgggcgactgacttcaagattctcctccagcgccgcgacgtcaccctgccgcgccagcgtgagcttgtcgggcagattcactccatcaagcggcgcgtgctcccttccgggaaggtgtccttcgacgccgagcgcaccaaccgcgggcacgcggacaagttctgggccgtcgccctggcatgccagcgcgagcgaggacccgagcgccggggtggcacggagattggagtgagggtgattgggtaa

SEQ ID NO: 7690 - DNA, 97 bp, Myxococcus xanthus
atgacgccgaacagccgcttgcccacgctcgtctatcgcggcgtgacgctggaagggggacaggcgagcgcgctggagacgctgttctccgcgaatg

SEQ ID NO: 7691 - DNA, 822 bp, Myxococcus xanthus
ggagtccctgtgaatcagcctgtcgcattcgacttcgagtcgcaccacgtccgcgtcgtcaccgacgcgcacggcgagcattggttcgtcgccaaagacatcgcagaatccctcgaataccgcatggccagcgacctgacacgcgtgctcgcaacggacgaggtccgtacgcacgacgtgcgtacggacgcagggactcgggagatgtccatcatcagtgagccggggctgtaccgcgccatcttcgcggccaagccccacagccacgagaaggccgagaaggtagagaggttccgccgctgggtgacacacacggtgttgccctccatccgtaagacgggcagctacacggcgccaggcgctccgtcaccacagccgcgcccctcgccgctccaagtccaggtgctggcccacctggaagtggccaggacgctcgcttccttcgttccaggcctcaagccggagctggcagcggcctgcgcgctcgatgccatccaccgggacacgggactgacgatggagcctcaccggaaggggctgccggccgccgccgagccacccgcgcggctcaacgccacgcagctcggccagaagctggggctgtccgcccggaagatgaacctccgcctggcagcctgcggcctccaggggcgcaacgagcgggaggagtgggagctgacggacgcgggccgggagtacgccgaggccgtccccttcagccgcaacggccatgccgcctaccagctcctctggcgacccgaggtgctcggcgtcctggaggatgccgctcgttcctcggccatttccgtcggcctcggctga

SEQ ID NO: 7692 - DNA, 990 bp, Myxococcus xanthus
atggcccagaagaagcccctcaagaagctggggcgccccaccaaggccgaaggccctcggctgcctcatgacgaggtggacaggctcctcgtggaaggcgaggaggtgcccaccacgcggggccgtgtgaagcgccgcttcccctccttgcgcgagctggccgagcgcttcggcgtcgcccacagcgccgtcgcccggtacgcccagcagcacgactgcctcggccgccgaaagcgcctcctcgcgggccagcagccggacgagacgcccgcgctggatgaagcgcccgcgccggccgaagccccacctcctccgaagcgcaagacaggccgcccccgtaagtccgaggagcccgcgctcccacgccaggagctggaccgcgccctcgtcttcggcgacgtgaagacgctccccgacggctcaaccatgacgagctacgcctcttaccgcgagctggccgagcgctttggtgtcgccacctcgctcgttgccaactacgcgaaggagcacaactgcctgcgccgccgcgaagaggccaagacgcgcatcgccaccaaggcggaccagaagctgattgaactgcgcgccaacgccatcgccgtctccaaggacgacgccctgaagatgattgacggctacctcctcggcttcgaggaagcgctgtccgagggccgcgtgcgcgtcgacaaccccaccgacttcaacaccatggtgaggctcaaggagttcgtcatgggtggcgccgactcccgccaggagctgcacgccaccttctcgttggagggcctccaggcccgacacgcccaggccctgcgcgctgctcgtgagacgacgcccgccgagcgcggtgaggtggacgcggaggtgacggcgagcgacgccgaggacctcgacaccgccgccccggagagccccaaggacgacgccctcgtagcacctccgaaggacgtcgcgcccccgccgaccccgattgaaagtgcccatcggtaa

SEQ ID NO: 7693 - DNA, 345 bp, Myxococcus xanthus
gacacgtacacgcagtcgcagctcgccgagtggctgcccgacgctcggcccgccacgccggtggagagccccagacggcccagcgtccgccggagcttcgtgcggagggatgcggtgctggtacacctcgcccgggccacgctgcctcgcagcgacgtcgaggtcctcatggccaccgtcgtccggcgcgagaagctgcgcgcctacgtcagccgcctcgtcgagggcgacaccaccgaggtcgagcgggtgtaccagcggctgaagcgccagcgcacgcggctgatgcagcgcctgcgcacccaggacgtggacgccgcagtacagccccccggaggctgctga

SEQ ID NO: 7694 - DNA, 297 bp, Myxococcus xanthus
ggactcagcatgacgtccaacctctccctggtcgacgccgcgttccacacgggcatcttcgtcgccccacagagcgggtgggtgggcagcacgctcgcccactggctgtcgaacggcgtggagttcgactcggatgagagcggcgggccgctggtggacctggacacgctgatgcccggcgagtgtgcggtggaccggggcacggacctgaggctgccctactgcggcaccgcgccggacatcggcgcggtggcgtcggactgccccgaggccaccaccgccgcgctcatggagtaa

SEQ ID NO: 7695 - DNA, 492 bp, Myxococcus xanthus
gtgattcgccgcatcgacctggtgcgcaaggcccacccggtgaccacgctacagggtgactggctctaccggccctcgggcgtgacggtgagcgcgcatggcaacaccctgttcgtcgtcgagtccggcatgtcccgggtggtgcgcatccgcgacggtctcacgtcggtggtggcgggcacgacgccgggcttccgtgacggcgcgccggagtcgtcccagttcctgccgtacctgggcatcgcggtgctgaaggatggctcgctcgcggtgtcggacccgggcaactaccgcgtgcgccgcgtcgtcctgaacgcggacggcaacgcgcggaaggtgacgacgctggccggcagcgggcgctacggccactcggacgggccgggagatgctgcggacctcgtcctcccggccggtctgacggtggggccggacggccgcctctacgtggcggacgccggcaattcgctggtgcgcgcgattactccatga

SEQ ID NO: 7696 - DNA, 138 bp, Myxococcus xanthus
agtgacccggggcctcccacgccggatcccccccagatcgccctgacggtgcccgcgagcatcatctccgacgacaagttccaggtcatcgtcacggtgtccgggctgcgaggccggctcgacgctcaacgtcaatga

SEQ ID NO: 7697 - DNA, 1341 bp, Myxococcus xanthus
atgacgctgacgctggagcgcaacgacattccctacgccacagcgggcctggccgcgaacctgtcgttgaacgcggtggccacgtgctctgacgggcgtacgaatcgctcgcagcccgcccctgtctcctacttcccggtgcagcgccgcatcgtggagccgcagaacgccggacaggtcgtcaccgaccacttcgtcatcgacggcaccagcgccaacccgaccttcttgggctgcggcgtcccgccgacggagatttccacgctgtaccgcgtgaacctcagcggcaaggtgacgggcactgtcggaatgcccatcgcctgcacccccgagacggtcatcaccgagcgcaaccccatcagcggcaagcgctgggtgtggaccccgaacgtgggcgccttcgccgtggacgccgacctgcgcatcaccgcgcgcacgacgacggacatcggccccacgcaactcactgtgctgccgggcggtgacgccatcatcgtcaaccgcatcgacgaggtgcgccggctctcccacaaccccgacggcacgtcggagagcgtggccgaggtcaagtggctctacgcgcccacgacgctggagagcgtcatcgctccgcccctggttcgcgcggacgggttgattctcatcgcctcactgggcacgggcccggatgcttcgcgcacggacgtcaccgtcaccgaactgtacgcgggcgagacgggtgagcagggcgccggcggaacggcccgggccgcatacaagctacggaccttcgcgcgcaacgagcgcctccccctgggcgccttcaacgacacgggcaacacgctcttcctgggcctccagctcggctcggagcagtcgcaggtcatcgcgtgcgccgcgaaccaggacgagtgcaagggcgctcgcatccagtggaccagccccgcgctaccggtgccggtggcgcacatcctctatcacccgggcgcctcgcgcctcgtcgcggtgggccagcagcgcgtgtggttcctcgacgcgtcggggcagattcgcaaccgggacaaccgctccatcgacgcgaatggcgcgctgaacgtgctccaggtgctgcgccggccgaactcgccggagctcttcctgctcaacgcgccggcccgcggactggatggcgcgccgacgctgcccaacgaaatcgtcgccgtggaccagacgtccggcggcgaggcccgcgagctgttccgccaccaggtggtcggcagcctgggcggtgcaatcgacccggaaggccggctgtgggtccgcactggcttcgacgtggtgcagacgctgcctctgtccgactaccgccgctaccggccgtag

SEQ ID NO: 7698 - DNA, 2640 bp, Myxococcus xanthus
acgtttcaactgaactcctttctggccgctcagcaggcgcgcgtcgaggccctgctgaacgagcgcgtggcgcggctcgggccttccgggacgccgccgcagctcgcggaggccatgcgctactccctgctggccggcggcaagcgcctgcgcccggtgctctgcctggccttcgcggacctcgtggcgcgcggaagcgccgtatcggcggtggcgggcgacgcggcgtgcgcgctggagtacgtgcacacgtactcgctggtgcatgacgacctgccggcgatggacaacgacgactaccgccggggccggctcaccaaccacaaggtgtacggcgaggccatggccatcctggcgggtgacgcgctgttgacggaggccttcacgctggtggccagtgggccggagagcatgcgcgccgcgctgtgccgggagctggcggtggcctcgggcgcggcgggcatggtgggcgggcaggtgctggacaccgccgaggaccggccgtccgcgctggactacctcatccggatgcaccgcatgaagacgggcgccctcatccgggccgcgtgccgcatgggcgtgctggccagcggtggagacgcggacgcattggcgcgcgcggacacctacggtgacgcggtggggctggccttccagattgccgatgacgtgctggacgtgacggccacggcggcggagctgggcaagcccgcgggcgcggacgccgcggccgggcgcttcaccttcccggcggtggtgggcctggaggcgtcgcggacgctggcggaccagaaggtggccgaggccatcgcggccgtacgccctctggaaggcgaggacgggccgctggcggcgttggcgcggctacacggtggagcggaagtcctaatgtcggagttgctgtcacgcatcggctcgccctcggacgtccgcgcacttcccgaggaggcactgccgctcctgtgccaggaactgcgcgaggacatcatctccatctgcggccgcgtggggggccacctgggggcctccctgggcgcggtggagctcatcgtcgcgctgcaccgcgtgttccattcgccgcaagacgcgctgctgttcgacgtggggcaccagacgtacgcgcacaagctcctcacgggccggcgtgaccgcatgcacacgctgcggcacgcgggcggcatcgcgccgttcctggacccgcgggagagtcctcacgacgcgctgctggctgggcattcatgcacggcggtgtccgcggcgctgggcgtgctggagggccggcggcagcaggggcaccggggccacgtggtggcggtgttgggcgacggcggcctcacggggggccttacatttgaagggctcaacaacgcgggggggagctccctgccgttggtcgtcgtcctcaacgacaaccagatgtccatcagcgccaacgtgggggccatccccgcgctgctgcgcacccgcgaggcgcgcgacttcttcgaaggcctgggcttcacctacctgggcccggtggatgggcacgacctgcctgcgctgattcgcgcgctgcgggaggcccgtgcctcgtcgcggccggtggtggtgcacgcgctgacgctgaaggggaagggcttcccgccagcggaggccgacacgcagacgcgtggacatgccatgggcccgtatgagtggcgggacggcaagctggtgcgctcgcgcggtggccagcggaccttcagcgaagccttcgcggcggtgctcgaggacgcgatggcccgggacccacgagtggtggcggtgacgcccgcgatgttggagggctcggcgctcaacgcgctcaaggcgcgcttcccggaccgggtgcacgacgtgggcatcgcggaacagcacgccgtcaccttcagcgcggggctggcctcggccggcgcgcggccggtgtgctgcatctattcgaccttcctccagcgcgcgtacgaccagatcatccacgacgtgtgcctgccgggcctgcccgtcgtcttcgccgtggaccgcgcggggctggtgggcgcggatggtgcgacgcaccagggcacctacgacgtggcgtccctgcgcccgctgccggacctgcacctgtggtcgcccatggtgggggaggacctggcgcctatgctggacactgccctggcggcgccgcacgcctccgtcatccgcttcccacgcggcacgctgccgcccctgcccgaaggactgggcgcgggcgaggcaccgctgcggggggctcgctggctgcttcgcgcggagcagccccggctgacgctggtgacgttggggcctttgggcatcgccgcgctggaggccgcgcggggcgagcccggctggagcgtgctggatgcgcgctgcgcttcgcctctggatgaggccgccttgctggaggccggccggtccggtcatgtcgtggtggccgaggagggcactacgcgcggcgggttgggcagcgcggtgctggagctcttcgcggcgcacgggctgatggcccgcgtccggttgatgggcatgcccgatgcgttcgttccccatggggacgcgcgggtccagcgcgcggagcaggggctggacgcggagggtctgcggcgcgcgggcctcgcgctgctggcagggggcggacggtga

SEQ ID NO: 7699 - DNA, 381 bp, Myxococcus xanthus
atgtcgaagctgaaaatcaccattgtcgatgatgaccgcgacacgcgggagctgctggcggcggccctggagtacgaaggcttcgccgtcaccatggcggccaacggcctgcggctcatcgcgtcgctccaactgcaccggccgcatgccatcctcctggacgtgaacatgtcctggattgatggcttcgagctgtgccgggcggtgaagaagaacgagcagttccgggacattcccgtcatcttcatcagtggccgcggggagcccgaggacaagcggcacggcatggcggtgggcgccgcggactacttcgtcaagccgctggacatggacaagctcgtcagccgcattcgcgagcttgtgcccgcgcagattccataa

SEQ ID NO: 7700 - DNA, 357 bp, Myxococcus xanthus
atggaagtggcgaagtcggacaaggcgcccaaggcggacaaggtagcggaggccgaggtccccgagcagtacggggacgtggtctcccggctcgaggagacggtgggccggctggagagcggcaatctctctctggaggactcgctcaaggccttcgaggaaggcatccggctggtgcgccggggcgagaagctgctcaccgaggcggagcagcgcatcgaacagctcctgctggacgaggacggaaacgacgtggtggcgcccctgtcggtcgccgcgcgtccggcggcgcccgcgcccgcggcccctcgggcccctactcctcgcccgcccccggaggatgacgtcccgttctag

SEQ ID NO: 7701 - DNA, 621 bp, Myxococcus xanthus
atgtcccgtcctcgcctgctccccgagcccgttggcctcaagttcgtcacccaggagaccccgccggactgggacgccgaattcggtttcagcggaccgctcgagctggaaatcggctccggcgcgggcggccacgccctggaatactgccgccgccaccccgaggtgcgcttcgtcgccttcgagtggcgcaagaagtacgcgcgcgacacccaggaccgcgcggacaaggcgggcctgcgcaacctgcgcgtcatcgaatccgacgcccgcttcatcgtgccccgcatcttcgcgcccgattcgctcgccgccatccacctccagttccccgacccctggtggaagcgctcccacgccaagcgcgccgtgattcagcccgcgttcgccgagctgctgtacggcaagctcgcaccgggcggactcttcgacatgcgcaccgacgtccaggaccgcggcgtgacgatgctcgccatcttggaatccgttggtttcaagaaccccctgggttcaggtgttttccatccctatgacccggaggaagtgccctccacgcgtgagcgccgctacctggccagcggggagcccgtgtatcgggcgcggctactgaagcctgcctga

SEQ ID NO: 7702 - DNA, 666 bp, Myxococcus xanthus
ggcctggagcgccgggtgttggagctgcgcgaggagcaagggcagctcgcgtcgcggctggaggaccctcggcgggccatcaaccaccagcggctgcacctgtccgagcaggtggagtcgatgatgcgcgtgctgcggccagccgtgcgggggcaccgcgaggagctgcggtcgctgaccgaaaggctgcagcgggcgcgtccccaggcacggctgggggagcagcgggcgcacctgttgaagctggccatgcggctgtcggaggcggtgcgcgcaggtgtggcgacgcggcacggggcgctggcgacggcacggctggggctcgagagggcgtcaccggcggcccaggtgtcccgtgagcgcgcccggctggccgcgcaccgggcgcggctgctggcgctccagcaaggggccctggcggatgcacagaagcgtttccagcgtctggagggacgtctggatgccatgagtccgttgaaggtgatgtcccgcggttattcggtggtgttccgacagcgcgatggcgcggtggtccgcactggcgcggatgtccaggtgggagagcgcctggggctgaagctcgcgtcgaacggggcgaagtcgctcgggggatgtgaagaaatcgaagccaccgtcacggcggtgaaagggccggtggactgctga

SEQ ID NO: 7703 - DNA, 2736 bp, Myxococcus xanthus
gggggcgatgccatcaccatcaccgccagcgggcagttcgccttcgcgacgccagtggccttcggcgcgagctacgacgtcaccgtcgaggcggtgtatccggtggcctgcaccgtgagccgggggaccggaaccatgggcaaccaaccggtgacgaacgtgagcgtcagctgcaagacgacacggttctcgctggggggcaccgtgacgggcatccttcccgcaagctcggtggagctcacgaccggcacggagtcgattcgcgtcaacgcggacggcgccttcgccttcgtcgggccggtggatgacctgagtggctactcggtgacggtgagctcgccgcccatgggccaggcctgcgacgtgcgcaacgggacgggcaccgtgagcggggcgaatgtgaccagcgtggtcgtgacctgctgggcgttggagtattcgctgggcggaagcgtggcgggactctctgggggacagtcggtggtgctgaagaacaacggaggggatgcgctcaccgttgcgtcaaatggctccttcactttcccgacgccggtgtcctactggagcacgtatgccgtcaccgccgaggctcgctacccgctgatctgcagcgtgccgaatggcacgggccgaatcggggtagggggcatcgcggacgtggtggtctcctgcaccacgcggtccttcaccgtcggaggtgaggtggcggggctcgtcgagggaaccgcgttggagctgtggaacaacgagcaggagcgcctcaccgtttccgcgaatgggcccttcgccttcctccagccggtggcggacctgagcgcctactccgtttcggtgatgacccagccggagggacagtcctgtgaggtgcggcagggcacgggcacgctggggggcgcggccgtcacgagcgtgtcggtcgtctgctcgccgaggtcctatctcgtgcgcggcaccgtggcggggctgggggatgggcagtcggcggtgctgaggaacaacggaggggatgacctcacggtctccgccgatggcgccttcgccttcccgacgccggtggccttcggcgcgacctattccgtcacggcccaggcgaccgcgccgctggtgtgcaccgtgtcgaacggtacgggcacgatgggcgagggtgacgtcacccacatcgaggtgctctgcggcacggcgtcgtatcccgtgggtggcagcgtgagcggcctggccgagggcgccatgctcgagctccagaacaacggcgacgaggtgctcctggtttcggccaatggtgccttcaccttcgcccagcaggtcgcggagcagggcagctactcggtgacggtgaagactcagccggagaaccaacgctgcgccgtgagctccggcggggggaccgtgagcggtgcgcccgtcacgaacatcgtcgtcacgtgtgagaacgtctaccggctgcgcgtcagtgtttcggggctgaccggcacgctggggctgaagtccggcgcggacaccctcacggtcgccaccgacggggagtcttcgttcccgctgccgctgcgtcctggcgaggcgtacgcggtcgaggtgagccgtcacccgacgggacagacctgcgaggtcgtctcgggcggaacgggcaccatgggcgaggcccacgtcaccgtcatggtggcctgtgaggcgaacgcgatggtggtccgggtgggcgcgggcgccgcggccctcaacacgaatgccacggagatcttcatcgatgagtaccgccccatgggtggtgctcccgtgcgcaccttcgccattcccgcctcgagcgcggcgggggcggcccgcctcacggtggccggcagtgatgtccaccagggttacctctcgcgctcgggcaatggtcgcctgctcaccttcacgggcttcgatgcggacgtgggcctggcgaacgtctcgggcacggccgcatcggagacacctcgggtcatcgggcaactggacctcgcggggaccttcaccctccctgtgcgtctgagcgatgcctatgaccgagaccaggtgcgcgcggcgtcgacggtggacggcaccggctactggctgtcggggcgaggcggcggcatccgccatgcgctgcctgccgagaacaccacggtgtcgacagccatctccacgggcgtgacggacacccgcttcgtgagcctgttcgacggccgcgtctacttctcgctcggaatccctccgagcccgaatccccagggctacaaccagggcgtcctgacgttccccaccgagcagcccaccgcggcggtcgcgccgaaccagctcccctcgttttcgacgacgttcaactcgtccggcttcgcgctgctcgatgagcgtcccgaggtggccggtgtggacaccgcttacgtgtccatcaacctcaaccagaatgcgagccagggcgggactccggacacgttgcgcctggagaagtggaccttcgacggggtgagctggagcaaggtgtccagcttcgtgcccaccttcgccgtcgcggggaccaccaccgtgcgtatcgccacccatggcgtctcggcggtgcggactccccgaggagttcgcgtctacgtcaccacgtaccagtcgagtggtggtggcgcgggcaatctcctggtgtccttcctggatgatggaagctcgtccacgccgtccgtgcgtgtcgtggccacggcgctggccaacaccagcttccggggcgtgagcgccagcccgctgccctga

SEQ ID NO: 7704 - DNA, 2502 bp, Myxococcus xanthus
gtgaagtccctgcggatttcgcctgagagcttctcgctcgccgtgggcatcggcgcggacgtcaccgcgaccgccaccttctccgatggcagcacgcgggacgtcacgcgtgaggcctcgtggtcctcgacggatgccgccatcggtacggtgtcatccgaggcgggcgccgcgccccaggtgcgcgcgctggccaaggggcagacgacgctgagcgcgacctactccgacgtctccgcgcaggcgcggctcgacgtgacggatgccacggctgtcgctctctccatcgagccgaaggacttgtcgctcgccgcgggcctcacgcagcagctcgccgccacggctgcgttctcggatggcacttcacacgggctcaccagcgatatcacctggtcctcctcgaacgaggcgattgccgcggtctccgagagcggcctggttcgcgccggttcacccggcgaggccaccctcaaggcccggttcggcacgctggaggccaccgtcaaggcgaccgtcaccgcggccgtcgtgacgtcggtggcggtgactccgggtgacgcctcgatggctcggggcagcacgatgatgctgaccgccatggcgacgcgctcggatggcacgacggtggacgtctccaatgaggccacctggagctccagtgatgcgagcatcgtgtcgctgaacaagcgcgtcgcgagcggcgccgcgctgggggggggccgagtcaccgcgaccttcgcgagcgtgagcggcggcaccgaggtgacggtctccgaggccgccgcgctcgccgtcacgccggcggcgagcatgctgattgaaggccacccgagccagctccacgccgaggccacgctgtccaacggccgtacccaggatgtcaccgcgagcgccgcctggacgagcgacatgacggacgtggccgtggtctcgatgaccgcatccacgcgtgggcaggtgacgccggtggggcagggctccgccaccatcaccgcgaccttcaacggacttcgcggtaccggccaggtgagcgtgtcgaagctgagcatcaccagcgtcgtcccgacgttccagacgatggaggatggggtggtctccttcacggcgcggatcaccaaggccctgccgccctccacgaggctgcggtggcgcgtgtcggtgattcgtcacaacccgccggccgatctccacctgccccccaccgatagccccgtggtgggccagccggtgcgctacttctcgggcgccgcgggtgaggtggccgaccggccggagacgtggacaggcggctcggagaccgacgcgagtggcgcggcctacgtggggcaggatgcgggcttcgaggtggtctcgaccgggcttcagggcgcggagggccacacgtactccttccgcacgcggttcgccatcaagggcgactactcgttccacctcgagctgttcgaggtcggcgccgggggcgagctggttcgaatcggcgacgccacggagctgagcgccaccgtggggacgatgcgcgcgacggatgactccgagctgctgctcttcactgcttctccctcggcggaggcccagacggaggaggagtccttcccgcaggcgttcgccgtgcgcccggatggctcccagttccgtcaaatcacccaggcgcccacgccgttcttctctccgcgagacgtccactcggaggtgattcgttcgccggaccgcaagtcggtggtctgggtggacgggcgagacaagttcgggggcatctacttccaggggctcctctacatcgcggacgcggacggaagccgggtgcggcgcctcacccaggcgagctcgtcgctgtgcggagagcgcatgccggagtactcgccggatgggcagtggatttcgttcatgaggtcgtgctctcgcgacccgtacccgggacgtgatggcctcgagttcaccttcatcatccgcgctgacgggacggacgagcggcgcgtcctcatcagtggcatcaacgacatgccgccacccgttcccatctcgccgctggtcttctcctccttctcgcgcgacagcaagacgctctacacggtgcagtacgcgacgaagggcgcccagctctgggccttctcgctggaggatgggagcgcgcgctccatcatcaacttctccgtccagggacaggagatggcctccattgtgcggttcccgatggagctgcccaacggcgacctgctgtaccactactggaacgaggacgtgtggacggacacgtggctggagcgcatccggcctgacggcacgggccgcgaaatcgttcggcccgtcatgcgcggcagcaggggcgagttgctccagtccctcttcacgctctctcccgatggcacgaaggtcgcctacaccgagcgggacccggtgacgggggtcaacaccatcatggtgtccaacatcgacggctcggaagccgtctccatgaagaaccctccggcctacttcgtgcggcgcatcttctgggctcgctag

SEQ ID NO: 7705 - DNA, 159 bp, Myxococcus xanthus
  unsure (1)..(159): unsure at all n locations
atgtctccggcgaccgcggcccggctccagctcgatgcgctggctccgttccatggcggccggtcgctctcgcaggtggggacttcggtcgccagcgttcgccggagcccgctgggctcctcggtggtgacgctgcngcaagaagtggggggagtccag

SEQ ID NO: 7706 - DNA, 1566 bp, Myxococcus xanthus
atggccatccgctacgcgctacccaacgggcttaccgtcgtcttcgaggagcagcacgccgccaaggtcgcggccttccaggtctgggtcaaggccgggagcgccgacgagcggccggaccaggcagggcttgcccacctgcacgagcacatgctcttcaagggcaccgagcgccgcggccccggtgaggtcgcccgggacgtggagtcccatggcggcgaaatcaacgcctggacctcctacgaccagaccgtctaccacatcgtcatcgccagccagttcgcccggatgggcctggacatcctgggcgatgcggtgcgccggtcggccttccacgcaggcgagctgtcgcgcgaaatcgaggtggtgtgcgaggaaatcaagcgcagccaggacacgccgtcccgccgtgcctcgcgtgacctcttctccaccgcctaccaggtgcacccctaccggctgcccgtcatcggcaccgacgagagcgtgcgcagcttcacgcgggagaaggtgctggagttctaccaccgccactacacgcccaagaacctggtgctgtcggtggcgggagacttgcgcgaggcggagctgcgcgagtgggtggacgacatcttcggcggcgactggggccggccgtatgagggccgggtagcgcgcgccccggagcccgtggccgcgggccggcgcatcctgctgcgcccggacgaggtgaaggaggcctacctccacctggccttcgggattccccaggcggaccacgaggacgtgcccgcgctggacgtgctggcgatgattgccggccagggagacgcgtcccggctggtgcgcgaggtgaagcgccgccacaacctggtcaacgacatccacaccttcgcgtatacgcccacggacccgggcctcttctccgcgtcgatgacgctccagcccgccaacgccgtccgggcgctggaggaggcggcgcgagggctggccacgctgcgcgccacgccggtgacggcggaggagctggccacggccaaggcgctggtggaagcggaggccgtgtaccagcgcgagacggtgcagggcgtggcccggaagatgggcttctaccagtccggcatgggcagcctggaggcggaggcccgctactacgaggccgtgcgcaacctcacgcccgagcacctgcgcgccgccgccgagcgctacctgcgcttcgaccgcgccgtcgtcaccggcctgctgccggagggcacgccgctgacggaagcgcaggtgcacgaggtgctggatgccgtggaccgcgcgcccgccgcggcgccgcccgagcgcaagccgcgcaaggtggccgtgagtgactcgccggtgcgcatcctgaagggcacgagcgccggccccagcgacatcatcacggagaagctgccgtcgggcgcgacgattgtcgtgcgcgtggagcccgcggtgccgctgttcgccatccgcgccgccttcgcgggcggtctgcgctacgagacgccggaggacaacggcatcaccacgctttgctcacccgcagccatcaccgcgggggggaacgccggacggcac

SEQ ID NO: 7707 - DNA, 405 bp, Myxococcus xanthus
atggcggaggagcgcacctgcacgttggaattgaaggtgcgccagcgggagaagcgcatcgtcttcgaggacggcgcgccggtggcgtgccagtccaacctcctccacgagacgctgggcaagtacctggtggagaagggcaagctgtcggagacggactaccagaaggcgctggcggagagcatctccgcggaggtgccgctcagcggcctgctggtgcagaagggcctcatcagtcccttcgacttgtacaagcaattgcaggcgaacctggcgcacaagctgctggactgcttccgctgggtggacgcgaagtaccggctcatcgccgacgtggagcctccggacgccagcgtgcggacgaacacgggccagctcatcctcacgggggtggcccacggtaag

SEQ ID NO: 7708 - DNA, 831 bp, Myxococcus xanthus
atgagcaagtggatattgtggctgttcctcaccctgctgacgggcagcccgctgctgtcgctgggcctcatcatcgtcatcatcttcgtggcggaccgcttcacgtggcaggtgctgcccagcccggtgcggctgctcaagcgcttccagcgcgcggggcaactggcgggcaccatcctcaccaacccgcatgagcggcgcgcgcggcacgaactggcggacatccgcgtggagcagcgccgctacgccgaggcggtggacatcctcaagcccaacctggaggcgggcgacgaggacgtggatacgctgtacctgctgggcgtggcctacctgggcgccggggacgcgcagcgcggcgagctgctgctggacgaggcggcgaagctggacccggaccacaagctgggcgccatcgacctggagcgcggccgtttccggctgaagcgcggcgacgtgccgggcgcggtggaggcgctggagcgctactgcaaggtgcgacacggcacggtggaaggccgctacctgctcgccaaggccctgagccgggcgggccgcggcgacgacgcgaagcggatgcgcgacctggcctggtccgaatacgtggtggcgccccggttccagcggcgccgggagcgcaagtgggcctggcgcgcgcggcccagccggccgttgatgtacgcggcggccgtggccctggtgctgagcctgctggcgtccatgttgccccggttcgtaataaccccagagggagactacggcggccgctacgaccatggcgcgtatggcgagccacccagtgcggtggggatggaggagtaccagggcgagtag

SEQ ID NO: 7709 - DNA, 1206 bp, Myxococcus xanthus
atgcctttcgacgcgccagtggatgccctcacgggaatgccggcggcccgcttcgggctgtacctgcatttcccgtactgcctcgcgaagtgcccgtactgcgacttcgcggtggcggtggcgcggcaggtgccggaggagcgctacgcccgcgcggtgctggcggagctggacacccggctggccgccgagccctcgctcgcggggaaggtgctcgactccatcttcctgggcggtgggacgccgtccctgtggcacccgcgctacgtggcccaggtgctggatggcatcgccgcgaggctgcgggtggcgcctggcgtggaggtgtcgctggagggcaatccggagcgcgcggacgcggagcgcttcgcgggctaccgcgcggcgggggtgaaccggctgtcgctgggcgtgcagtccttccagccggagacgctcaaggcgttggggcgcgcgcatgacgcggccatggtggaaggggccgtggacgcggcccggagcgcggccttcccggtggtggccatggacttcatctatggcgtgcacgggcagacggtggcgcaggtggaggcggatgcgcgccgggcggtggcgctggcccccgagcacctgtccacgtacgcgctgacggtggagcgcgacgtgctggcggaggacacgcccctgtcgaagcggctcaagcgcggtgagctggagctgccgcccgacgacaccgtggtcgacatggcgcgggtggtgcgcgaggtgtacggggcggcggggctgcaccgctacgaggtgtccaaccacgcgcggccagggttcagctcgcgccacaacgcgctgtactggaccggcggggagtacctggcgctgggcgtgggggccacgggcatgttgctgtcgccccagccgcaccggtacgtgaacctgcgcagcgcggagcgctacctcgtggaggcggaggcggggcggctgccagaggaaggccgcgagccgctgggcccggaggagctcttcgcggagcgcctggccatgggcctgcggctggtgtcgggcgtggactgggaggccgtctgcgagcgatatggacagccggtggagccccggcgggcggaagtcgcgcggctggtggcgcacggcttcgcgacgctgcgggacgggcggctggcattgacggagaagggcgcggacgtccacagcgccgtgtgcgcgcggctgctctag

SEQ ID NO: 7710 - DNA, 1935 bp, Myxococcus xanthus
gaaatccggatgcccatgggcggctcgcccgaggacaagctggagtacttccgggccgtggtccgccagaagacggagaccctggcgcgggcccggacgctgtacgcggagcgcgacggcgagctcaacggcgtgaagcagtcgctgacgctggcgcgcaaggagctggcggagtcgaaggccagtgtctccgccttccaggaggagctggcccgggcggaggcggagtcccagtcgcggctcgccagcctccaggatgagctctccgcggtggaggcggaccgcaaggacctgtctcgcgcgctggcggaggtcgaatccgatgtgccgcgcctgacggcggagctccaggaggagcgcgaggcccgtggcgccgtggccgaggagctgattggcgcgaaggaagcgctgtcgctggcccaggaccgcgtggcggagctggccgcggagaagtccgaggcccagggcgccctggaggccgttcaggagcagtaccagcaggccatcgccgacgtggagcggctgacctccgagctggaggccgcctcggcggagaaggactcgctgggcctgcgcaccgcgcagttggaggccgcgctggaggaggcccaatctgggctgagcgcgctggagagcgagagcgactggtcgaagagctcgctggaggaggcccagggccgcgcgggtacgctggaggccgagcgcgacgaggcgcgcaagcaactggcggtggtggaggacgggctgcgcaccctgcaggagcaggtggcggagctggagcgttcgctggcgctgaaggacgccgaaatcgtgggcctgcgcgcggcgctcaccgcccgcaccaccgaggccgcggagctgcccgcgctgcgtcaggcgctggaggcgcgcaccgcggagctggcccagctcaaggcgaagctggaggcggaggcggccaaggccgaggagcgctcacaggccctggaagagggattggcacaggccagtgagcgggcgcacctggcggagggcgaggccgcggcgctgaaggaggcgctggaagccgccgaggtggagcaggtgtcgttgcgcgaccgcatggaagcggacgcggcggcgctgggcgaggcggtgcagcaggccgagacgaaggtgtccgagctgacggcggcggtggaggccgcgcacgcggaccatgcgtcgtggaaggaacagctcgccgcggtggagctgaaggcggccaccaaggacgccgagcgcgtcggcctggccgcccgggtgtccatgctggaggcggcgtccggccagcgcgaggcggagctggtgcggctgcaagcagaggtggcgaaggcccacgaggcgctggcgctggagcgtgcgcgccgcgaggcggcggaggtcgagcgcaccgatgcggaggtgaaggcggcccaagccgaggcccaggtggagtcgctgacggtggggcagggcggcgccgaggcgcaggtggcctcgctcaccgaggagctggaggccgcgcgcgccgaggcggacaaggtggagcgcctccagggccggctgaagatgatggagggggccttggaaggcgcgaaggcccaggccgcggcggccggcaagtcggacgcggcgcgcgctgcgaccgaggcgaagctggctcgcgcggaggcgtcgctgaaggccgaggagcagaagcgggccgacgtggaatcctcgctgcgagcagagcaggaggcacggcgggcgctcgaggcgaagctggcggagcagccggggactccctcccagagcgcgggtgcgccagcggactgggaggcggagcgcgagcagctcaaggcggacgctgccaacctcaagcgcaagctggtggcggccgagacagcgctcgagaacgcggcgggctacaaggcgaagattgcccggctggaggcgcaattgaagggcaagaggtag

SEQ ID NO: 7711 - DNA, 774 bp, Myxococcus xanthus
atcagcctgttcttccccgcctggaacgaagaggactacgtcgagcgcgccgtcagccgggcgctggaggtcctccccgccctgacggacgacttcgaaatcatcgtcgtcaacgacgcatccacggaccgcacccgtgaggtctgtgaggcgctggcccagaaggtcccccaactgcgtgtcatccaccaccccgtgaatctgaagctgggtggcgccatgcgcaccgggctggcggcctcgacgaaggacatcgtcgtgtactccgatgtagacctgccctgggacatgcgcgagctggagcgggcgctgcacctgatgtcgtacctggaggcggacatgatttgcgccttccggttcgaccgcacgagcgagggcgccaagcgcatcatctactcgttcgtctacaacatgctcatccggtcgctgttcgacatccagatcaaggacgtcaacttcagcttcaaggtgatgcaccgccgcgtgctggaggccatggagctgcacagccagggctcgttcatcgacgcggagctcgtggtgaaggccatccgccagggcttccgcgtgttccagatgggcgtggactacttcccacgcacgcgcggcgtgtccacgctggcctcgccctccgtcatcacgaagatggtgcgggagctggtgaagctctatccgaagatgcgcgcgccgcagccgccagtgcacccggtgcgcttgccgccttccgtgcagcagctccacgcggtgccgccgggccgcacggcgcgaggctga

SEQ ID NO: 7712 - DNA, 1044 bp, Myxococcus xanthus
atggcggatggcgaacggaagaggacgctggaggtcgcccgccgtgcccccctcgcaggggaactcagtggccgcacggtgctcctcgtggacgatgacccggtgcatctccggcacgttcgcgacggactggcccctcacggttacgtcttcaccgaggcccatgacggcgcccaggcgctctccgccatccgggagtcccgccccgacctcatcctcatggacgtggagatgccgggactgggcggcgtggaggtgtgccgcatcatcaaggcgaacgcgggcgaggacggcttcggcttcatccccgtgattctcatgacggcccggcaggccgcgggaaaggtggagggactggagctgggggcggatgactacctggtgaagcccttcgacatgctcgagctgtcggcccgcgtgaagtcgatgctgcggctgaaggcgttgcaggacgcgctggtggagaagaaccgggagctggaccgcgccaacaaggagctggcggcgcggcgcgaagagctgctggcgctcacccgcacggatgcactcaccggcctgtcgaaccggcgcgccttcgaagagcggctgaacgacgagttcgcccgctcgcggcgttatggagcgcccctgtccctggtgatgctggacatcgaccacttcaagcgcatcaacgacagcttcgggcatcccttcggagaccacgtgctgaaggccgtggcccagacagcgcgggcgcggctgcgggaagtggacctgctggcacgttacggcggcgaggagttcatcgccctgctcccggagacaggccccgcggacgcgctccgggtctgcgagcgggtgcgcgacgccatcgccgccctggagctggagcatgtgggcgggagtggcaagccgcagtgcgtgcggctgaccgcgtcattgggcgtggccacggtgccgtcgggcgacctcccgagcgcggaggcgctgctgcgggctgccgacgccagcctctatgcggccaagggagcaggtcgcaatcgcgtccatcagcacgccgcgtga

SEQ ID NO: 7713 - DNA, 936 bp, Myxococcus xanthus
cgcgggcggctgctcctggtggatgacgaggagaacatcctcaagtccatccgccgggtgctgcgccgcggcgattgggacatcgagacggcgacggacgccgagcagggcctgcgggcggtggaggccttccaccccgaggtggtcatctccgatttccgcatgccggggatgaatggcgtcgatttccttacccgggtgaagcagcaggagccgcgggcccagcgcatcatgctgacgggccaggcggaccagcaggccatcgaagaggccatcaaccggtcggagatcttccgcttcatctccaagccctggaacgacagccacctggtgttgacggtgaagagcgccttcgagcagtacgcgcttcaggcggagaacgagcggctctacacggtgacgcaggcgcagaacgcggagctgaagctgctcaacgcggacctggaggagcgcgtcgcccagcgcacgcgcatgctgagccaggccaagcgcgagtgggagctgtccttcgactgcatggagacgccgctgtgcgtggtgcgcgcgcgggacttcgcggtgcggcgggcgaacctggcgtacgcggacgtggcggggcgctccatcgaggagattccctccgacaccacgtgctaccgctacctcttcggccgcaacgagccgtgcacgggctgcccgctgccggcggcggtggagagcggcaagggcgcgcgcggtgaggtccgtcagggcgggcgcaccttcgtggtggccgcctaccccattgcgggggatgagcgcgtcgtctgcacctaccgggacgtcaccgaggagcagtcgatgacgcggcggctcatcgagacggagaagatggccgcggtgggccagctcgccggcggggtggcgcacgaaatcaacaatccgctgggcggcatcctcgccttcgctggagagcac

SEQ ID NO: 7714 - DNA, 561 bp, Myxococcus xanthus
atggcgtcgctcgccgcccaggtgagcgagctgcagcggctgtcgtcgacggacgggctcacgggcctccacaaccaccggcatttccaggagcggctgagggaggagttccgccgtgcccagcgttatgacgactccctgtcgctcatcctgctggacttggattacttcaaggaaatcaacgacaagtacggccactccgcgggcgacggcgtgctgcgcgaggtggccgccgcgctcacccggggcgtgcgcgagacggacctggtggcccgctatggcggcgaggagttcgcggtgctgctgccccgcacccacctcaccggggcgctcaccgtcgccgagcgcgtccgccgcgagctgcgcgccctgcggctggaggtgtcggacagcctgcaagtcaccgcgtcattgggggtttccagcttcccccaccgcaccgtcctcaccccggagcagctgctcctgacggccgacgaggccctctaccaggccaaacgggacggcagggatcgcatctgcctacatccccagctcccggtcggtccgctcggaacctag

SEQ ID NO: 7715 - DNA, 669 bp, Myxococcus xanthus
atgagcgacctcatcgaacaggccctcctgcgctacgacgggctgcccgtcgccgagcgcttccacgtccacgcgcgggccttctccgcgccgctgctggccatggccgcgcgcacgcccgtgggcgctgtggcggacattggctgtgggcatgggttgctgtccgcgctgctggcgctggaggacccgcgccgcaccgtgcacggcgtggacccggactcgcgcaaggtggcctgggcacggcgggcgctcgcgggccagcccaacgtgcgcatcgaggaaggcaccgtggaggagacactggccgggggcgcttccgggcgcttcgacgcggcggtggtgtgcgacgtgctgtacctgctgccggagccgaagtggcccggcttcctctccacggtgcgggacctgctgaagcccagcgggcggctgctgctcaaggaggtggagggtgacggctcctggaagcaccgcaaggcgctggcgcaggagtgggtgatggtgtcgctgctgggccgcacgaaggccagcggcggcatggcgctgaagcctcgagccgagatgacgcgctacctgaaggacgcgggcttcgcggtgcgagaggtggtggacctgggccagggctacaccacgccgcacgtcctctacgtggcggagaacagcgttccgtag

SEQ ID NO: 7716 - DNA, 1134 bp, Myxococcus xanthus
atggcccgctccgcgtcccgcaccatcgtcctcgtcgtcctgtcggccgtcgtggcctgtggcgccgccgccaccgccggggcctggcgcttcttccacaaggaccccaacaaccccgtcgtccggctcgacgagtacttcaccatgggctgggtggcctgggattccagttggtacatgcggattgcccaggagggctaccagttcgccccgggccagcagagctcggtggcgttcttcccgctgtacccgctgctcatccgcgcggtggagtcgctggggcccaatgtgtaccagtccggcgtgctcatcacgctgctgtgcggcccgctggcgttgatgctcttcaccgtctgggcgcgcaagctgacggacgaggacacggcgctgaaggccgggctgctgatggcctgctaccccttcacgctctacttctacggcgccatgtattcggacgcgctgttcgtcctgctggtggtcgcggccttcctgctgctggagcgcgggcacctggggcccgccgtcctcgtcgcggcggtggccaccgcggcccggcccgtggcccccgcggtggtgctgggcctgctggtgcgccgcctggagtggaagcacgcgcgaggcgagaagtggagcgcggtggacttcctgccggtactgtcgggcctgggcttcggcgcgtacatgctcttcctgtggcaccagttcggtgacccggtggccttcgtgaaggtgcagggctcgcccggctgggagcagattccgggctggcacacgtggctgaaggtgagctggttcgagcgcgtcgtgctggcgccgcaggacaagcgcgaggccttccggctggccgcgcacgccttcttcacgctgctggcgctggcgctggtgtggcccacgcgcaagctgctggggtggggctacgccgtctacgtgctggccatcgtcgggttgcccgcgtggtccaccaaggacttcatgggcatggggcgctacctgctgtccgccttccccgtcttcctcaccgcggcgatgctcctgcgcgagcggcccttgctgctgcgcggggcgctggcggtgggcgccgcgtcgctgctcgtcctctcgtgggccttcggcgcggactactacgtctcatga

SEQ ID NO: 7717 - DNA, 255 bp, Myxococcus xanthus
ccgatggtcaacgaggccatccgctgcctgggcgagggcatcctccgcagcgcgcgtgacggcgacgtgggcgccatcttcggcctgggcttcccgcccttcctgggggggcccttccactacgtggacagccgcggccccgccgaggtgctgcgcaagctggagcactaccacgacaagctcggggagcgtttcgcccccgcgccgcacctggtggagatggtgaaggcgggcaagacgttctacccgcgctga

SEQ ID NO: 7718 - DNA, 900 bp, Myxococcus xanthus
atgtgccgcacttgcggcgaggggggctcgcaagcctggtgcccggcctgccgtcagcgcgagggcgtggggcaggcctttccgttgacgcgcgagaactggagcgtctccgggctgatggacctgtcctgggatgcgttcaagcgcgagtgggtgatgctctgtgtcggcgtgctcatcttcctggcgggctccttcgccgggcaggtcgtctcgcaagtctcctcgatggtcggtggcgcgacggggagcaccgtcatcaccgtcctgggcttcttcatcgggatcattggttcctacgccatccagggcgggataacgctgggtttcctccggatgagcatggacgtgctcagcggccggcgcgcggacctggggcggatgttcagccagttcggcaagattcccacgtacctggggacgctgttcctgtccttcctgttgatgctcccgctcctgttgctcatcgtcgtgggcgcggtgggcgcggggttggcgactggcaccgtgtcctggtcggagctggtggcgctgaaggacctgcctccctcggagctggactcggccgtgacgcccatgttgccgggcttcgcggtgatgggggccgtggccttcgcgctctacgtcttcccgggcgggtggctcctcacgccgctcatcctgatgcagccggagctggcccggaccgaatcgcccggcgccgtggagacgctgcgccgctgcttcgactactcgcgcggtcagcgcctgcccatgattggaacggtgctgctggggggcttgctcgccatggtgagcgtgttcctctgctgcgtgcccgtgattcccgccctgggtttcttgcagttgctgatggccgggctcgtcatggcgctcagcagcggcgccgaagaggcctga

SEQ ID NO: 7719 - DNA, 1431 bp, Myxococcus xanthus
atgagtgctccccctctgcaccctgacgacatccacaccagtcccggcgacgtcggacaagacctgaaccactctccgttgttgggcgaaacgctcgtggtggacccgcgcaccacggtgaagctccacaagtgccgcctggccgtcacctccggaccggacaccggccgctcggtggtgagcgacaaggagcggctgcgttgcggcgcgcatccaggcaatgacctggtgctggtggaggaccgcaccgccagccgtcaccacttcgaaatccagttcaccgagcgcggctatctgctggtggacctgggctccaccaacggcaccttcctggatggccggcgcatcgagcgggcctacctgtcacccggctcgcagattcgcgcgggctcgtcggtgctgaccttcgcgccactggatgaggaagtcaccatcgagcccgaccgcgagggcgagctgtgcggcatggtggggcagagcatgaagatgcggcagatattcggcctcatcaagaagatcgcccccatgggagtgtccgtcatcatccaaggtgagacgggcaccgggaaggagctggtggcacgcgccatccatgagctgtccggccgcacgaaggggcccatggaggtgctggactgcggcgccattccgcccaacctcatcgaaagcgagttgttcggccatgagaagggcgccttcaccggcgcggtgagcagccggccaggcgccttcgagcgcgcgcacgggggcaccatcttcctggacgaactgggcgagctgcggctggaccttcagcccaagctgctgcgcgtgctggagaaccatgaagtgcggcgcgtgggtggcaacgacgtcatcgaggtggactgccgcgtcatcgccgccaccaaccgcgacctgatgaaggagattcaggtcggcggctttcgcgaggacctctacttccgcttgtccgtcatcaccatccagctgccgccgctgcgacagcgccgcgacgacatccccctcatcctcaagcgcgcgctcgcggacccggaagtggtgggcaagcacggcaagaagcgtttctccgcggagtccctgggcctgctgatgtcgtattcatggccgggcaacgtgcgtgagctgatgaacgtgttgtctcacgtcctcaccttcagtgagggcgaggagattcagcccgcgcacctgccgcctcgcgtgcggggacaggtccgcgaagggccgctgcccttcaacgagcacctctccttcaaaaacgccaaggagcaactgctggagaacttcgagcgtgaatacatcaccagcgttttgacgcgctgcgaaggaaacctgtctcgcgccgcgcgtgagagtgggctccaccggaagtcgattgaacggctggtgaaaaagtaccagttggacacaaaggggatgaagtcacgttag

SEQ ID NO: 7720 - DNA, 720 bp, Myxococcus xanthus
atggtgttcctcatcttggggacgctgcagctcttcctgatgctgcaggggcggctgttggcggagtacgccgcctttcgcgcgacgcgggtgggcagcgtcaaccatggcgactgtcaggccatgactcacgcggccatcctcgcgctgatgcccagttattattcgttcctgggcggcgcgggcggctcaccggggcagaagctggccaatgccttcgcggcccgccgcgacaaccagtacaacggggcgacagggcgggccaaccgggtgtcgatgcccgacgggaatcacaccggggccatcgtgtggatcatccgcgacagcccactggccacggcggtgccgaacgaggacgcgctcttcgaccagttcgacaatccggcgggcatcgtgcggctcgagacgcggctggtttactggtttccgctcaagattcccttcgccaactgggtcatcgcccggttgacgatggcgcgctgggggtggcgggattacacgaaccagaacccgttgatgcagacccaacgcgccagatggacccaggggcctccgtccatggggctggaagggctgattcgtgaagaggcgctgcggcggatgaactccgagcagtacgtcatccccatccacgcctccgcttctcttcggatgttgacgccggtgcaacggcgcttcttccagacgcagaactgcgctcctgctcccgaggcactatga

SEQ ID NO: 7721 - DNA, 303 bp, Myxococcus xanthus
atgacgcacaagctactgagccgcggacagacgctggtgctgttcgccttgacgctgttgctcctcaccctgctggtgaccttgacgttgtcgtttggctccaaggtgaaggagaagatggaggtccaggccgcggcggatgccgctgcctacagccaggcggcgacgacggcgcgcgtcttcaacgagatggccttgatgagccgggcgcagattggccacctggtctccaaggccgcggtgaacagcctcatcgactggagcagctactaccgcgcgcagattggcgccacgcgaaaatgc

SEQ ID NO: 7722 - DNA, 672 bp, Myxococcus xanthus
atgaaaacgctgcacaagccgctgcagatcaccctctaccaggacgtgctgtgttcctggtgctacctcgccgacctgcgcctcgatgtcttgcgccaggagctgggcgaagccgttcgctggagcgtcaggccgtatccgctgcgcgtccatgacgtgctgcccacgacgcgcgaacaacgcgcgttggtggaagaggtcgagcgcgcacagcgcgaaccggatgccgccgcgcgcatgttgtccaccgacctgtggctcgggggcgatccaccgcgcaccagcgtgccggcgttggcggcactggaagcggcgcggctgcagggcccgcaggcgcgcgcgttcctcgcccgcgccatgcagcgcgcggcgctggagcagggcgtcaacgtatcccgcccggacgtggtgttcgagctggcctcgcgcgtgggcctggcgatgaacgaattctccgcggccttccgctcggaggagacgcgccgcctcatcctcgacgagcaccgggatgccacccaccgtggcgtgcggggcgtgcccacgctcgtcatcggcggccggtggatgctgtgcggcctgcgtgagctggccgagtaccgcgagcacatcctcgcgtgcctgggcaaggtgtccgtgccccgctcgggttcacccgagcgcgtggtgcactga

SEQ ID NO: 7723 - DNA, 402 bp, Myxococcus xanthus
atgccctggctggtagcgctggtcctgctgctgagcctgggtggctgcaaccggccgcgcttcggcaccccgcaggacgcctacacgtccttccaccggctggtgaagcgaggggagctgcagcaagcgtggggcgcgctgtccaagcccacccaggacgcgctggcgcagcgtgcgcaggtggtgggagaggcctccgggggtgaagaaaaaccggagcccatggccctcttcttcgcgaatgtccctccgcctccggatgttacggaggtctcgctcgtccgagaggagggagacgtcgcgacagtgctcgtgcgcgcgggagaaagctcccacgaggtccggatggtccgtgagccatccgggtggaaggtcgacctttcagcatccctccagccgtaa

SEQ ID NO: 7724 - DNA, 990 bp, Myxococcus xanthus
atgtctccgcgcaaagtgaagccgaagaaggtcccggtcctgcccgggtcccaggcacccgaccgtcccgaacgggccccacggcgagggcacgcgaagaagacggttgtcatcctgtcccgcaagcgcgcgctgtactccacacggaggctggtggccgccatccgcgcgcggggccaccgcccgttggtgctggacacgctgcgttgctgcctgctgctcgcgcaagacgcaccgcgcatgacgtatcgcggcgtggaggtgcgtggcgtggacgtggtggtgccgcgcatcggcgcgtccatcaccgcctatggcctggcggtggtgaaccacttcgagatgatgggcgtgcccgtcctcaacccgcccacgtccatcgcgcgcagccgcgacaagctgcgcgcgctgcagtacctgtcgcgctccgggctgaacatcccccgcaccgtcatggcgcacgaccgcagcaacgtgcgccggctggtggaggaggtcaacgggctgcccgtcatcatcaaactcatcaagggcactcagggcgtgggcgtgatgattgcccacacgctgccggaggtgcagaccatcctcgacaccttctgggacctgggacaggaaatcgtgctccaggagttcgtcgcggagagcgagggacgggacgtgcgggccctcgtcgtgggtgaccgcgtggtgggcgccatgcggcgcaaggccaagtccggcgagttccgctccaacatccaccgcggcggcgaagggcaggcaatcgagctgaccgcgccctacacggaagcagccgtgcgggccgcgcgtgtcgtcgggttggaggtcgcgggcgtggacatgctggagggccacgccggcccccggctgatggaaatcaactccagcccgggcttcgagggcctggagcgcgccacgggcatggacatcgcgggggccatcatcgaccacgcgctgaagtacgccgaggcgaagcgcgccgggtga

SEQ ID NO: 7725 - DNA, 342 bp, Myxococcus xanthus
atgaacggacatctggacggaggattcattccagtggcgacgctggacgtactcgacgcgcggggccgcgcggtggtgcaggtggacggtgtcgcggtggccctcttccgcgtgaatggggagctccatgcggtggcggacgcatgcccccaccgggccgggcccctgtccgagggggacctggtgggatacgtggtgcactgtccgttgcacacctggccgttcgacatccggacggggcagtgccctcggcatccaggggtgcaggtccgcacctatgtggtgcgtgtgcagggacagcacatcctcgtgtccgcatcaggtagggtccacgccccctga

SEQ ID NO: 7726 - DNA, 528 bp, Myxococcus xanthus
atggcgcgtgccgtggcggacttcctgcgcgccgccggtctgaacctccaggacgtccacctggcggacacccccacgcgcgtggccgaggcctgggcggccgagttcctcgacggctacagccgcaccccggagcaggcgctgggggagacgttccccgcgccgccgggctcctcgggcgagctggtggtggtgacggacctgcgcttccactccatgtgtccgcaccacctgctgccgctcaccgggcgggcccacgtggcctacgtgccgggcaagcgggtggtgggctttggccggctgtcatcgctggtggactgcttcgcgcaccggctcatcctccaggaggacatggcgcgggaagtggcgcgttccctggcgcaggtgctgggcagccccgccactgcatgcatcatcgaagcggagcaggcgtgcctgcgcctgcgcggggacaagcagcgcgacgccgtcactcacgcggaggcctatgaaggcaccctgcggcgcgacggccccctgcgcccgtga

SEQ ID NO: 7727 - DNA, 1419 bp, Myxococcus xanthus
atgattgcgcccctgccgcgcgtggagcccgagcgcgtggcccgcgtgcgcgaggcgctggccgccgttctggctccggagcagctgcgcgtggatgacgccgcgctggccgcctacgcccgtgacgagtccgacagtggcgtccatgcgcccgacctcgtcgtcttccccgcggacacgcggcaggtgtcggaggtcttcaaggcgtgcgcggtgcacggcgtgcccttcaccccctgtggcgcgcgcagcggcaagagcggcggctcgctgcccttgcacgggggggtggcggtgagcctggagcggatgaaccgcatcctctccatctcccccgaggacctcaccgcggtggtgcagcccggcgtcatcaccggcgacctgatgaaggccgtggaagcggtagggctcttctatccaccggacccgaactcctgggaggtgtgcacgctgggcggcaacgtggcggagaacgccggcgggcctcgggcactcaaatacggtgtcacgcgcgactacgtcatcggactggagtgggtgctcccggacggcgaggtggtgcgggtgggccggcgcaccatcaagggtgtggcgggttatgacctggtgggcctcttcgtcggctcggagggcacgctgggggtcgccaccgaaatcaccgtccagctcatcccgctgccgcgcgaggtgctgacggccctggtggtttttccgtccgtgctgcacgccgcgcgcgcggtgtccgccgtgctggccgcgggcatcctcccgcgttgcctggagctcatcgatgacgtggccctgcgggctgtggacggccgcggcttccagttccctccgggcgcgggctccgctgtcatcgtcgaggtggacggcaacggccgcgagggcttgctcgctgagctgtctcagttgggtgacatctgtgccagccagggcgccaccgagacgctggtggcccaggatgcctcccagcgcgagaagctctgggccgcgcgcagggtgatttccccagccctccgggccctcaagcctcacaagatttccgaggacatcgtcgtgccccgctcgaagattccggaggtcatcgagcgcttgaaggccatgggcgcggagctggggctcaccgtggccacgtatggccatgcgggcgacgggaacctgcacgccaacatcctctacgagggcgcccaccaacggccgctggtggaggaggccctgcggcgcatgctggtgatgaccgtggaactgggcggaaccatcacaggcgagcacggtgtggggcacgcgaagcgggaatatctttcgctggagcagtcccccgcgctcatcgacctgcagcgcaggctcaaggccttcttcgatccatcagggttgctcaacccttcgaaaatcttccccgcgctcatgcgttcttga

SEQ ID NO: 7728 - DNA, 797 bp, Myxococcus xanthus
atggccaattcgacgaagtacgcagccgaaggcctgtcgcactaccttcggaacctgggcgggcaccagcagctgacgcgtgagcaggagtacgagcttgcgcgtcgcgcccgcaagggtgacgagtccgcgcggcagacgcttgccagctccaatctggccttcgttgtcgccgtggcgaagaagttcgccaatcgcggcgcgcgactggatgacctcatccaggagggcaacgtcggtctcatgaaggcgatcgagcacttcgatccaaagaagaacgtgcgcttcgccacctacgcggtgtggtggattcgcgcctacatcacccggtacctgaaggacaaccgcagccaggtgcgcggtggtgaggccgagcgcggcagcatggtggacttctcgctggacgccaccatcgacgaggacggcgagacgaccttcctcgatcggctggaggacaacagcccttcgcctcagcaggtgttcctggcgcacgagcaggacacggagattcaggaggcgctcgccaaggtgcgcaagcgcattggtgacctgggctgggacatcctcacggagcggctgacacaggacaagccgctgacgctcgaggaactgggccagcggtggggcgtgtcgcgcgagcgcgtgcgtcaggtggagctgaaaactaaaaacttcctggagcggtacctgcacgggttcaactagaacgaggagcaccacctgtgcgagcgggccgccaacccggtgtgagcggtcattcagggcccttcccacctgggaaggcgcgtcatcggggc

SEQ ID NO: 7729 - DNA, 807 bp, Myxococcus xanthus
ctcttcgtcgcgtcccccgctcgcgcggacctcaacgtcgtcaccaccctgccggacctggccgccttgacgaaggccgtgggcggcgaccacgtcaaagtgcaggccctggcgctgtccagccaggacccgcacttcgtggatgccaagccgaacctcgccctggcgctcaaccgcgcggacctgctcatcgcggtgggcctggacctggagatcggctggctgcccacgcttcaggtgggcgcgcgcaacccgaaaatcctcgtgggcaacccgggctacctggtggcctcgcagttcgtgaagctgctggaggtccccaccgcgcaggtggaccggggccagggcgacgtccacccgggcggcaacccgcacttcctctatgacccgcgccaggcgctgtccgtcgcgcgagccatcaccgaccggctggcgcagttggatccgaagaacgcgcagtcctaccgcgacaacctcgccaccttcaccaccgagttggagaagtcgcgcgcggactgggagaagcggctggcgccgctgcgtggccagcccgtcatcgcctaccaccggaccatggcgtacctggcggactggctgggcttcgacaccatcacctacctggagcccaagcccggcatcccgcccaacccgtcgcacgtcgcgagcgtcctggcccagggccgtcagcgaaaggcgcgcatggtgctgatggagagctactacccggacaccaccgcgcggttggtggcctcgaagattcccgcgccgctcgtcaccctgcacggcggcacggacttcaaggcgaag

SEQ ID NO: 7730 - DNA, 1107 bp, Myxococcus xanthus
atgcctggcggtggctccgcgctctccatccccggggtgaacaatcccaacacgggcgcgaacttcctggacctgagcttcatcctggatgtggccgccgcggccttcacagacaaggagcccctgcagagcggcgcgcacgaccccacgcgcaacggcttcaacctgcagcagttggagctgtccatcggctcggtggtggacccctacttccggttcgacgccaacatcgtcttcagccagttcggcgtggaaatcgaagaggcctacggcaccacgctggcgctgccctacaacctccaggtgcgcgccggtcagttcctcacgcgcttcggccgcatcaaccccacgcacccgcattcgtgggacttcgtggaccagcccttcgccgtgggccgcatcttcggaggcgaaagcaaccgaggactgggcgccgaggtgtcctggctggcgcccctgccctggtacgtggaggtgattggcagcaccaccgacgccaccggcggggccaccgcacgcagcttcttgggcgccaccagcgaacgggttcagtctccgttcgacttgcagctcaccggcgcggtgaagcagttcttcccgctgtcggatgacctgtccctcatgtggggcctgtccaccgccaccggccccaatcccaccggctaccgcaaccgcacggacgcgttcggcacggacctgtacctgcgctaccggcccatcacccaggcccacaacaccacgctcatcacgctccaggcggaggccttttaccgccgccgccaggtgcccggggacgtgctgacggacttcataacctacgcgcaggccgcgtggcgcttctcaccgcggtgggccaccgcgctgcgctacgagctgggaacggcggcgcgaggcgaagacggagcgcgcgtcatcgacccgttggacccggactggacggagtcacgcaaccgcgtgtccgccaacgtcaccttctggcccaccgagttctcccggctgcgcctccagggcgccagggaccatgccgggtggcgggatgagcccggctactccctgatgctcgcgctcgagctggtgaccggcgcccacggcgcccacgctttctaa

SEQ ID NO: 7731 - DNA, 426 bp, Myxococcus xanthus
atgaatcagcgagcccacaccttcgcccgctgcaccgcgacgctgctcgtcgcgctgtggctgtgtcagccgctgggcgcgctgatgcacgcgagggacgagcacgcgcatcggttctgtccgcagcatcagacgttcgaagagacggcgctcggcacgggcgcgcggctgtcccggctcgccatcgaccagagcccgcagctatccgccctgcccgaagccgtcacggactcggccgccctcccccatgaggaatgtccgctggtgacgtccggctcccgcccggagcttctgacgccctaccgcacgacactggtgctgacgctgctcgctgtgagccgtccggccaccgcgccgcctcgcgtccaggcccccctctccatcctcgataccgcccccaaggcctcgcctcccgcgcacgcgtga

SEQ ID NO: 7732 - DNA, 756 bp, Myxococcus xanthus
atggacaaggtcatcgtcatcactggagcaagcagcggcattggcgcggagctggcgcggcaagcggccgcgaagggcgcccggctggtgctggccgcgcgccgcaaggcggagctgaaagtggtggccggccagtgtgggcacgaggcactcgccgtggtcacggacgcgacccggcgcgcggacatggagcggctccgtgacgccgcgctcgcccgatttggccgcatcgacgtgtgggtgaacaacgcggggcgaggcatcacgcgctccgtggcggagctcacggacgaggacctggagaccatgtggcgcgacaacgtgaacagcgccttgtacgggatgcaggcggtgttgccgcacttccagtcgcgcgacgccgggcagttggtgaatgtctccagcaccctggggcggctgcccatcgttccccaccgttcggcgtacagcgcggcgaagcatgcgctcaacgcgctcagcgcctgcctgcgccaggagctgcgtgagacgtacccgggcatcaccgtgacggtggtgatgcccggcgtggtcgcaacggcattcggggacaacgcgcttggcggagggcccgattcgcgggggctgccaggggctcagcgcgtcgaggatgccgcgacagtcatcctcgattccatcgaacgtccgcgtgccgaggtctacacccaggcggcgacccaggcacaggtggagcggtactaccaggatgtggaggccttcgagcggggaggcacctga

SEQ ID NO: 7733 - DNA, 1308 bp, Myxococcus xanthus
atggcgagacacgcggtgctcatcctggtcgtggccctgttccgcgcggcggcgttcgccgcgcccccgcccgagggctttggcggacatccggagtccctgcgcatccggctggtgacgattggccccggcgcggacatgcaccagcgcttcggtcacagcgcgctgtgggtcgaggacacgcgcctgaagaaaggccttctctacagctatggcacgacgtccatcgcgaatgggggaccggtccgcttcctcctgggccggccgacgttctgggcggcgcgcctgtccgtggagcggactttcctgctgtaccgcgcactggcgcggtccattgacgtgcaggacctcatgctcacggtggagcagcgtcaacggctcctggctcggctggagcgagacgtccagcccgcttcgcgtgaatatgcctatcacccgctcaaggacaactgcgcgacgcgtgtgcgggacgtccttgatgaggcattgggtggcgcgcttcgggaagcgctcacggagccggcacgtgccacccaacgagagctcctccggcgatacatccagacgcatccggtgtcggagctgctcttgatgttatggctgaacgacgccgtggacgcgcccgcgactcaatgggaggaggccttcctgcctcgggagctcgccaggctgctcatgggagtgtcctacgtggatggctccggcaggcgcatcccgttggtaaatcgcgagggggcctcatccccgtccatggacgcgtccgctcctgtcgacgccggctgggaaggaacctccgcctgggggcttggcgcaggaggcgcggccctggccatcatcctcgcgttcctgcgtgggcgtggcacgcaccggatgttccagattctcttcggcctctatcacgccgtgttcgggctcacgctcggcgcggcgggcgtggcgctgggtggtttgatgctgttctccaggctcgatgtcatgcagggcaatgagaacctgttgctggccaatccgcttgccttcggactgcttccgctgggcatcctcatgatgtccggcagtgagcgcgcggagcgctgggcacgccgatgcgtctggctgctcgcggcgggttcgttgctcgcggtggtgctcaagctcttgccctcattcgaccaggacaaccgcaggcccatggccttgtggctggtggcgaacctcggactggggctcgctcacgcctggcggttgcgccggccatccacggcgcctgctcctgccgccggggcgagggaaggggcccgcggctctacccgctggtgggcagtgtga

SEQ ID NO: 7734 - DNA, 567 bp, Myxococcus xanthus
atgacggtggccgagttcatggcccgcaaggagcgcacccagcgcaaggcggccatcaagcaggcgcgcggcgaggtcgaaaacgccgtggtggcggacttcctggcccagctcatcagcgacaaggcagaagtctccgtggtgctggcggagcgctccctgctggacacgctacaggccgaggagcccatcgccttcacgctggagcgcacgggccgcctggagaagctccaggtagtgctgctggcccggcgcacggactgggagcggctgctgcccggtctggagcgcgatgccaagctgacgcagaagccgtccgcggtggcgcgtcagccggacaagcgcccccactcggacccgcgcgccttcctggaccacatcgggcagacggtgcggatggtgctgcgcaacggcatcaccctccagctcccgctgatgcgcgtgggccggttcgacctgctgttgggcgaggagggccacgaagtcttcgtcccgctccacgccctgctgcgcttcgagcccgtcacctccacctccgacgagagcgcccccgcggacgaggcctga

SEQ ID NO: 7735 - DNA, 216 bp, Myxococcus xanthus
atgaagcgcctgggaaaagtcggtctgctggtcggagcgctcacgctgggcggcgcagtcgtcgggtgtaaggctgaggacgacaccgcgaagaagcaacgcatcgtcggcagcgaccacctgagcaagaaggagttcaaggaagccgccgcggcctacgcgctgtcgctccaggcggaccccaagcaggagaaggtttgggagaagaaggcgttc

SEQ ID NO: 7736 - DNA, 1179 bp, Myxococcus xanthus
atgctcatcgggctcggcgcggtgctgggccacctgtatgtgtaccgtcggctggtgcgccccctggtgcagggccgcatgcctcggctgctggccatcggcgtgctcgtgctgatgacgggcgtgctggggaaccggcgcaccgtgctggacctgcttccggagagcgccgaagggctgctcaccatggcggtgtacacgtggatgggcgtggcgctctgcctcgtcatcgccctgctcctgacggacgccggccgggggctcacggccctggcaagacggctgcggccacacgcccctcccgcgcctcccgcgccagcatccagccccaccgtggacgaggaccggcggcgattcctgggccaggccgtggccggtaccgccttcgtcgcgggaggcgggctggccgcctacggaagctggcgcgctttctcgccgccgctcatcacggaagtggcggtgaggattcccaagctgcccaaggccctggacggactgagcatcgtgcagctcaccgacatccacgtaggccacttcatccagcgccgctacatggacgcgctcgtccagcaggccaactcgctgcgccccgacctgttcgccatcacgggagacctcgtggatggcgacgtggcctcgctgggcggccacgtgtccgcgctcgccgcgctgaagtcccgctacggcagctacttcgtcaccgggaaccacgactactactcgggtgacgaggagtggtcggccttcctggagtcactcggcatctcggtgctgcgcaaccggcacgtccccatcggtgacaagggcgcatccttcgacctggtgggcgtggatgactggagcggaggtcggcggcgcaacaagaagggttacgacctggagctggcgctcgcggggcgggattccgaccgcgccgcggtgctgctggcgcaccaacccgcgaacttcaaggtggcggcggagtgcggcgtggacctgcagatttcggggcacacccacggtggacagctcatgcccatgacgatgctgattggtctggcgtgggagcactccgccgggctgtacgcgcacggtgactccaacatcttcgtcagccgtggctgcggcttctggggaccgcccatgcgcgtcggcagcccgccagagctggtcaagctcgtgctgacagcatgacgcgct

SEQ ID NO: 7737 - DNA, 447 bp, Myxococcus xanthus
atgctcctcatgacccctggcaaggcacacgccgtggatggtgaccggcaggtgacgcaccttcgtgtccgcatcgtcaccggaagcgacgacctgcgcaaagcgagcaacgccttcgccgagttcagctacacggcgatcaatggcagccacatctccatcagccagaacctgaacaacggcgcgaactggcccaacgggtcaacgcgcaccgtggatgtcgaactccccgacggcgtcctctacagcaacatgcgcgagttcgcgatccggtttcaatccgggcagtccaaccccttcgagaccggtgacaactggaacctgaacgacatccgagtcaccgctatcctggacgacgggtcggagaccatcatcgtgcaggactccggcaacccctaccaccgcttcaagagcgacgtgaacacccggcgcgcctgggtgctctga

SEQ ID NO: 7738 - DNA, 786 bp, Myxococcus xanthus
atcggcagcgcgggcgtcttcgcctcggtgatttgtggcattgcacggcggctggtcctggaggccggaaccgcgagtgtccacatggagcgtgcacgcacgaacctgcgcgcgctgctgcgcgagcaccatgacgtgcgcacgttgctgtccgcggcgaggctgcgcgccgacctcctcctccgcgagcccctgagcgccagcgcgcccggccatgcgagcgccctggtcgaggacctgggagagctgagcagcttcatcgagagcgtgaaggcccggaccctgagcgagctgactgtgattgaagatgcgacggcggtgaacgtgggcgccacgctgcgccgtgccatggaggtcgtccaggcgaggttcgcccgggtccggttcgagttggaaggaacagcgggcctggcgcgtgccgccgccaacgacgtcagcgtccggattgtcggtggagagcgagggctcacgcacgtggtcaccaacctgttcgtgaacgcctgtgagggtgatggccggcaaggcgcgcgcacggttcgaatcagcgtggagccgaacccggcgctgcaccgcgtcctgctcagcgtgagcgatgatggaccgggcttccgaccggggctgctggagggggaacgcccccgggccggtacgaccaagccagagggcgctgggctgggcatgctcctggtgagcgggctcgtcgaggcaagcggcggcaccttgcgcgcctgcaacccgcccgagggaggcgcgcgggtcgaagtcacactgcccaccagcgggtag

SEQ ID NO: 7739 - DNA, 207 bp, Myxococcus xanthus
atgtcggagaaggccagctccgactggtaccacgccatcctctacgtcggcgccgacatcgtcatgcagaccttcgtcaaggccattgccctggcgctgctcttcaccggcaagtcgaccttcgagacggtgttcgtgaagacgcaggacgaagcccgcgcctgggtggcccagcaccggctccggctcaagagcaaagcaggatag

SEQ ID NO: 7740 - DNA, 414 bp, Myxococcus xanthus
atgcagcaactggaatggacattcggttcccactcggtgcgctatgaggcgcccgacgtcgtgcaggcgaccttcgtcggccccatcgacctggatgaaatcaagcgcgcggtcgacgtgtacggggagattgcccagcaatacgggccctactacctgatcgccgacatcggccgctcccaactgggcgcggagccccggcgctacctgtcggagaacggcaaggcggactggttcaagggcaccgtgtacgtcggcgcggacgtggtgcagcagaccttcggcaaggtcatcgcgctgggcatgctcttcaccggcaaggcgcgcttcgagacgaccttcgtgaaggaccacgacgaggcgcgcgcctgggtggcgcagcaccgccagaagaacaagaagaagctgggctga

SEQ ID NO: 7741 - DNA, 538 bp, Myxococcus xanthus
tgtccccacctgggtgcccagtacaacccgttcacgggcccccacgcggaggacccgcacgccttcttcgagaagctgcgcaaggacgagcccgtcagcttcagccccatgctgaacatgtggctggtcagccgctacgaggacatctcccaggtgctgaagagcccggcgcagtactccaaccgggacatgctggcgagcggcacccacctcacggacgaggccaaggccatcctggaccagggcttccccaccgcgcacgtgctgctgggcatggacccccccgagcacacccgcctgcgccgcttgatgaaccggggcttcaccgcgcagcgcatcgccggcatgggccccttcatccgggagatggccaccaccctggtggaccgcttcgcccaggacggtgaggcggacctggtgaagcagctcgcctggccgctccccgtccacgtcatcctcggcgtcatgggcgtaccgcaagaggacgtctggaagatcaagcgctggagctccgactggcagcagcctttagagcaca

SEQ ID NO: 7742 - DNA, 810 bp, Myxococcus xanthus
atgaagcggccggggctgggcacagcgctggcggtggtggcgttcctgaccttcttcctggggcccttctgctggcaggtgctgacgagcctgtggccggatggcgagctgacccggccgtggccctcgcacctgacgctggagaactacgcgagcgtcctgtggggacggcccttcctgcgcgtggtgttgaactcgctggtggtggcggcgctgaccacgggcttctgtctcacggtgggggcggcggcggcgttcgccctggcgaagctggagtttcgtggcaagggggtgctgctgagcgcggcgctggcggtgagcatgttcccgccgattgccacggtgagtccgctgtatctgattctgcgcacggtggggctgcgagacagcctggtgggactggccttgccgtatgcgacgttcgctttgccgctgacgctgtgggtgctgacgtcgttcttccgcgcgctgcccgacgagctctaccgcgcggcgcgcgtggatggctgtacgccgttccaggccttccggcaggtgctgctgcccctggccgcgccggggctggcgacgacggcgattcttgtcttcatcttcgcgtggaatgagttcctgtatgcgctgacgttcctctccaccccggagaagcgcaccgtgcccgtggccatcagcctgttcgccagcgagtaccgtgagccctggggggagattgccgcggcctccgtggtggccacgctgcccctggtggcgctgacggtgctgttccagcggcggatcgtgtccgggcttacggcgggcgcggtgaaggagtag

SEQ ID NO: 7743 - DNA, 783 bp, Myxococcus xanthus
atcctcgccgcggtgtggctgagcctgcaccgcttcatcctcgtctttggcgagcggcgcttcacggggctggagaactacgcgtacctgctgggggactcgcgcttctgggcggcgctgggaaacacggcgtacttcacggccgtggcggtgacggtggagttgttgctcgcggtgccgctggcgttgctgctccagaagtcgttccctggaaggggactgctgcgcgcgtcggtgctggtgccgtgggcgattcccaccgtggtgagcgctcggctgtgggcgtggatgttcaaccccgagtacggcgtcatcaaccggctgttgcccgggcaggacatcaactggttgggggcacccgggtatgcgttgcacgcagccatcctggtggacgtgtggaagacgacgcccttcgtggcgctgttggtgctcgcgggcctgcagggcatctccgaggacctgtacaaggcggcgcgggtggacggggcctcgccgtggcggacctttgtctcgataacgctgccgttgctcaagccggcgctgctgttggcgttgctgttccgttcgttggatgcgttccgggtgttcgacgccatctacgtgctgacggagggcgggccggcgaacacgacggatacgctgagcatctacgcgtacaagacgctgatgcgttcgggggacttcgggtacgggagcacgctgtcggtggcgaccttcctgtgcgtggtgttgctggcggcggtgtggctgcggctcttggggcgcgaggaggcggcgcgatga

SEQ ID NO: 7744 - DNA, 1281 bp, Myxococcus xanthus
atgagacgcgtctcctccatcgtgctcgcgctgagcctcgtcgtgggcctgggcgtctggggctgccggcggcaggacgcggcgggcgaggccgggggccgcacgcggctggtcttcaagtatcagccgctgtgggggccgccggagccgttccgcgagctgctggcgcgcttcgagcgggagaatccgggggtggagctcgtcacggaggcgctgcccaacgcgtccgacctggcgcaccagttcttcctcacgtcgctggagggtggggcgagggatttcgacgtgctggtggtggacgtcgtctgggtgcccgagttcgcgcgcgctgggtggattgcagacctgtccgcggagttcccgcccgagcggctgcgcgaggacttcttccccggccccgtggaggccgtggtggtggaggggcgcacgtacgcggtgccctggtacctggacgtggggctgctctactaccgcacggacctggtgccgcgcgcgccgcgcacctacgcggagctggagcgcttcgcgcgcgaggcgatggcgaagacgcccgggctccagggctacgtgtggcaggggcggcagtacgaaggcctgtcctgcaatgtgtacgaggcgctgtgggggcacggcggccgggcgctgtcggaggatgggcgggtgctgctggatgacgcgcccgcgcgcgaggcgctcgcgtatctgcgagggctggtggagcgcggcgtgtcgcccgcgacggtgacgggcttctcggaggaggagtcgcgccgggtattccaggaagggcgcgcggtgttcatgcgcaactggccgtatgcgtggaacgaggcgcagaagccggactcgcccattcgcggcaaggtgggcatcgccccgttgccgacggtgagcggcgagccgggttcgggggcgctgggcgggtggcaactggctgtgaatgcccatgtgtcgccggagcggcggaagctggcggcgcggctgattgcgcacctcacatccccggaggccaaccgggtgctggcgctgaactacgcgcgcaacccgccgcggcccgccgtgtaccaggatgcgcggctgcgcgaggaggcgcccttcatcgccgggctgctgcccatggtggagcgcgcgaagccgcggccggtgacgccgtactacaacctgatttcggatgtgctccagagcgagttctccgccgccgtggccgggctgcgcacgcccgagcccgcgctgaagcgggcgcagcggcaggtggaccatctgacgggggaggggccgtga

SEQ ID NO: 7745 - DNA, 411 bp, Myxococcus xanthus
atgcgtcagttcatctcccgcatcatcaagccctggctcgccttggccgcgacggccgccatggtgggcatcacccagcaaggatgcacgaaggacgccgacgcggcgaaggcgcccgcggtccccgagaagcgggagaacggcgtgcgcatcgtcgagctctccgtcaccgagaagggctacgagcccagcccggtgagcctcaagaagggcgagccggtgaagctggtggtgacgcgcaagacggaccacacctgcgccaccgaggtcgtcatggacggctacgacatcaacacgccgttgccgctcgaccagccggtggagattgccttcacgccgaaggagtccggcaagctggtgtacggctgcgccatgaacaagatgatttccggcgttttcatggtcgactga

SEQ ID NO: 7746 - DNA, 1773 bp, Myxococcus xanthus
agcgcgaggggatgggcggtgagcgacctggtggcgcggacatggtgggcggcgcggcgaggcctgccgggcctgcggcaggcacgcggctatcagcgccgctggttccgggcggacctgctctcggcgctcaccattggtgcgatgctcatcccccagggcctggcctacgcgcagctcgtgggcgtgcgtccagcagcgggcctctacgcgggcgtggtgggaatgctggcctatgcgctgttcgggccctcgcggcacctcatcatcggacccgaagcgggtgccgccatcctcaccgccgcggcgctcgcgccggtggcggcgggggcggcccccgcgcgctacgcatcgctggcggcactgctggcgctgctggtcggcgtgctgagcctgctcggagggctgctcaaggtgggcgcgctcgcggacttcctgtccaagcccatcctcatcggctacatcaatggcgcggcgctcatcatcatcggcagccagctcgcgcggctcttcgggcaggagcgccagtccgacacgttctcgggtcaggtgttcgaggtggccacccacctcgaacggacccacgtcccgacgctcctgctggggctgggcgtcatcaccgcgctcgtgctgctgcggcaactcctgcccaaggtgcccggtccgctcatcctggtggtcctcaccacggtggcgggagggctgttccagttggagcatgggggcatcaaggtcgtgggccccctcgccgccgagccccccgctccaggcctgccgtccctgcgcttcgaggacgtgcggtcgctgctccccgccgccttcagcctggcgctcgtcaactacgccagctccgtgctgacgggccgattctacgccgacaggttccgctaccggctggacagcaaccaggagttcctcgggcaggccgcagccaacctcgccactgcgttcagccaggggttccccgtgacggggagcgactcgcgcacggccgtcaacgtctccatgggggggcggacccagctcgtgggggtgctcgccgcaggggtggtgctggtgttcgccttgttcctcacgcccctgctccacgacttgcccatggtgacgctgggcgccatcgtcttcgtggccgcggtgtacctgctggagttccgagccatcatcgacctgtggcgcgtgcggcgcgtggaggcggtgctcgcgtgcgtgacgatggcgggggtgctggtgttgggcatcctccaaggcatcctcgtcgcggtggcgctggcccttgcggacctcatccgccgggccgccaggccccacgacgcggtgcttggcgagcgcgagggcgtgcccggctaccacgacatcgagcggttcgagaacgccgagacggtgcccgggctcgtcatctaccgcttcgatgcgccgctgttcttcgccaacgcgcgccatctgcgggagcaggcccgggccttggtctccagcgcggatgcgcccgtgcggtggttcgtgcttgatgcgtccgccgtgttcgacatggacgtcaccgctgccgatggcctggagaagctgcgccgtgagttcgaggaagagggcgtggtgctgggcgtcgccgaggctcgggcgccgctgcgcgcgctgctgcggcgtaccggcctgctggagcggctgggcccggagaatgtgcatgccaccgtggaggcggcggtgcaccacttcctgaaggacgccgacgcgaggcacgcccgcgacggtgagcctccggcgctccctcccgtgcattga

SEQ ID NO: 7747 - DNA, 1662 bp, Myxococcus xanthus
atggcaagcaaggcgaaacccacgggcaatggaaacggcaacggcaagcagtcgcgtaagcccaacatcctggtcatctggggcgatgacatcggcatctggaacatcagcgcctacaaccaggggatgatggggtacttcacgcccaacatcgaccgcatcgcgaaggaaggcgcgatgatgaccgactgctatggccagcagagctgcaccgcgggccgcgcggccttcatcaccggcatgaacccgcttcgcacggggctcaccaccattggcatgcccggagcgaagtatggactccaggactccgaccccaccatcgcggagatgctgaagccgctgggctacacctgcggccacttcggcaagaaccacgtgggtgactccaacccctacctgcccaccgtgcacggcttcgacgagttcttcggcaacctctaccacctcaacgcggagggcgaaccggagtgcccggactaccccaaggacccgaccttcaaggagcgcttcggtccgcggggcgtcctccggagctgggccacggaccgcgatgaccccaccgaggacaagcgctggggcgtggtgggcaagcagcgcatcgaggacaccggcgcgctcacccgcaagcgcatggagaccgtggacggggagttcctccaggggaccctggacttcatggagcgcgcagtgaaggacggcaagccgttcttcctctggcacaacaccacgcgcacccacgtctggacctatctccaggagaagtaccggaacgccaccggctacggcctctacgcggatgccatgcgggagctggacgacatcgtcggcgtgctgctggccaagctggacgagttgggcatcgccgacaacacgctggtggtcttctccaccgacaacggcgtggagaagatgggctggccagacgggggcaacagcccgttccggggcgagaagggctccacctgggagggcggcgtgcgcgtcccctgcatggtgcgctggccgggcgtggtggagcccgggcgcgtcatcaacgacatcttcgcgcacgaggactggatgcccacgctggtctccgcggcgggcggccccaaggacctcgtggcacagtgccagcgcggctacaaggcgggtgacaagaccttccgggtctacctggatgggtatgaccagaccgggctgctcgcgggcaaggagaagggaccccggcacgagttcatctacgtgctcgacagcggaaacctcgcggccgtccggtacgacgactggaagctcatcttcagctaccaggaaggcgaaggcccggacatgtggttcagcggcaagcgcttcgacccggcgtggccgtacctcatcaacctgcgctcggacccgttcgagtacggccccaaggccggcctgtacttgaagtggtacggggagcggatgttcacgttcgtgcccgcgcaggcgctggtccagaagttcgcccagagcctgctcgactacccgcccagccaggccccgggcagtttgagcatcgggcccatcaaggagcgcgtgaagcggaagttgttggaggcgcgcgagcgcaaggaggagacggccattggcgaccaggtcatggcgctggccgaacaggtggagcggttcgtccgccgcgcccagcagtcgcacgcgtag

SEQ ID NO: 7748 - DNA, 1098 bp, Myxococcus xanthus
atgacgcaggtggtggcccctcgacggtcgcccgccgacttcgcgcggctgcccttcaacccgcactggaacctgggccgtgcggcgaggctcctccaactgacggatgacatcgcggcgggaggcgtgggcctgccggaggcccgtgcgaggttggaccgcatcgtggccgagcgctctccctacccgaagtggctcgtgctcctggcctatggcgtgtacggcgccgccgccgcggcgcgcgtggggggcgcgtggtgggagatgttcgcggccctcctggtgggcgccatcgcgggcgtcatccatttcggaacgttggtctcgcagcgggtggacctgcagaagagcttcctggcggcgttcctgggaacgctggtggcgttcgggctccgcttcgtcctgccgcccttcgatgtggtccaagcgttgtttggcggggcggtgctgctggtgcccgcgatggtggtcacgctcggctcattggagttggcctcggagtccgtggaggcaggcatgacgcgtctggtctatggactgctgcgcttcctgatgattggcgtgggcatcgtggcggccacgaccttgtggggctttctcttgccggtaccggagtacagcgacgtgcacgtgctgtcgccttgggtcaccttcttgctgctggcggtcggtggcgtggcactggctgtctgcatggcggggcggcggcgcgacctggtgggcatcgtcggcggggtgctgatcgcctacgggacgcaggctgggatgaaggcggtgctgggagagcaggggagcccgatggtggccgcgttcgtgctgggcgtggccgggttgctctacggccggggcggactgcggatgccaatgacggtcatcatgccgggcttgttgcagctcgcgccgggcttcatggggacgcaggccatcatcgcgttgctcggcatggggcgcccgggcgcggaggatgcccggccgttcgacgtgctgatggtggcgctccagttggtgttggggttggtattcgcgaccttggtggtgccgccgcgcatccccgtggacggcgacgacaccgcgccatcgggttccgggagcgcgtag

SEQ ID NO: 7749 - DNA, 2862 bp, Myxococcus xanthus
cgcacggtgaagggccgagtcgcggaccggctcaccaatgagggactgcccctggtgcgtgtcatcatcaagggcaccacccagggcgtggagacggagctggacggcaccttcaccctgcccaacgtgccgacccgatcggtgacgctgctcttctccagtcaggactacggcgagcgcgaggtgctgattggcgccaaccagcgcaccgtcgaagtcgcgatggagaacatcttcgcggaggagatggtggtggtggggcgcgccagtgaggtggcgcgtaagaacctggccaactcggtggcatcggtgaactccgaggagatcaaccgcgcgcctgcccagacggtggaccaggcgctccagggcaaggtcgccggcgccaacatccagagcaacggcggcgcgcccggtggcggtctccagctccggctgcgcggagtgtccaccatcaacggctcctccgccccgctctacgtcatcgacggcgtgctcgtcagcgacgtggccatcgcctccggtgtgttcgccatcaccgagtccgtggccggcgccaacgcgaaccccacccaggacaaccaggtcaatcgcatcgcggacatcaaccccaacgacatcgagagcatcgaggtcctcaagggcgcgtccgccgccgccatctacggctccaaggccgccaacggcgtggtcatcatcaacaccaagcggggccgctccagcgagccgcagttcgaggtgacccagcgcctgggcatgtacacgctggccaacaagcttggcacccgccgcttcaacagcgtggaggaggtgcgcgacaccttcggagaggccgcggtccagtactacgagcaggggcgaaggttcgaccacgaggccaccctggccggccgccgcgacctgtcctcggagacgctggccagcgtcagcggcgtgacgggcaacacgaagtacttcgcctcggcgatgatcaagaacgacgaaggcatcatcgccaacaccggctacgagaagcagtcgttccggctgaacctgggccagaagctgggtgacgccgtggaggtcaacgtcgccaccaacctggttcactccctgggtcagcgcggtctgacgaacaacgacaacgcgagcatcagcaactacatggtgctgccgcgcgcgccggagttcctcccactggaggccaactcggacggcgtgtacccgcaaaaccccttcctctccaaccgcgccaacccattgcagacggccgcgctggtgaagaacgacgaaaacgtgtggcgcttcatcgggtccggagacctgacgtggcacctgtggaagacggaggcccaccacctgcgcgtgctggccaacgcgggcgtggaccggttccagcaggagaactcgctcttcttcccgcccgagctcaacttcgagcccatcgatgacggcctgccaggctcgtcgctcttcggcaccagccaggtgcgcaacctgaactccggcctgaacctggtgcacacctacaagcccacgtcgggcggcatcgtggcgaccacgtccggcggtctccagttcgaagagcgcaacatcgattccatctacatcgtcagcaagaacctgaacgccggccagcagaacgtggacagcggcacggtggtcaacctgcggcagaaccgctcgctggtgagagaccggggctactacgtccaggaggaggtcctcctgctggacgagcgcctgacgctggtgggcgcgctgcgcggcgagcagagcagcgccaacggcaaccccaacgcgctgttcctgtacccgaagctggcctccgcctaccggattccctcgttccacccgaaggtgaacgagttcaaggtccgcgcggcctacggagagacgggcaaccttccgctgtacggcatgaagttcaacggcctgcgcgccaccggcaacatcgccggcagccccggcctggtgggcacgggcatcgcgggtgaccggaacatcaagccggagcggcagcgcgaggtcgaagccggcgtggacgccctcctgttcggcggcgacgtggtcgcggaagtgtccatctaccagcgaaacatcagcgacctgctactgcagcgcgccctggccccgtccggtggcttcgccacgcagatcttcaatggcggctcgctgcgcaaccgtggcgtcgaggccatggtccaggtaacgcccgtgcgcggcggcttcgagtggaccagcggcgcgacgttcgccctcaaccgcagccgggtgacggacctgcctgttcccgcgttcctcgccggtgggttcggcactgccctgggcgccttccgcatccaggaaggcgcgacggcgacgcagattgtgggcaacgacggcgtcgacgagaacggccgcccgattgtgcggaagcttggcgacaccgagcccaccttccgcatgtccttcaccaacagcctcaagtaccgggacttcagcctgtccttcctgttcgactggcagcagggcagcgacatcatcaacctgacgcggtacatctacgacgacgccgggacgtcaccggacttcacgacggggggccgcgagcggctcgtacggcaacgtacgcacgcgagcacgtacatcgaggacgccagcttcctcaagctgcgtgaggtgaccttcatgtaccagctgcccaaggactgggtgtccatggttccagcggtgaagtccgcccggctcagcctgagcgggcgcaacctcatcaccttgactggctactccgggttggatccggaggtgagcaacttcggcaaccaggccatctcccgcaacgtggacgtggcccccttccctcccagccgcagcttctggacctccctcgacgtcgggttctga

SEQ ID NO: 7750 - DNA, 1344 bp, Myxococcus xanthus
atgaccatccaactgaccaagaaggcattcgtggggctcttcaccgtcctgggcctgagcggctgcgggagcctggacgtcccggacctgaacaaccccagcctcgatgacttccgcgagcggcccacgcgccccgcggtgctcaccgccgccacgggattgctcctcggccaccgcgctggtgtcgccgctcccaacggctacgtggcccagctcggcatcatcgggcgcgaggcgtacgtcttcgaccccgcggacccgcgcgccgtcggcgaactgctgggccctaccctggaccctggcggcccggcgttcggcggcaatcactggaccaacccctacctgaacatccgcaacgccaacgcgctgctggactccctcgaccaggtccccaacacgcccgacgctgagaaggagggcctccgcggcttcgcgaagacgatgcaagccctggacttcctcgtggtcatcaacacgcgggacattgaaggggcccccatcgacgtcaacctgcccattggccaactggcccccatcgtcggcaaggaggcggtgttcgagcgcatcgccgccctgctcgacgagggccacgcccacctggggagcgcgggtgagtccttcccgttccagctcagcccaggcttcgccggcttcaacacgcccacgacgttccgacagttcaaccgcgcgctcgccgcgcgagtggctgtgtaccggggacgctaccccgaggcgctcaccgccctgagccagtccttcctcaatcagagcgcatcgttggacctgggcgtctatcactccttcgggacgaactccggcgacacggacaacggcctcatcagcgtcaacgtctacgcgcacccgtcgatcgtcactgacgcggagttccaggagaatgacaccgtggatgaccgcgtcgtccggaagctcacgcgcctgcccgagcccaggaccgcggcggacgggaagctgtcgacggagtggcgcttccgcatctaccccacgaacaactcgcccgtgcccatcatccgcaacgaggagctcatcctcctgcgcgccgaagccaacattggagatcggaacctcggaccggcggtggacgacctcaacttcatccgcaccacctccggccggctgcccccgcgcctggacatcgatgagaacaatgccctggatgagttgctgaagcagaagcggtactcgctcctgttcgagggtggccaccggtggattgaccttcggcgctacgggcggctcgacacgcttccccgtgagctggacccggacatcgagccccacgagcgcttccccatccccgcagcggagatgaacgcgcggcagtaa

SEQ ID NO: 7751 - DNA, 1557 bp, Myxococcus xanthus
atgaacgagcgttacgagccgcaggcgattgaaggtaagtggcagacccgttgggacgacgcgggcatcttccgggcaggcagccgccccggtgcacccaagaagtacgtgctcgagatgctgccgtaccccagcgggaagatgcacatggggcatgtccgcaactacctgctcggggacgtgtacgcgcgttacttccggatgaagggcttcgacgtgctgcatcccatgggctgggatgcgctcggcctgccggccgagaacgcggccatcaaggacggcgtgcacccggcggtgcgcacggccgagaacatcgcgtccttcaagaaggaaatcaaaagcctgggctactgctacgactgggatcgcgaggtcaacaccagcgatcccgagtactaccgctggaatcagtggttcttcatccagatgctggagcgtgggctcgtctatcgccgcttcagcaaggtgaactggtgtacgggctgccacaccgtcatcgccaacgagcaggtgaaggacggcgtctgcgagcgctgcgactcccccgtggtggacaaggagatgcccgagtgggcgttccgcatcacccggttctcgcaggagttgctggacgcgctggacacgctcaaggagtggccccaccgcatcaccgccgcgcagcggaactggattggccgttcggacggtgccgaggccgacttccgcgtgcaggggcacgacaccgcgctgcgcgtgttcaccacccgcatcgacaccatcttcggctgcacctacgtggtgctggcgccggaccacgagttggtggcccaggtgacgacgccggagcgccgcgcggaggtggaagccttcgccaagcgcatggccgcgcagtccaagacggagcgcctgggcgagggcacggagaaggagggcgtctttactggcgcctacgcggagaatcccttcaccggccaggcggtccccatctggatcgccaacttcgtgctgagcgactacggcaccggcgcggtgatgagcgtgcccgcgcatgacgagcgcgacttcgccttcgcgcgcaagtacagcctgcctgtgaaggtcgtcatccagcccgcgtccggtgacaagctcccgccgggtgacaagctggaggcggcctatacggagtacggcgtgctggaggactcgggcgcctacacgggccagacatccgagcaggcgcgtcaggccatggccgcgttgctggagaaggacggcaagggcaaggcgacggtgacgtaccgccagaaggactggggcttcagccgccagcgctactggggcacgcccatccccatcgtctactgcgagaagtgcgacccggaccgcaatggcatcccggtgccggtggcgcagctgcccgtgcgcctgccggagatcgacacccaggcggtgctcaccggcaagggtgagccgccgctggcgaaggtggcctcgtgggtgaacacctcgtgtccgaagtgcggcgggcctgcccggcgcgaggcggaaaccatggacaccttcgttgactcctgctggtacttcgcgcgctacctg

SEQ ID NO: 7752 - DNA, 201 bp, Myxococcus xanthus
aagtacagcccggcgggcttcaagatgcggctgggcctcaaggacgtggagctcgtcctgggcgccgcgcgcaccgccgaggtgcccatgcccctggccagcctcgtgaaggaccagttcctgggaggcgtcgcgcagggccacggcgatttggactggtccgcgctgggggcgctcgtcgcccgaacgggccggggctga

SEQ ID NO: 7753 - DNA, 851 bp, Myxococcus xanthus
tctctaagacgcgggctcgccgtcaatctggcggcgtcggtggccctgctggtggccgcgctgcgtgcccgggacgccttgaaggtgacgtcgttccccacgctgttgctgttcaccacgctgttccggttggcgctcaacgtatcctccacgcggctcgcgctcgcggaggggcacgcgggagacgtcatccaggccttcggtgagttcgtcgtccggggcgactacgttgtgggtgcggtggtgttcgccatcctcacgctggtgcagttgctggtcgtcaccaagggcgcggagcgggtggcggaggtgtccgcgaggttcacgctggacgcgatgcccggcaagcagatgtccatcgacgcggatctgcgcgcgggcgccatcgaccaggcgcaagcccggcgccggcggcgtgacctggagcgcgagtcacagatgttcggcgccatggacggcgcgatgaagttcgtgaagggggacgtgattgcgggcctggtcatcgtcgccgtgaacctgctcggaggaaccgtcattggcgtgctgcagggtggcatgcccctggccgaggcggcgtcgacattcgcgctcattgccattggtgacgggcttgtgtcccaggttccctcgctgtgcatcgccgtggccgcgggcctcgtcgtcacgcgcgtcgcctcggagaaggaagaggacacgctgggtgcggagattggggcccagttcttcggagaggcgcggacgctctgggtggtggcgggcctgtgcgtcgcgttggccctcatgccgggaatgccgcatgtgacgttccttctgctggcgggaggcctgggggggcttggccatgtgctgag

SEQ ID NO: 7754 - DNA, 2082 bp, Myxococcus xanthus
atgcccgaggtgagcagcggtggtgggtgtggggcgtgtggccggcggcatggggcggatgcctcgtgtccgacgctggtgcgcgcggacgtgcgggccgggggaacggcgcatcccaggtgtgcccccgtggtcgaggcgcaggaccctctggtgggcgtccggtgcggcagcttccggctggtgcggcgcctgggccggggcggcatgggggccgtctacctgggagagcacgtctccattggcagccgggtcgcggtgaaggtgctgcacgcgcacctgacgatgtacccggagctggtccagcgcttccatgcggaggcgcgggcggtgaacctcatcggccacgagaacatcgtcagcatcttcgacatggatgccacgccgccgcgcccctacctcatcatggagttcctggatggggctccgttgtccgcgtgggtggggacgcccctggccgcgggcgcggtcgtctcggtgctgtcgcaggtgtgcgacgcgctccaggccgcgcatgcgcgaggcatcgtccaccgcgacctgaagccggacaacatcttcctggtccggcgcaagcgcaacgcgcccttcgtcaaggtgctggacttcggcatcgccaagctggcggacgcgcacatgccccagacgcacgcgggcatcatcgtggggacgcccgagtacatggcccccgagcagtccctggggcgcggcgtggatggccgcgcggacctgtatgcgctgggcgtcatcgcctaccagctcctcactggccggcttcccttcaacgatgagggactggccgcgcaactggtggcccatcagctgaggccaccgccgccccccagttcggtgtacccggccgtgtccgccgcgttggagcacgtcatcctgcgcgccctggccaagaagcccgaggaccgatacgcctccatcgcggcgttccggaacgcgttgcaggtggcgctcgccgagcacgtgcgcgtgtcggcgcggaagacgcgtcccggaggactcgcggtgctcgagcgggcgcccgtcgcgccagacatgcccaccgaaggccagtcgcgggggcggcttggcgtggacgcgcgggcggggcatgtgccttcatcgctcgcgagcacgtcccagcggcgtcttgcccccgccgctccggcggtgccccgggcctccctcgtggaagtgccggtgcaggtcgtgctgcggccaggggaaagccctgtgcggctcaggggcagtggcctctcccggggcggcttgttccttcacggtgggcgcgtactgccgccgttgtgttcgcggctgcccgtggtgctggagctggcgtccgggcccctgtcggtcatgtgtgaagtggtgcgggtcgttccgcccgcgcaagcgcgcgtctgggggatgcccaccggcttcggcgtccagttcgtcgaggccaccgccgtgctcaaggccgccgtggatgcgctcctccagggcgagccggtacgtgccgtcccgcaagtgccgctcacggaagacccggccgtggcgcgcttgctggaggcctggcgtcagcgctcggcgggggacgcgtatgcggtgctggcgctggagcctgactcggacatgggcacggtgcgcctgcggacccgcgaggcctggcgctcgctggagtccctggagcagcactcgctgacgcctccccaacgcgcgcaggtggatgcgttgcgcgtccgcgtccgcgaggcggccgaggccttgggcgccacggtgcagcgggccctctacgatgcctggcgcggcaatcatcgcggggtggcgaagtgcctggaggcagggctcacggccgagcagttggagtccctgcggcgcgagttcctggcgcgcaggccccaggccatgggcacggcgcggagccacttccagtctggtggcgcgctggagcgcgacggccagctctcccaggcgctggatcagtacgaacgagggctgaagctcgcgccgctggaggtggacatgctccagcgctaccgcaggctccgccgggtgctgggcgggcgggcgacggcgccgaccggacatgacagggcccggtcaccttga

SEQ ID NO: 7755 - DNA, 309 bp, Myxococcus xanthus
atgtacgcagtgattcgcacgggcgggaagcagtaccgcgtcgccgagggcgatgtggtccggatcgagaagatcgcgggcgacgtcggggccgaagtgaccttcacggagattctgctggtcggtggttcggagagcccgaaggtgggccagccgaccgtcgctggcgcgaaggtcgtgggcaaggtcctggcgcaggacaagcaccgccgcgtcctccacttccggaaggagaaggagggctggacccgccgccgcggtcaccgtcagccgtacaccgaggtgaaggtcacctccatcgccggctag

SEQ ID NO: 7756 - DNA, 2967 bp, Myxococcus xanthus
atgggcggcgcggcggagctcttcacccggcatgtgttcctcgacctcgaaaccacggggttggatccgcgcgtggacgaggtcatcgagctgggctgcatcttcttcgagaacgggcgcgaggtggaacgcttcgcgcgcctgtactcggcgtcgcggcccctccccctcaccatccggcgactgacgggcctgacggacgcggacctcgaagggcatccgcgcttcggcaccgacatcgcagagcttcgcgagaagctctccggctggacggtagtggcgcacaacgcgccctttgaaaaaggcttcctgccggacctgctggggcccatccacgccccggtgctcgactcgtgcgagttgatgcactacctgcacccggagctgcccagccactcgctggagtcgctgctgcgctggggcgggctcgcgttgagacagccgcaccgcgcggtgtcggactgcgaggcggtgtactcggtgctggtgcacgccatggagcgctgcgtccgcgagggccgtggcgatgacgtggtggacctgctcgccgcgttggacccgcgcaagggcgcggagctgcgcctggcgatggagggcgtgggcctgaaagacggcgcgagcggcgcgttcgactatgaggaatggccgctggtggacctgctgtcgcgtctggccgccgcgtgccgtgaggaggctgcgccgctgtcgctggaggcccagggcttccttcgtgggaagccggagcggcggcgcgcggggggcgccacggcgctgcccgagccagaggcggatgcccccgtgctccccgtgcgtccggacgaggtctcagcgctgctgggcgttggcggcgcgctggagcaggccggtgaaggattcatgagccgggccgcgcagctcgacgtggcgcaggcggtagcgagggcgctgtcggacggcgggcaactcgcgatggaagccggcacgggcacgggcaagtcgctggcgtacctggctcccgccgccctcttcgcggcgcgaaatggacgcaaggtcggcgtggcgccgcacaccaagacactccaggaccaactcctggagaaggacctgcctcggcttcaccgcgccacgaagggcgccttcggctacgccctgctgaagggccagacgaactacctgtgccgccgccgcgcgctggaagccactcgagtggagcccggcatggggcactccgcgcgcgcgccccgggcgtatctgcgtgcgtacctgcgtcgcagtggcgaaggagacctggaccgactgagccactggttccgcgagcgcttcccggtgctgatggcgctggtgcccgccgtgcgctccgaggcgtcgacgacgctgggcgagaagtgcccgcacttccaccgctgcttctatcactcggccgtggcgcaggcccgtgaggcggacgtgctgatcatcaaccagtcgctcgccttcgcgtggcccgcgcgctacccgaagctggaccacctggtcctcgacgaggcgcacgaggtggaggatgtcgccaccaccgcgctgacgctggagctgtcagacttggccttcctccgcctcatcgaacggctgcatggcagggacggaaggcgcggcctgttcgccgagctgcgcaaggcgctgagcgcttcgcgccggacggagacacggtcactgatgggcgaggtggaggatggccttcgccggttgcttgacgacgcgcgtgacctcggtgcgcgcgtgacggagctgtgcgagcccaccgccacagccgtgggcgaggacccggatgaaggtgcgtactctccggagctgcgcatcaccgcgaccgtgcgcaccctgcccgcctgggagccggtacgcgaaggactggaaggcgtgcgcggcgcgctccaggcgctgcatgtcctgctgtccgtgcgcgtgctggccgcccttcctgagctggccgctcgacaacccgcgctggagcgggagctgtcgggtgccaccaccgagcttggcgaactggcggtgctcgcgggcgagctgtccggagaagccgcgccaggacggtgctacgcggccaccgcggaaccgaagcggcagcggtggagcttgagcgcccagccagtggatgtctctgcctacgtgtcgaaggacttcgcggagagcaagcgcacgctggtgctcgcatccgccacgctgggcactggcgacggcttccccttcgtcctccggcgcttgggtctcgatgggcgtggaggcagacctgcgccccgactggtacgcgcggccacgcccttcaagctgcatgagcaggcgctggtcgtgctcgtcaccgatgcgcctcgtgcgcacgaagaagccttcgtggagtgggcctcgctccggatttcgggcctggcacagacgatgggaggccgggtgctggggctgttcgcatcgacacgccgcatggagcgcgtgggcacgagcgtccgcggacggctggacccactgggcatcgaggtgctgcggcagtcacgggggcacagccgctcgctggcggcacggcaggagaaggacacgggcaccgtgctgctggggaccaagagcttctggcagggcgtggacatccccggtcgcggcgtcggctgcgtgttcatcgacaagctgcccctggagcccgccatgcgtccgctggtggccgcgcgcgaggagcccctctctcgcagcggcggcgaatacatgggcttcctccactaccggcttccccgcgccctgctgcaactgcgccagggcgtgggccggctcatccgggcgacgacggaccggggcgtggtcatcatctcggacccgggacaccccagctaccgtggccacctgatgaacgcactggagggctatcgcgtcgaggcgcttccgtgggcccaggcgcgcctgcgcatccacgcgatgctgaaggagacggggctcaccgtggagtcaggacccgcgcggtcctgggggtga

SEQ ID NO: 7757 - DNA, 276 bp, Myxococcus xanthus
atggctcataaaaaaggacagggttcttcgcgcaacggtcgcgattccaacccgcagtatcgtggcgtgaaggtgtacggcggtgagacggtgtcggcgggcagcatcctcgttcgccaggtgggcacggtcatccacgccggcgccaacgtgaagctcggccgcgacttcaccctctactcggtggtggacggcgtggtgaagtacgagcgcctgggccgcgaccggaagaaggtttcggtctacccggccgccgctgagcaggcgagcgcctga

SEQ ID NO: 7758 - DNA, 664 bp, Myxococcus xanthus
atgaagttcgtcgacgaggtccgcatcttcgtgaaggcgggggatggcggcaacggcgccgtctcgttccggcgggagaagtacatcgagcgcggtggccccaatggcggggacggcggtaacggcggctccgtcgtcttcgtggcggatccgcagctcaccacgctgctcgactaccgctaccagcagcaccaccgcgccaggaatggcgagcacggcatgggcagcgactgtaacggtcgcgccgccgaggacatggtgctcaaggtgcccgtgggcacgctggtgaaggatgccaacaccggagagctgctggtggacctcagcgaggccggccagcgctgggtggcggcgaagggcggacggggcggcctgggcaacatgaacttcgccacttccacccggcagacgccgcgcttcgcccaggatgggacgaagggcgaggagttgacgctccggctggagctgaagctgctggcggacgtgggcctgctgggcttccccaacgcgggcaagagcacgttcatctcccgcgtgagccgggcgcggccgaaggtcgccgactatcccttcaccacgctggtccccaacctgggcatggtccagtacaaggacggcctgtccttcgtgatggcggacatccccggcatctttagagcacaca

SEQ ID NO: 7759 - DNA, 915 bp, Myxococcus xanthus
atgtcgccaacccagcgccgcatccccgtcgtcaacctgtcccattaccgcacgggcacaccccaggagcgcgcccgcttcgtgcaggtgttcggcgacggcatcaaggagttcggcttcgtcacggtggaaggccacggcatcgacgacggcctcatccggcgcacgtacacggacgtggagcgcttcttcgccctgcccgaggccaccaaggcccagtacgcccaggcggggcacggcggccagcgcggctacatcggctacggtcaggagcacgcgaagaaccgccaggtgggagacctgaaggagttctggcacgtgggccgcgagctcccacctgaccacaagtaccacgcgctctatggccccaacgtgtggcccaccgaggtgtccaccttccgcgagcacacgctgtcgctcttcaacgcgctggatggcgcggcgggcgtcatgctccaggcgctggccgagtacttcggcgtggcgcgcgacaccttcagcggcatggccacggacggcaactccgtgctgcggctcatccactacccgccgctgaaggagcgcttcatccccgggggcgtgcgcgccgccgagcatgaggacatcaacctcatcaccctcctctgcgagggcacggcgtccggcctggagctgctcacccgcgacggggagtggctgccggtggacacactgcgcggacagattgtcgtcgactcgggcgacatgctcagccgcgtgacgaacgaaatcatccccgccactacgcaccgggtggtgaacccgcgcagcaaggaagaggacacggtgcgctactcgatgcccttcttcgtccatccctacgcggactgcgtgctccaggcgctgccctgcacccagacggcggacaccccggcgcgccacgcgcccagcaccgta

SEQ ID NO: 7760 - DNA, 204 bp, Myxococcus xanthus
gcgctgtcgttcttctgccgggagtcctccgcctggttccgcgaggccccgcccgagcaccgccgccgtcaggtggcccggatgctcgcgcggctgcggcccgaacatctgcgctggttgggacacatgcgcttggcgccggccgtgcgcggacagctcgaggtcctggtggccgcccacttcccggtggacggcacggcctga

SEQ ID NO: 7761 - DNA, 177 bp, Myxococcus xanthus
atggagtccatggagacggccctgaccatggcgctgctcggcgtgtccgtcctgccactggtgggtgacgacaatccaccggaggagtggaccgcccggcccgacgcggtgcgcgacatccgggacgacgctccggacgacgacctcgatttcgagtctgccttcgcgtcctactaa

SEQ ID NO: 7762 - DNA, 1809 bp, Myxococcus xanthus
atgacgaccgcgccccgccccaatccgctgctgtcggaccgcgacgtggacttccagctctacgaggtgctggatgccacgtcgctgtgtgccctgcccgcgttcgcggagcactcccgcgacaccttcaccctgctgctggacagcacgcgtcgcttcgcgcgcgaggtgctctaccccacctaccgcgacatggacgcccagcccccgtccttccgcgacgggcgcgtccacgtccacccgctgatgcgcgagctgtacccgcgtctggtggagctgggcctgctcaccgccacgcgcccgcccgacgtcggcggacagcaactgccgctcaccgtgcacgcggtatccaccgcctacctcatggcggccaacctgagcgtctacgcctggctgggcctgacgctgggcgcggcgcacctgctggaggtgttcggcacgccggaggtgaaggcgaccttcatggaaccgatgtaccggggcgaatggacgggcaccatggccctcaccgagccgcaggcgggcagcagcctcgcggacgtgcggacccgggcgacgcccgcgccggacggcacctggcgcatccagggttcgaaaatcttcatcagcggcgcggaccaggacttcaacgagaacgtggtgcacctgacgctggcgcgcatcgaaggcgcggagggcggcacgcggggcatctccctcttcgcggtgccctctcggcggccggagggcggcacgctggtggacaacgacgttcgcgtggcgggcgtcatccacaagattggctggaagggcatccccagcctggctctcaactatggcgagtcgggtgactgccacggttggctggtggggccccccggacggggcctggcgtgcatgttccagatgatgaacgaggcgcgcatcatggtgggcatgaacggggtggccaccgcgacggtggcgtaccacgaggccgtggcctacgcgcgtgagcgcccccagggccggcccactggcgtgcgcgacgccacgcggccgcagacgcccatcatcgaacacgcggatgtgcggcggatgttgctgcggcaaaaggccatcgtcgaagggggcctgtcgttgctgctcgccgcgtcgtaccaggcggacctcgcgggccatggccaggacgaagccacgcgccagcgcgcgggcctgctggtggacctgctgacgcccgtggcgaagtcgttccccgccgagcgcggcttcgaggccaatgcgctcgcggtgcaggtgcatgggggctacggctactccagcgagtacctgcccgaggcctggttgagagaccagaagctcaacagcatccacgagggaaccaccggcatccagggcctggatttactggggcgcaaggtggtggctggaggcggcgcggcgctccagtccttcgcggaggaagtgggcaccacggtggcgcgagcacgcgcggcgggcgtgacgccagagtggggcgaagcgctcgaacaggcccttgcggagaccaccaccgtggtgacggagctgggcgcgcgtggcatgtccggcgaggtcgagttgatgctgcggcacagcgcggacttcctggagctgttcagcgtgctcgcggtggcctggcgctggctggcccaggccgcggcggcgaaggaggcgctggagcgcggcgacccggacgccgacttctacgagggcaagctggccgcggcgcagtactggttcgcggtggagctgccccgagtgccactgctcgcccggctgtgccggacaggagaggattcctacgcgcgcatgcgcccggaatggttctga

SEQ ID NO: 7763 - DNA, 603 bp, Myxococcus xanthus
atgttctccgccgtgcgggtgtgtccgctgctgggcttcgtggacaacgagcgcaagcaggtaggctgcctggcccacccactggtgacgggcggcacggacctgcgggactgcggcgtgtaccgctcgtccgtctgtgagacgttcacctgcccctcgttcggttggctgacggacgcccaggcgaagctggtgcaggtcgcctgcgcggactggtacctgtacgggctggtcatcaccgacgtggagttcgtccgcggctgcctgcgcctgttggagtgggagctggccgggcccgcgcgtccggaagtgctgatggagcagccggaggcgctcgccgcgatacggcggatgttcgccctgaaggagacggcgccgcgacggggaacgaatgccacggtgttcggccgcttcaaccgggacgccgatggcgagcccgtgccgcgcaccgtggactacgtgaagctgggcgtgcgcgcgtcgccggaagacgacgtggtgctgtgcctgggctatgcgccgaaggacgccacggagttgatgggcgcacgcgaactggtgcgctcgcacgtgaaggccgtggcccgcgcgctggcggcgtga

SEQ ID NO: 7764 - DNA, 351 bp, Myxococcus xanthus
atgattggctccgaggcggtccaggcccgggaggatgaggactggtacctgggcgcggcgcgcgcggcgcaggacgcgacggtggagacgggccagggcggctcgggcaatacgcccctggaggacgtcatcatcgcctccagctccgtgaacgggcgcgtcacgaaggtgaagcagaacaccctcatcgtgaaggaccgggagggcagcgtctacgagttggagctggacccacgcagccgtggcctgcggcaggggcggaaggtgccgctgcgtcagctaaaggaaggcacgccggtgcgtgcgcaattcgtcctcatgggtggccgcaccgtcgcgcgcgacgtgcag

SEQ ID NO: 7765 - DNA, 207 bp, Myxococcus xanthus
atggaaatccttggcgccaccatcctgggagtcgtcatcttctccgtcctcatcatgggcgtgattctgggcggagccatggggcacaagcaggagcgcaacctgcgcgagattaccgagcgacagcaggccgctggcatcacgggcgacgtcacgatgaacgacaacgcctttgcttgcccaccggaccagaccgctcatgcgtag

SEQ ID NO: 7766 - DNA, 120 bp, Myxococcus xanthus
atgagcaatgacttgttggacttcacgtgcacccggctgggcggcggctacccggaagagggcacgcgcttccggctgtgtctgcctcgcttcgagaaaccagacatgctctcgcgttag

SEQ ID NO: 7767 - DNA, 927 bp, Myxococcus xanthus
atgaaggtctaccctgcggtggcggacgcgggccgggcgctggccggacaggcactcgcgctgggcaacttcgacggtgtgcacgtgggccatcaggccctcttcgcggaggcgcgccgccacgggcgggccgccgccttcaccttcaatccccatccaggcaaggtgctccagccggagctggcgccgaagctcatcaccctgctgccgcgcaagctggagctgttcgaggagctcgggttggacgccgcggtggtgcaacccttctcgcgcgaatacgcgcgcacgccgcccgcggacttcgaggcagcgctcttcgacgcgctcggcgtcgcgcacgtcgtggtgggcagcgacttcacctacggctcggcccggcgcggcaccgcggagacgctgcgcgaggccgcggcacggcgtggcgccacggtgcacgtggttcctcccgtcacggtggatggcgtggtggcgtcgtcatcgcgcgttcgcgagtacatcctggaggggcgcgtgtccgcggcgcggcggctgctgggccgtcccttcgacctggatggcacggtggtgacgggcgcggggcgggggcggggcatcggctttcccaccgcgaacgtggacacgcagaacgagctgcgccccgcaccgggtgtctatgccatccgcgtccaactgccgggcgagtcaaagggcacctggcatggcggtgcggcgaacatcggtgtgaagcctacctttggcggcacggaggtgacgatcgaagcgcacctgctcgacttcaccggcgacctgtacggcaaggagctgcgcgtgcagttcctcgaccgcctgcgccccgagcagcgtttcggttcggtggtggagctgacggggcagatcaagcgtgacgtggaggccgcgcgcgcagtgattgcgcgcgaggagagctga

SEQ ID NO: 7768 - DNA, 1296 bp, Myxococcus xanthus
atggggcacgcgacgtacgagcagcacttcaagcaccccatcgccgtgcgcatggacacgctgcgccgcgagcgcgagcggggcctcacgttggcggaggacgagcagctgcgcacgctggtggagcgcaacgtcgcggaggtgccggacctggtggctcgcctggacatcgagcgcgccacggcgctccaggccggactggcccgcgtgctgggcgagccgggcgaactggaggccctgctggcgcgcttcctctcggtggacgacgccaacttcgacacccgcttcggacagttctacggggagctggcgccctcgctgccgctgtaccggctcaagcccggggacgtgctgtcactgaagacgccgctggagagtggcaccgccgtgccagtgcgagtcttcggcatcttccgcttccggggcctgggcggcgacgacggccgggtcaacaccatgagcgtggtggacctcgtcacggcgcggcacctgtctggccgcttcacccaggcacagcaggacgaggcgcgggcgctgttcgagacctttggcatggaaggggaggccatggcgccccccgagtccctggacgccttccatccgcctgacatcgtggacgcggaggcgcagacggcgcacaccgaacaggccccggtcttcgagcgtgctcgggccctgccggagaccttctccgaggacgagctctcacgcggcacggtgttgcaggccgcggtggtgctggcgcccggcgcctccgccgaggacgtcgcggcccgcatgcgcgcgctgcccggtggtgaagcgctggccacggtgggttggcaggaggcgggtgggttgctgggcggtctggtggtgatgctccaggcggtgctgctgctcttcgcgctgttgatgtcctccttcgtcgcgctggtcgccgctggaacgctgctgctgctggcgcgggaacgcgtggcggaggtcggcacgctgcgcgcggtgggaatgcaacgtcgcgaggtcttcacctcgctgctgctggaagggtcgctgctgggcggtatcggcagcgtcctgggcgcggtgctgggcgcggcgttgttgtggcttgcgaccggagacggcgtggcggtggaggatggctccctgcagttcttcctgggcggccccgtgctgcgtccagcgctggcgctgggcggaaccgtggccgtggtggtggcggtgacggccgtggtgctgctggcgacactggtaccggcctggcgaggcagcgcggtggagcccatcgaagccatgcggaagggcgagggctga

SEQ ID NO: 7769 - DNA, 942 bp, Myxococcus xanthus
atgagcctggacgtcgcggccgagggcaacgcgggcttccgggtgcgcaccggttcgctggaagccctcgcgaagccacgcacggtggcgctgtccacgtcgctggcggagcggctccaggtggaggtgggcgagctggccacgctcttcgtgcagatgccgggcggcaagcgcaacgcggtggacgtggaggtggtggccctgctggagcgcgcgggtgtcctgggcgagtccgcggggttgctggtgtccaacgcgatgctgcgcgagctgtatggcttccgtccggactcggccagcgtgattcagctcctctgcggcgacggcacggagctggagccgctggcggggacgctgcgtggcgcgctccagaaggccggctacgaggtgctgccgcccgcgcacgaggcctacggcgacaagctggggcccctgctgcgcgagggctgggcgggccagaagctggacgtgagtacctgggaggacgaggcggccttcctcgacttcgtggggcagggcctggggctgctgctggtgctggtcggcgcggtggtgttcggcgtcgtggtggtggggctcttcgtctcgctcaacgtgtcggtccgcgagcgcacgcgggagattggaacgctgcgcgccatgggcatgcagcgccgctcgctggtggccgccttcatgctggaggggctgctggtggggtgggcggcctcgctcgtgggcgctggcatggcggcggggctgggggtgctcctgcgcgacgtgctgccagtgccggacgcgctctccaccctgttcttcagcggcacgttgccgctggcgcccaccttggggcacgtggtggccgcggtgctcctggtgacgctgggcgcgggcctggcttccatcgtcccggctttccgggccgcttcgcttcctcctcgttccgccatggagtccttgtga

SEQ ID NO: 7770 - DNA, 780 bp, Myxococcus xanthus
atgaacgcacgacgcccgctgtccgtcctgttgctcggctggaccctgctgcttccggcggtggcgctcgcggaggccgagcccaagctggcgcccgatgccctgctgcgccacatcgacgagaagatgtccttcaccagcgactacaagggcgtcatccgcctctatgagacgcgcaaggatggcgccaagcgggccatggaggtccacgtctaccggcgcgaggccgacaatgacttgctcttcctctccaccaagccgcggcacctcgcgggcatggggacgctgcgcatcggccgcaacctgtgggactacgaggcgacgacgggctcgtggcggcgcaacacccagcgcaccaacctgctcaacaccttcacctgcgaggcggacttcgaccgctcgcggctggccgaggactacgccggcaaggacgagggcgacgacaccgtcaacggcgtggcgtaccgcaagctgctgctgacggcgaagaacgaccaggtgacgttcccgctgatgcgcatctgggtggacccgcagaacaacatcgtcaagaaggtgggctacaccgcgtccggccgcacgctgcgcaccgacatcgtgcgcagctaccagcgcatcaaggacccgctctccggcaagcatgtcctccactacaaggaagtgctggagacggaggagcaggaaggcacgcagatggtggtccgctacgacgaggtggtgttggcgccgctggacgccaacatcttcaccaaggcgtggctggagagccgcctgcgctga

SEQ ID NO: 7771 - DNA, 462 bp, Myxococcus xanthus
gccctgccctcggtgcaagggcttcaggggtcggcggagaacccggtgcgctccatgccggaggagttcggcgtcctgcacaccgcgctggaggcggagctggccccgttgcattacgccgcgctctgggagcgggtgacggccctggccctcgagctgggcatgctggccccccactctagcgccgccaacgtgctcggcatctggcacgtgctgggcgaggtgctggtgccgcaggtggtgggctggaaggtgccgtccgtgcgcgcccgggtgcagctcttcacgagcgcgccgtcacgggccctgcacggggacacgctgggatgggagcggcacctgacgcgcgagcagctcgacgtggtgccgctgcccagttcccacttcggcacgctccagcagccctgcgtccaggagttggcgaaccacctcctggaggtgctgaagcggcagggaggctag

SEQ ID NO: 7772 - DNA, 468 bp, Myxococcus xanthus
agcaccaccgtcaccgtgaagcacggcccgccggtccgcgtggaggccgagggcgtcgcccagcccgtcgccaagggtgaatccatccgcgtggagaagggccatccgccccccgcgccccttcgaccgctggtggcccccagccccgggcagccggaggattccgcgcgcctgaagcgacgccccgaccgggacgggcacctgggcccggtgaagctgacctgggaggctgtacggggcgcggaacgttatgaagtggaagtgtcgcgcgcgcaggagcaacgcgccgtcttcacgcagacagtcaccagcctggaagcgaagctgccagtgctacccgcgggaagctaccggtggacggtgcgcgcggtgggccccgcgggtccgtccgagcccagcgcgcccaggcacttcgagctggtgtccgagcgcctcaaactcgaagtgaagaagggccagtggcagtaa

SEQ ID NO: 7773 - DNA, 1677 bp, Myxococcus xanthus
atgctggtggtgggcgtcgtccccacgctgatggtggggtggctctccgtctcccacacccgggagctcctggtgcgcgacgcccaggaactggcacaggagcgcgtgaagcagctgcgcctcaaggccgaaatcttcctcggcgagcccaccgacgcggtgctgggcctggcccgcgtgcccggcttcttcggcctgccattggaagcgcagcagacacacctggcctcggtgctcaaccagcggcgcgatgtgctggcgctcaccgtgttcgacgccaaccgccagcggctgccgggactccaggccttctccaagcacgacgtgccgcccaccgcgctggccgggcatgaggagcgcgcgcgggcgctgctcgagaacatcgagggcgtgcgctacgcggacgtggtgaaggacccgcagggtagcgagccggtgctgacgctggccttcccgctgggcgagcccgtccgggggtacatcgcggcggacctgtccctggccgacctgcggaagatgctggagcaggagcgcgtgggcagcaccggcttcgcgtatctggcggaccgtcacggtcacctcgtggcgggcggtggcggcgtcgccggcctgggcgaggacgtggcgcagcgcggcccggtggcgcacctgctgaagcagttggtgggcaagtcggacatggagctgttccacgtcggcaacttcggcgagggccgggacgcggtggtggccgcgtacacggtgctgcccgagacgggctgggccatcgtctccgagcaacccgtggagcacgcctaccgtcaggtggacaccatggaacagcgcatcctcctgggtttgggggcggccatcctggtggcggtggtgctggcggcgctcttctcgcggaacctcacccggccgctcaagggattcatcagcggcgcgctggagctggcacacggcaagttcggcgtcgaggtggacatcaagcagaagaacgagctgggcgagctggcgcagacgttcaactacatgagcaagcagctgctcgcgtacgacatggagaaccgcggcctctacgagagcctggagaagggctacctggagaccatcgtcgcgctggcgaactccatcgattcgaaggacgcgtacacccgtggccacagccagcgcgtgggcgacgtctcggtgcagattggccgggagatgaagctcaccgagcgcgagctgcggcagttgcagtacggcggcatcctccacgacatcgggaagattggcatcgtggagtccatcctctgcaagcagacgcggctgacggaccaggagatggacatcatgcgcgagcaccccgccatcggtgacgccatcatcggtccggtgagcttcctgggcgcggtgcgcgcgtgcgtccgccaccaccatgagcgctgggacggcaccggctacccggacaagctcaagggcgaggacattcccctgctggcccgcatcgtcgcgtgtgcggataccttcgacgcctgcacctccacccgcccgtaccagaaggccatgccgctggagaaggcgatggaaatcctcgacaacctcagcggcgcccagttggacccgaaggtcgtccaggccctgaagcaggtgctggcgaagcagggcgtgcggctggagggccaccggctgcccgtgaagctcgcctcctga

SEQ ID NO: 7774 - DNA, 1701 bp, Myxococcus xanthus
cgctaccggctcgttcgtccgctggcctctggaggcatggcggagctcttcctcggcgtcgcgcgcggcgcggagggattcgagcggccggtggccatcaagcgggtgctcccccacctggctcgcgagccggacatcgcgcgcatgttcctggccgaggcccggctggccacgctgctgcaacaccagaacatcgccaccgtccatgacgtgggccagggccccgaagggctcttcctggtgatggagctggtggacgggtgggatttgggcgtgctgctacgctcggccgcgcgcctgggcgtgcgcttccctccgcacctggccgccttcatcgtccatcaggccctggcggggctcggtcatgcataccggaaggtgcatgacgggcggccagtgatggtggcccaccgcgacgtgtcgccctccaacgtactggtgtctcgcgagggcgaggtgaagctgacggacttcggcatcgcgcggatggccggcccggcccacaccgcgcccggcgtcttccgagggaaggaggcgtacaccgcgcccgaggtgctgcaaggcgctcccgccaccgccgcgagcgaccagttctccctgggcatcgtgttctacgagctgctcacggggcagcatccgttccacaccgagaaggacgcgagcgcggtgacctacgccatcctgacgcggccggtggagccaccacagggcgtgcccacacccctggcgggcgccgtcatgcgcatgctggcgagggcgccccaggagcgcttccactcgccggagtcactggccgaaggctttgcccggtggttggcccaagtcggcgagcccgcgacgtctcagacgctggccgcgttccttcgcgggctgggattgccgccgcccctgagtgaacaggcagcggcttccaggcgccccgtgacgcaggcacaggctgacgcgggttcgctggcgatggccgtgcatgcgccgtcgcccgccgaggccgctgcgtcggaagaagagcctctctccatgccgggcggcgcggcgctcagcgtcagtgggcggatggtgcatcactgccctcgatgcaaccacgtgctctcctcgccccaagcccggtgctcacactgcgcgatgtggccggatgcctcgaccggcgcggcggcaacgcctcgcacgcccaccgctccgggcgccttcgctccatccgagggcgtcgagctcaccgcgcatcagacgctcgcggagagtgtcccccagacgcacgtcacgccgggcgcgaagagcgtgctccagaccgacgcagatgcactggagctggcggagcgcccgccctcgccagcgagcgactggcccgatgaggcggccctcctccggcgctcgcgcctgaaacgggcactggggctgctgctcgtggcgctgctggtgggcaccggcatctggctgtggcctcagcgctccaccctgctcattcgggtgatgtcggcgacggggctccgcctgtcggccccgatgctgcgcatcgacagcgacccgcctggagccaccgtctgggtccgagacgcggagctggggacgacgcccctgctgctcgagaaccgctatccagcggggcgcgtccccatccaggtccggctcaaaggccaccgcacatggaaggggacgttctccggcggcgaggccgctcacatcgaggcgaagctgaagcgctga

SEQ ID NO: 7775 - DNA, 519 bp, Myxococcus xanthus
atggacgacaagaaggttctcgacaagaaggagcggctgctggccgcgctcgaccagggcatggtgatgattcacctggacgcgcgtcgtccgggcgtgctcgtcccagcctccgtcaagacggaggcgcacctgcgcctcaatctctcgtaccggttcgacccaccggacctcacggtgggcgagtggggcgtgcgctccacgctgagcttctccggctcgcgcttcaccatcgcggtgccgtggtcggcgttgttcgccatcgccagccacgtgacgaaggagttctggatgtacccggaggacatgccgccggagttgctccagcagacggccgcgtcacgtccggcgcagcccttgcccgtcgctcccgtgccggtggccgcggagcgcccgcgcaccttcctccgggaagtgcagggcgaacggcgcgatgagccgcccgccgatgttccgcccgcggacggaccgccggacgagccgccgccgcgtcgtggtcatctgcgcctggtgaagtga

SEQ ID NO: 7776 - DNA, 456 bp, Myxococcus xanthus
agtgagcccggcgtgagagtcatcgcggaaaaccgtcgtgcgcgtttcgactacacggtcgacgaaaaggtggaggccgggctggcgctcacgggaagcgaggtgaagtctctgcgagacggaatcgccaatctgtcggacgcctacgcgctccccaagggggacgagctcttcctgctcaacgcgaacatcggctcctacaaggcggcgagcttcttcgaccaccttcccactcggggtcgcaagttgttgatgcaccgaggagaaatcgaccgttggacggcgaaggtgcgtgagcggggttattcgatcatcccgcttgtgctgtacttcaggaacggccgtgccaaggtggagctggggctctgccggggcaagacgcatgaggaccggcgccacgacatcaaggagcgggagacgaagcgggagatggaccgggcgatgcgccgacgttga

SEQ ID NO: 7777 - DNA, 897 bp, Myxococcus xanthus
cggaatacccgcctagtcatggctcccgccgtcctgaaaaccgttgcggacgtgaaggactggacggcggggctgctccgggaggggcaccggctcgcgctggtgcccaccatgggcttcctgcatgaaggtcacctctcgctcattcgcgaggggcggcgccgcgcggacgtggtggccgtgtccatcttcgtgaaccccacgcagttcgggccgaaggaggacttgtcccgctacccccgcgacttcgagggtgacgtcgccaagtgcatcagcgcgggcgcgcaggccatcttcgcgcccgcgggcccggaggtgatgtacccgcagggctaccagacgtacgtggaggtgacggacgtcagccagggcctgtgcggggcccggcgtccggggcacttccgcggggtggccaccgtcgtcacgaagctgctgacgctgttccgcccggaggtggcgctcttcggggagaaggactaccagcagctccaggtcatccgggcgctcaaccaggacctgcacctgggcgcggacatcgtcggcatgccgacggtgcgcgagccggacggcctggcgatgagcagccgcaatgcctacttgtcccccgaggagcggcagcgggcgctggccctgtcccgggggctcaaggccgcccaggcgctgctgcgcgagggcacgcgggagtcggagcccctggtggcggccgtccggcgcgaattggaggcggcggggcttcgggaagactacgtggaactggtggatgcggaacggctgacgcctctggcttcggtggcgcccgggcagcctgcccggttgctcgtcgcggccttcagtggcacgacgcgcctcatcgacaacatgcagttgggtggtgaggagaacgcgggacgcgtatga

SEQ ID NO: 7778 - DNA, 1251 bp, Myxococcus xanthus
atgcgcaacccaacccccctggccctggcggcgctgctcctgggcactccggtgtccgcgcaggtctccgtgtcgccgacggcgcagtccgagcccgccccgtccatcaccggcggggtgctccaggacgtggccctctgggtgagtcccggcgcccccagcagcagcctgttcctcaccgcctacaacagccccaacgcgggcctcgtcaccttcggcctggggggcgagcaactggatgcggagctcacggatggccccatgtcggccgtggccgtgcgggacggcttcccgctgtccggggtgcagcagaccctggtggtggcggccagcatcaacttcaacgggctggcggcctacacggcggaccccgaccgcgcggagcgggtggagcggattggcgccgcgggcttcctgacggggacgcagttctccgccgtggcgctctatcaaaacgaggactcgggccggttctatgtgttcgcgggcacgtccacgggcgtgctccggcagtacgaactggccggggacacggggagcgtgacggccaccctggttcgcacgctcgccacgacggggcccatcgcgggtctggccgtggacgaggcgtcggactccctgttcgtcacccagcaggggcagggcctgtggcgctatccggcggcagcggacgcgggcgccaccggacagcagctctccatccagggctcgggcgggctctccgccaatgtgggccgggtcgcgctgtaccgcgcgcgcaatggcgaagggtacatcctggtcgcggacacgggcgcggatgcgttcgccgtctatgagcggcgcgcgaggaccctcgtgggctcgttccggctggcggacgaggatgggggcgtcatccgggcgaatgacccagtggccctcgccgtcaccgcgtcgtcgctgggtacgacgtatcccgacgggctcttcgtgggcagtgacgcgttctcgaacccgcagcgcttcctgtacgcgcgctggccggcggtcgccgaggccttcgaccccgcgctgcgaatcgacacgcggttcgattcggacggggggacggacgggggcacggacggtggcccgggggacggaggtggctccggtggtccggggcccgcgccaggtccgggcaatcgtcccgacgagtcgggctgctcgtgtgcttcggcctccgtgccggccaccgctgcgttcgcgttgctcgctttggtgcgggtggggcgtcgccgtcgcgactga

SEQ ID NO: 7779 - DNA, 1032 bp, Myxococcus xanthus
atgcgagtcgttcattccccgcggcacgcccttcacgacggcggcatggagttgcaccgaggtgagctggtgccctgcttcgagatgcccgcgcgcgcggacttcatcctgcaggcggtgaggcaggccggcctggaggtgagcgagccgcaggccttcggactggagtcgctgtggggcgtgcacgacgccggcttcgtggagttcctgcgcaccgcgcacgcgcagtggagggccatcggcaagcagggcttcatgctgccgagcggctttccggcgcggggcatgcgccgcgaccacctgccctccggcatcaacggacagatgggctactacgccttcgacgccggaacgcccatcgtccagggcacctgggacgccgccttcgccgccgcgcagtgcgcgctgacggccgcggcctgggtggcggagggggagcgcagcgcctacgcgctgtgccgacctccggggcaccacgcgggtcactccacctacggcggctactgcttcctcaacaacgcggcgctggcggcgcagcacctgcgcgagcgcggctgcgcgcgcgtggcggtgctggacgtggactaccaccacggcaacggcacccaggacatcttctgggagcgcgccgacgtactcgtcgtctcgctgcacggcacgccggagacggagtacccctacttcctcggctacgccgacgaacgcggggccggcgccggcgagggcttcacccacaacttcccgctgccgcgcggcaccacctgggcgcagtacagcgccgcgctcgactccgcgctggacgccgtggcccgcttcggcccggatgcgctggtggtgtcgctgggcgtggacacctacgtgggagaccccatcagcgccttcgcgctcgagcgcgagcacttccctctcatgggccggcgcctcgcgcagttgaggctgcccacggtgttcgtgcaggagggcggctacgcggtggaggacctcggcctcaacgtggccggcgtgctcgagggcttcgacgccggacgctga

SEQ ID NO: 7780 - DNA, 738 bp, Myxococcus xanthus
atgacgacgaccacggcgcccctgacgccagccaagcggcgctggcgcaacttccttctcgaaacgggcttccagctcaagctgacggcgtacatcgtctcggtgacgctcgtgctgtcggcgctgctgggcgtgttcctcgtgagaggcgcgcaggcgctgatgcgcgagacagcgacggcggtggaggcccgctcccgcgcggcggaggtcagccgcgaattgtccggcgccacgctctccaacgagctgctgactcggatggacgaccccacgttcgaggcgagcttccgcgagaaggcaggggccattgacgcggcctacgaggccgagcgtgccgccatcgttgcccaacgcgctgagctggagcggcagcagaagctcacctggtgggcgcttgggggctttctggtggccttcatcgcggtggtgggattggggaccatcgtggtgacgcacaaggtggcgggcccactcttccgcatccgccgcatggtgcaggaggtccacgacggccggctgcgtccaccccagcacgggctccgggatggcgatgatctccaggacctcttcgatgccacgcggaagatggtgcagcgcctccgcgagcagaacgaggaggacgcgaggaccttggcgaacgtcctcctggccgcggagcgctcgggcgcttcccccgagctcatccacgagctgcgcgccctggatgcgcgctaccgcacccggctcgaagactga

SEQ ID NO: 7781 - DNA, 726 bp, Myxococcus xanthus
agctgggacacccctttgcgtatcgtctcgctcgcgccccggcggagtggaggcttcatcgcggggacggagcggggcctggccttctacgagccccggagcgcgcggctggagcggctgctggatccggagcctgaacacccccacaaccgctgcaatgacgggaaggtggacccacaaggccgattctgggtgggcaccatggatgaccacgaggaggcgcccaccggcgggctctaccggttcgacgcccagggacacctcgctcgaatcgatgagggctacaccgtgacgaacggccccgccttcagccccgatgggcggaccctctacgtgaatgactcgccccggcgcgtcacctacgccttcgacctgagcccggacggcgcggcctctcgtcgccgggagttcctccgcttcgacgagccccacggcttccccgacggaatgacggccgacgcggagggcggattgtggattgccttctatggagggggctgcgtgcgccgcttctctccggacggcgcgtggctggccgagtaccggctgcccgtggcgaagacgaccagtgtcgccttcgccggggacgcgttggaccggctgttcgtcaccaccgggcgagatgggctcagcgcggaggagctcgaggcccagccgctggccggtgggctcttcgagctgacaccgggcgtccgcggcgtcgcgccggtgcccttcgcgggctga

SEQ ID NO: 7782 - DNA, 333 bp, Myxococcus xanthus
atgctctacagctacggtggcggcgtcacccacctgcggggctgggatttgccggcgtcggtggtggtggagctggcgctgctggcagtgcttgccctgctggcgctgcggccggaggtggagcgcccgtcctggacgcgctacctgcccgcgggcgcggtggccctgtcgctcgcgttcgcggggctcaacatgcgcctgctccccgggcccttcgtcttcgtcttcggcctgggcgcggtgggcttcctcgcagtgcagcacctgcgcgcggctcgcgccgccgagctgcccccgcggcagtacgaagaagccgtcgaagaggaaggctga

SEQ ID NO: 7783 - DNA, 540 bp, Myxococcus xanthus
atgcccgagccgcccaagggaacgggcgcccgggccgcgctccgtccctcgcggccccagcgcgacctggcggagcccgcctatgcggcggacattctcgaggaggcggatgagcactcgcggccctatgtcgtgggtaacgcgcccgagcttccgcccgaggacaagacggacccgggccagtccgccccggcctacgacgggccgaagtggctggcgcacgtgccggcccactcgcccacggtgctgggcgtcatcgtggtgggctgcgccgtcttcctgtccggcctgctctcctcctctggcgtgggcctcctcgggacgctgctggcggtggtgagtggcacggtgctggtcgcacgcgagctgcgcgccgcggagcagtcgcctggcttcaccgagcgaatgcccgcggtgctgatgacgccggaggccgccgccgccgccaccgcggtgatggtggcgctggcgctgcgctcactcagcctgggcgtgctaccgctcctgatggtggcgggcgtgggggctggtggcccatga

SEQ ID NO: 7784 - DNA, 552 bp, Myxococcus xanthus
atgaagggctggcgctacacgctgggcttcgtggtcctctgcgcgggcctgctcttcgtgttgttcaagggcttcgggcgcaacccgcacgaagtccccttcatgatgaagggcaagccggccccggacttcgggctgcgcgcgctggacagcggagagaaggtgagcctggcggacctgaagggccggccggtggtcatcaacttctgggcgtcctggtgcggcccctgccgcgtcgaacaccccgtgctggagtggggtgcgcggcagtacggctcgcaggcggtgttcctgggtgtggtgttccaggacaccgacgacaacgcgcgcggcttcctccagcagtacggtgccagcttcccgcagttggtggatccgcgctcgcggatggcgctggactacggcgtggcgggcgtaccggagacatacttcatcgaccccaacggcatcatccggggcaagcatgtgggccctatcgacccgcagacgctggccctgcgcatccaggagctgtccacgccctccgcccccaccgaggccgcgcggaagtag

SEQ ID NO: 7785 - DNA, 1977 bp, Myxococcus xanthus
ttcgcgaccttcggcgcactcgtaggcctggtgagcggcctgcgtcgaagtgacgcaggcttcccgtgggtgctgcgcgcggtgtggggcttcgccgcctgcatggtgggctccaacctggtgatggtccacgcgctcgtcacgcacgacttcagcgtgcgctacgtggcgcaggtgggcagccgggccacgccgctggtctacaccatcgtctcgctgtggagcgccctggaggggtccatcctcttttggggtctcatcatgggcggctacatcgccgtcttcgcctacatccaccggcgcgagcacgcgcggtacatgcaactggcgctgggcaccatgctggcggtgggcgtcttcttcgccttcctcatcgcgggcccggccaatccctggggcgcggtgtcccccgtgccagcggacggccccggccccaacccgctgctgcagaaccacatcctgatggtcatccacccgcccatgctctacctgggctacgtcggcatgacggtgcccttcggcgtcgcggtggcgggcctgctgcgcggcgagattggcgaagcgtggatggcgcccctgcggcgctggacgctggtggcgtggctcttcctgtccattggcatcatcctgggcgcctggtgggcctatgccgtgctgggctggggcggctactgggcgtgggatccggtggagaacgcgtccttcctaccctggctgacggcgacggcgttcatgcactccaccatggtgcaggagcgcaagcggatgctgaagctgtggacgctcagcctcgcgctcgcatccttcgtgctcaccatcctgggcacgttcatgacgcgctcgggcatcttcaactcggtgcactcgttcacccagtccgacatcgggcccaccttcctggtgttcctgggcttcctgctggtgctgtgcgtgggcctgctggcggtgcgcggtccgctgctggtgccggaaggccagttggcctcaccgctgtctcgcgaggcgagcatcctggtgaacaacctggtgttcgtcgccatcaccttcacggtgctgctgggcacgctgtacccgctcatctccgaggcggtccacggcgtgcgcgtgagcgtgggcgagccgtacttcaacaagatggcggtgccgggcggcatcgcggtgctcttcctgatgggcgtgggcccggtgcttccctggggcaagccggatccggccacgctgcgccggcagttcatcatcccctccgtggtggggctggtggtgacggcggcgtgcttcgcggtgggcctgcgcggcgtgtacccgctgatgaccttcgggctggcgggcttcgtcaccgtcgtcactgtgcgggagttggtggcgccggtgcgggtgcgcatgtccgagcgcaaggaaggcttcgtcgccgcgctgaccaccagcgcgctcaaggcccagcgccgcttcggcggctacgtggtgcacctgggcatcgtgctcatcatcgtcgcggtggccgcgtcctccgcgtacgtgaagcacacctccggcacactgaagaaggggcaggtcatcgagctgggcggctaccagatgaagtacctgggcctggtcagcggcgaggagccccaccgcacctacgtggcggcgcgcattgaagtgacgtccccgggcggcaaggtctccgaactgaagccgcggctcaactactacgagcgcagcacggaccccattggcacccccggtgtccgggagacgccggccgaggacctctacgtgtcgctgatggccttctccgagcaggccggcacggcgagcatcaacatctgggtcttcccgctcgtcgggtggatctggtggagcatccccctgctggtgctgggcaccctcatcgcgctgtggccgcgccggaagaccgccgtggccatggcgggcgcgccggcggtgggcacgtccccgctcacgggtggtgacgccgagcgaggggccgcctga

SEQ ID NO: 7786 - DNA, 477 bp, Myxococcus xanthus
atgtcccccgtcgctcgcaaccgtctgattgccctgggggccctgctcgtcgcgggggctggcctgggattcgtggccttcggcaacatcggtgagaacctcgtctactactggagcccgtcggagatgctgggccagggtgacaaggcgtactcggccaccatccgcctggggggcgtggtggaggcaggcagcatccagtggaacgcggagcacaccaccctgcaattccgcgtggcggatgacgtcaaggaaggcgcgcccagcgtgctggtgcgcgccacggagacgcctccgcagatgttccgcgacaagattggcgtcgtcgtggaaggcacctacgacaagtccggcgtcttcagctccaaccggctgatggtgaaccactccaacgagtaccgcgcccccaaggagggtgaggatcctcgtcagtggcaggagacgctctccgacgccaccgccatgggtgcgaagtga

SEQ ID NO: 7787 - DNA, 189 bp, Myxococcus xanthus
atgatggcgcttgccacgcagatgctgtggatcctcgcggcggcgcccggacaggtgggcagcggccgcatcgttggcggctggggctatgtctgggcctgctacggcattacagtcgccatgctcgttctctacgctgtgtccctgtgggttcgtcggcccaaagcccccaccgacgccaaggagtga

SEQ ID NO: 7788 - DNA, 411 bp, Myxococcus xanthus
atggtgctcttcaccgccatggctgggctcaacccgtccttcttcatcctctacgcgacggtgacacgggcgatggacgcggtggatgcgatggtgggtgcgccggcccatgtgcagctcgacgtggccggacgggccagtgagacgagcgggctcgcggtggctggattggtcgcggtgctggtgatgatgacggcctatgtgggcggcgccgtcatcgccgagccgctgcgctccatcaccgaggacgccacgcgcatcgcccagggcgatttccgcccgccgcggcatcatcgccgcggaggacgaggtgtgggccacctccgccgccttcgcgcagatgcagacgcagttggggcaggcgctggcacaactgcggcgcgcgggcctccagatttccactaccactga

SEQ ID NO: 7789 - DNA, 606 bp, Myxococcus xanthus
atgcagcgcatgaaggaggacaaccaggccatcgcggacgcggtggttcggctcaacaagcgcgtgcagcagattggcaaggtggtggagttcatcaacgagattgccgacaagtccgacctgctggcgctcaacgccgagttggaaggcaccaaggcgggcgaggtgggccgcggcttctcattggtggccgcggagatgcggcgcctggcggagaacgtcatccgttccacgaaggcgattgagcagctcatcgcggagattcgcgatgcgacgcacgccgcggtcatggccaccgaggcggggctgaagacgacggacgcgggcacggtgctggccgcgcaggtggacgaaagcctgagcctcatcctggagctggcccggcagacgtcccacgcggtgcgcagcatctccctggccacgcagcagcagcagaccggaacggaccagttggcggccgccatgggcgacatccttcgcgtcaccgagcagaacttcgcggccaccaagcaaatggcggcggccaacgccgacctgtccaccctggcgcgtgatttgaaagacgcggtggagcgcttccacgtcgggccgggaggtgacgcgtga

SEQ ID NO: 7790 - DNA, 1770 bp, Myxococcus xanthus
atggcgcccgtcccgctggccaacctggtgggcgcggcgctcagcctgcgcttcgcctcgctcaccctcgccgagccgctggcggggcggatggggttgatgggcatcctgggcggcgcgctctgcgcgacggcgttggtgtcgggggccgctgtgtccctgggacggcagcgcaccctgcgcgggctggagcgtggggatgtgcccaccacgccgcagacgctggcgtcggcggtggcggaggtgacgcgcgcgccggacgaggccttcctgggctcgctgggactgtggctggtcaccaccctgacgctgggcgcgtgcatgtggctgggcgtgggcgtggagttggcggtggccgctcgcatcgccgcgttgggcctgctcttcgggccgttgaccgcgctgctcgtgtactgcctcgtcgtgcttcggtcgcgcaaggtggtgctgtggctggcggagctgggtatgacacacgcgcagctcatcgaggccatgccccggcgcgcggagctgcgtgcgcggctggcggccttcgccttcgtggcggtgatgacgcccgcggtgctgtccgcgcagctcgcgtcggcgctgagcaaccacatcttcacccggctcatggcggagcgggacgtcagccgtcagctgatgttggcgcaggagcttcgagtcgaggcgctgacgcagggcggagggctggtgctgctcgtcttcgcgctggcgctgacggccgcctacctgggcggcaccatgctggggcggcccctccgggagctgtcgcgcgaggcgaagcgcatcgccgagggggacctggccagcccgcgcgtggtgcccgcggaggacgaggtctgggacgtctccgcggcgttcaccaccatgcgcgtgcatctggcggacgtgatgtcgcagttgcagcgcgcgggcgcgcagatttcggcgaccacggaggagattctcaccacgtcgggacgctacgaagcgggcgcgacggagcaggccagctcgctggacgagacgagcgccaccacggaggagctggcgcgttcggcgcggcagatcgccgagaacgcgggctcggtggcggagattgcccagcgcacgctgggcgcggcgcagcaggggcaggggagcgcggaggccttcctgggctccatggcgcgtatgcgccaggacaacggcgccatctcctccgccgtagtgcggctcaacaagcgcgtgcagcagattggcaagatcgtcgagttcatcaacggcgtcgccgacaagtcggagttgctggcgctcaacgccgagttggagggcaccaaggccagtgaggtgggccggggcttctcgctggtagccgcggagatgcggcggctggcggagaacgtgctggagtccacgaaggagattgagggcctcatcgaggaggtgcgggaagcctccgccgcggccgtgtccgccaccgagggcggcgtgcgtgcggtggagacgggcaccacgctggcgcagcaggtgtccgagtcgctgcggcagattgtcgacctggccgggcagacgtcctacgcggtgcgcagcatctccctggccacgcagcagcagcagatgggcaccgaccaactcgccgacacgatggcggacatcctccgcatcacccagcagagcctcaacgccaccaagcaggtgacgacggcgaacacggacctgctcgtgctcgccagggacctgcagggcgtggtggagcgcttccagattggccaggagccgctgggggaggagggcgggtga

SEQ ID NO: 7791 - DNA, 750 bp, Myxococcus xanthus
atgcagctgctttcctccgccctcgtcctgctgctcctcgcgccttgcgcggccctggctcagggtgactcccgtattgccttcctgggcaagcagctccagaagagcaaggacccgcgctcgcgctcgcaggcggcgctggtgctcggcgccacggaggacccggaggccgtgccgctgctgtgcaacggattgaaggacgagagcgagctggtgcgcgcggccgcggcgaaggggctggcgaagctgctggagcccggcgggctcgactgcctccaggcccacaaggcggacgcggacgcgtcggtccaggcggcggtgagcgatgccgtgggggccctgaaggagtaccagtcccgcccgccgcgcttctacgtgcatctcgaggcggtcaaggaccgcacgggcaagctccccgccgacctggtgaaggcgacggaggcgcggctgcgctcgcggctgatgcggagcggggcccagctcgcgcccgcgaaggagacgaaggcggcggcgaagggcacgctgaagaagcttcgggtgcggggctaccgcatcaccccggagcttcatgcgacggacggcggcggactgcgggtggcgctggtgtgcctcacctacccggacctgtcgctgatggggcaggtggaagtgaatgccgcgggcgctcagcctggcgatctcctcaaggcgctggtacctcgcgcggtggaggaagcggcggagaccttcgagtggagcagcgagacatga

SEQ ID NO: 7792 - DNA, 1848 bp, Myxococcus xanthus
ctgctcaggcagttccgggacctggtgacggtgcgcctggagcgcatcacccggtccttgatggaactggagtctggcgccagcgcggaggcggggcggggcgtgctgcgagagctgcacggcttgaagggcgaagcccggatgatgggcttcgatgacgtcaacgtgctggtgcacgaaatggaggagctggtccgctgcactgagcccttgcgctacgcgctctcacccgcgtccacggatgcgttgctgaccacggcggacgccgtgctcgtgttctccgggacgcaggccgccgatgagccgccgcccgcggtggagcggctcgtcgcgtggttgcaggagtgcgtccgctccgagtcggtgcggctgccgcctggacgtctcgtgcccgcagaaggagcccccgcgacttcggaggccgctggccgcgtaggagcccaaggtggtccccactccgccgtgcagacgaacccgggggcttctccggggcggctgttgacgatccccgtcgcggaggggagccggcctcacgtgccttcaccgggccggagcgcgatgccgagcttcgtctctccgcaagcctctggcgccgaggcgtcctccggtgcgggagcccgggcggcctcctcggctccgacggtgcagggttccaacggcctcacggcgccccggcagcccgagtcacgtccggacactgcggtgcgcatcggcgtggagagcctggacctgctcaccagtgccgtcaccaacctcacgcaagtggcgcgtcgccgggagctggccaatgcccgacgcctggccctggcccgtgagctgagccagcttgcccgcgaggcggaagacctggggcccgcgggcgccgcgttggcggcacggttgggctcggccaaggagatggccgcggtcctccaccgcgagtcgaagctgctttccaatgcggagctgcgcgacctgggcatgttggtggaggaggtgcagacgctgcgcatgctgccgctctccgtcctcttcgagccttacccccgcatggtgcgcgacctgtcccgcgcgctgggcaaggaggtggagctggtcgtcgacggcgaggacactcgcgccgaccgcgccgtcgtggaggcgcttcgcgagccgttgatgcacctggtccgcaacgccctggaccacggactggagacgcgggtggaccgcgtcacggcggacaagaagccgcgtggctgtctcacgctgcgtgccgctcgagagggcaaccgcatcaacctccgtgtcgaggacgacggcatgggcgtggaccccgtccaactccgcaaggtggccgtgcgcagggggctgttcgacgagagcgccgccaacgccctgtcggacgccgcggcccgcgagctcatcttcctgccgggcttcacctcgcgggacgtcgtcaccgacctgtcgggccggggcgtggggttggacgcggtgcgcacctccatccaggccctgggcggtgacgtcggggtggagtctgcgccgggctggggcaccatcttcgagctgcgcgtccccgtctccctcaccgtggccccgctgctcttcatccaggtggggacggagacgctggccctgagcgccacccatgtctcgcgggcgctgaaggtggactcggcggagcaatgcgaggtggccggccgcccgtcgctcctggtggaaggccgggtcctgccgctggccccgctgtcgtcactgttggggctggagcctccgcggcccgctcgcgagggtgagctggccctggtggtgaagagccagaacggcgcggcggcgctggtggtggaccgcgtcctggaggagcgggttcaggccatcctcccc

SEQ ID NO: 7793 - DNA, 618 bp, Myxococcus xanthus
atgggcgccgcgcggaccacgcaggacggcgacatcatcgaggcggtagcgctgacgctcatcccctacccagacccggtgagcggcggcaccttcgagacgcgccgcagccgcgcggcccatgaagtcttcgccggtgcggggatgcggaacctccccgtggacgcgctgccgctggcgatgctggcactggaccgaggcaccctccgctggctggacaccttcctggtgcgacgtgaggtgggcgccgaacagcgcagcgtggtgggcttcggcgtggcaccacgcgagctgcgtgaagctcacgcgcttcaatatcagcagcacctgaaggaggtgctccaggcgcgtcgcgcggcgggccagagcgagcggttcctcgcgagcgagcacttcttcacgctgcccgccgcggggaccctgcccgcggcggccatcgaggcgggcagcctcacggagttctacttcccgcccgaagtggacgtcgagctgacggtggtagccgaggacgagctcggcgccatcctcgacgagtccctgcaactgccccccatcgacctcacacaaacaggcgaggccctggagtcggtgtccgtcctggtgatggtgccccggcgg

SEQ ID NO: 7794 - DNA, 804 bp, Myxococcus xanthus
atgtcgcccccgaatgacgccttgctcgacgcggagacgcgagaccggctccactacgacaccggcgtgctcctggacgcgggagacttcaccgccgagcagacctatcaccgaggccggctcacccgggccctggcgtacctccacggcgtcgggacggtggctgggctcaaggtgagtcaccacgagggcgccgagccggagcatgaggagctccgggtgtccgccgggctcgcgttggaccccttcggccgcttggtggaagtacccactgacgcgtgtctcaagctggaccgctggtactggcaggagccgctggagatggccgacttcggcgtcttcacgcccgccgagtaccggctgagccccgatgccgcgggatttccgcccacgggggtggtggcggacctcttcctgcgtttcctccagtgcgagcgcggcaagacgcctgccttcgcggcggggcccttcgacgcaatggacgccgtggtcgcttcgcgcattcgcgacggctacgagctgcgactggtgccgcgctccacggcgtatccccctccggaggtccccaagagccccttcccggaccccgtggacgaaccagacccggtgcagcgacgcatcaagctgcggcaggccgtcttcaacgcctggcgaggcagccgcgaacaggagctggcgaagctgtggagtgacaccttcatcccggcctcgctgctgacggacccgacccagcccgacctcaagatgagggatcccgcgtgggtcttcctcgcccgcgtcgtcatcggagcaacaggccgttga

SEQ ID NO: 7795 - DNA, 2421 bp, Myxococcus xanthus
atggacgccaaccgcctccggttctacatgctggcggatgcgccggactgggtcacggagagctcggtctccgcgggcgaggtgtgtctctacgacgcgaagcgcaggacgctccggctgggaagcctgggagagagccgcaccttcgatgaagcactcgacctcgcggtgctggagcccaggctcgctcgcgtaccgggcgcggtggatgctttcggcacgtgggcctggtgggacgacgtggccgggcaggtgcgcgcggcgggcggaggcgctggcaccaccctgcgattcgagcccgcccaggtagggctgtccggcgcggtgacggacctgtcgcctggagctggcggcatcctctacgtcgcggtggcccagcgcgtagtggcgctccacctgcgtaaggtgtggtccgccgtggtgttcccggccgaggggctcgccgcgcaccgtatcgccgcggacccgcggggtggcgcctacgtcctgagcggtccgccttccttcgcgcccaacgcgcctcccgccgtactcggccggatggacgggcagccgcttctggacgtcctgtccattccctccggcgctggtttgttccgcccgatggaagagaacccggacccgcctcggacccgggtgctggagacgctcgcgtggcctggcgaagtgccggtggcgctcgcctgtgacaccgagggacggctggcggtgctgagctgggtcatggacccggcgctcgcgggtgtgcccccaaacgcggggcacgcgcgactgcgcttctactcgggccggttctccacgcccgtcgcgctcccgggcgtgctggggcccttcagtctcgccatccttccggacggccgcgccgcggtgctgtcgctgctcgacgacggcaaggtggaggcggtggcctacgcgctcccggctggtgcgtcggaggcgattccccagggagactactttcccctgcccggccatgacgggggtccctttctccagggagcgaagcctccgcaccacgccgtcaacccggggctggccgacatggcgccagtgccgcttcaagccctgtcgctgccccggtgcgccgagcggggcagcgccgccaacccgccgaaccggcccttcgactcgggcgacgggcgcacggtgtggcaccgcctgtacgtggaggcgctgctgcccccacgcaccggggtgcgcgtctggcttgccgccaccgacgagcccctggctccgccgagcgactcgccgcactggcacgagcatcgcctgggcctcatcccggaagcccctgttcatccagacgtcccgcacgggagctgggtgcctcttccgtcggaggtgccgttccaaccgggaatgctgcccgcgccgccggccccgggcgagagtggcctgttcaccgtcctcatccagcgcgcccacgcgaaggtgcgtgcgctctccggacggtacctgtgggtgcgggtggagctgttcggcgacggccgccggacgcccgaagtgggagcgctgcgcgcgtatgcatcgcgcttctcctacgtggacaactacctgccgtccctctatcgcgaggagctcttcggcgaggacgcggacaccaccggccgggcgactcccgcggacttcctggagcgtttcctcggcatcgtcgagggtgtgctgacgcccatcgaggaccgcatcgcccatgcgcacgtgctcaccgacccggggcacgtgcctggtgattcgctggagtggctcgcgagctgggtaggcctctccttcgaccccgtggtgggtgagagccagcggcgcgcgatgctccggtccgcgcccgcgctcgcccggcggcgcggctgcgtcgagggcctgcgcctggcgctggacctcgtcaccgacggcgcggtgaaccgaggcgcggtggtggtggtggaggacttccggcttcggcgcacgctggcgaccatcctcggcgcggacctcgcggacacggaggacccgttgctaccgggcctggcccggagcgggaactcctacgtgggcgacacgctcttcctcggggatgaggcgcgcaaggagttcctggccgtcttcggggacgaaacgctgcagagccgggcggaggcggaggcggtggagcagctcctggagcggctggcacaccggctcacggtgctggtgcaccagggcacggacacgcggaccctgggcctcatccggaaggtggcggagcaggaggcccccgcgcacgtgcaggtctccgtcatcaccgcgagccgtccgctgctcgtcggagtcgcgtcgctggtgggcgtggacacctacgtcggacccgcccccgcccccacctcggtgcgagtgggccacagcgtgctggggctcgcggacgtcattgaacgcccgtcgagcctggaccccagattggaaggaggttga

SEQ ID NO: 7796 - DNA, 1236 bp, Myxococcus xanthus
tttcgcctgccctccggctccgtggagcgcgcaacgttccagctcttcatcgaagagccaggggcgggctaccgcgagtggcggctcatcgaagacctcgcgctggcccgccgcgacgagcccgtctacgccctggactccgaggcaggcgccgcccgctgtggagacggcgtgcgcggacgcgtgcctcccgcgggtgcccaggtgctggtggcccggatgcgcagcggtggcggcgccgcgggaaacctcccgcctggcagcttgaaggacatcagcgccttccgggtcgatggaagccccgcgccggggctgcgggtgcaacagccggagcccacgctgggtggccgggacgcggagacgctggcggaggccgagcgccgcatccccgcgctgctgcgccacgtggaccgggccgtgacggaggaggactatcggcggctcgcggccagcacccccggcgtgcagttggggcgcgtggaggtgctgccccgcttcgagccaaggcgacggcgagacggtgttcccggtgtcgtctccgtcatggtgttgcccacggccacgcggctggagccgccctacccgcgggcggaccggccgctgctggaagccgtccatgcctacctggatgcgcgccggccgctcaccaccgagctctacgtgattggctgcgaatacgtcccactggggctcggcgtgggcatcaccgtgcgtgagggctttggcagggagacggtggtgcaggcggtgcggcaggccgtgcgccgcttcatcttcccgctgccggcgggaggccccaccggagagggctggccgctgggccgggatgtccaggaccgggagctctatgtcgcggtggcgcaggtccccggggtggccagcatcgccggggtgaacctcttcgcctggggaacggtaacgcgcgtgctgagagaccctcgccgcgccggagccacggccgacgtggcgcgcttcacggtggagccccctgctccgtccgtccggcaggccgagggcccggtcaacccgagctggctccagctcaagggaagcaccgcgacgacaccggtggagctgtccatcgcggactggcagctcccggagctgctcaaggtggcggtgaatgccgacggagaggtgccgacgatgctccacggcatcggcgatgagggaagcggtggcatggactcctcgcaggcgggcgtggcggtgcccatggtccccgaggtctgctga

SEQ ID NO: 7797 - DNA, 786 bp, Myxococcus xanthus
tgtccaaagcgggagaacttcgaggcggcgattacgccgaagacgaagatggtgtgggtggagtcccccaccaacccgatgctcaagctcatcgacctggcgcgcatcgccgaggtcgccaagaagcggaacatcctctccgtcgccgacaacacgttcatgacgccgtacttccagcgcccgctggacctcggcttcgacgtggtggcgcactccaccaccaagtacatcaacggccacagcgacgtggtgggcggcttcgtctgcaccagccgtgaggacgtggcagagaagatgtacttcctccagaacgcggtgggcggcgtgtccggcgccttcgacagcttcatggtactgcgcggcgtgaagacgctgcacgtgcgcatggaccgccacgcctccaacgcgatgaaggtggcgcagttcctggcgtcccacccgaaggtgaagaaggtcacctacccgggtctggaggcgcacccgcagcacgcgctggcgaagcagcagatgtccggctttggcggcatggtgaccttcgacatccaggggggcctggaggccgcccgcaccttcctcaagacggtgaaggtgttcgcctgcgccgagtcgctcggcggcgtcgagtccctcatcgagcacccggccatcatgacccacgcctccattcccaaggagacgcgcgagcagctcggcatcaccgacggcttcatccgcctgtcggtgggcatcgaggacgcgcgggacctggtggacgacctgtcccaggcgctcgacgccgcgaagtag

SEQ ID NO: 7798 - DNA, 81 bp, Myxococcus xanthus
atgaagcggctgatgaaggccagcctcgagtggagcagcaccgtcctgaaccgggtggcggaccgcgtcttcggacgctga

SEQ ID NO: 7799 - DNA, 999 bp, Myxococcus xanthus
atgaaccccatcgagcgcggccggaaactcatcaacacggtccgtaccggtgccgagaaggccattgaccgtacgcaggacgccgtgggcaacgccgtcgacaacgtgaaggacgccgcggctgccggtggccgcaaggtcggccagttcgtggacggcttcgagaacgccgtctccggcaccgcccggggcgtgggcaacgtcgtcggcggcgccgcgcggggcgtgcaggagttcttcggcggtggcaaccagccggaccgcgtgcacgacggcaagctgctgggcgcggacggcgcgacgttcccgccgggtaccccgctggcggacatcccgggcgtgacgccggccaacaacccgaatccgcagtcgacgatcctctacgtcaacggcatcctgacgacgaaggaggcccagtcggagagcctgcaggccatcgccaacgcgacgggctcgcgcgtcgtcggcatccacaacgccaccgagggcatgggcgcggacctggcccagtccgtgaaggacaagctggacaagggtaccaaccccgccgtggacaccctggcggacgcgctctacaccgaaatcaaggccggccgtgacgtgcacctgatggcgcacagccagggtggcctcgtctccagccgcgcgctgaacgacgtgtacaaccggctgcgcatcgaagatgggatgtccaagcaggacgccaaggcgctgatggggaagatcaacgtggagacgttcggcggcgccgccgccacgtacccggacggcccgaactacgtgcactacgtgaaccgtggcgacccggtccccagcatgttcggcctgggccccatcccggacaagtggaaccccatcgcggacggtggcaagggctccaaggtccaccagttcaacgagttccacctgaacccgttcgacggccacagcttcgaggacgtctacctcaagaaccgcgtgccgttcgaccaggcccgcgaaggcaacttcaacaagtaa

SEQ ID NO: 7800 - DNA, 99 bp, Myxococcus xanthus
atgaaggtcagcatcaagtggaactccgaagtgttggaccgcgtcgcttcgcgcgtgttccacccggaggaactggaatccaaggacacgtcgcgttga

SEQ ID NO: 7801 - DNA, 441 bp, Myxococcus xanthus
atgcgctactttgaggacttccagcccggggacgtgagcgaacacggcccccacgtggtgtctcgcgaggaaatcatcgccttcgcgacgcagttcgacccgcagcccttccacctgagcgacgaagccgcccgcgacagcatcttcggcgggctggtggccagcggttggcacaccgcttccctgtgtcaccggctgttggtggacagcttcctgggacagacgtccagcatgggctcgcccggcttggatgagctgcgctggctcaagcccgtgcgtccgggggacacgttgcacgtgcgggtggaggtcgtctccgccacgccgtcgcgcagcaagccggaccggggcgccatcaagctccgcatggaggtgcgcaaccagaaggacgaggtggtgatgacggagctggccaacgtgctcttcggccggcgtccgtga

SEQ ID NO: 7802 - DNA, 471 bp, Myxococcus xanthus
atggctgagttgattcacaatcacgcctcgggggagatgcgctcgcgccggggggcgacgtacggcttctccgcgcggccctggctggggcgcggcggcgcggcccacctggtgctggagggcgcggtggatgcgcagcgcatgggtgaaggcatcagcaccgtgacccagctcctcgcgtccttcgggaaggaagtgcccgagcacgcgctggagcgggctcgcagggggatgctggcgtcccaggccgtctccttcatcagctcggaagcctgggtgaacgcgctgctgaccgcgcgcgtccgaggcttcgagccggacacggtgacgcgccggcccgcgctgctccagacggtgacggccgagtcccttcggaaggagttcgagggctgcttccagcggcccgttgtctccatcaccgcggatgagggcaaggcgcggcccgtcatccaggccatgtcccagccgtag

SEQ ID NO: 7803 - DNA, 973 bp, Myxococcus xanthus
atcacgaagctgaagggcgaggcgagcagccgctcgtactaccgcgttggcgcgccgcccgagagctgggtggtgatggtgatgccgcccgactcgacgaagaagagcgacgaggccaccaagggcgagccgcccaaggagctgcccttcatcaacgtgcaccgctacctggagaagctgggcgtgcgggtgccgcgcatcctccgctacgacgagccggccgggatgatggtgattgaagatttgagtgacatcaccttcgagtccgcgctggagggcggcaagcaccacgaggcgctctacacccgcgccggtggacctgctggcgcgcctgcgcccggcggcggagaaggcggaggacccggactgcctggccttcacccgcgccttcgacgaggacctctacgactgggagctgcaccacttccgcgagtggggcctggaggcgtggagtggcaagaagcccacggacgccgagcgcgccgaactggacgccaccttccgcgacatcgcccggcagctggccgccgcgccgcgtggcttcacgcaccgcgactaccagagccgcaacatcatgatgaaggagggcgagctggtcgtcatcgacttccaggacgcactgcagggcccgcgccagtacgacctggtggcgctcttgcgcgacagctacgtggagctggatcgcgacttcgtggacgcgatgctggaccgctacatcgccaccttccaggaggtgagcggcgagcgcatcgacgcggcgtccttcaaggccttcttcgacctgctcaccatccagcgaaagctgaaggacgcgggccgcttcgagttcatcaaccgtgtgaagggcaacccgggcttcctggtgtccatccccgcgtcgctgcgctacgtgcgtgacggcttcgcgcggcggccggagctgcgcaagctgcaggacctggtggcgaagtacgtcccggagctggcggcctga

SEQ ID NO: 7804 - DNA, 417 bp, Myxococcus xanthus
atgaaggccatggtcctctgcgcgggcctgggcacgcgcctgcgcccgctcaccgaacgctggcccaagccggcgatgccattcttgggacagccgctgctgcgctaccacctggcagtgctgaaggccgcgggcgtgacggcggtgggcatcaacacccaccacctgccagacaccatggaggcggtggcccgcgccgagtgcgctcgcgcggggctgccgctgcacgtggtgaacgagcccgtcatccagggcaccggcggcggcatccgcggcctgcgggacttcctgtcggacggcgacttcatcgtcttcaacggcgacatcctctacccggtggacctgcggccggtggtggccctgcaccaggcgtccggcgcgctggccaccatggtgctgcagcccatgccagcgggg

SEQ ID NO: 7805 - DNA, 1368 bp, Myxococcus xanthus
atggacatccacgagaacatcctcaccgccattggcaacacgccgctggtcaagctcaacaagcttgtcgggccgaacgacgcgaccgtgctggtcaagtgcgagttcatgaacccgggcgcgtccatcaaggaccgcatggcgctctacatcctcgagaaggccgagcgggaggggaagctcaagcccggcggcaccatcgtcgagaacacgtccggcaacaccggcatgggcgtggcgctggccgcggccgtcaaaggctacaagtgcatcttcaccatgccggacaagatgtccctggagaagatcaaccgcctcaaggcgctgggcgcgcaggtggtggtgacgccgacgaacgtgccggccgaggacccgcgcagctactacgagacggccaagcgcctgcaccgcgagacgccgggcgcgttcatgctcaaccagtaccacaaccccgacaacatcgaggcgcactacaacaccaccggtcctgagatctacaagcagaccgagggcaagttcgactacttcgtcgcgggcctgggcaccggcggcaccatgagcggcgccggcaagttcctgaaggagaagattcccggcctcaagaacgtgggcgtggacccggagggctccgtctacgagggctacttcaagacgggcaagctgaccgagccgcacgtctacaaggtggaaggcatcggcgaggacatgctgtgcggcgccatggacttcacccacctggacgacgtgcgccaggtcgatgaccgccagtgcttcatcgccgcgcgccgcctggcgcgtgaggaaggcatcttcgccggcggctcctcgggcgcggcgattcacgtcgcggtgcagctggccaaggaagtgggcaagggcaagacgattgtcgtcgtgctgccggactcgggcagcagctacatcagcaagttccactccgacgagtggatgcgcgacaacggcttcctggaggagaagggcgccggcaccatccgcgacatcctgggcgacaagcgcaaggacgtgaagacggcgcgccgcggtgacaaggtcgaccaggtggtcgagacgatgcgcggccacggcatcagccagatgccggtggtgggcgacgacggccgcacggtgggcatggtgcacgagtacgacctgctcaacgcgctggtcgccggcaaggcgaagttctccgacaccatcgacagcatcatcgcgccgctgcagggcgcgctgtcgctcgacaccagcatcgcccgcctgcgcgaagtcttcgctcaggacaacgtggcggtggtgaaggacggcgagaaggtggtcggcatcgtcaccaagatcgacctcatcgactacctgcaccgcacggcggcgtag

SEQ ID NO: 7806 - DNA, 1635 bp, Myxococcus xanthus
gtgtggacacccaaacaacagggcccaccgccaaccccgcgaaaccgcgggcctgagtgcccggcccgctacgtgctaccgccggagccaccgagtcccttttcgctccgaggtccacgctccatgtcgcccttcgcgcttcgcccctcctcgcgctccctgcgggccgcgctcctgttcctgaccgcgctgctgcttccccaggccccggcccgggcggagcccggcatccgcatcctgaactcgctccgcgccgaggagctggccttcaacgcgctcaccagcaaccgggccgcgctggacgccctcaccgagatgccactgcactcgaagacgttcgtcttagacggtcggctcaagcacgcgctggagcacccacctgcccggaacgtgatggcgtacctcaccgagtgcgcgctgccgcccggcgccgccgtggagtggaccagccgcgccggcgacacgtacaccttccaaggcgaggtggggctgtgccccgggtgggagaaggacaagccgagccaggcctgcctgggctacgtgacggcctgtctcctggcgcgcaacaacgccttcggccgccgcgtgatggtgtccatgcgcggcgaggacccgagcgagccccggcgcttcaacccctcgggcgcccgcgaggagtggagccccatgttcctgccctgcgcgtcgggtgaggcgggcctccatgccgagtgcggctggctgggggagaacgtgggcacctgcaacccgggcgacaaggtgacggtggccgcgggcgcgcctcacccggccacatgcacgggccagttgggccgcatcttcggagaccgggtgctgcgcgtgtgcgaggacccgcggggctgctcctgggaggaccgtctggcggacacgctcagcaacccctgcggcggaatcgagcccagcgtcgagttcaagtgccccgagagcggccgctacagcgtcatgtccgcgccctacagccgcgccgcgattccgggttcgtgggtggccccggtggccacctccggcacctacccggccgggcccttcggcgcgtacacgttccgggagggcgccttctacgggaacatgttcgactcgcgcggcctgacggtggaggtcctcctcaaccaggacaccttccagcccaagctcatcaacctgcgcttcaagggcgtggtccacgacaacgtccacgcctgccacggccgggactgggtggacggcgacagccacctgcgctcccgcatctgcgccaacgccgacatcggcggcgagcccatcgccggctgcgtggcccgcgcggcgggcccctgcgagccgggcagctacaacccccgccccgcccgctgcaaggtgaacgacggcaccgcggtgtggggggacggcgacttcgagggttgcgcggacgcgcgcggcatcctgcacccggagcccatcaccgtgttcctgcgctccccctgcgaggtgatttcccccaaggagcagaccacctgtggggtgacgtgtgactactccgagttccctcccaagtgctcggacacgtgcaagctcaagaagtccccgggccagtgcctccagacggacgcgtgcctgaacgaccccgcaaagtgcccggcgccaccgcaacagtga

SEQ ID NO: 7807 - DNA, 561 bp, Myxococcus xanthus
atgggcgtgtcgccggagctgcgcggggagcgccacgcggcggcggtgtccttccgcgtgggcatccagggaggaccgctcaacgaagggggcggcggcgccgacctgttcctcggactggagggccggcgcttcggcgtggacctgcggctgacgggcctgggcctgcccacggatgacggaacgagcggttcggattccatcaccctgacgcagtcgcacctcacctgggcgctcatctcccacgagcgtgcccgcctgcgcgcggaggccggtgtcagcaccgcgcacgcgccggacatcaccttcgtcggccccagcttcggcgcctccctggaggcctgcatcatcggccccctggacctggaggcgcgcctgcaggtgacgcccttcccctaccggcaggtggacgcgaacgccgcgctggcgttgaagctgggcgcggtggtgctgcgcggcggctaccgcggcatggtgctggacgacgccggctacgtggatggcgtctccaacgtcgacaccttccacggccccttcctgggcctgggcctcacctactga

SEQ ID NO: 7808 - DNA, 543 bp, Myxococcus xanthus
atgcgcgagccagaggacacagtgccgctgctggtgcgcatgggcgtgcagggagacttgctgggcgacgccggagccatggggctcttcatggccatggatggccgccgcctgggcctggacgcgcgcatcaccgggatgtcgctgcccgcgacggatggctcggatgccaccgaccgcatcaccctgctgagcgcgcacgcctccgcggcgctgtgggcgggggagcggggccggctgcgattggagggcggcgtcgccagcgcgcatgcgccggacatcctcttcgtgggccccagcttcgccgcgtccgtggaggcttgcatcggcccctcgccggtggacctcgaggcccgcatccaggcggtgcccttcccgcaccgtcaggtggatgcccaggccggcctggccgtgcacgtgggttcgctccacctgcgcggcggctggcgggccctctacctcaacgacgccgggcacacgaccggggagaagcaagtcgaacggctcaccggcccgtacctggggctgggcctcacgttctga

SEQ ID NO: 7809 - DNA, 330 bp, Myxococcus xanthus
atggcggaagcgctgcatgacgagggcttcgaggtgtccatggccatcaacgccgtggaggcgcttcgcgtgctcgcggcgttggagtccgcctgcctggtgctgctcgactgggagattccgcgcgtggacgggcgaggtctgctcgagcggctgcggtccgatgagcgcttcgccgggacgcgggtggtggtgatgacggcggaggccggtccgttgccgcctggcgcggcgggtgtgctgcgcaagcccgtgaggctggagatgctgctggatgcgacgcggcggcactgcccggtggccagcggcgcggtgaagacgcccgcgtga

SEQ ID NO: 7810 - DNA, 411 bp, Myxococcus xanthus
gtggtgcttctgcatccggtggacatgccggcgctgcgcgcgtccacgctcaagtcgctcctgaagatggcgggggacgtggatgagctgctgcgcccggagttcgagggcgcgcctggctggccactggtgctctcgcggagcggggcggagcggctgcgcgccgcggagggccagcaactggagcccgcgctggcgacgatgaaggtgcgccgcgtgccggtgaaggacccgggcgtggtggtgaacatcaacacgccggagacgtacgagcgcctgttcggcacgcagccgcggctggcgcctccgcccaagcggcgcggcgccaagcgtggcaccgcgcccgcgacgtccaacgtggcggaactgggcggcggttcggcgcccatggccgccgcgtccgaggagtag

SEQ ID NO: 7811 - DNA, 519 bp, Myxococcus xanthus
atgacgttggacaccgggcagcacctgctggggctggtggcgccagccctgtgcgccgacgccgccaccctgcggcgcttctgctcggagctgcaacgagaccttgcagggcaagcccaggaacaggatcaggacggagagcctgcctctcacctctctttctctgaatggcagaacgagctgcgcgaggagctgacggagcgagaccaccccgcggccaccttttgggagaagcacgggaccaccgcgggcgcggcggtgacactgccctttgaaaggcccgcgaacgcggcgcaggtgttcgacccggcgtcgctcgagttgacgctgagaggcgagcggctgtcgcggctcgacgcggcggcgcgcgagctggggtgctccctcgatgcactgctgatcgccacctggagcgcggagctctggaagctgaccggccagacggacctcgtgctgggccttcagtgcgacggacgcgagcacgaggaactgtcggaagtggtcggccccctctcccgc

SEQ ID NO: 7812 - DNA, 828 bp, Myxococcus xanthus
atggatgcggtggcacgcgaactggacgcgatggccgagctgggcacccagaacgtcgtcttcattgacgatacgttcaacgtgccgctgaagcgcttcaaggaactgtgccggttgctgatcgagcgccgctacggcttcaactggttctcctatttccggtgcagcaactcggacgacgaggccgtggacctggcggcgcagagcgggtgccgcggcgtcttccttgggattgaatccggctcgccgcgaatccttgccaacatgaacaaggccgcgacggtcgagaaatacgtgagcggcatgaagcggctgcatgcccacggcatcctcaccttcgcgtcattcatcctgggcttccccggcgagacggaagagacggtcgaggagaccctcgcgttcatccaggagacgcggccggactactaccgcacacagctttggtactgcgaacccggtactgccgtggatgcaaagcggcagcagtatgggattaccggccaggggttcatctggcggcacgacaccatggagagcctggaggcgatggatcacatcgaccggatgttcctcacggtgaaggactccgtttggttgccgcagtggtcattcgacttctggatcatcccctacctgctcgggagggggctccagacggagcagttcaaggcgctgatgcggcttgcccaccagctccttgcgctggagatcgcctccgtctcttcggagacgaagcgcgcccagcagcggaactacgtggggcagatggaagcgctggtgcgtcaatggaacggcgcatcctcccaagcggtgctggccggaagatga

SEQ ID NO: 7813 - DNA, 189 bp, Myxococcus xanthus
atgccagatgtggaagcgccgcggccgctgtccgagccgccagacgaggcggaggagcgacagagccgctacatggaggaagagccgggccacacgccggggagcgcggagggcgacgacgaagacgcgccgcaccgtgttcgcccctacccggacccggaccacaccccggggcgggcagaaggttga

SEQ ID NO: 7814 - DNA, 4941 bp, Myxococcus xanthus
gtcaaggtgctcaatcccgagcggagcgggggccatgcgtccatctttcaagtcaaactcctgctccaggacgtggcgctctcggagctgtcgctgcccgggctcacgattcagccggtggaggtggaacaggcctccgcgaaattggacctcaccgtcttcgtggcggagacgccgcgggggctggagtgcaagtgggagtacagcacggagctgttcgatgcaggcaccattcgccggatggtggcgcactaccagcggctcctggcgggcgcggtggcatcccctggctgccgcatctccgcgctcccgctcctgtccgcggacgaggagcagcaattactcgccgtctggaacgacacccggacggagtacccccacgcagcctgcgttcatacgctcttcgaggaacaggtccgccggacgcccgagtccctcgcggtccttcacgaaggcttcacgctccgctaccgcgagctgaacgagcgggcgaaccagctcgccaggcgcctacaggcgatgggcgttggccccgagacggtggtcggcctgtgcctcgagcgcggtccggagttggtggtgggcctgttcggtatcctcaaggcgggcggtgcgtacctcccgctcgaccccacctacccctccgagcggctcggtttcatgctccgggacgcccgcgttccagtgctggtcaccctcgaacgaatcgccgataggctcccctcgcagggagagcaactgctgtgcctggacgcggaccaagagccgctggcgcgcgaggcgacgtcgaatctggaggtccctgtcaccgccggaaacctggcgtatgtcctctacacctcgggctctaccggcacgccgaagggggcgatgattgaacaccggggggtggtgaactacctgagctggagcaccggcgcgtaccgcgtggcggagggctcgggggctccggtgcattcctccatctccttcgacctgacggtgacgagcctcctcgcgccgctggtggcaggaaagacggtgacgctggtcccagaggacgaccggctggagggactggccaaggcactccgctcgaagccagatttcagcctggtcaagctgacgccgacacacctgaggctgctcgcgcggcagctcgacgcggcggcgctggccggacaggcgcgagcgctcgtcattggcggggagaccttgagtgccgaagcgctggagccctggaggagccacgcaccagggacacggctcatcaatgagtacgggccgaccgagacggtggtgggctgctgcgtccacgaggcaacgccagatgacgcccgcacggggtcagtagcgatcggccggccgatcgcgaacacgcggctctacgtgctcgacgagcacctgcgcctcgtaccggtgggagtgcatggggagctctatatcggcggggacggcgtggcccgcggctacctcgaccggccggagctgaccgcggagcgcttcgtgccggatccgttcggcgacgtccctggcgccaggctgtaccggactggggatcgggtgcgccgcttcccggatggagtgctggacttcctcggccgcagggacgagcaggtcaaggtgcgaggatatcgcatcgagctgggcgagattgagggggtgctcggccaggcccccggcgtccgcgaagtggtggtggtcgcgcgcgaggacatcgagggcagcaagcggctggtggcctacgtggtaccgaacgaaggcgcggacgtggagccagaggtgctgcgccagctcgctcgcgcgaagctccccgagcacctggtcccctcggtggtggtgccactggacgcactgcccctgtcgccgaacggcaaggtggaccgcagggcgctccccgcgcctgaggcgatcgcacgcgagtcccacgacgggtacgtcgcgcctcggacccgtgcgcaagccctgctgtgctccctcggagccgagctcctgcgcctggaacgggtcggcatccgcgacaacttcttcgacctcggcggcgactccatcctgggcgtgcagcttatcggccgggcgaaccgggctggcctgcacctgaccccgaagcaactcttcgatcaccagacgttcgatgaactcgctgcggcgtcgggtaccggtgggtccatcatcgcggagcagggactggtcaatggcgacgtcccactcaccccgatccagtgctggttcttccggcagccccaacccgccccccaccacttcaaccaggctgtgctgctggaaacccacgcgtccttccgctcggacctcctcaagccggcgctcctggcgctcctggcccatcacgacgcgctccggctgcgctttgaagaaaccgggcatggctggctccagcgctgcgccgagctggagcgcgcgccagtcgtgagcacgttcaatctctctggcttgtccccggaacatcagcgccgcgagctggaggccactgcggcaagcctgcaagagcgcctggatctccaacagggcccattgctgcgggccgtgtggttcgacctcggccaagggaagccggggcgcctgctgctcctcgcccatcacctggccgtggacggcttctcctggcgcgtcctgctggaggatcttcaagcggcgcaccagtccctccttcagggacgcgaaatccatctccccgcgaagaccacctcgtaccagcactggtccaaacggctgcgcgagtacgcagcctccgccgcccccgccttcgactactggcggcggatggattgctccaacgtggcaagactcccggaggacctgcccggagcatcggccgccagcgacaccgccgcggacgcccggacgtacaccgtggaactcggcgaggaggagacgtccgcgctcctccgcgaggtgcctgaagcgttccgctgcgggatgaacgatgtcctgctcaccgcgctcacctccgtgctggcgaactggacggggggccgaaggtggctcgtggacctggagggccatggccgggagccgctgttcgatgacgtggacctctctcgcacggtggggtggttcacctccatcttccctgtcctgctcgaagcccccgcgggtgacggcctcctggagctgctggagtccgtgaaggcccagctccagcgcatcccgaaccagggcatcgacttcggcgtcttgcgctacctgcgccaggatgacgccggtggcccccccgcggacaaagcgcaggtgctgttcaactacctggggcaattcgatcaggtgttcgcgggcgacggcctctttcaacccgcggaagagtcccctggcccgaccgtcagccctttggcgccgcgcacccacgcgctcgaagtcaacggactcatccacgccggtcggttgaggatcggctgggcttacagcgaggcccgccaccacgcctcgacaatcgcccgactcgcggagcgcttcctccaggtcctccgggagctcgtcgcgctcgcgcgcgcgggcgggcaccgggagcgcgtggcccgattcccgcttgcacggctggcaccggtgtctcttgagcgcctgctggcggaggcgcctggcacggaagacgtgtatccactcgtgcttggccagcgcgagatgttcgaacacacgcgagcccaccccggggcgtgggcttacttcacccagctctcgtgccaggtggtgggcaccttctcgccagaagccttcgtcgcggcctgccagcgtgtgatggagcggcacccggcgctccgtggctcggtggcgatggagtcgatggcggagccccaccagctcgtccaccgcgccccctcgctccccgtcgagcggctcgactggacgaagcgaacggacagtgaggcgcacatcctgctggagcaattcctcgaggcggaccgcgaggccggcttcagcacagaccggccgccactgctacggttcacgttcatccagctcgcgcctcaggcgtgccacctcgtgtggagcagccaccacggcatgctcgacggttggagcatgtccctgctgctagaagaggtgttcacggtctacggaagcctctcgcgcggtgtccccgtggagctgccaccgcgcccccccttccgggaactcgtcgcctggttgcagcgccagcagccctggcgcgccgaggaatactggcggcgcgagttggcgggtttggccggaccaccggcgacctccctcgccccagccggcgggcagcgaccgctggagcatgcgcggtatgcggaacgaacgctcgagatggcgccggccaccacaatggcgctccaggaactggcgaggacacaccggctcacgctgaacaccctggtccaaggtgcgtgggcactggtcctggccaatggcccccgcaccgaggaggttgtcttcggggtgaccgcggccgtgcgccccgtggacctcccgggtgtggaggacatggtcgggcacctgatcaacacgcttcccacgcgcgtccggctcgtaccgggcactcccgtcctcgagtggctggtccagttgcaagcgcaacaggccgagcagcgccagttcggccacgttccactctcgacgttgaggcgttggaccgggctgccggacgacagccccttgttcgacagtgtcctccgcttcgagaactaccccatccgcttcgtcctcgagcgcacggcgccggggttcacggtagaggccatgcgaatcatcgatcgctggccctacccgctgtcactcgtggcagtcccgggcccaccactgaggctcgaactcggctggcagcgcgatcggattgacgaagacacggccacccgtgcgctggcgcaaatgcagtacgtgctcgagcgtctcctcggggaccccggacagagactctgtgcgttgatggagggactccaggagtgggcgcccccggcgcgggttgaatcaggtagcggcgtctga

SEQ ID NO: 7815 - DNA, 633 bp, Myxococcus xanthus
atcatcaagcggtacacgaaccggaagctctacgacaccgtggagagccggtacgtcacccttgatgagatcgcagcgatgatcaaggagggcaccgaggtacggattgtcgacaatcgtaccaaggaggacctgacctccgtcaccctcgcgcagatcatcttcgaagaggagaagaagaagaaccagatgccgctgtcggtgctgcgggaaatcatccgccaccccggcgagtccatctccgggttcatccagaaggaggtctccccgcgagtcgcctccatccgcgaggaggccgagtcccgcctcgacaagctcctgcgccgggacgagaacgccccccgggcagagggagagcccgaggcccccgtcgccgccgccgaggacaccgccgccgcggacaccgctgccgccgcggggctcagcccggccgacctgctcaaggccagccagcgcgccttcgaggagtggcagcgccgaatcgacgagcgcgtgaagcacgtcgtggagaacctgaccggcaacctgcccgcgctcggccgcgacatggcctcgctcacccagcgcctcgatgagctggagaagaagctggagcaggccgagcagcagaagggcccgccgacgcaggagtag

SEQ ID NO: 7816 - DNA, 915 bp, Myxococcus xanthus
atggccggactactcgacaagcgcctgtggatcgtctccggcaagggcggagtcggcaaaagcaccgtcgcagcggccctggccctgcgctcggcgcgcgcgggcaagcgcaccctggtgtgcgaagtgaacacccaggagcgcgtcagccgcttcctggagcgccccgaagccgggcccgaagtggcccaactggagcagaacctctgggccgtcaacgtgcggccccaggaggccatgcgcgagtacggcctcatggtcctccgcttcgagaccctctacaagacggtcttcgagaaccggctggtgcgccagttcctccgcttcatcccgtccctgcaggagctggtgctgctgggaaaaatcatgttccacctgcaggagaagctcccggacgggcgctggcggttcgacaccgtcatcatggacgcgccggccacgggccacgccatctccttcctcagcgtgccgcaggtgctgattcagacggtgccgccggggcccatggcccgcgaggcccagaagatgcgcgacctcctcgtggacccggcggtgacggccgccgtgctggtggcgctccccgaggagatgccggtgaacgaggcgctggagctgcacgcggcgctgcgggacaaggtgagcctgcgaacgcacgcggcggtgctcaaccaatcctttccggagcgcttcaccgaagcggacctggaggccctggggggccatccggagctgctcgccgtggcccaggcgcaccacgaccgcgcggcacaggcggtgctcgccgggacgaagctggagcgcaacctgcacgcgcccgtctaccccgtcccccggctcttcacgcccgagttcgggcgcaaggcgattgaacaggtcatggagcacctcgaacctctcgtgacgggggcggcgtga

SEQ ID NO: 7817 - DNA, 1077 bp, Myxococcus xanthus
cgcgtcctcatctgcgtgggctccggcggcgtgggcaagacgacggcggcggccgcgttggccctgcgcgcgtcggtggatgggcgctccagcctggtgtgcaccatcgacccggcgcggcggctggccaactcgctgggcctcacggcgctgggcaacgcggagacgcgcgtccccgccaccgcgctggagcccctgggcgtccagccccgcgcgtcgctgtacgcgatgatgctggacatgaagcagacgtgggacgagctcatcacccgcgtcgctccgcccgagcagcgcgagcgcatcctgtccaaccgcttctaccagtcgctctccacggccctggcgggcagccaggaatacatctccatggagaagctgtgggagctgcgccgcagcagcaactacgagctcatcgtcctggacacgccgcccaccgcgcacgcgctggacttcctggatgcgcccaaccgcgtgctggacttcctggacaacgacgcggcgaagtggctcctcaccccggcgctcaaggccggcaagctggggatgtccctgttcaaccgcggcggctatgtcatgcggggcctggccaagttcaccggcacggagatgctccaggagctctccaacttcatgctcgccatctcctcgctcaacgagggctttcgcgagcgcgccaggggcgtgcgccaactgctggaggacccgaacaccggcttcgtgctggtgacgagcccccaccccgagcgcatggaagaagccatccacttccacaagatgctcaagcagcaccgcatggaggtggtgtcgctggtggtcaaccgcgtgcaccccatgcccacggaggcgctgtgggcggacgcggccacgctgacgcccagccgccgcgccaaggtggaagagacgctgcgcgagcagcaaatcctggccgagcaggaccgcaccggcatcgaccagctccaggccgcctgtccgggtgtccccatcgtccaggtgccccgcttcgcgatggatgtgcacgatatctccgccctgtggcgtaccggacgctacctggtaggcgacgagacactcggctga

SEQ ID NO: 7818 - DNA, 522 bp, Myxococcus xanthus
atggccgcgctgggcgtcgtcgtgtccgggtgccggacgacgggctccgccgcgcgggaggagccgcaggcgaagtcgcccaagcaggagttccacttcgacgcggtgacggtgacggcggacctggagctggacaagctcaacgacgaggagctcttcgcgggcggcacgtcggccttcgccgcgaacgatttccaacaggcggcgcgctacttcggccggctcgtggacttcttccccgacagccgccaccgccgcgcggcgctctacaacgcgggccttgcccaccagcgcatcaaggagtgggaggaagccggtcaccgcttctccgagctgtcggacccggccaggggccagggggacgcgttggacgcggccttccgcgtggcggaggtggactaccacctggagcgctacgaacaggcctcgaagctgctgggcatcatcgccgcgcgcgaggacctgcccctcaatcgccgcctcgaagcgcaagtgcagcagggcatctgccagttggagagc

SEQ ID NO: 7819 - DNA, 801 bp, Myxococcus xanthus
atgaggcgcatcgcgttcatcaatgagaagggtgggacctgcaagacgaccctggcggtgaacaccgccgcctggctggccaaggagcgtggcctgcgggtgctgctggtggacctggacacgcagggccacgcgggcaaggccctgggcgtggacgtgcgcaccttgccgcgcaacgtgtttcacctgctgacggacacgtcggtgcgcttcgaggacgtcgtccagcgctcggccctcgagggccttgacgtgctgcccgcgtacaaggagatggcggactttcccgtcgtggtggccgcggatgaacgtcgggcccaccggctggcggaccgcctgcgcgcggcggaagcggcgggctatgacgccatcgtcttcgacgcgccaccctccatggggaccaccacgcgcaacatcctggtggccgccaccgaggtggtggtgccggtggcgctgacgtacctggcgctggatggctgcgcggaggtagcggacaccgtgcgccaggtgggcgaggcggaagggcggccggacctccgcgtcacgaaggtggtgcccacgctgtaccggaagacggcgctggccacggcgattctggagcgcctgaaggcctacttcccggacgcgctggcggccacgccgctgggctacgacgtgaaggtcgacgaggcccagagccacgggcagaccatctgggagtacgcgccgcgcagccgaggcgcgcagatgctggccgccatcgccgcggagttgcacggagagcccgcccccaagcggaggcgggcgtcacagaaggcctga

SEQ ID NO: 7820 - DNA, 285 bp, Myxococcus xanthus
atgaagaagctcgtggaaacgggcgaggagcgcatcggcaagctggcgcagcaactgctctcgaacgagaagttcgtggcggcggtgcagacgctggtgtcgcgctccctggcggcgaagggcaccctggacagcgcgctgcgcacggccctgtccgccgcgaacctgccgtccaccgcggacctggagcagcttcgttcgaaggtggacgacttggagcgtctgctctcgtccgtcgagggcaaggtcgacacgctgctggcggcgaagtccccgaagaagtag

SEQ ID NO: 7821 - DNA, 906 bp, Myxococcus xanthus
gcggacgtggtggacttcaccgtgcccaagggcacatccgggcgtggcctgggcacgctgctcgaatcgcattggctgatccgcgacgcgcgggtgtggcgctggcacctgtaccggcgcggcagcttcgcccccaaggcgggccgccatgacgtcagcgcctccatgacgctggccgagctgtccacggagctggaaggcaaccccattcccgaggacgttccgttcgtcgtcgtcgagggctggcgcctgcgcgacacggacgcggcgctcgtggccgcgggcttcatcaagccgggcgcgtacatcgccgcggccagcaagcccaagaacttcaccgcgcccttccccctgccctccacgggcacgctggagggctacctctacccggagacctacggcgtgattccgggcaagttcgatgtcgaggcgctcatccagcgtcagctggacgccttcgcgcagcgcttcttcgcgcccaaccgcgataccatcacgaagagcggtcgcacgctgcacgaggtggtggtgatggcctccatgctggagcgcgaggagccgctgcccgaccagcgccccctggtcgccggcatcctgtggaagcgcgtggacaagggattcccgctcggcgtggacgccacgtcgcgctacgagctggcgcagtggaatgaccgcgtcgccttcctcaagcgcctgcgggatccgcaggacccgtacaacacgcggcacaagaagggcctgcctcccggccccatcggcgcgcccaccgtgtcctcgctccaggccgcgatgttacccaagccgagcgagtactggtactacctgcacgacgcgcagcgcatcctccgcccgtcgcgaaacgcggaggagcacgaggcgctccgccgcaagtacaacgtgtactga

SEQ ID NO: 7822 - DNA, 1062 bp, Myxococcus xanthus
ccagcgccgcccacgaattaagagaacccttccatggaaagcgccgcccccgactctctgcccgtgcccgacgcctcaggcgacgacctccgtgccgtcgaggagctcgcccaggcccgcaacgaaatcgtcgcccagattgaaaagcgcgtcgtcggtcagcgcgaggtggtggagcacctcctcatctccctcttcagccgcggccactgcctcttcgtgggtgtgccgggcctcgccaagacgctgctcatctccacgctggcggacgtcctcaacctgtccttcaaccgcatccagttcacgccggacctgatgccgtcggacatcaccggcacggacatcctggaagaggaccgcaccaccggccggcgcaccttccgcttcctccagggtccgctgttcgcgaacatcatcctggcggacgaggtgaaccgcaccccgccgaagacgcaggccgcgctgctgcaagccatgcaggagtaccgcatcaccgccggtggccgcacgtacccgctggagctgcccttcctcgtcttcgccacgcagaaccccatcgagcaggagggcacctatccgctgcccgaggcccagctcgaccgcttcatgttcctggtggacgtgggctaccccaccgccgacgaagaggtgcaaatcgtcaagagcaccaccggcggtccgcagccgaagctggagaagattctgtctcccgagcgcatcctcgcgcttcaagagctggtgcgccgcgtgccggtgccggaccacgtggtgcgctacgccgtggagctggtgcgccacacgcggcccaaggagccgggcgcgctggacttcatcgcgaagaacacgtcctggggcgcgggcccccgcgccagccagtacctggtggtggccgccaaggcgcgcgccatcctccacggccgcttcgtcgccaccgtcgaggacgtgcgcgccctggcccgtcccgtgctgcgccaccgcgtgctgcccaacttcaccgcggagagcgagggcatcacctccgtgaagctcatcgatcagctcctcacggtggtgaagggctag

SEQ ID NO: 7823 - DNA, 879 bp, Myxococcus xanthus
atgctgctcgacgcacagacgctggcccgcctccagggagtgaagctgcgcgcccgcgcggtgatggagggcgtgttgtccggcctccacaaaagcccgcatcaggggcagagcgtggagttcgcggagcacaaggagtacgcccccggcgacgagctccgccacctggactggaaggcctacggcaagttcgacaagtactacgtcaagcgcttcgagcacgagacgaacctgcgcgccgtcatggtggtggatgcgtccgcctccatgggctaccgcagcggcgcgctgagcaagctggacgtggccaccacgctggcgggcgcgctgtgctacctgctggtgcgccagcaggacgcggcgggcctggcgctgatggcgggcggcaagtggaaggacgtgccgccgcgcgcgtcggccgggcacctcaacgtgctgctggacacgctggagcacaccgagcccaccggcaccacggacctgggcagcgcggcggaccacctggcggaggtgttgcctcggcgctccagcgtcatcgtcctgtcggacctgctggatgagaatcaggacgccctgcgccgcatcctcgcgctgcggcagcggaagaacgacgtgtccgtgttccacctggtggacccggcggagctgacgttccccttcgacgaccccacgctcttcatcgacatggagggccagggccgcatcgaggtgaacccgcgcgaaatcaaggagagctacctggaggagttcaacgccttcctggcgaacgtgaaggccgcgtgcgccgaggcggacgtggactacgacctggtgcgcacggacgacaagctggatgacgtgctgctgcggtacctgtcgcggcgcgggaggcgccggtga

SEQ ID NO: 7824 - DNA, 897 bp, Myxococcus xanthus
atgcaactgttcctgacgggcgcgagcggcttcatcggcggctcccttgctcattcgctgaaggcccgcggccacgccatccgagggctggtcagggacaaggtgaaggcggagcggctggcggcgctcggcatcgagcccgtgctgggtgacttggaggaccgcgcgctgctgacagctgaggcgcggcgcgcggacgcggtcatcaacgcggccagcagtgaccacgcggaggccgtcgaggcgctcctggcggggctgcgcggctctggcaagccgctgctccacaccagtggttccagcgtgattggcgacgacgttcgaggcgaggtgctctccgacaaggtgttcgacgaggacacccccttcatcgtcgagcccgacaagcgggcccgtcacgcggtcgacaccagcgtgctcgccgccgagggaatgcgcggcatcgtcctgtgcaacacgatgatttatggcacgggcaccgggctcagcccggacagcgtgcagattcccccgctggtgaagcaggcgcgcaagagcggcgtggtgcgcatcgtcggcaagggcgtcaaccgctggtccaacgtgcacatcgacgacgtggtggcgctgtacctgcttgccttggagcgcgcgcccgccggggccttctacttcgtggagaacggcgaggcctcctacgcggagattggtgccgccatcgcccagcggctcgggctggggcccgtgcaatcctggtcggtggaggaagccagccgcgaatggggtgaaggccacgcgcgctactccttcggctcgaacagccgcgtgcgtggcaagcgcgcgcgccgcgaactggactggaagccccggcacgactccgtcacggcgtggattcgcgacgagatgccgctcggttga

SEQ ID NO: 7825 - DNA, 943 bp, Myxococcus xanthus
atgctgctgggcgcgctgggcgccctcatccccctgctggtgcacctgttcgaccggcgccgtccccggccgcaccccttcgggccgctggccttcgtgatgcgcagccagaagcgcaccgccagccgcctcaagctcaagcgcctgctgctgtacgcgctgcgcacgctcatcctgctggccatccccattgccctggcgcgccccgagctgacgcgggacgcggccgccgcgcaggtggtgaagggccccgcggccaccgccatcatcctggacgcgtcgctgtccatgcgctggtcggacggcacgccgctcttcgagcgcgcccgcgacgaggcccgcgacgcgctgaaggacctgctgcccgaagagcccgccaccgtgctggtgtgcacacagtcccccgccgcgccgccgccgccgggcttcgaccgcggccgtctgcgctcgctggtggatgaagcgaaggccacccacggcaccgcggacctgtcgcgctgcctggacatggcggcccgcgcgctggaggagaaccccatgccagccaagcggctggtgctggtctccgacatgacagccgcggccttccgcctggaggcgccgccgcccacggtgaagggccccacgggcgcgcccgtgaagccggaagtcgtcctgcgcgacgcggccgagggccacgaggtgctgaacaaccgcgccatcgtcgacctcaaggtggagcccgctctgcaggccggtccgcgcacgttccagttcaccttcacggtgcgcaacttcggcacggaagccgtgaaggacctggacgccgcggtgcgcgtgggcgagttcacgctggccaagggcttcgtggacatccccccgggcggcacgacgcagaagacgctcaccgtgcgcttcccgctgggcggcacggtgctggggcaggtgacgctggcgccggacg

SEQ ID NO: 7826 - DNA, 771 bp, Myxococcus xanthus
gtccttctcgaggtggagggtgccgtcgccacgctcaccctcaacgataccgcccgacgcaacgtgatgacgcccgagctgggagacgcgctgtgcgcgcgcgtcgccgagctgaaggggcgtgacgatgtccgggcggtggtgctcaccggggcgggaggcgcgttctccgccggtggggacctgaagatgctggagcggctgcgccaggtgtccttcgaggatgcgcgcgcgttcatgctcggcttctacgcgcgttacctcagcgtgctggacctgccggtgcccgtcatcgcggcggtggatgggcccgcgattggcgcggggctgtgcgtggcgctggcgtgtgacgtgtgcctcgtggccgaggactcgaagctggcgctcaacttcgtgcaactgggcctgcatccgggcatgggcgccacgtacctggcgccacgccgcgcgggggcgcaggccgccgcggagctgctgctcaccggccgccgcttcgatggcaaggaagcggtgaagctgggactggcgttggaggcggcgccggcgggacaggtgctcactcgcgccagggaactcgcgggacggattgccgcgaacgcgccgctcgccatgcgtgcgctcaagcagcggctggggctcgacagggcggagcttcagcgcgcgctggaggaggaggcgcgctttcaggcggagagctacggcagccaggacctgggcgagggactggccgcggcagccgcgcggcgcgcccccgtgttccaggggcgctga

SEQ ID NO: 7827 - DNA, 627 bp, Myxococcus xanthus
atggacaccgcgctgcacgcggcggcgctggcgccttcgggacagtcgattctggccggacagctcgtggacgcgctggaggtggacggccagacgttcggcgcgcccggtgtgcgcggcttcgtggtgctgacgttcgatgcgtccgggcgcttgctgtggggcaaggagctgccgggcgtgaagggccgcatcacctcggtgacggtgggcgcggatggcacgctcgtggcggcgggtgacttcatcggtctgctggtgtggggggatgcgtcgctcggttcctccggggccttcgtgctgacggcgggcgcggatggcagcgtgggttgggtgcgccagcccctgtgcgggccggtgacggagctgggcgcgtccgtcgcggtggaggatgcgggcggcgtcgcggtgacgtgtggcagcgtgctgacgcgctacgcggcttcgggggcgtggctgggggagcagacgctggaggcgcagccctgcgccagcggggtgtgctcgctgaccaccgcgggtgtggccacggtgccgggccgcgggctcgccgtcaccggctggcagcgcgacggggcgggcgacacctggaatcaggacgccttcctcaggctcgtggtgccgtag

SEQ ID NO: 7828 - DNA, 720 bp, Myxococcus xanthus
atggtggcggcctacgccgccgcgggcacgccggtgcgtgatgtggaggagctggtgctgcgccagacgcgcgccaacttctgggacccggaccccattggcgcggtgctcaacgcggacgcggcgggacacggcctgacgggcctgctcaagggtgagcgcttccgcaagctgctggatgccacgctgccggtgcgcaccttcgaggagctgccacacccactgctgctggtgggcgccaacctcacgctgggcagccacgacgtgttcacctcgggcgagctggccccgcgcgtccacgcgacgtgcgcctaccccggcctgttccgcgcggtccccctggagggcagcctgtactgggacggtggcctggtggacaaggcccccgcgttgtcgctgcacgagagcgccgtgggcgcggagctggacgccatcctcgtgcactacctgcccagcaagacgcgcaaggtggtgggcggccccatggcatacgcgcaggggctggccgcgggctcggcggcgctgcgccaggaccacttccgcctccagctcaccgtgctggagcagaagcaggtgcccgtctacgtcgtcgtctccaatctgccgcccgtgtctcccaccaccatggagcgtggcttcgacgcgctggaccaggcgaagctgggcgccgagcgcgccctggcgcggcctccggtgcccttcgcgcaggcggagtggtga

SEQ ID NO: 7829 - DNA, 447 bp, Myxococcus xanthus
atgctgtccctgtccgtgctcgccttcgccccctcggcggtagcggcgccgcccgcgaagtccctgaagccgcgcgcactcgccgccaagcccaccggccgcgagctggccggggacgcctacgtggagcgcatcgtggtgaaattccacgaaggcagccgggtgcgcctgcgcgaccagcagttggtggccctgtcgtcggaccgggacgccgcggagcgctcgctgctggccggacgtgggctgggcgacgcgcgcctggaggcggacctgggccatgtgacgtcactgctggagcgcgcgccccgcattggcgccatggcccgcttgttcgacgaagccgagtccaccctggaggcgcgcaaggcctccggggagcggaagagcggtgagcaactggcggacctgaacatggactttcaagtccccctgatgccgggcaccacg

SEQ ID NO: 7830 - DNA, 2304 bp, Myxococcus xanthus
atgcgtgagcgagtgctggtgctggatggtgccatgggcacgctgctccagaacgaggacctcaaggcggcggacttcggcggcccggagtacgaggggtgcaacgagcacctcgtcctcacgcgccccgagctggtggagagcatccacgcgcgctacttcgcggccggcgcggacgtgacggagacggacagcttcggcggcacgccgctggtgctggcggagttcggcctgggccacaaggcgctcgaaatcaacgaggtctccgcccggctggcgcgcaacgccgccgccgccgccgaggcgaaggacggccgcatgcgctgggtggcgggctccattggccccaccaccaaggccatcagcgtcaccggcggcgtcaccttcgaggagctggtggacaacttcgcggtgcaggccgaagggctcgcgctggggggctcggactacctgctgattgagacggcgcaggacacccgcaacgtgaaggcggcgctgttgggcgccgagcgcgcgttccagaaactgggctacgcgctgccggtggcggtgtccggcacgattgagcccatgggcaccatgctggccgggcagagcgtggagagcctggccgcgtcgctggagcacacggacctgctgtacctgggcctcaactgcgccacgggcccggacttcatgacggaccacctgcgctcgctggcgtcgatgagcgcgttccccgtggcatgtgtgcccaacgcgggcctgccggacgagaacggcaactacctggagacgccggagatgctggcgcgctccgtgcggcgcttctgtgagcagggctggctcaacgtggtggggggatgctgtggcacgcacgcggggcacatcgagacgatggccaaggcggtgcaggggctgaagccgcgcgcgggctcgccgcgtccccgggcctcgctgtccggcgtggactacctggaggtgacggacgagcagcgccccctcatcgtgggcgagcgcaccaacgtcattggcagcaaaaagttcaaggagctcatcgtcgccggccagttcgacgacgcgtcggagattgcgcgcgcgcaggtgaagcggggcgcgcaggtcatcgacatctgcctggccaacccggaccgcgacgaactcgaggacatgcgcaacttcctggaggcggtcatcaagaaggtgcgcgtgcccttgatgattgactccaccgacgagcgcgtcatcgagatggcgctcacctacagccagggcaaggccatcatcaattcggtcaacctggaggacggcgaggagcgcttcgagaaggtggtgccgctggcgcgccgcttcggcgcggccctggtggtgggctgcatcgacgaggtgggcatggccgtcacgcgccagcgcaagctggaggtggcggagcgctcgtacgagttgctgacgaagaagtacggcatgaagccggaggacctgtacttcgacccgctcgtgttcccctgtgccacgggggacgcgcagtacatcggcagcggcgtggagacgattgaaggcgtgcgcctcatcaagcagcgcttcccgcgcagcaagacggtgctgggcatctccaacgtgtccttcggtttgcccgccgcgggccgcgaggtgctcaactccgtcttcctgtaccacaacgtccaggcgggcctggacatggcgctggtcaactcggagaagctggagcgctacccgtcgctccccgaggaagagcgcaagctgtccgaggacctgctctacaaccgcggcgcggacccggtgacgcccttcgcggcggccttccgtgagcgcaaggccgcgcgggtccaggtgagcacgctgccactggaggagcggctccagcgctacatcatcgaaggcacgcgtgacggcctcaccgcggacctggaagcggccatgcagaagtacacgccgctggagatcatcaacggcccgctgatgaagggcatggacgaggtgggccgcctcttcggcgccaacgagctgattgtcgcggaggtgctccagagcgccgagtccatgaaggcggcggtgagcttcctggagccgcacatgagcaaggcccaggcggccatgcgcggcaaggtggtgctcgccacggtgaagggcgacgtgcacgacatcgggaagaacctggtggaaatcatcctggccaacaacggcttccacatcgtgaacctgggcatcaaggtgccccccgagcagttggtgctggccgtgcgcgagcaccagccggacatcctgggcctgtcgggcctgctggtgaagagcgccatagagcac

SEQ ID NO: 7831 - DNA, 900 bp, Myxococcus xanthus
gatatggaagagctgtctcagtcattcagggtgctcggagacccgacgcggctgcgcatcctccggttggtggcagaggccccgttgaacgtgacggagctggtgtccctggtgggcgtggcgcagtcgtccgtgtcccatcacctgggcaagctgaagggcctgggcctgctgcgcgaggagcgccacgcgggctacagctactactcgctggccttggagcaggcggacgggcgctggccgctcatccagatggcacggcaggcggaggacgcggcgggggactcggcgcggctgaaggatttgctgcgggcgcgcgaggaccggcaggccctcaacgaacggctgctggagccggggcagtcgtggttcctgtgggcaggcgcgctggcgtcgctgctgccgccgctggaggtggccgacttcggctgcggcaccggcgtgctgagcgtggccattgcccgctgggcgcggcgcgtctgggccattgaccagaacgcggacgcgctggaacaggcgcgggagcgggcgggccgcgagggattggagaacatccgcttcctccgcgaggacctgcaccggctgtcgctcgcgtccggcagcctggacctggtggtgatttcgcagagcctccaccacgtggaggagccgcagtcggtgctgtccgagtccgcccgcctgctcaagccgggcggccggctggtgctgttggagttgatgccgcacgaggagcgctgggtactggaacggctgggccaccggcacctgggcttcgcgcctgaatccctcgaagccgcgctgcgcgaggccggcttcacgtccctgacccgggagacacacgcccgggacggggccagtccctttcgtgtcttcctgctgactggagtcaaaccgtcatga

SEQ ID NO: 7832 - DNA, 711 bp, Myxococcus xanthus
atgcgggtcgcaggcgcgttggggcaggggctgctggtggccttccggttgatgggcgtggggctttggggcgcgctgaaaggcggagcgctcttcggtctggtggggttggcggtgggcgcggccacctacgcgttgccccggtggctgggcgttccgcccgcgcccacgtggctcgtcattctgggcgcggtgttgccgccgctggccctgtcggtggcgggcggctacgcgttcatgctgcaggccgtgtcagggcggctggccgaggcggccaagtcgcggggcgtggtggcccgcgtctattccgtgctcaagcccgtcacggcgcaggtggcgcggcggctccaaggctcgggctcactgtcgcgcgaggagttgtcgcgcgtcgtgaacgagtcgatgagcgagcatctgcggcaggccgagcaggcccggggtgaagcgccgtcctcgcgcatggcggaggtggagcgcttcctcatggagcagtcccgccgcgtcctgggcgtgctggcgctgcgcgccgtcgtctccgcgccggacaccgccaccgcggtgcggaacctggagacgctgggcatcgagcgcgtggagatgatgctggtggagtcgctggaggacctcttcttcctccaggtgctgctggccttcggggcgggcgtgctcgtggcggccacgcccgcgctgctcatggtgtggctgcgctga

SEQ ID NO: 7833 - DNA, 312 bp, Myxococcus xanthus
atgcccgtcatccaccgggtgctctttcccgccacgccccaggccacgctgacgcccgcgaaggcgctgttgggctgtgtcgtcggcccgggggacgtgccgattccgggcgcgctcgtcgaactgcccacgctgaagctcaccacgcgcacggatgccaagggctgcttccgttttcccagcgtgccccccgtgcccacgctgggacggctggaagtgcgcgcgaagggtgcgctgctcgagatgggcctggaggtgcttgccgccgagccccagccgctgctcatccgcctgccgttgaaggaggagtga

SEQ ID NO: 7834 - DNA, 708 bp, Myxococcus xanthus
atggcggtggcgacgttcatcctgctggggacggtggcctccctgctcgccgcgggcagggcgaggcagcccagccctggggcgccctgtccggatgggcattgtggcaaggggctgacgtgcgcgaagcagctcgatgggggcgtgtgcctggcctcgcaaggccagccctgtgaggcgggctcccagtgcatcaccggcttctgtgagcccggcgtggggtgcacggtgccgctgggaaaggactgcgtctccccggaggactgcccgggcgcgctgacgtgtgccgacgtgctgggctcgtccgtctgtctcctcgagccgggagaggactgcgagcacgaccgcgactgcgccagcttcttctgcaacgcggagcgcaaatgcaaccgcgatgacggacgctgtgacagcaacgccgaatgtcattcgcccacgcagtgtggcgcgacgaagctgtgccagcttccagatggacagccgtgcatgcggcacgaggcctgcctctccggttactgctcggagacctgccagatatcgccggagtccttccagtgcgagtcaccgtgccccgcgtacaccgcatgtgtgtcgggaagctgcacccccgtggacggcaagctcctcaaccagaacatgctgctgacggcgcctcgaatcctcaagggcatccgggagctgcgcatccagcagggcacccagccgtag

SEQ ID NO: 7835 - DNA, 498 bp, Myxococcus xanthus
atgcgcacccacactgaggccattccctacgaagtccaccgcgatgacgggctcgtcgcctccgacgaccccgcgcgcatcgacctggacgtcgtccatggctacctgtcccgctcatactggtccgcgggcattccccgggagacggtcgagcgggccgctcggaactcgctcgtcttcgggctctattcgtctggaggccaggtgggctacgcccgcgtcgtcaccgaccgcgcgagcttcgcctatctttgtgacgtcttcgtcctggagccgtaccaggggcggggcctgggccagtggatgatggaggcgctgctcgagcatcccgacctgcaagggcttcggcggttcttgctcgccacgcgagatgcccattcactctatgcgcgttgcggctttcagccattgggcgcgcccgcgtccttcatggagcgccatgacccggacgtctatgtccgaaatcgagaagagggcgcgaaagggaaggcagattga

SEQ ID NO: 7836 - DNA, 459 bp, Myxococcus xanthus
atgacagctcccgtccagctcgacgcgcccgacatccaggatgtggtgcagagccggacgttggggctggcatatgtcggcacggtgctggtggtggcgcacaacgcgcagccaccggcccccgacgactgggcgcgctactgcgagctcatcgcgcgtcaccaggacacggccaccgggcagctcgtcctggccgaagggcccgggcccaatgccacccagcggcaacaggcgctcaaccaggtgcccaaggactacgtcattccgcccacggcggtgttcaccgagtccccactggtccgcggcgtcgtgacgctcttcaactggttcagtccccgggccatgcgcgccttcattccgggggacatcccgggcgccgcgcggcacctgggcttgagcgaagaacaggtgcggcggctggtggacatcggcaagacggtgcggccggcactgcagtga

SEQ ID NO: 7837 - DNA, 801 bp, Myxococcus xanthus
ctgccgaacaacaccgtcaccgtctggggctcggccgaccccctgaatgatgtcactccgattccagcggggctttccgatgtcgtgagcgtgggcgcggggatgaccttcgctgtggccctgcaggcggatggaaccgtggtcaagtggggaggccccgaccccgtcccggtgcccgcgggcctgtcggacgtcgtggacatcagagcgagcggagtcctggccctcgcgctcaagcgggatgggacggtcgtggccatcggtgcggaaatcgacccgcagacgcatgtccctgaagggcttcaggacgtagtcgcggtgtccgcgggggcgtaccacggcatggcgctcaaggcggacggcaccgtcaccgtctgggggcaggacgtgttcgacctcctcgtcgtcccggcggacctggacgacgtcgtggccatctccaacacgagcagcagcgcactggcgctgcgggcggacgggaccgcggccgtctggggatttggcgcggcgtactacgacctcgcgctcaccccggacctcagcgacgtcgtggatgtcgcggcaggcgaacaccactacatggcgctccggtccaacggcaccgtcgtcgcatgggggaatagcgcctttggccagacgacgctccccccgggattgacggatgtcgccaccgtcgcgggccaggccttcaacaagagcctggcgctccggcacaacggcaccatcgcggcctggggagacaccacctccgcctcgagcctacctccgccgggcctggtcctccgcgtccctgcccggtag

SEQ ID NO: 7838 - DNA, 744 bp, Myxococcus xanthus
tgacggggaccgcttcgggggcaggcacgcggcagactttctgtgcggcccggcagattccccgttgggtactcggtggtgaacaccgactgcgacgacacggcccccctcctctggaggctcctggcctactcgcaccgggatgcggacggtgacagcttcaccgcgccggaggtgggcacggtgtgctcgggcatggcgctgccgcccggccatgccaccacaccacgagggaacgactgcgacgacgcggacccgagcatccacaccaccgtccaggcgtggacggatgcggacggggacggcgtgggcgcgggagacgcggtcgcgctgtgcacggatggcacggtgcccgcgccgtggtcggcccgggggacggactgcgcggcggaagacgcggcgcgctggcgacaggcggcctacgcgcatgtggaccgggacgcggatgggcacacccaccccgaagcaggaaccgtgtgcaccggtgcgtcactccccgagccctacttcacccaggccacgggcaatgactgcgatgactcggacgccgcgcgctatcgttggacggttctctaccccgacatggatggcgacggcgtgggcacctcgccccgcacgattccctgcatcggcgcacagacgcccctgggcttctccctcaagggatacgacgtggacgactcggacgcatccatccaggaggaccccgaggacgacctgatgttggaacttatcctcgactag

SEQ ID NO: 7839 - DNA, 732 bp, Myxococcus xanthus
atgagcggctttgtcgacctgcattgccatctgctgcccggcgtggatgacggggcacgcacgctggaagacgcgctggagatggcgcgtgcgctggtcgacctcggcttctccaccgtcgcccccagtccgcacgcgcgccccgagtacgcccccgtggaggtggtggacgtgcgccgtgcggagctggcggaggccctggagcgcgagcgcatcccgctggcattggggcgcaacgcggagaacgtgctcgacgatgccttcctgcgcggcctcagcacaccccaggcccgcaagttgggcccgggccgctacgtgctcgtggagctgccctacaccgcgcccgtccccgcgctgccggacatcctcttccgcatccgtaccaagggcgtggtgccgctgctggcgcatcccgagcgctgcctggagttcgagcggaagggccgcgccgcggaggccgtgcgagctggggcattgttgcaactggatatcggtgcgctcatcggccgctatggcggcacggcgaagaagctgtcccgcgccttcctggacgacgggctctatgcggtgggcgccacggacctgcatgggcccgtgggggcccgggactgggtgggacgctcgctggcggagctgcggagcagggcaggggaggcgagcttcgcccgtctcatgagggacaatcccgcgactttgttggccggggagtcactggagtccgacccggactga

SEQ ID NO: 7840 - DNA, 1017 bp, Myxococcus xanthus
atgtggtgggccttccgggacacggattgggcgacgcagctggccagcctgaagtcggccaactacgcgtggctggtgccgtacttcggctgcctgttggccatccacgtcttccgcaccctgcgctggggctgccttctgtcgggcctggagcaggtcccgttccgaaagctgaatgaggcgtccggcatcggcttcatgatgctgctggtgctgcccttccgcttgggcgagttcgcgcggcccttcctcatcgcgcagcgcagtggcatccgccgcagcgcggccatgacgtccgtggtgctggagcgcatcgtggacggcctcttcgtggcggcgatgctgcgagcgctgctcttcttcgtgcccacggagacgccggagattcgctacgtcaagctgggctcgtggctgatgttcgcggtgttcggcggcggtctggcgttcctccttttcggcctctggcagcagcagcgcacggtgaatctggtgcgcgccaccgtgggccggctggcgccgcaggtggcggacaaggtggcggacatcgtcgacaccttcgtgggtgccatgcggcagttgccgaaggggcggcaggtcgcgctcttcttcctctacacggggctgtactggggcgtgaatggcgcggggatgtccatgttggccaacgccttcgactgctcgggcgcggcgcccggcaccgtctgcgagcccatggacctgacgctcttccaggcctacgtcgtgctgggcgtgctggtggtggggctgatgattccggcggcgccggggatgatgggcaccttccaggcggccacgaaggtgggcctgagcctcttccttccggccgccgcggtgaatgcgagcgggctggcttacgccaacgtcatgtggctgagccagacggtgcagcaggtgggcctgggcctcatcctgctgtcgatggggcacctgtcgttcaaggacatcgccggcaagctggacgacaaggacggcgaggcggcggcaccttccgcctga

SEQ ID NO: 7841 - DNA, 705 bp, Myxococcus xanthus
atggctacccacttcgaccccagcgccgccgcccagccggactccggcgtgttcggcctcccccactccccggaagaggcgcacgtcatcctcatccccgttcccttcgaggccaccaccagttacggcggtggcacgtccgaggggccaaccgccgtcctggaagccagccggcaggtcgacctcttcgacgtggagacgggtcgtccctacgagcgtggcatcgccatgctccccgagccccaggagctgcgcgactggaacacccgcgccaaggagcgcgcccaggtcgtcatcgaggccggtggcatccactccggcgaggccgcgctgattcaggccgcgcaggacgtgaatgtcctctgcgaccagatgaacgagcacgtctaccgcaccaccaagcactggttggaccagggcaagcgcgtggccgcggtgggcggtgaccactccatctcctacggcatcatccgcgcgcacgcggagaagtaccccggcctgggcgtgctgcacctggacgcgcacgccgacctgcgcgtggcctacgagggcttcacctggtcccacgcgtccatcatgtacaacgtcgcggagcgcatccccggcgtgaagacgctggtccaggtgggcctgcgcgacatgagcgcggaggagtaccagtacatcgcggactcccaacggccgcgtgcacggctttcttcgacg

SEQ ID NO: 7842 - DNA, 495 bp, Myxococcus xanthus
atggagagtgtcttagtcgaagagtactcggtcaccatcgaccagctggacgcgggcatcgcagagcacggcaacacgaacgccccgcttgtgttcgccaccatcgacctcatcaggcaggtcgccacgcgggcccccgcgagcaagacactcaagaaggtgtccaagaaccccttcgtccaccacggcgacctcgtggtggagggccccctgaaggtgctgtcgctcctggtgacggggaacctgacggtgaagggcaaggcgtccaacttcgaagggtgccagctcttcgtgggcggtgacttcgaatgcgacaccttccagaccgagggccccgtcatcattggagggaacctcaaggcctcgaccgtcgacgccttctacaacgactacagcctggacgtccggggcgtgctgacggcggaccggctggtgattgagaaacatcaggtgctggccgggcgtttcgacgtcaaggaacgcatcgagaagtaa

SEQ ID NO: 7843 - DNA, 342 bp, Myxococcus xanthus
atgacggagcagcagcaagagctcgaaaagctattccggcagatcaacgacctccactacatccagacctatcaccgggtcgaaatgccggaggccgagtaccggcagagcctggccaaggcggagcgcaagaacgccgaggtggtgactcaaatccgggcactgctcgccagcggcgtcagcctggacttcaagaccatcaacgggcactcgccgatgatgatcgccgtgccccagaacaacgtcgacgtcatccagttgctcatggagtacggcgcacgacatccgggcgggttcgaactacgagttcccgattcaccgggctgcggagttcggcgctga

SEQ ID NO: 7844 - DNA, 990 bp, Myxococcus xanthus
atgaaggtccttcgcatcacccgtccgggaggccccgaggtcctcgccgaggaagaacgccccgagcccgtcccaggcccaggggagattctggtccgggtgcgggcgtccgcgctcaaccgagcggaccttctgcagcttcgtggccactaccccgcgccgccggacgtcgcaccggacattccaggcctggagtacgcgggcgaggtggtggccgtgggcccgcgcgcacggcgcttccagcccggcgaccgcgtcatgggactggtgggcgggggcgcgtggtcggacctgctcgtcacccacgagcgagaggcgatgcccatccccgacggcatggacttcaccgacgcggcggccattccggaggcgtacctcaccgcgttcgacgcgctggtgctccagggcgagctcaagcccggcgagacggtgctcgtccacgcggtggccagtggcgtgggctcggcggcggcgctcatctgccaggccatgggcgcgcgcgtggtgggcacgggccgcaacgcggcgaagctggcccgcgcggccgcctggggcgtggcgcgcacggtcctgtgtgacaccaggccgccgcgcttcgccgacgcggtgcgcgaggagacaggcggccggggcgcggacctgtgcctggacctggtgggcggcggctacgtgccggagacgctgaacgccctggcgccccgggggcggctgatgctggtggggctggtggcgggcgcggccaccgaggtgaacctgggcacggtgctgacgaagcggctgcgcatcaccggcaccgtgctgcgcagccgtccgctggaagagaagatcgcgctggcgcagagcgcggagcggcatctgttgccgctgttccgcacaggggcgctgcggcccgtgatagacgcggtggtgccgcgcgcggacatccggcaggcgctggagcgcatggccggcaatgactcggtgggcaagctggtggtgcgctgggcgtga

SEQ ID NO: 7845 - DNA, 492 bp, Myxococcus xanthus
atgcgtctcccgattgtcagcgccgcactcgcgctcgccgccgccggctgtgccacccctggcttcgacaagctctacccgggcatgtcgtcccatcaggtcgtcgatgccatgggctcaggacccacgcgcgcgcaggagttcccggacagctccaccgcctggtactacggcgaggaccgctgcgtgctgatgcgcgacgacaagctcgtcgccaaggccacgtccgaggactccaccaccatcaacacccccgtcgtctccgtgcgcgacacctcgaaggccctgtgcgcgccagagggctacgcctcctcggagaagcgggagcaggtcatcgacacgccgttcggcaccctcaagggcaacatcgacccgaaggccgccatggagaaggtgaagggtgtggtgacgggcaagagcggtgacaccgcccccgcgaagacgggagccgctcccgcggagacggagcaggcgtcgacgcccaccccgtaa

SEQ ID NO: 7846 - DNA, 579 bp, Myxococcus xanthus
tcccaggccatgaaggcggcgtggctggaggacctgctcagcctcattccgcccatctccttcctggtgggcagccgggtggcgcaccggaagccctccgccgagtacccctatggctaccaccgcgccgtcaccgtggcgtacctggtgggctcggtggcgctgctcttcatggggacgtggctgttcgtgaagtccgtgctcaagctggtgcgcgccgaatacccttccatcggtaccacgcagctgttcggccacaccgtgtggatgggctggctgatgctggcgaccctgctgtggtaggcgattccgtccgtgttgctgggatgggcgaagctgccactggcggagtcgctccacgacaaggtgcttcacgccgacgcgctgatgaacaaggcggactggctcaccgcggtcgccgccatgttgggcgtgctgggcatcggcatgggctggtggtgggcggacccggtggcggcgggggtcatcgcgctggacatcgcctgggacggacagcggcacctgcgcaccgcgctgggtgacttgatggaccgcacgccgcgcacgctcgactcgaag

SEQ ID NO: 7847 - DNA, 921 bp, Myxococcus xanthus
caggccgtgggtcccactccgctcgtccccgtacgtctccacgaggagggccccaccatctggtgcaagctggagttcctcaaccccagcggctccaccaaggaccgcatcgcgcgctacatgctggagaaggcgtggcgccagggggagctcgtccccggcggcgaggtcatcgaggcgtccagcggctccacgagcatcgcccttgcgctggcttgcgcccagatgggcctgcgcttcacggcggtgatgccggagggcgtcaccggggagcgcatcctcaccatccgcgcctatggtggtgacgtggtgctggtgccgcgcgaagccggcgtgcacggcgccatcgtgaaggcggaggagctggcgcgtgagcgcaaggccttcgcgccgcgtcagttcgagaacctggacaacgccgaggcccaccgggtgtggacgggccaggagattctgtcgcaaatcccgggcgggctggtgcacggcgtggtcagcggcgtaggcacgggcggcaccgtggtgggcctgtaccaggccttcgcggaagcaggctgtccggtgacggccttcgtggcgcgccccatcgccggcctgggctgcgacatcgaatgttgcagcttcagcccccgcgtcccgggcgtggtggatggcatgtcccggctgtaccgcgaggccgacatgccgggccgcgttgaaatcgacgtgtcggacgacgtcgccatgagcaccgccagggcgctcatccgccgcggcttcccggtgggaccgtcgtccggcctcaactacgtcgccgcggtggaagccgcgaagcgactgggcccgggggcgcaggtggtgacggtgttccccgaccgcatggagcgctacttctccaccgagctcatccagcctaagcccgtgccagcacgcggcgcggcatga

SEQ ID NO: 7848 - DNA, 408 bp, Myxococcus xanthus
atgctcgtccgagtcctgacagtactggtggtcctggggctgcctcccatcgcgggggcggtcgaggggctgttccatttctgtcagggcacggtgaagctggacctgacgtgtgtctgcccccagtcgaagcggaccaaggccgcgcccgacactcaggaagcaggcatccgtggcaaccaccacgactgctgcggcgaactcgccgtgcagctcccggcgccggagcccgtcaccgcgagttcacgccatgcgtgggcgctgacacctctggcagtgcttccccaggctgtccccgtggtgccgccagcgcccgaggccctgcccacgtcgtgggtgcgcatccggggcgtgcatcacgccaccgcgccaccgctgtacctgcagcactgctcctacctcatttga

SEQ ID NO: 7849 - DNA, 1068 bp, Myxococcus xanthus
atgctgacctatgaggtcgcgccgctgagcatcactggcagcgtgcccttcggacaggtcgtggggctgagccaacagctccccttccccggcaagcgcggcctgcgaggggagatggcgctggcggaagcgcaagcgatgcgtgaggaccgcgaggccctgcgtctgcgcctggcgctcatggcctccacgctcttcgatgacttgttcgtcgtggagcgctcgctcgacgtcacggcggagcacctgcggctgctcgggcagctcaagaagagcgcggaggcccaatacgtcaccggccgtgcctcgcagcaggatccgctccaggcggaggtggagctgagcgaggtgctgcgcgaacaggtgatgttcgaagccgaacgcgagaggcttcgcgcccagctcaacggcctgctgcaccgcgccccccaggcaccgctgccgccgctgccggaagccatgcccgcgcataccgcggagtccgtgcccgccgaacggctgcaagacgaagcgctgcgcctgcgcccggagctggagggcctgcgggcccggctcggtggtggcgaggccgccgtccggctcgcgaagcgcgactactacccggatgtcatggtgatgggtgagtacaactccatgtggatggacacgccccaccagttcatggcgggcgtcaccatcaacatcccgctcgacttcggcaagcggaaggccgctgtgcgggaggccgaatccggcctgaagcgcctgcgccgggaggaagagcagctcatctccgacatccgcgtcgaggtggagcaggcgcgctcgcgtgccgaggaggcgcggcgcgtggtggcgctcttccaggagcgtctcatccccgcggcgaaggaccaggtgtccgccgcccgcgcgggtttcgagagcggcaagaacagcttccaggtcctcatcgaggcggagcgcggcctgcgccgcgtggagctgcgtgaacagacggccctggcggacgtgcagcgccgccgggcggagttggacaaggccatgggccacaccccgggactgccccggaacggagagacgcgatga

SEQ ID NO: 7850 - DNA, 1239 bp, Myxococcus xanthus
atggtggagggggtgaatcagtggctccagcgcgagcccaagctggagaacccgtacatgggccggcgcatgctggcgtgtggcaccaccagcgagtggcgctcggccgctcccgcgggtgctcacggcgagggcgatatcgcgcactacacctgccccatgcacccgtccgtgaagcagcacggcccgggcgcgtgccccatctgcggcatggacctgacacccgtcagccgcgccgagctgcagagcggcatcatccgggtggacgacctgcggcggcagcgcatcggcgtgaagacggcgaaggtggagcagtcctccatggacctgtccctgcgcgcgctcggccgcgtcaccttcgacgagaagtcactggtggacgtcaccctcaagctggacggctacatccacgagctgcgcgtcaacgccacgggcgagccggtgaagaagggcgacgtcctcttcaccctctacagcccggagctctacgccgcgcagcaggagtacctgctggcgcgtcagagccagagcgcggccaacgcgtcgctcgtgggcgcggcgcgcaagcggctggaactatggggcctgtccgcggcgcaaatcgagcgcgtcgcccagcgtggccagccggtggagaacatgcccttcctggcgcccgccagcggctacgtgctggagaagaacgtggtggagggcgcggcggtgaaggccggtgagcgcctgttccgcatcgccccgctggcgaaggtgtgggtggaagcggatgtgtacgagcaggacctggcgcgcgtgaagccgggccatccagtggaagtcaccctgccctacctgcctgggaagaaatacgcgggcagcgtcggctacgtgtacccgtccctacaaggcgccacgcgcaccgggcgcatccgcatcgagctgcccaacccggagctggagctgaagccggacatgtacgcggacgtccgcttcctcctgcagggcggcgcgccgcgactccagattcccgactcggccgtcatctacaccggcccgcggcggctggtgttcgtggacctgggcgagggacggctgcggccccaggaggtgaagctcggcatcaagggcaacggcacctacgaggtgctggagggcctgtcgcccggcgacgtcgtcgtcaccagcggcaacttcctcatcgcggcggagagccgcatccgctccgccacggatgacttcggaggcagccatgcagcccactga

SEQ ID NO: 7851 - DNA, 230 bp, Myxococcus xanthus
atgcagcccactgagaacggcgaacagggcttcatcggccgcatcatcggcgcgtgcgcgcgcaacccgttcctcaccatcctgctggtgggcggcctggcggcgtgggccgtccacgcggttcgcaacaccaagctggacgccatccccgacctgtccgacacgcaggtcatcgtcttcaccgaatggatgggacgtgggccggatctggtcgaggaccagatcaccta

SEQ ID NO: 7852 - DNA, 972 bp, Myxococcus xanthus
tccgcgccgctcgagcgggagctgctggtccgcatccatgacctcatggtgaagacgcgcgtcctcgaggagcgcctcatccagatgtacaagcaaggccacggatacttctggattggcggccccggcgaggaggcgttcaacgtctccctgggcctgctcatgaagaagggccagggccccgacttcgactatctgcatgcgcactaccggcagtccggcaccctgctcgcgctgggtgaggagcccatcggctccctgcggcagatgaagaacacggccacggacccgtattcgggcggccgcaacttcgcgggccactactccgcccggaagtacaacgtggcgccggtgtcctcgcccatcgaggtccagtacgccatcgccccgggcacggccatggtgcagaagcgccacggcggtgacggcatcaccatcgtcaccggtggcgacgccggcacggccgagggcgatttcgcctcgtgcctggtgtggagcagccgccccgccaacccgctgcccatcctcatcatcgtcaccaacaacaagtggggcatctccacggcggcggagggccagcacggcgagcagcgcatcagcgaccgcggcaaggcctttggcatccgcagcaagaccatcaacggcaacgacgccgtggaggcctacaccgagctgcgcgaggccatggcctacgtgcgcacggagcgcaagcccttcctcctggaggccaacgtgtcgcgcctgtacggccactcgtccgcctccggagccaactacgtgagcaacgaagtcgactgcctcacggacttcgaggcgaagctggagaaggacggcgtcctgacgcgagagcagatggacgcgctgcgcaacagctacaccgaggagatggccgccgccgcccgacaggtgcgcgacgagccacagcccgaccccgaatccatctggaagcacatctacgcggaggacaagtaa

SEQ ID NO: 7853 - DNA, 1059 bp, Myxococcus xanthus
atggcgaacatggcacaggccatccgcatggccctgcactacgccgaggagcacctgggcgtcaccgacatcttcggcgaggacgtgggcgcccccctgggcggcgtcttcacctgcacgcagggcctgaagacgacgtggaactctcccctggacgagcgcggcatcatcggcgcggccatgggcatcgccatggccggcggacggccggtggcggagatccagttctgcgactacgtctacaacaccatcgacctgctgaagctggcgggcaacaccagctggtccaccttcggtgactggaacctgcccatggtggtgcgcacgccggtgggcagcggcatccgcgggtccatctacctctggcactcgttcgacgcgacgatgacccacatcgccgggtggaaggtggtcatgccctccacgccgctggacgcgtacgggctgctcatcaccgcgtgccaggagaagaaccccgtcatgttcctggagcccaaggcgctcctgcgcgtgaagggcgaggagcggattccgggcgagccggaggatgaccgcgcgctgtcgaagctcatcgacgcgccgctgggagaccgctcccagtggaagccgcagtggcccacgggcctggaggcgtacgcggtgcccttcggcaagggcaagatcgtgcgcgagggcacgcagctcaccgtggtgagctacggccgcaccctgcccctgtgcacgaaggccgcggagacgctggccgcggacggaatcagcgcggaggtcatcgacctgcgctcgctgtggccgtacgactgggagctcatcaaggcctccgtccagaagacgggccgcgtcctcttcgtcaacgaggacaccgaagtgacgaacttcggcgagcacctggtgcgccgcacggtggaggagctgttctactcgctgctggccccgccgcggctgctggccggcaagttcctgccgggcatcggcctggcggacgcgctggagatggcgtcggtgccgcaactgggtgacatcaccaccgccatccggtcgctcgcgggcgagcagccgtaa

SEQ ID NO: 7854 - DNA, 402 bp, Myxococcus xanthus
atggcgtcgctcctcaaggagctgggctacccccaggggacggaccagcagacggtccactgggtcgtcagccatccggagattgaaatcttcgtggccggcgacccgcaggaccggcccgtgggcatggtgtccttctcccaccgtccccagctccggctgcgcggacgcgtgggcaccatcgacgaattggtggtgacggagacctggcgtcgtcgcggcgtgggccgcgcgctcatccggcagattctggagcgctgcaaggtgctgagcgcgaagcagctccagctcgtctcacccatgacgacgacgccggagacgcgcaacttctacacggcgtgtggcttcaccgaaatcgactcgggcgtgttccgccacgtcgatacggaatcccagcgctga

SEQ ID NO: 7855 - DNA, 876 bp, Myxococcus xanthus
atgcgtgtagaccgccgctatgtgttgactggaaccctggctttggccctctgggccgtggcctgcaacggcggcaacgggccgggccccggcgccccgcgggacgcgggcaccgatggaggcagaacgcccaccgtggacggtggcgggacggacgcggacggcggcgcgcgggacttcgcctgcaacgtggcacggcaggaaggctgtgccgacggccaggactgctacttcgcggacctggcggacggcggcaccggcagccgctgcttcgaagcggagtgcgacgtggtggcccaggactgcgcccagggccagcgctgcacgtatgcgatggagaatgacgtcacccagcggcgctgcgtggccccgggcaccgcggacgaaggcgcgccctgcacgctggcgcccagtgacgggcgcctggcctacgacacctgccggcaaggattgttctgccgcgaggcgcctgacggcgcaggaagtggatttacttgccagcgcctgtgccatgccacgacccaatgtgggaacacgagcgagtgcaacaccgtgctccgcctggatggcaccaaggagctgccgctggtctgcggcccgccgtccacggcgtgcaccccctttggcgatgactgcgaggcgccactgagctgctacccgtccacgtccggtccgctgtgcgcgggcagcggcaatcggacggaggggcagtcgtgcgacttcagcaatcaatgcgcgccgggaagcgcgtgtgtgaatgcaggaggcggcctcacctgccgcccgctctgtcagcccggtggcacgcccgcctgctctacgggcggctgccgggcattggatggcaacccaggcgtgggggcttgcgtcccctag

SEQ ID NO: 7856 - DNA, 981 bp, Myxococcus xanthus
accttccgcatgcgcgtgccggtggcgcgtgacggcgggcgcatccgcgtgacgttccgcgcgggcaacggaagcatgacgctggtgcgcgccaccgtggcccaggcgggcgccaatggagcgctggcgtccacgccggtgaagctctccttcgatggcgcggagggcttcaccgtggacgcgcgctcgcggaagacgtcggacccggtggacttcccggtggcgttccgggacgaactggccatcacgttcgaggcccgtggcgcgctggcggccagcaccatcagcgccttcccaggcagcttcgcgcgcgtggggaaccatgcgctggtgacgggcgcgctgggcggcaccctgttcgaccgcgccgtcggagtggccaccgtcgacgtggaaggttccacgggccgtgccttcgtggccattggcgacagcatcaccgagggctacgtcgacacgaagaacgacacgcgcaacgcctggcccgccaaggtggaggccgcgctgggcgtgcccgtggtgaacgcgggcgtgagtggccagggcttctacgacgcgctggcgcacctcgacggcgaggtgctggcgctccagggcatcaccgactgcatcgtcctgctgggcaccaacgacctgggcgacaaggactccctgtccctcatccaggcgcggatgaacacgatgctgggccggctcgcgcctttctgccgcacctgggtcagcaccctgctgcccaaggagaagtcgaactacgcgccctacgaagtggtgaagagccagcggccggagctcaacacgtggctccgcagcggcgccgccggcccggacatcatcgacctggaggcggtgacgcgccagccagcgaacgtgcacttgttcctcgacgggctggatgtggacggcatccaccccagcgtcgaaggccaccgggtgatggcggacgaagtcacgcgcgtgctgcgcgaagagggcggcctctag

SEQ ID NO: 7857 - DNA, 303 bp, Myxococcus xanthus
atggcgctccgccccgggaagaaggaggcggaacgcgcgcaacgcaacgccgagacgctcatcgcggcctgccgcgcctaccaggcccggcacggacagctccccgacaccctggagcagctcgtaccggagttcctcccccagctgccacccgccaagttcagcggccctcacttcggcttcacctacgacgtgagcggcccggcggacgcacgccgtcacgtgctgggatggacggacaggattcccttcgggcgccccttcttcgtcttcgaggaggagcgctggggctacctggattga

SEQ ID NO: 7858 - DNA, 342 bp, Myxococcus xanthus
atggagaacggggatccagccgcatacgcgaaccggcgggcggatgagcgtgtggcggcgcggttcgaggttcgcttcaaccagacgcaggacgcggcgcgggcgctgcgtgcgtactccatcaacatctccgcgggcggcctgtgcctgctgacgcggaagtcctacgacgtgggctcccacgtccggctgtccatggccattgaaggcgaggagttccacctcaccggcgtcatcgcctgggtgcgcgacgaggccgaggccattggcgtgcgcttcacggacatgagcgacgaggaccgggcccggcttcagcgcgtggtggacagcttcaagcgatag

SEQ ID NO: 7859 - DNA, 309 bp, Myxococcus xanthus
tgtgctctaaagttggagcgggtccaggccgccatgcagccgtacctgcccggtttcgaggtgacgccccagccaggccgcgccgccttccgcctggagcccggtggacacgacgtgtcggcgccggaggggagccgggaggcccccgtctccaccttcgagccgctgctcctccaggtgaaccgcctgctggagggggccggggccccggtgcgctgggtgcccacggaggacgactggattctggcgccgccggggctcgcggagctgctggtgctccacggcgtgctcggctcgcgcaagggctga

SEQ ID NO: 7860 - DNA, 252 bp, Myxococcus xanthus
cagcgggctctaaagcgcacccgcctgttcgtcggcgtcacgggcagctacgtggccggcgtcgtcgcggatacggtgctgggtctgcgccgcattcccgtggcggacatcctccctccgcccctgggcggcgacgccgcggccgagcacctgctgggcgtggtgcaggccagcggcaatcaggaggccatcaacctcctcaacttctccaagctgctccagacggcacggcagcgggcggtggcgcggtga

SEQ ID NO: 7861 - DNA, 1254 bp, Myxococcus xanthus
atgtccctggacacccccaacgagaagcccgctggcaaggctcgcgcccggaaggcccccgcctccaaggccggcgccacgaacgcggcgtcgacctcttcctccaccaaggccatcaccgacacgctgctgacggtgctgtccggcaacctgcaggcccgcgtgcccaaggagctggtcggtgagtccggcgtggagctggcgcacctgctcaaccaggtgctggaccagttcgcggcctccgagcaccgcaagcatgtggcggcgcaggagatcgaccaggcgttggatgcgctcatcggcctggtgcgcgagggcgacctgtcccggtggaacaccaccaccgaagacccgcagctcgggcccctgctggagggctttggcaaggtcatcgagacgctgcgcaccttcgtgcgggagatcaacgaggcggcgttgaggctgtcctcgtccgccaaccaggtgctggcggcctccacgcagcatgagacgtcctccacggagcaggcggcggccatccacgagacgaccgccaccatggaggagctgaagcacgcgtcggcgcagatcgccgagaacgcgggcagcgtggcgcgcgtggcggaagagacgctgggcgcggcgcgcgcgggccggggcgccattggcgagttcatccaggccatgcagcagatccgcagcgacggcgtcgcggtggcggactccatcgcgaagctgtccaagcgcgtggagcgcatcggcacggtggtggaggtcatcgacgagatcgcggaccgctccgacctgctggcgctgaacgcggcgctggaaggcagccgcgcgggtgaggccggcaagggcttctccatcgtcgcggcggagatgcggcgtctggcggagaacgtcctggactccaccaaggagatcaagaacctcatcaccgagattcgcgaggccacggccgccgcggccggcgccgccgaggcgtccaagtccgccacggagtctggtgagaagctgggcgcggtggcggcgcaggcggtggaaggcatcctcgccggcgtccaggagacgagcgacgcggcccgcgtcatcaacctcgccacgcagcagcagcgcacggccaccgagcaggtggtggcctccatggcggagatcgaggacgtgacgcgccagacgacgcaggcctcgaagcaggccacgggcgcggccgcggagctgacgcagttggccggacggctggccgagctcatcaagcggttcaaggccgactag

SEQ ID NO: 7862 - DNA, 2334 bp, Myxococcus xanthus
atggacaccgaggctctcaagaaatccctcctgaagaagttccaggaggtcaccgccgaccgcctccagaagattcagctgggggtattggacctggagaaggagaccgcggaccaggccgcggaggacgtcgcgcgcgagctgcacacgatgaagggcgaggcccgcatgttgggtctggccgccatcgggcagctggcgcacgccgccgaggacgtcctgcgcgcagagcgcgagggcaagacggccaccgaggtggccaccgacgtcctgctcagggcgtgcgacgtcctctccgatctcaacgaagacctgtccggcgccaacacgggcaacccggccagcgaggagatggtccgcatgctcgcggaagtctccggacagacgccgcccgccatcgctggcgcacggcccgtggcgccgcctcctgcaccgccgccggcccctgtcgccgcgcccgtggtgacaccggcagccgtcgccgcgccgcccgcgccggtgcaggctccggtggctccgcccccgacgcaggcccccgtggccgagccgggggcgcacgccgccgcagccgcgcctcacccggctgccgcgcatggccgtgacgaggaggccccgagcgccgcgaagtccgcggtggccgaccggagcatccgcgtcaacgtggaggtgctcgacgcgttggggttgctcgcgggcgacctgctggtggagagcgcccgcggccggctgcgcagctcggagacggaggcgttgttcgagcgcttcagccgcctgggggaccgcttcctccggctggcggaagagatcgacatctcgaacgaggtgcgtgagcagttggaccgcgtggagagcgacctccacatgctgcgcgacgacgcgttccgcttcgtgcgccgcaacgacgacggcatcaacacgctgcacggcaacctggcgaagatggcggaccacgtggccgaggcccggctggtgccgctgtccaccgtgttcgacgccttcccgcgcgccgttcgcgagatgtcgcgcacgcagggcaaggaagtggacctggtcatcgagaacgccgacatcggcgtggaccggtccatgctgggcgacgtgcgagacgcgctggtgcacctgctgcgcaactcggtggaccacggcgtggagtccccggacacgcgccagcagttgggcaagccgctcaacggccgcatccgcatccgcgtgcgcgtggacggcgacatgctccacatcgaggtggaggacgacggccgcggcatcgacccggagcggctgcgtcaggcggccatctccaagcgcctcatcaacgcggtgcaggccgccgcgctgtcggagcgcgaggccatcgagctcatcttccgccccggcttctccacccgcgaccaggtcagcgagctgtctggccgtggcgtgggcatggacgtggtgaagcgcaaggtggagacgctgggcggctcggtgggcgtgagcagccgaatcggccgtggctccaccatcaccctgcgcctgccgcagtcgctggcgttgatgaaggtgctgctggtgcgcctgggggacgacgtctacggcatgcccgccgcggacgtggaagccgtcatgcgcgtcaagccggatgaccggctggagatcttcggcacgctggccgtgcggcaccgtggcaagcccacggcgctggtggcgctggggccgctgttgggcctcaacggcggcaatcgcttcgacaagccacccgcggtggtggtgcgtcacggcgaggaccacgcggcgctggtggtggacggcttcgtggacgagcgcgaagtggccgtgaagccttgcggcggcgagttcctcaaggccgcgcccttcatcgccggcaccgcggcgctggaggacgggcgcatcgccgtgctgctccatgtcccggacatcatggcggaggtgcgacggatggcccgccccgtcacccaggcccccgccgccaagcgcctccgggtgctgctggtggacgactcgcccattgcccgcgctacggaaggggcgctggtgaaggcgctggggcactcggtggaggaagcccaggacggcgaagaggcctacgtgaaggtgcagaacaacacctacgacctcatcctcacggacgtgcagatgcccaagctggacgggttctcgctggcgcggcggctcaagtcgacgcccgcggtggctcgcattccggtcatcatcctgtcgtcgctcgcctcgcccgaggacaagcggcgcgggttggatgccggcgcggacgcgtacctcgtcaagggcgagctgggcgtggaggttctcgcgcaggccatcgaccggctgacctga

SEQ ID NO: 7863 - DNA, 1005 bp, Myxococcus xanthus
atggcgtttcgggtgctcatggtgggcaaggggctgcgtgcgctcgcggcccggggcctgttcgatggggaatccctggtgcccgtggggccggcggaggtggacttcgccggcgccctggtggccgtgcagcggcacttcccggacgtggtgctggtggacctgagcgcgctggacgcgctgcccgccatcgagcacgtcatggtggagcggcccgtgccggtgctggcgttgcaccccggcgtgttgtccggccaggaggccttccaggcgatggtggcgggcgcgctggacgtgctggagcgtccggcgaaccccgggcccgagttctggacgcacgtgtcgcgcaagctggtgctgctggcgcaggtgaaggcggtgcggcaggtgcagacgcggccgccaccgcaagcggcgcgtgaggcgaagccgcctcctccgtatccgctggtggccatcgccgcgtccctgggtggccccaaggcggtggcgcaggtgctgcggatgattccgcgcgccttcccggcgcccatcgcctactgccagcacatcagcgacggtttcacggaagggctggcgcactggttgtccaatgaaacggcgctgcgcgtgctggagcccgagcatgacgtgctcatggcgccgggcacggtgtacatcgctccgtcgggcagtcacctcttggtccgacccgagggcaggttggagctggacgcgggccccgcgcttcgcggtttccggccgtcctgtgacatgctgctgacttcagcgggtgagtcgttcggcccgcgctgcatcggggtcatcctgacgggcatggggcgcgacggggcgcgagggttgaaggagattcgagagcgcggcggtcggaccattgcccaggacgaagcgtcgagcgtcgtctggggcatgccgcgcgaggcggtgttgatgggcgcggcgcacgaggtgctgccactgagccggattggcgcggcgctgatgcagtgggtggatgtgtgttga

SEQ ID NO: 7864 - DNA, 1665 bp, Myxococcus xanthus
atgcccgtgctggggctggaagagcccgagcactacatccagcgactgacgggcgccggtggcgaagaggagctgcgctcgctgttgccgctggtgacggtggggcacacggagttcttccgcgacgcgaagcagttccgcgcgctggagaagagcgtgctgccggacctggtgtcccgttcgcggcgcgagatgcgcaaggtgtccatctggtccgcgggctgcgcgacgggggaggagccctacagcctggccatggtgctggcggagctgggcgcgctgtcgctggaggtggacctgtgggccaccgacctcaacctggccgcggtggaggccgcgaagcaggggcgcttcacctcgcggcgggccatcagcatcaaccaggcgcggctgacgcgcttcttcaagcccgtggaagagggctatgaggcgctgcccgcgctgcgtgagtacatccgcttcgatggacagaacctggcggttcccgtcttcgacaaggtggccctgtcgtcgctggacctcatcctctgccgcaacgtcatcatctacttcgacctgcccaccatccgcgggttgatggaccgcttcctcgccgcgctgcggccgggcgggctgttgttcctggggtactcggagagcctcttcaaggtctacgaccgcttcgagatgatcgaagtcgatggggcgttcgtgtaccgccgcccgctgaacgacaagagcatgcgggcgccgccgctgcgcatcaccccgtatcctggcgagcccgatgtcgccgcgcgcaggcccgtgcctgcggacgcgttcaccgcggacctgcgcaagcggatgctgcccgaggacgtcccgttgacgacgcggctgcccgcggtgtcagcgtcgtcggtggcggcgcctggctcgcccagcgtgacgctgccggcgctgggggcctcttcgagtccgcgttccgtggtgccggggcggctgcccgcggtgtcgcctcactcgccgctgccggccatcgccgcgcgctcgcgtgtcaccgcggagttgcccacggtgggaagcgtggactccgcccgtccgcgcatcaccaccgagctgccggccgtggccaccacgccgcgcgcgcccaccgtggaggtgcccgcctggcccacgctgctgcctccggcggagcggctggccatggcggtgcggaagatggcgcagggggatttctcggcggccatcgctggcgtgcagcggctgctcgcggacgagcccagtgacttggatgggctgctgacgctgggcaacctgttctcgctcaccggccgcatccccgaggcgcgcgaggccttcgcgcaggccattcagcgcgagccgctgtgcgtggaggcgcgggtgttcggcggggtcgccgcgttgcaagcaggggagttgagcgaggcgcgctccgagctgagcaaggccctgttcctggagcccacgctggccattggccactacctgctggcgcaggtgcacgagcgcacgcaggaccatgaggcggcccgccgcagctaccgcaacgccattgcccagcttcgcttcccgcagcgtcccctcgcggggcactacccggagatgccggactcggcggatgccatctctcgcgcggcgcgttacgccctggccgcgctggaggagcagcccctgcgctga

SEQ ID NO: 7865 - DNA, 312 bp, Myxococcus xanthus
atgaagttcgatatcccccactccctccccaaggaggaggtcaagcagcgcgtcgatcagctgctccagtactggggcggcaagtacggcgtgaaggcggactggcagggggaaggcgcgaaaatcgtcggcaaggtgatgggcatccaaatggacgcctcgttcgtcatcaccgacaaggccgtcgagggtgagggcaccgaccctggcatgttgctgcgcggccaggccaagagctacctgcagaagaagttcggctccgtgctcgacccgagcaagagcctggaccaggtgaagagcagcctggactga

SEQ ID NO: 7866 - DNA, 1095 bp, Myxococcus xanthus
gccatcgtgtcgaacctgttccccacgtacatcatcccgggcccacctgcgcgggcgccgccaaggcccctgaacgtgccgctgttcgccgtggatgcgtcatgcgtggtgcccatgcagcgcatcgccacgcggcagattggcgcctataccttgcggcccaagctgaagaagctgtggccggagtacctggaccgcgccgtgcccaaccgctcggtgaaggccgccgcggccggacgcaagctggagccggacttcgccacgtcagacgcacgcgagtcccgcgagtccctggacgcctttgacttcgaccattcggtggcgcccatccaggagcgcggaggacgcaaggcgggcctcgatgcgctccaggccttcgtgcaccaacggttggagggctatgacgaaggccgcaacgacccgggcctggcgcgacagtccaacctgtcccccttcttccactggggcaacctcttcgcgggagaggccgcgcgcgccgccatccgcgcacgcggcgcgcaggatgcttcggtgcagggcttcctggaggagctgctcgtccgccgtgagctgggtttcaactactgcttccacacgccggggccgcagcagctctccgtggcctccctgcctccgtgggcgaaggagacactcacccgccaccagaaggacgcgcgcgagcaccgctattcgttgaagcaattggagacagcgcggaccgcggacggcttgtggaacgcggcccagcgcgagttggtggagcgtggccgcatccacaactacctgcgcatgctgtgggggaagaaaatcctggagtggactccatccccccaggaagcgctgcaacgcatcgcgttcctcaacgacaagtacgcggtggatggcagggaccccgcgagcgtcgccaacttcatgtgggtgctgggactgcatgaccgccctttccaggagcggcaggtgctgggcaaggtgcggcccatgagctccctgcgcacggcggccaggtacaacctggcaccctacctggagcgctggggccgcccggaggacccaccggtgaagctcaagcgcgttcgcaagacggcaggcccgtga

SEQ ID NO: 7867 - DNA, 1116 bp, Myxococcus xanthus
atcctgccgccatacctggctcgctccatcgcggagaacggcaccagcgaacaacgtgagcgcgtcctgcggacgctttccacggattcgacgttccgtgcgctccggctcgcggggagcagaacgaccccgtcgacgctcgtcacccgtcccagggcgatgatggtggaatccgcgctgcatcggaccatctacgacttgaggaacagtgaggcgtttcctggcacgcctgttcgcttcgagggacaggaggcgacggacgacatcgccgtcactgaggcctatgacggcctgggagacacctacaacttcttctgggagattttcgggcgcagttccatcgacggagatgggatgccgctgcaggccttcgtccattacgggaacacctacgacaacgccttctgggatggccggcgcatggtgttcggggatggggacggcgacctcttcaaccgcttcaccatctgcctggacatcatcgcgcacgaactcgcgcacggtgtcaccgaggacgaggggccgctctggtacttccgccaggcgggcgcgctcaacgagtccatgtccgacgtcttcggctcgctggtgcgccagatgaagctcaagcagaaggcggatgcggcggactggctcatcggcaaggaactcctcaccggcaacgtggagggagtcgcgctgcgctccatgaagaatccggggacggccttcgatgacgacgtgctgggcaaggaccctcagcccgggcacatgaaggactacgtccatacgtgggaggacaacgggggggggcacatcaactccggtatccccaaccgggcgttctacctggttgcgtcgcacctgggcggctacgcctgggagcgggcggggcgcatctggtacgacgccattcgcgactcacacatcaagcccgacatgggcttcctcgactttgcgcgcatcaccgtgatgtccgcgacgcgcttgttcggcgcgggagaggaggaagacgcggtccgggaggcctgggagcaggtgggcatccgcgtcgcccggtctggtgtccgcatgcccgcgttcgtcggcgccgtcacccagccttcgccacaagcggggcgcgcccccagggcgtga

SEQ ID NO: 7868 - DNA, 204 bp, Myxococcus xanthus
atgggccactgccacttccacccggcggagggccgagacgaggcccgcctggtcttcgacaatccctacccgtgccgcttcgacatgggactcgtgaagggcatggcccggcgcttcgcgcccgaggccaccctcacccacgacacttcagcagggtgccgccagaagggcgcgaattcctgcacctacctcgtcctctggtag

SEQ ID NO: 7869 - DNA, 342 bp, Myxococcus xanthus
atgcgcatcgaactcaagcgtgaaggcgggccggcctacttccctgggctggctcggccaagagtggtggacctgacgagcctgccaccagagcaggcggaggcgctgcggcacagtgtccaggccgcccgcttcttcgaactgcctcccgttgtgggcaccctgcctccaggcgccgcggatgcccgccggttcaccgtgaccgtggaggaggaggggcggcggcataccgtccagttcatcgagcccgtggaggagccacggctccatgacctgctggagcaggtgacgaaggcggagagggcgcagcgccgcggcgctcggccaggcacgcctgggtga

SEQ ID NO: 7870 - DNA, 1104 bp, Myxococcus xanthus
atgacgacgctcgtcggccgccatatcggtcgctaccgcatcctcgagcaactgggctcggggggcatgagcgtcgtgtacaaagggctcgacaccgccctggaccgtgaagtcgcggtgaaggtgctgcacccgcacctggccggcaaggacgagtcccgccggcggctggcccgcgaggcccgcgcggtggccaagctgcaccaccccaacatcctggaggtcttcgacttctccgccgcggacgcccaggacgcgttcatcgtcaccgagtacatccgcggccagacgctgaaggcgttcatggacgagggccccatggacccgccggagctggcggccatggtcatccacgagttggccgcggcgctggcgcacgcgcacgagtccggcgtcatccaccgcgacctcaagccggagaacgtcatggtgcgcgaggacggcgtcctcaagctcatggacttcggcatcgcgcggctgatggacatcgaggagcggatgaccgtcaccggcacgctggtgggctcgccggcccacatggccccggagatcatcgaaggcctggaggcgggccccacggcggacgtcttcagcgtgggcatcatgttctacgcggcgatgacgggacggctgcccttcagcgcgccgaacaccaccgccacgctcaagcgtatcctggacggggactacgaggacgcacgccggcgcgtgcccgcgctgtcggacgagctggcggacatctgcgccatctgcctgcagcgcgacccggagcggcgctaccccgacgcggcccggctgcgggacgccctggcggactacctggccggcctgggcttcgcccgcgtgggcgaggagctggtgtcgtacttcgcggacccgccgtcgtaccggaagctggcccgtcagcgcatcgtcgccaccctgctggagcgcagcgagcggcagctcgcggagaagcgcaccccgcgcgccctggccagtctcaaccaggtgctggcgctggacaccaccaacgcgcgggcactggcgctcctcaagggcatccagcgcgcccagcgcatcaagacgtggcgccgccggggtctgcgcctgggcgtgggcgtg

SEQ ID NO: 7871 - DNA, 1086 bp, Myxococcus xanthus
atgagacttggagtcctgaccggcggtggcgactgccccggcctcaacgcactcattcgcggcctcgtgaagcgaggcacgcacgaattcggctacgagttcgtgggcatcgagaacggctacatggggctggtggagccagggctcgcccacccgctcaccgaggaggacacccgcggcatcctccccaagggcggcaccatcctgggcacgtccaacaaggccaaccccttcagctacgcgacccgtgaggatgggcactgggtggagcgggacgtgtccgatcaggtcctgctccgctgcgaggagctgggcctggacgggctcatcgccgtgggcggcgacgggacgctgtccatcgcccaccggctcgtggagaaggggctcaaggtcgtcggctgtccgaagaccatcgacaacgacctgtccgggacggatcagaccttcggcttcgacaccgcgcggctcatcgtcaccgaggcgctcgaccgcctgcactccaccgccgaggcccacgaccgggtgatggtcgtggagatcatgggccgccacgccggcttcctcaccctggagagcggcatcgccgggggcgcggacgtcatcctgattccggagattccgtacagcgtggagtccgtggtggagaagatccgccgccgctccacccgccgtcgcagcttctccatcatcgccatctccgaaggcgcgttcccccagggcggcgagctggccgtgctggacacggcggaggccattcccggccggggcgtggtgcggctcggcggctcggggaaggcgctggcggacctgctggcccggcacatcgaggcggagattcgcgtgacggtgctgggccacctccagcgcgggggcagccccagcgcggcggaccgggtactggccactcgctacggctgcaaggtgctggacctggtgagcgcgggccagtgggaccacatggtggccctgcgtgcgggcgaaatcatcgcggtccccttgagcgagtcgcgcaaggagcgccgcgtggatccggcgggtgagctggtgcgcttcaccaagagcatgggcatcagcttcggggactga

SEQ ID NO: 7872 - DNA, 483 bp, Myxococcus xanthus
atgaaccccgccgccagggccgacatggagtcacgtgccgatcgcgccctgcgccgcggcgaactcaccgaagcgctccgcctgtacgagtcgctcgtgcgggccttcccggcggacgaggggctcgccctcaagctcgccaacgcgcgcgaattgctccaacccgcggagttggaggtgctcgaagccgcccgggccgaggccagcatccccctccccgtgggcccttcctcccccgtccaggaaggcgagcgcctcttcgcgctgggcgactatgcgggcgccgctgcttgctaccggcgcgcggtccaggaacgcccggacagcgagctgctcaaggagcggctgatcgagctctatggcctcgcgaaggccatgcccctacagtcaccgacagatagggcactccccgacaagccggagcctcggctccaggccctgctggaccgggtggcctcgcgccgccgcctgaagcgggactga

SEQ ID NO: 7873 - DNA, 1357 bp, Myxococcus xanthus
atggcgaacacgatgagccgatgtctcaggggcgtgctgttcggaaccgtgctgctctccaggagtgcggcggctcaggaagttccggcacgactccaggagaccttcggtccggtgctgaatttgagcgggacgcccaccttcaacttcgaattccagacagccgtcgccgacagcaacgtctacatcgtgtggagtgatacatcgtccctggacgtcacccacgtctacctgcgcaggagctcggaccagggaaagagcttcgagcctccccagaggctgagcaacgacaccgggtccgcctacctccccaccgtggtcgcggagggaaagaaggtctacgtcgcctggcacgaacagggcatccagttccgcgtgagccacgacaacggaagaaacttcgctcccgcggtgaccctggccgcgcacggcatttcgccccggctcgcggccgagaacagcgatgtgtacgtgacatggaccgagctcacgggcgcgcggtcagcgacccagcacttccgggcgagtcacgacaaggggctgaccttcggccccacactggcgctggatgaccgtcatggcaccggggtgacagagatgaccgcgtccaacaatcgcgtctacatggtgggcgacgacatcgacgcggatgaccggcccgacgtgtacctgaggaccagccccgatcgagggaacggccttcgctcggcgtctcaacctcagtgccgcagagggaccgggtcagccgtcgctgctcgaccgcatagccgtcaaggctcagaaggtccacgtggtctgggaggaatgcaacgacctcttcccggacacctgcaccatcctctaccgccgcagcaccgaccggggggagagctttggccccacccaagccatgagtgggagccagggcttcgcgctcgctccggacctcgaaatctcgggtcagcacgtcttcgtggcgtggcaggacgacagccccggcaacttcgacatcctcctgcgcgccagcaacgaccacggggccacgttctccgcgccacgcaacctgagcctcaccccgggatactccggctccgtcagcctctccgcggcccaatcgcatctgcgcgtcgcgtgggaaaacaccaccgccggctcggtcgacatcttctaccgggccagcggtgacctgggcgcgtcgttcacgcccgtgacgaacctgagcaacacgccgacgcgctcttccgcgccgcgtgtcttcgcctccagcggcggatcgcatggctacgtggcctggctggaagacctggccaacgaaaacaccgacgtgttcttccgccgcaccgaggcgaaatagcccgggacaccacgtctcctcgca

SEQ ID NO: 7874 - DNA, 321 bp, Myxococcus xanthus
atgtcctgaattctactcgtcatcgcggggttgctccaggtcggttgggccatcggtctcaagtacaccgaggacttcacccggctggtaccaagcgtcctcacgggcggcgccatcgtcgccagcatggtgcttctggggatcgccacgaagaacctgcccattggcacggcctatggtgtttgggtcggcattggcgccgtgggcgcggccatcatgggcatcgtgctcttcaatgagccggccacgcccgcgcgcgtgttcttcctggtgctgctcctcacctccatcgtgggcttgaaggtcaccagcggccggtag

SEQ ID NO: 7875 - DNA, 1041 bp, Myxococcus xanthus
ctggagcggatgaaggcatcgtcgcgctaccaggccggcatcttcatcaacaccgccggtgccaggctgccgcagaatgggccggactggggcacgttgaaggagatgctcttcggcacccagcagcgtacgccgccgtccgcgctgcccatggaacgggacgtggccgcggcgctggcgaagccgccggagagcggcctgcgcgtgacgtggctgggccactcctcgctgctggtggagattgacggcttccgcattctcacagaccccatctggggcgagcgcgcgtcgccgtccaccattgctgggcccaagcggttccatccgcctccgcttccgctggaggcgctgccggacgtggacgcggtgctgctgtcgcatgaccactacgaccacctggacatgcccaccattcgggcgctggtgccgcgtcaggtgacgttctacgcgccgctgggcgtgggagcgcacctggagaagtggggcgttccggcggagcgcgtggtggagctggactggtggcaggaggtgtcactgggggagggggagggccgcctgcgcatggtggccacgcccgcgcagcacttctccggccggggcctgacggaccgcaacagcacgtcctggacgtcgtggacgctgctgggctcgcagcatcgggtcttcttcagcggggacacggggctgacggaggagttcgcggaggtagggcgccgcttcggtccgttcgacgtcaccatgttcgaggtgggcgccttccatccatcttggggaagcatccacctggggccgcagcaggcgctgaaggcgcatgagatggtgcgggggcgcaccttgctgcccatccactgggggacgttcagcctggcgctgcacgcctgggatgcgcccgcgaacgagctggcggccggggcgcgcgagcggggcgtgagtctgctcacgcccgtcttgggccgccccgtggaaccgacgcgggagcgcgcggacacggcgtggtggagcacggtgcaggccgctgctgtcgttggcgacgcgccttga

SEQ ID NO: 7876 - DNA, 678 bp, Myxococcus xanthus
atgctcctgttcgcaggcaccgggaaggctcatggcgtggaggccgcgtcggtgccgcaggcacctcgcgcggagcgtgccgggctggccatctggacggcctccgtcatcgattggagcctgcttctggtggggccaatcctgggcgtgggcctcaatgtcgcgctgccagtgggcatgaacgtgcctttgacggatacaacggatggcgttttcgaactccgacccatgctggcgcgcaagaggtgcaccaacatccacggagacgccatgccccgttgcggcaccctgcaagcccttcgggccacggtgggcctggcgtggacgccctggccgggcgagcggggcgatggcttcttcatccagcccaagctgagtggcatggtgacgcatcagaccgtgcgtgggacggaaatcccagtgacggcggagggcacgaggatggagacgggcggacaggtctccctcgggttcgacgtggggtaccggaagacgtcccgccgctcgcgttctttcctggctccggtgataggcgttggcgtgggctatagctggaaccagcagcgcgggcgggtcgacccgggatggctctttgctcgggagcaggcacgtggctggaaagacaagttcatcgtggacctgaacctggacctcttgcggttcggggccacgttctaa

SEQ ID NO: 7877 - DNA, 1533 bp, Myxococcus xanthus
atgcgactctcactcacccataaaatcaccctggcgcccatcatcgtggcgctcctgttcgtccttctctctcagggctacaccgtgcctcgcctccaggaggccttcgaggcgcaggggcgggagctgagcggcgcgctgcctgcggtgctcgccgccgcggtggcggacggcatgaagcggagcgcgcacgacgaggtccagcagacgctggaggccgtggctcggcatggtggggcggcctacgtcgccgcgttcgacgcgggggggacgttggtgggcgtggccggtgagaaggcccagatgctacgggatgcccgcgagcagttgaggtcctccgagggagggctcgtcctgcgggatggggacacggagctgcaggacctggtggcgccggtaccaggtgacgccggctgggtccacgtgggcttcgaccgcacccatgcgcgtgggctcgtggaaggggcgctggcgaacgtgggcatcaccgtgctggtcgcgctgctcgtcttcaccgcggcggccttcctggtcagccgcgccatcgtgtcgcccctgaaccagctctcctccgcggtccgccatatcgccgagcgcggcgacctgcggcagactattcgcatcgactcggatgacgaggtggggcagctcgcgcgggccgtgggcatgctggtgggcaagctgaaggagctgctgcatcagctccagtcctcgacggagctgctgagtgactcggtgtcggggctgacggagtcggcggatcagcagaatgagatggtgacgcgccacgcggccgcactccaggagacgcaggtgacggctcaggagattcgccagacggcgatgctggcgtcgggctccgcggagtccgtcatccaggtggccgagcgcgccgagcaactgagccgcaccggcgaggaggccgtctcggcgagcatcgacggcatggaggaggtgcgcaatcaggtggcagagatcgccgcgcgcatcacctccctgggcgagcggaccaggcagatcagcggcatcaccgagacggtgaaggacctggcggaccagtcccacctgctggccgtcaacgccgccatcgaagcggcgcgctccggggagcacggcaagggcttcgtcgtggtggcgaaggagattcgtgcgctggcggaccagtccatccgggccaccaaccaggtgcggcgcatcctccaggacatcaatcaggccatcatcggcacggtggagatcaccgtcgaaggcaccgagcgcatggaggcggggctggcgcaggtccgcacgtccggcgagacgctgaaggagctcaccgccatcgtcgaggacagcaccgcggcggcgcggcagatcgcgcggacggtcagccagcaggccacgggcatcgagcagatcttcaccgcggtcaacgagctgaacaccctgatgacggacaccgtgtcccgcatctccacgaccagtgactccgccatgtccctgaagatgctctccgagcgcgtctcccaggtcgtccgcgcctacaacgtctga

SEQ ID NO: 7878 - DNA, 270 bp, Myxococcus xanthus
atgtgccggaacatcaagcccctgttcaacttcgcgcctcccgccaccgatgccgacatccgcgcggcggcgcttcaattcgtccggaagattgccgggacgcggacgccgtcgaagcagaacaccgacgccttcgaggtcgccgtcgaggaaatcttccagagctcgaagcgcatgctcgacgggctggtggccaccacgccgcccaaggacagggcccgcttcgaggccatgaagcgcctgcgctacaagaaggcggagtcccgctga

SEQ ID NO: 7879 - DNA, 627 bp, Myxococcus xanthus
atgaacgactatgagttgattggctcaccgggatgtggctcggccatcgtggagatggcgctgagcatcaccggcatcccgcaccgcttgacggagctgccctacctggagcctggccccggacgcgaccggctgctgaagctcaatcccctggggcaggtgcccaccctgatcctccccgatggcgcggtgatgacagagagcgcggctatcatcctgcacctgcacgacgtctcgccccagagcggcctggtgccggagcccacggcgcccgagcgcgtgcgcttcctcaacctcttgttccgcctcgtgggcgcggtgtacccgacgttcacctacgcggacgacccgccgaagtggaccctgcccggtcccgccgcggaccggctgcgcgacaccgtcatggagcgccgcgccaacctctggcgcgaaatcgaggcccaggtgggcaagcctcacgtgctcggcaagcgcttcagcgcgctggacctctacgtcaccgtgatgacgcactggcgcccgaacaaggcctggttcattcagaactgccccgccctggcagcggcggcctctcaagcggagaagaacccgcacgtcgctgcagtgctggagcgccacttcagttag

SEQ ID NO: 7880 - DNA, 465 bp, Myxococcus xanthus
ccgctctacctcacctatcagcgcgtcctggacgccgtgcgcatcttcgcgggcgtccccttcgcgctcgtgggcggcgtgctcgcgcttctgctgcggggcctgcccttctccatctccgccgccgtgggcttcatcgccctgtcgggcgtctcggtcctgggggacatggtgctcgtctcacgggtccgcgccttgctggagcaaggtcaggccctgggcgaagccattcgccaggcggccgtgtcccggctgcggcccgtgctgatgaccgccgcggtggccgccatcggcttcgtgcccatggcgctcaacaccggcgtcggcgcggaggtccagcggcccctggccacggtcgtcattggaggcgtcctgtcgtccaccctgctcaccctcgtggtgctcccagtcctctactcggtcttcggtgccgggaaggacacgcccatgacgaggactccgtga

SEQ ID NO: 7881 - DNA, 1155 bp, Myxococcus xanthus
ctaaggttcatctggagcatgtggggaccagagccccggctcgcccacgcgctggtcaacgccgtggccgttctcatcatcgcgtgcccgtgcgccctgggcctggccactcccatctccatcgtggtgggcatggggcgtggcgcgcaggccggcgtcctcatccgggacgcggcggcgctcgaggaactggcgaaggtggacaccctcgtcgtcgacaagacgggcaccctcaccgagggcaggccgagcctcaccacggtggtggccgcccccggcttcgacgaggcgcggctgcttcacctggccggcagcatcgagcgcgggagcgaacacccgctcgcgtccgcaatcgtgaagggcgcagaggcacgtggtgccgtcctcaccgagacgcacggcttcaagtccgtgacgggccagggcgtgacggggcgtgtggatggtgcgcaggtggcgctcgggaatgcccggctgctcgagggactcggcatcgaggcaggggcgttcctggagagggcggaggccctgaggcgagaagggcagacggtgatgttcgtcgccgtggacggcaagccggccgggctgctcggcgtggccgacccggtgaaggccagcacccccgaagccgttcagcagctccgtgccgatgggctgcgcctcgtgatgctcacgggtgacagccggacgacggcggaggcggtggcccggcgcctgggcatcgacgaagtccacgctgaggtgcgccccgaggagaagaacgcgatggtgaagcgcctccaggccgaaggccacgtggtggccatggccggagacggggtgaacgacgcgcccgcgctcgcccaggccaacgtgggcatcgccatgggcacgggcactgacatcgccatggagagcgccgccgtcacgctggtgaagggtgacctccgaggcatcgtccgcgcccggcacctgagccggggcaccgtgcacaacatccgccagaacctcttcttcgcgttcatctacaacgtgctcggcgtccccatcgcggcgggggtcctctacccgttcttcggactgctgctgagccccatgattgccagcgcggcgatgagcatctcgtccgtctccgtcatcgccaatgccctgcggctgaagcggctggacctctga

SEQ ID NO: 7882 - DNA, 104 bp, Myxococcus xanthus
  unsure (1)..(104): unsure at all n locations
atgcccgcgggggcccgggagctgaagaatccgctcgcgcccctctcaccgcaggccctcgccgaggcgcgagcccattgggnnctgaccactgcgcccatctg

SEQ ID NO: 7883 - DNA, 954 bp, Myxococcus xanthus
aacagggcggcgggccaggcgcagggctccgcacagggccacagttgcaggggaccgggctccgtgcgaaggcggaagctgcccgtgcacctcgaccttcagcccgcaccgccggccggtgccttccgcaagctcgccctggggacatggcgttcgccgggagaccccagcgcctatgcggcggtggaggtgcgcatggagcgggcggtggccttcctcgaagccttccgtgcccggacgggacagcgcctcacggtgacgcatctggtggccaaggccgccgcggatgcgctgcgccgccatcccgaagtgaatgtcctgatgcgctggaatcgcccctggcggcgcaaggaggttggcgtctgcgtgttggtggtgcagccctcggagacggggcgcgcggacctgacgacggccacggtgcatcgcgcggactcgctgtcactgggggctttcgcggagacgatggcctcgcgcatcgcagcggtccgagcgcgccgggatgccgtcatcgagcgtggcaagcggcgctcctcgctcatccctggcttcctgatgggattggcgctgcggatgttgtccttcgtttggttcacgttgaacgtggacctgcgctgggtgggcatgccgtgggacccgttcggctcggtggcggtaacgagtctgggctcgttggggctggagcggggctatgtggccctggtgccgtacacgcgcgtgcccttcctgctggccccgggcgcggtgcggacggagcccgtggtggatgcgggcgcgctggtgcctggacaggtgatgacgctcacttgcacctgggacgcccggctcatcggtgtggaggatgccgcgcgtgtcttgcgcgacatcggcgccgcgctggaggatccggaggggacgtggggctcggcttcgccagaagggggcggggctgcgagcggtgcggaggtggggtag

SEQ ID NO: 7884 - DNA, 228 bp, Myxococcus xanthus
atgtccgtggatacgaaccgccgtgtcattgcttcgcgccccgtggggcgcgcgctcggtgggcaggaccgcttcgagaaggaggggctggaagggcccgcggagggcggcctcgcgatggctcggcggcagcggatggcgggcgggacgctgcgggctggggaggagagcccgttcgccgcgaagctgcggaagctcgcgggcggcgcttcggatgacgagcgttga

SEQ ID NO: 7885 - DNA, 348 bp, Myxococcus xanthus
atgttcgagaagcactacacgccggagcagctccagcagttgaaggcccgccgcgaggcactgggcgaggaggccatccgccaggtcgaggccgagtggccccaactcatcgctcgcgtccgcgcggagatggaccagggcacggaccccacgagcgagccggtgcgctcgctggccatgcgctggcgggagctgctgaaggcgttcacggggggcgaccctggcatcgaaggggcgctgaatgcgacgcatcagcaggaacccgaggtcgcggtgaagcacgggttggaccccgcgctcttcgcgtacatcggcaaggcaatggccagtctggaggagcaggcgtag

SEQ ID NO: 7886 - DNA, 967 bp, Myxococcus xanthus
atgcggctggaccggcccatggtggaggcggacgacgacgccacggtgttcggcggggaccttgtcaccagcgcggtgtccgcccatccgggccctgctgcgggggtgttgctggcgagcgccgcggcctggttcgtccgcgccgcgggcctgttgggctcgctggaggaccccgcgtggacatacggcctggtgtgcctgggcgcggtgctcgcgctggtgctggtgctcaaccgcggccccgcgaaggggatggcgcaggtgggcgtggtggtgcaactgctggccacggggtggctggcgcgtgaggcaccgctggcccccgtccacgtggcctacttcatcctcggggtgctcgccttggtcatggtggtgggcgagccggggcccatgcggcgctacctggggctgggtttgggcctgggagcggcggtcgcttcggcggggttgttggcgcttcccatcgcggggacgtcgggcgcgggtgtgcgtcagtccctggtgggcagcgagctggggtatcggctggagctgcccccggggtggggacagttgacgcgcgagcagctcgcaccgcacctggtcctgcccgcgtccaccctgcagggcggcggcgtgggcttcggcgacgcggcgcaggaacgctacggcctgctctgggtggagcgcggcacgggcaaggcggcggccgcggggtgcaaggggttgttccaggcgctgggcggtgcgctgggggaggcgctgtcacttcccgcgcctccggcgttggggagcgcggccaccgtgcatccgctgcgcacgccgggtggcgcggaaggcacgctggcgtgcggggtgctggcggacgggcggctcgtggggctggtggtggtggccgcccaggcgagtggcggcgcggacgaggcggccttccctcccgcgcagcacgggctccacggcgtcggccatggcttccagctggaccgat

SEQ ID NO: 7887 - DNA, 867 bp, Myxococcus xanthus
atgaatccgcagccgctccccgcccctgcccctgagactccgcccaccgccccggactcgctcgcccgtcccttcaagctctcccggcgcttcgaccggaccggccgcctgctgggcgactccgcgatggagcggctggccaacgcgcgcgtggtggtgttcggcctgggcggcgtgggcagcttcgcggcggagggcctggtgcgcagcggcattggccacctgacgctggtggaccatgacgacgtgtgcgtcaccaacaccaaccgccagctccacgcgacggtgaaggccgtgggcaagcccaaggcggagctgatggcgcagcgctgccaggaaatcaatccggcggcgaaggtggaggcggtgcgcgagttctaccgcgcggacgtggccgagcagatgctccagccgggccagtacgacttcgtcgtggacgccatcgacaacgtgaaggcgaagctgcacctgctgcaccgctgcgtgacgctgggcgtgccggtggtcagctccatgggcgccgcgggccggttggaccccaccgccatccgcgtggaggacctgtccgagacgcacatggaccccttcgccaaggacatccgcaagctgctcaagcgcaagtacgcggtggagacggacaagcacacgggaatcaccgccgtgtactccatcgaagcgcggcggctgccggtgacgctccagtacgacgacgccaccgacggcttcctgtgcgtgtgcccgcaggacaacgagttccacacctgcgaccaccgcacgcagattgacggcagcgtggccttcgtcacgtcctgcttcgggatgaacgcggcgggcgtggtggtgcggcggctcgcgtcggcgcgctag

SEQ ID NO: 7888 - DNA, 798 bp, Myxococcus xanthus
atgatagacacccactgccacctggatgcgtcccgcttcgacgccgacaggaatgaagtcctctcgcgcgcctgggccgcgggcctccacggcatcgtcatccctggcgtgggcccgcatgactgggagcccttgctggagatgtcccgccaggatgcccgcctccaggtgggcctgggcatccacccgcagctcctccccgacatgcccccggcagaggacgacgccgtgctcgagcacctggacgcgttgctcgcgaagggcggcgcggcggccgtgggtgagtgcggattggatggccccagcctcccgggcgcgccgctggaacggcaggtgatggtgctgaagcggcacctcgcgctggcgcgcaagcacggcctgcccgtgctgatgcactgccaccggctgcacccagccctcatcgaactactgaaggaggagcccctccccgaggccggcctgctcatgcacagctacagcggcggcgtggagttggcgcgcttctatctccagaagggctgccacttctccttcgcgggccccgtcacctgggcggaggcccgcaagcccctggatgcgctccgggccatccccctggaccggctgatggcggagacggacgccccggaccaggcccccatgccccaccgggggacgcgctccgagccgggctaccttccccgcatcctggagggcatggcccgcgtccggggggagcccgtcgaggaggtcgcccggcagacgaccgagaatgcccgccgcttcttccgggaagctttccctgcaccttcgcggtag

SEQ ID NO: 7889 - DNA, 186 bp, Myxococcus xanthus
atgcccgcgctccggcgaacggctcagcgggcccgggcggcagcgggcaaggtccacctgacggtgggcgaggtcatcgcggcggccttcgagacctccggcggggagctggtggatgtgctggcccagctcacctcgccgcagatgacccgggcgctggggcgtcgcatcgtcgtggagggctga

SEQ ID NO: 7890 - DNA, 1149 bp, Myxococcus xanthus
gtccacaccgccggcggcctcttcatcatcggcaccgagcgccacgagtcgcgccgcgtggacaaccagctgcgtggccgcgccggccgccagggtgacccgggtggcagccgcttcttcctgtcgctcgaggacgacctgatgcgcatcttcgggtccgagcgcatccagggcctgatggagcggctgggcatggaggagggcgaggtcatcgagcacgtgtggctgtcacgtgccatcgagggcgcccagaagcgggtcgaaggccacaacttcgacatccgcaagaacctcctcgagtacgacgacgtgatgaaccagcagcgccgcaccatctacaagctgcgtcgccaggtgctggccgcgggcgcgggcgtgccgctggtggagtacgacgaggatccgaagacgcgcatcaagacgcgctccgagcggaccgtcagctgggcggacttccgcgagctgatcctggactcgatggaggacgtcatcgtgtccctcaccgacacctacgcgcccacccggggcgtggagggctgggacatcgccgcgctccagcagggcgtgaaggagaccttcaacctcgagatgaacttcgagggcgtgggcaaccgcgaggagctccaggagcacatctacaaggcggcggagaaggtcttccaggcacgcgatgaggagttcggcgagaacttcatgcgcttcctccagtacaactacctggcgaccatcgaccggctctggaaggaccacctgctggccatggaccacctgcgccagggcatcggcctgcgcggctacggccagaaggacccgaagcaggagtacaagaaggagggctaccagggcttcatccagatgctctccgccatcaaggcgcagttcgtcacccagctcatgcacgtgcagccccgctccgcctccagcgcggcggaagaggccgcccgcatccagcgccagctcgcgcagcagcagaagaaggcggtggagggacgcgccacggcggacggcaagctggatgagggctcggtggccgcggcggcgcgtccggcggcggccagcaggccggcggtgggccgcaacgacccctgcccctgcggcagcggccggaagtacaagaagtgccacggtgcctcggaggccagcgtctag

SEQ ID NO: 7891 - DNA, 975 bp, Myxococcus xanthus
atggaaacgcaggacacgcagacgcagcagcaggcgatggccgccgccggtggcatcacgatgaggcagctcctggaggccggtgttcacttcggccaccagacgaagcgctggaacccgaagatgaagccgttcatcttcggcgcgcgcaacggcatctacatcatcgacctgcagaagacggtcgtgatggcccgctcggcgttccgcttcgtggcggacatcaccgcgcgcggtggctcggtgctcttcgtcggcaccaagaagcaggcgcaggacgtggtccgcgaggaggcctcgcgcgccggtcagttcttcgtcaccagccgctggctgggtggcacgctgaccaacttcaagaccatcaagcagggcatcgaccgcctgaagacgctggagaagatggccgaggacggcaccttcgagcgccttcccaagaaggaagtcgcccagctcgagcgtgagcgcgagaagctggagaagaacctgggtggcgtgaaggagatgtcgaagctgccccgctgcgtcttcgtcatcgacccgaagaaggagcacatcgccatccacgaggcgggccgcctgggcatcccggtcatcggcctggtggacaccaactgcgatccggacggcatcgacttcgtcatccccggcaacgacgacgccatccgctccatcaagctgttcacctccaagatcgccgaggcctgcctcgagggcgccgcgcgttaccgcgcctcgggcgccgccgagcgcgacgagcaggaggagcgcgagggccgtgacgaccgtggcgaccgccgcgatgaccgccgtggcccgcgccgcggtgaccgccgcgacgaccgtcgcgaccggggtggtgaccgtggcggcgaccgccgtggccccctcgttgagatgaagggcgcggcccctgtcgcgtccgccgagccggccgccgaggccgctcccgagggtgaggcggcggccgagtag

SEQ ID NO: 7892 - DNA, 648 bp, Myxococcus xanthus
gaagttagcgcccagatggtgaaggagctccgcgagcggaccaacgcgggcatgatggactgcaagaaggcgctcgccgagtcgggtggcgacttcgccaaggccgaggagtggctgcgcaagaagggcatcgccaaggccgctggcaaggaaggccgcgttgcctccgaaggcatcatcggcacctacgttcacagtggccgcatcggcgtcatcgtcgaggtgaactgcgagacggacttcgttgctcgcaaccccgacttccaggagctggtgaaggacgtggccatgcagattgccgcggccggccccaagttcgtccgtcgtgaggaggtccccacggacaacctggacaaggagaaggacatccagcgcgagatcctcaagcagcagggcaagcctgaggcgatgctggagaagatcctcgtcgggaagatggagaagtactacgagggcgtgtgcctcgtggaccagctctgggtgaaggacgacaagaagaaggtcggcgagatgatctccgagcgcgccgcgaagattggcgagaaggtctccgtgcgccgcttcgtccgctacgagctgggtgagggcatcgagaagaagaaggacgacctcgccgccgaagtcgccaagacgctgggccaggcgtaa

SEQ ID NO: 7893 - DNA, 759 bp, Myxococcus xanthus
  unsure (1)..(759): unsure at all n locations
atgtcctccgacacgaagaagccgctcccgtatcagcgcattctcctcaagctctcgggcgaggccctgatgggggaggggaagtacggcatccatccgcccacgctgatgggcatcgccgaggaagtcatcgagttggcgcaggccggcgtggaggtcgcgctggtgattggcggcggcaacatcttccggggggtcgcgggcgccacggagggcatggaccgcgccagcgccgactacatgggcatgctggccacctgcatcaactccatggccatgcaggacgcgctggagaagaagggtctgcacacgcgcgtgctgtccgccatcaagatggagcagattgccgagccgtacatccgccggcgcgccgtgcgccacctggagaaggcccgcgtggtgattttcgcggcgggcaccggcaacccgtacttcaccaccgacaccggcgcctccctgcgcgccatggaaatcaacgcgcaggtcatcctgaaggcaaccaaggtggacggggtgtacagcgcggacccgaaaaaggaccccaccgcacggcgctatcggtcgctgacttacatggacgtgttgaagcagaatctcaacgtcatggactccacggccatctcgctgtgcatggacaacaaagctgccccatcatcggtgttcgaacctggacggcagcggggcaacatcccccgcgcggtgctgggtgaagggnacattggtacgttggtgggtggcagcgagacggtctgggcctga

SEQ ID NO: 7894 - DNA, 9005 bp, Myxococcus xanthus
ctcgcggacgacgaggaacagctcgtccagctcgtgctcgcgcccaagggacagggccggtacgacttcgagctctacagcctctccgccaccgccgacgaggagaccgagggatggctgctgaatggcacgggaacgctggtggtgggagacggccccgcccgtcccgagcccctctcgcggaaggacatcgaggcccgctgcgcgcgtcagctcgacggagggctctacgagcgcaactgggacatcggcttcaacctggggcacgcgttccgctggattgagcgcatccacagtgggggccgtgaggcgctgtgtcagatgcgcctgcccacggacctggatgaccggagcctgtacgtccatccgggactggtcgactcgttcctgcaggcgatgggaacggacctcatccgcgaggacgcgatgctgagcaccgtctacgtccccatttccgtggagcgcttccgattccacgcgcagccgaccggacccgtctgggcctacgccgtgcgacgggacgcggaggaagcggtgggcgaggtcatcaccggcgacgtcctggtggtcgacgcggatggtcaggtgctcatcgagattgaggggctgaagcacaagcgagcgccgcgagaggcactgatggcggtgctgcgccacggccagcgggactccctctacgaactgggctggaagccgcagcccgtgcccgaggcttcgcccgaagccggctgctggattgtgttcgctgacacctcgggcaccgcggaggcgctcgcggagcgcatcctgaagcaaggcggccgtccggtgctggtccatccgggagcggcgttcgtccgtcatggtgaagggcgcttcacgctggatgcccagcggcccgaggactacgcgcggctgctccaggaggcggtgctgcccggcgagtccctgggcggcatcgtccacctctgggcgctgcgtgggcccggtggcgaggatgtgggtgccctgcgagaggcgcaccaactgggagcgggcagcgcgctgtccctggcccaggcgctggcgaactccgccttcaccgcgcgcatctggtgggtgacacggggcgctcgcgcgctcgacacgcgtcctacgccgctggcgatggagcaggtccctctttggggcctgggcgccgtcttctcgcaggagcaccccgagctcgctggcgcgctcatcgacctggagccctcctctgtgccgggtgacgcggccgccgccatctggcgcgaactgggcgccaccgacggtgagcggcaggtggtgattcgcgaagggcaacggcacgtggcccgccttcgcgcctcgcgggacgtggcgcggacggagttgccgcgcctgaaccccgaagcgagctatctgctcacgggcgggcttggcggcttgggcctcgcgctggccggctggatggtggagcagggcgccaggaacctggtgctcatcggacgcggcgccccccagccggaagcgcaagaggccatccgcgcgctggagaccgcgggcgccaaggtgcttgtgctccaggcggacgcgtcgaagcaggaggacgtccgtcgcaccttggatgaagcggagaagctggcgcctctgcgcggcgtggtccacgcggcgggcgtgctggatgacggcgtcctcctgcaacaggactggaagcggttcacccgggtgctcgcgcccaaggtagacggggcgtggcacctgcacacgctgacgcagggcaagccgctcgacttcttcgtcctgtactcgtcggcgtcgtccctgctgggcgcgccggggcagggaagctacgcggcggccaatgccttcctggacgcgctggcgcatcaccggcgtgccctgggacttccggcgctgagcatcaactggggaccctgggccgaggtgggcatggccgcggagctcgcgtcccgctaccaggcgcaaggtgtggaggccttcaccccggccgaggcgctggaggccttcggcaaggccttcagccgtgcgcagccgcaactcaccctgttgcaggtgcagtggtcgcgctacctggcgcagttcccccggggggcggcgcccacgctgctcgccgacgtggcagggcaggtgcgtgccgagcccgaggcggacggcccgtcggcctcggagttgcggcgccggctcgacaccgcggaaccccgccagcgcatggcgctgctgttggagcacgtcctggacgcggcggtgagggtgctcggcctggatgcatccacgccgctggagccacggcagcggctgttcgaagtgggcatggattcgttgatggcgctggagctgcgcaaccggctgcagaagacggtcggtgcgtcgctgccttcgacgctcgtcttcgactacccgacggcggaggccatcgcggcctacctgctgggcgaagtcttcggccaggagccgcagccggccgcggaaggacagggagcggctcaggacacggcgcttctcgatcgaatcatggagctgtcgccggatgagcttgccgcctcgctcgaagcgaagctcgccgcactgatggaagaaggaacatgagcaactcgccaaagtcagctgaaccctccgcgttgcagcgcgccgcgttgctcgtggagaagatgcaagcccgcctcgatgcggtggaacgcgcccggaccgagcccatcgccgtcatcggcatgggttgccgtttccccggtggtgccgtcgatggaccgtcgtactggcggatccttcgagacggcgtggatgcgctgcgcgaggtgcccgagtcccgctgggacgtgcagggctacttcgacgcgacgcgcgggatgccggggaagatgtacggcacccgcggtggcttcctcgatgacgtggagcacttcgacgccgagttcttcggcatcgcgccgcgcgaagcggcgagcctggacccacagcagcgcatcgccctggaagtggcgtgggaggccctggagaacgcgggcgtggcgcccggtcagctcatgggcagcaagacgggcgtcttcatgggcgtgatgtccagcgactacatggcacgcctgctcaaggaagacgacgcgacccgcttcgacgggtacatggcgacgggcaacggctacagcttcgtcccggggcgcatctcctacgtgctgggcctgcaggggccgtgcatgccgatcgacacggcgtgctcgtcatcactggtgtcgctccacctggcctgcgagagcctccggcgcggcgagtccaatctcgcgctcgcgggcggcgtcaatctcatcctgtcccctgagacgacgatttgcctttgcagcatgcaggcgctcgcgagcgacggccgctgcaagaccttcgacgcggcggccgacgggtacgtgcgcggggaggggtgcggcatcctcgtgctcaagcgactgtcggacgcgcagcgcgatggcgacgacatcctcgcgttgattcgtggctccgccgtcaatcatgacggggccagcggcggactgacggtgcccaacggaccgtcgcagcaagctgtcgtgtcgaaggcgctggagaacgcgcgcgtgccgccggccctcgtgggctacatcgaagcccatggcacgggcacgccgctgggcgaccccatagaactccgggcgctgggagccgtgctgggcaagggacgtccggaggaccggcccttcttcatcggctcggtgaagacgaacatcggccacctggagccggcggccggaatcgccggcgtcatcaagacgattctgtcgctccagcaccgggagataccgccgcacctgcacttccacacgcccaatccccacgtggaatgggaccgcatccccgcgcgtgtccccgtcgagcgaatcccctggccggcccacgaggggcggcgcatcgcgggggtgagctccttcggactgagtggcatcaacgcgcacgtggtgctggaggaagcccccgcacccgcggccacgcccgccgcttccgaggtcgataccgcgcagctcgtcgtcctgtccgccaagacggcgccagcgctggccgacctggcccggacgtggagcacgttcctgaagcgcgaggacgtgggaacgctcgcggacctcagctacacggcggccctgtgccgtacgcaccatgaccaccggctcgcgctcgcggcgaagtctccccaggagctggtcgcgcagctcgacgcgttcgccgccggagagagtcaccccggtctgtccgtggggcgccggagcaacagccagaaggtggtcttcgtgttccccggccagggctcgcagtggctcggcatgggacggcaactgtacgcccaggacacgacctcccgtgaggccatcgaccggtgccacgatgcactgggccgctacacggactggtcgctgcgcgagctgttgacgaaccccggtcagcaaccgcgttggaatgacatcgacgtcatccaaccgacgctgttcgccttgcaggtgtcgctcgcggcggtgtggcgttcactgggcctggagccgcacgcggtggtggggcacagcatgggcgaggtcgccgcggcccacgtcgcgggggcgctgtcgctggacgacgccgcgcgcatcatctgcgagcgcagcaagctgctccggcgggtcagcggccagggcgccatggcggtggtggacctctcacgcgaacaggccgaggcggagattcggggcgcggaggaccggattgccatcgccgtcagcaacggcccgaaggccacggtgctctcgggagacccggcggcgctgaaggaggtgttggagcgcctggagaagcgcgaggtcttctgtcgttgggtgaaggtggacgtggcgtcccacagcccccagatggacccgctccggcaggacttgctggagcggatggctggcatccgtccgacgggaagcacggtgccgctctactcgacggtgacgggcgcccccatcgacggccgggagttgagcgccgcgtattgggtgcgcaacctgcggcagcccgtgctgttcgcggacgcggtgcagcgtctcatccaggacgggaacgtcctgttcatcgagctgagcccgcatcccatcctggtgcccttcgtggacgcgatgctgcgggaaggcgacgcctccggccgtggcctggtcgtcccgagcctcctccgggaacaggaggagtggccgtcactgctcgcgtcactgggcgcgctggccacccgagtggaccgcgtggactggctccggctgcatccggacaagcggcggcgagtcgcactgccggcgtatccctggcagcgggaacggcactggctggagctgaggcccacgcgtgcagcgggaggccgcttcgtgcgagcaggggcgggtgcccatccgctcctgggtgtttccttcacgacctccgtgcagcaggagacccgcttctgggaatccacactgagcgcgagcgagcccccgttcctcgcggaccatcgcgtggcgggctcggtggtggtgccgggcgcggcctatctggagatggcgctgtccgcggcgcatgcgatgtcgggaggcaccgcgcacgagctggtcgacacctccttcaaggaggggctgctcctgcccgagggccaggagcgcaccgtccaactggcgctgcacggcgagcagggccgcaccctcacgtttcagctgtcgagccagaaggcggaagcagcggggtggatgacgcacgtcgtgggcaggctccgcctcttggacgcagggcaggcggggcaggcgtccgaatcgttggaggccatccgcgagcgttgccccgacgtcctgacccaggcggcgcattacgagacgctggcacgcaacggcgtggcctacgggcccgcgttccagggcgtgcagcaggtctggcgagggcgaggggaggcgctcggccacctccgcctgccggagtcattggccgctcgggcctcggcgtatcgaatccatcccgcgttgctcgacgcctgcttccagttggtgtccgccgcggtgcctccggaggacatgccacaggacgtggggcccgccgtcccggtggcgctcgagaacctgcggcttcacgcaccgcccccgacggagggcttctgccacgtccggatgcggacacttgagggcacgcgccggggcgtctacgagttcgacctcgtgctgcgcgatgcgtccggcacgctgctgctggaggcgctggggctgcgggttcagcaactggatgctcccgtggcggatgcggagggccgggacctctacttcgcccagacgtggcgccatgccccctccgtcgatcagctccccgcacagggcgccgaggcgggcggaagttggttgctcatcacggatggcagcgagctggcggacacggtggagtcacagctccgcgcgcgccagggcgaagtcacccgtatcgacctgggtggctccaagccgggccgccgtaccgtggacgtgtcgtcgccgatggccttcgatgaggtgctggcggagacgttcggcaagggagccgctgcgcgcggcgtgattcacctgacgggcctggaatcgggcgacgtggacccgttgatgagctgtggcggcgtgctgcacctcgtgcaggggctctcccggttgggcctgtcgagtccgccacgtctgtggatggtcacgaagggggtccaccatggttcggacagccgctccgcttcggacgtcgtgcaggcgccgttgtggggcctggggcgcacgctcgcgcaggagcacgccgagctgaagtgcacacgggtggacgtgtccgcggtcatgcgcaccgaggacgccaccggcgcgctggtgcgtgagttgctcgtggcggacgcggaggaggaaatctccctccggcctgatgggcgacatgtcggccgcatcgttcgtggcacacccggcagggcctcccatgaggccatggtccccgccgagggccagtccttccgggtcgagcgtgatgctcaggggcgccaggagtaccggtccgcggcccgccgtccgccggggcctggagaggtcgaactcgaagtcgaagtggcggcgcgtccggggctcggcggggcgtcgagcccggagcgctgggacgaagcaggtgtcaccgcatgcagtgggcgcatcgtggctgtgggagagggcgtgaaggacgtcaccgtgggcgaggagcgcatcgcgctcgtgacgtcgggcctcgggtcacacctgtgcgtgcccgttgggcacaccgcgccgcgtccgccctcgtcgtcgcatgaagaggccgcggcgctggcagcgacggtgctgcctgtctggtacggcctgttccacctgggacgcttggagaagcgagaccgtgtatgggtcctcggggcttcgagcggactcgggcgaacggccatccaactggcacggcgcatgggggcggaggtcttcgccgaagccacgacggatgaccagcgggcctccctgctggagctcggcgccgcccacgtcgtggaccccacggacgcctcattcgccacgggactgctggatgcgacgggaggccgagggctggacctggccgtcatcgcgccgggcgctgtcggcctcaatccgagcctcgccgtgctggcggagggggctcgcgtcatcgacctgcgagggacgtccgaagcgccctcggccggggatgcgaacgtcgcgtggtgcgtggtcgacgtgcacaccttcgcgcgccgcaagcccgaccggttcgcccggctgtggcgcgaggtgaaggacgcctccgaggccgggggcctgccctccaccgtgaaggaggtgagcacgctcaccctgaatcatcccggggcacgcgtggtggtgccggccacggcggctcggcgactccgcgcggatgggacgtacctggtgacgggtggcctgggaggactgggcttcgcggtggcgaagtggatggtggagcagggcgcacggcacctcgtcctccttgggcgtgacgcctcgttgacaccagcgcaacaggcggacgtggccacgctcgaagcggagggggcgcgcgtgcgggtgatggcggcggatgtgtccgaccggcctcagttggcctgggtcctcgcggagatcgccgagggtggagcaccgctgcgaggcgtcatccacgcggcgggtgtgctggacgacggcgtcctgtcgcagcagacggtggagcgcttccgccgggtgatggcgcccaaggtcctcgggggctggaacctgcatgtcctgacgcgcgacctgccgctcgacttcttcgtgctgtactcgtcggcggcctccctgttcggcgcacccgggcagggaaactacgtggcggccaatgccttcctcgacgcgctggcccatcaccgccgggtgctggggctgccgggcctgagcatcaactggggacccttctccgaggtcggtctggccgccgcgcagtccaaccggggagagcgcctggctcagcggggctccgacagtctgacgcccgcggaaggcaacgtcatcctgggccggctgttggatggcgacgtgacgcagatggcggtcatgccgctcgacctccgcaagtgggtggagttctatccgcgagcgaagtcctcgcattggctgtcggagctcgtcccggccagcgcgggggagggcgcgcaggccgcccgggatgtggcgctgctcgaagccctgcggacggcgacacctcgggacgcgcgggtggcgctggagaagttcgttcgcgagcagctgggccgggtgctccggctcgactccgcgcgcatcgacgccgaagcgccgctccaaggcttcggactcgactcgctgatggggctcgagctgcgcaaccggttggcgtcgggactggggctgtcgctcccggcgtcactgatttggaagcacccgacgctggatgcgctctgtgcgcatctccagagtgaagtcatggaccgcgccctggccgagactctcgcaatccaggcagaggcggccgcaaccaacgacaacgaggtcttcgtcctatga

SEQ ID NO: 7895 - DNA, 558 bp, Myxococcus xanthus
atgagtggagacgtcgtcgccgaactgaagggccgtatcgacaaatcgctcgagggcctgcgcacggacctgacgagggtccgcacgggccgcgccagcatcgccatcctggagggcgtccgggtggactactacggcacgccgacgccgctgtcgggcgtggccagcgtgaacgcgcccgagccccggctcatcaccatcaagccgtgggagaagagcgtcctcaaggacatcgagaaggcgctgcgcgaggcgaacctgggcatcaacccgatgaacgacggcgagatgattcgcctgcccttcccgccgctcactgaagagcgccgcaaggacatcgccaagcaggtgaagaccaagggcgaggagttcaaggtcaccatccgcaacctccgccgcgacgcgaacgaggtgctgaagacgcagctgaaggacaagaagatcaccgaggacgaccacaagcgcatcaccgaggtcgtgcagaagcagaccgacgcgggcatcacgcaggtggatgaaatcgtgaagaagaaggagaaggaggtcatggaggtttga

SEQ ID NO: 7896 - DNA, 591 bp, Myxococcus xanthus
atgcccaccgtcctgctggcgtccggaacgggcgccctggacggtgaggcgctgtgccggagcatgcgggccgaaggcctcgccgcgccggtgttgctgttgtattcgccggacgaggagcaggcagacacgcgggccgcccaggcgggcgcggacgggtgcctggtggggccgctgaagcgccccacggtgttgacgtgcgtgtccctgcttgtccagcgcgaggaggcgctgcggcgggtgggttccgtgggcgtacggccgccgccacccccgttcgatggggcgtctcacgcgggtgggccccctccgcttccgggcgcgttgggcgggcggatggttccgcctcctcctccgccgctcgacggcgtggatgcacctgtcgagagtgtggatgcgcggggcatgccccctccgccgccgctcgacgaagaggcaccggaagcggagagcgcacaggcgcgggtggtgccaccgccgcgcgaggcggaagcgccgttgtccgagggccacggcgcgaagtccgcgtcgctgccacctgagctggacgaagagcccatcacgtcgccgtcctcagaagcggacagcacg

SEQ ID NO: 7897 - DNA, 213 bp, Myxococcus xanthus
tgctctaaaggcgacttcgtcctcaagtcgaagggcgtctacaacggctcgcacgtgaactggaagggcacccggcgcctgcgctgccgcaccctgcgcgccgagcccgtggacggcggcgacgtgttcctggacgtggacggcgagacgccgggccgcctcccgtgcaccatgacgctgctgcccggggccatccgcctcaaggtgctgtag

SEQ ID NO: 7898 - DNA, 255 bp, Myxococcus xanthus
atgctcccgccggacctcggctacgaggaggcgcgcgcgcgttacgcgccgttcaacaagctggtggacgaggacgtccccacgcgcgatgtcctggcccgggtgtgcctggcggcgctgcgccgggacaagcccaccttcatcaccatcaacaacaaggccgagggcagcgcgccactgtccgctatcaaactggccgagcgcgttgtcctgggcaggcgggaagaggccgagcgtcacgccgccacccgttga

SEQ ID NO: 7899 - DNA, 222 bp, Myxococcus xanthus
atgtccgcagggggcgcaggcgcccagggcgagcaagcagccggccgccagcaaggcgacccgggcagcatctccacgaacctctccgcgctgaagggcgaagtctcatcgctgtccgagcgcttcaaggccgcccgcgagcggcgccgcttgcaggcggagaaggagaagcaggagtgggagcgtgagccgaaggcgcctgccggtcctcgacgcgaatga

SEQ ID NO: 7900 - DNA, 2541 bp, Myxococcus xanthus
ccgcaccaggtcgaaggcgccatgttcgcgctcgactcgctgtcgcgcggcggctgcatgctgggcgacgaggtcggcctggggaagaccattgaggcggggctcgtcatcgcccagctcatggccgaggggaagtcgcgcatcctcatcctggcgcccgccacgctgcgcgcgcagtggaacagcgaattgcgggagaagttcgacctggacagcgtcctggtggacggccgcaccgtgcgcgccaccgggaactgcttcgaccagcccttccccgtcatctgctcgcaccccttcgcggccaacaaggcgcacctgacggcggagattccctgggacctggtggtcatcgacgaggcccaccgcctgcgcaacgcccaccgccccaacaacaagatgggccaggcgctgaaggcgtccctggccggcaagcccaagctgctgctcaccgccaccccgctccagaatgacttgatggagctgttcgggctgatgtcgctgctggacgagcagatcctcggccccgagcacgccttccgcagccgctaccgggcggacgaggccggtggaatgccggaggccgccgccatcgagctgaaggagcggctggcccccgtggtgcagcgcaccctgcgccggcaggtgcgcgaatacgtccgctacaccaaccgccgctccatcgtggaggacttcaccccctccccggaggagcacgacctctacgaaaaggtcagcgagtacctccagcgctccgaggccgcggcgattgaacccggcaagaagacgctgctgacgctctgctaccgcaagctgctggcgtcctccacgtacgccatcgcccccaccctgcgccggctgtccgacaacctggagaagcggctccaggcggcgaagctgggccagcaggccctggcgatgttcgagcccgaggaggccaagcagttcgtcgaggagggcgaggagtggtcggacgaccccgccaaggcgcccaacgtccgcgcgctggagcaggaggtctgggagctgcgccagtacgcggacctggcggactccatcaaggtcaacgccaagggcgaggcgctcaagcgcggcctggaccggaccttcgccgtgatgaagtcgcacggctggccggagaaggcgctcatcttcaccgagtccaagcgcacgcagcagtacctctccaacctcctgtcggagagcggctaccaggggaagatctccctgctgtccggagacgcgggcacgcccgaggaccggcgcgcgctggtggaggagttccgccaccgcacgcagatcctcatctgcaccgaggcgggcgccgagggcctcaacctccagttctgcaacctggtggtgaactacgacctgccctggaacccgcagcgcgtggagcagcgcatcggccgctgccaccggtacggccagcagcgggacgtgctggtcatcaacttcctcaaccggatgaacgcggcggacgcccgcctcttcgaactgctggagaagaagctgaacctcttcgacggcgtgttcggcgcgtccgacgaaatcctgggcgcgctggagagcggcgtcgacttcgagcggcgcatcctggacatctaccagtcctgccggaagcccgaggacatcaacatcgccttcgacaagctccgtgaggagttggaaggccgcatcagccagcgcatgacggagatgcgctcggtggtgctggagcgcttcgacggcgacgtgcggcgccggctgcgcggacagaacgagcagacgaaggaggccctggccaagcgccagcaggaggcgcgtgccctcaccgcctccgtgctgggcagccgcaactcggggcggctggaggtggccaaggccgcctatgccgtcaaggagcgcacccaggacgcggtgagctacctgcaactggacgcggcgggactgccgtcacggctggcgcggctcgcgggcagcgagggctggtggttcgcgtacaagttcgagacgaccggcctcaagcccgaggagaagctggcccacctggtgctcgtgcgtgacagggacggcttccgcgccctgcccatggcggacagcgcgcacttcgtgaagctggcggcgaagccggagcggcggcgtcagcccgcgccggtgtccgtgcaactgatgcaggagcaggcgctgatggcggcgaaggacgaaatcgtccgggccgcggagcggcgcaacgcccaggagctggacaaggccaaggagcgcgcggaccgctacgtcgaggactgcctcatggagtcgcgtgaggccgtggaagccgcgcggcagacgtggattgaagcgcgcaagcaggtggggctggccgaggacatcgccgacaaggccaaggcccgcgcgcactccgaccggatggagcgcgagtaccgccgcaagctgtcctcgctccgcaacgaggaggagaagcggtacgcctccaaggaccggcagttggcggagctggccaacaaggcgaaggtgatggagaagcgcgccctcatcgcctccgcctacttctggctgtcgtag

SEQ ID NO: 7901 - DNA, 1173 bp, Myxococcus xanthus
cgcgcccagagcgtccgcgtctggcggcgcgtggagcccgtcctctcctccggcacgcgcaacgccgtgcacgtggcgctggagcgccaggacaccggcaccgcgccgctgcacgtggaggtccgcgacgagccgcccgaggacatggccagcagcgggcaccggcaatccctcaccctgcccgcggcacggtccacgccccaggagctcacctacttcgtcacgccgccttcgcggggtgacgcccgcttcggggacgtgcacctgcggctgcgaggccccctgggcctgtgcgcgcgacaggtccgcgtccccgcgacgatggacgtcaaggtgtacccggacctcaccgcgctcacccgcgaagcactggcgctggcccacgcctcggacgccccttccgcgcgcacacagcggcggcgcgcctcggagggccgggagttcgagtcgctgcgcgagtaccgccccggcgacgactaccgccacatcgactggaaggcgtccgcgcgccacgcccacaccctggtgcgcacgtggcagccggagcagcaccagccggtgctcctgctgctcgactgcggccggcacatggcgggccgcatccaggagcggcgcaagctggaccatgcggtggacgcggcgctgcggctggcgcgcgtgggcctggaggccggggacgtggtcggcgtgctggcgttcgccagcggcgtgcgggcctacctgccgccacgcaagggccgcgagcacctgcggctcatcaccgaatcgctctaccgcaccgaggccgcgctcgaggagagcgactacggccgcgccttcgacttcgcctttgcacgccagacgcggcgcgccctggtggtgctgttcacggacctggtggacccggacgcctccgccagcctcctcactcgcacgctggcgctgcgcccccggcacctgcccgtcgtcgcctcactgctggacgaggacgtccaggcggccgcccacggtgtgcccgcgcagacgcaggatgcctacgcgcgccaggccgcggcacggctggaaacggagtaccggcggacggccaccaccctgcgggacgcgggcgcgctggtcatccgagcccccgcgcgcggcttcggcgcggccacgctcaacgcctacctggacgtgaaggcgcgcggactgctctag

SEQ ID NO: 7902 - DNA, 477 bp, Myxococcus xanthus
atggccggccctcccgacagtgacttggacgacgtggcgcgcatccgcctcgtgctggcacgtgagctggagaccatcaacgagtacgaagcctacgctcgtgcctcctcgaaccccgaggtccgcgcgttcttccagcacctggccgccgaggagaaggagcacgtctccgaggccgtccacatgcttcgcatgttggacagtggtcagaacgaccacttcgccaagcccttcgtccccggtcatttccaggccgccgaggcccctgcccccgccaccgtccatgtgcccacaccggacggcccggcgttctccgtcaacggccgcaacggccggctcccctccgagccgccaacgtccctgccgccccagcggctgctgtacggcctgcccgcgccgccgcccgccgtggagtcgcacccgctcaccgtgggttcactgcgccggggtggcggtggttccggcagcggtcgctga

SEQ ID NO: 7903 - DNA, 864 bp, Myxococcus xanthus
atgcctgacttccttggacatgccgagaacccgctccgcgaagaggagtgggcgcgtctgaacgagactgtcatccaggtcgcccggcgttcgctggtgggccggcgcatcctggacatctacgggccgctgggcgccggggtgcagacggttccctacgacgagttccaaaacgtttcacccggcgccgtggacatcgtcggcgagcaggagaccgcgatggtcttcaccgatgctcgcaagttcaagaccatccccatcatctacaaggacttcctgctgcactggcgcgacatcgaggccgcgcgcacgcacaacatgccactggacgtgtcggccgccgcaggcgccgccgcgctgtgcgcgcagcaggaagacgaactcatcttctacggcgacgcgcgcctgggctacgaaggcctgatgacggccaacggccggctcacggtgccgctgggtgactggacgtcgccgggtggcggtttccaggccatcgtcgaggccacgcgcaagctcaacgagcagggccacttcggcccctacgccgtcgtgctctcgccgcggctgtactcgcagctgcaccgcatctacgagaagacgggcgtactggagattgagaccatccgccagctcgcgtcggacggcgtctaccagtccaaccgcctgcgcggggagtccggcgtggtggtgtccaccggccgggagaacatggacctcgcagtgtccatggacatggtggcggcgtacctgtgcgcgtcgaggatgaaccacccgttccgcgtgctggaggcgctgctgctgcgcatcaagcacccggacgccatctgcacgctggagggcgccggcgccacggaacgtcgctag

SEQ ID NO: 7904 - DNA, 1392 bp, Myxococcus xanthus
acgacttccaccatggccaaggtcctggtcatcgacgacgaggcgaacctccgcaaggtgctcgccgcgatgctgcgccgggacggcttcgacgtcaccgtggcggagaacggcgagcaagggctcgccgagttccacaagaacggcgcggacatcgtggtaacggacctggtgatgcccaaggtgggcggcatggaggtgctcggaaccatccgcgccgccaacccggacgtccccgtcatcatcatcaccgcgcatggcacggtggactccgccgtggacgccatcaaggcgggcgcgttcgactacatcaccaagcccttcgatcaagcggagctgtcctccgtcgtcgccaaggccgcgaagacgaacgagagcgcccgccgctccgtgcgcccggacgtgaaggcgcgcgcggccatcatcggcgactcgtcgacgatccaggaggtctacaagatcatcgacaaggtggcggacacgccgtccacggtgctcatcaccggggagagcggcaccggcaaggagctcatcgccaccgcgctgcacggcgcctccagccgccgcgacaagccgttcatcaagatcaactgcgccgccattccccacacgctgctggagagcgagctcttcggctacgagcgcggggccttcaccggcgccgtcacgtccaagcccggtcgcttcgagctggccgacgagggcaccctcttcctggacgagatcggcgagattccggtggagatgcaggtgaagctgctgcgcgcgatccaggagggcgagttcgaacgcgtgggcggcatcaagacgacgcgcgtggacgtgcggctcgtggccgccaccaaccgcgacctccaggcggagattgaagccggccgcttccgcgaggacctctactaccgcctgcacatcgttccggtggtactgccgcccctgcgcgagcgtcccgaggacatctccctgctggcccgacacttcgtggccaagcacgccatgcgcgtgaaccgacgtgtgatgggcttggacgacagcgcgctgcgcgccctggcccgccacgcgtggcccggcaacgtgcgcgagctggagaacgtcatcgaacaggcgctcgtcttcgccgaaggtgagcagctcaccgacctggacctgccctcacacctcaccgccagtggcaccccgcgcgtcgaggcgggcctgccagtgctccagggcgaccgccccctgcccgacatcctggaggatttggagcgtcagctcatcgcccgggcctatgagaaggccagcggcgtgaagacggagacggcccgcctgctaggtatcaagacgtccgcgctgtactacaagctggagaagtacggcttcctccccaaggggacgcctcccgaggagagctga

SEQ ID NO: 7905 - DNA, 1093 bp, Myxococcus xanthus
atgggcagacaggctggcactcaccttgctctggggctgtcgctgatgaatctccgctccctcgccctcctgctgagcctgctgctggccatgcccggtcaggccgcgtctgggctggaggcggtgcggggaagggctcagtcggctcgcgcggagacgcgctcgctgcggggtcagcagcaggccctgcgcgacgagctcaacgggctggccgcacgcatcgaaacgctgaaggcgcagcgccagggccggctgatggcggggacggagctggaggacgcgctgcggcgttcgcaggagctgagcggtcagctcaccgggctggcgcaggccgtcgtcgcggcggagggcgaagcggagcgcgcccacctcgccctgcacacggcgctgtcggacgagctgacgcggctgctcgcggcgtgggaaggcacggcggaccggggccagcgggagaagctgttggaggcggtgcgctccgttcgcgcccgagcgggaagccatccgcgccgccctgcccgcgtcccaggtgccctcgctggacaaagccaccgcgggcggtgatgaccccgaggatttgctggcccaggcggacacgctccgcgatacccgggacaaggtgcgcgagcggctgaaggcgctccgcggccgcatcaccgaggtgcgcgaggagcgcgacctggaccggcgcatgaacgacttcctcggcgaggagtcgatgttcgacgaccaggaccggcggctgcgcctgcgaatggggagcgaccggacgctgcaggtggagcgctccgtgccaggccccagtgcgccgaccttccagggtgacagccccgacgatccgacccccaacgtgggcggacgccccggtgaaggtgtcgacccgagccgccccccctatccgacgcagttgtcatcccgggccacggaccggcggccccaggtcgaaacgcagcgcgcccaggacctggcgtcgggcggccccgtggacctggcggcgatggaggcagaggccacgcggctggagacgctggccagggaactggagggccgcgccacgaagctggagcgccgcgcccaggagatgggcgtcccctga

SEQ ID NO: 7906 - DNA, 183 bp, Myxococcus xanthus
atgctcgccgccggccgtgcgcccgcggccgagtgggaaggggcactgaggggaaccggccgcctgctgctggacaccaacgcgccccgggacttatccgaccagctcacccccagcccggagcgggacttcgccctcagcctgttgggctccgccgaggggcgcggctccttcgaaccgtag

SEQ ID NO: 7907 - DNA, 774 bp, Myxococcus xanthus
atggtcgtcgtgaagcgggcgtcgggtgccatcgagacgcgcggcccggtgggggatgctcccgccgaggcgaccgcgacggccgaggagacgaccgccgccgccgaatcctccgccgcgacgccggcccccacgccgcgtccggtcattccgacgccggcgccgaccagcgcgctgtatgaggaagttcccgaggcccagtccttcgccgagatgttcgaggctcaggcgaaggagggggggacgcccagccgcaagggcctgcgcgtgggcgagaaggtccgtggcaccatcttccagctcggcgcggacaccgcgttcgtgtccgtggaaggcgcggccaagagcgaggcgatgatcgagcttcgcgagctgaaggacgacgagggcatcctgcgcttcggcgtgggtgacaccatcgacgcgcacgtggtggaggtgggggccaagggcatcctgctcagccgcgcgctggccaagggcagcgcgaacctggccctgctggccgaggcccgcgcttccggcatgcccgtcgaaggcctggtgctgagcgtgaacaagggcggtgtggaggtcgccatcggtgacatccgcgcgttctgccccatcagccagttggacctgcgctacgtggagaagccggaccagttcatcggtgagaagctccagttccgcgtgagcgaggtccgcgagcgcaacgtggtgctgtcgcgccgctcgctgctggaggacgagcagcggcagctggccgcggagacgagcaagaacccggag

SEQ ID NO: 7908 - DNA, 1587 bp, Myxococcus xanthus
tcccggctgatgggcctggtgcgcgagcgcgtcttcgcccactacctgggtaatacggaggtcgcggccgtcttcaaggcggcgctgcgcattcccaacttcctgcagaacctgttcggcgagggcgtcctctccggctcgttcattcccgtctacgcgcagctcttgggccgcaaggacacggagacggcggaccgggtcgcgggcgccgtcttcggcatcctgtccctggtcacggcggtggtggtggcgctgggcatggtgttcaccccgctgctggtggatgccatcgcgcccggtttccagggacaggagcgggagctggccgtccacctggtgcgcatcctcttccccggcacaggcatgctggtgctgagcgcctggtgcctgggcatcctcaacagccaccggcgcttcctcctttcgtacctggcgcccgtcgtctggaacctggtcatcatcgccgcgttggtggccgcgggaggccgctacgaggaagaggcgttggtttcggtgctggcctacgccgtggtgctgggcagcttcctccagttcgcggtgcaggtgccctccgtcctcaagttgatgggccgcttccgcccgacgctgtcgctggcggcggagccggtgcggcaggtgttgaagaacttcgggccggtcgtgctggggcgcggcgtggtccagttcagcgcgtgggtggacacggccttcgcgtcactcatctccaatcgcgcgctgtcctcgctgctctacgcgcagaccatctacctcatcccggtgagcctctttgggatggcggtgtccgcggcggagttgccggagatgtcgcgcgccacgggggagggcgcggacgtggccgccaggttgcgccaacgcatcgacggaggcgcacgccgcatctgcttctgggtcgtcccgtcggcggcggccttcctcttcctgggggacatggtggcggcggcgttgctgcagacagggcgcttcgatgcggcggactcgcgctacctctggtacctgctgatgggggcggcgctgggattggtggcctccacggtggggcgtctctatgcctccgccttctatgcgctgaaggatccgaagacgccgctgcgcttcgcggtggtgcgcgtgctggtgggtaccctgggcgcatgggtgctgggcctgtggctgccgggatggctgggggtgccgcagcacctgggcgcgttgggcctcaccctggccagcggcctggtggcctggctggaggcgggactgctgcgccgcaagctggtgaagcagctcgggccggtcggcgtcccgtctggactgctgcctcgcttgtggggcgccgcggtggtggctggattggtggcggtgggcatcaaggtgggcctcacctcgctgctcgggccgatgcccggtgtgtcggcggagtggggggggggcttcctgatgccgccgcgcctgcaccccgttctgggcttcgcggcggtggcgctcccgttcggtgctgtttatttcgggatgtcagcggccttgggcatcccagaggcgggaacggtgttgcgcaaggtggggcggaagctgcgtctggtgcgctaa

SEQ ID NO: 7909 - DNA, 375 bp, Myxococcus xanthus
atggacttcgacaagaaccaggacttcaagaaccaggggattcacaagggcgaggtgacgtccgtcaaggtggagtccctcacgctcaaggtcctcagccccaatgaccaggacctccgtttcctggactcagtggagttctatgcccgcgcgggagaccgggaggcgcgcatcgcggcgcgccaggacgtgtccgcgctggacctgaggccgcccaaccccgtgctgtcgctgcgcgtggacaacgtggagttgcagcccttcgtctccgcgccgtccatgagcatcatcatccgcggccgcggcatcatgccggcgcgcgaggtgcggctgcaggcggtggtgaagctccaggtggagaccgggctcttgtag

SEQ ID NO: 7910 - DNA, 309 bp, Myxococcus xanthus
atggctttccaagaccgctcgaacgcactgcaggcgctagaggccgagttccaggcggagaaggcctcctcgctccggaaattggaagtgaagctggaggagacgctgcgggagctgtccgaggtcgaacgtcaactgcggtccctccggaccgccgaccggcgcgcgcagattgcccgccaccaggccctgcgcaaggaagccgagcaccagcgctggtgcttcatggtgcagcgggaggcgtgtggcttcgtcaaccacgacgacctcgaccggtactacccactccccccgtcctggagggagtga

SEQ ID NO: 7911 - DNA, 663 bp, Myxococcus xanthus
atgacctcacccaacttcattccttcaacgaagccgcttcccttcgagctgcacccgtcctccatccagggccagggtgccttcgccatccgccgcatccgcaagggcacgcgcatcatcgagtacctcggtgagcgcatcacgcaggcggaagcggacgtccgctacgacgacgaatcgatggcgcggcaccacacgttcctgttcaacctcgacaagaggacggtgctggacgcggggacgattcacaacgaggcgcgctacatcaaccactcgtgcgcgcccaactgcgaagccctcatcgaaaagggccacatctacatctacgcgctcacctccatcgagcccggtgaggagctggtgtacgactacggctacgagcgcaccgaggacatggggcccgaagccgaggcgctctacgtctgccgctgcggcgcgcccaattgccggggcaccatcctggccccggcgaagaaggcgccggcccggaagacgtcggccaagaaggcgaagacttcgtcgacgtcgagaaagaagtctgcgtcgaaatcccggggcaacaagggcgcggggggcaagaaggcggcggggaagaagtcatccgccggtacccgcaagtccacccagcgggcgaagtcgcccagccgtaagcgcgcgagctga

SEQ ID NO: 7912 - DNA, 771 bp, Myxococcus xanthus
tctggctaccacgccgcgcaccggcgcctgtttccggagctcccggcggagcggaccatcgcgctctgcgccacggagccgggtggcgcgcatcccaatgccatcgagacgcggctgacggatacaggcgcgggcccgcgcctgtctggcaccaagacgttcgtcaccctgggcacgcacgcggagctgctgctggtggtggcgtcggaggggcaggacgcacagggccgcaaccgcctgcgcatggtggcggtggacgcgaagcggcccggtgtgcggctgagcgcgctcccggagctgcccttcatccctgaggttccccacgcggagctggctctggaggatgtggcggtcgcctcggaggacgtgcttccgggagacggctacgcgcgctacctcaagcccttccgcaccgtggaggactgccacgtccagctcgcgatgctgggctggctgctccaggtcgggcgccgcagtggctggccggacgacgtgcgcgaggagctgtccgccctggcggtgatgatgcggggcctgtcccagttggacccgacggcggcgtccacgcacgtggccctgggcggagggctggcgctcaccaagcgcgcggtgctggagcggtgtgaacccctctgggccgccacggatgccatcacgcgagagcgctgggctcgggaccgcgtgctgctgggcgtcgctggcaaggtgcgcgcgaagcggctggatgcggcccggcagcgcatccacgaggaaactcgtcgaagcggctga

SEQ ID NO: 7913 - DNA, 609 bp, Myxococcus xanthus
atggtgcccatggaggacccgattccagcggactccatctccgggcagacgatgaactacatggagttgctgcccaaaacggtgagggtgagcacggcgctgctggagggccgccgctcccgctcgtggcgcgcggcggagtccgtggggctcacggacatgctgcgctcggacaccttcgccgggttcgccgccgcggtgacgggccgggcgctgcggcgcaagtggggcatccaggccctgtgctacgggccgggggactactccgggccgcacaacgaccaccacccggaggagcccgaggcccgggacggctacgtggacatgcacgtcagcctcacgctgcccggggtggaccaccagtacctcatctatgcccaggacgggcacttcacgcagatgacccccgtcagcaccgtgggcggcatcaccgtgtaccggctgcccttctggcactacacgacgccgctgctggcccggaaggggaaggaggagacctcccgccgctgggtcctgttgggcaccttcctggacgcggccccgggggcccggcccgcgaccaccattctccccgcacagcctcccgcgaaacgcctgcccgcccggtag

SEQ ID NO: 7914 - DNA, 1061 bp, Myxococcus xanthus
atgcagttcgccgagtcggccctgcgtgagcaggcctggctggcgggggccgctggcggccgggagcgggccttctggaaggagaagctccagggactgccgccacttcagctccccgtggaccgtggtgtctccagcgccaccagccaccggggtgcgaccgtgcccgtggccttctcgcccgggttgagcgaggcgctgcgcgagctcggccagcgtgaagggtgcagcctcttcatggtgctctacgccgcgttcgccgcgctcctgcaccgctactcgggacagctcgacttcggcgtggggacggtgaccgcgaatcgggggagcgtgccgccggacctcatcggcttcatcgccaacacgctcgtgctccggagtgacgtgtccggagacccgaccttttcgcagtggctggcccgggcgcgcaagacggtgctcgacgcccaggaccaccaggcgctgcccttcagcgaagtggtgaaggcggtcggcgcatcgcgtgagggcgggctcaacccgctggtgcgtgcctgcttcacgctggagaacatccccgcgcccacgctggacctgcccgggacgcgctggtcattcctgggcggtgcacctgacggcagcgtggaaggcgtcgccaagttcgagctgtccctcatcctggcctctggcgaacagggcctggctggcatgctcgaatactcgcgcgagctcttcgacgccacgacggcggagcggatggtgggccacctccaggtgttgttggaggccgtcgtcgcgaaaccagagacgcccctgtcaaagctgcccgtgctgtcgacggaagagcggacgcggctgctcacggcctggaacggcccggtgctcggcgtcccggcgctgtgcatgcacgagctcatccaggcccaggtggagcggacgccgaacgccgtggccgtggtgagcggaacgcggacgctgacctacgccgagctcaaccgccgggcgaaccaactggcccatcacctgcggcggctgggcgtgcggcccgaggcgcgcgtggggctctgcgtcgagcggacgga

SEQ ID NO: 7915 - DNA, 1267 bp, Myxococcus xanthus
atgagccccatcgacaccgacgccctggctggagacctcctcgagtacatcgacgcctcgcccacgccgtaccacgcggtgcgcgagtcggcccgccgtctgacgcaggcgggctaccgccagttggacgagcgcgagccctgggcgccggagcctggcgcgcgcgtgttcatcacccgcggcgacacgagcatcgcggccttccacctcggcacccagcccgtggaccgggcgggcttccggctggtgggctcgcacacggactcgccgaacctgcgcgtgaagccgaacgcggcggtgacgaagaacggctaccagcagctcggcgtggagatttacggtggggtgttgctgcacacctggacggaccgggacttgtcgctcgccggccgcgtcatggtgatggtggagggccgcccccagcggcacttggtgcatttccgccgtcagctgtggcgcgtgctcaacctggccattcacctcagccgcggggtgaactcggatgggctcaagctgaacgtgcaggagcacatggtgcgcgttctgggcctggagcgtcgtgttgtccgtgagctgcacggtctgctgttggaggagttggtcaaggccggtgtataggcgcaggcggggcacatcctcggataggacttgtgcctgtatggcttgcacccgtccatctggtcgggcgcgcacggcgagttcctccacgcgccgcgcctggacaacctggccagttgtcacgccagcctgtccgcgctgctctccagcagcgagccgcgtgaggccaccagcggcgtcatcctgttcgaccacgaagaggtgggtagccgcagcgcgcagggcgccgcgtcacccttcctgcgcacgctgctggagcgcctgacgctggcgcactcggacggcaagccggacgcgttccaccgcgccatcgcgcactcgttcctggtgagcgcggacatggcgcacgccatccatcccaactacccgtccctgcacgagcccaagcaccagccgcacatgggcgcgggcccggtcatcaagtcgaacgtgaatcagtcctacgccacggatggcgagtcgtgggccttcttcacggcgctgtgccgcgaggcccggcgtgacgctgcagctcttggtcatccgcaccgacctgggctgtgacagcaccattggccccatctcagcgggccagctcggcatccgcacggtggacgtggggcaaccccatgctgtccatgcactccatccgggagatggcctgcgccac

SEQ ID NO: 7916 - DNA, 1275 bp, Myxococcus xanthus
atgcgcgccttcctcttcgtctcgctgttcgccaccaccgtggcgaccgctgccgaaccgacgcacaccgccccaccagcgtcctatctgttgcgtcccgaccgcgtcttcgaaggtgtcacctccaagccgcacacgggctgggtcgtcctggtgacgggcgaccgcatcgccgccgcggggccggaagccaaggtgaaggtcccccagggcaccacgtccgttgacttgagcggcaccacgctgctgcccggcctcatcgagggccactcccacctgctcctccatccgtacaacgaggcctcctggaacgaccaggtgctgaaggagtcgctggcgcttcgggtggcccgcgccaccaaccacgcccgcgccacgctggcggcgggcttcaccaccgccagggacctgggcaccgagggcgcggccgacgcggacgtcggcctcaagcaggccatccaccagggcatcatccccggcccgcgcctactggtggccacgcgcgccatcgtcgccaccggcagctatggccccaagggcttcgcctcggagtggcacgtcccccagggagcggaagaggcggacggcgtggagaccctcacccgggtggtgcgcgcgcaaatcggccagggcgcggactgggtgaaggtgtacggcgactaccgctggggccccaaccacgaagcccgccccaccttctccctggaggagctgaagcgcatcgtcgacaccgcccgaagcagtggccgcccggtgtccgtccatgcgaccacaccggagggcatccgccgcgcggtgctggcgggcgcggagagcatcgagcacggggacgaaggcaccgccgaggtgttccgcctcatggcccagcggggcgtctacctctgccccaccctggccgccagcgaagcgatgttcgaacaccgcggctacaagcgcggcgtggacccggagcccacccacctccaacagaagcgcgccaccttccgcgcggccctcagcgccggcgtccccatgtgcgcggggggagactccggcgtcttcccccacggagagaacgcgcgcgaactcgagctgatggtggcctacggcatgacgcccgcgcaggcgctccaggttggcacctccaacaacgcggcgatgctccaccgcgaggaccagttgggccaggtgaaggcggggctgctcgcggacttggtgtcggtgaagggagatccatggaagggcatcaccagggtgcgagtggtggtaatgaagggcggcacggtggcagtgtag

SEQ ID NO: 7917 - DNA, 372 bp, Myxococcus xanthus
atgcggtggtggctcgtcctgggtgccgtgaacgctttcctctccgtcagcgcgggggccttcggcgcgcatgccctgaagagccggctgccccaggacctccaggtcatcttcgagacgggggcgcggtatcacatgtaccacgcgctgggcctgctggccgtgggcctgctggggcacttccgcccctcgtccctgctcaacggcgccggctgggcgatgatggtgggcatcgtcctgttctatgccagcctttacgcgctcgccctctccggcgtgcgcgtgctgggagccatcaccacgctggagggcctgggtttcctcgaagggtggctcctgttcacggtggaggcctggcgcaccacgaagtga

SEQ ID NO: 7918 - DNA, 1017 bp, Myxococcus xanthus
atgggcaccatcgtctcgcgcatcgccgcgtccaacgcatcgcggcatgcggcggcacggcgtgggtcgatgacaccttgcagtgacacaaagggacgcgccgggtcgagcagcgcgcccaccacgtcacgctccctgccgtcgaggatgcggcgaccccggggggtcagccagtcagcgaactctttgggaaaggccttcattgcggcggaacatatcgccccacgcaacctttacagctgtcttgcgataatcaccgacaagctgatttttcccggagccccccaggccatgtcccgcatcgacagccgcccccgcgtcatctcgaaccccaccaccgcgcctgcgcgggcccagccggcagctcagcaggccgccaacgtggcccgggccaccgccgtgggtcacacgcaggtgaactccttcgagggcgcggcccgggcccgtccggccgcggcggcccagccgattcccggtgcgtggcgcggcggtccggataccgaggtgggcaaggcggtgcagtccatcgtctcgcggctccaggcgaacccggacgcgaacaacatcaccatcaagggtgacaccgcggccagcctgttcagccgggccatcctcgacagcaagcacgtgacgaacgagcagctcatcgccatggcgaacgtgtcgctggaccagctcgccagcgacgagaagacgaaggcgaaggtctacaagaaggtcccgaacgtgcgcgacctgccggtgcacaagttcaccgtggcgatgatgtccgccgcgacgggcatcgacccgcagaagctgtccgaggccgtgccggacctgggcctgacgggcgcccccaacacgccgctgctctacgcggccaagggcgagggcatgcagcgctccaccgcgctacacgacttcaccgactacctgcgcggcgcgggcatcaagggcctgaacaaggccgtgtggggcgtggagaaccgcgtcctctccgccatcgtctccgccgtgggcggcggccggtactga

SEQ ID NO: 7919 - DNA, 567 bp, Myxococcus xanthus
ctgcttggctacaaggtgacgtggtccagccagcaacgcgacgacgccgacctgccctgggccgaggcgacccggcggcatgccgttcacaccaccgtgggcgtggtgctggcggcggtggcgttcttcctgtcgcccgggctgctgctgtggctgtcgcccgtcgtggccggcctgctgctgtccatccccctctccgtcttcacgtcccgcgcgtcgctgggcctctggctggagcggcgcgggctgctcgtcatccccgaggagacagagcccccgcgcgtgttggagcgggcgcaagaggtggccgaggagcacgcgctggagccggtgaaggacgcggtggaccacgtcatctccgatgccaaggcgcacgcgctgcacctggcgctgctggagtcccagccctcgccggccgccgtccccatggcgctggcctccgcgcggcgcaagctgctgggtgacaacgtggagccactgtccccgccggagaagacggcggtgctgatggacgcgcccacgctgacggaagcccgcgagcgccggctgacgctcgcggtctcctga

SEQ ID NO: 7920 - DNA, 1521 bp, Myxococcus xanthus
atgaacgcgaccccagcgcccgaagccaccgccgtcgaagtcaaggcgcgtgccctgaagggcatgttcgtcctggcggcgcggaccgtggcgtcccaggggctgcgcgtggtgagcgcgctgttcctctcccggctgctcttcccgtcagattacggcctgttcggaatcgtgtcctacgcggcctccctgggcgtgttcctgggtgacctgggcctgagcgcggcgctggtccgccagccgcacgagcccacgcgggatgagacgttcaccatcttctggtgccaccaggcgctcaccgccgtcgtggtggcctccgtctgtctgctggccccccagttgacgcgcggctatgcgctgggcgacggcgcggtgcccatggtgtgggcgctggcgctgggcctgttcttgtcctcgctgcgcgtgattccgttgatggcgctggagcgccagctcgccttccccgtcatcgcccgcgccgagttgattgaaaacgtggtgcaggtcatcaccaccatctccctggcggcgctgggcttcggagcctgggcgctggcgctgggcggcctggtgcgcggcggggtggggctggtgtgcatctggtgggcgtccccctggcgtccccaggggcgcttccgcgtggacgtgttgcggcggctcctgggcttcgggctggcgttccagcttccgcccctggtggcggcgatggtggcgggctgggtgccgctggtggtggggcacgtgttgggcaaggaggcggtggggctggtcaactgggcctgggcgctggcctccacgccgatgatgctgagcgtggtgctcaaccgcgtggccttccccgcctactgccggttgcaggatgacccggagggcttcgccgagtacctgcgcacgtcgctgcgccggctggcctcggtgttgctgctcgccattcccctggcggtgctggccgtccccgtggcggtgcccctcttcttcggcacgcggtggctgcccgcggtggtgctggtgcagtggttcagcatggagtgcatcctcaccaccctggtggggctgctggccacggcgcagaacgcgggcggcaggccctgggagcggctggccgtcgtcgtgtgcgtgggtgcggcgaagtgggggctggggacgtgggccatccaacgcttcggcctggagggcatgggccccgcgggcgtggtggtgggactggccgaggtgtgggtgacggcgtggctggtggagcggctcaacccgtcgatgcgagggctgacgcggcaggtggtggagcccttcgtcaccctggggctggtgctgctgggggcgtgtctggcggcgctgcggctggtggaggagggtgtggtggcgcaggcgctggtgggcgcggtgctgttcgccatcctggtgtgggcccgtgagcggctgccgggaacgctgccactcctgggcgagctgaggcagattctcgaattcatccgggcacggagggccgcgaggccaactccggcgagtccggcgtcgacgtga

SEQ ID NO: 7921 - DNA, 951 bp, Myxococcus xanthus
atgaagaagcccgacctggtcatctccatcgtcaatcacagcaatccggagttgctgcacgactgtctgcgcacgctgtacgcgacgacgcgcgacagctccttcgaggtctggattgtcgacaacgccacgggcggtcgcggcgtggacgccatgcggcgcgactttccccaggtgcgctggctcttcaacacggagcgcaagggcttctccgccaaccacaaccaggtgttgcgccaggcccggggccgtcacttctgtatcttcaatgacgacaccatcgtccacgagggcgccttcgacgcgctggtgcgcttcatggatgacaacccgcgcgtgggcatggcgggcgcgcggctgttgaacgcggacggcaccatccagaactgcaccttccggcccatgtcgctggccgggcagctcttcgacatcgtcttcctgccgcgtcccctccacttcctcaaggcgatggccatcgacccggcgcagtacggccacgacgaggcccgcgtgagctgggtgctgggcgcctgcatcgtggtgcgcgaggaggcgctcgcggaggtgggcctgctcgacgagcagatgtccccgctgggcaacaccgaggacaccgactggtgcgtgcgggcctggaaggcgggctgggaggtggccttctgcccggaggcggtgattacgcacctgaccagccgctcgttccgtccgtccgacaccggggcggacaaggtgcgcatcgagctgtggcgcacgcgcctggcgtacttccgaaagcaccacggccggctgcacgagacggccatgcgggccatcctggtggggacgttgccgtacaactcggcggtgctgacgcagacgctgctgcgcgggcgcatgagcctgccggagtaccgcaagcaactggccaccttcctgggcatctcccagatgggcctgcgcgcccgcgtgtga

SEQ ID NO: 7922 - DNA, 567 bp, Myxococcus xanthus
atggcgtgcctgaagcagcaggactcagcgctgtcgctccacctgctggccggaacggcggggccgctgctcgacgaagcgcgcgcgttgggcgtggatgctcggctgctgccattgccagagcacctgtccacgctgggcgactccgcattgcgaggccacggtccgctggaagcgctgcgcttcgcccgtcggctggcgcccacatccggactgctggtggaccatggacgcgcgctccgccgggacgtcgccgacatcagccccgacctggtgcattccaacggcatcaagacgcacctgctcagcgccgccaccgcgggcctgcccttgaagcgggtctggcacattcacgacttcctgggcgaacggcctctggtccgccgcgcgctgaggctgctgtcgcccctggcatcggcggccatcgccaactcgcgggcggtgggcgacgacacgcgccaggtgctgttccgagtgcccgtgcacgtcgtctacaacggcgtggacaccacgcacttctcccccggccccgcggacggcgcgcaactggaccgtctggccggtctg

SEQ ID NO: 7923 - DNA, 783 bp, Myxococcus xanthus
cctcggcgcgagccgcgtccagcgtggttccgcgccatggcccgtgcccagctcgcgggactggagcgcgcggccatcgtgttccacagcacccaggcggtgcgcatggagctgctcgcgcatggcctggtgccggagtcgcggctcgtctgggcgccgtatggcgtgtcccccgaataccgcccggtccccacacccggagcgcccgatgccagcgaagccgtgctcgcaccgctggggggccggccctacctgctccacgtcggcagcgcgattcctcgcaaacgcctggacgtgctcttcgccgtgttcgccgcgcttcgcgcgcgctacccggagcttcggttggtgcagcagggcggcgcgctgaacggcacacagcgcgcgcaggtggaggcgttgggtattggcgatgcgttgcttcagccgcctcggcaggaacgtgccacgctggcgggcctctaccggcgcgcgacggccgtgctggtgacgagcgaggcggagggctttggactccccgtcatcgaggcgctggcctgtggtgctcccgtggtggccagcgacctgcccgtgcttcgggaggtcggagcagaagcctgcacctactgccccgtgggggacgtgccggcgtgggtggagtccgtgaccgcgctgctcgccggccatgacacacagccctcgcgcgaggcacggctgacccgcgcctcgcgcttcacctggtccgcgcatgcgcggacggtgctggacgcctacctgcggctgctcggtgcctccacgccgtga

SEQ ID NO: 7924 - DNA, 885 bp, Myxococcus xanthus
atggccatcgccatggactcggtctgggatgagacggccgaggcactgcgcgacatggcggatccgcaggcctggatggcgacggtgacggcgtccgtcagcatgtacttgctgctgtgggccttgccagagccggtgagcaagggtgttgctgctctcgtgacggcgaccgcgattgcctacctgggcgtggacacggtgtggctcttgctggatgggtggattgcgctggtgcgccaggtggaccgtgccacgaccttcgcgcagctcagcgaggcgggtgaggcttacggcgaggtgctcggggagaacgccgcgcgcatctttgtcatgctggccacggcggccatcgggaacacggcggggctggcggcgaaggcgcccaggctaccgggctcctcacaggcggcgctgaacgtcgaggtgcaggcgggctaccggtacgcggcgctcgggcgcgtggaatctgtggcgatgacggccgatggtttcaccgtcgcgctggcaccgcatgccgtggcgatggcggccggtggctctagcggtgcgggccgcatacagaagcaccacatcgccacgaacaagaacgacgtctccgctgcgcgtggtgggccgtggacgccggagttcaggagaatcttcaagcgtgccgggatggagctgaaggacccggagaacatcgtccagattcaaggccaccaaggtccgcatccccaggcgtaccacgaactggtcttcaggcgattgaacagcgcgaccgcgcgttgccgcagcgtagaagagtgccgcaaggtcctgaccaaggcgctgcaacaactggccagggaagccgccacccagggaacggagatcaacaagctcctgacccatgggcacccgcgctag

SEQ ID NO: 7925 - DNA, 711 bp, Myxococcus xanthus
atggtgcgcctggtggcgagcgccgccaaccgcgtgttcgtctccattccccagtgggcggagcacctgcccgctcgcgtccggccccacgcggcctggctgccggttcccagcaatctgcccgtcgatgtctcccgtgccgccgtggacgcgctccgcgcggagttgggtgaggggccctggctgggacacttcggcaccttcggacgcctcaccgctgagcccctggaggccgcgctggtgccgttgctgcgcggtgagggaacgcgccgggcgttgatgctgggcagaggcagccgcgccttcgtcgaaggcgtggagacgcgccaccccgagctgcgaggccggctcgtggccagggactcgctcgcgctggacgacatcgcggtgcatctgacgacgtgtgacgtgctcctgcagccctatccggacggcgtgagcacaagacgcaccacggtcatggcgggcctggccctggggcttcctgtcgtcacgaacaccgggcacctcacggaaccggtgtggcgcgaacacggcgccgccgcattggccgaaggcacggcgcccgctgcgttggtggagcgcgcggaggccttgctgtcgagcgcggacacgcggcgggagctaggccagcacgcggcccgaatctaccgcgagcacttcgcgctggagcgcacggtggaagcgctgctgcgcgtcggcccgacatga

SEQ ID NO: 7926 - DNA, 669 bp, Myxococcus xanthus
atgcgtcccggtggaaacatcttccagttcctgaagcgcgaagtcctcgtgggcgagcacgaggtgctccaccgcacgctgaaggaggcgctggtcggcacctgcgacagcgtgctggacatcggctgtggctcgcgctcgccgctccacagcttctcgaacctgctcccacacacggtgggcgtggatggccaccccaccagcatcgagcgcagccgggccgcgggcatccaccgcgagtaccactgcatggacctgatggaagcgggccagcgcttcggtccgaagagcttcgacgccgtcgtcgcgctggacgtcatcgagcacttcgacaagccaggcggattccggctgctggagatgatggagtcgctggcgcgcaagcgcgtcatcatcttcacgcccaatggcttcctcccccaggacgagtgggacaacaacgtccaccaggtgcaccgctccggctgggaggtctacgacttcgagctgcgcggctaccacgtcaccggcatgagcggctggaagcccctgcgcggtgactacgccctgccgcgcatccggcccttccggctgggcagccgcctgtccatcctcaccgagcccttcgccacgcgctggccccgtcacgccttccagctcctcgccatccgcgacatggaagtgtcctga

SEQ ID NO: 7927 - DNA, 435 bp, Myxococcus xanthus
atgtccgagcagaagccccgcctgaagcgccccgtggagaacgtccgcgccgaactgctcgcggacccagacacccagcgcatcgcgaagtccctggatatggagctggaggcctacgtcgagctggtcctcgactacgcccagaacccggacaaggagccaacgctcatcgttgcgccggacgaggagctgcgcgccgccggctacaacccgccgaccacccaggacgtcgccaacttcttcatcgccgccgccaatggcgagctgggcattggcccgcccaagtcctattacagcggcttcgaagggaagcaggacgacgcgaacaagccgtcactccggggggatgagggccaggagcccgtgaaggtggacgaggagaccagccagaagctccgccagcacgtccccaagggcgggcctgatcgcgtttag

SEQ ID NO: 7928 - DNA, 279 bp, Myxococcus xanthus
atgattggcggcctgctggacaagatgcccttcggcatcggccagctcgccaagccgttcgtcgacaagttcatcgacaacgggctggccatggtcgccggcggtccgctgggtggcgttgcctcgatgttcggcaaggccggcaccgtgggcaagctggcggacatggtggagacggtccgcacgggcgcgaagacggtgggcgacatcgccgagggccgcttcaacgcccagcagatggcggccttcgcccaggcccagctgatgcgcggcctgtaa

SEQ ID NO: 7929 - DNA, 1464 bp, Myxococcus xanthus
atgcgaaccactcatcgtcccctcaccaccttggccctggccttgagcctcttcatggccgccttggaagccactgtcgtttccacggccatgcccacggtggtgggcgagttgggcggcatccagcactacgcgtgggtcttcaccgcgtacatgttgtcctccaccatcaccgtgcccatctacgggaagctggcggacctctacggccgcaagcccgtgctcgtgttcggcatcgtgctgttcctcgtgggctccatcgccagtggcctgtccacgtccatggccatgttgatcggcttccggacgctccagggcctgggcgcgggcgccatgcagccggtggcgctcaccgtcatcggggacatctacacgctggaggagcgcgcgaaggtccagggcgcgttcagcgcggtgtggggcatcgcgggactgatcgggcccatcaccggtggcttcctcgtgaagtacctcacgtggcactgggtcttcttcatcaacgtcccggtgggcgtgggctgcctcgtcctgctcctgagctacttccatgagcgcgtggagcggaagccccagaagctggactacgcgggcgccgcgctgctcaccggctgggtggtggcgctgctcgtcggcgtgcaaggtgtgggcgtgaatctgtggggcttgcccgtggcggccgtgctgctcgcggccttcgtcgcggtggagcgcaaggtggccgagcccatcatccccatgtccatcttcaaggtgccggccatcgtcatctcctccatcgcgggagcgctcttctccgcggcgatgttcggggccaccacctacgttccgctcttcgtccagggcgtcctgggcggaacgcccaccgaggccggcgggatgattacgccgatgattgtcggctggccgctggcggccctcgtggccgggaagctgctgctcaagacgggcttccgccccctcatcgtgggcgggctgggattgacggtggtgggcacgtcgctgatggcgctgctcctggggccccaggcgcccaggctgctgccggaggtggccatgggcctgttcggcatcggcatgggcttcgcgtccaccgcgctgctcatcgccgtgcagaccagcgtgggctgggagctgcgcggagtggccaccgccagcaacatgttcttccgcaccatcggcggcgccattggcgtggggctgatgggcggcgtcatggtgtcgcagctcctcaaggacccgacggtgccgatttcggcggccaacgccttgatgagccccgaccacggccaggacttgcccgcggatctgctggcgacgctgagcggcgcgctgggcaccgggctgagcatcaacttctggctgatctgcgccttcaccgtggccgccttcgccgcagggctgttcttccccaaggtgtcgcgcaccacgacggtgtcctccaccgaggtggtggcgccgcactga

SEQ ID NO: 7930 - DNA, 1191 bp, Myxococcus xanthus
atgggcctgggcacgtcgctcttcgaccagttcttcagtgacttcggagacgaggacttcggggggctgtcgcgttcactccagcagccggtggagcgctacgacatcaccgaggccttctccgatgagacgcggcgcgtattggaagcggccttccaggcggcgcgaagcgcgggggcggcttccatcgacacggagcacctgctggtggcgctcgcgaaggacccgctgggccggaccgcgctcagccgcatgaagctggacccggcccgcgtcgccgagcgcgccgagtccgagatgcgccgtgggaagcgccccatggagcgtcccgagctgtcgccgcatgcgaagcgcgccctggaactcgcgtaccaggaggcctacgagctgggacattcctatgtggggcccgaacacgtgctgctggggttgctgcacgaaggggaaggcctggcgtcggagattctgcgcgagcaaggggcccagcacggcaaggcgcgcgcggccgtcgcggaagcgctggcaccttcatccgaggcacgccggtcgcccacgcccacgctggacgagtactgccgcgacctgacgagcctggcctcggaagggaagctggacccggtggtggggcgggccaacgaaatcgagaccacgctcgaaatcctctcgcgtcgtacgaagaacaaccccgtgctcattggtgagccgggcgtgggcaagacggccatcgtggagggcattgcccagcgcatcatctccgccgcggtcccggacacgctgcgcgacaaacgcgtgctgcaactggacctgtccggcctgctcgcgggcagcaagtaccgcggtgagttcgaggagcggctgaagaaggtcatggacgaggtgaagtcgcacagcgaggacatcgtcctcttcatcgacgagattcacaccatcgtcggggcgggcgcggcggagggggccatggatgcgggcaacatgctcaagccatccctggcgcgcggcgagctgcacgtcatcggcgcgacgacgttggatgaataccgcaagcgcatcgagaaggatgctgcgctcgaacgccgcttccagcccgtggtcgtcccggagccgacggccgagcaggccattgagattctgcgaggcctcaaggaccgctacgagtcccaccaccgcgtgcgcatcgcggacgaagcgctg

SEQ ID NO: 7931 - DNA, 1479 bp, Myxococcus xanthus
gtgcaacccagtaactccgccggttcgccgtttcgtcgcttcaccgctccggccgcgctgatgctcgcggcggccctcacgactgcctgtggtccctcggagccacccgccccggcggaggccgaggcgctcggcagtcgcaccgacgcgctgaccgagctcgtctccaatggcaccttcaacggcggcaccgtgtcgccctggtggagcggccccaatacgcagtcccgcgtggagaacgcccgcctgcgcgtggatgtggggggcgggacggccaacccctgggacgcgctgattggccaggatgacattccgctggtgaatggccgggcgtacacgctgtccttcaccgcttctgcttcagtgtcgacgacggtccgtgtgacggtgcagttggagagcgcgccgtacaccgcgccgctggaccggcagattacgttggacggcacgtcacggcgcttcacgttccccttcacgtcgacgctggccacgcaggcaggacaggtcaccttccagatgggaggccgcgcgacggggttcagcgcgttcatcgatgacatctcgctcaccacggaggacggcggcggaggcggcgggccgctgtcgatgacgaacggcttctacatcgacccgaactccaaccccgccaactgggtccgggccaacagcggggactcgcgcgctgcgcgcatccagtcctccgtcgcgaacaacctggccgcacgttggttcgccgcttggagcggagacatcaccacggcggtgtccagcttcgtctcggccgcggacgcggcggacaagctgccggtgctggtggcgtacaacatccctggccgggactgcggaagccactcgggcggaggcgcggggtcgccagaggcgtaccggacgtggatttcgtccttcgccgccgccattggcaaccgtcccgccgtcgtcatcatcgagccggacgccgtcgcccagctcgactgcctggcgaacgacgccgagcgtcagacgcgcatcagcctcattcgctacgccaccgagcagttccgggatcgcgcgccgaacacgtgggcctacctggacgcgggcaacgccttgtggatcaacgcggacaccatggcccagcggctggagaacatgggcgtgcgcaacgtgcgtggcttcgcgctcaacgtgtcgaacttctacaccaccgcgcagtcggcctcgtacgcgggctccgtcaacagctcgctgagcagccggtacggctacaccaagcccttcgtggtggacaccagccgtaacggcaatggctccaacggtgagtggtgcaaccccgccggccggaagattggcacgacgaaccaggtgggcgtgggcggcgcggagatgaccctgtggatcaaggtccccggggactccgatggccagtgcggcgtcgcgcccaacacacccgcaggcacgttcgtgccggacgtggccctgcggatgattgacggcctctga

SEQ ID NO: 7932 - DNA, 960 bp, Myxococcus xanthus
gtccatgctgctcatggaaatctgcgtcaccatcagcctgctggggcgcatgggcaaggcggccttcgacgcgcgcctggtgtccatgatggccaagacggccgtcatctgcgcggccatcgccgtgctggaccagacgctgctggccttcctgaacccgtgggtgcgcatcaccgtggaagccgtgctgtacatcgtcgcggtgctggccaccggcgcggtgcgccccggcgaggtgctccaggtggtgcgcatcgcccgccgccgtggaaaccccgcgcccgaagccgcgcccaccccgtgaggagagttccaccgctcatgccgtccacgcaccgccagccgccttccgccccgcgccgtccctggcgctcgttcgcctgcgccgcgctgctgctgctggcgcccgcttgccggggcctgggcaagtacacctgggtggatgactaccaggagaagccgcccccggtggactcggcgtaccgcatcgccgcgggcgacctgctcaacatccgcgtgtggaaccaggagtcgctcaccacgcaggcccgcgtgcgcgaggacggccgcatcagcctgctcttcctggacgacgtggaggcagcgggccacacaccggccttgctgtcgcagcaaatccagacgcggctgaaggactacatcaaccaccccgtcgtcaccgtggcgctggagatggcgcgccccatcaaggtgaccatggtgggcgaggtcaaccgcatcggtccgctggaaatcgacccgggcgccagcctgctgcaggccctggccggcgcgggcggcttcaccgagtacgcccacaaggaccgcatcttcgtcatgcgccaggaagagggcgccgcgcccgagcgcatccgcttccgctacgacgacctcatccacgccgaggggcgcgcgcccaccttccgcctgcgccccggtgacgtggtggtggtggaataa

SEQ ID NO: 7933 - DNA, 567 bp, Myxococcus xanthus
atggcccctcgctacttcgacctctccgaggacatccaatccgggaactgggatttgggcgaccctcgcgatgcgcaaggcaatgaggtggaggacccctggatgttccgggcgggacaacctgttcaggtccaggggcgcctgaccatccccgtcgacgcgacggggaggcggttggacttctcgaccgcgggcatcggtgtgacaccggtggttcacgtcagcgtggcatcgctcttcgcacagctggcgcccgatgacgtgcagctcattcccgtggatgttccggggcagccggactcgtacctcatcctcgtcgccaccaagctcatccgctgcatcgatgatgaggcgtcccaggtgcagttctggaagcccgaggacgacctgcccgagaaagtggggcagtactccgcggtggattccatgcacatcgacccctcgaaggtgggcgacgccaaggtgttccgcacctggggctgggacatcgcgctcatcgtctccgaggacctcaagagcgcgctggaacagtccggcgccacggggatgaagttcacccccgtgtga

SEQ ID NO: 7934 - DNA, 657 bp, Myxococcus xanthus
atgcagtatggcccgcgcgcggatgtgtccctcagccacgcgctgtcacccctgagcgccatcaccacctccgtggccttcaactacgcgcgcttctccaccggggcgaacaacaccatcgtcacgctgcgagaggcctgggggcaccgggtggacaggcgcacctccctggaggccggagcgggcgtgagcgtggtgcacaccatccccgtgccccccggcgaaggtgagcccgagcccggcccgctggacgcgccccggacggagctgctccccaacctgaatgtcggggtgagccaccggattccctcgcgcaccgcggacttcaacggccgggcggacctgcggctcgtccccttcacggaccggctcacggcgcgcgtctacccccgggcggacctgacgctgacggggacctgggccctggggccccgcgtgcgcgtgtccgccattggcggcggcgccgcggccgtgggcggaagtcgtggggacagcatcctttccggaggcttcaccggttcctggattctcacacggtgggtgtccgtggataccgacctccgcgggacgtggagccgctcgcccgaactgccggcggcccggctgacgtgggccgcaacgctgggcctctccgtgcggcaaactggtattctctga

SEQ ID NO: 7935 - DNA, 159 bp, Myxococcus xanthus
atgtccgtcctcatcctcaccatcgccctgccagccaaggcggcgagggatccgcatccgatgcgggggctgaagaaggccatcctctggttcgtcctcttcaacgcggcatacacgtatggcgtcctcgtctgggtgccacggctcgggttcggctga

SEQ ID NO: 7936 - DNA, 405 bp, Myxococcus xanthus
atggagtccgacctgcacacggtcctcttggtggaggacgcccccttcttccggaagatgctgggcgactacctgcgggacatggggttcaaggaggtcgtggagctgcccagtggccgcgccgcgctcaagcacatggagacggccgcgcgtcccgacctcgtgtgtctggacctgacgctgccggacatctccggctatgacctctgcgagcacatccgccgctcggcgacgatggcggacgtgcccgtgctggtggtgagcgcccgggacttgccggaggacaaggcgcacgccgaggaggccggcgccaacggctacctgggcaagcccttcacccaggaggagttcacccggcgggtgcagtcgctcctcaagagcactggggccaggagggcaccgtga

SEQ ID NO: 7937 - DNA, 1296 bp, Myxococcus xanthus
atgccgcgcaagtaccgcgtggagacgcggatgctgacgcagcgcaacttcatcatctcctcgctggccaaccccgggcgctccatccccgtggacgcggaccagcccacgcgcgccgcgtgggagatggtgatgaagcacgacaacctcaagtccatcgtcgcgcaggcgaagctggtggagtactgggagctgcagcgctcgccgctgaaccggctgaaggagaaggtgctgcgcaagccgccggtggccatgtcggacgacgacaagcgcgacgcgctcaccgccatgctggagcaggcaatgattgtcggcgtggagggtggcacgggcaccgtctccatcggcgtggagtggaccgacccgcagctggcgctcaacatcgtgcaggccgcgcagcagaacttcctcgacatgcgccaggcggcggagatgggcgcggtgcaggaggccatcaccatcctggagaagcaggtggtggaggaggccgcgggcatccagcaggccattggccagctcaacgcggcggtgaagcgcgtggaggcccggcagaagaaggaggaggagaagaagggacggcggggcggtgccgcggccgcggccaacgccgcgctgggcatcaacaccgaccacctgctggcgcagatgcgcttcatgattcagacgaagcgccgggccattggcgacgtggaggatttccgctcgcggcggctgacggagctgcgcaaccagttgtccgagcagcgcgtcatctattcgccgcagcaccccatcatcaccgacctggagcagcgcatctcctcgctccaggaggattcgccgcagttgattgcgctgcgctcggagatgacggagctcatcaacgagtacgtgcgcaacggcggtgacccgggtgagctggagtccgggctggcgacggcggccatgggcggcgcgacgttcggcgggccggccacgtcggatgacccggaggtgtcggtggcggcggaccgggtgcgcatgctggtgatgcggcaccaggagaagatgcggcggttggaccaggcgcgcacggagctggagatttcccgcgcgtccatgaagcaccgcttcagtgtcctgtcgccgcctaccttcccggagcggccgtccaagccgaaggtgaagctcatcgtcgccgcgggcgtggtgggcggaatcggcatgggcatcttcgcggcgctggcgctggacatcatccgccggcgcattctggagaagtggcaggtcgagcggattctgaagctacccgtgctggcggagctggagcggcgctga

SEQ ID NO: 7938 - DNA, 1101 bp, Myxococcus xanthus
aagttcgacatcatcatccccgcgcacaacgaggagctgggcatcgcccggacggtgaagaacctgtccgaggtggactacccggcacacctgcggcgcatcatcgtggtggcggacaactgttccgacgcgacggcgcagaaggcgcgcgaggcgggcgccttcgtcctggagcggcaggacacgacgaagcggggcaagggctacgcgctggcccacgccttcgagttcagccagcaggacggcttcgccgaggcggtggtggtggtggacgcggacacggtggtgtcgcccaacctgctgaccgccttcgcgaagcgcatcgagggtgtcgagggttcgaaggccggagccgaaggggcgcacgccatgcaggcgcactacggggtgatgaaccccacggcgtcctggcgcacgcggctgatgaccattgccctgggcatgttccacaaggtgcgctcacagggccgcgaggccctgggcgtgtcgtgcggcctgcgcggcaacggcatgtgcttcacgcaccacgcgctggccaaggtgccgcatgacgccttcagcgtggtggaggacctggagtacggcatccgcctggcccgcaacggcttccgcgtgcactacgtctgggaggcggacgtgctgggggagatggtgtccgcggagaagcagagccgctcgcagcgtcagcgctgggagggtggccgcgcgcagatgcgcaagctgcacgggtggccgctgctgaaggacggcctgcggaagagggatggcacgctgttggacatcgccatggacgtgctggtgccgccgctgagccagttggtgctggcggcggtgggttgcgcggtgatggccggggcgttcgcctggtggtcccacaacccgatgccatgggcgctgggcgtggcgggcttcagcgtggccagcctgggggcgtatgtcctgcgcggctggtgggtgtctggcgtgggcgttcgcggcctgctggacctggcctgggcgcctgtctacgtggtgtggaaggtgtggctcatgctgcgcggccccggcgcggagaagcgcggcgagtgggtgcggacctcgcgtgagggcgagaaccggtag

SEQ ID NO: 7939 - DNA, 249 bp, Myxococcus xanthus
atgtacatggcaggcgtcaagacagccatggacgaggccgccaaggaagaagaggcacccgtcatctgggacgacgcccacaacggggaccttcccgaatggcggcgcgagtgcattcggttctacggcgactgcaagacggagcctgggtggacgggcccttgctacgagtgcctacgccgctgcgaggcccaagaagagtggcccgtgtcgatgtgcaagcccggaagaaagacgcggaggaagtaa

SEQ ID NO: 7940 - DNA, 423 bp, Myxococcus xanthus
atgttcagcatcgagatccgcttgaggtcggatgcggcggtcgccgccgcgttgagccgccgctacgcccgtgagcatggcctgacggcgcaagccagcgccgaggtggcggtggtggtgagcgagctggccaccaatctggcgcgccacgcgggtggccggggctgggtggagctgtggctcgaggctgagtggctcttcatccgctcccgcgaccgcggccctggcatggaggacccatcccggttctttgctggcagggaagggcgtccaagcccgctgcccggagacagcctgggggaaggcggggccgcggtgcgacggctcaccgacgacgtccaggtggccaaccgcgaaggtggagggttcgaggtgctggcgcgcaagcgggtggtggtccaggcgaaaaggaggcacgggtga

SEQ ID NO: 7941 - DNA, 618 bp, Myxococcus xanthus
atgtcggagacggcggcgtggttggtgctgcgaggcaccgtggagtccctcggactgtccctggacacggcgaccgcggcggacctgccgcgcatcatcgaggcgctggaacccgccacccgccacttcgtggacccttctcgccggccgcagatgatggcgcagcttcgcgcgcagcgcgcgccctcggcggggccggagggcacggccacttccgcctcggcggaggttcgggcgaccacctatctggtgcgcacggaagcggacgccagtcacgcgcggcttgccgcccggatgctgtgcgaatccctgggcgggcgcggctacgagtgccagaaggtggccacggcggtgagtgaactggcgcgcaaccagatttcgtatgcgggtggcggcaccatccagctcgcgccgcagcttgcgcccaagcggctgctgcgtgtcagcgccgaggactccgggcaaggcatcccggacctggagcgcgtcctgtcggggacgtacaagagcaagacgggcatgggcctgggcttgttgggcgtgaagcggttggcggaccgcttcgacgtgcgcaccggcccgacgggcacgcaggtggacttcgaggtgtggctgtga

SEQ ID NO: 7942 - DNA, 135 bp, Myxococcus xanthus
atggtgcgccaggaatgcgcccggacgctggtggcggtggtggacgcgctggggcacgggcccgtggccgcgcagatgctggcggaggagatgctcggcctggtgttgcccgcgcccacgaagtcctctgtttga

SEQ ID NO: 7943 - DNA, 1044 bp, Myxococcus xanthus
atggccggcaactcaggggaagacaacgccaacccgggaaacgcccgggaggtggccccagagcgccctgacgagggcgattcgcccgtgttggatggcgtgtcggatgcggagctggatgccatcgtgggccagctgcgcacggacaagagccttcgtacccggcccagcgcgcagccgcgctaccgcgaggccacgcagtcggagcgactgcaccggggcgcgggccgttcacgggcgtccaccttgggcgaagaggaggcgccgccgaaggaagccgcgcccgtcgtgaagcatgcctggtacttcgttgcgggcggcgcggcctacggtcctcacgacctcgcggacctgaaggcccacgtggagcggggttttctgggctttgattccctgtgctggcgcgaggggttcagtgagtggctgcccctggggcacatcccggaactcgcttccgcgctgctgccgccagccgtgcccgcgggacctccgcccattccgccggaagcgtccggggccttcatgcccccggttgcgcgcgcggtggacgtgtccgaggccaccacggagcgggtgatcctgaacgcaccgggcacggtggtgccccccttcgcggccattgcccctgccgccgtcgtggccactcccgcggtgagcgctgccgccatgccgcagacgcaggcctacggcgcatcactttctgtggatgcgccaagggctccggccgagggcgctgtcgtcgggcctgctccggaagctgatgtcgcggcgctcgcaccagaacctgtcaccgtgccggccgagagtgacttcgccgcgcacggagcccctgcgccggacccgatgcccgtggcggagcccgtgggaacccacgcggtgctagcgttgcctgtccccgaggaacgcgcgcgtcgcaagcgccagctgggtttcatcctgccggggggtgccatacaaggcgttctacctgctaatcaactgaggagccatgcgcgcgtgcgctgtcgaagtgaagtacgccatcggcgatggacaagggcctga

SEQ ID NO: 7944 - DNA, 1239 bp, Myxococcus xanthus
atgccatccagtgtgcagaagattggctatttgattcccgagttccccggacagacgcacatcttcttctggcgcgagttgcaggcgctccaggggaagggcgtgacgccggagctggtgtccacgcgtccgcctcccgcgcgcatcatctcgcacagctgggcgcgcgaggccatgtcgcgcacggagtacctgacgccgccggggccgctgggggtcgccaaggccgccgcggaggtggcccgcgccatgcccacgggctgggcccggtgcctggcctccatcgcccgagcggaggggctggacgcaaaggggcgcgcgcaactgttggccttcgccgtcatgggcggccggctggcgtcgctggcgcgggagcggggctggacgcacgtccacgtccattcatgcgccaacgccgcgcacgtggcgctcttcgcgaacctgctgtcggggttgccctacagcctgacgctgcacgggccgctgtacgactacggccccaaccagcgcgagaagtggcggcacgcgcggttcgccttcgtgattacaaagaagctgctcaaggaagtgaatgacgagctggccggcgcgctgccgtcgcgcatcgagctggcacccatgggcgtggagctgcgcaagttcaaccgctccgtgccctactcggcgtggacgggtgaaggcccgctgcgcatcttctcctgcggccgcctcaacccctgcaagggccacgcggacctcatcgacgcggtggggatgttgcgcgcgaaggggctggacgcgcggctgtccatcgcgggcgaggacgaggccggcggcaccacgtaccgcaaggtgctggaggccaaaatccaggagacgggcctgggcgacgcggtgacgttgctgggcgcggtgagcgaggacacggtgcgcggtgaaatcgagcgcgcgcacatcttctcgctggccagcctccaggagccgttgggcgtggccatcatggaggccatggccatgcgcgtgcccgtggtggtgacgggcgcgggtggggtgccggagttggtggatgacggggtggacggaatcctcgtgcccccgcagcagccccgcaccctggcggacaagctggagaccgtggcgcgcgacgcccaggaggcccaccggctgggtgaggcgggccgccgcaaggtggagacgacgttcagcagcgagcgcagcgcggacatgctcgcgcagatgctccagcgggcggtggtgtag

SEQ ID NO: 7945 - DNA, 1608 bp, Myxococcus xanthus
atggcggacgacatcgcaatcggcatcgacctgggcacgtcattctcgtgcgtggcggttgtccaggacggccagcccaccgtcatccccaacgagtggggagagacgactcacgcctcctgcgtctcgttcctcgaggatggctcggtcctggtcggtaacgcggccaagaagaacatcatcaccaaccccgagcagaccgtctattccgccaagcgcctcatcggccgctactacttctccgacgaggtgaagaaggcgcaggcggtgatgccgtaccgcatcgtcgagggcgacaacaactcggtgcgcatcgcgatgaacgagcactcctattcgctcccggagatcagcgcgctggtgctcaaggagctgaaggcggtggcggagacgtacctgggccaggaggtgaccaaggccgtggtcaccgtgcccgcgtacttcaacgacaaccagcgccaggccaccaaggacgcgggccgcatcgccggcatggaggtgctgcgcatcctcaacgagcccaccgccgcggcgctcgcgtacggcttcgggcgtgacgtcaaccagcgcgtggtggtctacgacctgggcggcggcaccttcgacgtctccatcctggagattggcaaggacgtcttcgaggtgctggccaccgctggcgacacgtacctgggcggcgacgacttcgacgaccgcatcatgacgtggctggcggatgacttcctggcccgcacgcgcctggacgtgcggcagaacaagttctgcctgcagatgctcaaggaggccgcggagaaggcgaagatcgacgtgggccagacgggctccgcggagattctctgccagggcatctgccaggacgccgacggcaacgtcatggacctgcgtgggcagctcaaccaggaccagttcaaccgcatggtgatggacctggtgcagcgcaccttcaaggtgtgcgacgaggcgctgcagagcgcgcgcctgacggctgcagacatcgacgcggtcatcctcgtgggcgggccgacgcggctgcccatcatccgcaattcggtgaagcactacttccagaaggaaccgctggaaggcatcaacccggaccaggtcgtggccatgggcgcggcgctccagtcgcacgcgctgctggacagcaagacgcagacgttcctggtggacgtcacgccgctgtcgctgcgcatcggcacggtgggtgggtacaccgagaagatcatcgacaagaacacgccggttcccatcgaccgctcgaagacgttcaccaccagccgcgacggccaggagaaggtgaagattcgcgtgtaccagggcgagtccaaccgcgccgacgagtgcgagatgctcggcgagttcgagttcgcgggcttccgcatcggctaccgcggcgaggtgaagattgaggtcaccttcgaaatcaacacggatggtctggtgcacgtgtccgcgtgcgacacggcgacgggtcagaagacgtcgacctccatcaccctgtcctccggcatgagcgaggccgatatccagcagtccatccaggccaaccggaacattcggcttgctggccacaacagcgacgacctgcccgccgcggcgcagtaa

SEQ ID NO: 7946 - DNA, 1008 bp, Myxococcus xanthus
atgctcgaggagagcgctgtgacgaggggcaagtggatgttggcggccgcatgggcggtcgttcttgtgggcgccagggtgcatggtgccgagctgaatacgctgcggggacttgatgtgtcccgcacgggctcgggtgcccaggtggtggtgaccggcacccggccaccgacctttaccgtgttccggctgagcgggccggagcgcctggtcgtggacctgtcgtcggcggatgcgaccggcatcaagggacaccacgagggctctggaccggtttccggtgtcgtggcgtcccagttctctgatcagcgcgcgagcgttggccgggtgctgctggcgctggacaaggcgtctcagtatgacgtgcgcgcggacggaaaccgggtcgtcatctccgtggatggcacctcgcagtccgttgacgcgaagcgcgccgagacgccggccaggacagaacgcatgaccgcgtcggtggaggcgaagccacacccggtcgccgcccaggctccggccaaagtggtgaaggcagaatcagcggcagtccccaaggccgcgctcccggaaaacgtggtggctgccgaggctgatgagcgggaggtgtcgaatccggcccagcacatcactgccatgtcgttcgcggacgataccctcagcattcgtgcggatggtgacatcgcccgctacgaggtgctggagcttgccgacccgcctcggctcgcggtcgacctgtttggcgtcggcctcgcgacgcgtgctcctcgcgtgaagtcgggggcgctgcgcgatgttcgtgtgggcgcgcatgcagacaaggttcgcctggtactggacgtgcgcggtacgatgcgtgcctaccgagtggaccgcgcgaaccgtggcctccaggtggtgcttggacgcgcggttgcccggaaggctaccccatcagcccaaggtacacagcagtccgcgttccgcttaggcttgtcggaatccggccaacgcgattcacggccttacagaaggttt

SEQ ID NO: 7947 - DNA, 225 bp, Myxococcus xanthus
atggtcgaagacccggccggacgtgggcacatcgtgcgtcgcaacactcgcatgggacgtcagggcggcaaggtcactcagattcttcgtgactcggtgacggtgacagaggtgttctccggcaacggagagatcatcaagaatccggtgacactgcagttgaagcctgatgcgaagcaggaccccgcctacaacatgatgacgggcaggaactacggagagtag

SEQ ID NO: 7948 - DNA, 618 bp, Myxococcus xanthus
atggacaagtacctggatcaattcgtcaaggcgccgccagccatcaaattcgggggcctggcgttcgtcgtcggtgccctcacggccgccaacttcttcatggtcatccagcccacggaggaagaaatcggttgggcggtggccgagcgccgcaagctggacctggaactggcggacaagagtgagattgctcagaacctgaatgagcgtcggcgcgagatggacgtgctggagcagaagctctcggaggcgctcacggaacttccggagcagcgtgacatcgaggagctgctcgcgcagatcaacgacatcgggaagaagagcggtctggaactctccagcgtgacccctggcaaggagtctgtcgggggaggggagttcttcgcacgcatccccatcaagatgacggtgagcggcaactaccacgagattgcgctcttccttcaggagatggccaacatgcgccgcatcgtcaacgtcaacaacatcaagttcgactcggccaaactcaagaacgagaaggtcgtcttgcagagcgagttccaggccacgacgttccggttcgtcgaacagaaggccgctgcgtcgaccgcgggcaactcgaactcgaagaaatag

SEQ ID NO: 7949 - DNA, 678 bp, Myxococcus xanthus
atgatgattcgcatcaacctgctgcccgtccgggcggtgaagaagcgtgagatgggccggcaggtgctggtcctcttcgcggtggtcctgattggcgctggcgttgccaactacctctggtacgacgaccgacagagcgagcttgaggcgcaccaagcgggcgtcgcttcaaccaaggcgaggattgccgagctggagaagatcatcggcgaggtcaagaacatcaacacccggaaggccgaagtggagaagaagctggccgtcttggatgcgctgcgcaagggccgtagcgggcctgttcgcatgatggacgcactcgcgtctgcgacacccaagaaggtgtgggtgaagacgttctcggagaacaacaacgcggtctccattgatggctcggccgtcagtcatgacgaagtcgccgagttcatgcgcgggctcaacggtgtggtgtggacacccaagggcatggggcgcctggtggaccgtcgccgggacagcaagacagcacgagtcgagatgctcacctcggatgccacgatcgaagagttcccggaggcgcaggtgtccccgttcttcaagaacatcgatctgcagactgccaagcaggttggcggtgcgcaggtcggggtcccgatcctggtcgagttcaagatcacgatgacttccaactacgccatctga

SEQ ID NO: 7950 - DNA, 1077 bp, Myxococcus xanthus
aagggcaaactggtactcggcctggatatcggatcgacgtccatcaagatgattctcctcaaggagcagcgcaagcgcggcgaggtcatctatgcgctgcagagcttcgggatgaagccgctgcctccggaggccatcgtcgacggcgcgctgatgaactccacggccattgtccaggccgtgcaggacctgatgtccgagctgaaggtgaagggcaaggacgtggccatcggcgtgtccggccactcggtcatcatcaagaagattcagatgcctcgcatgtcccaggatgagctcgaggagagcatccagtgggaggcggagcagtacatcccgttcgatgtgaaggacgtcaacatcgacacgcagatcctcgacggcggcggcaacgacgccacgggacagatggacgtgctgctggtcgcggccaagaaggacatgatcaacgactacaccacggtggtctccgaggcgggcctggccccggtggtggtggacgtggatgccttcgccgtccagaacatgttctccgtcaactatgacgtgccggagcgcgagacggtggtgctcatcaacgcgggcgcctcggtggtgaacatcaacatcatctccaacggcgcgacggtgttcacgcgcgacgtcaccatcggcggcaaccagttcaccgaggagatccagaagcagctgaacgtctcctacgaggaggccgaggcgctgaagatcggtggcaacggcgctgacgcggacgcggtggtaccgcaggacgtggagcgggtgctctccagcgtcgccgaacaggtcgcgggcgaaatccagcgctcgctggacttctacgcgggtaccgcggccgactcgaacttcagcaaggtctacctgtcgggcggcacggcgaagattcccgcgctgttcaagaccatcgaagcgcgcacgggtgtaccggtggagatcctcaaccccttccgcaagatcgaagtggataaccggaagttcgaccccgcgttcgtcatggacgtggcgcccatggcggcggtggccgtgggactggcgctgcggcgcccgggcgacaagctggcctga

SEQ ID NO: 7951 - DNA, 1227 bp, Myxococcus xanthus
ctgcgggaggtcctgcatgcgcacccggctctgacggtattagtgatgaccgcctgcggttcccaggaccagggggtccaagccgttgcccgcgccgagtgcgactacgtgcacaggacatgcaggccggacgaaatcgtcttcgtcctccgaaaggcggaggagcgggagcggctggttcgcgagaaccggcggctgaagcaggccagcctgccttcaacgcccggggggcacatcctcggagagagcccggcgctgcatgcgttgctgcgccaggtcgcgcggctcgcgccggtggacaccaccgtgctcatcagtggcgagagcggcaccgggaaggagctcatcgcgcgggagcttcatgttcgcagtccccgcgcgcccatgtctttcgtcgcggtcaactgtggtgccattccctccggcctcatcgagagtgagctgtttggccacgcgaagggcgccttcacggacgcacgcaccgccaagagaggcctcttcgcggaggccgatgggggcaccctcttcctggatgaggtgggggagcttcccttggccgcccaggtgaagctgctgcgtgtcctccaggagggagaaatccggccggtaggggagaatcgcgtcgagaaggtcaacgtgcgcgtggtggcagccaccttgcgcgacctgtctcgcctggtcgcgaagggggattttcgtgaggacctgtactaccgcctcaacgtggtgaacctccgcgtccctcccctgcgggagcgccgtgaggacgtgccactgctggcgcgagccttcatcgctcggttcaaccgcgagctgaaccgagagcctcccgtcgccgggctcaccgcagaggccgaggcgctcctgaagtcctacgcatggcctggaaacgtccgtgagttggaaaacgccatggagcgtgccgtgttgttggcggacgagccgcacatccttcctgcgaacctgcccgaaaggctgtgggccgcgtccccacctggccctcatggcgagaagccacatggagatccggtgctacagggtggtggtgacctgtcgctcaagcgagccatccgggagctggaagagtcctacatccgagccgccttgcgaaagacgaagggcaaccgcacccgggctgcggagttgctggacatcagtcaccgggcgctcctctacaaaatcaaggagtacggcatcgatccggacgccgaggcggagcgcgggtga

SEQ ID NO: 7952 - DNA, 1002 bp, Myxococcus xanthus
gctgcaccagggcctcaaggagcgtcagggcgtgttctggtgagcgccagacgcggcggtgctaaagaggggagttccatgaaaccggccgtcgtcgtcacgggcatcagcggcaacctcggccgcaccctcgcgaagctgctgcacaagcacgagcgcatcatcggcatcgaccggcggcccttcgcgggacgtccgaaggacgtcgagatgtatgagctcgacctccgcaagaagaaggcggaggacgtcttccggaagaacgaaatccgcgccgtcatccacatgggcatcatgcatgacccccggatgagcgaggaggagcaccactccttcaacgtcgtgggcaccacgcgcctgttggagtactgcgcgaagtacggcgtgaagaaggtcgtcgtcctgtcctcggccaacgtctatgggcccagtccggacaactccaacttcctcacggaagacgcgccgctcatggccgccagccgcttctccggcgtgcgtgacctcatcgaagtggacatgctggcgcacagcttcttctggaagcacccgcacatcgagacggtcatcctccggcccgtccacatcgtcgggccgaccatcaagaacgcgccgtccaactacctgcgcatgcgccgaccctggatgatggcgggcttcgaccccatggtgcagctcatccatgtggaggacgtcgcgcgcgccatggtggaggcgctccgccccgagcccaagggcgtctacaacgtcgtgggccccggcgaggtgcccctgtccgcggtgatgcgcgagctgggcaatacccccatccccgtgccgcaccccgtggcccgcccgctgctgggcatgctcttcaagtaccggctggccaacttcccgccgccggagttggaccacatccagttcctgtgcgcggtggacggcagccgctgggtgaaggacgtggcctggaagccgcgccactccatgcgcgacaccatccgctccgtccagggcgactag

SEQ ID NO: 7953 - DNA, 3723 bp, Myxococcus xanthus
atggccaagtcgatggtggagcgttacgagcagctcctccggcaggaccccacctcttccgttttcgtcgaactcgccaaggccctgctggaaaagggggatgccgcgcgtgccatcgaggtctgcgggcaaggcatttcccaccacccagcatccgtcgtcgggcgcgtgctgtggggcaaagccctcatcaagcaggggcggcccgcggaggcgatggaccagttcgagcaggccatctccatcgagaaggacaacccctacgcctacaacctgattggcgaggtgctgctccagcaccggttgtaccggtccgcgctccccattcttcgcaaggccctggcgctgcagccgaacgatggccgcgtgaagcagtggctggagcagacagagcaggcgttcgcgggtggcccggctcctgtgttcgcgaacctgatggggctggagaagccctcgtcggatgaggacgcgtcgtcggaggaggcgtcgaaggacgaggcttcgagccccacggtggcgcccatggccgctgcccggctgcgcgccgccgcgctgggtgacgcggcgaagctgaagcccgcgagcgccggtgcggcgccggagggagacgccaaggttgcggcgcgcgcggatgtggcatccgaagcctccgcgaaggacgcggggcaggggcgcacgaacgcggacgcggacgggaacgctcgggcgggcacggacattggcgcggcggagcagggcggggcggtggtcccttcaggtgacgcggctccggacggtgctgatgggggccgtgacgcgagcgcctcgctgggcctgttgaaccggccggtgccggtgtcgtccgtcctgggagcggagcttccgagcctggacctggggctgggtgatgacgatggcgcccctccgcgtggcgaggacgaagcggcttccgaggcccaagcgccctcggaggactccgcgctcgagcagcgcgctgacgcagagcaggactccggcgctgtcgcggacccgccgacgcagcaggtgtccatcgcggaggagcccgccgcggcctcggagcccgaggcgagcggtgacgtggatgaaccgcaggccggggccgctccggccgaggacgccggggcctctggcgcgggcggtctcctgggcgaccttcctcctcccgcgtcggcggcgccgaggcccgtcgtggcgagcacgcccgcgacgccgcgaggctccgggggcaagcgctccttgctggaggacatcccggacgcggcgcccgcacccgcggccaccgccgcgaaggccactgcgcgcaagccggacaccgaagcgctcaccgccgagtacgagaaggagctgcgggcgaagctggcgcgtgaggcggcgaagacgtcgttcatcgcccggcatggcgtgaaggtcgctggggccgtggtcggcgtggtggtgctggccatcgtcgtcttcagcttcgtcaacatccgcgcgcgccagggcggacagacgctgagcgagacgctggcccgggccgaggacctcatcatccaggacactggggcctcgctggatgccgcgctggcgcagctcgagaatgcgcgcgacatggacgaaagcagcagccgggcctgggcgctgacggcctgggcgcacgcgctgcgctacgtggaccatgggcaggcttccgaggaccgacgccaggcgctggaagcactggagcggccgggcgtgaaggacgcggcccccgcgcaggtgctggtcaccaacgtgctggtggcggacgagcgcggacgtgccctggcgcggagcgcgctgctgggctcgcagcaggacagcaccgaggtccatgcgctcgccggcagcctgctcctggaggcgaagctcaaaaatcaggcgctcgatcgctatgaccgcgcggttcgtgcctaggacgctaatgtccgcgcggtggtggccctgggggattactacaaggcttccgaggactttccgcaggccatcgagatgtacgagcgcgcgcgcaagaaatcccccgagcacccctcggcccgcatcggccaggcggaggctcggctcgcactgtaccaggacctggaggccgcgctgacggacgtggcgcggctcgcggaggacccgaagcttccttcgtcgctgaaggcgcgccagcaactggtgcatggcgagctgctgtccgcgcagggcaagcattccgaggcccgcgcgctgctctccaaggggacccagggccccctggccttcgagttccaactcgcgctcggcgccgccagtcgtgcggccgggacgctggatgcggcgcaggccgcctacgaggccgcgctcaagcttcggcccaagagcgaagaggcccgcgaagggctgggccgcgcgctgctggaccgcgaccgggagcgcgacgtcctcacccacctggaggccgacgggggccgcaaggtggccctggtgcgtggcgccgcgtatgcgcgcctgggagactggaagaaggcccgtgcggagctggcgcgcacgcgtgtgaatgaccggtatcccccggaggccgtctcctggctggccctggcggacgccgccgagggcaacggcgcccaggcgcgggagctgctggagaaggccctgcacgcggcgaagcggcctcgcaacgacatgcggctggcgctggggcagctctactggcgcgagcgggcctacgacaaggcgcaggccctgttcgaggaggcccagaaggacccgcgtgactatgaggccgcgtgctcgctggggcggttgatgttgtcgcgtgggctgccggacatggccctcaagccgctgacgcaggcggtggagcgcaacggcgcgcatggcgaggcccgtgacgcgctggggcgcacgctgctggccctggggcggacgcaggacgcgctcaagcagttcgaggcgtggcagttggagaacccggggagcgcggccgcgcacaagggcttcgcactggcgctgttccactctggccgccgcaaggacgcggagggcgcggtgcaacgctcggtgaagctggcgtcggatgatgccgaagcgcacaagcttcgcgcggccatcctcttcggcgcgggagacgcgcggggcggcttctccgcactggagcgcgccaacaagctggacccgaaggacgcgggcacgttctgtgagattgccctcgccttcatgcgccagggcaacagcggcaacgcggaggcggccttcgccgcggcccgacgggaagggcccgatgacacctgcggccgggtgggagagctgtacgcgcagttgccgggtggtgggcgtggcgccgctcggacgctcgaggacctggcggccagggcaccgactgtctgggacaaggccttcgctcgggccaccatggcgcgcgcgctgctgggggcgggggccgtgaaggatgcccgtaccgcggcggacgaggccgtgcgtctggcgcctttcgatgggcgcgcccagcttgcactgggaatggtggcgctcaggcagaagcaggaggacgtggcccgggccgcgttggagaaggccgtggagctggagcctgcggacggcctggcgcgtcttgcgctcgcggatgcgttggtgcgcgagcccggtgcactgccgcgagccgtggagtcctacgaggcgttcctgaagctggccggtggctcgaatgaggccgcgcgggtgaagaaggccctgcccagcctgaagaagaaggcggcgaggtag

SEQ ID NO: 7954 - DNA, 225 bp, Myxococcus xanthus
atgcccgagcaacccacgttccatgcgctcacccggctggagccgctcgccacgagtgtcctgctggtggacgacaacgcggccaacctgctcgcgctggaggccgtcctggagccgctgggtcaacggttggtgagggcgtcttcgggccccgaggccctgcgatggctgcttcgggaggatttcgccgtcatcctgctggacgtgcagatgcccggcgtggac

SEQ ID NO: 7955 - DNA, 339 bp, Myxococcus xanthus
atgtggggcaatgcgttcctgctgtcgctcatctacctgctgctggggctcggggtggagattgccctgcgctacttcccctcgcgattcctccagcggctgtcgctgtcgctggactcgctgccggcacgggccctggagctgacgggggccatggagcccttgcgcgcggcctacttctccggccgcatctccgagatgggcgtgcgcgtcgtgttcggcgtcaccaccatggtcgtgattttcctgctcgcgatggtggtgggcacgttgatgggcggcgtccgaacgctgctggcgcgccgggccctgcgcgagggcggacgtcggcacccctga

SEQ ID NO: 7956 - DNA, 156 bp, Myxococcus xanthus
atgcgcctgccctcggcctccgagcgcaccgccgtcgtcacctcggagttcgtcttccgggacgggacgtggctcctggagagccaggacgacggccccttcgagggcgagctgccgagcccgagcaccagccccgagcagcccccatccccctga

SEQ ID NO: 7957 - DNA, 300 bp, Myxococcus xanthus
aattacagcgagctggcctccacggagctacggcgctggcgcaaggagctggcgaaggacctgggcgttgcccccttcatcatcttcaacgacgccacgctgctgggcctgtccgcggcgctaccggtggaccgggagggcttcctcgcggtgaagggcaccggggagagccgctgggagcgctttggccccaaggtggtggaaatctgcctgatggcgcgcgccgcgggccacgagccccaagccgtaccagacgccgcggtgcgcgcgcgcaagcccacgattcgtcgccggagctga

SEQ ID NO: 7958 - DNA, 606 bp, Myxococcus xanthus
acgaacatggcgcctccttcctccgctgtgccccgagcaagcgacccagcgctggacctggccctcctccggcaggtcgccatgggaagcccgcaggccatgcgcgacgtctatgcgcgctgcggcggacggtgtttcgccatcgcgttgcggttgctaccaacacacgctgacgcggaagaggtgttgcaggagaccttcctggaggtctggcggcgcgcccgagagttcaatccagaacgcggcggtctggaggcatgggtggcgacgattgtgcgcacgcgcgccatcgaccggctgcgggcgcagggaaccgcggcccgggtggtggaaggggccgtgcagcaggagcctccggtcagcgccgcgcccgccgcgccggacgaagcggtcagccaggaggaggctcgtgctcgcgtggtggcggcgctggcccagcttcctccggagcagcgggcggtggtggagcttgcctacttcgaaggcctctcccagcgggagatttccgagcgcaccggagacccattgggcacggtgaagacccgtgcgcggctcgcgttggagaagctgggggcgttgttggagatgctgcgcccccacgcctag

SEQ ID NO: 7959 - DNA, 693 bp, Myxococcus xanthus
atgaaggcgattctcgtctcccttttcctgttgggctcggcgccggactccagcgcgccagcgattccgcccgaagcgctcgcggcgcctcctgtcgcggatgagtcccccaccgcgtggtcctgcaccgtggacaccctgcgtgctgggaaggaatgcgtgttcgaggcggacctgtccgcgggcgcgcccagcgattcgcaggacgcatccaacaagaagctcctccaggacgtggcccgcgcgctgtgcacggaggcggtgggcaacatccgcgagggccgcccggacgcgacgctcaccgcgctttgtgagcggcgctacatcaccgccgtggaccagtgcggactggaaggcacgtcgttcgtggtggacgccaagggtcgcttcgctcccggcgcccgctcctgctaccgcgcgctggccaacgtccttcaagaggtgcagttcatggccacggtggcctcgccgtgctgcgagtgcgccgcccgcgccaactgcccgggcaccgccgaccgctgctatgccgaggtcgcccagcaggccaccgcgccccagacgcaggcgtgcctgagtgacaggtgcgcggatgcgtgcgccgtcgtgctgccgctgcctcgctccggagcgcaccccgcgcccaccgtccagcagcgcaaccgttccgccagccctggctccgcttccctctag

SEQ ID NO: 7960 - DNA, 1155 bp, Myxococcus xanthus
atggacctggatcccctctggtacaagaaagcccttatctacgagctgcacctgcgtgccttccatgactccaatggcgacggccacggggacatccccggtctgattgagaagcttccgtacctccaggacctgggcatcaactgcctctggttgctgccccactacccttcgccgctgcgcgacgatggctacgacatcgcggacttctacggggtccacccggactacggcacgctcgcggacttccagcgactggtggatgaggcgcacaagcgcgacatccgcgtcatcaccgagctggtggtgaaccacaccagtgaccagcacccctggttccaggaagcgcgcagcgaccccaacagccccaagcgcaactggtacgtctggagcgacaccgacgaacagtacaagggcgcgcgcatcatcttcctggacacggagcgctccaactggacgtgggacccggtggccaagcagtacttctggcaccgcttcttcagccaccagccggacctcaactacgacaaccccgaagtgcaggaagccatgctggacgtcatgcgcttctggctcaacatgggcgtggacgggttccgctgcgacgcagtgccctacctcttcgagcgcgaaggcaccaactgcgagaaccttccggagacgcacgccttcctcaagcgcctgcggaagaccatcgactccgaatacaaggggaagatgctgctggcggaggcgaaccagtggcccgccgacgtgcgcgtgtacttcggcgacggcgacgagttccacatgggcttccacttcccggtgatgccccgcctctacatggcggtgcgccgcgaggaccgcacgcccatcgtcgaaatcatgcagcagacgccggacatcccggacaactgccagtgggccatcttcctgcgcaaccatgacgagctgacgctggagatggtgacggacgaggaccgggactacatgtaccgggaatacgccaccgacccgcgcatgcgcatcaacctgggcatccgccgccggctggcgccgctgatggacaacggccgccggcgcatcgagctgatgcacagcctgctcttcaccctgcccggcacgcccgtcctctattacggcgacgagattggcatgggcgacaacatctac

SEQ ID NO: 7961 - DNA, 732 bp, Myxococcus xanthus
atgaaggccctgggcaaggtgggcttcacccagtcgtacacctacttcacctggcgcaacttcaagggcgagctccaggagtacctggaggagatcacccagccgccggtgtccgactacttccgcggcaacctctggcccaatacgccggacatcctcccggagttcctccagaacgcggggcccggtgccttccgtctgcgcgcggcgctggccggcacgctttcctccgtgtggggcatgtactgcggctacgagctgtgcgagggccgccccatcccgggcaaggaggagtacaccgattcggagaagtaccaactggtcgcgtgggacctggaccggcccggcaacatccgggattggattgcgcgcctcaacgccgcgcgccgcacgcaccccgcgctgcatcagtacgggacgctgcgcttcttctcgtcgaacaacgaccgagtcctcttctacggcaagcgcacgccagacggcggcagcctggtgctgatggcggtgagcctggatccgtatgccgcccaggaggcgctgctgcacgtgccactcgagtggctgggcgcgcgccctgacgagacgtatcaggtgcacgagctgatgtcggaccagcgctcgctatggcagggtccggacgtgcaggtgcgcctgacgcccgagcagcctgcggccctctgggccgttcaccggttccgccgcaccgagaacgcgttcgactactacgagtga

SEQ ID NO: 7962 - DNA, 177 bp, Myxococcus xanthus
atgggccccgcccgtgagtcgctctgggcggagctggaatccgtcgtcctccactgggtgaagcaaggggtgaacacgttcagcgtggacaacccgcacaccaagcccacgcaattctgggcctggctcatccgccgcgtgcaggaagcccatccgcaggtctttttcctgtcgtag

SEQ ID NO: 7963 - DNA, 261 bp, Myxococcus xanthus
atgcgcttcctcggcaatgaccggtgggaaggcgaattccccctgacgcggaacggccgctacgagtacacgattgaggcctggccagacctcttccggacctggacgtccgagctgaagcgcaaggtcgacgcgggccgggacgtgcgcagcgagttgttggaaggcgcctccctgctggaaggcgccgtctcccgtacccgtacggcgaagcagccggaccactcgcgggtgctggacgaatcggacgttcggatgtga

SEQ ID NO: 7964 - DNA, 639 bp, Myxococcus xanthus
atggccacccagcgcatccacgaagaagacagcttcgagaacgaaaccttcgccgacctgaacctccaggagacggacctgggcgggaaggagttctaccgctgcacgttcctcaactgcaccctgcaggagagccgctggacgaggactcggatggaatcctgcgtcttcaccggttgcgacctcacgcgagcccggttcacggagacatcgctgcgggacgtgcggttcgaaagctccaagctgatgggcatcgactggacggacgtgggcaccttccccgaagtcaccttcgacggctccaacctgcgctactgcaccttcgcggggctcagcctgcggaagacggcgttcctgcgctgcacggcgctggagatgaacttcatcgacacggacctgtccgaggcggacttcagcgattcggacatcaccggcagcaacttccgcggctgcacgctcacgaaggcggacttcggaaccgcgcagggcgtgttcatcgaccccgcgcgcaaccgggtgaaggccacgcgcatccccgtggaggccgcggtgaacttcgtccagacgctcgggctcgtggtgtccggctacggtgaggtcccgaaggcgaagacggagcgcaagaagggccgttcctga

SEQ ID NO: 7965 - DNA, 951 bp, Myxococcus xanthus
aagccccgccgcgccgctcagggcttctcgcccctgcacggtctggaggacgtgccccagacgccgcgcacgcgcctcaacgccgtcatgctcaccgagcagggcgaaggtggcgcgtccggcgcggacggcctcttcacccgcaccgagctgcaggacgccatcctcagcaaccgcggcatgatcgccgagctgctcatcgacgacgtggtggcccgctgcaccggccacacgacggtgccctacggcacggacaccgtggacatcagccaggcgtgctcgctgattgcccagtgggaccgtcgttatgacgtggacagcgtgggcgccatcgtgtggcgcgagttcgcgggcacgttcaccatgggtgagcttcaggcgagcccggcgctgtacgccacgcccttcgacgcggccgaccccatcgccacgccccacacgctggcgccggcgcccgcccagggcaccgaccccgtcctgacgaagctggctcaggccgtgaccgcgctgacgcgcgcgggcctggcgctggacctcccgctgggcgaggcgcagttcaccccccgcgtgagcggcgagcgcatccccatccacgggggcggcaactacgatggcgcggcgaacatcgtcggcttcggcacgctgaagtccaccacgcccaacgccgaggtgggcagcgccacgcggaccgtcgtcaacggacgcacggccctggccaacggcggctacgtcatcaacaacggcagcagcttcatcatggccatggagttcacgcccaccggcgtgcaggccagcgccctgctgacctacagcgagtccagcaacccggcctcgccgtactacgcggaccagacgcggctgttctcccagaagcagtggcggcccatcctcttcacctccgaggaaatcgccgccgcgccggctgagcagatcaccctcaccggcgactga

SEQ ID NO: 7966 - DNA, 981 bp, Myxococcus xanthus
atgagattcgccgccctgctcctcgccctgctgccggtggccgcgggcgccgcctcaccacaggccgcgacgcctccgccgcgcaccgcatccttcgcgctcatcatcggcgtcaatcgcagccatgaaccggaccagcccgcgctgcgcttcgcggatgacgatgccgcgcgctacctggacctgttccgcatgctcggcgcacgcacgtacctgctcgcgcgcatggatgacaacacgcgccggctacacccgcaggccgccgccgaggccctggaccccaagcaccccgagctggcctcctccgtgaagaagctgggcgaagacatcgccctcgcgcgcagccgtggcgtggagacggtggcctacgtcgtctacgcgggccacgggaacgtgcgcaacggcgagggctacgtcagcctggaggacggtcccctcaccgggcagacgctgtcctcggacgtggtgggcaagctcggcgccgaccgcgtccacctcatcgtcgacgcgtgctactcgtacttcctggcctacagccgcgggcccggcggacagcggcgccccctgcccgcgggcttcacgcgcgcggtgggactggcgctggcggacaacgtgggcctcttgctgtccacctcgtccgcccgcgagagccacgagtgggaggccttcgaggccggcgtcttcaaccatgaggtgcgctcgggcctcttcggcgcggcggacgcggacggtgacgggcaggtcagctaccgcgaaatcgccgccttcgtggagcgcgccaacgcggccattccgaacgagcgcttccgcccccagctccacgctcggccgcccaagggctccgaactgctggtggacctgcgcccggggatggagcggcggctcgaggtcgacggcgcccagggcgcccactacctcctggaggacgccaacggcgttcgtctggccgagttccacaacgcgcaaggccagtccctgcgc

SEQ ID NO: 7967 - DNA, 294 bp, Myxococcus xanthus
atgggcacccagggcggcaccatcgcgcgggatgaggacttcggcggcctggcgcggctcacctacgagttggatgacacccgctccttccacgccatcgcctgctccgtcaccggctggctcctctaccaccgcttcttcgacaacgcggcggcggccaccgccgccttcgaggagatgaagcccgcattggaggcgctcctcacgcagcttcccgaaggaggaccgacgtctcccgcgaacacccgcctggcggggcccctgctggcggccttcaccgtccgtcatggatag

SEQ ID NO: 7968 - DNA, 783 bp, Myxococcus xanthus
atgtccaactgctacgaggtgtccttgaacgagcggagcgcgctctacaacaaggaccatcaggcgattgcccggcggatgaagctcgtccaggaggacttcgccctgagcagcaaggcgaagaagcgcatctggaagcgcttccccgtcagtgacaactcgaagcggaagctgaccctgtcggacttcttcgacaaggggcggcagtcactctactggctgcgccgggggccggaggggtggcacatcggggtgaagcacctggacccggtgcccaaccagacgctgaagaaggggaaccggcctcagtttcagccgcgtcagaatcagctccagggcgggtatggggccttctatccctacgagcacaactaccatcacctcatcccggtcggcgccgtcgaggagtgggtcatcggcaagggcgagtcggggagcccggcgcgctccgaccaggtggtgaagctcatcctcatctcgcggtggaacatccacaacgagaagaacatggtcctgctgccgcagcaggagttcgaggcgctcatcgtgggcctgccggcccactgcccttggggcgtgcccgcgcatgcggcgtatcagtcgtcgctccaggggcggctgcgtaagttgcggagcaagatagatcgtgcaatccgccagaagaagcaccccaaggacctcaaggcggacatcatcgaggagctggattcgctgtcgaatgcactgctgagccaggtcgagaatatgagagcgggtgttcagctcggacccgtgaatgtttag

SEQ ID NO: 7969 - DNA, 384 bp, Myxococcus xanthus
atggagtcagaggaggacttccactacttcggcgccctcatcgccctggtgctcgcgcagtctcacctgggcgcggagctcgccgcgttcgagcggacgctccagggcggaggctcccaccgcttcgacgtggtgcaggccctgtcaaagcaagaggccgatgccttcgacgcgggcctccacggaatgattgaggagcaggccgcctgggtcgagcgccagcggcgctccggcctgttcgatccctaccgccacaagacggaggccttcgtcttcgtcgaaggcgccgcgctggtccaactggcccgccgcctgggcgtaccgacgcaggagcgctatcgcctcatcccctctgctgccttggaactccaggcccgcacttga

SEQ ID NO: 7970 - DNA, 999 bp, Myxococcus xanthus
ttgcccgtcatcgacatggcgtcactgttcgatgcatcccgcgtcaccgagcgtgcgcgcgtcgcgcgtgaaatcgagcaggcctgtcgcgacagcggcttcttctacgtgacgggccacggcgtgtccggcgaggtgctcgcgcggctggagcgggagagccaccgcttctttgcgctgccccgggtggcgaaggaggccatcgccatgtcgatgggcggtgtcgcgtggcgaggctggtttccactcgggggggagctgacctcggggcgcccggaccggaaggaggggttgtatctgggcacggagctcggaagcgagcatccgcgcgtaaaggccggctggccgttgcacggcgccaacctgtggcccgcggaggtgccggagctgcgcgcggcggtgctcgactacgtggcggcctgcacgcgcgccgcgcatgcgctgatggagggcatggcgctgagcctgggcctggacgcggactacttccggcggcactacacggcggacccgacggtgctcttccgcatcttccattaccccgcggagccccagcacgaggaggtgagctggggcgtgggcgagcacaccgactacgggctgctcacgctgctggcccaggacgacaacggcgggttgcaggtgaagacgccgcgcggctgggtggaggtaccgccgctgcccgggacgctggtgtgcaacatcggcgacatgctcgaccggatgacaggcgggtggtaccgctccacgccgcaccgggtgaagaacgtgagcggcaaggacaggctgtccttcccactcttcttcgacccggacttcgccgccgaggtccaccccctgccacgcggcgcgggcgctgacgtagatgatgaccgcgcccgccgctgggatggcgccagcgtccacgccttccagggcacgtacggcgactacctgctgggcaaggtgttcaaggtgtcccttagaagtcgtccgaggggtgtgcccacgcgcgcatag

SEQ ID NO: 7971 - DNA, 1176 bp, Myxococcus xanthus
ccccacaccgcgctgtccaccgggctcgtgtggctgatggccgccgcctcgggcgccaccgtcgcgaacctctattacaaccagccgctgctgggagacatcggcgaggccctgggggcctcggggagcgcgctggggctggtgcccatgctgacgcaggtgggctacgcggtggggatgctcttcatcgtcccgctgggcgacagcctggagcggcggcgggtcatcgtcaccatgaacatgctggtggcgctggcgctcgttggcgtggccctcgcgccgacgctgcactggatggtggccgcgagcttcgtcgtgggcgtcaccaccatcattccccagctcctcgtccccttagcggcgctcctggcgcccgcggcgcagcgaggccgggtggtgggcaccgtcatgagcggtgtgctgattggcatcctcctgtcccggacggcggcggccttcatcggaacgcacctggtatggcgcaccatgttctggattgcggcagggctgatgctcgcgttggccggcgtggtgcgcttcacgctgccgtcgcagccgcccatggcctccatgccgtatccgcaactgttgcgctcgctcatccacctggcgcgcaccgagcccgtgctacggctgcatgcggtgctgggcgcactcagcttcggcgcgttcagcgtgttctggtccacgctggcgctgtacctccagagcctgccgcagaagtacgacgcgcaggtggcggggctgttcggcgtcgtgggcgtggcgggcgccgccgtggctccgctggtgggccgctacgccgataagcgcggggaccggcgcatcaacggagcggccatcgtcgtgttgctgctgtcgttcgtcgtgatgtggcccctgggacgatggctgtggggcatggcgctgggcgtggtgctgctcgatttgggcgtccaggcgaaccagatttccaatcagacacgggtgtactcgctgcgtccggaggcccgcagccggctgaacacgctctacatggtgacgtacttcgcgggcggcgccgcgggctcgtggctggggaccttcgcatggacgcactggggatggagcggggtgtgcgcctccggcgccgcgctgtgtgtcgtggccctgctggcgctcaagcgagggccgaagggcggcgcagcgaaggcgtga

SEQ ID NO: 7972 - DNA, 438 bp, Myxococcus xanthus
atggcgagcaccaacaaggacgtcgagacgctcaactcgttcctgcgcggcgaaatctccgccgtggagacctatcgcaaggcgatcgggcacgtctcggacggactggcccgtgacgcgctggagtattgccagcacgaccacgagcaccggatcgaggagattcgcgagcgcatcctgaagatgggtggtgagcccgtggagagctctggcatgtggggcaccttcgccaagctggtccaaggcggtgcggacgtcctgggcgagaaggccgccatccaggcgctggaggagggcgaggaccatggccttgccgactaccagcgcgacgcggaccaggtgcatggcgagaatcgacgcttcgtgaggatggagttgattcccgcgcagaagcggacgcatgagcggctcagtcgtctgaagcgcacccttcactga

SEQ ID NO: 7973 - DNA, 675 bp, Myxococcus xanthus
atggacgccagccatgcggggacgctgagcgcgggttgtgaagccctcttccgctccaccgagacgacgctccagtgggcctggcgggtgctgaagtgcgcgaaggcgggtccgggcgcgggccccctggccacgtccgcccgtcagtgcgcgctcgagttcctggatcgcgtcccgccccatgtgcgccgcggcgtggcggagctcctggggtacagcagcctgtggcaggcggtgtgtacgcggctgggccgcccggtggcgcgctccaccgaggagctgcagcatgagctgggcgaggacctccaggtcctgctccacggcgcccaggcgcggctggggaccgccgccgcgctggagcaggggctcctggtccacctggggcggctgcgcgattcccgccggggggagccgggcgcgccgctggagctgcgcgcggccctggacgccttcacccactccctgtccgagctgatgaccgcggccagcgcctaccgccgcgcgtgggaagccgccgagacggagctgtccgagtccgcggcgtggctgggcgccggagacccgggcttctgctcgtggatggcggaccatctgtcagagacagtcttcgcgtggcgcaacgcccaagcctccgtccgcacgctgcgcgagctgggagagctgtcccagcagtag

SEQ ID NO: 7974 - DNA, 720 bp, Myxococcus xanthus
catgcctcccgggagctgctccggctcgtcgtggtcggctccgtggatgacgggaagtccaccctcatcggcaggctcctctacgagtgcgacgggctcttcgaggaccagatttccgccgtgcggaaggccagcgcgaagcggaccgccgccgccgtgtccgtgccctccgaggtgctggtccaaggcctgaaggccgcggccggcgcggacggggaggaactggacttctccctcttcaccgacggcctgcgcgccgagcgtgagcagggcatcaccatcgacgttgcctaccgctacctcagcaccgcgcggcgcaaggtcatcgtcgcggacacgccgggccacatccagtacacgcgcaacatggccaccggcgcctccacggcggacgcggcggtcatcctggtggacgcgcgactgggcgtgctgccgcagacgcgccgccacgcgtacatcgcctcgctgctgggcatcccctacctggccgtggcggtgaacaagatggacctcacgggcttcgaccgcggcgccttcgagcgcatcggcgccgagctggtggacttcgcccacgcgctcggcttcgagggcgtgcggctcttccccatcagcgccagtcgcggggacaacatcacccggcccagcgcccgcacgccctggcatgaaggcggcagcctgctcgcatggctggagtccctgccccaccagcgccggcaggac

SEQ ID NO: 7975 - DNA, 918 bp, Myxococcus xanthus
atgagtgagcacacgttcgcgcgggcgtcccacctgtcggagctggaagcggagagcatccacatcctccgggagacggtggccgagttcgccaacccggtgatgctctacagcatcggcaaggactcccaggtcctgctgcacctggcgcgcaaggccttccaccccgcgcccctgcccttcccgctgctccacgtggacaccacctggaagttccgggacatgtatgcgttccgggacgccttcgtggcgcgccacggactgcgcctcatcatccaccggaaccagcgcgcgctggccgagggcatcaaccccttcgaccacggcagccagaagtacacccatgcgatgaagacgcaggcgctgctggaggcgctggcggcgcatggcttcgacgcggccttcggtggcgcgcggcgcgacgaggagaagtcccgcgccaaggagcgggtgttctccttccgggaccggcacggacagtgggacccgcgccgccagcggccggagctgtggaacctcttcaacggccgcgtcgacgcgggcgagagcatgcgcgtcttcccgctgtccaactggacggagctggacgtgtggcactacgtgctgcgcgagcgcatccccgtggtgccgctctacttcgccgcggagcgtcctgtcattgaccggggcggcacgctgctcatggtggatgacgagcgcatgcggcttcggcccggggagaagcccgaaatccggcgcgtgcgcttccggaccctgggctgctacccgctcagcggcgccatcgaatcctccgccaccacggtggagaccgtcatccacgagatggtgaacgcccgccagtccgagcggcagggccgactcatcgaccacgacgaagagggctccatggagctcaagaagcgcgagggctacttctaa

SEQ ID NO: 7976 - DNA, 1451 bp, Myxococcus xanthus
atgccttcacaccccctggattatcccgtgtgccttcgactcgagggacgctccgtcctgctggtgggcggcggcgccatcgcggagggccgtgccctcgcggtgctcgacgccggcgcgcgactgcgtgtcatcgcgccggaggccaccgccacactgcggcggctcgcagccgatgggcgcctggaatggcagccccgttcctacaaggccggcgacgtgcgcggccatcacctggtgctcgcggccacggatgacgtggccgtgggccggcaggtggccaccgaagcccgggacgtgggcctgtgggtcaacaccgcggacgaaccggcgctgtgtgacttcaccctgccctccgtcggcaggcgcggccccatcaccgtcgccgtgtcctcggcggggcgggccccagcgctcgccagccacctgcgcaagacgctcaccgcccaggtgacgcgacaccacatctggctggcgcgactcagcggctggctccgcgagcacctgccccgaggcgaagggcgccagcggctgctgaagcaggtggcggtgggagacatcggcgcgctgctggagcgaggcgagcgcaaggccgcctgggctcggctccgcacggagttggagcactcgaagatacctggagagacacgatgagagagcagacgagaggccgagtgttcctggtcggcgcggggccgggagacccggagctgttgaccttgcgcgccgcgcgcgtgctccgggaggcggacaccgtcgttcatgaccggttggtccaccctggcgtgctcgagcatgcgcggccccacgcccggctcatctacgtgggcaaggagggcggcggggactccgtgagccaggaggagattcacgtcatcctcatcgcccaggcgctgctggggcgccgcgtggtgcggctcaagggcggtgaccctttcgtcttcggccgcggcggcgaggaagcgctcgcgctggaagaggcgggcatcccctatgaagtcgtgcccggcctcaccgcggggacagccgtgcccgcggcggcggccattcccgtcacgcaccggggtgtctccggggcggtgacgttcgccactgcataccgaggcggcagcgcgccggcctgggacttcctggcgaaggcccagacgttggtcctctacatggcgggcagccggttggaggagacggtgcgcgcgctggtcggcgcggggcgttccgcgtccaccccggccgccgtggtggaggcgggcacgtgggcgcatcaacgggtggtggaggctccgctgagccacatcgcccaggcggcgacgcgtgacgcaatcggctcgccgtcgctgctcatcgtgggcgaggtcgtctcgctgcgcgggcgcctgccttcgctggtagcgcaaggaacctcggagcatggacacgcgccagcgcgcgtggcggagggcggtcatgagtga

SEQ ID NO: 7977 - DNA, 90 bp, Myxococcus xanthus
atggaggcgctcgtggagcagggcgacctcgacgccgtgctccccgctggcgcggacgccacctcgctccagctccaggtcatcccatga

SEQ ID NO: 7978 - DNA, 723 bp, Myxococcus xanthus
atgtcgcccccgcagccccaggcctcggccctgctcgccgaagccgctgaagtgaaggacgcccccgcgcaggacctcctcgcctggaccgagcgccgcttcggtgcgcgcgcggccatcgcctccagcttcggcgtggaggacatggtcctcatcgacctggcgcgccagcatgcgcccagcctgcgcctcttcacgctcgacaccggacgcctgcccccggagacgtacgaactcatggaggtggtgcgtaagcgctacggcgtcaccgtggagacgtacttccccgagcgcgcgcgcgtggaggcgttggagtccacgaacggctacttctccttccgccagagcctagaggcacgcaaggcgtgctgcgccatccgcaaggtggagcccctgtcgcgcgcgctcgcgggtcaacaggcgtgggtgacgggattgcgccgtgagcagtccgtcacccgcaccgacgtggcgacgttagaggtggacagcgcgcatgggctgctcaagctcaacccgctggccacgtggagcagccgggacatctgggcctacgtccgggcgaagagcgtgccctacaacgcgctccatgaccgtggctacccgtccatcggctgtgcgccctgcacgcgcgcggtgaaaccctacgaggacgagcgcgcgggccgctggtggtgggagtccgcggagaaccgcgagtgcggcctccacccggtccgatga

SEQ ID NO: 7979 - DNA, 1662 bp, Myxococcus xanthus
tggtggcgcgcttccccaaggggcgagtaccacccggtggcgcgcatcttccatctcaagcagggcaaggtgcgcgcgggccgcgtggccgtggtgacggcgggcaccagcgatatccccgtggcggaagaggcggccacgacggccgaggccatgggcgcggaggtgcggcgcgtctacgacgtgggcgtggccggcatccaccggctgctgcggcgccgcgaggaagtccaggagtgccatgccgccgtggtggtggcgggcatggagggcgcgttggccagcgcgctgggcggactggtggggattcccgtggtcgcggtgcccacgtcggtgggctacggcgccaacttcaagggcgtgtccgcgctgctggccatggtgaactcgtgcgcctccaacgtggccacggtgaacatcgacaacggttttgggcggtggcttctacgccgccctcatctcccgcacgaagggacgcaggtgagcaccatgcgacgcatcctctacctggagccggtgggcggcatcgccggggacatgttcctggcggcgggcctggacctgggcatttccccggcggagctggagcgcgcgctatcgggcctgcgcgtcccgggctggaagctggcggtgagccgcgcggtgcgccacgccatcagcggcacgcacctggacgtcgtgctggatgcgcgcgaggcccatccgcaccgcgcctacgcggacatccggcgtctcatcgaggaggcggacacgctgcccccgcgcgcgaaggagcgggcgctggcggtgttccgcgccatcggcgaggcggaggcgaaggtccacggcgtgtccatcgacgacatccacttccatgaagtgggcgcggtggactccatcgtcgacatctgtggcgcggcggtggtgctggagctgttgggcaacccggaggtccatgcggcgccgccgccgctgggcagcggcaccatccgcgtggctcatggcgccatgcccattcccgtgcccgcgacgctggagttgctgcgtgacgtgcccgtgcgcttcgaaggcgtgggtgagctgacgacgcccacgggcgcggcgctgctcaaggtgctggcgcacatcggccatccgccggacttcatcgtgaagaaggtggtctacggcgtcggaacgaaggacttcaaggaccggcccaacgtgctgcgcgcgtcgctgggccggctggagcaggccagcaacgaagggctctgggtggtggaggccaacctggacgacgccacgccgcagctgctggggcacctgctggagcggttgctcgcggtgggcgcgctggacgcgtgggtgacgccggtggtgatgaagaagagccggccggggcacctgctgagcgcgctggtggagggcggcacgcgcgaagccatcgtggatgtggtgctgcgcgagtccaccacgctgggcgtgcgctaccaccgtgtggagcgtcaggcgctggagcgtgactgggtggaggtggagacgccgtggggcaaggtccgcgtgaagcgcgggctgcgccagggcgcggtgctcaacgcccacccggagttcgaggactgccgccaggtggcggaggctgcgggcgtccccgtgaagcaggtgatggccgcggcggtggcggcgctcggccccaaggactga

SEQ ID NO: 7980 - DNA, 1347 bp, Myxococcus xanthus
ctgttcgcccggctcaccggagaacagctccgctggatggcggaccatggccgtcaactccacttccccgctggcacgcgtatcgccgagcaaggcgccgccgcggatggcctgtccgtcatcatggagggccacacgcagtggagccgccgcaccggcacggagagcgtgcccacgttcacgctggaggccggcgacctcttcggcgagctcatcctcttcctgaacgcgccctacccccacagcggcgacgcggtgacggacgtgcgcctgttccggctggagccggccaccttctgggagctgctgcggctggctcccggactcagccggggactgatggagctggcctcgcagcgctcccagcagcaggcgcaagacgtccgtcctcagtcggaagtgctccccgtgggccgcatggcggccgaactgggcgccgagctgggcagccccgccgcggcggcccggcggagcgcggcgcggctgggcgagctgatggccacggtgtccgcgcgcgccatggccctgggcgaccacggcctgtccctgccccagcgcagcgtcctgctggcgctgcctcgggaagcggcggagcgcgggcggacctctccgccgctggagcccctggcccgcgccgagcgcgaggaagcgctgggctcctggttggaggcgcgcggcgtggcggatgcgtgggaggcggcgcccgcgctggtggcctccggcctggacgtcgcgtggctggagtcggtggcgacgcgcgtgggcggggcgctgctgggcgacgtgctcgcgtggctggtggtggcggtgagctgcgacgtgctcatggcggaggtggcgcgaggaacggcacgcgtgtccgcactggtcgaaggcgtgaaggcctatgccttcatggacccggtgccgcgtgaggacgtggacgtccacgacggactggagcacgcgctggcggcgctgggccaccggctgcgcggagagcacctcacggtggagcgtgagtacgacccgcacctgccccggctgaaggcggaaggcgtcgcgctcgacgagctgtggacgcagttggtgctcaatgcgctggaggcgctgggcgagcgcggaggccgcgtgcgactgcgcacctggaaggatgccgcgcacgtggtcgtcgaggtctccgacgacgggccgggcattcccaaggacttgctgccgcgcatcttcgagcccttcttcagcacgaagccccatgcggcgggcatgggcctggacgtctgccggcgcatcgtcgagcgccatggcggcgacctgtgcgtgcgcgccgagcagagcggcacccgcatccaggtgcgcttgccggcgtaa

SEQ ID NO: 7981 - DNA, 1320 bp, Myxococcus xanthus
atgggctggttcggcgcgaagctggtgtccgtcgtttcgtcccgccccacgcaccagttgctgggcggtctgctgctggcgctggctccgcccatggcggcgcggctggggcatctgacgctgtgctcgcactggctgttggtggccatgatgtggctgcaactgcgcgacacaccggatgcccatgcggcgaagcggagcctcctgtgggccgccgcgttgaacgccgtgggcgcgggcacgcatccgtacctggtggccatgctcgcgccgctggccatggcgctgaccgtgcgcctggccctgggccgcgtcatcagttggggacgcgcgctgctggcctcggtgggcatcgtcatactggacgtgctcatcttcgccctcttcggctacttcgtcggcagcaacctgggcgcggaaggcttcggccagttctccgccgacctgaccacgctgttcaatcccacggactggtcgcggctgctgccctcgctgcccgtggcgcggcggcagggcgaaggcttcggctatgtgggcgcgggggcgctgctgctcgtggtgctctccgtcgtgggcgcagcgcttcgctttcgcgccctgcgggacctgccctggcggcggggactgcccttcgcggtggcggtgctgctgctggccatctacgcgctgtcgtcccgggtgacgtggacgggccggctggtggtggacctgggcgggctgtacgaacccttctcgcggctgacgtccgcgttccgcgcgtccgggcgcttcatctggccgctgtgctacgcggtgatgggcggcgccctcctcctgtggctgcggcagtggcgagagcgcgcctgggtggggacggcggtgctcgcgctggtggtcgccgtgcaggcctacgacgtgcgccaggacaagagcgagctgcgccgccgcccggaaggcttccgtcggctccaggccccggagtgggcggagctgaagggccactaccagcacctggccatcttcccgcctcaggtgcagtgggtgtgcccctacaacgagccgctggtcaacgcgacggggtacatggcctaccgactgggcctcactttcaacagcggctacgtcacccggaccccaccgtcgatcgccgaggagtgcaacgccaccatgcgccctggcggcgtggacggggacacggtgtacgtcgtggtgcgtcagcaggtgggcgccttcctccgggcgggcgcgcgctgcgggatgctggaggggctgccggtgtgcgtgtccgggcagcggaacgacgcctttgcgcaggcgttgacgcggcaacccttgcgatag

SEQ ID NO: 7982 - DNA, 1014 bp, Myxococcus xanthus
aaggggcttttctactctgggggagcgttgaccatccgcggcagcaacccgctcaacgaggtgcgcgtcggaccgcagacgccggaggcgcttccagccgttcgcgtcgaaagcctgacgctcaactcgctccccgccctttcgtccctgagcggcgtggccgccgtggcgccccacttcgacctcaccatttggaacaccggcgtgcagtggagccccgacgcgttcccccacgtccaggtgctggcgggcacgctcaccgttcacgagaacgccgcgttggagaagctgcccgtgtcccatctgacggaggtgggagggagcgtcatgatttcgagcaacccggtgcttcagtccctggaggggctgggacctctgacgagggtcggcggcgtgctcgacatctccagcaacaaggccctcacgcacctcaccgggctggaacacctgatggtggtgaaggaccgcatcaccgtgatgaacaacgcccagctcctggacctccgcttcgatgccctctccgaaacaggcgcgctcgccgtggcgggcaacgcggcactggagcaggtaggcccgatgccgtcgctgctccgggtgaataaggacatcatcctggcggagaacccgcggctgctgcgcgcggcggacctgccaaagctccagagcatgggtggcgcgttgttcgtcaacctcaacccgctgctgacggacctgtctggctttgagcaagtgacgtggatgcgcggcctgtacgtcaagggcaatgacgcgctggagcacctgagccccctgggctcgctccacaccctgggcaccctggaggtgcgggggaatccagcgatgacggcgctgagcctggatgcactcgcgcgcgtgcgcgatgcgttcgtcgtcacggacaacccccagctcccctcgtgcttggcgacgatgctcgcggacgacgtctacatcgggccgccagaggagcgcctcatcgggaacaacgacagcatcacgccttgccacccctag

SEQ ID NO: 7983 - DNA, 6526 bp, Myxococcus xanthus
gacatcctgaccgcactggagctgcgcaaccggctcgagtccgggctgaagctcacgctgtccgcgacgctggcctatgcctatcccacggtgcagacgctgacggcgcacctgttcggcaagctggagcccgtcctcgacgtcgagtcgcgcgtcacggtgcgtccggtggtgaaggaggcgcaggttgttccggcggtggggacgacggcgcagggccccgaactgctcgccatcgtcggcatgggctgccgtttcccgggcggcgcgaatgacccggaggcgtactggcggctgctgagcgaaggcgtggacgcagtccgcgaggtgcccgctgaccgctggaagagcagcacggacgcggcggagcacaagggcacgcgctggggtggcttcctggaccgggtggatggcttcgacccggagttcttcgggattgcgccacgtgaggccgtggcaatggacccgcagcagcgcttgctgctcgaggtcgcgtgggaggcgctggaagacgcgggcctgccgaaggcgcgcttgtcgggcactcggacgggcgtcttcgtcggcgtctgcggcaatgactacgcgatgctccaggcggagcgcgacgtggagggcgacgtctactccgtcatcggctgctccaacagcgtgattgccgggcggctctcgtacctgctggacctgcgggggccggccatgtcggtggacacggcttgttcgtcctcgctggtggccttgcacctggccggccagagtctgcgcaatcgcgagtgcgacgcggcgctcgtgggcggcgtcaacctgctcctgtcgcagcggcccagttcctggctctccaagctgacggcgctgtctccggatgggcgctgccggaccttcgactcgcgggcgaatggcttcgtccggggtgagggctgcggcgtcgtggtgctgaagcggctctccgatgcgctcgccagcggagacaacgttctgggcgtgattcgcgcatcggcggtgaaccaggatggtggctccaccggcctgacgacgcccaacgtcctgtcgcagcaggccctgattcgcgaggcactggcagcggcccaggtgtcgcccaaggacattggctacatcgaagcccacggcaccggcacgccgctcggcgacccgatagaggtggaggcccttcgggagacgtatggccaccggcgcgaggatgcctcgcgctgcttcctcggctccgcgaagacgaacatcggtcatctggaggcagcggccggcatggcgggcctcatcaaggtgctgctcgcgctccggcacgaggccattccgaagcacctgcacttcaaggcgctcaaccctcgcatctccatcgaggacacgcccttcgccatcccgatgcagcaacagtcgtggcctgtctcccagcggcgccgttacgcggcggtgagttccttcggcatcagcgggacgaacgcgcacgtgattgtcgaagaggcccccgcgtcttcgcccgcgcccgaggccacccagaccgccgcgcggctgctcacgctgtccgcgaggagcgagggcgcgctgcgagccctggttcgctcgtaccacacactcctggttcaacctggggacgcggcgcctcggctcgaagacctggcctacaccgctgcgctgcggcgcaacccccacgaacaccggctcgcggtggccggttgtacggcggcggagtggggcgagcagctcctggcgttcctcgaaggcggggcaccgccgtatctgacgacgggcgtcgcggaggggcgccgggaacaggtcgtcttcgtcttcggaggccagggctcccagtggcagggcatggggcgtgacctcttcgcgagcaacggagacttcgccgccgcgttgcgtgacgtggacgcggcgctggccccgcacacccggaactccatcatcgacgcgctgatggcggacgggcccgagtcccgtctggaggagacggaggtggcccagcccgccatcttcgccatccaggtcgcgctcgcggccgcatggcgtgcactgggcgtcgtcccgtccgcggtcgtggggcacagcgtgggcgaggtggccgcggcacatgtggctggagcgctgagcctgcccgaggccgctcggctggtggcgcaccgcagccgcatcatgcagaaggcgacggggcagggcccgcatggcctccgtcgaactgtcgcccgacgaggctcagcacgagctggtgccctacgtgggccggctgtcggtgggtgccatcaacgacgcccggagcgtcgtcttgtcgggtgaaccggcggcgctcggagcggtgctcgaaacactgcgtgcccgaggtgtcgccacgagggacctgggcgtcaactacgccttccacagctatcagatggcaccgcttcaggccgagctgacccaggtcctgggccacatcgaaacgcggccgacgtccgtcccgatgttctccacggtgagtggcgaggccatcgacggcacggcactcgacgcggcgtactgggcgcgcaacgtaggagtgcccgtgcggttctcagcggccgtggaagcgctactggcgcaagggcaccggctcttcgtcgagctggggcctcagcccgcgctaggccggtacgtggagcaggcgctgcgacgccgtgagctggaaggcgcggcggtgccgtcactgcgcaaggggcgggctggccagacggtgatgctgggcgcgctgggcgggctccacgtgaagggctaccccgtggagtggagtcggatcttcccggagggaggccgtctcgcgtcgctgccgctctacccgtggcagcgctcgcggtactggattgacgatgcccccgtgaagacgctgacccgggcctccgtggcccggagcgcggacacgtcgaatgtccaaagtccgggtggctgggtctacgacatcacctggcacgcgcgtgagcggggggcgccttcgccgcgtgcgcccaggggcgagggaacctggatcgtcttcgggaaccgtgagggcgttggtgccgcgctggcggcccatctggacgccctgggcgaaccgtgctggctggtcgtccccggagaggtcgcggccgtcggaggccagaaggtgcggtccatccacccggacaacgcggagcactacgcgcaattgctccaggacgtgggcccggtgaaggccgtggtgcacctgtggggcgcggataccgtgtccggcgcggagcccacgctcgcggaggtggagtccgcgcagaaacgaggcgtccacgcggcgttgcgcctggtgcaggcgctggtgaagtcaccgtccgcgagcggcgcccggttgtggttgtgcacgcgggggacccagccggtgggcaacgtcacgagcggctcgcccgtacaggcgccgctgtggggcctgggccgtgtcctggcgctggagcacccggaggtctggggcggcttgctggacctggaccccgccgtgccgcagggcgaggtggaagcgctgtggcgcgagctgtccggagcggatggcgaggaccaggcggcgctccgcgatggcacccgtcacgtggctcggctggttccctcggcgcctgtcgttggcgatgcccgcctcacgcttcacgcggatgcgacgtacctcgtcacgggtggcctgggcggattgggactccacgtggcacgctggctcgtctctcagggcgcgcggcaccttgtgctgctgggccggaagggactgccgagccgcgacgcgtgggccgccattccccgcgacaatgatgtgggccggcaggtctccgccatcgaagccatggaagcggagggcgccgttgtccacgccctcagcgcggatgtggcggatgtggcgcgcatgtcggaggtcatcgacgccgtccagcggggaccggctccgctgaagggcgtcattcacgccgcgggagtctccacgcaggtatcgctggaggccatggacgcggcattgctcgctgccatcctgcgcccgaaggtggcgggtggctgggtgttgcaccagctcacgcaggggctggacctggacttcaccgtctacttctcgtcgggctcggccgtgtggggctcggcgcagatggggcattacgccgcgggtaaccagttcctcgatgcgctggcgcaccaccgccgcgcgcggggccagcatgcgctgagcatcaactgggggccgtgggcggccgaaggcatggtcgctgaggaaggactgcgctggttcgagcgcatcggcgtgcgcggcgtcaccgtggagggcgggctccagttgctcggagcgctgctcgccatggacgtgacgcagcggagcgtggcgcagattgactggagccgcttcaagtccgtgtacgaatcgcgggcgccccggccgctcctggaggtgctcggtgctccctccatgcccacgccggtggcaccggtggacggcagcgagacgctggcgcagttgcgcaacgccacgcccgcgcggcgcaaggagttggtgacgtcgtgggtgcgtgaggaggtgtcccgggtgctgggcttcgcctccagcgcggcggtgaagctggagcagggcttcttcgacacgggtatggactccatcaccgccgtggagcttcgtcggcgactggtggcgcgtttcggtgtccaggtcccgtccaccatcgccttcgaccgtccgaccgtcctggccctctccacgtatctgctcaaggacgtgctccggctggatgtggaggcgaaggaggagacaagccgcgtcgtcagcaacgcgacggagcccattgccatcatcggcatgggttgccgtgtcccacaggcctcgggtccggacgccttctggaagctgctggagggcggcgtggatgccatccgcgaggtccccgcctcgcgctggaaggtagacgactactacgacgcgcggccgggcgtccctggcaagacgtacacgcgctggggcggcttcctggacgacgccgaccagttcgatgcccagttcttcgggattgcgcctcgcgaggcctcgaacatggacccacagcagcgtctgctgctggaggtcgcctgggagtcgttggagcacgcggggctcgcgcccgcgcggctggccaacaccaagacgggggtgttcgtcggcatcggcagcaacgagtacgcgatgctcaacggcgtggggagcgcgtcggcggcgggtgacgcctatatcgccaccggcaacgacgcgagcttcgccgcgggtcggctggcctacttgctccgcttccaggggccggcgatgagcctcaacacggcgtgctcgtcgtcactggtggcggtgcacctcgcctgccaggccctgcgtggtggcgaggcgaacctggcgttggcgggcggcgtcaacatgacgctcgcgccgcactccaccatctacctggcgcaactccgggccctgtctgcggacggccggtgcaagacgttcgacgaatccgccgacggctacgtgcgcagcgaaggctgcggcatggtcgtcctcaagcgcctgtcggatgcacagcgggatggcgatgacatcctcgccgtcatccgtggctcggccgtcaatcacgatggtccgagcagcgcgctcaccgtgccgaacggggatgcccagcagcaggtcctccgcgccgccctggccaacgcgaacgtcgccccctcggacgtggactacatcgaggcgcacggcacgggcacgtcgctcggcgaccccatcgaggtccgcgccgtggccaacgtgctcggcgaggggcgcacgcccgagcagcggctgctgatgggctcggtgaagaccagcattggccacctggaggccgcggcgggcatcgccgggctcatcaaggtcgtcctggcgcaccggcacggcgtgattccgccgcacctgcacctcaagaagctcaactcgcacatcgagctgaacggcttcccgctggacatcccgacgcaagtcaccgcctggccggagcgggcgcgtccacgaatcgccggcatcagcgccttcggcttgagcggcaccaacgcgcacatcgtcgtggaggaggcgcctcggccggagcccgccaaggcgcaggccgagcgcggcgcgcaggtgctcgcgctgtcggcgaagacgaagggggcgctcgcgcagctcgcggtccgagtcggggagcacatcgctcagcggccggagctgtcgctcgcggatgtcgcccacgcggcgaacacgcagcgcacgtcgttctctcaccgcatggcgctcgtggtggagacggcggagcaggcccgggagcggctgcaggctttcgcccgaggggaggaagtcccccggctggcccagcaccgattcgagggggaggagcccaaggtcgtcttcgtcttcacgggacagggcgcgcagtactcgggcatggaccgtgagttgtacgaaacggagcctgtcttccgcgcggccctggaccggtgcaatgccctgctcgagggtgagtggagcgactcactcctctccgtgatgcacggggcggacgcgcgg

SEQ ID NO: 7984 - DNA, 1227 bp, Myxococcus xanthus
ttctcaagacccatcctctgggtcggcgtgtccgggcccttcagccagcaggtggtgagtgactacgcccgctaccgcgtgaaggagaagctccagacgattccgggcgtgggcgaggtgcagctgggcggcatgctggagcgcaacgtccgcatctgggtggacgcgcagaagctggacgcgctgggcctcacggtgacggacgtgtccgcggcgctccagcgcgagcacgtggagctgcccgccggccgcatcgagacacagggccgcgaggtcaacgtccgcgtcatgggcgaggcgctggacctggagacgctgcggcgcatcatcgtgcgcgagcagggcggcttccccgtctacctgaaggacgtggcgctggtggaggacggcttcgaggacgtgcgccgcatggcgcgcatcaacggcgagccggcgcagggcctgggcatcaagaagcagcgcggtgccaacgccgtggcggtggcccagggcatccgggccgagctggacaagatgcagaaggacctgccggaggggatgcagctgggcatcaacttcgactcgacgcagttcatcgaggagagcgtccacgaaatcgagttcgagctgatgctcgcgtgcatcctcaccgccttcgtgtgctgggtgttcctgggctcgatctccagcacgatgaacgtggtgctggccatccccatgtcgctgctggggacggtggcggtcatctacttcctgggcttcacgctcaacaccttcacgttactgggcctggcgctggcggtgggcatcgtcgtggacgacgccatcatggtgctggagaacatctaccggcactccgaagaggggaaggaccgggtgcgccccgcgcgcgagggcaccgcggaaatcaccttcgccgcgctggcggcgacggcggcggtggtagccatcttcctgcccgtcgtcttcatgagcggcgtcatcggcaagtacttcctccagttcggcgtgacgctgtgcgtggcggtgctcctgtcctacgtggaggccatcaccctggcccccgcgcgctgcgcgcagttgctcaagacgtcgcgtgaaggccgcagccggattggcgtctgggtggaccggggcttcgagaagctggagcgcgtctacgcgcgcaccctggcctggggcctgaagcggccgtggtgggtgctgggcgcggcggtagtgctgacggcctccagcgtctttagagaa

SEQ ID NO: 7985 - DNA, 1038 bp, Myxococcus xanthus
acgggtgagagctgccgcagcggcgtctgtcggaccgttccacctggctcgggcgcgtgttcctcctccctggactgccccgggtcccagatctgcatcaacagcgtctgctcgcagttctgctcgcgtgactccgactgcggttcgggccagcggtgcgacaagaactactgcgttgggaacggcgggacgcgcccggacgcgggttctgatggcgggacgcgcccggattcggggacggacggtgggacgcgcccagacgctggctccgacggtgggacgcgcccggatgcgggcgtggacgggggggctcctcagcagtgccgggtgaacatggattgcggtgcggggaactactgcatcaacaaccagtgcatccgcggctgctatgacgattcctggtgcgacgccaaggacacctgcgtgagcggcctgtgccgtccgcgcccggtggacccgaacacctgctccaccgcggcggactgctccggcgggaaggactgcgtggatggccagtgccgcgcggcttgcgactccaccacccagtgcccggacgactacagctgccagattggctactgcatgcccattccggatgggggccagtgccgcgccaactgcgagtgccccgccggccaggtctgcttcaatggcaagtgcaagtcgccgcagccggacccgggccagacgtgcgtggccaactgtgactgcccctcgggtgacgtctgcaccaacggttactgccgtccgccggccccgccgccggacgcgggcacgggcacggcctgccaggccaactgcgactgcccgtcgggcgaggtctgctccaacggccagtgcaaggtgccgccgcctcctccggtgcaggatgccgggacgtccaccccggtgtgccgcgccaactgcgagtgcccgtccggtcaggtctgcacggacggcgtctgcaagcccgtcaacacgggcagcggcaacagctgtcacgccacctgcgagtgccccgccggcgagcgctgcatcgacaacgtctgctggctgtag

SEQ ID NO: 7986 - DNA, 639 bp, Myxococcus xanthus
atggtttcgtccattttccccgccccggacgttgggcatttcgtggaccccgtaggcccctccagacgtggccctttgagcgacgacacctcggcggagacaggcccgtggcttgcccggttccacgccggagacgcccgcgtcctcaacgcctgctaccgcgaccacttcgacacggtgtaccgcgccgccgtccgcgtcctcccggctgtggacgcggagaccgtggtccacgacgtcttcctccggctcgtgtccgacgaggccgcgcgccgctccttccagggcggctccctggcaggctggctgcacacgctctcccacaacctcgccgtggaccgggtgcgccgtcagcggcgtgagtcggacgccctggcccagctcgccgtggagtcctccgcctccgaagagcccacaccacccgagcccgggcttgacgccagcttcctcctggagcgcttccgccaggaaagcctgccgcccaaatgggcccccgtcttcgaggctcgcttcgtgctccagctcagccagcgcgaggccgccgccgccctgcgcatgcgccgcacaaccctcgcctaccaggagctgcgcgtccgccaactcctcaagaagttcctcctcactccggaggcccgatga

SEQ ID NO: 7987 - DNA, 660 bp, Myxococcus xanthus
accgcggcccccctcatccctgagtctccgacgtacgacaagctccgaaaggcggctgcggggtgtcaggcctgtccgctctggcgcacgggcacccagactgtctttggcgagcccgagggccagccgcgccccggcccccgggtgatgctggtgggggagcagccgggagaccaggaggaccgggccggcaggcccttcgtgggtccctccgggcggctgctggacgaggcgctggaggccgccggcatcgaccgcgcgcaggtgtacgtcaccaatacggtgaagcacttcaagtggaccggccaggggccccggcgcatccacgcgaagccgaccacgacggagattcgcgcctgcctgccgtggctggaggcggagattcgcgtgttccgcccggacgtcctcgtctgcctgggggccaccgcggcgcaggcgctgctgggcaaggcgttccgggtgacgcagtctcgtgggcagccgatggcgtcggaatgggcgcgggtggtggtggccacggtgcacccgtcctccatccttcgcgcgccggaccctcgggcgaaggaggctgctctggaggccttcgtggacgacttgcgccaggtggcgcgcatcatccacggcctgtcggaaggggagggcgcgcacgcgcccatgtaa

SEQ ID NO: 7988 - DNA, 762 bp, Myxococcus xanthus
atgagcgtgcgcgtcgagaagaacggcctcgtcaccaccgtcatcctggaccgcccggaggtgcgcaacgccgtggatggcgccaccgcccaggcgctggcggaggccttccgcgccttcgacgcggacccggatgcgcgggtgggcgtgctccatggagaagggggtaccttctgcgccggggcggacctgaaggccgtctccgagggccggatgccccgcctggagctggacggggatggacccatgggcccctcgcgcatggtgctgtccaagcccgtcatcgcgtccatcggcggccatgccgtggcgggcggcttggagctggcgttgtggtgcgacttgcgcgtggccgaggaggacgccgtcctgggcgtcttctgccgccgctggggtgtgcccctcatcgacggggggacggtgcggctgccccggctcattggcctttcgcgcgcgctggacctcatcctcacgggccggcctgtgtccgcccaggaggcgctggccatggggctggtcaaccgtgtggtgccccgggggcaggcgcgcgaggccgcggaggctctggcgcgcgaggtggccgccttcccgcaggcgtgcatgaacgcggaccggcgctccgcctacacccaggcggggctgggcaccgaggaggcactgcgtcaggagttcgcccgcggtgtcaaggtactggagtcggagtccattgctggcgccacgcgttttgcccaaggggcggggcgtcacgggaagttcgaatag

SEQ ID NO: 7989 - DNA, 362 bp, Myxococcus xanthus
gcagggagggactgtgttagttcccccggcatgcgcttcgacacgcttgccatccacgccggtcaggagccggatcccaccaccggcgccatcatgacgcccgtctacctgacgtccacctacgtccaggacggccccggagagcacaagggctacgagtacagccggacgcagaaccccacccgcaaggcgctccaggactgtctggccgcgctcgagggggcgaagtacggcgcggccttcgcctccggcctggcgggtacggacatgctgatgcacatgctggactcgggcgaccacgtggtcgtctcggacgatgtgtacggcggcaccttccgcctcttcgacaaggtgttccggcg

SEQ ID NO: 7990 - DNA, 837 bp, Myxococcus xanthus
atggactccgtagcgcagacggatgatcaaaaaatttatttgatcggctttcgtctttccggagacccatggccatggaggtatgtagtggcctggacctttcagtcggtcaccgggccgggctcgtatcgcgccggaccccgaccacccatcgagggagaacccctggtgttcctgcgtggagcccgctcattcgcgcacgtcacccacctccccgaggagcgaaagggacgcgacgtgtccggtgttcccgcccaggacgaggtgcggctccaggcactggtccggcgcatccaggagggcgacctgacggcattcgaacagctctatgcgctcacgcaggcggatgcctcgcgcaccttgtggcacctggtcggcaaccgcgtggacgtggaggacctgctccaggaggcctatctccggctgctgacagccgtgaagagctaccggggcgagtcccggttccggactttcttctatcgcgtgtgctccaacgtggccctgtcccacctgcgctggaagcggcgccggcctgaggactccgtctgggacctgccggaagcggtggcggagggagacgaccccgagcgggtggcctcgcggcgtcaagcggcccggctggtggagctggcgctggaacggctgaagccaaagaagcgcatcgtcttcgtgtactacgagctgtgtggaatgagtccggacgagattgccgacgccgtgggcagctcccccaacaccgtccgcagccgcctccaccatgcgcggctggagttcaacgaagccatgcaacgactgctcggcgccaaccggtccggaggtttccatggcgcgacatga

SEQ ID NO: 7991 - DNA, 933 bp, Myxococcus xanthus
atgttcgccaaccgcctgcgcaagggggacaagcgcttccggaaatgggcccggacgcaggggctgacggccttccgcgtctacgacagggacatccccgagtacccgtacgccatcgacgtctacggcgaccgcgtccacgtcgtggaatacccccggcggcgtgccatcgcctccggtgccgcggacacgcagcgggaggaagtcctggccgcagtgacgcaggtgctggccgttccctccgagcgcgtcttcgtgaagacgcacacgccccagccctggggccgctctcagtacggccgggtgggccaggacagcgggcgcatcgtggtggaggagcagggcctgaagttctgggtgaacctgggcgactacctcgacaccggcctcttcatggaccaccgcaacacccgcgcgcgcgtgcgggaggaggcccggggcaagcgcttcctcaacctcttcgcgtacaccggggccttcaccgtctacgccgccgcgggaggcgccgcgagcacgatgacggtggacctgtccaacacctacctggactgggccgaggacaacctggacctcaacggcctggccgacgcgcggcacacgctggtgcgcgcggatgccaaggcctgggtggaggcccaggccgacgcgccggagcggtacgacctggtggtgtgcgacccgccgtccttctccacgtcgaagaagatgtcgggcagcttcaacgtgcagcgcgaccacccgcgcctgctggccgccatccgggcgctgctcgcacccggtggcgtcctctacttctccaccaacttcctggggttccagttggaaccgaaggccacgcggggaatggaggtggaggaaatcacccctcgctccatccccgaggacttccagcgcaaggagatccaccgctgctggcgcatggtggctccctga

SEQ ID NO: 7992 - DNA, 1662 bp, Myxococcus xanthus
atggacccaccggccatcacccagagcatcaagagagacccgggctacctccgggcgctcgacacactgcacaccgagttcgacaacctcctggccgagctgaagaagtccgcgccgttcttcagcatgcgctaccaggtccacatgacgtgggagcagacgctcccgggcatgaccggctacttcgcggccatgctctacaatcagatcaacgtcgcgctgaaggcctcaccgctatcgacggtcctggaggtccgtgctggcgaggacctgtgccggatggtgggctacacccagcagaacggcatccggccctggagccatctgaccagcggtggcaccaccgccaacatcgaggcgatgtgggccgcgcgaaacttgaagttctatcccctgtccctgcgcgaggcccttcagcgggagtccacgctttccgccgcgaaggccctcaaggtaacgctgccctcgggaacccaggcacgtctggttgacctggatgcgtggcaagcgttgaacctggatgtggacgaggtgctgggcctccccacccgcatccatgaggagttcaaaatcccgccggagaccctgacggcgaacgtgagcaactacatgctccaggatttagggctcgtggagttcacccgccgctacctgggagacctcccggcgcccgtgttcatggtcccaggctcgaagcactactcgctgcccaaggcggcggcgattctgggcatcggcgcggaccacatgttcagcattcctctggatgaagaggggcgcatggacgtgtcggccctggaggcgcggctggaccaatgcatgaaggacaagcagcccgtcatcgcggtgacggccgtgatggggacgacggaggaagggttggtggacccgctcgcgtccgtgctggcgcttcgccggcagaagtaccatccgcaggggatgtcgttctgcgtgcacgccgacgcggcctggggcgggtacttcgcctcactcctccgcgcgccgccgagttcaaacaagcgcctcgcggggcctcccgcccccgtgctgtcactgagccgctatgtcacggagcagttcgaggccctcccggaggcggacaccatcaccgtggatccgcacaagacgggctatctgccctaccccgccggtgcgctgtgctaccgcaatcagtccatgcgcagcttggtggccttcgaggcgccctacatcaacacagcggggagccaggaggacctcaccgtgggcaagtacggcatcgagggatccaagcccggtgccgcggcggcgggcgtgtacctcagtcatgccgtcgtgccacccgaccaacgtggctacgggaagatcctcggaagggcgctctacaactgcaagctcttccatgcccggctactgacgatgaacaccgtggcgagcgacttcgtcgtggtaccgggtccgcgattcaagctctccgattccctcaagcgcaagtacggcggagagaagcaggcgctggagttcctgcgtcagcaaatccagggcatgcgtcaggagcagctccttagcgcctcgagtgaggaggaactggagctgctgcgcgaaacgggcgcggacctcaacatcctcacctacgccttcaacttcaagaccgagcagggactcaacacgagcctggaggag

SEQ ID NO: 7993 - DNA, 1107 bp, Myxococcus xanthus
ggggaagaagtagattccgattcggtcatgtatgaatgtggcgacagtcgctggcgtcggggcggtcggttgagtcagtatgatatcaagggtgccaccctgctctacggtgactcgatgtgggggcgccagtttggagctgaccaaagcgctggggggtgggaggtgggctaccacgagcgtgtcatgggggatgtcactggggatggactccctgacatcgtcggcttcggctatgcgggcgtgtttgtctcccggaccgtgtacgtgcccccatctttagatgccggttacttcgctccctcgctgctccatcttcaagctttcggctatgctcagaactggcgcgtggaccggcacccacgtaccgtcgcggacgtcaatggcgatggcaaggcggatctcattggcttccatgacgctggcgtacacgtcgcgctgtcgaatggcttcggctttggttcgccccagttctgggtgggggattttggctacaatgtcggtcaatggcgagtggagagccatgtgcgcaccgtcgcggatgtcaatggtgatggtaaggcagatgtcgttgggtttggtgatgcgggtgtatatgtttctctttccacgggctcttcgttcggtgcttcgaggctctggttgggagattttggcgtaaaccagcagtggtttgtgccctataccgtgcgcgccgtcgcggacgtcaacggcgatggcagggcggacatcgttggcttctccaagagtggcgtatacgtcgcgctggccaacaacacgggcactggcttcaatcccacccagcaatggacttctgagttcacctgggaccagggatggcgtgtggatcgccatgtgcgcaccgtcgcggacgtcgatggtgatggcaaggccgacattgttgggtttggagagaaagagacccgcgccgccctgtcgacgggctccagcttctctgcgtccacgctcatgtcgccggattttgtctacggtgtcggagactggcgcgtgaacaggcaccctcgcttcgccgtggacatcaacaacgatgaccgagccgacctcatcggttttggcgacctgggtgagtacgtgaagctgcgctga

SEQ ID NO: 7994 - DNA, 738 bp, Myxococcus xanthus
atggacagcgtggcgctgtcgacgacgacccagttggctgtgatcggctcgggtagcggcatccccttcaagattgattcggggggcaaggtgcttgcctcgcgtgcttccacgttggactttttcgtcggcgacacggataccttcggaggcaactcagggtcgggcgtctatgcgaaaatcgacggcagctatttgctggctggtatcctcgtgcgtggcaacaaggactacgtcaagcgcatcggaccggcgggcgaatgctatgtcgtcaatgtcatcacgtccatcggtagttgcacggatgccatttgcagcgctgaagccatcaactacgtgcggcccgccatcgatgcgtattgcgctgtggcgaccaacacgcggctgtgtcctggtcaaggaccagcgacaccggtgacgtttgatttcgcgaccagcggcaccaacaatgcgacgcgtaacactgtcgcccagaatgtcacgttgtcggcgggagagaccctctatgtggggaccgccatggtgatgtacgccacagccaggggggacacgtacttgcgcctggatcgatacgagaccagcaccaatacgtataccggggtcgcgaacaacgacgatgcctatgacagcctctcctacatccggtacacggcgaaggtcgcgggtacgtaccggattcgcgttggctgtgctcgggacagcgcctgtgctggaagggtgtcgtatatcatccgttag

SEQ ID NO: 7995 - DNA, 495 bp, Myxococcus xanthus
cgcgatgacgacaccttcgtgctgaacgtcatccagtacgtgctgacgaagggggaggggagccggctgatccgctcgctggtgtacgagcagaagctggccgtgtcgctgatgctcgactggagctggcgcatcgacccgggcaccatcctcttctacctggccctgaagccggactccgacccgaagaaggtggaggccgcgctgtacgccgaactggagaagatcgcgcgagagggcatcaccgagcgcgagctgcagaaggcgcagaacaacctgcgctcggaccacctgcgcgagctggccacgaacagcggccgggcgcatgccctgggccactacgaggcgctgctcggtgactggcgccggttgctgacgctgccctccacctacacctccattaccaacgaccaggtcaaggccgtggccgcgaagtacttcgcgcccgagcaccgctccgtggtgacgctggttcccgcgcccaccgaagcctga

SEQ ID NO: 7996 - DNA, 759 bp, Myxococcus xanthus
cgcctgaacatcggccagctcgccatcgaccagctcaccttcgaggaggcggtgacggagattggccggctggtggactcgcgccagggcggctacgtgttcaccgccaacgtggaccacgtggtgctggccgaggacaacgtgcagttccgcgaggcgtactcacgcgccacgatttcggtggtggatggcatgcccatcgtctgggcctcgcgcgccatggacgtgccgctgcccgagcgcatcgccggttcggacctcatcctcccgctaatgaaactgggggcggggcgcaagtggcgcgtgttcctgctgggcgcgggccccggcgtggcggagaaggtgggccgcatcgtcagcgagcagtacggcgtggaggtggtgggctgggattcgcccatggtgcgcctggacggcggcgacgcgcagaacgacccgattgtcgcgaagattcgcgagaaggacccgcacctgctcctggtggcgctgggcagcccgaagcaggaggtgtggatttcgcaggtggcctccaagctgggccccacggtggccattggcattggcgcggggttggacttcatcgccgggacggcgaagcgcgcgcccgtgtggatttcgcgcgcgggcttcgaatggctgtaccgcctggtgaacgagcccaagcgcctgtggcggcggtacatcctgaatgactcccgcttcgccacgattctgctgcgcgagttctggcagcggacgggtgcgaagaagccggagtag

SEQ ID NO: 7997 - DNA, 1329 bp, Myxococcus xanthus
gccacgacgagcgccctcacgcttcccacgttgcacgaaagcaccacgtccagtggcctgaaggtcatcgccgccgagcgcgggcccctgcccatggtgtccgtgcggctggtgattcgcgcgggcagcgccaccgacccggatggcaagcacggcctggcggacttcaccgcccggttgctgcgccggggcacccgcctgctgaacgcgcaggccatcgacgaagcggtggagttcgtcggtgccagcctgggcgtgggtgtgagtgaagacacgctgtcggtggccctcaccacaccgtccgagcacttcgtacagatgctcgacatcctgggccagttggtgcgcgagcccacgttcccgcagtccgaagtggacgatgcgcgcgagcgcgagctggcgcagttcgccaatgacctggacgacccgtccatcatcgccgaccgcgccatggtccgcgcgctctggggcaaccacccctacggccacgacgtgggcggttcgtcgaagagcgtgaagaccttcacgcgcgatgacgtggtgcgcttccaccaggagcgcatgggccccaaggtgtccatgctcatcgtggtgggcgcggtggatccgcagcgtgtggctgccgcggcggaagacgccttcgctgattggacgggaggaccggatgcgcccgtggccattcccgcgccggagcgcattgccctgggtgggcgggtcatcatcgtggacaagccggaccagacgcagtcgcaggttcggctgggcggccccggcatgcgcatgggccacgaggactatttcccggccacggcgatgaacatcgccctgggcggtggattcacctcgcgcctgatgaacgagattcgcgtcaaccgcggcctcacgtacggcgtcagctcgtggttcgactcgatgaacgcggccggcgtcttcgcgctgtccaccttcacgaagacggagtccacgcgcgaaatcatcgacgtggcgctggcggagattggcggcgtccgggagaaggggctcaagccccgcgagctggcggatgcccaggcctacctcgccggcctgtacccgctgcggacggagacgaacgagtccattgccggaagcatcgccgaggcccgcctgcacgggctgggggatgactgggtggagcggttccgggaccggctgcgcgcggtgacgccgaagcaagtcgtggccgccgcgaagaaatactgcttcgcgcaggcgcccgccgtggtggtgctgggcaaggcggacgcggtgaagaagcagctcaagggcctgggtcccatcaccgtggtgccggcgtcggagtacgagtga

SEQ ID NO: 7998 - DNA, 699 bp, Myxococcus xanthus
gacgtccgcatcctcttcgagggcggcggcgtgctcgtggtggacaagccgcccgggatgctcgtcattcccgggcgcgaaggcggcccctcgctgcgggagttgctggagacgcatcggcgccagaaaatcttcgtggtgcaccggttggatcgggacacctcgggggccctcgtgttcgctctggacgccgcggtgcaccgggccctgtcgggtgccttcgagacggggaaggtgtgcaagcgctacgtggcgctggtggaaggccgggtcgaagcgccgcaaatggtggatgcgcccctggtggcgggcaggaagggacgcatgcgcgtggctcggcctggggatacggacgccaaggcctcgcgcacccgcgtgcggcccgtggagaccttcgagcgtgcgtccctggtggaggccgagcctctcacggggcggacgcaccagattcgcgtgcacctgctgtccctggggcacccgctgctggtggaccatcagtacggccgcgaggccccgctgacggagaaggacctgggcggggaaggggactcggtggtgctgtcacgcacgccgcttcatgccgcgcgtgtggagtggcctgccctggcaggtgtcgaggcacgcgccgtggaggcgcccgtgcctgaggacatggcccgtgcccgtgagttgctgcgggcgtccgtcacttcactttga

SEQ ID NO: 7999 - DNA, 672 bp, Myxococcus xanthus
gtgcggcgccccttccggctggtcaacctcttcgcccaactggacttcgtgggtgtggggtccatcttcatcgtgtcgctcaccggcacgttcaccggcatggtcttcgcgctgcagacgtccaccgcctttcagctcttcgacgcggagagcctggtgggccccacggtggcactgacgctcacccgcgagctggcggccgtgttctccgcgctgatggtgaccatgcgggcaggttccgccatgtgcaccgagctgggcaccatgcgcgtcaccgagcaggtggacgcgctagagaccatggccgtcaacccggtgcagtacctgctggttccccgggtgctggccggcctcttcatggtgccggcgctcaccatgctcttcaacaccatgggcatgggcggggcctacgtggtagccgtcgggggcctgggcatctcccccggaaccttcctctcccggacgcagcagtggctggcgcccgaggacatcttccagggcctgctcaagggcgccgtgttcggcctgtcggtgtccctcatctgctgcttcaagggcttcaacgcctcgggcggcgccaagggcgtggggcaggccaccacggaggcgatggtggccagcgccctgtccatcttcatcctcgacttcatcctgggcatcctcttcttctga

SEQ ID NO: 8000 - DNA, 744 bp, Myxococcus xanthus
acgccgatgatccaggtggtcgacctgcacaagacgttcggcgaccacaaggtgctcaccggcatcaacctcaccgtgccggccggcagcacctgcgtcatcctgggcggatcaggctccggcaagacggtgctgatgaagcacatgattggcctgctcaagccggaccgcggccaggtcatcatcgacggggaggacatcgtccccatgggcgtcgagtcgctccagaaggtgcgcaacaagttcggcatggtgttccaggccgccgcgctgttcgactcgatgaccgtcttcgagaacgtagccttcccgctgcgggagcacacgaaggatccggaggacgtcatccgccagaaggtccgcgcgcggttggatctgatggggctcaagaaggacgtcgaggaccggttccccgcggacctgtccggcggcatgcgcaagcgggtggggctggcgcgggccatcgtcatggacccgaaggtggtgctctatgacgaaccgaccaccggcctggaccccatcaccacggactacgtggacgagatgatcctggccgcccagaaggaactgggcgtcaccagcgtggtcatcagccatgacatctcctccgccttcaacgtggcggaccagattgccttcctctccaagggcgtcatcgtggccagcggttcgccggagcagctccgcgaggcggatcaccccgcggtgaaggtgttcctggagacctggttcgggaagaactga

SEQ ID NO: 8001 - DNA, 984 bp, Myxococcus xanthus
gtgggcctgctggtcatcgcggcgggggcttttttcgtcaccttcgtcctgttcgctcgcaaaggtggtttgagcgacagcgaatccacgagggtgtgggcctatttccgggatgcgtccggcctcgccgtgcgtgggcgcgtgcagatcgccggtatcccggtgggcgaaatcgacgacatctcgctcgaggggacccgggcgaaggtctggttgaagattcgcaacgacgtggacctgcgcgaggacgccgtcgtcaccaagcgctcggaatcgttgctgggtgactacctgctggacctgaaccccggcacggagagcgccccccacctggggtcgggtgggcagatccgccgcgtcgtcgatacccagggcatggaggccgtcttcgagtcgctgtcgcagatcaccgccgacatccaggaggtgacgggggcgctgcgggaagtgcttggcggtgagcgtggtgcggggtcgctccagcgcatcgtggagaacctggtgcggctgtcggactccgtggattccacggtccggcgcaacgcggaccgcctggacaccatcgtcggcaacgtcgaggccatctccgcggacgtgcgcggcattacccagggcaaccaggcggaaatcacccgcatcatcgacaacatcgagttcatcacccgcgacgtgcgccaggtgctcggcagcgtgaagaacatcgtgggcacgggtgaaggcgacgtgaaggagaccgtcgccagcctcaaggagacgctcaagaagctggacggcacgctgggcaacctggaggagatcacccgcaaggtgagggacggggagggcgccgccggcgtgctgctggccgacgaggccgtgggccgcgagctccgcgagacggtgcaggacgtgtcgcgcttcacgtcccgcctgaccgacctccaggcggagattggcatccagagcacctacctggccgcgcagggaaattcgaagaacgtcttc

SEQ ID NO: 8002 - DNA, 498 bp, Myxococcus xanthus
atggtgggaacgaagattgctcgcgtgcgttgcaacacgtgtggcggagatcacgcatatcgcgcggctcctggcgcgacggatcgccccgcgtccagcaccacccgcaccgcgcgctcgtcctccagcagcagctcaagcgcgtccaaggcggagaaggtcatcatctccttcgaggagcagctcgctggaaaggatgtcgccaacgcgccccgctacagcccgaaggacacgtacaaggtggatcaggtcatccagcatcccaccttcggcacgggttacgtgtcggccgttcgcggcgacaaggtggacatcaccttccgcaccgacaccaagacgctggtgcacggccgtggtggcggcccggtggagaagccggtcttcaacccgcccaaccggcaggtgaccggacccgcggacaagcccctgcccgtcggtgacagcgccgagccggcgcccgctgacggcgccgagccgccccccgcgtcggaggattga

SEQ ID NO: 8003 - DNA, 1527 bp, Myxococcus xanthus
atgtcgcgcccccgtatcctcatcgacggtgacaccctgaagctcgaggaaatcctccaggtggctcgcaacgaggccaccgtggagctgtcgcccgacgccgccacccgcgtgcgggcctcgcgcgccctggtggaccgcgtcgccgccggagacacgcccgcctacggcatcaacaccggctttggcacgttggccgaggtccgcatcgacaagaaggacctgcgcgacctccagcgcaacctcatcctctcccacgcgtgtggcgtcggcacgcccctcccccttccggaagcgcgggcgctcctgctgctccgctgcaacgtgctcgccaagggctactccggcatccgcatggagacgctggccctggcgctggacatgctgaaccgggacgtcgtgcccgtggtccccgagcggggcagcgtgggcgcctccggggatctcgccccgctggcgcacctggcgctcgtcttcatcggcgaaggtgaagccttctatcagggccagcggatgcccgcgaagcaggcgctggagcgcgccggcctgcaaccggtggtgttggaggccaaggagggcctcgccctggtgaacggcacacaggccatgtgcgcggtgggcaccctgctccagcttcgcgcggagtccctggcggacatcgccgacgtcgcgggcgccatgacgctggaggggctgctgggaagccacaagcccttcattcctgagattcacgacgtccgcgcgcacccgggccagaaggacgtcgcggcgcacctgcggcgcatcctggtggacagcgagctggtggagtcgcacgtcaactgcagcaaggtgcaggacccctactccctgcgctgcatgccgcaggtgcacggcgcggcgcgcgagggcatcgcgttctcccggcgcatcctggaggtggaggtcaacagcgcgacggacaacccgctcgtgttcgcggacacggagcgcatcgtgtcgggcggcaacttccacggccagcccatctccctggccatggacgtggtggcgatggcgctgacgcaactgtcgtccatcagcgagcggcgcgtggagcagctcgtgaacccgtcgctgtccaacctgccggcgttcctggcgaagaactccgggttgaactccggcttcatgatcgcgcaggtgaccagcgccgcgctggtggccgagtcccgcgtgctgagccaccccgcgtccgtggattcgattccgtcatccgcgggccgagaggaccacgtgtccatgggcatgacggcggcgctcaagggccgtcaggtcagcgacttcgcccgttcgtgcctcgcgattgaaatcctggtggcggcgcaggccctggacttccgcctgccgctgaagcccggcaagggcgccctcgcggcgtacgagctggtgcgctcgaaggtcccccacatggacaaggaccgcgagctgcaccgggacatcgaggcggtgagccagctcgtcgactctggcgagctgctcgcggcggtgcgctccgccacggcctga

SEQ ID NO: 8004 - DNA, 1182 bp, Myxococcus xanthus
gtggcactcatcgtccagaagtacggcggtacctctgtaggtgacgtggcccgcatcaagagcgtggcgctgcgctgcctggccgcccaggaggcggggcatgacgtggtcgtcgtcgtgtccgccatgtccggcgagacgaaccggctgatgaaactggtggcgcaaatcaccgaccggccggacgagcgcgagcaggacgtggtcgtcgccaccggtgagcaggtctccatcggcctgctggccatggccatccacgcccagcaggggaaggcgaccagcttcctcggccaacaggtgcgcatcgtcaccgacagcaccttcgccaaagcgcgaatcaagagcatcgacgcgcagcccatccgcgccgcgctggcccggggccacatcgtcgtggtggcgggcttccagggcgtggacgagtccggcagcgtcaccacgctgggccgtggcggatccgacaccaccgccgtggccctggccgccgcgctgaacgcggacgcctgtgaaatctacacggacgtggacggcgtctacacctccgaccccaacatggttccgtccgcgcgcaagctggaccgcatcacctacgaggagatgctggagctggccagcgtgggcgccaaggtgttgcagatccgctcggtcgagttcgccatgaagtacaaagtgccgctgtgggtgaagtcgtccttcaccgatgaccccggcaccctcgtgtgtgaggaggacagttccatggaggatgtgctggtccgcggcgtcgcgtatgaccgcaacgaggcgaagatcacggtgtgcggtgtgccggacgtcgcgggcgccgcggcgaagatcttcggaccgctcgatgagaagcacatcgtggtggacctcatcgtgcagaacccgtccaaggacggacgcacggacgtgaccttcaccgtgggcaaggcggacttccttaccgcgcaggaagtggtgcggaaggtcgccgaggagattggcgcgtccggtatcgagacggacggggacatcgcgaaggtgtccatcgtgggtgtgggcatgcgcaatcactcgggtgtggcggcgcggatgttccgggcgctgtccgccgagggcatcaacatccagatgatctccacgtcggagatcaaggtgtcctgcgtggtccaggccaagtacacggagctggccgtgcgc

SEQ ID NO: 8005 - DNA, 816 bp, Myxococcus xanthus
gcggtgttccgcagcagggcgctggagagtctcctgggctgggtgggcttcagcccgttcctggtgacccccgggaactggcgggcgtggcacgtccaggcacaccacagcgcggcgaacgtcctggttcgagatccggacatcctgccgcgtcagagcgagtggcggacccagtggttcgcgaaggtgttccacgcgatgtccccgggctcgggctcgttgctgagcttcgtcagcttcagcttcttcttcaccgcccagggacaggccttcctctggcaccacagccggctgccgcagttcaagcatgtgcacatgcatcgaacgcgggagcgcgtcctcacggtgctcgtgatggtggggtggggcgcggtgggctggtggatggggcccatgggggcgctctatgcgctcatccttccgctcctcatcggcaacatcaccttgatgatctacatcgccaccaaccattggctgctggccgcgcacgaggagtcggacaaccccttcgtgaacacggccagcgtggcgacgcatccggtgatggactggctgcactacaacttcagccaccaccaggagcaccacatcttcccggccatgagcccgaagttcgcgccgctgcttcgcaagcacctgcgcgatctcaaccccgaagcgtcacaggtgtacccgcacctgcacgcgctccggatgctgtaccggcgcccggcgctctatgccgaggacggacagacgctcatggcaccggaggggacgcctgcgattgccacagaggacctgcgccgccaactcaaagagccaatcgtgctttga

SEQ ID NO: 8006 - DNA, 1044 bp, Myxococcus xanthus
atgaggctggggctcaaagcggacaacctgctggagcgcgtggcggactggttcaacctggccccacagccagtagcccatgccttcttcgggatgatggcgtcgcggacgctgatggccggcgtgcggctgggcgtctatgaagccctgacggacgggcccatgtcggcggagacgctggcggcgcggctgaagctgtccgaggagggcactcgcacgctgctggaggccctcatcgcgtgcgaggccgtggagcgtcagcgcggtggacgctaccggctggcccctcgcgccaggcgatggttggacccacgctcgccccgctacgtgggcgccttcctggagttcaactacgcgcagtgggactggtggaccgggctggagggcgtggtgcgcactggccaggcggtggacatccacggcttcgcgcccgacgacgcacgctggcgggactacatccacgccatgcaccagatggcgcggctggcggcgccggaggtcgtggcggccatccccctgccccggggtgcgaagcaggtgttggacctgggcggcgcgcacggctggttcgccgccgagctgtgcctgcgcaaccggggactgaaggccacggtgttggatttggaaggcagcgcccgcgtgggccgggaaatcatcgcctcggcggggctgagccacctcgtcacccaccgcgaaggcgacatcctcaccgcggagctgggcggcccgtacgacggggtgatgctcttccaggtgatgcaccacctgacccccgcccagaacgtggccctgctgcgacgggtgcgcgcctcactggcgccccgagggacgctggcggtgctggagtatctgcgcgagaacgccgacacgcccaccagtgcggcgccgttgattggcttgcactacttcctcacctctggcgcggctgcctatacgcccgccgaggtggaaggcttcctggacgacgcgggcttccgcatcgagaacagccgccccatccggcacctgcccttgcagacgctcctggtggcccgactggactga

SEQ ID NO: 8007 - DNA, 2004 bp, Myxococcus xanthus
atgctgtacgacggaggcctgtcccccgattggaaggacctcggctgggcgcagcgcgagctccccaagggcgcgccggcgcgcatgcgcctgttcaactacgccgggtggattctctaccggcccaagctggagggcaccttcggcgcgctgtcgttccggttcagcgctccagagtccttcggcgagttcctggaggtccgcctggacgctccgggcgccgccagcttcccacgcgtccccatcatccccgagctccaggtccgcaaggacggtgagtggtctgagattgtcatccccatggagcagctcaacccgcgcggccagccgttcgaccgcgtggtgctgcgcgcgtccaagagcgtgggccgtgaatgggtgctgttcgacaaggtgtcgctggtgccgctgccgcccgaactggccgccgcgctggccgcggggggcggacgcacgggccagggcagtggccgcgaagcgccgatgaccatcgactgcaccgcgccgagccaccgcatcagcccgctcatctacggcatcgccttcgacgggttgacggagaagcgcgacaagcaccagtacgaggtgggcgccaccacgcgccgctggggcggaaaccccacgtcccgctacaactggaagctgggcggcgcgtggaacaccgcgaacgactggttctaccagaacgtcgacatcggcctgagctacgacgacttcctggagtccaaccgcaagcacgggatgacgtccgcgctgacggtgcccatcctgggctgggtggccaaggacgcgaagtcggtgggcttccccgtgtcgcgcttcggctcgcagcagcaggaggacaatggctcgggcaacgggctcgcccgggatggcacgccgctgaagcccggcgcgccgacgctcaccagtaccgaggccccaccggagttcatcgccgagtggatccgcgccatccggaagaaggaccaggagcgagggcagcgcagcgtccagacgtacatcctggacaacgagcccatgctctggaactccacgcaccgcgacgtgcacccggagccgctgtcgtatgacgggttgctggagcgcacgattgcctacggcacggtggtgcggaaggaagacccggagggcctcatcgcgggcccggccgagtggggctggacgaactacctgtggtccgcggcggacttcgcgccggggaagatgccgcactccgaccggcgcgcgcacggcaacatgccgctgctgccctggtacctgcggcaactgcgcgagcacgagaagaagacgggcgtgcggctgctcgacatcgtggacctgcacttctatccacagacgaacgtcggtgtcggcctggagggcaacacggacccggccaccaacgcgcgccgcatccgctccacgcgcgggctgtgggaccccacgtacaaggacgagtcctggattggcgagcccatccggctgattccgcgcatgaaggagtgggtcgccgacaactacccgggcctgcgcatctccattggtgagtacaacttcggcgccttccggcacatgagcggcggcctggcccaggccgaggcgctgggccgcttcgcgcaggagaacatctactccgcctacttctggcagtaccccaccgagggctcgccggtgttctgggcgttccgcgcgttccggaacttcgacggcaaggggagccgcttccaggactggtgggtgcccgcgaaggccaccgagggcaccagcgtgttcgcctcgcgcgacgaggcgggcgggaagatggtggcggtggtgctcaacttcgacccggaccaggccgcccaggcgcagattcaactcaagggctgcgggacactcgacagcgtgcgcgtgctgggctactcgggcgcacctggggggttcaccgagcagactcccggtgcgaaggccgcgggttccctgacccagcggctgccgccctattccatgaccgtgctcgacctgacggtgaagaagccatga

SEQ ID NO: 8008 - DNA, 1383 bp, Myxococcus xanthus
gggacgctggtacgcacggacacgctgcacgagaacctgctcgtcctcttcaaacgcgcgccctggctgctgtttctggcgccgctgtgggtgctcaagggcaaggccttcttcaaggcggaagtggcccggcgcgccgccctggacgcagccagcctgccctaccacgaggagttcctgacatacctgcacgaggagaaggcccgaggacgccggctggtgctggccaccgcggcggaccggcgcatcgccgaagccgtggccgcgcacctgggtctcttctctgacgtcgtcgccagcgaagcgacggtgaacctgtccggcgagcgcaagctggcgaagctgaaggagctgctgggcaccttcgactatgcgggcaacgacgcggtggacctgcccttgtggcgtgaatgccgccgcatcgtcgtggtccacgcgccagccggagtgctgaaacaagcacaaggcctgggccgcgacgtccaccgcgtcttcgagcgcccagccacccgactccgcacctgggtgaaggcgctgcgcgtgcaccagtgggcgaagaacgcgctcgtgttcgtgccgctactggccgcccacaagggcaccgagccggacaagctgattcaggcactgctggcgtttacggccttcagcctgtgcgcctccagcgtgtacgtgctgaatgacctgctggacctggactccgaccggcgacacccgacgaagaagcagcgtccgttcgcggcgtgcacgctctcggtgagcactggcgtcatgctggcccccgtgctgctgctggctggcgccgcggtgtgcctgctgttgccgcccgccttctccgccctgctgggcacctactacgtgctgacgctggcctactcactgcggctgaagcaggtggtgatgttggacgtgctggtgctggccgggctgtacacggtgcgcatcttcggcggcgcgctcgcggtggacgtgcccacgtccagctggctgatgatgttcagcatgttcctcttcctctcgctcgcgctggtgaagcgactgagcgaggtccggcgcctgcggcagtccaatgagacgtccgcgcatggccgtggctacctggcccaggactacgagcagctcgccagcctgggcgcggtttcgggacaggtgtccgtgctggtgctggcgctctacatcacctccgatgaagtgacggcgctgtacggacacccagagcggctgtggctcatctgcccggtgatgctgtactgggtgggccgggtgtggctgctggctcaccgcgggctggtgaacgaggacccgctcgtcttcgccctgagggaccgggtgagctacgccgtggggctcgtgtgcgcgctggtgctatgggccgccacgtga

SEQ ID NO: 8009 - DNA, 1395 bp, Myxococcus xanthus
atgaagccacgggagtcctgggggcgttatccccaagtcgagcagcagacgcacgccctggtgtggcgcacggatgcgctgccccggaaggacggtagcctgctgccccacgggctggggcgcagctacggcgactcatgcctcaacgcggggggcacgctgctgctcacctcggggctcgaccgcttcatcgccttcgacccggccaccggcgtggtccgctgcgaaacgggcgtgtcgctggacacgattctgcgcctggccgctccgcgcggctggttcctgccggtgacaccgggcaccaagttcgtgacggtgggcggcgccatcgccaacgacgtgcacgggaagaaccaccaccggggtggcaccttcggccgctacgtgcggcgcttcgaattgctgcgctcggacggcagccgtcgggtgtgcgcgccggatgagaatccggactggtacggcgcgacgattggcggcctgggcctcaccgggctcgtcacgtgggccgaggtgcagctcacgcccatcagcaacccgtacgtgctccaggagacggtgcccttcgggaacctggatgggttcctcgacgtcgcccgcgcgtcggagaaggactacgagttcaccatggcgtgggtggactgcctggcccggggcaagaagctgggacgggggctcctgtaccggggcaacttcgcgccgccacagttcgacgggctgccgttggccaggagccacctgtcgcacggcgtggggctggcggtgcccatggacatgccggccttctgcctcaaccgcctgtcggtgtccgccttcaactggctctactaccaccggcagaacggcaagccgaagcagcggctgacgcactacgacccgttcttctacccgctggacgccatctacgcgtggaaccgcatctatggccggcgcggcttcctccagttccaatgcgtggtgccctactccaccgcgcgggacgcgctgaaggaaatcctggagcgcagctcgcgcggcggactgcccagcttcctctccgtgctgaagacgttcggtgacattccctcgccggggtggctgtccttcccgcgcgagggcgtgacgctggccatggacttcgcaaaccgcggcgagaagacgtggaagctggtggaggacctggaccaactgacgcggcaggcgggcggcgcggtgtacccggcgaaggacgcgcggatgagcccggagaacttcgcggcgtactttccgcagcgggagcgcttcatgcagtacgtggacccgtcgttctcctcgtcgttctggcggcgggtgaatccggtgtccctgcccttttccctggccgcggagcgaggcgagacggcatccccgccgccgcggtccctgcttgccatccgctga

SEQ ID NO: 8010 - DNA, 738 bp, Myxococcus xanthus
atgaagaaagtgctcgtcctcggcgccaccagcgccattgcccaggcgacggtgcggctcctggccgcgcgcggggcctcgctgtacctcactggccgcaacgcggcgaacctcgacgcggtgacgaaggacgccgccacgcgtggcgcggcgaaggtcgcgtcgcaggtggtggacctgaacgacttcgacacccacgaggcgctggtggaggccgcgtacacggcgctggacgggctggacggcgtggtgctggcgcacggcgtgctgggtgaccaggcggaggcgcagcgctcgtgggcggcgacggaggcggtgctgcgcaccaacttcctgagcgcggtgtcgctgctcacagtgctggccaaccgcttcgaggcgcagaaggccggcacgctggtggtgatttcgtcggtggcgggtgaccgcggccggcagagcaactacgtgtacggcgcgtcgaagggcgcgctcaacgtcttcctccagggcctgcgcaaccggctggcgaaatccaatgtcgcggtggtgacagtgaagccgggcttcgtcgacacgccgatgacggcgcacctgccgaagaacaagctgttcgcctcaccggagaaggtggcgcgcggactgctgagcgccgcggactcgaggaagaacgaagtctacgtgcccggcatctgggcgctcatcatgctcatcatccggacgattccggagaccgtgttcaagcgcatgaagctctga

SEQ ID NO: 8011 - DNA, 1356 bp, Myxococcus xanthus
atgagcgccacggccccactgtcctcggtccccgagccccagcctgcagcgtccgaagcgagcgtgacaccttccgcgcccgaagcctggagtctcgcgcggcggctggccttccgcttcgccttcgcctacctgggcctctatttcttcccgttccccttggacctcatccccgtcctgggtgacttcatcacctcgttccaggaggggctctggaaggccgtggtgccctgggtcggcaagcacgtgctgcggctgtccacggacatcaccatgatgcccaacggcagcggcgacaccacgttcgactacgtgcaggtgctgatgttcttcgtcgtcgccgtggcggtgacgggcgtctggtccgtcatcgaccggcgccgcaccgagtacgtgaaggcccacgacgtgctgcatacgaatgtccggtacgtgctcgcgatgagcatgctgtcctacgggctggccaagctcttcaagtcccagttccccttccccagccctgagcggctggtgcagccactgggggacttctctcccatggggctgctgtggaacttcatgggctactcgaagggctacaatgtcttcacgggcggcgcggagttcctgggcggctgcctgctgctcttccggcgcacaacgacgctgggcgcgctcgtcgtcgcgggcgtcatggtcaacgtggtggcgctcaacttcttctacgacgtccccgtcaaactctattcgtcccacctgctgctgatgtcgctgttcctggtgctgcccgatgcccggcggctgctcgacgtgctggtgctcaaccgtgccacgcagcctcgcccgctccagccgccgttcccaccttcgcgatggctgagtggcgccgggctcgtgatgaaggtcctggtggtgggcggcatcgcctacggatttgggagctcgcggctggagttcatccgcaagtacggggactccgcgccgcgtcccccattctacggctactacacggtcgactccttcacccaagacgggcagcacctggatgccacgtccggagacgcccggcggtggaaggcggtggccgtcagccgcttcggccggatgaacatcaagcacctggacgacaccgtgaagtccttcggactggaggaagacgcaccgaagaagacgctcaccctcatcgacggccaggacgacaccgcgaagaagttcgtgctcgcctacacacgctcggacgcgaaccaactcgtcctccagggcacgctccaggaggccgccatcgaggtccgcctcacgcgggtggatgagtccaagttcctcttgctcaaccggggcttcaactggattcaggagtaccccttcaaccgatga

SEQ ID NO: 8012 - DNA, 570 bp, Myxococcus xanthus
ctgcggcgcctggaggaggcgcaccatccgcgcttcatcgtgggcctgggcaacaaggcgctgctggacggcgagggcttccggcacgtggtggagctggactggtggaagtccacggaggtggcgccgggccgcacggtgacggcggtgccggcgcagcaccgctccaaccgcgggctcaccgacagcgcggcgacgctctgggcgggctacgtcctcgccacatccggcgggccggtcttcttcgcgggcgacacgggcttcggtccccacttcgcgatgatggccgagcgcttcggtcccatgcggctgtcggtgctgcccattggcgcctaccggcccaccgccttccgtccggtccacatggggccggtggaagccctccaggcgcacaaggtgctgcgctcggccacgtcggtggccatgcactacggcaccttcgcgctcgcgctggatggccaggacgaggcgaagtaccacctgctgtggctgctggcgcgcgagcccgtccggccgcgcttctgggccctgggcttcggcgagggccgcgacgtgcccgcgctggactga

SEQ ID NO: 8013 - DNA, 585 bp, Myxococcus xanthus
atgggctttccgcagaacgacctcgaacaacggttggccgtcatccgtcccgacgacacggtgcgcgggctcgtcttcaactcggtgttcaacctgacagagaagaagctgggtgtggaggcggccactcgcctgcgtgagcccttcttcaagcgctccccggtggacttcttctcctacccggccattgatgccctgcgcctcttgtacgcgacgtcggaagcgctcacgcccgtctacggctccatggaggacgcggtgcgggcctgcggggccgcggccgtcacgcacttcttccagtccacggtggggcagacgctcaaccggctcatcggcaagggcgaccccaagcggctcctctcccacgcacccaccgcgtactcgacgctggtgagctacggccggcgcgaattcgccgtgctgggagacaagcaggtgcgcctggccttccacggggacatgcagccggtgcagtaccacgagggcgtcttgaaggaggccctgagcgtcgtcggctgcaagagccgggtggtgggcacgcctcgcggcgtgacgggcgctgactacgtcatcacctgggagtag

SEQ ID NO: 8014 - DNA, 474 bp, Myxococcus xanthus
atgctggagcagctcatgcggtatttccagacgcgctcaccggaccggtggagagaagaactccagacattcctccgcagagcctttcccggccagtacgaagcgctggccaccctgctgcgcgaccgtctggactacgagaagtgggtaaaggacaacgacgcctacctgcgagggttggactcgaagcagcgccgtgccgccgtttgggacgcgcgcaaccgcctcttcgggaaggagacggcgcaacgcctctgggcttcggagctgaagcaccacgcgctggtggacgcgctccaggtgattgatgcgaggcaggacctgcccctctcggagaagctgtctgcctacaaggcgcggctgggagaggtctacggagacggggcaccagcgcagctctcccggcattcgcaggagacgatgaatcgcttcctggggctggcctccgtcccccgtgagctgacgggcattccc

SEQ ID NO: 8015 - DNA, 222 bp, Myxococcus xanthus
atggtggtggatgcgcccgcgggcaaggtggtgttgcgctggcgctgtcagcacgaggtgtccgcgcgccgcggcccgcgccagctcatgtaccggctgatgtacggccagcacttcggctggtacgggctggacgtcctgcactgggaagcaggacgtctgcgcgagaagcggacgtatgcccaggccgggctgcccctggtgcgacgtgggaggccttga

SEQ ID NO: 8016 - DNA, 2449 bp, Myxococcus xanthus
gacgacagcgggctcgggcacgacgcggccagcttgcgccgttccttcctcgaccacgtccgctattcgcgcggaaagaactacgagtcgtccaccccccatgaccgcttcatggcgctgtcgctcgcggtgcgtgacaggctggcagaccggtgggtgaagacgtcgcgcacgtattacgaaaaggacgtcaagcgcgcctattacctgtccgccgagtacctgctgggtcgggccctgggcaacaacctgctgaacctggggatgtacgaagcggcctccgagtcgatgcaggaggtgggagttgacctcaccaacctgctggagatggagccggacgcgggcctgggcaacggcggcctgggccgcctggccgcgtgtttcatggagtcgctggccacactggcctaccccggcatggggtacggcatccgctacgagttcggcatcttcacgcaggacatcgtcgacgggtaccaggtggagcgcgccgacgagtggctcaagttcggcaacccgtgggaaatcgtccggccggagaaggcggtgccggtgcgcttcttcgggcgcgtggagcaccaccagggcccggatggccgtcccgtggcgcgctgggtgggcggcaagacggtggtgggcgttccgtatgacacgcccatcgccggctaccacaacaacaccgtcaacacgctgcggctgtggcaggcgcgcgcctccgaggagttcgacctgctgctgttcaacgcgggcgactacgagcgctcggtggtggagaagaacgactcggaggtcatctccaaggtcctctaccccaacgacgcgttccaggccggcaaggagctgcggctcaagcagcagtacttcttcgtcgcgtgctccatcgcggacatcgtccggcgctatctgaagaaccacacggacttcaaggacttctcccgcaaggcagccatccagctcaacgacacgcacccggccattggcgtggcggagctgatgcgcgtgctggtggacgagaagcgcctgctctgggacgaggcgtggacgattacccaggagacgttcggctacaccaaccacacgctgctggccgaggcgatggagaagtggccggcgacgctcttcgagcggctgctgccccgccacctggaaatcatctacgaaatcaactcgcgcttcctgcggcaggtgcagattcgctacccgtacgaccaggagaagatgcagcggatgagcctggtggaggaaggggccgagaagaagattcgcatggcccacctcgccgtcgtcggcagccacagcgtcaacggcgtggccgcgctgcacaccgacctgctgcgccgggacgtgctgacggacttcgcgtccatgaacccggagcggttcaacaacaagacgaacggcgtgacgccgcgccgctggctggcatggtgcaacccccgcctgtccaagctgattacgtcccgcatcggcgagggctgggtcacggacctggacaagctgacgaagctggaggcgcacgcggagaacccgaagttccagcaaggccttccgtgaggtgaagcgcgccaacaaggaagacctggcccggcacatccgtgacttgcgctgggtgcagctcaatccggacgccatcttcgacgtgcagatcaagcgcctgcacgagtacaagcgccagctcctcaacgcgctgcacatcgtggcgctgtggatgaaggcgcgcagggatccgtccaccatcatccacccgcgggcgttcatcttcggcgccaaggcggcgccgggctaccacctggcgaaactgaccatccggctcatcaacggcatcgccgaggtggtgaacagcgacgcgggcaccacgggcctgcaggtcgtgttcgcccccaactaccgggtgagcctggccgagcgcatcatccccgccgcggacgtgtccgagcagatctccaccgcgggcatggaggcgtccggcaccggcaacatgaagctgatgctcaacggcgcgctgacgctgggcacgctggacggcgccaacgtggagattcgcgacgcggtgggcgacgagaacttcttcctcttcggcctcacggcggacgaggtgattgctcgcaagcgcgagggctaccgcccgcgcgacgagtacaaccagcaccaggagctgcgcgaggcgctggacctgatttccaccggcttcttctcgccggaggacaagcaccttttcaagccgctggtggacagcctcctcgaggaggaccgctacctcatgctggcggacttcccgtcgtacatggcgaagcaagaggacgtcgcgcacgcctacaaggacgaggacggctgggcgcgcaagtgcatcatcaacgtggcgcgcggcggcatcttctcctcggaccggaccatcaagcagtacgccgaggagatctggcgcatccagcagacgccggtggatccgtga

SEQ ID NO: 8017 - DNA, 537 bp, Myxococcus xanthus
atgattggctcgctcgtcacggatgcgctggaactggcgaaggccgccaatggcaactcggacgcgaagtccatcgccaaggtggtgctgaccagtgattcgtaccgcatcaccgcgctcaaccgcgcccgcgaggccgcgctggcctaccgcatccccctggtcaaccacgtactgcgcgtggcgcagacggcggtgatggggattgagattggcaaggacgtcacgctcggcaagggcgtgtacttcgtgcacagcctgggcgtcgtcatcggcggcgacgcgcgcattggcgaccgcgtgcgcttctacgggaacaacaccgtgggcaccgcgaaggacaacggctatcccgtcatcgaggatgacgtctggattggcgcgggggcccgcatcctgggaccggtgcgcatcggcgcgcgctcgcgcatcggcgccaacgcggtggtgctccaggacgtgccgccggacagcgtggccgtggggattcccgcccgcatcttcccgcgcaaggacacggacgaagtcgcgctctag

SEQ ID NO: 8018 - DNA, 1179 bp, Myxococcus xanthus
atgagaatcgctcccctgctctgcctggccgccgcgctgctggcttcgacgtccgaagccgcggtccgtcacgtcatcaagaaccgccgtatcgagccgcgccagacgctcgcgcaggcgctgcacgacgcgcaactcccggacgcgcaggtggccgccgtcatctccgcgctggagggcgtgttcgacttccgcaagtcgcgcgtgggcgaccagttgcggctcgtcatccgcgacggggagctggacttcttcgactaccgccagagcatggtggacgagtggcaggtccgccgcgacggcgagaagtacgtgggcagcaagcgcgccatcgaggtggagaagcaggtcgccgtggtggcgctggaaatccagtcgtcgctgtacgaggcggcggtggccgccggcgaggacccggccatcggcatggtgctggcggacgtgttcgcctgggacatcgacttctaccgtgacgtgcgcaagggcgacacggcgcgcgcgctggtggagaagttcgtctccaagggccgcctgctgcgctacggcgacgtgctggcggcgacgtacgcgggcggcctcgtgggcaataagaaggtgtaccgctacgtgctcccggacgggcagcccaactacttcaacgaggagggcgccagcgcgaagaagaccttcctcaagacgcccctgaagtacgccaacgtcaccagccgcttcggctcgcgcttccacccggtgctcaagtacctcaaggcccacaatggcgtggactacggcacccccatcggcacccccgtgtgggcggtggccgacggcacggtgacgcaggcgggctacgcgggcgccgccggcaacatggtggtcatccgccacgccaacggcttcgagacgcagtacatgcacctgtcgcgcttcggcgaaggcgtccgcgcgggcgcccgcgtgcggcagaagcaggtcatcgcctactccggcaacacaggccgctccaccgggccgcacctgcacttcgggctcaagcgcaacggccagtacaccaacccgctcaaccagcagttcccccgcgcggacccactgcccaaggagctgctgccggacttcctcgccaaggcgcaggagctgacggggcagatggaggcggtgtccgtggccgccgtcgccgggcaggccgcagcgatgccgtga

SEQ ID NO: 8019 - DNA, 1494 bp, Myxococcus xanthus
atgcccaagagcctcccccctcgcctcgcctcgctccgcgacgaaatccatggctacgccaaggagttcggcctggatttcttcgacacccactttgagatggtgtcctacgacgagatgaacatggtggccgcctacggcggctttcccacccgctatccccactggcgctggggcatggagtacgagcagctcgccaagggctacgagtacgggctgagtaaaatctacgagctcgtcatcaacaacgacccttgctacgcctacttgatggagagcaacccagaggtggaccagaagctcgtcatggcccacgtctacggtcactgcgacttcttcaagaacaacttctccttccggcacaccaaccgccggatgattgatgagatggccaaccacgccacgcgggtgaggcgctgggtggacaagattggcgtggagaaggtcgaggacttcatcgaccggacgctgagcctggagaacctcatcgaccagcacgcgccgcacatccggcgcaacccggacccgaagaaggccgaggacgagctcaaggccaacgagcgcgtggagggcttcaaggtggaccgcgaatacatgcgcggctacatcaacccgtccgagttcctcgactcacagcgcaagaaggtggaggacgagaagcagcgcgccaagaagttccccgagcgcccgcagcgcgacgtgctgctcttcctgctggaagaggcgccgctggaaccgtgggaggcggacatcctcgcgattctgcgcgacgaggcctactacttcgcgccccagggccagacgaagatcatgaacgaggggtgggccagctactggcactccaccatcatgacgcgccgggccctcaaggacgacgaaatcatcgactacgcggaccaccactccggcaccatggggacccgccctggcgccatcaacccgtacaagctcggcatcgagctgtggcgcgacatcgaggagcggtggaacaagggccgcttcggcaaggagtgggacgagtgcgatgatttgcgcgcgcgccgcgcctgggacaagaagctgggcgccggccgcgagaagatcttcgaggtccgcaagcactacaacgacatcaccttcatcgacacgttcctgacgcccgagttcgcgatggagcagaagctcttcgtgtacggcttcaacgacaagcgcaactcgtgggagatcctcgaccgcgagttcaagaaggtgaagaacaagctcctccagggactcaccaacttcggccagcccatcatcgaggtggtggacggcaacttcgagaaccgcagcgaactgctgctggcgcaccgccacgacggacaggacctcaagggcgactacgcccgcgagacgctgcgcaacctccagtccctgtggcgccggcccgtcaacatcctcacgcggtacgacaacaagggcgtcattctccgcttcgacgggcagagccactccgagcggaaggtggaactctga

SEQ ID NO: 8020 - DNA, 1008 bp, Myxococcus xanthus
tgggaagaagggaaggacgccatctccatccccatccccttcatcgacatcccccgcttcaagtacggacacaaggaacaggggggcgtcgggcagggtgacggcgacgtcggccaacagctcggccccggggcggtggagcccggcgagggcaagcaggccggccagggcgaaggcgaccacgccatggaggtggacgtcacgctcgacgagctcgcccagattctgggcgaggagctgcagctgcccaacatcgagcggcggcagaacgagcgcatcatcacccagaagatccgctacaccggcgtcaacaccaccggcccggagtcgctgcggcacttcaagcggaccttcaagcaggccctgcggcggcagattgccgctggcacgtatgacccggcgcggcccgtcatcatccccacgcgcgaggaccgccgctaccgcagctacaagctccaggacctgcccgaaacgaacgcggtcatcatctacatgatggacgtgtccggctccatgggtgacgagcagaaggagatcgtccgcatcgagagcttctggctcgatacgtggctgcgccaccaatacaagggcctggaggcgcgctacatcatccacgacgcggtggcgcgcgaggtggaccgcgacacgttcttccacacccgcgaatccggcgggacgatgatctccagcgcctacaagctcagccgggacatcatcctggcggactacccgaagagcgcgtggaacatctacccgttccacttcagcgacggggacaactggagcgcggacgacacgcggcagtgcattgaaatgctgcgcaacgacgtgctgcccaacgtcaaccagttcgcctacggccaggtggagtcgccctacggcagcggccagttcatcaaggatttgcgcgaggcggtgggggacacgcccaacgtcgcgctgagcgaaatcgcggacaaggacgccatctatgcgtccatcaaggacttcctcggcaagggccgctga

SEQ ID NO: 8021 - DNA, 123 bp, Myxococcus xanthus
atgtcgaagccggtggggaagcaggagtggttccggggcgtcgaagcgttccaggcgagtgggctgacgcagcaggagttctcgcggcagagcgggctgcggctgagcacgctgcagtcgtga

SEQ ID NO: 8022 - DNA, 108 bp, Myxococcus xanthus
atgcgcaagtcgatagattgcctcatggcgatgctgctggacggcatcgacgtggccgaggtgaggagccagcccgcctggacgcctcccgggcgtacgggcacctga

SEQ ID NO: 8023 - DNA, 843 bp, Myxococcus xanthus
gtggatgtgtccatcgcgaccaatcccagcactggggtgaagtacgacacgccgtaccgcaacttcgtgagcgactcagccaactacagattcaccacccaggccctgtccgaggcaggcattggcagcacggtgagccgcagcacgttcatcgaccatcagctcgtcaccaacgaactctgggccagctacgtccccaactcgacccaggtgatccgaccgagcatcacgggctaccgggacaacacgtccgaccactaccccatcatcagccgcttcaacttcggcaatgcgggaggcgggggaacggggacgggcgggacgcagtacaaggtgttcatcaacgagtacctgccgcagtcgcacaacaaaccgggcaccacgatgccggattatgaccagcagttcgtcgaactggtgaacacaggcaccacggcggtggacctgggtggctggaagattcacgacgccagctcctacgcgggcgaagacgacacgcggcacgtattcccggcggggacgatgattcagccgggcaagtcgtacgtcgtgtactcgggtccgacggcggtgcccacgggcgcgacgaacgccacggcggcctcgggaggcgggctgtacttcaaccggggcgtcaacacgggcagcagcggcgacaccgtgctcctggtgcggccggacaacaccgtgcaggacagcgcggggtatcaggacacggaggtgggcatctcctacaaccggagcccggacgggagctccaccgggacgtggatgccgcatacgcagctgtcagccggtgttgaggcttcgcctgggcggcgggtgaacggcacggcgttctga

SEQ ID NO: 8024 - DNA, 1035 bp, Myxococcus xanthus
atgaccgccagcgcgcgagacatcctccaggccctcctccagaaaaaggctcgcgcgcgggaccttcagcttcacggtgcggacctcactggcgccccactcgacggactgcgtggagacggcttggacctgggcactgccagcctgcgtggcgccagcttgcgcggttcgcggttctccgcatgctcgttcgagcgcgcggttctcgaggaagccgtgctggaaagtgcgacgctccggcagtgccggctcgacggcgccgacctgcgacgggcgcgactctccgaggcccgcatcgaggacagctccgcgcgcggcacagacctatcccaagccgacctgcgcaagacccggctctcggagacatcgttctcacgggccatcctccgcgaagccgtgctcgacggcgcggaaggcgtcggcgtggagctacgaggcgcggacctcacgggcgcgtcactcgtggacgtgcggctggacgaggcggactttcgcggcgccgacctgacgggtgccaacgtgtcaggcgggagcttccgccacgcggacttccgaggcgccatcgtggacggcgtgcagtggaccgggtgcgaccgcaccggcgcccgcttcgatgcggaggacgccaccctgccgcgctcccagcccagcgatacgggcatcccgcccagcgctcccgagaacttcgatgccccagcgatggccacctggctcggaaacctgatggagcacgcgctgcgctccgcgccaggcagcgtgcacggcgcagccacacgaggcccggagacacccgccgaattgttacagctcctcggctcgctgcagcaggacctcggcgcccgtggcgttgaactcccggacctgaccgctcgcgtccaaccgctgctctccgccctggaacagcgtggcgatgaaccgcccgaggaatggaaggccttgctcgaagcgctcacccccacgggaaccgaggggcgtgacgcgagcgccgaagacatcgtccgcgcgctgctcgccaggcttcagccacctcgatag

SEQ ID NO: 8025 - DNA, 279 bp, Myxococcus xanthus
atggcctgggtcatgttgcagcttcacacgcacaacgcgttgagcgcctctgacctgtcccccgtgggcgtctggcggccggacgagctggtgcaaatcgtcccggcggaaattcctcaggaagacatcttgcggatgtgggacgccttgcgacgcccttatcgcccttccgtcacgtacgtcgcccgcgtcgtctgcatcgacgtgcagggcaaacccgctggacggcccgtcgtcgcgcggcgcttcgacttcacggacgaggtgcccaggcgatga

SEQ ID NO: 8026 - DNA, 732 bp, Myxococcus xanthus
atgattctcgagcgcaccgagagccgcgccctggccgccatccgcttcctcgacgcggagacgcaacgccccctcacggagcccatcaccgtcgcggggcatggcctccgcttcactcgcaacgtccgcgggctgcacgtggtgacggacgcgccgggcttctccgactacgcggcgagcttcgatttgccgaacccgcttcccgccgcagccgccttcaccctggtggcgagcgaccccacacgccactatcttgcccggagcttcacgctcgaattgccacgagacgcgacggctccgcccacgggccagccgctcccgccagattccgtcttccgcccagtcgacgtcacgctctacccgtcgccgctgatgcgcccgtccgcacgcagtgccgtggtgcggctccgtgtcgtggacgcccacgacacgcccctgcccggcgcgctggtgtcgctcgcgctggccgacccggaaatcacgcgctggggccagtcgaacgagcggggtgacgcgctcatcctcgtgcccggcattcccatcgcggactggggcaatcccgaagcccccgtccacttcaccttcagcctggccgctgcctgggcggcattgccgcagcctccggaccccgacgcactctcccaggacttccaccccttgagcagcaccctcgacgtcgccgccggcgaagaggtcaccaccaccatcaagctcgattgggtcgagctctga

SEQ ID NO: 8027 - DNA, 2373 bp, Myxococcus xanthus
gtgcctgaatatctcgcacccggtgtctacgtcgaagagacgagtttccgagccaggtccatcgagggcgtcagcaccagcaccagcggcttcgcgggtccggcacgcaagggccctgtttccggccccccgtcgctggtgacgagcttccccgaattcgtccggctctttggcggcctcgcggacctggacctcaccggcacccaggagacgaccaactacctggcgcactcggtccgcgcctacttcaacgagggcggctcccgcctctacgtggctcgcgccttctcggggacgccggccaatgccaccgctggcgcggacgtcatccccaacgcggacgcgaacctgcgcgcacgcttcaccgcgaggttccccggccgtgcgggcaacgggagcatcagcgtccgggaagtgctcgcgcccgccacggtcggcgccatgcggcgcgcgcccacgggcagcctggtccggctgaatcagaccgccgcctcggccgcgcgcatcgtgggcaccctgcccccgcccttcaatgtccccgatggcaccacgctcacgctgacgttcgacgggaacaccgacgtcaccctcaccttctccgggcgaaatgccgaagccgcggcggcggcggagctcgacccttcgacgacattcctcgaagccaaccagacgctcaccgtcaccctgggcggacaggcgcagaccctcaccctgcccaccgatacgccgttgacgcccgcggaggtcgtggacactctcaaccggcagcttcggggtggttacgcccggctcagcggcgccgatgacgccgcgcccgtcggccgtctcctcctgggcaccgatgcccgcggtaccggggccatcatccaggtctcggccaacccgcagctcaagctcgctgcacagacggtcgacaacgcggcggacccgcagagcaacgtgagcgacctgggcgcggtgtccctcgcggacatccaggtactcctgggtgccaacgccacggcgtccgtcgatgacaacaagctcgtcatcagccacccgctccccggtgccagccattcgttggaggtggcctcggtgagctccagcgcgctgggcctggacgcggccacctcggagcccgggacggacggcacggcgggggtgacctggtggttgaagcaggcgaacggcacctggtccaacggcagtgacacgttgccgctgccgaacgacaccgcgtcgcagttccagcaactgcccgggaacagccagttcgtcacgctcaccgtcaccacgcaggacggtgacgggcaggagcggctgtatgaagggctgggcgtggaccgcgcccatccccgttacccgggccacgtgctcaccccttcgcccgccacgctctccgagcagatggagcggatgtacgcgttcgaggcgggcaacggcgtttccgcgttcgccctgcgcacggcgctggccgcgggccccttcacgctcaccggtggttccgacgggagcgagccaagcgcggcctcgtacgaagacgcgttcgagcggctgggcggcgtggaggacatctccatcatcgccgcgccgggctcctcggcgtatgcgtcggcgcaggccgtaaggctcgggctcatcagcgccgcggagcgacgccgtgcctatcgcatcgcggtgctggacacgccgcgcggatacgggccgcaggacgcgctggcacttcgcgcgcaggtggactcgaccaaggccgcgctctactacccctgggtcgtcgtcgccaacccgctggccgggtccgaggcggccgatgtccctcgtgaaatcgcgctgccgccgtccgccttcctgtgcggcatctacgcccgcagcgacatcgaacgcggcgtgttcaaggcgcccgcgaatgaagtggtccgtggcgcgctgcgcttcgagcaggacatccacttcgcgcagcaggagacgctcaacccacagggcatcaattgcctgcgcttcttcccgggacgcggctaccgcgtgtggggcgcgcgcaccgtcagctccgacccggaatggaagtacgtgaacgtgcggcgctacttcaacttcctggagcgctccgtggacgagggcacgcagtgggccgtgttcgagcccaatggcgagcgcctgtgggccaacatccgcgagacgattggcagcttcctggagaaccagtggcgcacgggcgcgttgctgggcgccgacccgaagcaggcgttcttcgtccggtgtgaccgcaccaccatggaccagaacgacctcgataacggccggctcgtctgcctcatcggcgtggcggtggtgaagcccgctgagttcgtcatcttccgcatcggccagaagacggcggatgcccggacctaa

SEQ ID NO: 8028 - DNA, 1002 bp, Myxococcus xanthus
tccgcgccccggctcagcgtcgtcatcgccacgtacaaccggctgcccctcatcacccggctgctgtggcagttggccgggcagacgctgccgcccgagcagttcgaggtcgtcgtggtggacgacggctccaaggagcccactcgcgagccgctgcaggccctggccctgccctacaccctgcgcgtggaggtgcagcagaacgcgggcgccgccgccgcccggcaccggggcgtcatggccgcccggggcgacgtggtgctcgtcacggatgacgacatgcaggtggccccggacttcctggagcggcacctggcgcaccatccggagggctcgcgaaccgtggtgctgggccgcatccggccggacccgtccattggcgacatgccgttgttcgagcgctggtacgcgtacctcaacaaccgcatggccgaggagctctccacgcccggtgcccgcgcccgcggcgtccacctgttcaccggcaacgtgtccttcccccgcgcggactacgtgggcgtgggcggcttcgacaagtcattgggacagtcggaggacgtggagttgggcgtgcggctggagaaggccggctgcgccttcgtcttcgcgcgtgacgcgtacgtactgcacggcagtgaccacgtgtccttcgagcgctggctgaagcgcgcgcaccgctacggcatgttcgacacgcaggtggcccggaagcacccggacgtgcgtgacgtcaatccgtggcggctgctcttccagaccaaccccctgacccgcccgctgctggccgccaccctggtggcgccggacgcgtcacgcgtgctgacgcgcgcggtgatgcacgccgccaacgccgcggacaagctgggcctggagaaggccgccttcgccggcacctccgtggtgtacgggatggagtatctgcgcggcgcgcgcggcgaggccggcggctggacgggcattgcccgcgaggtcgcccgctacctgcagggccggggggagtag

SEQ ID NO: 8029 - DNA, 456 bp, Myxococcus xanthus
atgcctacccgccccacgccctacggcgccttcaatttcgaaatcagcttcgacggcacgtccttcggtgggttctccgacgtgtccggactcagcaccgaagtcaccctctccgagtaccgcgagggcagcgacccggagaaccacgtgcgcaaggtgcccggcgccttcaagacgggcgacgtcaccctcaagcgtggcgtcgtcgactctcgggccatctggacgtgggtggaggacgtccgccgcaacgggccgctgggccgcaaggccgccgtcaccatccgcttgctcgacgaggcgcgcaaccccgtgcagtcctggaagctggtgaacgtcacgcccatgaagttcaccggccccacgctggccgccaagggtggcggagacgtggccatggaagagctcgtcctcgccgctgaaacggtgcggatgggcttcccggacgtggactga

SEQ ID NO: 8030 - DNA, 243 bp, Myxococcus xanthus
atgcggcgactgaccttcgaagtcacagaacgcgcggcgcccaccgcgcccgagcggatggacgttgccctcttcgtgggcttcgtccgccgtcgaccgggcacttccgtgcccgccgcgctgtcccgctacctgttcgagcaggggtggatgaccgcccccacgctccgcgtggaccccaacgatccgcaggccccgctcaccgacgtccccctgccttcgagagcttcgccgcttctttag

SEQ ID NO: 8031 - DNA, 972 bp, Myxococcus xanthus
gaggacatggacgggttccaggacgaggacggttgccccgacccggacaaggacaacgacggcgtgctggacggcaacgacaagtgcccgctcacccccggcgtgccggagaaccagggctgcccggccgaggcgcccaaggaccgcgacggcgacggcatcatcgactccgaggacaagtgccccgaccaggccgaggacaaggacggcttccaggacgaggacggctgccccgacctggacaatgacggcgacggcatcgtcgacacggccgacaagtgccccaacgaggccggccccatgcagaacctgggctgccccatcgtcgacaaggatggtgacggcatcctcgacgtggacgacaagtgcccggacgagcccgaggacaaggacggcttccaggacgaggacggctgccccgacctggacaatgacggcgacggtacgccggacgtccaggacaagtgcccgaacgaggccggcccgacggagaacggcggctgcccggacaaggacaccgacggtgacggcatcgtggaccggctggatgcgtgccccgaggagccgggcgtccaggaggagcgtggctgcgccaagcagtacaagatggtcgtcatcaagcgcgaccggattgaaatcaagaagcagatcctcttcagctccggctcgcacaaaatctacggcaagcagagcaccgcggtgctcgacgacgtggcgcaggccctgcgcgacgcgccgtggatcaagcgcatccgcatcgagggccacaccgactcgatgggcaacgacgcctccaacctgcggctgtcccagcgccgcgcggacgccgtcatggcgcagctcctccgccgcggcatcgacccgggccgcatccaggccgtgggctttggcgagacgcagcccattgcccccaacagcaccaagacgggccgcgcgatgaaccgccggaccgagttcaaggtggcggagtaa

SEQ ID NO: 8032 - DNA, 1062 bp, Myxococcus xanthus
atgcccagagtcctgctgctgcataccgggggtacgctcggaatggccggggggcgcccgtccgccctgaagcccgcggccttcttcaagacgctcaaggcccgcgtgccggagctgttcgagctggccgacatcgagttggagctgttcagcaacctggacagctcggagatgcagccggagctctggagccggatggccgcgcacctccacgcgcgcctgccccacttcgacggggccgtggtgacccatggcacggacacgctcgcctacaccgcgagcgccctctccttcatgttgcgcaacccgccctgccccgtggtgttgacgggttcgcagcggccgttgggcaagattcgctcagacgcgcggctcaacctcatcgacgcggtgctgtccgcgctgcacgggccccgcgaggtcaccatctgcttcgactcgcgcctgtaccgaggcaaccgggcgcgcaaggtgaaggtgtccgagtacgacgccttcgacagccccaacttccccgtgctgggcaccctgggcgtggacaccaccttcgagccgggcctcaagtcccgcggggccttccgcctctacgagcggttggacgccaaggtcttcctcctcaaggtgtacccggggctggaccccgcgctgccgctccagttgctaccgcacgtccggggactggtgctggaggcctacggggcaggtaacttccccatcgccccggaactggggcgctcgctgacgcccctcttcctccaggcgcgcgagcggggcgtccccgtggtggtggtgagccaggcgcaccggaatggcgtggacctttccttgtatgagtccggagcggcggcactggaggccggggcgatgggcggcgcggacatgacgccgtcggcggccctggtgaagctgatgcaggggctggcctaccactccggctcgtctggggccctggcgcgctacatccagaccccggtggccggagaattgaccgtcggaaggccgacagtcgctccggaggcccccgccggcccccccgccactcggcggccccgaggagagtag

SEQ ID NO: 8033 - DNA, 603 bp, Myxococcus xanthus
atgtccgaggagaaaacttccgtccattcgatttcggacctgctgggcagtgcccagcagcagagcgcctatctgatcgtcatcagcgccaagtccgcggcgggcatcgggcgcatgttcaagctggaccgctccgaggtcgtcctggggcgcagctccgaggcgcagttccaggtcgaggatgacggcatctcccgcaagcacgccaaggtggtggcgctgggagacggccggttccagttggtggacctggccagcacgaacgggacgtacctcaacggcctgaaggtcaacgccgccccgctctacgacggcgacaagatccagatcggctccaacaccgtcctcaagttctccatccaggacgcgctggaggagcagtaccagcgcagcatctatgagtccgccacgcgtgacggcctcacccgcgtctacaacaagaagtacttcctggagacggtccgcgacgtgcgggtgatgtccgtcatcatgaaccggcacgagacacgcgtcgacggggaggacctcaccaccggggagcgccgccacttccgcctggaccacatcacccgcgccgaggtgctgcgcgccgccggaccgtga

SEQ ID NO: 8034 - DNA, 996 bp, Myxococcus xanthus
cccggctgtgggggcgccttcaagctggttcccgaggacttcgaggtcgaggaggttcccgcctacctgccttccggcgagggcgagcacctctacctctgggtggagaagcggggccgtgacacgcgcgagctggtgcgcgcgctggccgcgtcactgggcgtgtccgaggatgacattggcgtggcggggatgaaggaccggcacgccatcacccggcagttggtgtccgtgcccgcgcgcgccgagccgaaggtgccggagttcgccttggacggcgtccaggtgctgtggacgaagcgccacggcaacaagctccgcaccgggcacctgcggggcaaccgcttccgcctgcgcctgcgcgacgtgaaggattccggcgcggcgcgggagacgttctcccggttggtggcgcagggcgtgcccaactacttcggcgagcagcgcttcggccgggcaggggacaacgccgacctgggccggctgctggtgctgggccagcggctgccgaagcggccggaccgtttccagcgcaagttgtacctgtccgccttccagtcgcgcctcttcaaccaggcgctggcggcgcggctgcacgcggggacgctggccaccgcgctcgccggcgacgtgctgcgcaaggaggagacgggcggcctcttcgtgtgcgagtcacccgaggtggacggcccccgcgtggcctccttcgaggtgagcccggcaggcccgctcttcgggccgaagatgacggcctccgccggagccgtggccgagctcgaggcgcggctgctggcggaagcgggcgtcacgccggaggacttcaagcgcggcggtggtgagacggaaggcagccgccgcccctaccgcgtccgcctgggctcgcccgagctgaccgcggagaagacggcggacggcgaggacctctggctcaccttcgagttgcctcggggcgcgtatgccaccgaggtcctccacgagctgctcaaggacggctga

SEQ ID NO: 8035 - DNA, 1239 bp, Myxococcus xanthus
atggcgacggcgcccgacctgctggtgttctcccgtacgcccgcggagggcggctccattccgctgccgcgcgtggtgcttgcgggggacgcgggcggcttcccgctgtcggacctcatcgccttcctcagccagtcgcgctggagcggcgtggtgcgcgtgcactcgccgggcggagagcgctccgtcaccctgcgcgagggtgaggtgcgcggcgcctcctccgacgacccagccgaccggctgggcgaggtgctggtgcggatgggctacgtggagcgcgcccaggtggaggcggcgctgcgtgagcaaccgccctccaaggtggggcgctcgctggtggagaaggggctgctcaagtcgcacgacctcttcaagtgcgtcacccaccaggtgagcgaaatcttccacgccatcgtcctgtgccgggaggggaccttcttcctcatcgaccagccggtggaggacaagtccggtcacatcatccaactgtccacgcagagcctgctgatggacagcatccggaagattgacgagatggcgcacttccggaagcgcatctcccacggccggctgtatgtgacgcgcaagcgcgcctcggacggcaagctggaggaggacgaggaccgggtgctgggcctgctcgacggccgacgcacgattctggagctggggcacgccgcgcgcctgtcggagttcgacgtcaccaaggtggtcttccgcctgctggagggcggattcgcctcggtgacggacaaaccgctgatggttcctggcccgggcgtcccgacgccgattccccagccgtccgaacgcacggcgcaggctccggcccgcgcgcccgcgcgcccggtggtgacggtggatccgcgcccggtggcccgcgtcttcaacttcatcttccgggagattcgcgacgaggtggccaagcagggcatggatcgcgagttcatcgccgcggccaacgcggccctctccggtcagggcctgtcgtcgtcgccggtgctggaagggctggccttcgctccggatggcagcctcccggagaacaagctcatcgagagcttcgagcgccaccgcgcgcagttgggcagtgagcccctggcgaccttcaggcaggcgctcagcgacatgatgttcttcctgctcttccaggccggtgagttgctggagtcacgcgcggacgaggacctggcccgccgcgtgaaggaactgctgtccacgctcgaggtatcgtga

SEQ ID NO: 8036 - DNA, 645 bp, Myxococcus xanthus
atggcgcagctggccgcgcggagggtgtccgagggcagcccggccaccgaggtcatcctctccctgtcgacgtactactccgccttccgcgacccgcgggcgcagttcaaggtggatgaccggatgtgcatgggcccggccggcgcgccggtgacggtggtggagttctccgacttcgagtgcccgtattgcgccaaggctcgcccggtgttggaggccttcgccaagaagcacgcgcagcaggtgcgcttctgctacctgccgttccccctgtccatgcacgccaacgcgaagccggccgcccaggcggcgctgtgggcgagggatcagggcaagttctggcagatgcacgacgccctcttcgagcaccagtccaacctcaagcccgatgcgattgccgccctggcgacgtcgctgggcctggatggcgcgaagctggcggcgctgctgaagacggacgcgtataaggaagagctggacggctaccgcagccaggggcgtgcggcgggcatcagcggcacgccctccgtgtacttcaacggacgtgcgctggacctgtccttcgtggaggcggagatgctgtcgcacagcctggaagacgagctggagtggtccgccaacaagaacgcctgggcggctgactga

SEQ ID NO: 8037 - DNA, 93 bp, Myxococcus xanthus
ttccgtaccctggccgaaggccagaaggtggagttcgagacccggaagggccccaagggcctccaggccgagaacgtccgcgtcgtcggctga

SEQ ID NO: 8038 - DNA, 1101 bp, Myxococcus xanthus
gagcgccggatgctggagcagcagggcgagctgcgcttccgccggctggtggacaccatgccccagttcgtctgggagctgctgctggacggcaccatcggctatgccaaccggggctggctggactacgcggggctgtcgccggagcaggggcggaagtggaaggacacgctgtactgcctgcacccggaggacgctcccagccttcggagcgcctggcaggaagcccagcgcgagggccacccgctggagcaggagtgccggctgcggcgggcggatggcgagtaccgctggttcctgacgcgcaccattccagagcgcgacgagcaggggcagctcgccggctgggtctccacggcgacggacatcgacgacgcgcgccgggcggtggagacgctgcgggcggccagtgaggcgaaggacatgttcctcaccatggcggcgcacgagctgcgcacgccgttgcaggccgcgcgggggtatgcgcacctggcctcggtgaaggcgggcgacacgctggcgccgggcgtggacaaggcgctgcacggcatccaccgcagcgtgaatcgcatggcgaagctggtggagaacctgctcgacgtggggcgcatccagcggggcgagctgcacctggagccgaagtcgctggacgtgggcgcgctgctgcgcgacgtggccgagcacttcgagccgctgcccgaaggccagcacatcgagctggacgcccccgagggactggtggtgccgggagaccgcgagcggctggaccaggtgttcaccaacctggtgtcgaacgcgctgcgctactcaccggagggcgggcgcatccggctcgccgcccgcgaggaggcggggcgcgtgcacgtggaggtggtggaccacgggctgggcatccccggcgagaagctggagaacatcttcgagcgtttcggccgcgcgcacgggatttcctacggcgggctgggcctggggctgtcgattgcgcggggcatcgtcgaacgccacggcgggcgcatctgggcggagtctcccggcagccagggcatgggcagcacctttcacgtcgtgcttccggtggagccgggcaagcccgcgccatga

SEQ ID NO: 8039 - DNA, 198 bp, Myxococcus xanthus
atgacccatccggccagcctgccgctggcgctggccgccgacggctgcctcctctgcgtcaccctgggcgagacggacttcggcgccgccagcaagaccctggagttcgtgggccgcgagcgcttcctcggcagcgtcacctttccccggctgacgaagaagcagcgccgggcggcgtcccagaagaagaaggcatga

SEQ ID NO: 8040 - DNA, 1320 bp, Myxococcus xanthus
atggagcccgaggccgagtcggtccacgaagacgagctgcgtgacgcgtggccggcgctgtcggcgcgagagcgggtggagggtttccacctgctgccgcccgagcgcgcgcgggacttcttcgccaccctgaatgctccagcgcaactggggctgctcgaggcgctctcgcccggggagcggggcacgtggctgcgggcgatggcgccggatgacgcggcggatgtcgtgcagcggctgtctcccgaggcgcgggaggcctggctggccctgctcgacgcgccgtccttgcgtgaggtgcgggcgctgctggcgtacggcgaggacgcagcgggtgggctgatgaacccgcgcttcgtccgcgtgcggccggagatgcgcatcgacgaggccctcagctacctgcgccggcaggcccgcgagcaggtggagaccgtctactacgcctatgtgctggacgaggcacagcgactcaagggcgtggtctccctgcgccagctcttccaggccacgccggacaaggcggtgcgggaggtgatgcgcacggagttgatccgcgtgcgggaggacacggaccaggaggaggtggggcgcctcttcgcccggtacggcctggcggccatccccgtggtggacgaccaggggctgatgaagggcatcgtcaccgtggatgacatcgtcagcgtggtgcaggcggaggccaccgaggacatccagaaggtgggtggcacggaggccctgggggcgccgtacctggaggtgggcctgcccgccatgctgaagaagcgcgcgggctggctgctggtgctcttcctgtcggagatgctcaccgccaccgccatgacgcgctaccaggatgagattgcccgcgcggtggtgctcagcctcttcgtgccgctcatcatctccgcgggaggcaacgccggcagtcaggcctccacgctggtcatccgcgcgttggcgttggcgcaggtgcgcctgcgggatgtggtccgcgtgctgcggcgggagctgctgtccggcctggcactggggttggtattgggctcggtgggtgtggcgcgcatcctgctctggcaggtgctgttccacctctacggcgagcacgccttcagggtggccctcacggtggggctggcggtgttgggcgtggtgacgtgggggacgctggcggggtcgatgctgccgttcctgctgcggcggctcggtttcgaccccgcgagcgcgtccgcgcccttcgtggccacgctggtggacgtcagcgggctggtcatctacttcaccacggcggagctcatcctccgtggcaccctgctgtag

SEQ ID NO: 8041 - DNA, 861 bp, Myxococcus xanthus
atggggccgctcaatggcggtctgccctggcccaagggctttggcggcgcgcggcggctggagaaggagtggctgagctacatccgtgacgtctacaagctgatgcccttctacaagtccacgcgggagaacgcgtccgccatcatcaccggctcgcgcgccacgcgggggcaggtgtcggggcagtggcagggcaagacggtgtacgtgccggagaacgccatcgacacccggcgcttcggcacggagaagtcggagggcccggtggagctgcccctgcgcgtggccttcgtgggccgcttcgtgccgtacaagggcatggccatgctgatggaggccgccgcgccgctcatccgcgagggcaaggtggtgctggagtacatcggtgacggtcaggagatggccaacctccgggcgcaggcggcgcgcgagggcatcgagtccggcgtcaccttcgccggctgggtgaagcaccaggaactccagggccggctggcgaagaaccacatcttcggcttccccagcgtgcgcgagttcggcggcgcggtggtgtgcgaggccatggcgctggggttggtgcccatcgtcatggactacggcggcccgggggaaatcgtgagcccggccaccggcttcgccatccagatggggacgccggaggaaatcgtcctgcgcgtgcgcgaggtgctgacgaagctggccgcggacccgtccgtcatccgccccatgggcgagcgcgcccgggagcgcatcttcaagtacttcacctggagggcgaaggcggagcaggtgctggaggtgtaccgctgggtgaagggcgagcgcggccagccggactggggtatgccgctggcggactga

SEQ ID NO: 8042 - DNA, 1584 bp, Myxococcus xanthus
atgtacgcacccgaccggccgccctacctgcgctacggcgcactgcttgctttcctggtgctggccaccgtgggcggcgccgtcatccaccccgtggtcgcgttggcccctgtgctgtgcgtgggggtggtgtgggtcatcctgaaggtgccggtgaagtacccggtgttggtggtgacctggctcgtcctggcggtggactacgtgccagaacggccccagtcgggcctgtggccctcgccgctccacccgctgggcgagctgatgttcgcgcagctcagctacatcaccaaaatcggggcgctgcgcttcccgctggtggacgtgctcatcctcgggttgatggggctggcgatgtaccggcgggtgacgaagtccaccatcgacccggagccgctgcccatgccccggccgctcatcgccgtggtggcgctgtccctggtcgccatcctctggatggaggtgcgcggcatcgcccggggcggggacatcaagaactcgctgtggcaatggcaccaggccgcgatgatgcccttcatcgtggcgatgtatcactacgccatgcggggcccggaggactggcccgccttcgcgaagaccatcatcctggcgggcctcaccaagtccgcggtgagcacctacttcgccatggtcgtggtgcacgagctgggcgtggaggtggagtacaccacgtcccactccgactcgatgacgttcgtcttcgccctgctggtggcgacgatgcgcttcatcgagaagcccaagtccgcgcacatgctgcgcggcctggccatcatcgccttcattggcattgggatgattttcaacgaccggcgcctggcctatgtcagcttcgccggctgcctgctggcggccttcctcatcaacccgtggacgccgctgaagcggttcctggtgcggacgctgccgttcttcgcgcccttcatcatcgtgtacatcgcggcggggtggaactccggctcgtccgtcttcgcgccggtgcagaccatccgctcgctgattgacggccagggcggcgaaggcaacctggactaccgcgacatcgagaacctggacatgattgcgacgtgggcccagttccccatcctgggcaccggctacgggcatgagttcctggagcccatcccactgccggacatcgccttcgtcttccctcagtaccgcttccacccgcacaactcactgctggggctgttcgcgttcggagggctgctgggctacacgggcgtgtggatgtacctggccgtcaccatctacctggtggtgcgctcgtatcaccgcaccgacgtctcggagtaccgcgccgccgcgctcatcatcgtgggactggtggccacgtacatcaaccaggtgttcggggacatgggcatcatctcgtacatctgcacgttccagatatcgctggccgtggccatgacggggaagctcgccgtgcacaccggcgcgtggcccatgccccacagccggctgctgggccccgcgcccgcggcgcccgtgccaccaccaggcgccatcacctaccccaacgaggacgccccatcctccgccgcgaacccgcgctga

SEQ ID NO: 8043 - DNA, 1302 bp, Myxococcus xanthus
tctcaagctttagagtccctggacgcgcggggctacgaggcggtggggcgcacctcgcccgaggaggcgctggccctcttcgagcgcgagtccttcgacctggtcatcaccgacgtggagatgccccgcatgcgcggcacggaggtgctggaggcgctgctgacgcgcaagccgggccagttggtggtgctcatcaccgccttcggcagcgtggagctggcggtggcggcggtgaaggccggcgcctgcgacttcgtcaccaagcccttcaacatcgacgcgctcgtcctcacgctggagcgcgccttccgagagcggcaactgcgccgcgaaatcgtgcgcctgcgcgcggccgtccccggcgacacgcccggcgggctggtggctcgcagctccgccatgcagaaggcgctggaggtgtcccgccgcgcggcgcgcagcgacgccaccgtgctgctcaccggcgagacaggcaccggcaagagcgccctggcgcgcttcatccacgaatccagcggccggcgcacccagcccttcctccagctcaactgcgcggccctgccctcggggctggcggagagcgagctgttcggcgccaggcgcggcgcctacaccgacgcgcgcgaggaccgggccggcgtcttcgtgtcggtcggcggcgggaccctcttcctggacgaagtgggcgagctgtcgctggaggtgcaggccaagctgctccaggccctggagacgggacgcgtgcggcccctgggctcgagcacggagacacccgtgcgcgcccgcgtgctggcggccaccaaccagccgttggaggtgctgctgcgtgaaggccgcttccgcgcggacctctactaccgcctcaacgtcatccgcatcgaggtgcccccactgcacgagcggcgcgaggacatcctgcccctagtggacttcttcctcgggcgcctggacgagcagcagcagcgcgaggtcctgggcgtgtccgccagcgcgctgaaacggctgctggcccacgcgtggcccggcaacgtgcgcgagctggccaacctgctggagcgcgcggtggccctggcggaccacgacacgctggtgccggaggacttcgacctgccgggcggcggcgaaagcggcctgacgtcgctgctcagccacgcctcgggagaagacgcgcccctggaagaggtggagcgcgcctatgtgcgccgggtggtggaggcgcagggtggcaacaaggccgccgccgcgcgcatcctgggcatcaaccggcgcacgctgtaccgcaagctggacctggacgagtga

SEQ ID NO: 8044 - DNA, 885 bp, Myxococcus xanthus
cactacgcggggagccggtaccagagcgaacgcccgatgaacgtgaccgcgatgaagggcatggcacgtcagtggccggacctgctctcgctgaccgagcagttccgcaaggccttcctcgcgcgcatgccgccccggaccccgggcgtgctcaccgcgggcgagctccacatgatggtcgtctgcacgctcgcgtcggtcgggtacgtgctggtgcggggcacccagccggtgccgaacggagagctcgacagcgggctcgcggccatgttccggctgatcgacggagttcgcctggtcaccaatgacctggtgcgcgacgcccccgagcagcccgtcaccgcgcaatcgatcgtggactatgccgagcgtcacgcggtcttccatggtccgcacggcgtgtgcgccgggccgccggcgctgatcaacgagtacatgcaggtgttgaccggctcggccccggcacccatcgaggcccagcccgacatcgcagcgcgcctcggcgatctcgacgccgcgctcgattacggcctgctcgggcagcgcgtcgaatcggtggtccgcttcctcggcgcgacccaggggctgctccacgaacggctccgggcggcgttcgccggacacctcccgcgcaccgggctgcaagagtgcgtggaggcgcccatcgatgtcgcgcattacccgttgctccgggacgatttcccgctcgccgagacataccagcgcgagatcaagctcagccgctggttgttcgcgcgcatcggcgaggcgttccccggcacgccacagggcacctcgctggacgagctggcgaagctggaccccaccgaacaggccacgagccagcggggactggccgagctcttcgcgcatgggctgccggga

SEQ ID NO: 8045 - DNA, 174 bp, Myxococcus xanthus
ctaaaggagctgtccgtacgcgcggagctgctggaacagggcggcgcaccgctctggaacgccttcatggaggagctgcaccacctgcatctcggctcgccgcggccggcgcgctcggtattcggcgagctgcaggccgcctacgagaaggcgctggtgaagcgctcccgctga

SEQ ID NO: 8046 - DNA, 687 bp, Myxococcus xanthus
atgcaccccgccctgcccctattgctcctggccctcacgggcgcagcgtccacccctaatgcccgaggactgaacacccagggcttccggctgtaccaggcggggcgctacccagaggccctggagcgcttccaggcgtccgcccgggagtccccggactatgcgctggcccactacaacctggccgccaccctggggatgctccgcaagcaggggaaggtctgcgagtacagcgcccaccgggacgtcatcgtcgagcacctcacccaggcggtgaagctggatgcccggcggctcacccgcgcgaaggaggacgcggacttcacccccatccgggacaccctgggctggcagaagctgctgggccgcagcccggcgagggaggcggatgtccccgtgctgctgcgcgaggtgtcctggttcggcccgggcgtgggcgtctacggcaccacccaggggctgcgcttcggcccctccggcagggtcaccctgtggacgaaggaggtgggcgacgacgggacgccccgccagaaggaaacgcggggccgctacacggtgcgaggcaggcaggtagcgcttcggttgaatggccgtgcgccgctggaaggcacgctgacggagtcgggcgcgctcaccttccccggcctggagacgttcaccgactcaccttcggaatgcgaggcgtaa

SEQ ID NO: 8047 - DNA, 693 bp, Myxococcus xanthus
atgagcgcccggcccttcatcgtcgccatcgacggccccgcgggcgccggcaagtcctcggtgtccaagcttctggcgcgccggctgggcttctcgctggtggacacgggcgccatctaccgctgcgtggccttgatggctcagcgtgagggcatcgccttcgacgacgacgcgggcctgggcgaactgctgggccgcgtgcacatccacttccaggtggtgggggaggagaaccacgtcttcctgggtggccaggacgtgtccggggagattcgcaccccagacatctccatggcggcgtcccaggtgtccggacggccggtcgtgcgcgcgggcctgctgcaactccagcgacggctggcgctggagtcggagaagggcgccatcctggagggccgtgacatcggcacggtggtgttcccggacgcggacgcgaagttcttcctggcggccagccccgaggtgcgcgcccggcgccgctacgaggagctgttccagaagggcgtggagagcagcctggatgccgtgctcgcggaccagacgaagcgggaccgcgacgactccgcccgcgccgtggcgccgctgaaggccgccgaggacgcggtgcacgtggattccagcaccatccccctgtcggatgtggtgcacgggatggagtctgaaatcctgcgccggatggcccagcgcgcctag

SEQ ID NO: 8048 - DNA, 1068 bp, Myxococcus xanthus
gttgagacgctcaagccgtacgtgcccggcaagcccattgaagagaccgagcgtgagttcggcctcaagggcgtcatcaagctggcctcgaacgaaaacccactggggccctccccgcgcgccgtggaggccatgcggaacgtctctggcgcgacgcacctgtaccccgacgccacgtccttccacctggtgcgcaagctggccgcgcacgtggacgtgaagccggagcaggtggtgctgggcagcggctccaacgaactcatcgagctgctcatccgcaccttcaccacgccggaggatgaaatcctcctgtgccagggctccttctccgcgtaccgcatctccgcgcaggcccatgggcggcccttcgtggagatgcccatgcgcgagggcttcctgtacgacctggaggccatggcgaaggccatcaccccgcgcacgcggatggtgttcctggccaacccggacaaccccacgggcaccgcgttcagccgcgacgccctgacgcgcttcctggccgcggtgccgccggaggtgctggtggtgcacgacgaggcctactgcgagttcgtcgagtggcccgagtacaccagcgccgtgccgctggtcggccagcacccgaacctggtggcgctgcgcaccttcagcaagattcacgggctggcgggcgtgcgcctgggctatggcatcatgaatgcccggctggcggcgtacctgcaccgcacgcgcatgcccttcaacctgacggtgctggcccaggccgcgggtctggcggccctggaggacaccgagcacgtgcgccgcacgcgtgaggtgaaccgcgcgggtctggactacttcgccgcggagttgccgatgctgggcggcacgctcacgcacagccacgccaacttcgtgttcgtggacttcggccgtcccgcagtggcgctgtacgagcagctgctgcgcaagggcatcatcgtccggcccttcgcggggcaggggttcccgaaccacgtgcgcatctccgtgggcacgcccgcggagaacgcgcgctgcgtccaggtgctgaaagagatcctgacatga

SEQ ID NO: 8049 - DNA, 969 bp, Myxococcus xanthus
atggcaaccggtaccagctatgtgctcgagttcgagcgccccctgattgagctggaaaagaagatcgacgagctcaaggtcctctccaccagcggcacggtggacttctcctcggagatctccaagctcgagaagaaggcgaagaagctccagacggagatcttcagcgacctgactcggtggcaggtggtgcagatgtcccggcacccgaaccgcccctacttcctcgactacgtccattacctcttcaccgacttcgtcgagctgtgcggtgaccgggcctttggtgaggacccgtccatcgtcggaggcttcgcgcgcttcgacggcaagccggtgatggtgatgggccaccagaagggccgcaacaccaaggagaacatggcgcgcaacttcggcatgccgcgcccggagggctaccgcaaggcccgccgcctcatggagctggccgagcgcttcgagaagcccatcctcaccttcgtcgacacgccgggcgcgtacccgggcatcggcgccgaggagcgagggcaggccgaggccatcgccgtcaacctggaggtcatgagccggctgcgcgtccccatcatctccacggtggtgggtgagggcggctccggtggcgcgctggccattggcgtgggcaaccgcgtgctgatgctccagaacagcgtctactccgtcatctccccggagggctgcgcctccatcctgttccgcgacgccgccaaggcggacaaggccgcggacgcgatgcggctcaccgcgaaggacctgctggagatgaagatcatcgacgaggccatcgccgagcccgctggtggcgcccaccgcgaccccgcgaagatggcggaggcgctgggcaagacgctgcgcaagcacctgggccagctcgccgagctgtcgcccgatgaactggtccaggaccggtacgcgaagtttcgcgcgctcggtgtgttctccggacgctga

SEQ ID NO: 8050 - DNA, 1485 bp, Myxococcus xanthus
ctcgtggccctgctccaggagtctggtgtcgtcgcgcttcaggtgtctggcacggacttcggcaatgcgcacctcgcctcgctggaaaacgcgacccagctcgaagccctgcacctcaatgccacccgagtcaccaacgtggggctggctcctctcaaacgaatgcgacgactggcagtgctgcggctggacgaaacgccggtctccgacgcaggccttgcgtcgctgtcagagcacaccaccctgcgtcgagtaaccctcgccggaacagccgtatccccccagggacttggattcctcgcgaggcaaccggggctggaggaactcgacctgtcagataccgcggtggacgacaccgtcctcgcagtgctgccgggcgccccgttgcacacgctcaacctcagcggaacgaaagtcacgaatgccggcctccgcggcctcagcgccatgccctcccttcggcggctgggcctcgcgcgtaccgctgcctcagacgccagcctcttgcacatcacgggactccgtgaactggaagccctccacctgggcagcactcaggtgacggacgccggcttgctccacctcgcgaaactgcccgcgcttcgtgcgctggttctcagcaaggcgcgaatccgaggcgcaggacttcgccacctcgcgggcctctctcgactggaagcgcttcacctcgacgacacgctcgtgggcgactcagcgctgcgccatcttcgaggactcaacgagctgagagagcttgacctctcgcgcaccgccatcacgggcacgggacttcaagaattgagcaccctggtggcgctcgaatcactctggctctcagggctcgcgctgacggacgattccctcacggcactcgctcccctcagccaactgacgcgactcgcgctcagccacacgccgattggcccggaggcgctgaaccacctgggttcccgcccactcctgcgacacctggacttgagcaagaccgggttcaccgacgaatgggtgccctccatacggcaggcctttcccggcctccattcattgaaagccgaacgcaccctcctcacggacgcggggctgggccagttcgccgaatggacagagctggaggcaatccatgtcgcggggactctcatcaatggctctggcctgacgcgcctgcacacccttgcccgactcacgacgctcgacctcggcgcgacgaggttggactcagagggccagaaagcgctccagggcttcacgaaactcgtctggctgagcgtcgccggcgtccgcaccggcgacgagatgcttggccacctcccccgttcgctccgaaccctctacctgacgcgcacgaaagtcaccgacgcgggcctcccggcgttgcacaagctgccacacctgcgggaactcgacctgcgcggaaccgcggtttccacagaggcccggagcgccctggcacgggagcgcggcatccacctcgtcactgggatgtga

SEQ ID NO: 8051 - DNA, 1854 bp, Myxococcus xanthus
  unsure (1)..(1854): unsure at all n locations
ctgctcgtgtcgttggatccggtccgctccctgtcggacctggtgaagaagaagctcccggccaaggcgaccaagctggtcccgggtaagggagacggcggcgtgtacggcctggaagtggagccggcggcgctgatgaagcccttcctggcctcctacctgccagcgctgtcgaaggccgcggcgaagggcacgcacgtgtcggaagacgacatgggcaagctgtaccagcaggccgtgccggggctggaggagttggtggcgctcttccacgtggtggacctgctggagggcgaggagttcgaccgcatcgtggtggacgccgcgccgaccagccacaccctgcggctgttcgacctgccgacgagcctgcgcaagttcctgggcctggtgaaggccggtggggacaagacggaggcgccgccgaagaagggcaagaaggcggcggccgcggccgaggcgcccggcttcctggagcaggtggggcagaaggcggagaagctgctggcgctgctgaaggaccccgcgcgcacggccttccacctggtggcgctggcggagccggtgcccgaggcgcagacgcgcatgctcttcacccagcttcgcgagcgcgggctgccggtgacggagatcgtcgtcaatcagatcgaggacaaggacggctgtcccgcgtgccagggccgtcgcggcctacaggccccccacgtccgcaagttccaggcactggacaagacggtgccggtgcacctgctgggccggcgtgaagtggcgccgcgcgggctggatggcctggcgctgttcgccaaggcgtgggccgctggcaaggagaccaaggcgctggagttcgccgcggccgaagggcctccggcgctggtgcgcgcgccgtccatgccgcccatcgccgcgccgccgctgccgcccacgcggctcatcttcttcgtggggcagggcggggtgggcaagagctcctgcgccgccgccgccgcggtgacgctgacggagaaggaggggccggtgctcctcatctccacggatccggcgcactcgctgtcggacgtgctgcagagccgcctgacggacacggagacgcaggtgaagggcaccaagggcctatacgctcgcgagctggacatcgccggctggttcaatgccctgcgcaagcgggtgaaggagaaggcggagaaggcgttcgagggcgcgccccggtcgggcagcgaggtgcccgcggatctgctctacctgcgcaaccttctggagtgcgcgccgccgggcatcgacgagctggccgcgctgtcctgtctgacggacgcgctggtgcaggagcgcttcaagcgcatcgtggtggactcggcgccggtggtgacgtccgtgcgcgtggtggaaatggcggagacggccaagacgtggctgggcgcgctgcacgcggtgctgaccaagcaccgcgccaagggcctggccgagctggcggacgacatcgccgggatgatcaagcacgtgaagcgcttcgaggacgcgctggcctccccgagcgaggcgcgcttcgtggtcgtcacgcgcggcgaggagctggccgcggcccgcaccgagcggctggtggagtacctgaaggagaagaagctccccgtggagcgggtgctcgtcaaccgcgtgggccccaagtccacctgcgacaagtgcgagagccggcgcaagctggagttcaacgcggcgaaggccatcgagaagaagctgggcctgcccgtgaccatggcgccggccctgggccgtcacccggcgggtctgcgcgagctgaaggccttccgcacggcgtggtacgcgctgtcgccgtcggccgccaagaccaaagcggnctga

SEQ ID NO: 8052 - DNA, 1440 bp, Myxococcus xanthus
  unsure (1)..(1440): unsure at all n locations
atcctggccgtggatgacgaacgcgacacgtgtgaggcgctggcggacatgctcagtgcctgggggcacaaggtcgagatcgcattcgacgggcatgacgcccttcgcaaggcgaacgagttccggccggacgtggtcttgtcggatctggccatgccggagacggatgggctctggttgctgcgcaacctgaaggaggagctgccggactgcccggtggtcttcctgacggggcgaggcaccattgacgccgcggtggagtccatccgcgagggcgcctacgacttcatcgtcaagccgctggataccgcgcggctcaaggtctgtatcgaccgggcgctggagaagaaagagacgatgcgcgaggtgcagacgctgcggcggcgtctgaagcagctcggctcgtcggacctgattgcccagtccgtgggcatgcgcaaggtcatcgagctggtggagaaggtggcgccctccaaggccagcgtgtccatcagcggcgagtccggcacgggcaaggaagtggtgtcccgcgcggtgcacaatctgtccttgcgccgcgacaagcccttcatcgccatcaactgcgcgtccatcccggccacgctcatcgagtccgagctgttcggccacgagcgcggcgccttcaccggcgctgatcagcggcggcccggcgtgttcgagatggcccacggcggcacgctcttcctggacgaattgggtgagatccccatcgagttgcaggccaagctcctgcgcgtgctggaagagggcaagctgcgccggctgggcggcaaggtggagatcgaggtggacgtgcgcgtgctctgcgccaccaaccgtgacctcaagcaggagatcaagaacgggcgcttccgcgaggatctctacttccgcctcaacgtcttccagatccacctgccgcccctgcgcgagcgccgcgatgacgtccccatcctggtgcagcacttcgtggacaagttccgcggcgactccggcaagcgcgtcagcggcgtgcacccggaggccatggaggtcctgaagaactacgactggccgggcaacatccgcgagctgcgcaacgcggtggagcgcgccgtcatcctgtgcgacggggagctgatcacccgcgagcacctgccgcccgacatggccggcaagagcccggagcgccacaccttccggctgcccttcgggctgagcctggacgcggtggagcgcgagtacatcctgggcagcctncagcggaacgggaacaacaaggcccgcaccgccgaggtgctgggggtgagcgagaagaccctgtacaacaagctcaaccgctacgcggccgaggcccgcgcgcaacaggcgcccggcggcggtggcggcggccccctgggcgggcaggggagtgacggcgcgatgggggccatgggcaccaactggttcgtcatccgctga

SEQ ID NO: 8053 - DNA, 339 bp, Myxococcus xanthus
tgggcgggctggggcactagggccgccaagcgccgcgtccaggtccagccgtcggtggagacgggcgtccagatccgtctgcagtacacgtcggaggtgggcttcttcctcatccagacgatgctgcgcgccttccgccgggcggagaatggcggctcgatccgcgtcacggtgcggggggacgagacgagcgcggtgctggaggtcgaggattcggccggcgcctgcccggagcccttgcccgaaaccgtggccgcgctgcaactgcgctgttcacagttgggcgttgacctgcacgtccgggcggggctgtgccgcctgagtttctcccgcgcctga

SEQ ID NO: 8054 - DNA, 885 bp, Myxococcus xanthus
atgagcagccagcgcgcgaaccagctcatcgaggcaggactgtggctgcgcctcagtggcgacgcccagggagcgcagcggctcttcgagcgcgcgctggagctggatccggccaacacccgcgcccgggagtacctggcggccgccgcgggcgcgccttcgcggggcacggcgacgccgttcgagcggcctccggagttggagccttcgctggggcggctggcgcccaccgacgcggacctgcccgtctcaccggcgctggaaggcgactggggcgcatgggcggaaggacagggcggcccctcggaggccggtggcaagtcgccgcccgcgcccgtcgtccttccggaggcgctggacggcgcgccggcggacgtgctggagctgctggcgcgtgacgtggtcatcgaattcgacgagcccgtcctccaggcgaagggggacaccgacgagtacggcatccccgcaggccacacccaggagttcgacctccccgtgatggagagcgagctggacctgctcctgcgcggggccgaggacctgctggaactggatgaccactccggcgcggtggacctgctcttcaaggcgaaggagctggcgccgtcggacatccgcgtggagtcgctgcgcgcgcgcagtgagcggatgctgatgggccggctggagtccaagctgggcgacctgggccgggtgcccgcggtgcgcctgcagccggacgacatcatctggctcaacctggaccaccgcgccggcttcgtgctggcgcagattgacggttcggtgagctacgaagacctcttctcgctgtcggggatgacgcggctggataccgcgcgcatcctcgtccagctcattgatgaaggcgtcatttccgcgggctga

SEQ ID NO: 8055 - DNA, 351 bp, Myxococcus xanthus
atgcagtcgaagcacgcccgggcggagagttcgctcaccgaccagcagaagaaggacgggcgctgcctgtcctgccactcgccggagcaggtcacccaggcgacggtgaatgtcacctgtgagacatgccacggcggtgggcagtactactcgcccgagtacgtgatgaaggactcggagctggcgcgcctggtgggcctggtggacccctctgagaagcagtgccgctcctgccacgacgcttcctcgccctccctccggccgttcgacttcaaggagtcgctcaaggccatcgaccactggtccgccgagcgcgcccgccgcgccgcggatccgtcggccaagaaatga

SEQ ID NO: 8056 - DNA, 618 bp, Myxococcus xanthus
atcaaggtcctcgacgcacgcttcgtcaccaccgccgtggagcccaagggctacccgacggaccacacggcggaggtggccttcgtcggccgctccaacgtgggcaaatcctccatgatcaacgcgctcaccggccgcaggaagctggtgcgcgtgtccaacacgccggggcgcacccggacgttgaacttcttcgacgtggacctggagcgcggcggcgtgcgccaccagatccgcctggccgacctgccgggctacggcttcgccaaggccagcaaggcggacaaggcccagtgggagaagatgatcaccacctacctggagaagcggcaccgcctggaggccgtggtcagcatcgtggacgtggaggtgggccccacgccggacgacctcaccacgctcgactatctccaggcgcacaaccgccgggtgctggtggtggccaccaaggtggaccggctcaccaaggccaggctcaagcctcggctggtggagctctccaagctgatggacctgccgctggaggtcatcctccctttctcctccacggagaagctgggcgtggatgaggtctggggcgcgctgctcgacaccttcggcaagtccgcccgcgtctga

SEQ ID NO: 8057 - DNA, 1702 bp, Myxococcus xanthus
  unsure (1)..(1702): unsure at all n locations
atgaggttgtccccgcgtcagcgggtggacgccctcctggatgtcgcggaggcccgcgcgctggtgcgctcgatgcccgccgaggacctctacgtcaccatccaggagctggggctcgcggattcgacggagctggtgcagctcgcctcgcccggccagttccgcgccttcgtggacctggccggctggcggcgggacgcgctggactcgcacgccgtcctcacctggctgcgcgccgcgcggggcggggtggaggacacgggggagttcctgcgcaagctgcacacgctggacctggaagtgctcgaaatcatcctgcgcgagttcatcgaggtgcacgacctggaagagaacccggacgtcaaccctccgggcgtgacgatggagaccccggaggggcgttacctcgtcgaaatcaaggtggagggcgtggagatgtccgccgtccgctcgctcctcaacgacctcatcgcggagaaccccttcgaggccgtgcgcctgctggaggccgtgcgctgggagattcccagtgagctggaggaggcggcgtaccagttccgacgcggccggctccaggacatgggcttcccgtccctggaggaggcggtgtccctgttcagccgcgtggacgtggcgcccgctcccgtggccgccacgcgcccggggctggcgcccaccacgggccacgtggactacctggaggcggccttccgcggcctgacgatggtggaggcggtgaacgcggaggacgaactgcgcgaggtggccagcgccgcgctggtggcggacctggcggacccgggggatttggacgccatccgccgcgcgagcgagacggtgcgggactacctgtccctggcgctcgagcacctgacgggagcggacctggagcgcgccacggacgtgctgcgcgacacgccgctgcggcgcatcttccagacgggcttctcgctcacgctccagctcaagtttcgcgcggaccggctggccaaggcgcctggcgccctggtggagggcgtgctgatggtgctcccggaggaggcggccgccatctccgcgctgcgccagaagcggccccggcgggcgcttcgcgtggaaggcgcggagccggtggcgttccgctcccggcgcgagctggccgccaccgaggcgctgctggcccgcgcggaggcccaggtgcaggtgttccgcggcgtgctgggcggcaccgacgattccacgcgcgaggccctggctcgcttcggcgtgcccctggagacgctgggccaggagcgcttgctggccgcggtggtggccatggcggtgctggaggagcgcgcggacgcgcgcccggttccgctggggcgggtggtggaactgggccagcgcctcttcgaaggtgccccggaagcgccgcgcctgcgcgcctccgctgccgagcgcgcccagaagggcctggagccggcggtggcgccggaggcgcatgcggagctgcgccgtctggtgatgctgaccctgtcgcggctgttggaggagctgggcacgccctggctccaggacgggcggctggagccggtggcctcggcggttcttccgatggagagcagcccgtcccgtaggaatttcagtccggggcggcccgcacgttcggcgaggccgccccgttctagaagattcagggtttngcccgcggggcccctggcatgtctctggttcgcccagg

SEQ ID NO: 8058 - DNA, 480 bp, Myxococcus xanthus
atggccctcgacaagcaattcatcggccgtgagtacggcccgtaccactacaccctgggcgaggagaagatgcgcgagttcacgctcgccgtcggcggcgcgaagccgggtgccggaacgccgggcgagcctcccgcgcacgtcagcccgctcctctacgacgcgcaggccgccaaggcggggcctcacgggggcctcatcgccttccccagcttcgccgtcgtcttcgccatccgccccttcagcgccgccatcgcggaccccgcgctgaacatcaacatgcagatgctggtgcacggcgaacaggacctggagttcctggacgtcatgcgcccaggcgacgtgatgacgaccaccggccgcatcgcggacctctacgagcgcgcccgaatgggcttcgtcatcgtcaccagtgagtcgcgcaaccagcacggcaccctggtggtgaagggcacgtggacggccatcatccgcggctag

SEQ ID NO: 8059 - DNA, 1143 bp, Myxococcus xanthus
atgagcgagacgcgcaagaaggccacggccggaacgtacttcatcaccggctacccgggattcatcggcaagcggctggtggaacacatcgcccgcgaggacccgaaggggcacatctacgcgctggtgcagcccaagtcgttcaaggaagcgcagcagcacgccgcccgcgtgaagggcgccaaggtggagctgctcaccggcgatgtggtggacatgcacctgggcctgtcgggcgaggagtaccagcgcctgtgcgagcgggtgacggacatcttccacctggcggcggtggcccagttgggcgtggccaaggagacggcctggcgggtgaacgtggacggcacccgcaacatgctggagctggctcgggactgcgggaagctcacgcgcttcaactacttctccacctgctacgtgtccggcgaccgcctgggcgtcatcgccgaggacgagctggaccggggccagggcttccgcaacgcctacgaagagacgaagttccaggcggagcggctggtgcagcgcgcggctgccaccgtgcccatcaccgtcttccgtccgtgcagcgtggggggcgactcccgcacgggggagatcgaccgcttcgaggggccctactacctgggcatcctcctggtcacctcgccgctggtggtgcccctgcccctgccgggcaatggcgtggcgccgctcaacgtggtgccggtggactacgtggtggaggcggtgtggcgcctgtcgaaggacccgcgcgcccagggcaacaccttccacctggtggaccccaacccgatgagcgcgcgccgcgtgtacgagctcatcgcggagaagtcgaacaagaagctgccgcgcttcaacctctccgcgcgcgcggcggacgtcatgctgcggctgccgctgctggagaagctggcccgcccccagcgcgccgccatcagctacgtcaaccacctggccatctacaactgccacaacacgctggagctgctggacggcaccggcgtgcggtgccctcccctatcatcctatctggatcagctcgtggcctacgtgcgggaccagtaccgcaagcgccgtgagggctcggacgaatacgacccgttggatcagggcacggcacccgacgcggagcgtccctga

SEQ ID NO: 8060 - DNA, 591 bp, Myxococcus xanthus
gtcttcggactgacgggaggcatcgcctccggcaagagcaccgtgacgcgcatcctgcgggagctgggcgcggaggtgctggacgcggacgtgattgcccgcgaggtggtggaaccgggcacgcccgggctggccgcggtggcggcgcgcttccccggcgtggtgggctcggacggccggctggaccgggtgaggctgggcgcacgcgtcttcggggaccccgcagagcgcgccgcgctcaatgacatcacccacccgctggtgcgtcaggccttcatggacaagctccaggcgctggaggaacggggcgtggcgcgcgtcatctacgacgtgcccctgctcatcgaaagcggcatgcacacctggatggaggccgtggcggtggtgtgggtgccccgcgcaatgcagaaggcccggctgatgtcgcgcgacgggctggactccgacgccgccgacgcccggctggctgcccagcttcccctggacgacaagcgcgcccatgccacctgggtcatcgacaacagtggggacctggcctccacccgcgcccaggttgaagcgatgtggcgcgccatgctcgcgcgcggctga

SEQ ID NO: 8061 - DNA, 387 bp, Myxococcus xanthus
atgaaaaacctgaccggcgtgctcgtcttttccgctgtcctcttcctggctcctggctgcacccgcaagtcgggcgaggccccgggccccaccgacgcctccgccgcgacggacgaagccgcgcgcacgggcgccagcaagggggccctgcgcgccgaggacgcgggctccggcagcacggctcgcgcggcccaggaggcctgcgtggactcgtggctccagaagcaggggctggacgcgtacggcaacccggagggcagcatgtacgcgggcggcacgccgctcttcaatgagcgcacgggtgagcagatcgatcggctggacttcatcttcaagaacaagcccgaagtccgccaggcgtgctcgggtgacgccgccgcggagtaa

SEQ ID NO: 8062 - DNA, 468 bp, Myxococcus xanthus
atgcgcatcctgaccgtcctcgccgtcctcaccttcgccgtccccgccgccgccaagccctggcagggcattgagccgggcgtgtcgaagcgcgacgaaatcatcaagaagttcggtgagccctcgcgtaccgtcaaacaggacggcaaggagatcatcgcctacctgtccaaggaggccatcaagggcaccacccaggctcagttcaaggtggatccggacacgcaaatggtggagcgcatcgacgtgttccccgggcccatcatcgacaaggagacggtggagaacagctacggcccctcctgcccctccggcgccgcgcccgccacgccctgctacctgcgcaagctgacggacgacttccgcacctactttctctacccccgcctgggcctggccatcttcttcaacgaggacggcaagacggttcagtcgttgacgttcaccacgcagaaggccgcgaagtaa

SEQ ID NO: 8063 - DNA, 558 bp, Myxococcus xanthus
atgaagaccgaacgccagaagatgctggacggggaactctacgacccgtttgacgcggagctcgtggcggcccgaaatcgcgcgcgggacctctgccaggtgctcaacgccacccgtgagggtgagcaggaggagcggcggcgcatccttcaagcattggtgggggtgggtggcgacacggtgtggatgcagccgcccttcttctgtgactatggctcgaacatcgagctgggccagcgcgtgttcttcaacttcaactgcatcgtgctggacgtgtgccgggtgagcatcggcgactacacactgttcgggcctggggtgcagatctacacgcccatgcacccgttcaacgcggagctgcggcggaaggaggagttcggcaagcccgtcacgatcggttcagacgtctgggtgggaggcggcgccatcatcctcccgggcgttcggatcggctcacgcgcggtcatcggcgcgggcagcatcgtcaccagggacgttccggatggcgtattcgcggccgggaacccctgccgcgtcatccgcgagattaccgagtaa

SEQ ID NO: 8064 - DNA, 153 bp, Myxococcus xanthus
atgctcactgccgcgctgggcaagggagtcctcgccggaatcttcgtgctgtccttcgaatcgcccgtgcgaggactcgttcagcgactcatcgaggcgacggttttcggctggatggtcctggtgggcgtgtggctggtggtcggggcctga

SEQ ID NO: 8065 - DNA, 420 bp, Myxococcus xanthus
atggcgttgctgcgagagctcggcccggatgagaatatccttgcatacgcgttcaacttccggactgccacgggggagctcaaccgggaccttgcgctggccaaccagctcaacaaggcaatttatgatcggcttagcatcgatccgggatcggacatctatggctatgacttgatcgtcagcacgacggatttgtctggcccgggttacggtcgtggcttcatcgagaactacaaggcccggctcggagtaggtggctcgccgggcgacaacatcacggtgctgcgttcggtgacgatggacccctgggttaccgaaacgaaggagggatcctttatcgacgtgttggaggttgagttccgcaaggtggtgtgtgcggctcttgaggaactcattcccactcgagacaggggctactga

SEQ ID NO: 8066 - DNA, 174 bp, Myxococcus xanthus
gcgcccggtgggtccagccccatcctccgcctcaagctgcagcacttcaagccggaggaactgtacgcgacgctcaccgcggcgaggttggtgccgcgcgagcgctacggccgcttcgacggcaagcccttcgacctggaggactcgcgccacatcggcatcgccggaacgtga

SEQ ID NO: 8067 - DNA, 477 bp, Myxococcus xanthus
atggtcctggccacggtgttggcctcgatgctcgcgcttccggcgtgtgaagaccgcgacgcccaggcgacctggacccaggcgtcgggctcggtggcgctcagccgggatgacgcctttctctacgtggtggactcggacaatggcgtcctcgccgtggtggacacggcgcgtcgtgaaaaggtgggcgaggtgaaggtgggcctccttcccgagcgcgtggcggtggggccggacgacaccgtctacgtctccaatcgcggctcgcgcagcgtgtccgtcatccgccggggggactggaacgaggcggcccgcatcgcggtggggggtggagcccgtgggcctgtcggtgtcgcccgccggggacacgctgtacgtggtgaacagcaccgcgctggcgacgtcgagccacggctcgttgatggcggtggacacacgctcgctgtcggtgcgctgggaattgccggtgggggatga

SEQ ID NO: 8068 - DNA, 1581 bp, Myxococcus xanthus
atggcggtggacacacgctcgctgtcggtgcgctgggaattgccggtgggggatgagccccggggcattgcgctggcgcagggcggcaagcgcgcgctcatcacccgctttcgccagggcgacctggtctccgtggacctgacggacgcggaccggccccgggtggtgcgtgagcagacggacctgtacgcgcgcgccaacgtccgggacaacgtggccgcgtccccgaacgggctgtcgccgcggcttccgcccgcggacatccgcttccagccgcgcagcatgtcgagcgtcgcggtgacgccggatggagagcgcgcgctggcgacggtgatgtgggcgcgggaggacccgttgtctccagacgggacgcccacggcgccgagcgggggctcgctctacggcggtggtgggccctgcaacacgggcggcgtggtggcgccagggctggtcaccttcgacacggacacgggctcgccccgggtggatgacctggaccggtgccgtccgccgccggacctgtcaccggacttcccgccctccaccatcatcagcccggagtcgacgcaccccatccaggggccggtggcggcggtggtggacccgacgggcctgtgggccttcgtggtgaaccgggagacggacaacgtcgccatcatccccacggggcgccgttcgggctcggacctgaggtcgggcctgggcagcacggtgcgccagttggtgcgcgtgggctccggccccaccggcatcgcgatgacgcgggatgggcgcaaggcctatgtctacaacgcgttcgaccacacagtgacgacgctggtgagcgacggcgcgggtggcaccgccaacatccgcacggacggcgcgccgctgcccatcgccggggacgtgctggcgcccaacgaggtggcgggccgcaagctgttcttcagcgcgctggactcgcgcatggccagtacgtcggtgggcgcgtcgtgcgcgagctgccatcccgatggccgcgaggacggccacgtctggggcttcccggacgggcctcgtcagacgcccagcctcgcgggccggagcatgacgaagacggggccgttccactggagcggcgagttctccaccatgcgggacttcctcgacgcgacggtgcgccaccgcatgggtgggacggtgctggacggcgtcatggtggcgcagctgtccgacttcatcgacgtgctgcccgcgccggacaacccgcacagggccgacgtcctcaccgacgcgcagacacgcggcgaggccgtgttccgcaaggccgcgtgtgacacctgccacggaggggcgcacttcaccctcaacacgcaggccgacgtgggcaccttcgtcacctcggggctgctccaggatgacccggtggtgcgcaagcaggggctcaacacgccgtcgctgttggggctggcccgcaccgcgccgtacctgcatgacggcagcgccgtgtcgctgaaggaccggctgatgcagggccgcgagtcgaaccggcacggcatgacggcgcatctcaccgacaccgaggtcgacgacctggtggagtacctgctcacgctgtag

SEQ ID NO: 8069 - DNA, 699 bp, Myxococcus xanthus
atgagcgacaagacgcggagcatcctggtcgtggaggacgacctgtccatcctcacgggcctgtccatgaacctgcgcttcgagggctacgaggtgctccaggcccaggatggccgcaccggcctggcgcgcgcgctggacgagtcgccagacctggtggtgctggacgtcatgctgccggagctcaatggcttcgaggtcctcaaggagctgcgccagcgcggccgggacacgcccgtcgtcgtgctctccgccaagggcatggagacggacaagattgtcggcctcaacctgggcgcggacgactacgtggtgaagccgttcggcctccaggagctgctggcccgaatcaaggccgtgctgcgccggcgctacccctccgcgggggcgggttcgccgccgccggtgaccttcggcgacgtgagcgtggacatggccgcccgcacggtggcacgcgcgaggacgccggtggagctcaccgcgcaggagttcaagctgctggcgcacttcctcgcgcaccctggacgcaccttcacccgcgaggagctgctgtccggcgcgtggggctaccactacgaaggcagcgcccgcaccgtggacaacttcatgcgccagctgcgcctgaagttcgagcccgacccggaagccccccgccacttcctcaccgtgcgcggactgggctaccgcttcgagcgctga

SEQ ID NO: 8070 - DNA, 945 bp, Myxococcus xanthus
atggggcggctggtgtccgaggtggcgcaggcgcgcgccagcgccctggggcccacggggctcgctgagcgcgtgctgtcctcgcccctccaggacttccggctggtggtgctgcccaccggcgaggacccggtggcgcgcgcgtccacgcgcaaccgcgtgctgtacggcgtgctgctgggcgtgttctacctgacgctcaccttcggcgtcgtctacaccggccgcgcgctctaccgtgaggcgcagctctcgcggatgaagacggacttcgtgtcgctggtgagccacgagctgcgcacacccctcacgtccatccgcatgttcatcgagaccctggccctggggcggctgaaggacccggcgcagacgcaggaggtgctcaccctgctgatgcgcgaaacggaacgcctgtccatcttcgtcgagcgcgtgctggactgggcgcgcatcgaaggcgggcgcaaggtgtaccagcgcgaaatcgtgccggtgtcggaactcgtgaacgcggcggtggaagccttccgaacccagcgcatggaggacggcgtggacctgacggtggaggtgtcagacggcttgcccgcgctggacgtggaccgggccgcggtggccggcgcgctgctcaacctgctgcagaatgcctacaagtacagtgggccggacaaccgccgcatcaccctccaggtccggggcagcggcaagggcgtggacctgacggtggaggacaacggcgtgggcatcgctccgcaggagcgcactcgcatcttcgagcgcttctatcgcgtggacaacctgctgacgcgcaggacggaaggcagcgggctggggctggccattacccggcgcatcatcgaaacccacggaggccgcatctccgtgcagagcgagccaggcaagggaagccggttcaccatccacctgccggcggggaaggcatga

SEQ ID NO: 8071 - DNA, 267 bp, Myxococcus xanthus
atggcccccaccctccaggccggcggcgtggaggtgcccgcgctgggccgtgccgcggtgcggcgcgcgcccgcccagggcatgtcccaggtgctggcctgggatgacgacacggactgcgcggtcgtcgtcacctggctgggcggtgagacggagcgggccgtggaggtggcgcgctcggcgctcatcgccaccaagcccgccgtgctcgacgcggggactcccggtgccccaaaagaggacgcgggagactccggcgagccctag

SEQ ID NO: 8072 - DNA, 447 bp, Myxococcus xanthus
atggccacatccgtctacaagaccgccatcatcggcagagtgttcttcctccgctgggaggcaccacccagtcaggaagaaatccacaccgtcttccagcagatgaagggcgcgcacgagcagcttcagcacccgctcgtcctcgtcgccagcctttcaccgaagtcctccgtgcccaattcggagcagcggcgcaacctgtccaccttccattcggacgcgcgcccgctcttcacggagattcacgccatcgtcgaaggcaatgacctgcaatacaacctgcagcgggtcatcatctccggcatcaacctggtgacgcgcaccttcgacgaggcctttcaccgcgtgcacaagcacgctgacctcgtcgctccctacctgggcaagagcctgggcgtggacggcgtgaaggtcatcgaggaggcccgggcgcgcggcgtggtgtga

SEQ ID NO: 8073 - DNA, 1284 bp, Myxococcus xanthus
atggattcccaactcgcattgagcgaggaaacgcctgccaacgacctgcgcgcccgggtgcggaaggtcctggagcgccgcaagctgacggacagcgtgtcggcggagcaggccgccgcctcgtgggagcaggaccgcttcgtggcacgggcccgcgcgctcttctacgcgcggatgatgttcctcacgctgggcctgctcatcctcgcggtgccggcctggagcggctacttcggcctcaccgggcccttctccttcgtgggctacttcgcgatgctgctctacagcgtcgccaacctcctggtcatcgaccaccccaaggccggccgctgggtgacgtacatcaccctctgcctggacgtgaccatcagcgtggtgctcatcgccaagccgcacgtcggcggcggtctccagagcccgctgctggccacgcagctgctcttcaccacgctcttcgccatcctctttcccaagccgctggcgatcctgccgccgctgctggcgctgcccatcaccacccggctggacctgctcctcaaccgctccgtgacggcggtggagctgctgaccctgctctggtacctggcgctcaacttcatcatcgtctacgtgctcgtgtacctgaacgagcgcgaggccgccgcgcaccgcgaggtcgtgtcgctccagggagacctcaaggagctcgcggtggtggaggagcgcaaccggatggcccgggagatccacgacggcctgggcgcgtccctgtcgtcgatgatcatccagtccgaatacatcctgaacctcgcgcgcgaggagggcctgcgcgaggagatccgcgaactgaagctcaccgcggaggagtccatcgaggagctgcggcgcagcctgcggatgatgcgcgaggacttcgagctggcgcagggcctggaggactacgcgaagacgttccgcgagcgcacgggcctggacatccgcttcgagcgcaccgggctccagcgcaagctggacccggacgtgcaactggcgctgttccgcatcctccaggagtcgctgtccaacgcggtgaagcacgcggaggccaagggcgtccaggtgcggctcgacttcagcgaggaccgtgtcaacctcgtcgtacgcgacgacggcaagggcttcgacccttcccggacgccgcgcggccactatggcctgttgaacatgcgcgagcgcgccatgaagctcggtggccagctcatcgtggactcgtcacccggcgctggcgcccaggtggcattctcccttccctgtcgcccgtcatga

SEQ ID NO: 8074 - DNA, 384 bp, Myxococcus xanthus
atgtctcactcgtactcgaaagtgttcggggcgctggtgctgttggggctcgctgtgtcctgccgggccaatcacgctcccaaggtctccacggggcctcggccttcgccgcaggtcgtcggggcggggggcgtggtgtccttcgtcttcgaggtcgaagacccggacggggacgccatgaccttccaatggcagcagctccccgcggagcccgcgggcaccttcagcgacgcgaatgcgcgcaaccccacgtgggtggcgccggaagtgtcggagacgacgaccttcgccatcatggtcaccgtggaggacagcgagggcgatggcatcctggcccaggggccgtgcgccatcttccactcggcgggatcccaggcgtattga

SEQ ID NO: 8075 - DNA, 180 bp, Myxococcus xanthus
atggtgctgctgattccctgctacatgctcttctacgccttcagccagttcgagcaccggcgcaagggcctcatcgtcgcgggcttcatggccagcaccgtgctggccgccgtgttcctgggactgggcctgcacagcctttcggcgctggcctcgcgctctccgccctcgggcttctga

SEQ ID NO: 8076 - DNA, 528 bp, Myxococcus xanthus
ccgcacgtcggaatctccctgggggacgtgtcgggcatcgggccggaggtgacggccgcggccctgacgaagccctccgtgcgcaaggtgctcgtccccgtcatcttcggggacgggcccacgctggcgcgcttccccgccttccgccgctatgcccgcgtggagccctccgccctgggccgcgtggaaggccccaccgtggtggaggtaacgcggctcgcggagaaggaccgcgtgcccggagagccctcgcgcgagggcggccgcgcgcaatacgccttcgtgacggcggccatcgacgcgatgcgggccggacacgtggacgcgctgtgcaccgcgcccgtgtcgaaggagcagatttcccgcgcgggcatccccttcatgggtcacaccgaagtgctggcggaggccttcggcgtggacgtgatgatgttgatggatgggcctcgcgtgcgcgtggcgctcgccaccaaccacgttcccctggcggacctgccgcgcctgctcaccgtggacggactgaccttt

SEQ ID NO: 8077 - DNA, 2032 bp, Myxococcus xanthus
atgcgcttttctcccacccgcgccttcctggtcccactcgccatcgccctggccgcgggggtgggcatgcccgcctgcaccaagcccgtgatggagacgccggaggccctggtggtcgccagcgtcaacggcgaggtgctcagccgggcggacttcgaacaggagctgtggcgcgagctggcgctgacggacgtgtcccagcgcaccttggaggacgtggagcccttcaagcgcgcgctcctcgatacgtacatccaccggatgctgctgctgcaggaggcgcgcaagcacaacgtcaccgtcaccccggaggaggtggaccggggggtgctgcggctgtccggggactatccggcgggcaacttcaacgaggtcctggcccaggggcagctctccatggcggagctgcgctcgcgggaagcaagccggctgaccatcgaaaagctgttcgccagccacgtctattcgcgcgtggcggtgacggaagaagaactgcgggcctggtacggcgcgcacgagaaggacttccacgagcccgagcaggtccacgccgcgcaaatcgtggtgaagggcctggacgaggcacggcggctgcaaacccagctcaagtccggcaagaagttcgcagacctggcgcgcaggtattcgctcagcgcggacgccaaggtgggaggcgacctggggttcttcccccgggggcagatgccgcccgccttcgacgaagtggtattcaagctgggggtggggcaggtttcggacgtggtgtccaccgagtacggcttccacctgttccgcgtgctggagcgcaagccggcgcgcaagcgggagttcgtggaagtccgttcgctggtggagggcaagctgctggagcagaagcggtcgcaggcgcaggagacgttcgaacaggagctgcggcagaaggcccaggtccaggtgaacgaggccacgttgcaggccatccgcgggcgtccgacgcctcagcaggcgacggcggagtgacgacgaaatcgaagaccggggcggcggttggacgcgcccggggcggtacggaaggatggcgggaatgaagaagctggtggcggcaatcgcggcggtggcgctcctggggagcggcggcgcggcgcacgcggagctggtggacaaagtggccgcggtggtgaatcgcgacatcatcgcgctgtccgaggtgcagcagcgcgcggcgccagagatggcccgcgtcaacgacccggacccgcgcaagcgcggcgagcagcggctgcagctgatgaagacggccctggacaccctcatcggcgagaagctgatggagtccgaaatcgcgcagctgggcatcaccgccagcgaggcggaggtggatgagctggtggcggacgtgcgccagcagaacaacatcaccgaccccgcgcagttcgagcagctcctgctgggtgaaggcctcaccatggccacctaccgggacatgatgcgcaagcgcatcctgcgtgaccgcctgctgcgcatgaaggtgggcccccaggtgaagattaccgaggaggacctcaaggccgcgtacacgcagtacacgcgcatggagagcggtgactcggaggtccacgcgcgccacatcctggtgcaggtggacgccaaggccacggcggagcaggtggaagccgccaagaagcgggcggaggccatcgccacggaagcgcgccggccgggcatggacttcgcctcgctggcccgcgcccgcagcgaaggccccagcgccgcggacggcggtgacctgggctggttcaagcggggcgtcatggttccagccttcgagaaggccgcgttcggcctccccgagggcggcgtcagtgagccggtacgcaccaacttcggctggcacgtgctgaaggtggaggagcgccgcacggtggccgccgcgtcctacgaggagatgcgccccaagctggagggcaagctgctccaggagaagacggagaagttcctcgaccagtacgtgcaggaactgcggcagaaggccaacgtcgacgtgaagctgtag

SEQ ID NO: 8078 - DNA, 864 bp, Myxococcus xanthus
cccgtcatcctctgccacgggttgggggccaaccgcttccacatggacttcgacgagcagtacagcctggcccgctacctggcccggtccggcttcgaaacgtgggtgctggagctgcggggccgggggctggcgggcgactgcccggatttcaacttcgatgaccaggccgagcatgacgtgcgcacggcggtgcgtaccgtcttgtccacaggtgcgaaggaagtgctctgggttggtcattccaagggcgggctgatgctctatgcccacctggcgaagacgccgcaggcgcccgtgcgggcggccgtcaccctgggcagtcccttcaccttcgcggtgcagccgggcctgcgcaccttcatccagaaggtggagccggtgctgaagctgcgggtcatccccaccagccgcgtcaccagcatcgccctgttcggcgcgccgccggggcccatgagccgctacatgatgctggcggagaacatggagacggaggtggtgcggcgcgcgctggccaacgtgcccgccgacatcgccggcggcgtggggcgccagttcgcgcggtggatcaccaccaaccgcttcacgtcctacaacggcgagttcgactaccgcgagtccctgtcccgggtgaccatccccttcctgctgctggcgggcagcaaggacctgctggccccacccatggcggtggcgcgcgccaaggagtacctgggcgggccggtgaaggtcctggtcgccggcaaggcccacggcttcggggcggactacgggcacgcggacctggtcctgggccgccgggccccggacgaaatcttccccctggtggaggcgttcctctccgcacacgcgacgcagccgtag

SEQ ID NO: 8079 - DNA, 315 bp, Myxococcus xanthus
atgaacgccgccaagacgctgctcaacttcatcctcgcgggcgccctgctgggcttcgtggtcgcctcctggctggggcccaactacctgggctggtacaacgagacgccctacgccacccagacgatgtgcaacctgcccgaggtcgtccgcaagacgtccgcggacctgatttcgtaccaggtcatcggtgggggcgtgggcgccggcctcttcctcatcctgggcgtggtcgtcgagaaccgatcacaccggaaggcccgggtgcagacgtcccaagcgcccccccctcaggagccacgcgcccccgcttga

SEQ ID NO: 8080 - DNA, 645 bp, Myxococcus xanthus
gactccgtggtggtgaaggaaatctacctcagcgtccagggggagtcctcccacgccggactgctgtgcgccttcatccgcctcacgggctgccacctgcgctgcacctactgcgacagcgagttcgccttccacggcggcgcgcgccggaaaatcgcggacatcgtcagcgaggtgcggggcctgcgcacgcccatggtggaggtcaccggcggcgagcccctgctccagcccggcgtctacccgctgatggaggcgctgctcgacgccggcttcaaggtgctgctggagacgagcggcgccatcgacgtgcggctggtgcctccggcggtgcacaaaatcgtcgacatgaagacgccctcctcgggcgagcacctgcgcaacgactaccgcaacttcacgtcgatgaacgccaacgacgagctgaagttcgtcatcggctcgcgcgaggactacgactgggccaaggcgctcatcgccgagcaccaactgctccagaagccctacggcagcctgttctccaccgtgttcgacaagctccacccgcgcgagctcgccgaatgggtcatcgaggacaggctcgccgtgcgcttccaactgcagatgcacaagtacatgtgggacccgaacgcgcgcggcgtgtga

SEQ ID NO: 8081 - DNA, 816 bp, Myxococcus xanthus
ttcgtccccgaccacatcccgcccgaccggccccgcgagggcgccctgctcttcctcgcccggggcatggacgtgctcgtccaggagcatgcggacggcgtcgccattcccaccggcgcggccttcccggagctcgccgccgccgcgcactacctgggagcgctggacggcgtggactgctacgcggcggggttcgccaaggacttcgtcccgccagagcgctacaaggccgtcgccgcccgctcgctctacaagcgcgtggatgacgcccgcttcgccgtggcgggccgcgcgctcgcgattgtcgagtgggacctcacccaccgcttctgcggccgctgcggcgaacccaccctgttggttccgggtgagcgcgcccgccgctgcccggtggacaagacgcccttctatccccgcatcgcccccgccatcatcgtcctcatcacccgcggcgacacgatgctgctggcgcacaacgcccaatttccagagcccatgttcagcacactcgccggcttcgcggagccgggcgagtcgctggaggagtgcgtggcgcgcgaggtgaaggaggaagtcggcatcgacgtgaagaacatccgctacttcggctcacagccgtggcccttcggccgctcgctgatggtgggcttcaccgccgagtacgcgggcggcgacatcaccgtggaccagaaggaaatctccgaggcccactggttcagcccggacaacctgccgcgcatccccccgaagctcagcatcgcccggcagctcatcgacaccttcatcgagcgcgtgaagggccccaccgccccttga

SEQ ID NO: 8082 - DNA, 1554 bp, Myxococcus xanthus
cccctgggcggcatcgccgcctcgtacatgaacttcagcgtgggcttcttcgtcggcggccaggtgctggccggcatcctcggcagcgccgtcacctacgggtacggcgcggagggcaagcacggcgccaactacatgcagacgatggccgcatcagtggcctcgctgtgcgccatgtccgtgctcatccagtccatggtgtggctgggcatggagatgcccgcggcctggcagctcatgctcttcgtcggctgcgtgggcatgttcgccgtgggcgtgggcatgctctacacgccgctgctcgtggacaagctccagctcgactatccgtccgggctggcggtggccaacatcctgcgcgccctcacggacaagcgcctgctcaaggcgtccatctccaagctgggcggcggcaccctgctgggcgccctggcggcgtggatgacggagaaggtggccttcgtctcctccatcggcaccagcgcggcgacgctgggcgcgggcatgattgtcggcagtcgcatcaccgtccccgccatcgtgatggccgtcatcggcgcggtgctggtgcccaccctccgcgagatagggtggctcggccctcaggatccgttccgcaaaatcggcttcgtcatcggcctggggatgatttgcggcgcggccgtggtggacctgtcgctgctggcggtccaggcggcgaagcgcatccgcgagcgggcctcggcgaaagacgaagaggaggagtcctggaagaaggtcaacatcccccggctgctggcctgggtgggtgtctggggcggcgcgacgctggtggtgggcacgcaggtgctgaatcagcctgtcggctggctcctcttcggcatgctgctcgccctgctgttcgtgctcatcaacggcatctcgttcggaatcaccgaccagaaccccatctccagcgccttcgtcatctccgtgctgatgatgtccatgatgggcctgcgcgttccgctggtgggcatgatggccgccaccatcctgctcatctccacctcggtgggctgcgacatgcagcaggaccgctccaccggctggcgcctgggcaccaaccgcgtcacccagttccgctatcaggtgctgggcgtcaccatgggcgcgctgctgtgcgtgggcctggcgcgcgtgttcatgaccgcctacccggcgctcaccatcaaccagctcgacaaccccaacgccgaattgtggccagtggggctccgcgatgacgtacaagctggtgggcgccatccgcgacctcggctcgctgtcgcaggccgtcgtgaatgccctgctcctcggattggccatcggcttcatctacgaactgctgcgcaaggtggtgcgaggcaacgcgcgctaccagcagtacgtgaagggttcccgaaagggcttcgccgtcggctggacggtggacgccatcctgcttcccagtccctacgcgtcgtcgttcggcggcttcgtggcgttcccggtgtcgctgtggttcggcgcgggcggcatcgtgacgtccgtctggaacacgttctccaagcgtga

SEQ ID NO: 8083 - DNA, 741 bp, Myxococcus xanthus
atgaccggagctcccgtggacgccccgcagcctcctgattcgccgcccattcgcgtcttcgtggtcgaggatcaaacgaagatcctcaagaaccagctccgcctcttcgagaaccacccggagatggacatcatcggcaccgcgctctccggtgaagccgcgctggaggaagtgcccaagctgatgccggacgtgctgctgctcgacctgggcctgccccgcatgaccggcatcgacgtgacgcgcgaggtgaaggcgcgcttcccgaagattgaaatcctcatcttcaccatcttcgacgaggaggacaaagtgctggaggccgtgaaggcgggcgcctccggctacctgctcaagggcgccccggtggacaagatcatcgaggccatcaaggaagtccgcgcgggcggcaccgtcatccagcccaacctggcccgccggctgctccgtcacttccgcgtggagcccgacgccagccccttgatctcaccgcccgccgcgccggagccgtcggccagcgacctgccccaggagcccctgctcaagccgctgtcggaccgcgagcgcgaaatcctccagctcatcgccaagggcgtctccaacagcgaggcagcgcgcctgctcgacctcagcaaggccaccatccgcacgcacctggagcacatctaccggaagctggaggtcaccaaccgcgtggaggccgtcaccgaaggcatccgcaagggcctcatctccgtctga

SEQ ID NO: 8084 - DNA, 465 bp, Myxococcus xanthus
atgacgtacaagctggtgggcgccatccgcgacctcggctcgctgtcgcaggccgtcgtgaatgccctgctcctcggattggccatcggcttcatctacgaactgctgcgcaaggtggtgcgaggcaacgcgcgctaccagcagtacgtgaagggttcccgaaagggcttcgccgtcggctggacggtggacgccatcctgcttcccagtccctacgcgtcgtcgttcggcggcttcgtggcgttcccggtgtcgctgtggttcggcgcgggcggcatcgtgacgtccgtctggaacacgttctccaagcgtgaagagcccgcggtgagtggcagcccgggtgaaggcgaggcccttccggaggacatgagcaccatgtccctcatgggcggtggcctcatcgccggtgagtcgctgttcttcctcatcgccggcctcatcgggctcgcgtcgctgttggcgtag

SEQ ID NO: 8085 - DNA, 1197 bp, Myxococcus xanthus
gacgaacacgaccaccgcgcgctgggccaacgcctggacctcttccacctgcaggaagaggcacccggcatggtgttctggcacccgcgcggactggtgctgtaccggctgctggaggagcacgtccgccagcgcatgcgccgcgagggctaccaggaagtccgcaccccacagctctacgcgcaacccttgtgggagcgcagcggccactgggacaacttcggggagaacatgttcctggtggaggacggcgcgcggcacctgggcgtgaagccggtgagctgccccggccacatcgaactggtgcagcgcatggcgcccagctaccgcgacctgccgctgcgcctgggcgagttcggcctggtgcaccgcgcagaacccggcggcgcgctccatggcctgttccgcctgcggcagttcacccaggatgacggccacatcttctgcgccgagccgcaggtggtgccggaggtcgtccgcttcgcccgctcgctgaaggacttctacgcgggcttcggcttcgacgacgtccaggtggccttctccggccggcccgcgtcacgcgcagggcgcgatgagctctgggacaaggccgagtcctggctcctcctcgcggcgaaggaagcggggctccagtgccacatgcagccgggcgagggggcattctacgggcccaagctggagttcgtcctgaaggaccggctggggcgcgcgtggcagtgcggaaccatccaactggacctcgtgctgccggagcgcttcgacctccactacgtcgacgcctccggggcccgcgtccgtccggtgatgcttcaccgcgcgctgctcggcagcctggagcgcttcatcggcgtcatgctggaacaccacggcggcgcgctgccgccctggctggcgccgcagcaggtggtggtggcctccgtgggtgaaggcgcggccgactacgccgagcgcttcgccgcgaagctccaggaggcgggctgccgcgccagcgtggaccggcggggtgaatccctgtcccgcaaggtcctggatgcccacgcggcgggcgtcccgtggctggtggtggcgggcgcacgcgaggtggccgcgggcaacgtccgcctgcggcagcgggacggcgcgcagcgggacgtcccgtgggaggacgccgcggcggagctcgtcgcatcgtgccgtccggccccgaacgcctga

SEQ ID NO: 8086 - DNA, 396 bp, Myxococcus xanthus
gacgaatggcgcaagcgcttgagcccccaggagtatgaagtcctccgccgccagggcaccgagcggcctggctccgggtgcttcctgggcacgaagacgcccggcacctacgtgtgcgcaggctgcggcaatcccctgttcaaggcgggaacgaagttcgagtccggcacaggctggccgtccttcacgcagccggtggcgcccgacgcggtgacggaaatccaggacgtctcacacggaatgattcgcaccgaggtccgctgtgcgcgctgcgatgggcacctgggccacgtcttccccgacggccctccgcccaccggcctgcgctactgcatgaactcggtgtccatgaagcacgtccccgaaggccagccgctggagctggtcaagacatag

SEQ ID NO: 8087 - DNA, 411 bp, Myxococcus xanthus
attggcgagctgatgaccaagaacctggagaccatcgaagcgggcgagcccatccgggccgcggcgctgaggatgcgcacgtgcaacatcggctccctgccggtgctggagggtgggcaactggtgggcatgctgacggaccgggacatcgcggtgcggtccgcggcgctggggcaggacccgaacaccacgcccgtgcgcgaggtgatgacggccacggtgatcacctgcgacgtggacgcgacgctcgaggtggcggagaaggtgatggaggagaagatggtgcggcgcctcgtggtggtggacggtgaacggcggccggtggggctcttgagcctggacgacctggccacggtgccagaggaagtcctgcacgcgggcgaggtgctggagcggctccagcaggtctga

SEQ ID NO: 8088 - DNA, 1614 bp, Myxococcus xanthus
ggcatggagctatgccccgcgctgggcctcaccatccccgtgggcaaggactccatgtccatgcgcaccgtctgggaggaaggcggtgcccgcaaggccgtgacgtcgccggtgtcgctcatcatctccgcgttcgcgccggtgctggacgtgcgcaagtccctgacgccgcagttggtggacgtggcggacgacacgcggctgctcttcatcgacctggcgcgcgggaagcagcggctgggtggctccgtggtggcgcacgtccacgggcaggtggggccggagagcccggacgtggaggaccccgcgctgctgcgtggcttcttcgccgcggtgcaggcgctcagcgaaagcggctcgctgttggcgtaccacgaccgctccgacggtggtctgtgggccacgctgtgcgagatggccttcgcgggtcgctgcggactggatgtggacctggcgccgctgggcggtgacgtgacggcggccctcttcaacgaggagctgggcgcggtggtgcaggtgcgcgcctcggatgtggcgcgggtgcgcgaggtgctggcgcagcacggcctgtcacgggatgtccacgagctgggccgcccggtgacggcgcttcaggtgcgggtgcgccacggcggtgacacgttgatggcggaggacacgttggccttgcgccgcacgtggtcccgcgtcagctacgagatgcagaagctgcgcgacaatcccatctgtgcggaccaggagtccgccgcgaggagtgacgcgtcggacccgggtctgtcgccgaagctgacgttcgacccggcccaggacgtggccgcgcccttcatcgcgaagggggctcgtcctcgggtggccgtgctgcgcgagcagggcgtcaacagccagcaggagatggccgcggccttcacgcgggcgggcttcgccgcggtggatgtccacatgagtgacatcctgtcggggagggtgtcgctcgaaggcttcaagggcgtgctggcgtgcggcggcttctcctacggcgacgtgctcggcgcgggcggcgggtgggcgaagtccatcctcttcaaccctcgcgcgcgggacgccttcgctgccttcttcgcgcggccggacagcttcggcctgggcgtgtgcaacggctgccagatgatgtcgcagctcaaggacatcatcccgggcgcggagcacttcccccgcttcgtgcgcaacgcctccgagcagtacgaggcgcgcctgtcgctggtggaggtgtcgaagacgccgtcgctcttctaccagggcatggaaggcagccggatgctcatcgtcacctcacacggggagggccgcgcggagttccccagtgtggaggacgccgcccgcgtcaacgggctggggctggtgacgacgcgctgggtggacaaccacggacgcgtggcggagtcgtatcccgccaaccccaatggctccccccacggcatcgccggtctgacgacgcgggatgggcgcttcaccatcaccatgccgcacccggagcgcgtgcaccgctccgtgcagcactcgtggcggcctcgcgagtggggcgacgacggcccctggatgcgcatgttccgcaacgcccgcgtctggctgggctga

SEQ ID NO: 8089 - DNA, 903 bp, Myxococcus xanthus
atggactcgttccggaaggcgctgacgacggccatcggaaacggagaccggtacctggcggcatacctccaggagcggctgacggagctggtgggcaacgacgcggcccgcgcgctccaggtgttggagtgggccaagggcgccagcggaccggaactgggcatctacatggacgcactgaaggccgcgcccgcggtgcatgcgccgcaggtggcgcagagcctgatgaagctgggcgaggacccaggtgcgcctttgcagacgcgctccgccgcgctggacgcgctggagacgcaacggaagctggcgccgggagacatccagcgactcaagaagctggcgctggacgagacgctggactccaccgcatgggtggccacgcgcacgctgggccgggtgatgaaggaggactacgagcgcaccggcaccttcgagccctactggaaggagctcctggacatcggcggcacgtccgacgacatggccgtgcggctgctcgcgctggagatgccgtcgtattcgaaccccgtcatcggcgcggagtccttcgactcgctcaagcgcatcctctccagcgaccgcgagcgggacgtgcgggagatggcggccttccggctgggcgtcaccagcgagccggagaaggcgatggagatcctccgcgccgccttcctggccgaacatgacctctgcgtgcgctgggccatcttccgcttcgccgtgcgcgcgggtggcgacaaggcgctgccgatgctggagcagttcgccgcgaaggacccgcgcttcacgcaggactacctggagttccaagccctctacgcgtcgggcaccgtggacttcgcccgcatctggctgggcaagcgcgagcaccacaactgcctggtcgaagaaggagcgccgcactga

SEQ ID NO: 8090 - DNA, 963 bp, Myxococcus xanthus
atggggcgcgcggcgctcctggtggccctttcgtccctgactcccgtgacggcgcgcgccgaggcgacgctccgccccgcgcaatgcacggtgcagggcatgctggacgacgtgcgcgtggcgatgaagaacggctcccccgcgctgaagcgctacgtgaagatgcggttgaaggaagccgcgctcgccatgcccgcggagtcactgctggcggcattgcacggagaaagagacccggaggtgctggaggccctgggcgcggcgctggccaccaaggcgagcaacgcggagaaccccggcctcatccagccgctgctcgcccgggccaccggggatgcggacccggcgctgcgcgcggcggcggtgcggggcctgcgcggcgtgccctccgtcgagttcatggagaagaacggcggcgtggtgacgtacgagcagttggtgcgcgacgcgtcccccgaggtgcgcgcggcggtggcggacaacatcgtctccgagagcgcggacgtctacagcggccatgaccgccgggtgtcggaggcggcggtgtcggtggcgacggcgtcggaggacccggcggtggcggcgaagctgctgcgcgaggtctccatggaggccgtgggccacgaggcggtggagcaggtgacgcgccagctccgcgcggagaacccggagctgcgcgcggcggcggccacggcgctgggcggcgtgcccggcggtgcgtccgcgggcgcgcggggctcgctggtggacctgttccgcgaagacaaggacccggcggtgcgcaaggcggcgctccaggggattgcccggctggggcaggcccacgcggtgcccgtgctggagtccttgcgcggcgtggaccgcgccatggacgcggaaatcgacgcctgggtgtccgtcctgaagctcaacctccaggagtgggagctggtgctgcgcgagaagcagcgccgccggaggtga

SEQ ID NO: 8091 - DNA, 540 bp, Myxococcus xanthus
atgaagctgaccatggcgggcctggtgctcgccgccgcgggctgggccacctctgtcacggccgcgacggccgtgggtcccatctgtgacaccgccgcgcgcgtgggttccacgacgtactactcgtgctcgggcagcagccacaacgcgctcgacatgagcaacggcacctgcagcgtgtggaaccaccgcgggatgatcaacgtcagccgctactacgcctactacggcggctgtgcgaacaactgcagcggcggcacgagctgcaacggcggcgcgggtaactactacgtcgtcacgggcggcagcggctgggacttccgccagctccacctgaactccaacgtgtcgtcgggctccaagacgtgcgaccgctgcgcgctggggctcgtgggctccacgggtaactccacgggcgcgcacgtccacgcggacaaccgccagtacggcacgcgcaagacggcctggtacaccaccgtcggcaccacctgcggctccagcgcgtactgcagcaaccgcgtcggcacgcccacgctgtag

SEQ ID NO: 8092 - DNA, 339 bp, Myxococcus xanthus
atgcggctactccggctcggcaacggccccagcctcgagttgttcgaatacgcggcccccgagcagcgcccaccggcccgccccaacgacctgggcatccagcacctggcggtctacgtggacgacatggacacagcgctcgcgcgcttccaggcggcggggggcgaggtcttctcgagcccccacgaactgccagccctggagaaaggcccgggcaatgccttctgctacgcccgggccccctggggcaccatcatcgagttcatcacctacccgtcgccccagccctacgagaagcagaccgcgctgcggcgatggaaaccgccggagcgcgactga

SEQ ID NO: 8093 - DNA, 993 bp, Myxococcus xanthus
cacgcgctgccaccggaccaggtgctgacgtcgctcgggagtacggccgaagggctgacggacgaggaagcgcgcgagcggctgtcgcgtcatgggcccaacgtgctggagcgcgcccagggggatggcccgctgaagctgctgtggcggcaggtgaacagccccttcatctgggtgctcatcgcctccgcggtgctggctgtcatcatggggaaggtgacggacgggctggtggtggccgcggtggtggtgctcaacaccctcatcggcttcgtgcaggagtaccgcgcggggaaggccattgagtcgctcagccgcatggtgccggagaacgccacggtgattcgcgcgggccgcaagctgcgggtccccgcggcgcagggcgtgccgggcgacgtcatggagctggcgccgggtgacaaggtgcccgcggacatgcggctgctctccgcgcgcaacctcacggtggaggaggccgcgctcacgggcgagtccgtgcccgcgcaaaaggccgtggcgcccgtgccggaggaggcggagttgggggaccgggccagcctgctcttcggtggcaccctggtgacgtccggctctgccaccgcggtggtggtggccaccgggcaggccaccgagctgggccgcatctccacgctgctccgcgaggccaccgacctccagacaccgctcaccaaggcgctggccgtcatcggcaagtacatcaccctgggcatcctggtgatctccgccgcgctgctgggggtggggttggttcgtggctacgcggtgagcgaggccgtcgtggtggcgattacgctggctgtcgccgccattccagaaggactgcccgccatcgtcaccatcgccctggccattggagtgcaacgcatggccgcccggcgcgccgtcatccgcaagctgcccgcggtggagacgttgggcagcaccaccgtcatctgtacggacaagacgggcacgctcacccgccatgagatg

SEQ ID NO: 8094 - DNA, 336 bp, Myxococcus xanthus
atgatcaacctgaagcactccgtcgcggcaaccgtcctgtggcttttcgtcgtcgtcctgggcatcgccttcggcgcggggctctacgagcaccgcgtctcgttgccccgatggctcgacaccccgggcggacactggtcagcccaggccgcgcggcaggacaacgtgggactccgcttctgggccttcgtcaccacggggccgctgacgctgctcaccctggcgagcctctatttcgcatcccaggccaccggcgcgctgcgcgtctggtggctcggggccgcgttggcggcgttggccgaccggctcctgaccttctcgtaccatagagcaacg

SEQ ID NO: 8095 - DNA, 1086 bp, Myxococcus xanthus
atgtccactgcacgcacggttcgaatgggtgtcattggcgcgggcttcgcgcgcaccacgcaaatccccgcgctgcgcgcattgccgggcgtggaggtggtgagcctggccagtgcgcggcgcgagaaggtggaggaggcgggccggcagttgggcgtgtcacatgtgacgacggattggcgtgaggtggtgtcacggccggatgtgacgtgcgtgtgcatctccacgccgcccgcgctgcaccgggacatcaccctggccgcgctggaggcgggcaaggcggtgctgtgtgagaagcccaccgcgttggatgcgagggaagcggaggccatgtggcacgcggcccgtgagcggcgtgtcctggcgctgctggaccatgagctgcgcttcctccctgcgcggcagcggatgcgagcgctgctgcgttccggtgagctgggcgcggtgcgcggcgcgcgtgtcttctatcgcaacgacaaccgcgcctcgccggagcggccgtgggactggtggtcggacgcgtcgcaaggaggcggcctcctgggcgccatcggctcgcacgcggtggacacgctgcgcttcatgctgggcgccgagcccgacgaggtgctgggcgagctggccacgcacacgcccgagcggcccgatgcgctcacgggacagtcgcgcccggtgacgagcgacgacgaggcgcggctgctgctccgcttcggtgcgacgacagccgcaatcgagatgtcgatggtgtcctccggcaagcccgtgcacggcgtcgaggtgtcctgcgcgcgcgggggcctgcgcgtggagggccgcgagctgtggcgctccacggtgggggcacgtgcctgggagcgggtagcgcttcccgaggaaccgccgcttccacccggcctgccagacaacgagtgggcgcgcggcttcctgctgttggccggtgcgctgacgcaggccctgcgcgaaggccgcgcctcggtggaggacgcggccacgctggaggacggctggcgcaaccaacgggtgttggatgcggctcggcgctcacatgcggagcgccagtggattcgcctgtcctccgggccgtaa

SEQ ID NO: 8096 - DNA, 516 bp, Myxococcus xanthus
atggccgagcacaagggcatcgtcacgttcaaggggcagccggtgacgctggtgggggacgaggtgaaggtgggcgacgccgctccggacttcaccgtcttcaaggggctcaacgacgccgtgcggctgtcggacgtgaagggcagcgtggtggtggtgagcgtggcgcccagcgtggacacgcgggtgtgcgcggcgcagcttcgcgcgttcaacaaggaagccacggcgctggggccggacgtgaaggtgtggttcgtcacgctggacctgcccttcgcgctggggcgcttcatcggcgccgagggcatccagaacgtcaccacgctgtcggactacaaggaccgcgagttcggtgagaagtacggcgtgtacatgaaggagctggggctgctcgcgcgcagcaccttcgtggtggaccgtgagggcaaggtcgtgttccgggagatcgtcccggagatgacgcacgagccggactacgacggcgcgatgaaggcggtccgcgcggcgctgtga

SEQ ID NO: 8097 - DNA, 354 bp, Myxococcus xanthus
atgtaccagcagaagggcaccgcgctgggcctgcgcaacgccatccgcttcttcctcggaattgaggtgcgcgccgtctcccccttcgcctcggacaccctcgtgctgggcgagtccgagctgggcgtggactgggtgctgggcccctcggagcgcttcgcccgctacgccttcaacgtcgaggtggagcgcctcctctcgactgcggagcgccagcgcctgcgcaccctcgtcgagtacctcaagcccgcgcatacccacttcatcgacttggtggagcccctgccacccattctccccgagcactgggagctgggactcagcgagttgggcgagacgacgacgctgcactga

SEQ ID NO: 8098 - DNA, 774 bp, Myxococcus xanthus
atgctgggcttcatcaacgggcacgtcacccagggcgcgggggcccacgccgcctccgccgtctccgtcgcggacgcgggcaacctgctgacggcaggcaccgtcgaagcggcgctcgcggaagtcctctcggccttcagcggcgggcacttccgcggcaacgaaacggcggtgggccagcacaaggccatcctccagcccgtcctgggtaccggccgtgtccttctcctcgacgcccaaggtgcgggcggcgccgccgcgcggctgcgcctctacgctgacagcgactcggtgtggttcaccctcaacgccgcatggaatgggagcgcctgggcccgggacaccaccggcgcggctgccgccggcttccgcctctcgcgcaacgaggcggagttcctccacgacgccagcctcaccgtcacattcacctcttggacgcgcacgttgcgactcccactgagtagcaccgccagcaacacttcattcgaggtggcgggcagcgtgcgcgaggtgggccggctcggcctccagtacagcaacagcgacaccgccgcgcacgacaacctggccgggggcggctcggtgacgttccgcagtcgctttcctggcgtgccctcctccatcaccctctccccctacgccttcgccggaagcttcgtcggcaatcccaccgtcatggtgccggacagagacggcttcgccttctacagccaccaaaccctcccaggcctcgcctcgacgtattggttcggctcgtacaccgccgtcgcgtaa

SEQ ID NO: 8099 - DNA, 285 bp, Myxococcus xanthus
atggttatcggcactgacaccacctacctcggcaacgaaatccccggcctccgggggcagaaggtccgcatcttcgcggtgctgcgcggcggcctgcgccccgacgccaaccccgacgcggacgactactatgtgaatgacaacgagacgctggcgcacctcggaggcgtcacggccgaggactgcatcgacgccgccctcattctcccggacggcaccacctccttcgtgcatttcgacccgcgcgccatcgacttggagtgcttcgcgcacctgcgcaaatag

SEQ ID NO: 8100 - DNA, 621 bp, Myxococcus xanthus
atgccccgcaccaccgccccgaagacgaagaagctggagtccatgaatttgacggagctgcgcgcccgcttccgcgaagtggtgggcgaggagacgcgcagcccgaacaagacgtacctcatccgccgcatcgaggaatccctcgccgccaagaagcggcgcagcccctcccgccgggccacagccaccgcccccagcgcccctcctccggcccctgctgcaccggccaccacctcggccgagggcacgcagcccgctcgccagcgcgggcgcttcgcgggcatgtcgctgcagcaattgcaggagaagtaccgcgaagtcgtcgggcgtccgacgggcagcagcaacgtctcctacctccagtggaagattcgggaggcggaggctggacgaatcaacgtaggcccgcgtcccgagcgcgaggtgaaggtgcgcgaggacggcaagcgcgtcatccctctctccttcgacgcagaggccctggacgccctggacaaggcctggcgcgacgcgggcctgccgagccggacccgcttctttatgcgcgcggtgcaccgggaactcacggccatgggcgccacccaggccgccgagcacttcgctccgaaggccgaggagtag

SEQ ID NO: 8101 - DNA, 231 bp, Myxococcus xanthus
atgagcgttgacgcgcgcgcgggctacctgacggctgtggttcgggtggacaagcgaatctccaggcgcctcgacagccagccgaacgaaacgttggtcgcgctcttccgggagcggttggcggccgaggatagccagcgcgtcaccgtccacccgctcgcggcccagagcttcgaggaggccgcgaaggagatgagcggcgcggacctcggcgccagcagcgacgagtaa

SEQ ID NO: 8102 - DNA, 150 bp, Myxococcus xanthus
atgctgaggcgcctggcggaacgaatccccatcatccacacctgcctgccgcggctggtggattggggcgccgaggacgcccaggccgccctgaacgaactgaggcacacggccatccgggagcgcttgcaccgcccgaaacaagggtga

SEQ ID NO: 8103 - DNA, 477 bp, Myxococcus xanthus
atggcacgaggaagcaaggcgaagtacacggcgaagcagaagcggatggccgagcacatcgaagagggctaccagaagcgcggcgtctccgacgagacggccgagtcccgggcctgggctaccgtgaacaagctcacgggcggcgggatgaagaagggcggctcgggcggcaaggccaaggtcgcgcgcagccgtcccctggcgcggaagaacgcgcgcaaggcgggccgcaagggaggcaaggccaccgccgcgaagcgcgccggcacccgtcgccgcgccgccaccggccgcacgcgcaagcccgctgctcgagccatgcgttcgggttccaagtccaccgccgcccggggcacctcggcccgtcgcgccaccgcccgtcgcacctccaccgcgaagcggcctgcttccaagtcccggagcggtacgcgtcgcggaaccagcagccgcggctcgcgcggacgcacccgtacctag

SEQ ID NO: 8104 - DNA, 999 bp, Myxococcus xanthus
atggacaccgtctctgctgcccgccccgcgccgcgttactgggtgcacctgttgctcctggtgctgacggtagggaccaccttcacctcgtatctgctctacttccatttccagcggccctactcactgggagaggtgtcccccgaagcggccttccgcgcgctggccttcagcctgtcgctgctggccatcctggggacccacgagatggggcactacgtgttggcgcgctggcaccgggttgaaacatccctgccatatttcatcccgctgccggtgctcggcgtgggcacgctgggcgccgtcatccgcattcgcgaccgcatcccgaaccgcaacgccctggtggacattggcgcggcgggaccgctcgcggggttggtggtggccctgcccatcctcttctgggggttggctcactccaccgtggtggatgcgccggacatcccgtccaccctcttcccgggggacggctcgctgtgggtcattggccgggacgtcttcacttgggtgatggaccgcgtcaccaacgcgccgcccgcgccggagacgcctttcaacggcgtgcagacgctcttcggcgacagcctgttgatgcagggcctgacgcgcctggccttggggccgcttccggagggcaaggacatcctggtccatccggtggtcatcgctggctggttcgggctgctcgtcacgctgctgaacctgatgcccgtggggcagctcgacggcgggcacctggcctatgcgctgtggggccggcgcgcgcactgggtgggccgcgcggtggcgttggtgctgttggttctcacccttttcgtcaccgcgtcctggggcttgtggctcctggtgacgagcaagctggtaggcttcggccatcccgaggtggtggaaccccaggaaccgctcagtccactgcggaagtggatctgcgcgctgtgcctgctggcactcatcggctgcgccatgcccattcccctgcgccaggtgatgacatga

SEQ ID NO: 8105 - DNA, 897 bp, Myxococcus xanthus
atgttgagccccgagcggatcaagtccctgtgtgagtcgtcgcgccccaagctggagttgatgcgtgccgcgctgcgggcccatggcagcgcgctggtggcgttctccggcggtgtggattcgaccttcgtgctgaaggtggcggtggaggagctgggcgaccgggcgctcgcgctcaccgcgctgtccgcgtccgtggcgccggaggaggccgacgaggcccgcgagctggcgacgcggctgggcgcccggcacgtggtgctgggcagcaacgagctggcgaacccgcagtacgcggccaacccgacgaaccgctgctacttctgcaagacggagctgtacgacatctgcgaggcgcagcggaagtcgctggggttggcggtggtgttggacggcttcaacgcggacgacttcaaggaccaccggcccggccacaaggcggcgcaggagcaccaggtggtgtcgccgctggcgcaggcggggctgacgaaggaggagatccgggcgtggagccagtcgctcgggctgccgacgtgggacaagccgcagatggcgtgcctggcgtcgcggattccctacggcacggcggtgacgcgggatcggctgctgcaggtcgccgccgccgagtcggagctgcgcaagctgggcttccgacagttccgcgtgcggtaccaccaggacgtggcgcggctggaggtcgcggcggaggagtacgaacgcttcctcgcggcggacgtgcggcagaagatcaacaccgcgttcctggcgctggggttcaagttcgtggcgttggatctggagccgttccgctcgggccgcatgaatgacgcggcgggtgtggcgcggccggggggcacaggcaagccggagggcttttcactgcccgtggtgagctga

SEQ ID NO: 8106 - DNA, 756 bp, Myxococcus xanthus
atgaagttccagtgtgacgcgtgcgagcggctcgtgccgctggagacctaccggacggaggccgggggactcgtggtgacgtgtggccgctgtggcgcggacagccgcgtgggcccgccggccaccaccgcgccgcgaacggaggtgccggctgtcctcgccgcaggggcggcgccagcgccgttggtgccggtggcgccgccctccgacagttggagcgcttccgcgccagtgacgccggccctgcgggtggtgcgttcggagtcggcgccgctgacggacgacgcgctcttcgagccaccccctggcgtctgtcccaagtgcgtggcgcctcggcgcgaggaggccctgtcctgtccgcagtgcgggctcgtctacgtcaactaccagcccgaggagcaccccctgtcggacgtgctggcggacgcgtggcgcaagctggcggcgcgctgggaggactgggacgcccatgaccggctgatgacgctggcggtggggcggggcgagctggccatggtggggcggctgtatcggattcgcctggcgcgcgcgcccgacgatgccgtcgcccggcggggccgtgatgaggtggtgcgcaaggccaccctggtggtgccatcatcggtggagcccgccggaacccccaacgtcttccgacgcctgaagacggtggcggtgggtgtgggcttcatcgtggtgctggtgctggccgtgctcgtcttccagcacctgcgcacgctgagcgcggggtactga

SEQ ID NO: 8107 - DNA, 286 bp, Myxococcus xanthus
atgtcgctctccgtctccacccctccgtccgtcgacagcctgctcggtccgggaggcgcgctcgaggttgcgctgcccgcgtacgagcaccgcccagagcagcttcagatggcgcgcgccgtggagcgggccttcgccgagcacagctacctgctggccgaggcggggaccggcacgggcaagacgcttgcctacctggtgcccgcgctgctgtcgggacgccgggtggtcgtgtccacggccaccaagactttgcaggaccagatcttcttcaaggacctgccgc

SEQ ID NO: 8108 - DNA, 786 bp, Myxococcus xanthus
gtggtggaacggatggtggcacggggcacccgccgcctcatcgtgggaggaggcgacggcaccctgagccgcgcggtggtccggctgctgggccgcgacgtgacgctgggcgtcctcccgctgggcactggcaacgacttcgcgcgctcgctgggaatcccgcccgacatcgaggccgcctgtgacgtcatcgcccagggctacacggcccgcgtggacgtgggcctggccaatgggcgccccttcctcaacgccgccagcctcggactggccaccggcatcgccaagcggctgacgaagcggctgaagcagcgcgcgggcaagctggcctaccccgtggcggccgcggcggagatgaaggacctgcgccccttccacatccggctgaaggcggatgaccaggagctggcgctggacgtgctccagttggtggtgggcaacggcctctaccacggcgccggaaacatggtggcgcccgatgcccggctggatgaccggcggctggacatctacgccatcgccgcgccctccgccgcgtcggggcacgaaggcaccggcctgggccagctccaggacatcgccacgttgatgcgggtggccctgtccctgcgctcgggcgagcacgtggagcaccccgccgtcaccgctctgcgcgccgcgcggctctacgtggaggccgcccccgtccaggaggtgaacgcggacggcgagctcgtgggcaagacgcccatgcgcttcgaggtggcccccgcggccctgcgcgtctacgcgcccgcgccctcctga

SEQ ID NO: 8109 - DNA, 718 bp, Myxococcus xanthus
atggtggaaaacgtcatcttcgacgtggatggaaccctggtggattcggtggacgagcacgccgaggcatggcggcgcgccttccttcacttcggccgggacatcccgttcgcgcacgtgcgcagccagattggcaagggcgccgaccagctcatccccgtcttcttcaatgacgaggaagtggagcgcttcggcaaggagctggacgaataccgcggcaagctgttcctggacgagttcctgccgaagggtgcgtcccttcccccgcgtacgggagctcttccagcggctgcgcgcgggcggcatccgcatcgtgctggcctccagcgcgaaagagcaggagctgaagcactacgtgaagctgtgcggcatcgaaggcctgttcgagacgaagacaagcgcggacgaggtggacaagagcaagccccacccggacatcttcgaggccgccctggcgcggctgggcaagccctctccggacgtgacggtcgtcgtgggcgacacgccctatgacgcgctcgccgccaacaagtcgagcctgccctccgtgggcgtgctcgcgggcggcttccctccggatgacctgcgcgccgcgggctgccgcacgctggtgaaggacccggcggcgctgctcgcgcgctacgaggcgtcccggcgcgaatggccctggaacgagtccggcaccagccaggtggccaaggacgacgagcggcgctga

SEQ ID NO: 8110 - DNA, 804 bp, Myxococcus xanthus
atgcgtgaacgcctcctcctgttgtgtgccctgacggccctcaccggctgccccaagaagggcggcgatgacgcggccatgctgctgcccgaagtcaaagccgggctcgccacccgcgaagcgaagctgaagagctaccgcatcgcaggcaccgtgcaggacgcggggctggagccggtgacgttcaccttcgaataccgcgcgccacagcgcctgcgtggcacgctgggcccgcccgcctcgcgcaccttcgcgtgggacggcgcgcacttcttccagcagttcgatggggagaagcgcttcgcaaccttcacctcggagctgccgcccgcgaagctcgccggcttcctgtcggagacgttccaccccttcatgccggagggcttccggacgccgctcttgctgagccatgcgacggtccgccgcgccacgcacccgctggcgccgcaggcggtggagctggtgcagaagctggacggtgacgccgcgggactggagatggtctacgtgctgcgctggccccagctggacttcctgggccggcgcaccgtctcaccggacggcgccgcggccgaggagcgcgtggaggaggagcactgtgacgcggccttgtcgctgtgcgtgcccaagcgccttggccggtggcagggaggcaagcgcgtaggtgagacggtgctcacgcgcgtggagctgaacgcggccctgcccaacgacggcttcaccctcaccgcccccgaaggctacgacgtacagacgcggacactggtggagtccacccccgccacccagcccacggacggttga

SEQ ID NO: 8111 - DNA, 348 bp, Myxococcus xanthus
atgaagaagctcgtcctgtccgccgtttccgccagcagcatggttgcctgcaccagcgttgagagcgccgttgtctccggcacgaagatcgcctccaacggtgaggccgtggccgttgttcaggccaacgccctgggcctgaccgccatcttccacatcgtcgacatcgtgcagagcgacctcgacaccgtcatcaacaagctgctcatcgccgaggccaaggccatgggcgcctccaaggtggagctgctgaccgcgggcaccaccgcgcgtcacggcatctacgccctgaccggcaccatcatcggcgtgaccagctccagcgccgtgggcgtggcggtcaagtag

SEQ ID NO: 8112 - DNA, 3253 bp, Myxococcus xanthus
catgagcaggtcgcggagcaggctcggcgcacgccggacgccatcgcaatctggtccgaagagggggaggtgtcctatggggagttggaggctcgtgccaaccggctcgcccaccacctgaggcggctcggggtggggcccgagtccatcgtggggctgcacgtcccgcgctccatcgacatggtggtctgtgtgcttgggatctggaaggcggcgggtgcctatcttccgctcgatccggagtaccccgccgagcgcctgcggctctccctggctgacgcgcgcgcggacgtgctggtgacctccggcgccgtggacgcgtggtgggagtggggcggccatcgtgtcgtcgatctccggcgggatgcggcccggatcgcttccgagcccgattccccgtccgacaacggactcaccgccgagcacctggcctacgtcatctacacgtcgggctctaccgggagcccgaagggcgtgatggtgacgcaccgggcggtggccaaccacttgcgctggcgtcaggcgacgtaccctcttggcgcggcagacgcgttcctgcaaaaggcctcgctgagctttgacatctcggtctgggagatcttcgcgccgttgatcgctggcgcgcgtctggtgctggcccggccgggtgggcagcgagatggaggctacctggccggcctgatcgcgcggcagggcgtgtccatcgcgcacttcggccccacgctgcttcggctggtgctggatgcgccggagctggagcgctgcacctcgctgcggcacgtcttctgtggtggcgaggtggtcccggtctccttgtgtgagcggttgctggcgcgggtgccggcgcggcttcaccaccaatatgggccgaccgaggcgaccatcgatgcctcctgctgggactgtgtcccgggggagacgcgctcctatgtcccgatgggagcgccggtggcgaatacgcggctccatgtcctggacgcgcgcggtcacctcgccgcgccgggtgaggtgggagaactcctcatcgggggcgtggggctggcgcgggggtacctccggcgcccggacctcaccgccgctgccttcgtcccggatccgttcagcgaggagccgggcgcgcggctgtatcgcacgggagatctcgtccgacggatgccggatgggacgctccagttccttggccgccgcgatcatcaggtcaaggtgcgtggctaccgtgtcgagttgggcgagatcgaggcggccctcttgggccaccccgggctccgcgaggcggtggtggtggtccgtggcgaaggggaggacgagcacagactggtggcctatgttgtcccggcgcggaatgccgtggagccgctcgaactcacggcgcttcgggcgttcctggagcggtccttgccggattacatggttccggcggtcttcatcccgttggacggactgccgctcaccccgacaggcaaggtggaccgcggcgcgctgcccgagccatcggagttcaaccgcctcgtgccatcgggccttcatgaggcgccgcgaggtgcgctggaggaaaggttgtctcggctctggggagaggtgctgcgcgtcgcgctcccggggcgccacgcgcacttcctggagctggggggagactccatcctcgctgtccggatcgctgcccgtctccgcgaggcgggttaccggtgccgcccctcccagctcttcagccatcccaccatcgcggaactggccggggggctgcgcgcggccttgcaggaactcccggacggagggaaagcctccgctgtcccggaggacgagtggccctcttctgccgcgtcagagccgtatccgctcacgcccatgcaggagggaatgctgttccacacgctgctcgcgcccggttcgcgcgtgtaccacgagcaactggagttcgaacttcgcggtccgctcgttccggagctcatcgagcgcgcctggtgcgaggtgggcgcccgtcatccggggctgcggatgcgcttccagtgggaggggctctccgctccacgccaggtcgaggcgcgggagttgccgccgatcgagtggtgggactggcgctcgcaggagtcgctcgcgttcgaggaacggcgcgagcgttttctcgccgaggatcgagcgcgcggtttcgcgctcacggatgcgccgccggtgcgcctgtcggtggtccagttggaggacgggcggtattgggccgtctggagcctgcaccacctcgtctttgatggctggagcgcggcgctcgttctgggcgaactcttcgccacgtacgcggcgctccgggctgggacccgtcgtgagctgcccccggcccgaccgtaccgggatttcgtgcgctggattcgctcgcgcgacttctccgcggaggctccgttctggagggaagcgctgggtcctggcgtctctccaacgccattgtttgcggaccgccggcccacccgccgcgtgccggagccggacgcggcgctgcggctgcggctcaacgccggacggaccgcccggctcaaggccctggcggtgcgtcaccgcatcacgctgaacacgcttctggcgggagcgtgggccgtgctcctgggtcgctacagtggccagcgcgaggtcacgtttgggctggcggtgtccgggcgttccatcgaactggacggagtggaaggcattgccgggttgctgctcaacacgttggccgtgcgggtggaggtgccctcccaggccactgccgacggctggctgcacacgctccaggctcggctcaccgagctccttgcgcacgagcagacacccctggccgatgtccagcggtggtgcgctggcaagcccggtgaggcgctcttcgagagcctgctcgtcttcgagaactaccccgcggaggcggcgtgctggagcccgccgggggccggactcgttgtcgagcgccgcttcggcgcggcgcgtgctccttatgcgctcacgctcaccgcgcgtccgggcgaggcgctcgaactctgggcctcctacgagcgtgaccggttcagcgacgaggtgatccaccggttgttgcggcacctggagcagtcactctgggcgctggcggagggaagctccaaggtgttggcgtcgctggagttgctgccggcggacgaactgtcggcgctgctggcgcgaggccgaggaccacgggtggcactaccggacgaggccgagctccccgccctgttcgaagcccaagccgcgcgcaccccggagacggtcctgagag

SEQ ID NO: 8113 - DNA, 387 bp, Myxococcus xanthus
atgaacctggtccccttcgcgaacgagcacctggaagcggccgcctcgctgctcgccctgcggcaccgcgcccatcgggccacgctcccgctgttgccgggtgagcccgagtcagccaccgaagcgcggcggatcctggaagcgctccggcagcgacctcgcacgagcggcttcgccgcgctccagaatgggcgactcatcggcttcgccctcgggacactgcggatcgacaccacgtgggggcgctcggcctggctgttcgcgcccggccacgccctcgccccaggaacgagccccgaggtgtaccgcgacctgtatgcggccctggccgcgcagtgggtccaggaaggctgcttcgttcacgccgcgcttagtccaggcccatga

SEQ ID NO: 8114 - DNA, 1236 bp, Myxococcus xanthus
atggtgccgagcgagaacagcatgtcggcgctggccaagctgccgatgctgctcgatctacaccaccgctattttttcaatgatggggcagaagaggagccctgggagttccggggcgtacaagagctgtcctcgctggagaccgagctggcgaggccgctgctgcgcgagttggccggcgccgagttcgtcaacgtgcgcgcgctgtccgggctgaacctgatgaccctgacgctgtccgcgctcggaggcccgcctggctccacggtgatgctgctatcccgcgcccagggcgggcactatgcgaccgcgagcgtcgccgcccggctgggattgaaggtctgctacgccacgggccccgacgcgcacaccgtggacgagacacagttcgcagagacgctgcgggcccaccagccggggctcgtctacatcgatcaatccaatgcgctgtttcccctgggcgtcgaacggctggcgcgggccgtccagcgagatgccccgaacaccctgctccacatcgacgcaagtcattggatgggtctggtgctcggccgtcagcttcccaatccgctcacggagggggcccactccttcggcggctccacccacaagaccttcccgggtccgcagaaggccatcttcgccaccaaccggagggagctcttcgagcgcttccgagcaacccagcagtacatggtgagcagccaccacttcggggcgacggtgagcctggcgttggcgctgctcgagttcaagcactgccggggtgagcagtacgccgcccaggtggtgttgaatacccggcgcttcggcgccgcgctcgatcgtctcgggttggcgcttgacggcaaggaacgtggcttctcggccggccatcagctctggatccggacgcgggcctccggcgtggacgcgttcaccgcgagccagcggctgttcgacgcgggcatccgcaccaatgcctatccatcgctgcccggcatccctgaaccggtcctccgggtcggcctgaacgagcccacgtaccacggactcatggccgacgacatggaggagctcgccgggctcttcgtcgcggcaatcttccagacgcagccgacggagcagatcgccgggcgtgtggcggcgctgcgcgcgcgctaccggttcccctaccgcttcccatccgacgacccaaagctgctcgaacaagcgatgcgactggtgcgtctggcgttgacacagcccgtggagtga

SEQ ID NO: 8115 - DNA, 354 bp, Myxococcus xanthus
gccatgcagaagctgagggttggatacacgatccttgtcatggccggggccgaagcctccgagaagaacccggcgaccaagcgcggcaaggtactgaagatcgatcgcgaggctgagcgcgtgacggtcgagggcctgcgcctggtcaagcgtcacatgaagaacacgcctcagagcccggaaggcggtatcgtcgagaagccgggcacgatcgcgctggcgaacgtgcaggtggtttgcgccaagtgcgacaagccgacccgagtgggcattcgtactgaaggtgaagagggcaagaagaagcggttctgcaagaactgcgacgccctgattgactaggtgtccgcgttggtg

SEQ ID NO: 8116 - DNA, 759 bp, Myxococcus xanthus
ggtttcaccctctggctgaccggcatgtccggtaccgggaagagcaccaccgccgcctacatcgccgcgcgcttgcggcaggtgggtcgcaacgtcgagatcctcgacgagggtgaacttggcgaggcgctgtgggcggggctgggggatggcaaggaggaccgtatcaccgtcgtgaagcggctgggcttcgtggcgaacctgctgacgcgaaacggcgtggcggcgctggtaccctgcgtgagcccgtacaagccgggccgtgaggagaaccgccggtcgattggtcgctacgtggaagtctacgtcgactgcccgaccgagaagctcatcgagcgcgacagcacgggccgctacaagaaggcgctcaacggggagatccccaacttcatcggcatcaccgagccgtatgagccgcccaactcgccggaggtcaccatccactccaacgtggagtcggtggaggacggcgcggcgaagatcttccagtcgcttctggacctcggctacatgagcaccgaggagctgaaggtcatcaccggcaagaagatgaaggccaacccgctccccgcgaagggggagaaggctgagaaggccgagaagggtggcgccaaggcccgccgcgccgaggagtccaagcccgcggcgaaggcgccgaaggcggacaagggcgccaaggcccgtccggccacgcgcgcggcccgggtggcgaagccggccgcggcggcgaagaaggccgcgaagcggaaggctcgctag

SEQ ID NO: 8117 - DNA, 237 bp, Myxococcus xanthus
atggctgacgagaagaaggccgagcagaaggaaaagaaggcgaagcggggcaagaaggaagaggccaagaaggttggcttcgccgccaatatcgaggaaggcctggagtccaagccggcccgtctgaaggtgcgcttcttcaaggaaggtgttccgtccctcctgaaggagctgagcctgaagaacccgatgcaggttccccggctggagaagatcgtcgtcaacatgggtctgggc

SEQ ID NO: 8118 - DNA, 1182 bp, Myxococcus xanthus
gcacgggccgccatcgaccaggtgcgcgcccgccacgccacaccggatgctccggccgtcacccggtgggagcgggagacgccggtccgcgtcgtggtgacggacgaatcgaacacgtccgcggtggaaccggaagtcgagcttccggatgccacacgcgacgagctccctcccagccgcaggggcccgctgtcgctggtgcctccgcccgccacggacgcgggtgagtcgtcctatcgggagtccttctctccggagtccggacggggtgagccagagggtatccgtcccctggcggagcgcgccgtgggggccctgtccctggcgcgtgacatcgctgggcaggccctggcgagcgagagtctggcccgggcgatgctcgcgatgggcggcctgaaggacatgctccgcgccggcctgggcactggcggtggcgcgaacctggacgagtacggcaaggacccatcgctcgtcgagcggctggagcccgtgctcgagttcctctattcgcagtactggcgcgtgtccgtgcagggcgtggaccacgtgccgccgggcgcggccatcctggtggccaaccattcgggcgccctgccctacgacgggctcgtcatgtccatggccctcacgcgtgagcgcccggacctgcgcgagccccgctggctggtggaagaccaggtcttccacgcaccgatgctgggcaccctcttcaatcggctcggcgccgtgcgggcctgcccggagaacgcgctgcggctcctggacgagcatcgtccgctggtcgtcttccccgaaggctaccaggcactcagcaagcccttcggcgagcgttaccggctgaagcgcttcggccgcggtggcttcgtgaagctggcggtgcgcaccggcgcgcccatcgtcccggtggccatcgtcggcgcggaggagacgtcgccgctgctgggccgcatccccgcctccttcctgggactgccctacgtgcccctcacgccgctgggccccctgcccctgccggccaagtggagcatccgtttcggcgaacccattggcgtcgaggacctcgcgcccgaggccgcggacgacctgggcgaggtccagcgcctcaccgagcgcacccgtgaggccatccagagcatgctccagtcactgctgcgcgagcgccgctccgtcttcgcgggctga

SEQ ID NO: 8119 - DNA, 306 bp, Myxococcus xanthus
atggctcgtagtgaacccaagtccctggaaagtctccttccccgcgtcctggcacggctggcgggagagtccggcaagggccacgcgctggcccccgtgtgggaggcggtggtcggtccgcacctcgcgcgccacaccaccccccaggccctgcacggaaccaccctggtggtggcggtgacgggcgcccagtgggcccagtcgctggagtccgaagcggcgtcgctctgcgagcagctcaacgcgcggctcggcccggacacggtgaagtccctctccttcacgttccaggtagcgcgccgatga

SEQ ID NO: 8120 - DNA, 1515 bp, Myxococcus xanthus
atgatggccttgttgccgctcatcgccgtcctggccgccacaccgccggcgtcggccggaatggaacgcagcgccgcgcagcacgtcagccgcgaattcgagcgcgtgggacggcgcgccccggtggaagacccgaagctgaccaccgccgcgcggcggctggcacacgaggccctcaccgaatacaccaccggcgcgccgggcctcttcaccctcacctccgccgtcagcgacgcgggcgcggcggacccctcgcctcgcgcgctggtcatccgggcgtgggtgccacagcacgccgtcgagaccttcctcgaccgcgacgacttcaacagcgagcgcgcctcgcacttcggcgtgggagtgtccgtcctcggcaagcgcgcggcgctcgtcctgctgctggtggaccgcaaggcggagctccaggacttcccgcgcctcatcgccaacggcgagcgctcgaccatgacgctctgcggcgccctggtcccaccactgcggcgggcagaggtgtacgtcacccagccgaacggcggggtgagtctcatgcccgtccagaaccggggggcggggggcggcttctgcagccggctcgccttcgccacgccgggtacgtacaccgtggaggtggtgggacgcgcggacggcgggccggaggtggcggcgctcttcctggtggaccagggtgaaccccgcaagcacgccgccagcgaggacaccgccgagcccaccacgctggaggacgcccgccgggccgtctacgagcgcatcaacgccctccgccgcgctcacgcgttgcccgaactgtcccccgacgccgtgctggaacaggtggcccaggactacagcgcgcgcatgtcgaaggagggcttcttcgcccacatcgccccggacggctccacgctgacgaagcgcctgccagcgggcgcgcgctacgtgcgcgcgggagagaacctgggcctggcaccggggccgctggcggcccacttcggcatcgagcacagccctggacaccggcgcaacgtgctggacccgggcttccgcttcatgggcgtgggcgtggcgttccacacggtgaacgggcgccaggaggccgtcctcaccgaggtcttcaccgtcgccccgcccgcttcgccggagctggcggacccgcaacaggaggcctacgacgccctgagccggcggcgtgcgtcccgcaagctgccgcccctgacacgcaacgccgcgctcgagacactggcacgcgcccacgccaggcgcgcgctggagctggaccagccctccgcccagccgggtgaagccccggtgcacgaccgcgtcttcgaactgctgcccgacgcgggaacggcgtccgtggacttcttcgtggtgtcggaccccacggcgatcccggagtcccgcagcatggccgacgccacgaacaaccgcgtgggcgtaggcgtcgtgcggggagactcccgccgcttcggcacgaatcagtactgggtggccgtcatctacgcggccgtcccctga

SEQ ID NO: 8121 - DNA, 336 bp, Myxococcus xanthus
atgtcgctgggacaatcccccacggcgctggaggccgtccgcctccacaagccggatgcggccgccctggcgcgcgcggagctgacggcctgcgccgcgaagaagtgcgacgacgtgggacggctggcgctgctcgcggggacgctcgccctctctgacggtcaggccgccgaggcaagggaactgctggctgcctggcccgcccctccactgctggcgccgtaccacgccttctacctgggccaggcccgcttctacgccggggacgccgcgggcgcggccgaggacttgcgcgagtgctggaatccaaggcacccgcggaactcgcggctcgtc

SEQ ID NO: 8122 - DNA, 498 bp, Myxococcus xanthus
atctaccggctgaccacgatggacggcctcacgcagatctacaaccggcgctacttcgacgagcagctggaccgggagatttcgcggaaccgccgctacgagcggatgctgtcgctggtgctgctggacatcgaccacttcaaggccgtgaacgacaagtacgggcacctggcgggggactcggtgctcaagcagctcgcatccacggtgcgcacgaagatccgccgtgaggacgtgttcgcgcgttacggcggcgaggagttcgccatcctgctgccggaggtgtcgctgtccggcacgcgtcagctcgcggagaaggtgcgccggctggtggagaagcagcgcttcgagttcgaccggcaggtgattcccgtcacggtgtccgtggggctcgcggtgctggagccgcaccaccgcgagccaggtgaactggtgcgcgacgccgacgagaagctcttcgatgcgaaaacgtccggccgcaaccgcgtggtgggctga

SEQ ID NO: 8123 - DNA, 2541 bp, Myxococcus xanthus
atggacatggggcctgacaaccccgtgggtccgttcccacaggtgacttactgctccgtcgatcaggactgcccggacccctcgctcttcttctgtgactcggccacctcgcgctgcgagcccgcctgcctgacgcgcgaggattgcggcgtggcgcggcggggccctcatgcactggccgcgtgtgacgaggtaggcggcgctggctgccaatgcgacatgaaccggtgcgtgcccgttgtctgtgccgccgacacggactgtgactcaggcacggtgtgccgagacggcgcgtgtggctcgccgccgtccgaatcccgcgcggtcgcgtgcgaggtgacgccggatgtcgtcgtgggcaccccgggcatgacggtggacttccgcgtgtgggtgcgcgaatcgacgggcgctccgttggtgttgcgtgacggcgtggcatgggaggtgctgtctccctccgtggtcggaggcgggggcggccaccaggcctctgtcgtgctgagcgagcccgcctcggagcaccaggcgctggcggtccgagtgggcaatgtctcctgccatgcgcgcgtcaccgtgctgcccgccgaagtagccccgggtggggtgcgcgtgctggtggtggatgcgctgaccgggcgcccggtgccgctggccgtcgtcgcggtgtccgccgatgacggcggcctggaagcggcgatggtgacgaacgccgacggagccgtctgggtgcccgcggaaggcgaggtggcgctctccgccttccactccgactacggctacctgacgctggcgcgccacgacgcgagccagttccgcgacgtgcggatggccctgcgccgcaaccccttggaccgcttcggcggcgtgaagggcccattccccacgttgacggagaccttctcgacggcggtttcgctgcgcgtggggctgatggggttgtccgtgcccgggctccccaccgacctggctcccgagtccttcctgggcccggagcacgaggtggcgctccccgtgggcacgggccaggaccgcctgtcgctgccgtcgggcagcgcactgtggttgacgggcagcacggctccagacgtcgcggccccgggcgtggcgggtgtgtgtgacagctcgcttccgggtgtgttggatgcggagctggccattcgcacgggcgcctgtgggacgcggacggcctgggcgctgacgggcgagctccccctgaaggaactccccctcaacctcatggcgccggggacggatccgttgctgcaattggggcagttgttgcccggctcgacgcgcttcttctcggcgctgtcgcgtgacgcccgcttcaccctggcgcccacgcccggcatcctcaccggcgagccggacacccgtgcggcggagtacgcgcaggcgctgcctttcgagcgggaaacgccgggcgtgcggctgtcgttccccttcgccgtgcgcgtaccgccgctgcctcagtaccggggcgcgcacctggaccgcgcctacgtgctggccaccgtggcggtccccggccgaggcatggttccgctggggctgggcgccgcggccaacgtggcgccggccgatccgaacacggacgccgatgcgcggctgggccggcccgggctggtgcccgtgcgcatggcgcccacgcaccggggcctggagggcctgccgtaccggctggtggtgtccgccacatcaggtgaccaggccgaggacggcacggtggcgaccagcacgctcgtggcgaacctgcccaggccggagttcgacccggacggcgtgcagcccgtggacgcggggctgagcttcctctccctaccggagtccgttcgctacaacttcgatggggccccccgcggcgagctcgtcggccgcgagttccaggcccaggtggacgggcgggccagcgtggtgcgcgccgagttcaccaaccgcgccggccgccgctggacggtgttgatggatccggacgatacggacgacggcgtcgtcgttccccggccgccgccagggttcgaggaccgcaccttcgacttcgacggcgtgttgcaggcgacgcgggcgaagctccaggtggaggcgctgcgcgtgcggggcctggaccggcgtgtggggcagggcccgtcccgcctggtggcttcagagggcctgggcgcggagcggctcgcggacctgacggatgccgtcgccacgctgagcgtgggccggccggaggtgacgtggcgccatccggaggcggacgggcagcggctggcccgaggcagcgcggtgcgggtgagcgtctccggcttccggctgggcacgggttccggcggcgaaggccaggtgcgcgtcagcatgcggggcggctcgggttgcaacgaccaggcgctgttcgcctccgcccccattgcaccgggacgcggcgaggtggagttgcagctcccggcgcagtgctcggggctgggcgtgtcgctggtggccaccctggtggacctggagggtgaccccctgcgtccgctcgtcaccgcgacccggcaggtcgacattccctga

SEQ ID NO: 8124 - DNA, 6336 bp, Myxococcus xanthus
gactacatcgcctggctccagagccgggagatttcgcaggcggagacctggtggaagcaagcactgcgaggcttcggcgagcccacgcccctccccggtgaaacgggaggccaggcgcgcaccgctgcgcaggtcatgggcgagcgcaaggtccacgtgtccgccgaggtgacggagcagctccgcgccttctcgcggcggcaccaggtgacgctcagcacgctggtccaggcggcctgggccctggtgctcggacgtcatgcgggccaggacgacgtcgtcttcggcgtcaccgtcgcgggccgaccaccggagcttccgggcgtggaacagatggtgggcctgttcatcaacacactgccggcccgcgtgtcgctgttggcccaaagcaaggtggtggactggctgaaggcgctccaggcgtggcaggtggagcgggctccgttcgagtacgcgcctctggtgaatgtccagggctggagccccgtgccgcgtggcaccccgctcttcgagagcctcgtcgtcttcgagaactaccccgtggaggattcagtgcggcagggcgcgggcgcgctggaggtgcgcgacgtcaccgctcaggagcgcaccaactatccgctgacgctctccgcgcatgcggacaagcagctgatgctgaacctggacttcgagtctcctcgcctcggcgtggaagccatggagcggctgctggagcagatccagacggtcctggtgggcatcctcggcgcggaggacaagcacctgtgggagctgtcgctgctcacgcaggaggcccgtcgcgaggtgctgttcgactggaacgacacgcacgtgcctggactgggcgcgtgcctccacgaactcttcgaggcacaggcccagcggacgccggacgcggtcgccgtggtcgcgccggaggcgggctcgctcacatacgggcagctcgacgcgaaggcgaaccagctcgcgcaccacctgcgctcccggggcatcggccccgaggtgctggtgggcgtgtgcctggagcggacgccggagctgctggtagcgctgctgggcatcctcaaggcgggcggcgcctacgtcccgctcgatcccacctacccagccgagcgactcgcgcgcatggcctccgaggcccggctctccctgctgctcacccagcagtccctcgtggagaccttcgtcaacccggaggtgtcgctctacctgctggacacggaggcaccagcccgcgccgcgctgtccacccaggcccccacgcggctcaccacgctggacggtctggcgtacgtcgtcttcacctccggctccacgggcacgcccaagggcgtgatgatctcccaccggagctggaccaacgcgtacctcggctgggagcggagctatgggctgcgggagcactgccgcagccacctgcagatggccagcttctccttcgacgtgttcgcgggagacctgtcccgagcgctgtgctcgggcggcaagcttgtgctctgcccgcgggagtggctgctcgaaccgccccgcctgctcgcgctgatgaaggagcaggccgtggactgcgccgagttcgtccccgccgtgctgcgcgggctgctccagcacctggaggagacgggccagacgctggacttcatgcgcgtgctcgtggccggctccgacgcctggtacgtgaacgagtaccaccggctccaggccgtcatcggcgacgacacgcggctcatcaactcgtatggcgtcagcgaggcgaccatcgacagcacatggttcgaaagcggcgacctgggccccggcgacacgcaactggtccccattggccgtcccttcgccaacaaccgcctctacgtgctggatgcgcaccagcagccggtgcccgccggcatcgcgggcgagctcttcatcggcggcgagggcgtggcgcgcggctactgccaccgccccgacctgaccgcggagcgcttcgtccccgccccgttcgccaccgagcctggtgcgcggctctaccgcacgggagaccgggcgcggtacctgctgggaggcgacctggagttcctcggccgggcagacacgcaggtgaagctgcgcggcttccgcgtcgagctgggcgaaatcgagtccgcgctcggcaagcacccggccgtccagggcgcggtggtgctgctacgcgaggacccggggacgccccgccgcctcgtcgcctacgtggtgggctcagacatccgcgacacggcggtgctccgcgaccacctgagggagagacttcccgactacatggtgccggccgtcttcgtgcgcctggagtccatccccctgagtccgaacggcaaggtggaccgcaaggccttccctgcgccggacgcaactcagcgcacgggcgagcagcgggtcgtcgaaccgcgctcggagacggaggtgagtctgctcgcgctctggaaggacgtgctgggccaaacgtcgctgggcgtcacggacgacttcttcgacgtgggcgggcactcgctgctggccacgcagatcatctcgcgcaccaacgcgatgttccaggtgacgctgccgctgcgcgccctcttcgagcaccccaccatcgcagggatggcggagcaagtggtgctcgcgcagttggaaggcgtggacgaaaccgcgctggcctccgccatggaggaagtcggcgccctttcggacgcggacctggagaagctcctggaggggacgaatgagtgacctgctcaagaagctcgcgggcctctccccggagaagcgcgaggcggtgctcaagaagctgcgacagcagaacgtggtcgccgcgccgaaggaagaggcacgcacacccggcatcccgcgcgtctcacgggagcagccgctgccgctctccttcccgcagcgccggctctggttcctggaccagttcgagcccgggacacccgcttacaacatcccggagttcgtgcgcctcaccgggccgctccacgtcccctccctggagcgtgcgctgaacgaggtcatccggcgccatgaggtgctgcgcacgaccttcgtcgcgaaggacggcgaaccccagcagcgcatcctcccggagctgacgctgtcgctgggcgtgctggacctgagctacctgccaggccccaagcgcgatcccctgtgcgaggagctggcgattcagctcgcggggacgtccttcgacctcgcggcggggccgctgctccacgcgaggctggtgcgcatgggcgacgaggaccacgtcctcctgctcgtcgtgcaccacatcgtgtcggacggctggtccaccggcatcttcgtccaggagctgacggcgctttatgccgccttcgcccaggacaagccgtcaccgctgccggagctcccgctccagtacgcggacttcgcggcgtggcagcagcagtggatgcagggcgacgtgctggcgtcgcagctcgactactggcgccagcagctcgaagggagcgacagcgcgctcaagctgcccaccgacaggccgcgcccgcgcgtgcgcacctacgcgggtggcaagcagagcttccaggtcgcccctgccgtagcccagcaactgaagacgctggggactcaggagaaggcgtcgctctacatggtgctgctggcggcgatccagacgctgctccaccgctacacgcgcgagccgcgcatcagcgtcggcacgtacatcgcgaaccggaaccggacggaggtggagccgctcatcggcttcttcctcaacacactcgtcatgcgcacggggctcgaaggcaatcccaccttccgggagctgctgcggcgcgtggtggacgtgacgctgggggcttacgggcaccaggacatccccttcgaaaagctgctggaggagctggcgccgtcgcgcgacaccagccactcccccttcttccaggtgatgctggtgctccagaacacgcccacgcccccagccgagctgggcgcgctgcggatggagtctttcagcgtctccggtgaagccttcgcgcagttcgacctgacgctgtggttctccgaggaagccggtggcctgcaaggcatctgggagtacaaccgggacctcttcgacgcctccaccatcgagcggatggtcgcccacttccagacgctgctcgcgggcatcgccgcaaacccggcacagcggctcatcgagctgccggtgcttccggcgaatgagcgtcagcgcatcctgcatgactggaaccaggcccggctcgacgtaccgccgggcacgtgcatccatcacctcatcgaggcgcacgccgcgcgcacacccgatgccatcgccgtcaccgaccccggacgccggctcacctacgcacagttgaacgcgaaggccaatcaactggcgcaccacctgcgttccgtgggcgtggggcccgagcgaatcaccggcgtcttcctggaccgctccgtggacatggtggtcgcggtgctcgccgtgctcaaggcgggcggcgcctacgttccgctggatccgtcgtatccgccggagcgcacggcgctcatgctcgcggacagccggcccgcggtgctcatcactcgccagggcctggcgtccctcctctccgcgccgctgccgcccgtggtggccgtcgacacggacgcggacgccatcgccgcgagacccacgacgacgcccgagggcggcgcgagcccggagcacctcgcctacgtcgtctacacgtctggctccacgggccgccccaagggcgtgatgatttcgcaccagagcttcgccaacgcctacctcgcctgggagcgcgactaccggctgcccgcgctgcgcgcccacctccagatggcaagcttctccttcgacgtattctccggcgacctcgcccgggcgctcggtgcggggaagacgttggtgctttgcccgcgtgaatggctgctcgagcccgaaaagctctacggcttgatgcagcgagagcaggtggacagcggcgagttcgtccccgccgtggtccggctgctgatggggtacctccaggagaacaatctccggctggacttcatgcgcctgctcatcgtcggctcggacacctgggacatgcgcgagtaccaccagctccgcggcctgtgcggaccggacacgcggctggtgagttcctacggcctgagcgaagccaccatcgacagcacgtacttcgaacagcccgagcccacgcccagcgagcagatcgtccccattggccggcccttcgccaacacgcagatgtacctgctggacagcgcgatgcagccggtgcccatcggcatctcgggagaactcttcgtgggcggtgacgggctcgcgcgtggctactggggccagtcgaacctgaccgccgagcgcttcgtgcccaatcccttcagcgccacaccgggcgcccgcctgtaccgtacgggcgacctggcccgctacacggaggacggcaccctcgccttcatcggccgcaacgacacgcaggtgaagattcgcggccatcgcatcgaactggatgaaatcaaggcgaagctgctggagcacttctcggtccaggccgtggagctgctcgtccacgaggacgctggcaacaagcagctcgtcgcctacctcacgctcacgacgccagacgtggccacggccgatgacttgcggcagcacctcaagaagcacctgccgccgtacatggtgcccgcggccttcgtcatcctggccgccttcccgctcacccccaacggcaaggtggaccgcaaggccctgcccgcgccagagagcgtccgccgcgacgcgcaggacggcttcgtcgctccgcgcgacgaggtggagacccggctcgcggccatctgggaggagctgctggcagtgcgccccatcggcgtgcacgacaacttcttcgaccagggcggccattcactgctggccgtccggctgatggtgcgaatccgtgagcaattcggccgcgcccttccgctgtcggtcctcttccagaaccccgcgctggagcagctcgccaaggcgctccacgaagaggcgtcgcccgcgccatggtcgccgctggtgacgctccaaccgggagcaggccgccgcgccctgttctgcgtcccgggcgccggtggaaacgccgtctaccttcgcgagctggcccaggcactgggccccaccctgccggtgcatgccttccaggcacgcgggctggatggacgcgcggagccgcaccgctccgtcgaggagatggccgagtgctacatcgaagcgctcaagcaggtgcaaccgcaggggccataccacctgctgggccactccttcgggagctgggtcgccttcgagatggcgcagcagctccggaagcagggcgagtc

SEQ ID NO: 8125 - DNA, 849 bp, Myxococcus xanthus
atgagggccatcgcccagcgactgttgcggcaggtggttctggtgcctgtcgtggccgtggcgtcgtacttcctcatggcctcgcttccgctgaccacggagacggacgcgaagcggcaggtgtcgcgtgagctcgcggcctcgtaccggagggacttgggcatcggcgagccgctgggcttcctccgcccgtgggagaagctctttcgcggcgagcgtctgggcacgagcgcccagggcatcaccggcgatgagctgctgacgaagctgtctggcagcgtaggcgtgggcttgatggcgctgccactctcgctcacgtgggccctgggctttgccttgcttcggacccggtggaggaagggcccgtgggccgcgctcggtgacgtggtgcccgccgtggcgttcggcacgcccgtcttcatccccgcgctgctgctcgcgcctggcgtggtggagcgtggacacctgctgccggagctgtgcgcggcgctggtaacgtccatctggcccggcatcttcctgggcacgctcgtgggcgactcgctggaggcggagctgtcgcgcgactacgtacgcaccgcgctgggcaagggcctgtcgcgcgccgccgtgctgcgccgtcacgtcctgcccaacgtgtggcccgcgatgctggacgccgtggggccggtggccacgtcgctgctcgccggttccttcgccgcggagcgcgtcctgggcctgccgtacttcggccagctctacgtcctcgacgtgctcaacaagcaggtggccgtcgtcgtcgtcgccaccaccaccttcgcggccctgctcgtcatcgtgagcctcgcggtggaggtgctgcgctac

SEQ ID NO: 8126 - DNA, 642 bp, Myxococcus xanthus
atggcgctgcgcgaagatcagatcctgcgctactcccggcagatcctcctgcgcgaggtgggcggacgtggccaggagtccctgctcgcgggcacggcgcggttggatggcattggcgcgtcggggctgacggcggcggcgtacctggcgggaggtggcacgccggtgacgggcgcgggctcgctgacgctggggccctgggcgccgggcttcctgatggggccttccgacgtgggcctgcccgtgacggaggcgctggcccgcgaggtgcccgcgctgaatccggacgcgggcgcggtggggcaggggggcgggctggtggcggagctgcccgcggcgtggagtggcgaggcgccctgggtggcgctggggggcgacggcatgcgggccgccgttgtcttccgaggccccgaggggtgcctctggtgcttcggcgagacggtgcggcacctgggctcgcccccggatggggcgctgggcgtggccgtggggacgctgggagcgctcgtgtttcagcggctgcggttgggcctgggccccgcgctgggcggccggtggttggtggcacctggaaccgtggaggagatggaaatgcgcaggtgctcgcgctgcgcgggccgtgagccgcccgccgagtcgtga

SEQ ID NO: 8127 - DNA, 1581 bp, Myxococcus xanthus
atgcccaccacgctggattggagccactcggacccggacagctgggcgaactacccggtgatgctggccacccagcgcgggctcacgcagttggggccggaccacggcgtggagccggggctggccgagcggtgggagcgcgtcacggacgggcaggggcgggatgtctacacgttccacctgcggcgggatgttcgctggtcgaatggggcaccactggtggcgcgtgacttcgtcgtgggctggcggcgcgcgctgcagggccgcgagcgcggggagatggcggacctggagggggcctccgaggcgctggcgctccaggagcgaggcgcgccggaggccgaggttcgcgccgcgttggagcgcgtgggcgtggaggctgtggacgcgcacacggttcgggtgacgctggctcggccgcgcagctacttcctggcgcgcgtggccaatgtgtacctgttctatccggcgccctcggcggacctcgaggggaagtcggatgaggaggttcgggactacttcgaccgtccgcgcgatggccgccccctggcgctggggccctaccgcgtcgagcggtgggaccgcgcgggggagcgggtgcggctggtccacaacccggcttcggcctttccgccgcggatggcagaaggggagacgcccgttccggtcatcacgctgatgaagtcggaaatcggtccggcgctgtacgagcgggagcgggtggacttcgtcttcgtggacagcgccgcggcgctgcgcatccaccggccggacgacttgcgccgcgagccgttgctgtccacgtacttcctggccttcaacacggagaaggcgccgctggacaggcccgaggtgcggcgcgcgctgtcccgggcgctggaccgcgaggcgctgctggcgggactgctgcccgcggcgcggccgtctcatgtgttgcttccgccggagctgccaggggccgcgacgccggagcaggccgcgcggctgccgcgctatgcgccggagcaggctcgggcggagctggcgggtgtcgagcggccgttgcggctcgtctaccggtcgggggatggattcgttcccgaggtggccatcgcggagcgggtggccgcgcagctcgcgcgcgtgggggtgcgggtggtgctggaggcgcgctcggatttctcggcggagattgcccggcgctccgcgcaggggcctcgcacgtatgacttgtacctgaggcgcctgggggcggactacgcgcacccgaatacgttcttcacgctgttcgagcgtgagggcaaccaccagacagggtgggagacgcaggcgggcggcgagcccctggcgcgcttcgagcggctgctggaggcgggggacagcgcgccggatgcggcgactgcgcaagcgtcatatgtccaggcgcaggaggtgctcgtgggggaacaggccgtgattgcgcccctgtaccacccggaccgttattaccgcgcgcgctcgcggcttcgcgggctggacgtggaccccttcaacttcctggcgctgcgcgcgcttcgcttgggggcggcgtcggatgcgccttgggcgggggagtcgccgtga

SEQ ID NO: 8128 - DNA, 2455 bp, Myxococcus xanthus
atgttcttcggacgtgacgacaagaaggaagcccagaagcggggtttgacggtcccgctcttgccccttcgggacatcatcgtgttcccgcacatggtggtgccgttgttcgtcggccgggagaagtccatcgcggcgttgaaggacgcgatggcgcacaaggggccggacgacaaggccgtcatcctgctggccgcgcagaagaaggccaagacgaacgaccctacccccgacgacatctttcacttcggtacgctgggccacgtcatccagctcctcccgctgcccgacggcacggtgaaggtgctggtggaaggcgtgcgccgcgccaaggtgaagaagttccaccccaacgacgccttcttcatggtcgaggtggaggaggtggaggagcagacggagaagacggtggagctggaggcgctcgttcgcagcgtccactccgtcttcgaggccttcgtcaagctcaacaagcgcatcccgcctgagatgctgatgcaggtggccagcatcgacgacccggcgcggctggccgacaccatcgtcgcgcacctctccctgaagctgaacgacaagcaggccctgctcgagacggagtccccggccaagcgcctggagaagctctacgagctgatgcagggtgagatcgagattctccaggtggagaagaagatccgcacgcgcgtcaagaagcagatggagaagacccagaaggagtactacctgaatgagcagatgcaggccattcagaaggagctgggtgagcgcgacgagttcaagaacgagattcaggagattgaagagaagctgaagaacaagcggatgagcaaggaggccacgctcaaggtcaagaaggagctgaagaagctccggatgatgagcccgatgagcgccgaggccaccgtcgtccgcaactacatcgactggatcatcagcctcccctggtacgacgagacgcaggaccgtctggacgtcactgaggcggagacggtgctcaacgaggaccactacggcttgaagaagccgaaggagcgcatcctcgagtacctggccgtgcagcaactggtgaagaagctcaagggccccgtgctgtgcttcgtcggtcctccgggcgtcggcaagacgtcgctggcgcgctccattgctcgggccaccggccgcaagttcgtgcgcctgtcgctgggcggcgttcgtgacgaggcggagattcgtggccaccggcgcacgtacatcggcgcgatgccgggcaagctcatccagtcgctgaagaaggcgggcagcaacaaccccgtcttcctgctcgatgaaatcgacaagatgtccacggacttccgtggcgatccgagcgcggcgctgctggaggtgctggaccccgagcagaaccacaccttcaacgaccactacctggacctcgactacgacctgtccaaggtgatgttcatctgcaccgcgaacacgatgcacaacatccccggtccgctgcaggaccgcatggaagtgattcgcatcgcggggtacacggagccggagaagctctccatcgcccgccgatacctcatcccgaaggagcaggaggccaacgggctgtcggacctcaaggtggacatctccgacccggcgctgcggaccatcatccaccgctacacgcgggagtcgggcgtgcgctcgctcgagcgtgagattggcggcgtgttccgcaagattgcccgcgacgtgctgaagaacggcaagcgggacatcgacgtggaccggaagatggccatgaagttcctgggcacgccccgctaccgttacggcatggcggaggccgaggatcaggtgggcatcgtcacgggcctggcgtggacggagctgggcggtgaaatcctcaccaccgaggccaccatcatgccgggcaagggcaagctcatcatcactggcaagctgggtgaggtgatgcaggagtccgcgcaggcggccatgtcctacgtgcgcagccgcgccgagcgcttcggcatcgaccgcaaggtgttcgagaactacgacatgcacgtgcacttgccggagggcgcgattccgaaggacgggtccgtccgccggcgtcaccatctgcaccgcactggtgagcgcgctcacccgcgtgctcatccgccgcgacgtggcgatgacgggtgaaatcaccctgcgtgggcgggtgctccccattggcggcttgaaggagaagacgctggccgcgcaccgggcgggcatcaagacggtcctcatcccgaaggcgaacaagaaggacctgaaggacatcccgctgaagattcgcaagcagctgcgcatcgtcccggtggagttcgtggacgacgtgctgcgcgaggcgctggtgctggagaagccggaggagttcggccgcaagccgacgacggacggcggcaagctgggtggcaccacggagctgccggcctcgccggccgtggccccggcctag

SEQ ID NO: 8129 - DNA, 2166 bp, Myxococcus xanthus
atgtcgctcgcggcgtgtgcctcccagaaggaggccgcgcgtgatgagctgcccgcggcagcctccgcggcccccgtatccgaggagtctccccgcatgtcctacccggcgacccgggcggagcaggttgtcgacacgttgcacggcgtccaggtagcggacccgtatcgctggctcgaggacgagaaggcccccgaggtccagacgtggatgacggcgcagaacgcgcacgcccgcgaagcgctggcgaagttccccggccgtgaggccctggccgcgcgcttcaaggagctgttctacaccgactccgtctccaccccgtcgcgccgcaacgggcgcttcttctacgtccgcacccacaaggacaaggagaaggccatcctctactggcgccagggggagagcgggcaggagaaggtgctgttggatccgaacggctggagcaaggacggcaccgtgtccctggggacgtgggccgtgtcctgggacggcaagaaggtggccttcgcccagaagcccaacgccgcggatgagccggtgctgcacgtcatcgacgtggactctggcgagtggtccaaggtggacgtcatcgagggcggcaagtacgccacgcccaagtggacgcccgacagcaagggcttctattacgagtggctgcccacggacccgtccatcaaggtggacgagcgccccggctacaccaccatccgctaccacacgctgggcacggagccgtcgaaggacaccgtggtgcacgagcgcaccggcgacccgacgacgttcctccagagcgacctgagccgcgacggcaagtacctgttcgtctacatcctccgcggctggagcgagaacgacgtctactggaagcggccgggtgagaaggacttccgcctgctggtgaagggcgtgggcgccaagtacgaggtgcacgcctggaaggaccgcttctacgtcctcaccgacgagggcgccccgcgccagcgcgtcttcgaggtggatccggcgaagccggcccgcgcgtcgtggaaggagattgtccccgaggactcgtccgcgtccctgctgtccgtcagcatcgtcggcgggcacctgtcgctggagtacctcaaggacgcgacgtccgaggtgcgcgtggccacgctgaagggcaagccggtgcgcacggtgcagctgccgggcgtgggcgcggcgtccaacctgatggggctggaggacctggatgacgcctactacgtcttcacgtccttcaccacgccccgtcaaatctacaagacgtccgtcagcaccgggaagtctgagctctgggccaaggtggacgtgcccatgaacccggagcagtaccaggtcgagcaggtcttctacgcgtccaaggacgggacgaaggtgcccatgttcgtggtgcaccgcaaggacctgaagcgtgacggcaacgcgcccacgctgctctacggctacggcggcttcaacgtgaacatggaggccaacttccgctcgagcatcctgccctggctggacgcgggcggcgtgtacgcggtggccaacctgcgcggcggcggcgagtacggcaaggcctggcacgacgccggccgcctggacaagaagcagaacgtcttcgacgacttccacgcggcggccgagtacttggtccagcagaagtacacgcagcccaagcggctggccatctacggcggcagcaacggcggcctgctggtgggcgcggccatgacgcagcggccggagctgtacggcgcggtggtgtgcgcggtgcccctgctggacatggtgcgctaccacctcttcggcagcggccggacctggattccggagtacggcacggcggagaagcccgaggacttcaagacgctgcacgcctactcgccctaccaccacgtgcggccggacgtgcgctaccccgcgctgctgatgatggcggcggaccacgacgaccgggtggaccccatgcacgcccgcaagttcgtggcggcggtgcagaactcgcccggaaacccggcgacggccctgctgcgcatcgaggccaacgcgggccacggtggcgcggatcaggtggccaaggccattgagtccagcgtggacctgtattcgttcctgttccaagtcctggatgtccagggggcacagggtggggtggcggcgcagggccgctga

SEQ ID NO: 8130 - DNA, 546 bp, Myxococcus xanthus
atctgcggcggcgccttcggcgggctggaccaggtgattgagcggcgcatgggcggtcgcagcctgggctttggcgcggacgtgcagtccaagaagcaacgcagcctcacggagctgctcaagcacgtggagccggaggacctgctgaagttcggcatgattccggagttcatcggccgcctgcccatcatcaccgcgctggaggaactggatgaggctgccctcatcaacatcctcaaccagccgaagaacgcgctcaccaagcagtaccgcaagctcttcgaactggacggcgtgacgctgaagttcaccgacggcgccctcaaggccattgccaacgaggccatccgccgcaaggcgggcgcccgtggcctgcgctccatcctggagtcggccatgctggacgtgatgtacgaaatcccgtcccgcaagacggcccgcgaggtgctcatctccgaggaagtgattctcaagaagagcgagccggtggtgctgcacgcccagccggagaaggaagccgcggagccgaagaaggaatccgcctga

SEQ ID NO: 8131 - DNA, 1104 bp, Myxococcus xanthus
atgaccgaggaccaggacgccatggcccgacagcgcgtgctggagaaacaactcaccgaggtagacaccgaactggagaaactccgaaccgcctccgaacaacgagagcgccacgtcgaggtgcgactctcctgtccccaaggcacccgggcccgcgtggcgctgacgtacctgatggggaacgccagttggacgccctcctacgaggctcgtgcgaacgacagtacccggacggtggaattgacgacgctggccacggtgcgccaatccaccggagaggactggtcggacgcgaagctggtgctgtccaccgcgcagccgcagcgggacgccacccttccagaaatccagccgctgtatgtcctggcggaagaacggccgaaggagcgtcaggtgctggtgcgccgcgacgagcagccacagcacgccaacgctggcggcacccccacggcgacggtcacgaagggactcgaagccatcccccaggggctgtccgtgcagttcgcggcacaggcgcgcgtgagcatccccggcgatggcaatgccgtgcggatacaggtggcacgaacccgattcaaagccgcgttcaactggcgcaccatccccaagctacaccccgtcgtcttccgcgtggcccgcttgaacaacgccgccgcgttcccgctgctgccaggtgatgtggacctctatcgtggcgcgggcttcatcggccgccagtcactggagcacgtggcgcaaggtgcccccttcgagctgaccttcggcgtggaagaaggcctgcgcgtggagcgccgcgtggtggaggaactccagcgccccaagggcctgttcaaggacacgcagcggttccgctacgcctaccagttcacgctgaacaacctccgcgggcacccggaagaagtggagatctccgagcactttcccgtgtccgaactgcaggacgtgaaggtggcgatggagccagagacgacggccggctacacgctccagtccagcgacggcatcgcaacctggaaggtgacgctggccccgggtgagaagcgcaccctggacttcgccttccacgtcgacgtcccctccagctacgaaacgaaggggctctga

SEQ ID NO: 8132 - DNA, 1140 bp, Myxococcus xanthus
atggtggaccccgccgtggaccccggcctgcttcattcgtacacgccggtgctcatcggcaaccggctgggcgccatcgaaatcaccgagtcgctgggcgaacagcagaagtacgtcaacaccgtggtcatgggcaccttcgccgccaccgccgccatggccatcggcttcatcgtggccgccatggccatgggccgccggctggtgggcgagccggtggaccagctcgtgtccctggcccaccgcatcggcgagggcgacctcaccgcccgtgtgccgctcccgcagcgccgcggcgacgagctcaccacgctggccggcgccatgaaccgcatgggcgagcaactggaggagacgcgctcgcgcctcgccacggagacggccgcgcgcctgtccgccgtggaccacctgcgtcacgcggaccggctcaccaccgtgggcaagctggcctccggcgtggcgcatgagctgggcaccccgctcaacgtcgtcatgggccgggcgaagatgatctcctccggcgaggcggagggcgaggaagtgggcgagtgcgcgcaaatcatctcgcagcaggcccagcacatgacggccatcatccgtcagctcctcgacttcgcgcggcggaggaagccgcaccgcgcgccggaagacgtgcagggcctggtcgaacgcaccctgtcgctgctgcgctccatggcggcgcgaaacagcgtcacgctggagacggacatccccgcgggactcacggtggaggtggacgcgggccaggtgcagcaggtgctcaccaacctggtgatgaacggtgtgcaggccatgaagcagccgggcacggtgcgcgtgcgcgcggcccacacccggagcaccccgcccccggacgtgggcggacccgaggcggacttcgtgcgcctggacgtggaggacgagggccagggaattcccgaggacgtgctggcccatctcttcgagcccttcttcaccaccaaggacgtgggagagggcaccggactgggcctgtctgtttcctatgggctcatgttggagcatgacggctggattgccgtgcgcagcgagcccggacgcggtagctgcttctccatctacctgccaaggggtgaagacacatgccaggccgcgtcctag

SEQ ID NO: 8133 - DNA, 1320 bp, Myxococcus xanthus
atgttggagaaggggctcacgcgccggggcttcacgcccgtggcgctcccgtctgcggacgaggccctggtgcggctggccgccgaggacttcgacgtggtgctcaccgacctgcgcatgcccggcatggacgggctggcgctgtgcgagcgcatcgccctcaaccgcccggacatccccgtggtggtggtgacggccttcggcagcctggagacggcggtggccgccatccgcgccggcgcgtacgacttcgtcaccaagcccatcgacgtggacgcgctggtgctggtgctggagcgcgccgtgcagcaccgcgccctgcgtgaagaggtgcgcaggctgcgccaggagctgggccggcgcgaggacagtggcactgtggtgggtgagagccccgccatgaagcaggcctacgcgctcatcgaccgcgtggcggacctggactccacggtgctgattaccggcgagagcggcaccggcaaggaggtggcggcccgcgccgtccacacgcgcgggcgccgcaaggacgggcccttcgtcgccatcaactgcgcggccatgccggagaccctgttgcagagcgagctgttcggccacgccaagggcgccttcaccgacgccaaggccgcccgcaccggcctgttcgtccaggccaacggcggcaccctcttcctggacgaggtgggcgagctgcccctcacgctccagcacaagctgctgcgcgccctgcaggagcgcacggtgcgcccggtgggcggagacacggagctgcccttcgacgcgcgcatcgtcgccgccaccaaccgcgacctggagctggccgtggaggaggaccgcttccgcgaggacctctactaccggctcaacgtcatcggcgtggagctgccgccgctgcgcgcgcgcggcaacgacgtgctggccctgtcccagcgcttcatcgagcagttcgcctcgcgcaccgggaagcgggtgctgggcctgtcccccgcggcggcccagcggctgctcgcctacggctggccgggcaacgtgcgcgagctgcagaactgcctggagcgcgcggtggcgctcacctccttcgaggaaatcaccgtggacgacctgcccgagcgcgtccgcaactacagccagccgcgcgtggtgccggagacgcaagacgcctcggagctggtgacgctggagcagttggagcggcgctacatccaccgcgttctggaggcggtgggcggaagccgcacgctggcggcgcgcatcctcggggtggaccgcaagacgctgtaccgcaagctggagcgcgacgacgacacgcgcaagggctga

SEQ ID NO: 8134 - DNA, 801 bp, Myxococcus xanthus
atgcggattccatcctcgctgctgtccttgctcgcgctgggcgcggcgtgccattgcagccccacgaaccggccggtgccggatgcgggaggcagcgtgcaggaacccgtgcggcgcgtggcgcacatcatccgtgagtatccccacgcgacgaatgccttcacccagggactggtattccaccaggggcacctcttcgagagcaccgggcaccaggggacgctgcggcaactgtcgctggagagcgcgcagccggtgtggatggagcgtctggggaacatcttcgcggagggcctggccagcgacggcgagcgcctgtaccagctcacctggaccgaaggcctgctcttcacctggagcggcatgccgccgcagcgcgagcggaccacgcgctactcgggggagggctggggcctctgctactggaacgggaagctggtgcgcagcgatggcggcaccatgctcaccttccacgagcccgacggcttcgccctggtgggcgcggtgcaggtgaagctgcgcggccagcccgtggagctcatcaacgagctggagtgcgccaacggcgtcatctacgccaacatctggcacagctcggacgtactggaaatcgaccccgccacgggcacggtggtgggcgtcatcgacgcgtcggcgctgacgcgcgcggtggcggggcaggtgaccaatcccgaggcggtgctcaacggcatcgccgtggagccgggctcgggccgcatcttcatgacgggcaagctgtggccccgcctcttcgaggtgcgtctggacgtggtggactga

SEQ ID NO: 8135 - DNA, 471 bp, Myxococcus xanthus
atggggccagacgaattcacggcggtcagcgacgaggtgcgggagtggccgctgtcgacgcgtgagtgggtgtcgcgccgcagcgctccgcgcatcctcctgggggaggaccaacccgagatgcgcagcctgctgcgtcgggcgctgtcccggcgcgggtatgacgtcgtggaggccccggacggtccgggactggtcaaggcgctggtggacggattgctcgcgcagcagacgcaggtccccgacctcatcgtcaccgacgtgcgcatgcccggcttttcgggcatcgaggtgctggcccgcctgcgccgcgagggctggacgacgcctgtcatcctcatcaccgccttcggcgatgcgcagctccaccaggaagcggagctgctcggcgcggcgcgcgtgctcaacaagcccttcgccatggaggatttgtgcgaggcggtggagatgctggtaccgccgccgcgctga

SEQ ID NO: 8136 - DNA, 267 bp, Myxococcus xanthus
acccttcgtattcctactccgatgcggggcttcactggcaatcaggcggaagtcgcggctcccggcgccaccgtgggtgaggtgctgaagaacctggacgcgcgccacccgggcattggcggccgggtgttcgacgagcgcggcgcggtgcggcgctacgtcaacgtgttcctcaacgacgaggacatccgcgcgctgaacgggttggacacgccggtgaaggacgctgaccgcatcaccctcatccccgccatggcggggggctga

SEQ ID NO: 8137 - DNA, 261 bp, Myxococcus xanthus
gctctcagggtcgccgacgcgagcattgcgctctcctcgcagggacccaccatcatgattccccggacggcgctggtggagagcggaatgggcacctacgtcctgcgggtgcaggatggcgcggcgaagcgcgtgcctgtctcacgcggcatgcgtgccggcgagaaggtcgaggtattcggcgcgattgagactggagacgtgctcgtgttgaaggcgtcggaggagatgaaggacggaatggccgttgccggcggctga

SEQ ID NO: 8138 - DNA, 285 bp, Myxococcus xanthus
atgaagacgaagctcgccgcggtgacactggttgcatccctgctcgcgtcgtccgccgcgtgggccgcggtgacggtgcgctattacaaccgcgattcgcgcgaccactcgtggtccgtggtgtgtagcggcgtgaagacgtcggtgacgttcggcaagagccagacggcctccgtcaccatccagggctccgggccctgctccgtgaagacggacgcgggaaccgtggtcctcaagggcggtgaagacctggaaatcaaggacgggcgcatcctggtgaagtga

SEQ ID NO: 8139 - DNA, 1392 bp, Myxococcus xanthus
atgaagaagtggttcgcgatggcccttctcgtgggtgtgggtgtgacggggttgctggtcgaaccggcggcgcagttgaagcaaggggggcccatcgacacctcggacacggcgtggatcctcacagccacggcgctggtcctgctgatgacgccgggactgtccttcttctacggcggcatggtgcggctgaagaacgtggtgtccacgctgctgcagagcttcatcgccatggcggtcatcagcctgatctgggtggtggtgggcttcagcctgtgcttcggcgacagcttccatgggctcatcggcgacccgcgaaccttcttcatgttcagcggcgtgggcggtgagacgcacccggacctggcacccaccatccccttgatgctgttcgcgctgttccagctcaagttcgccatcatcaccccggcgctcatcaccggcgcgttcgcggagcgcgtgcgcttcaaggcgtacgtgctcttcatggtgctcttcacgctcgtcatctacgcgccgctggcgcactggacgtggcacccggagggcttcctccgtcagtggggcgtgctcgacttcgcgggcggcacggtggtgcacatgtccgcgggcttcgcggcgctggctggcgcgctggtgctgggccgccgcaaggtgcacgtggagaacacgacgcacgcgcccgccaacatccccttcgtgatgctgggcacgggcatgctgtggttcggctggttcggcttcaacgcgggctcggcgatgtcggcctcgtcgctggccacgctggccttcgccaccaccaacacggcgtccgcggcggcgatgctgggatggattgccttcgactggctgcgcggccgcaagcccagcgccatgggcgcgtgcatcggcgcggtggtgggcctggtcgcggtgacgcccgcggccggcttcatcaccgtggggcagagcatcttcgtgggtctggtcgccagcttcgtgagcaacgcggcggtgcacttcaagaaccgcacccccgttgatgacacgctggacgtcttcccctgccacggactgggcggcgtggtgggcatggtgctgacgggcgtgctggccaaggacgtgggcctcatccacggcgagacgcgcaccttcatgatgcacatgctggcgctggtgctggtgtcggtgttctccttcgccggctcgttcctgctctacaagttggtggaccgcatcgtcccgctgcgcgtcacccgcgagcacgaggaagaaggcctggacctgagccagcacggcgagacggtgggcgagtccatcatcgcggccgcgccacagcccgcgctcaccgcgacgacggcggtcgccaccgagccagcgccggacgcatcccgcctgcctcagccagcctga

SEQ ID NO: 8140 - DNA, 1974 bp, Myxococcus xanthus
ctgcggaatacgtacaggattgtctccctactgggacggggaggaatgggctcggtgtacctggcccaacacctgcggcttcccggcaagcaggtcgcggtcaaggtgctgcgtggcggcgaccacctgacgcccgaaatcttcgcgcgcttccgccgggaggcggagattgcctcgcggctgggccaccccaacatcgtcgaggtgctcgactacgacaccctggagaacggcaacccgttcctggtgctggagtacctgcgcggtgagagcctccaggagcgcctggcgcgcggacgcctgcccatggaggacgtggtctccttcacccggcagatgggctcggcgctccaggcggcgcacggcgcgggcgtcatccaccgcgacctcaagccagccaacgtgttcctggtgcccaccgactccggtggcgtggtgggcgagcgcgtgaagctgctcgacttcggcatctccaaggtcctcagctccacgacggtgcagacgcaggaggcgaccatcatcgggacgcctcagtacatgtcaccggagcaggcccaggggaagaaccgggacatcgacgcgcgcacggatgtcttcgcgctggggtgcatcgtctacgagatgatggccggcaaacccgtgttcggctcaggcagcctcgcccagatgatcttccgcgtcgtctatgagccgcccgaaccgctggccccgctctgtcccgaggccacgccggaggccatctccgcggtgatgcgcgcgctcgccaagggcgtggacgagcgctacccggacgtctcctccttcatcgaggacttgacgggcacgccgctgcactcgctgtccaccacggcgggcaatcagcccgccccgcgcccccaggccccggcgtccggaatcgcgctgccctccacggacccggcctcactctccgccaccgtcccgcccggaagcctgaaggtggcaccggacacgggccgcgagggcttcgattccacgatggcgcccggcaccggccagcagggcttcagtccatccaccacggggcagatgggcgtggcgcaggcgcagggcttcagtccatccgccacggggcagatgggcgtggcgcagttgtccgccgcatcgctcatcgacccgcctggcctggagcccacgctcatctcaaagcagcttccggccattcccgtgccggaacgccccgctcagcaccacacggccgtgagcgttcccgtgcccatcccgggcgccgccgaggccgatgccgccgccgcgctggtgtccgctccgtccacgccggtctcgccgccccctgcggcaaaggggcgcggtgcattcatcggcgccaccgcggcggtcctgctggcatccagcgtgggactcgtctggtggatgaagggtgggacctccggcacgggctcgcccacgacgcccgtggcagacgcccgcgcgccccaggacgcgcggcaggccaacggtgcgcagcagaccaacggccagcaggccaacggcacgcaggcaaacggcacgcaggcaaacggcacgcagcagacaaacggcactgagcaggccaacggcactgagcaggccaacggcactgagcaggccaacggcacgcagactccgccggacacagagaacccgcagcaggtggtggtggccactgtcaccccgcccgacaagccgacctctcgcccggtgacgcgtcccgagcccaaggaagaacttcccgagcaggtccgcaagctgttgaaggaaggagaaagcgcgttggcctcgggtgacgccagccgagccatcgcgctggcacgcagcagccagcgcacgaagcgctccatcgcggcgtattcgctgctcacccgcgcatactgccagcagaaggacctgggcggtgcggtcagcgagtggcccaaggtcgcgtcagcggagcgtgccaaggtcaagaagttctgccagaagcacgacatcgagctctga

SEQ ID NO: 8141 - DNA, 804 bp, Myxococcus xanthus
atggtcgcagtgattgtcacggcagtcgcgctgggggcgtcgcaggccctggccgccgcgccggtggaagctggcaaggtgtactccggtacggagggcgaagaggtggccgtggtgccgctcacgccccgttccgacaagaagttcatcctgcgcgtgaagggcacgggctcggagttcgacggcctggtgttcccctacgagcagaacgactggagcacccgcagcaccgagcagttcaactacagcacccagtggcacggccggaagtacacggccctgcacgtacgcgacacgaagtacgagctctacgtgcccggccgccagcgccccatccgcctggcctatgacgagaagaagaccgccgcgctgaagccggaggaggtctacgcgctgcaccagaagcagatgaaggacggcaccctggcgaagctgatggccttcgaccgcaagggcgaggagtccggccacaacaaggaatttgccgccaccctccaggagatgaacaacgcgtgtggcacgtccgtggccgcccgcatcgactggagcagcatcaacgaggaccagctcaaggagctgagcatctccagcttctgtggcaccccgctgaccagcctcaaggagctgtgcaccgcgtccgccatcgcgaagcagaccatccaggagaaggtgaagcaggtcagctgccgcttcggctccgcgttggaacccaagattgaagcggaccgcgtcatctggacgacctcccgcgacgcctccaatcaggacaagttcgccaccaagtacttcaagcagaacctgtag

SEQ ID NO: 8142 - DNA, 202 bp, Myxococcus xanthus
atggcggccgagcccatccagcccccctggggcaaggagtccaacctcggcgagaagatgatgttggaggccacgtcggtgtgcaccgacggcaagggccacttcgtggcgctcacgcccgacgacgaggacaccaacgccgtcctctactacggcgatgagaagcagttcgtccaggtgcctcgccccgggccctacacgt

SEQ ID NO: 8143 - DNA, 381 bp, Myxococcus xanthus
atgcggccgctctttgtggaggagctggcggtgcacccggactaccaggggcggggcgtgggcagcttcatgttggatcagctccagcacctggcccggacgcggggctgtacgcacctggtcctggaggtggcggagaacaacgagtccgccctgacgtggtaccggacgcggagcttctacaagctggatgccgccatcttcatggcgcagaaggtgcccggcgaaccggacctgctgccgccgcgccggttgaagcgccggcagaagcccaccgtggagacggggacgccctcgacgggccccatgccggaaaccgcgcccacccgggccgcggcacgcaaggggcgcgcgcccgcggcgaggaagaagagcagctga

SEQ ID NO: 8144 - DNA, 3537 bp, Myxococcus xanthus
gagcgcgtccccggccgggacttccccgccatcggcttccgctgggaggacttgccggagacgccgcacgagggcgcgggtgtgctccgactcgaatcggcgcgcgcctacgctgatcaatccaagctgtgcctctgctgcatgcggacgcggtccgcgctcacgctcgaacttcagtacgatcgaagcctcttcccactcgctgctgctgaacaagtgcttgggcagctcgaggcgctcctggagcagatcgccggctcaccgcgggcgcggttggatggcttggatgcggtgagcccacgcgagcgggcacggttgctggtggacttcaacgccacggaccgggagcacccggcgcgctgcgtccacacttggatggaagaacaggcctcacgccatccggaccgggtggcactcgtctacgaggagtgcacgctcacctacgcgcagctcgacgcgagggccaaccgggtggcgcacgcactccgccgccggggcgtgggtccggagatgcgtgtggggctgtacctcaaccgctcgctcgaaatcatggtgggaatcctggccgtcctgaagtctggcgcggcctacgtcccgctcgatccgggccaacccaggcaacggctcgccgggttgctcgacgacatccaggcgaaggtcctcctcacccagagacggttgcgcgaaaccgtccccgaggccgaggaccgcgaggtgctgtgcctcgacgaagagtccacgttcgccggagaacccaccagtgccccgcactgcggagcccttccggagcaccccgcgtacgtcctcttcacctccggctccaccggccggcccaagggcgtcgtcgtcgagcaccggcaactccacaactatgttgcgagcgtgatggagcggctggacctgcccgaaggcgctgcctacgccaccgtctccaccttctcggcggacctcggcaataccgtcatcttccccgcgctctgtctcggcggaaccctgcacgtcatctccgccgagcgcgtgtcggatccggcggccttcgtggagtacctccagcgcaacccgattgacgtgctcaagattgtgcccagccacctgcgcgcgctcgcgagcgctggcacggccggggcgcttctcccgcggcagcggctcatccttggcggcgaggcgacgcccctcgcgtgggccgaagaactgcaagcccaggcgcccgggtgccgtatctacaaccactacgggcccacggagacgacggtgggcgtgatgacgttccggctggagccgtcgcggcccttcgccgcgaacaacaccctcccgctcgagcgccccatcgacaacacccaggtctacgtgctcgacgcaaggctgcggccagtggcggtgggcatgaccggcgaactctacgtcggtggtgccgcgctcgcccgagggtacctgaaccgtccagacctgaccgcgcagtccttcctccccaatcccttcagcaccacgcctggcgcgaggatgtaccgaacaggggatctcgcccgccacctgcccgacggcaccctggagcacctcggccgggcggacaaccaggtgaagtaccacggctaccgcatcgagctgaacgagctgcgccacgcgctcaatcagcaccctcaggtgcgcgacagcgtgatgatgctgaaacgggacacgaacggtaacgaggtgctcgtcgcctactacgtctcgcgccaggagcaggagcacgctcaactccgagccttcctcgcggagcggctcatcgaggaggtgctcccgaacgtctacgtccatctgaagaagctgccgctcaccctgaatgggaaggtcaaccacgaggccctcccttccctggacgaggcgcggcggaggcaacgcagccaactcgtcgccccccggacgcccgtggaagccaccctggcggacatctggtgccaggtcctgaacctgaaggaggtgtcggtcaccgacaacttcttcagcgtcggcggggactcgatcctggggatcctcgtcgtttcgaaagccgaccaggcggggctcaagctgaccccgcggcagctcttcaagcaccagacaatcgccgagctggccagcgtcgcggcccaggcacctgcctctcccgacgccgaggggccggtgaccggccccctgccgctgacccagatccagcgctggttcctggagcaggaagtgccggacctggatggctggggcattgtcgtaccactcgaagcgcggcaacccctggacccgtccaggctccagcaggcattgaccgcgctgctgaatcaccacgacgtgctcaggctccgggtgacgcgcaatggctccggctgggaagccctcgtggccccgcctggcgcaccgatgccgttcactcggattgacctcgcatcggtccctgacgccttgctcaaggagcgattccaagcgctcgggcatgaactccaggcgaagctccggttggacgggggccccgtggtgacgaccgccctgctcgaactgggcccccaccgcccaagccggctgatgatcgccgcgcaccggctcgtggtggacggcgtttcctggcgcgtcctcttcgaacagctccagctcgcctatgagcagctcggaggaggcggcgaatgcaagctgccgcccaggaccacctcggtccgcgcatggctcgagcgcctccagggctacgcggaatcgccccggctgcgggaggaactcgcgcactggaccgctcagggaaaagagcaaccccggccgcttccagtggagcgcccggggcccctggttcccacgagcctggagcgagaactcacacacgccctgtcgtctgaagagagtcggctcctgctcaacgagctgcccgaggcgtaccggtgtgaaattggtgagctgctgatcgccaccctggcctggaccctgcacgagtggacgggtcatccggaagtgctgctcgacatcgaagggcacgggcgcgaggacgtcttcgaggacgtcgatctctcccggacggtgggctggctcacctcgctgtacccggtacggctcacgccggaacgggtggggcccagcgccaccgtgcggacggtgaaggagcagctccggtccgtgccgaaccggggcctgggctacggggtgctgcgctacctctcacccgacgcggagcttcgcgcccggttggcgcgagcgccccaggccgaggtgctcttccggtacgtggggcagtaccacctcgcgggtccgtggttcaccgtgctggaccacccggagcaacgggcgcccacgcgccagcacaagctggcggtgattgcccgcgtggcggacggtcagctccatgtcacctggtacttcagcagcgacatgcatgagaccgccaccgtggatcggctctctgctcggtacctggacacgctccggacgttgctcgcggagcgaggggttcccgagcggcaggtcctcgcgccttcagacttcccactggccgggttggaccagtcgaagttggacaagctcctgggcaagctcaagaagtag

SEQ ID NO: 8145 - DNA, 2223 bp, Myxococcus xanthus
ccccgcaccgcggacgcgccttccaccgagttctccgaagagcgtgcccagcgcgtcatgcggcacctggcagatggcatcggtcggcgcatccccggcacccccgcccaccgggaggccgccacctacctggccagcgtgctgcgcgagcttccgcgcctcgaggtcgagattcaggaggcggaggggcactatctcgatgacgacaccctcgtcgcctacaccgtccggaacgtggtggcccgcttgccgggacgcaggccggacgcggtgctcctctcggcccattacgacacctctcctgagggcgccggagcggcggacgacgcgctcggaatcgccgcgatggttgaggtcgcgcgcgcactcgcgaacggaccggagctcgagaacacggtcctcttcaacctcaatggggccgaggagtatggcctgctcggcgcggccggtttcatgcagcaccggtgggcgagccaggtccgcaccttcctgaacctcgaagccactgggctgggcggccgggccatcctcttccaggccgggccggacgcatcctggctcctggaggcctatgcccgggccgtgccccaaccgttcggcgacgtgctgggccaggacctcttccagtatcgactggttccggcgggcaccgacggccacgtgtaccgcagcgcgggcatctccggattggatctcgccctcttccgggacggctatgcggtgcactccccgttggatcgacccgagcgggtagaacccggaagccttcagcacatgggcgagagcgcgctggcagtgacacgcgagctcgccacacggccattcccggacgggaaaggctcgggcccgtccatctactacgacgtgctggggcgctggatgctccagtacggcgcccacgcggcgtgggcatgggccgcggccgccgcgctgctggtggccggcgccaccgtcctcgccacacggcggaaactcgtccgcctgtccgtggccgccgaggggctcggcttctgtacgctttcgctcgcggtggcgctggtggtgccggttgccttcggcttcctgccccactacgcattcgaacgcccacatggctggtacgcctcgccgtggctggccgtcgcgaccttcggcacgctcgctgtgacgggggcgctgctcccccgcgcgctgtgggcgcaaaggctggctgcccggggcgtggctccccaggagcgagtgttcacggcctggctcggagggctctggctgtgggtgctgacacttggcgcgttgcagctcctggggcttggcaccgcctacctggcgctgtggtggaccgtgggcggcgcgctcgggctcatcgccgccaccttcctcgcctcgcctcgcgctcggatgatggccctgtatgcgagctgggtgccgggcttgctgctgaccgtgcagatggggcgctccctgctggagctcttcgtcccggtggcgggccaccttcggctgggggtaccactcgatccactcgtggccctgctggcggcgctgccggtggccatggcgtccgtgctcggccttgcccccgtccaggagcagtctcgcttcggcccatcggccgcggccttcgccacggcgagcgtggccttcctggccgcgctgctcctgcgcttcccgtacacacacgaacggcccaagcggctctggctggagcaccgccttcaagagggccgcagtgagctgcagtactcgagctgggactttcccgatccgcgcgccgcgctctccgggcagcccgggcccctccagacggccgcgcggatgccgggctttcgcggtggttacaccgcgccagtgccgcccgcgaacctgcctgcaccccaggtcgacgtgctcgaatcacaggacgacgaaaccaccgcgctccgaaccgtgcggctgcgcctccaattgggcgcggcatacctcggccgggtgcggattccgcgggctgccctcgtgggatggtcgctcccggcccccctcccgccgctggcgcccgaggactcggtctatgtcctcgacgtgctcgcaccgccaggagggcactacgaggtctcgctgcgtctgagaggccaggaggaggtgccggtggacgtacaagccttcttcgcggaatggacgccgccgctcgaagaggcgcgttcgcggctccccgcgtggacgacagcgaacctgcgcgtctccacctacgccaccatccggctctga

SEQ ID NO: 8146 - DNA, 387 bp, Myxococcus xanthus
ttcgatgcgcggaccggcgtgctccggaccagcgtgttcaagggcctcgcgcgcgatgtctacatgtactgcgcggagatacgccgctgggacgatctcaaccaggagttcatcgagccgggcagggccaccgcgcagcagattgcggagctcatcgaggggtggaaccagcagggcttgttgtaccgggaaggggagcgcttggaggggggccggttcctctcactggcccccgccttcacgcctgagttggcgtcgcggcgcatccgtgcggcccacgcggcggaattgcagcggcgcggcgccagggctgatgcgccgaagccccatcccatgcctcctcgggcgggtgacaaggccccgccgcccgtccaggtgaaggcgtaa

SEQ ID NO: 8147 - DNA, 231 bp, Myxococcus xanthus
atgacggcgaggctggacatcacccgcgaggtctgtccgatgacctacgtgcggacgaagctgaagttggaatcactggagccgggcacgttgctggaggtgctccttcggggcaccgagccgctgaagaacgtgcctcgcaacgcgcgcgacgagggccacgaggtcgtgtccctggacgcgctcccggacgggacgcaccggctggtgctccgcaagcaaggcaggtga

SEQ ID NO: 8148 - DNA, 597 bp, Myxococcus xanthus
atgcatcctcgacctcttcgactggccctcctggccgcgacggcgattctcttcgccgcatgcggcgcttctgattccgactccgacgaaatcgagtgtggaggatatggacacctccacggcgaccactgccactgcgacgagggctatgtcgcggacggcctcacctgtgtcatcgccgaggagcccgtcgaggaatgtggcggtcacggacacctccatggtgaccactgccactgcgacgagggctatgtcgcggacggcctcacctgtgtcatcgccgaggagcccgtcgaggaatgtggtggtcacggacacctccatggtgaccactgccactgcgacgagggctacaccgaacaggacggcacctgcgtcgtcgcccaggagcccacgctcgactgcggcgagcacggccacgcgcacggcgaccactgccactgtgacgcgggttacgtggagcagaacggcacgtgtgtcgcggagacgccagtactggactgcggcgagcacggccacgcgcacggcgaccactgccactgtgacgcgggttacgtggagcagaacggcacgtgcgccccggctcccgcgccgtga

SEQ ID NO: 8149 - DNA, 1941 bp, Myxococcus xanthus
atggacggacttcgagcaggtgccgtggtgttcctggcgtgcgcgggcatgctgggagcaggtccttcctgggcgcaggcgcccctggaggaagagcccggcgaggtgctttccgaggaccagttggaagcactgctcgactcaccggtggcgcagccttccgacggtgagctgtccaccgcggccttcggaccggagcggttggcgccgtacttcgtggaaggcaccctggcaaaggcccacgcggagttccggcgcgggcgctacgcgcgggcgcggagcctgctggcccatgaggaggccacgccgcaggttcgcttcctcagggcgcagtgcgcgctgctggcgcgcaaccacgcggtggcggccgaggagttcgccgcgctggcggacggctacggcgcgctgcgcgaccacagcctgctgcgggccgcccaggccaacgagcggctgcgcaagctggacacggccgccgggcagtaccgcggcgtgagcccgggctcgccgctgtacccggaggcgcgcttcagcctgtcgcgggtgctccagcggcggggggacattccgggcgcgttgacggcgctccaggagctcatcgacagccgccagtcgcgagggccggacgcgctccggatgaaggcgctgctggccatctgcgacctggcgcgcgcgcaagggcagtacaacgccgagcaccgcgcgctgctggaggtgtgggccaccagtccgctgtcgaacgaggcgcgccgcgccgagaagcggttgaaggggttgccgctgcccctcaagtggcgggtgcgccgcgcggaggcgctggtggagctgcaccgcaaccatgccggcatggcgctgctggacaaggtgctgccgcacctggagatgccggacgagctggcctgccgcgcgcacctcacctacggccgggcgctgcgcaaggagcgcaagcaccgccgggccatcgaggcgctggagcccatggtggtgggctgcaccgcgtccgagcagcggccgcaggcgctctacatcctgggctactcccagtcggtggtggagccgaaggcggccgtcaccacctatgccatgctcgcccgggactacccggagcatggctacgcggatgacgcgctcttcttcgaggcgtggttgctccagcgcacgggcgacgtggagacggccctggcgcgctacgaagaggccgcgcggcgctacccggcggggaacttcgcgtcggagtcgctcttccgtgccttctggctgcactcccgcaaggccaacgccccggcggccctggccgcgctgaaggcggtggagaacctgcccgaggcggcacgcacggacgaggcgctgtggcgctcgcggtactggcgtgcgcgcatgcaggagtccggcgcctcggcgcaggcggcgctcgatgcgtacgcgcacatcgccgccgagcgccccgcggcctggtacgggatgctggcccgctcacggctcgcgctgctctcaccggagcgcgtggcgcggctgtaccccaagcccgtgcctcccgaggccatggagggcaccggcggctccggccgcgatgacgccccggcggacgaagtggtggaggaggtgggcgagcccgaggagatctggccgctgccgcccggcgcgctggcgaaggacgcgcgcttcaacgcgggcgtggagctgatgcgcctggggctgcccggcgcggtggatgagttcctcgccgtggatgcgcgcgcgctgcccgaggccccggcgcggctgctgtatcagacgctgaagcgcaccggccgcaatcgggccgcgcggcaggtggcgcgcacctcgctgaagcaggaggtgcacggtccgctgagcgccgcgtcccgtcccatctgggaggccacctggccgctggcgtaccgctcgtccattgcccgttacgcgcgggcccatcgcgtggac

SEQ ID NO: 8150 - DNA, 174 bp, Myxococcus xanthus
atgattcgcgccgagcacgggctgccgctgcaccaggactcctcgggcatgcgcccaggcaacaaccgcagcctgcgcatgttcgagcagggcccggacaatcggaacttcttcccgcggatgagcggccagccgccgcccatcggcaagatgctcaacgacctggagggctga

SEQ ID NO: 8151 - DNA, 165 bp, Myxococcus xanthus
atgcgctggctggaggcacaccatctcctgggcgcggtgcgctcggtgagcgagccgggctccatgcccatgctccacctgcgctgcgcgccgcgggtgctggaccagctgcgccgtgccccggagttcgaagcgggcacgatgatgcccctcgacctcatctag

SEQ ID NO: 8152 - DNA, 1428 bp, Myxococcus xanthus
atgaagtcctacctgttggttccaaaggagtccatcgagacgcaggctcgtgtggggcctcgcggcacggagcagggcgagcgcgtgctgtcgcgcacgacggcgctgcgcttcgcggtggcgaacaaggcgcccgacgcgttgttcgctctcggactgcggtcggccacgctgcccggcgcgcgtccgcccgtcagtggacaggaagagcgccgtcggaagggcaagggcgcgaagtcggcgcgcacgggcacgcgcggcgcggactcctccacgccgcccatgccgggcgcgacggtggccgagcagaccggcgcggagcccggcagctaccggtacatgccgctcatcggtgccaccatggctcacttctacgaagaccatacggagaaggaagcccgcggcgagctggaacgcgacttcgagttcatccccgacgtcgtcccgttgtccttccccggcccggtgtcggctggacaacccggaccgcgcaaccggggcatgtcctcgctggccgagcgcgagtggcccgacgagtgcggcgttcccctggcccacgcccagggcatccgcggcgccggcgtcatgctgggcatcctcgacaccggtgtggacgcggaccaccccgagcacgcggcgcgcgtcatccagttccgctacgtgtcgctgttccccaactcgccgcacaatccggcgcgtgacatccgcggcttcgacccggacggccacggtacgcacgtgtgcggcattgccgcgggtgtgcaccacggcgtcgccccggaggtggacctctacgtcgcgtccgttatcgaatcggagaccatccgcaccagcctgggccgcgtggccgcgggcatggagtggctgctgcaccagttcagccgcccggagaactcgacgcggcccgcggtggtcaacctgtcgctcggcttcccgctgatgccgccgcccggcatctcggaggcggactacaacctcaacctgcgcgcgctgcagacgatgattcgtcgcctgctcgacagcaatgtcctgccggttgtggcggcaggtaacagtggacccgacacggttggttatccagccgcctttccagagtcactggctgtcggcgcggtcgacttcgagcgtaacgtggccacattctccgcgagtggcaccgtgggtaggcgcgtcgtgccggacatcatggggtatggggtgaatgtctattccagcacggagcgtcgttgtaacaaccaggcgttctacgagcgaatgagtggcacgagcatggcagcgccttatgtagcgggtatcgcggcgctgtaccgttgccgtgcccctgacttgacggcgctcgaggtgagggatttgatcctgtcgaatgcggtgaagctccctcggtcgggaacgcacaagacaggcaagggcctggccgtattcaggtga

SEQ ID NO: 8153 - DNA, 1913 bp, Myxococcus xanthus
atgtgcggcatcgtcggcgcggtttcccagcgcaacatcgttcccatcctcgtccagggcctgcagcgccttgagtaccgtggctatgactcctgcggcgtggccgtgcacgaggccagcatgggcaacaaccccatgggcggcctgcaccgcgcacgcagcacggcgcgcgtggccgagctgcaggcgcaggtcgatgccgaacatctgcagggcgcgaccggcatcgcccacacgcgctgggccacgcatggtgcgccggcggtgcacaacgcgcacccgcatttcagccacggccccaacgccgcgcctgccgagaccgaccgcgctggccgcgtcgcgctggtgcacaacggcatcatcgagaaccaccaggagctgcgccgcatgctgcaggcgcgtggctatgcgttctcgagccagaccgacaccgaggtcatcgcgcatctggtcgacagcctgtatgacggcgacctgttcgacgccgtgaaggcggccgtcgcgcaactgcacggggcctatgcgatcgcggtgatgcacaaggacgaaccgcaccgcgtggtcggcgcgcgcgccggatcgccgctggtgctgggcgtgggcgtgggcgagaacttcctcgcgagcgacgcgatggcgctggcgggcgtgaccgaccaggtcgtctatctgaaggagggcgatctcgtcgacctgcagcccggccgctactggctcgtcgatcacgacggccagcgattgagcgaggcacagcgccccgtgcgcaccgtacacgcacacagcggcgcggccgagctgggtccctaccgccactacatgcagaaggaaatcttcgagcagccacgtgcgatcgccgacacgctcgagggagtgcagggcatcgtgcccgagctgttcgacggccttgatgccgacggcaacacccgcacagccgcgtggcgcgtgttcaaggaaatcgactcggtgctgatcctcgcctgaggcaccagctaatacagcgcatgagcgtccaagaactggatggagtcctatcacgaagctcacagtgcaacgtggaagtcaccacagaataccgctaccgcaccagcgtgccgaacccgaagacgctggtagtcaccatcagtcaatccggcgaaacggcagacaccctggccgcgctgcgccatgcgcagagactgggcatgacgcacacgctcaccgtctgcaacgtggccaccagcgccatggtgcgcgaatgcgagctggcctacatcacgcgcgccggcgtcgagatcggcgtggcctccaccaaggcgttcaccacgcagttggcgggcctgttcctgctcacgctcgcgctcgcgcaatccaagggccacctgagccaggagcaggaagcgcaatacctcacctccatgcgccatctgcccgtcgcactgcaggccgtgctcgcactcgagccgcaggtcatcagctgggccgaagatttcgcgaagatggaaaatgcgctgttcctcgggcgcggcatccactacccgatcgcgctcgaaggcgcgctcaagctcaaggaaatcagctacatccacgccgaggcctaccccgcaggcgagctcaagcacggcccgctcgcgctggtcaccagcagcatgccggtggtcaccgtcgcgccgcacgacgagttgctcgaaaagctcaagaacaacatgcaggaagtgcgcgcgcgcggcggcgtgctctacgtgctggccgacggcgactcgcagatcgaaagcgaagacggcatccacgtgatccgcatgcccgagcactacggcgcgttgagcccgattttgcacgtcgtgccgctgcaactgctcgcctaccacacggccgtcgcacgcggcacggacgtggacaagccgcgcaatctggcgaagtctttgaccgtggagtga

SEQ ID NO: 8154 - DNA, 423 bp, Myxococcus xanthus
atgctcagcggctgcaagaccaccgtcacggtcaagctggcgctcgcgcccaatgcccccagatcacagcctaccgccgaaccgttgcgttggcagcttccctgcgaggacgtcacagagacgaaggtcgccgcgtcggagctcgggcggcatggaatccgggtgaatgtggtggcccctggagccatccagacaccgctggcggagagtgtcggactcatcgaggtcatgggtcatgagttcctggctcgcacgccgctgggcaagccgtgtggaatgccgtcggatgtcgcgggcgtggtctccttcctgtgcggcgaggacgcggcgtggatcaccggggagaccctctccgtcgatggtggaaaccacatccgtggcctgcacagctactgggacatgctgagccgcgccgcgaagtag

SEQ ID NO: 8155 - DNA, 1341 bp, Myxococcus xanthus
atgacccgcggggacgtggcgtcgctgccgacgcagctgaagaaccagctcacgcggcttgcgtgtcgaccccacagtacgcttcccatccagttctactccgaggccgatagcccgagtcagctgttccagtactacctcctcgacaccaacgacttcgagcccaacgtcttcacctcgctcatcccgggcgtcaacaacacggcgatgctcaccgccacgggcgccaactgcgatcttccgacggttgctgcggtgcgcctcgtcctggagcccaagcaggggctcccggtcgacccgaatgacccgcgagcgttcatcgacatcatcacggacatctcgggtcttttcgtcatcaacaacgagagcggctggtacgaggggtggatgattcacgacctgcgcgtggcggaagtccacgagccgggccaggacggcagcgcgatctacgggaccatcaccccgaacgacgccgcactgctggcgcagatgggaagtggcaacaacgtgcccggcaacttcttcaccgtcgatggcgaggagccccgccccccgagcgcttccgacaacttcccggaccgtgtcacgaacctggtgccgctccagctcagcatgggcgcgtacaactcgctccagcaatccgacgcacaccagtactgggagttcaactacacgaccaactggatccaccccctctacgaactgcccttcaccggcggcttccccgaccaatcggcgacggacccggcgaccacgtatcaggaaggcaagatcggccggaaggcctcgatcgttccgggcaatcggatcggcctcaacaaggacccgcagcggaccatcgagttcggcgacaacccgtccctccctcgcgatccggaccgcttcgacgcagaggaagactctcagcgcgagttccgccagcgcttcattccgagcggcgtcgcgcgggaggtgttcctgaacgtgttccagcgacttgactccttccaaccgggtgtgaccaacctcgagcagcggctcgtggcggcctacaaggcggcgatcaccgtcgcggacacgaatggtgacggcatcatccaggcggccgagggcgacatcgacacctgcaacgcgaagtgcttccctgcgacgccgagcgacgagtgcacggacagtgacagctcgtgcctctaccttccggccacgacctacaaccgcttcgcggtgacccgggagatcaacgacggctacctcgcgccgcgcttcgctccgagccagcgtgggtgggtgctctccggcaatagggtcgaagtctccccggcagtgccggcctccgcaggccgcgacagcgacgaccgctga

SEQ ID NO: 8156 - DNA, 390 bp, Myxococcus xanthus
atgaagctcggctacatcatcctctacgtaccggacgtgagcgccaccatcgcgttctacgagaaggccttcgggctggcgcgccgcttcatccatgagagcggtggctatgcggagatggagacaggcaccaccgccctggccttcgtcgaggaaggcgcggcgaaggagcatggcttcaccgtgcgccatctgcgaccgaaggaggaggccgcggccattgaactggcactcgtcaccgccgacgtggccgcagcgtacacgcgcgccgtggaggcgggcgccgaggccacgcagcctcccaagcagaagccctggggacagacggtggcgtacgtcagagacctcaacggcgtcctggtggagctctgctcaccgatgaaggagtag

SEQ ID NO: 8157 - DNA, 669 bp, Myxococcus xanthus
ccggcgtcgttggcgttggcccaggccggtgtcgggcacctgacgctgccggatccggactgcgtggacgtgacgaacttgccgcgccagctctggcaccggggcgaagacgtgggccggaacaaggcggagtccgcgacggcgggcctggcgcgggcctttcccggcctgagcacggaggccatccccgagcgcgtggacgcgagcaacgcggaggggctcttccgcgcgcatgacgccgtcatcgacgccacggatggcgtggccaccaagttcttcctgtcggacgtggcggtgctgacgggcgtgccgctcatctatggcggtgtgctgcgcatgcagggccaggcgatgcgcgtggacccgggggggccgtgtctgcgctgcctctatgaagcgccgcctccgccggatgccgtgcccacgtgtgcccaggcgggggtgctcggctcgctggcggggctggtgggcgcggtgcaggccctgctggcgctggagctgctgtcgggcgccgcgcgaggtgggcagggcgaggctacgctgcacgtgctggatgcggtgtcgatcctgggacggcggacacgcgtggcgcgggcaccggactgcgagggctgtcgagtcacggccatccccgcgtacccggagtctccggaggcgtgcgcgacatga

SEQ ID NO: 8158 - DNA, 627 bp, Myxococcus xanthus
atgaccgaccagcccgcctctctgtcgttcttcgcccgcttctggctcgcctggctgtgcttctggcgctgcctcgtgtcccgcgagttcgcgcaggccgtgctgcccacgagcaaggcctatgacgccggccagctcgcccagcttccttcgggcggccccgcccccaccccgcttccgaagcaggaggaggtccggcccacgccccgagcgcccgagccgccccctgccctgccccccgagcgcgagcacgccagcgccctgtccttgctgggcatgctccagcgagagggccgcttcgtggacttcctccaggagaacgtctccgccttctccgacgcggaagtgggcgcggcggcgcgcatcgtccatgagggctgccgcaaggtggcccagacctacctgacgctggagcgggtgctgccccagtcggaaggggactcggtgccggtgcccgtcgggttcgacgcccagcgcatccgcctcaccggcaacgtggcgggccagccgccctacaacggaatcctgcgtcaccacggttggatgacgacggcggtgaagctgcccaccgtcagcccggccatcgacccgcgcgtgcttgctcccgcggaggtcgagctttcctga

SEQ ID NO: 8159 - DNA, 593 bp, Myxococcus xanthus
atggcccgctattccattggcatcgacctgggcactacgcactccgcagcgtcctacttcaatctggaggagggcaagccccgcggcggcgcgcagtccatgctgcccgtcccccagttgaccgcgcccggcaccgtcgaggcccgcccgctgctcccctccttcctctatctcccctccgagcaggagttccccgccggcagcctggcgctgccgtggaagccggaggccagcaccctgatgggtgagttcgcccgcacgcacggcgccaaggtgcccacgcggctggtggcctccgccaagagctggctgtcccaccccggcgtggaccggcgcgcggcgctgctgccgtggcaggcccccgaggaggtgcaacgggtgtcgccgctagacgcctccgcgcgctacctccgccacctcaaggacgcgtgggaccacaccttcgcccgcgagcgcgaggagtccgacaacgccctggccgaacaggacgtcatcatcaccgtccccgcctccttcgacgcggcggcgcgcgacctgacgctggaggccgccaaggccgcgggcatccccaacatcaccctgctggaggagcc

SEQ ID NO: 8160 - DNA, 513 bp, Myxococcus xanthus
gtgcgggtgctgatgatgcgcgacatcgtccgcttcttccgccagccctcccgggtggtgggcgcgctcgcgcagcccgtcctcttctggttcgtcatcggctccggcttcgcgggctccttccgcgtggagggcgcgcagggcttgggctaccagcagttcttcttcccgggcgtcgtcaccatggtgctgctgttcagcgccatcttcgcgacgattaccgtcatcgaggaccgcaaggagggcttcctccaggcggtgctcgccgggccgggctcgcggctggcggtggtgctgggcaaggcgctgggctcgtccgccatcgcgctgctgcaggcgtcgctgttcctgttgctggcgccgctggcgggtgtgagcgcggccacgctgaacgtgccgctgctgctgtccgtcatggtgctgtcggcgctggcgctgacgggcatgggcatgtcgctggcgtggggggtgcgctccagtgcgggctaccacgcggggatgagcatcggcatg

SEQ ID NO: 8161 - DNA, 993 bp, Myxococcus xanthus
atgcccgaagtcctgctttccactgccacctctcagccgctgctccagttggaggggctcacgcgtcgcttcaaggggcgcacggccgtggatggcctgtccctgtcggtgcggccgggggagattctgggcctgctgggccccaatggcgctggcaagtccaccaccttccaggtgctggccgggctgctgtcccccgatgcgggcctcgttcgcttcgagggccgggagctgtcgctgagcgacccgtcgctgcgccggcagatgggcatcatcttccagcgcagcagcctggatgacctgctgaccgcgcgggagaacctgatgctcggcgcccggctgtatggcctgggcggagagcgggcccgcgaacgggtggaggcgatgctgtcgctcatcggcctggccgaccgtggcgacgaacgggtgtccacgtggtccggtggcatgcgccggcgcctggagctggcgcgggccctggtgcaccagccgcgcgtcctgctcatggacgagcccacacagggcctggatgaggcggccttccgtaccttctgggcacacctgaagcgcctgcgcgacagcgagggcctcacggtactgctcaccacgcaccgcgcggacgaggccgacgtctgtgaccggctggcggtgttggacgcgggcaagctggtggcgtgtgacacgccgcaggcgctggcctcgcgcatgggtggggacatcctctccgtggaggcgctcgagccggaggcgctggcgaccgagctgcgcgagcggctgaagctggacgcgaaggtggtggaggggcgggtgcaggtggaggccccgcggggccacgcgctggtgccccgattggtggaggccttccccgccgggcggctgacctccgtcgcgctgcgccggcccacgctggcggacgtgttcctccaattgacggggcgcgcgctgggcgcggacgtgcccaccgctgaacccgcgccgaggagacgtcgatga

SEQ ID NO: 8162 - DNA, 921 bp, Myxococcus xanthus
gtgtctgtcgtgcctacctctggagtctgtgtgaacgcgcgtgccgagtccttgccgacagtcgcgtccgacctgatctccctcaccaagccgcgcctctcctccctggtgctcgtcaccgcggcggggggcatgtggctggcgcccggccacatgggcgccgtcaacgcgctggtgacgctgctggccacggcgggaaccgtgggcgcggccaatgccctcaactgctactgggagcggcacagcgaccagttcatggaccgcacccgcaaccggccgctgccctccgggcgcatggagccggcggtggcgctgtggttcggcatctccctggcggccgtgtcgcttccggcgctggccctgggcgccaacgtgctcaccgccgcgctgggcctggtggcgctgctgagctatgtgctggcctacacgccgctgaaggcgcgcacgtccgcggccatgctggtgggcggggtgcccggcgcgctgcctccgctcatgggctggacggcggtgaccaaccagatggacgtggggggcttctcgctcttcgccatcatgttcctctggcagatgccgcacttcatcgccatcgcgctcttccgcaaggaggagtaccgggcggcgggcctcacgtcggtgcccctggagcggggtgacgagtccagccgcgcgcaggtggtgctctacctggtggcgctgattccgatgacgctccagcccttccaactccacatcgcaggcgcgtggtacttggccgcggcggtgctcctggggctgagcttcctcgggctgggggcgtggggcttcttccgacggctgggaaacacctgggcccgccagacgttcttcttctcactcatctacctcaccggcctgttcgccgcgctggcgctggaccgagttcctcgcgaatagcgtccg

SEQ ID NO: 8163 - DNA, 2235 bp, Myxococcus xanthus
atggaggcgatggtcgtctgcaagaagggggtgaaggcccacccgaatgcggcggacccccgcctcctgctcgcccgcgtctatgcggagcagggcaaggacaagaaggcactggaagaggcgctcggcgcccttcaggtgcagcctgaagacaaggttgcgctgcgcatggccggcgcgcttcagctgaagaccggcgaagcggagcccggcaaggcgaaccttctcaaggcctacaccgcggacccgggcgacccggacaccgtcacgctgctccagcagcacaagattgaaccgccgcggcccgccgcgccggctccggtcgccgcgcccgctgctccggttgcgcccgcgacgccggctccgtccgccacccagcagtccgcctccgcgctctccagcgtcgcggcgacggcggggacggaagcgcccgcggcgaagcccgccgccacccaggccgcgaagcccgcgcccaccgcgcgcgcggaggcccccgcgccgcgtcccgcccctcagccgcgtcggccccaggtcgtcgtggaagaggtggatgaggacgaggacgacgagccggtgtcccgccgctccccctcctcgggtggcaagggcagcaagatggtgacgttgggcctgctcgtggccatcccgctgttcgccatcggctatggctggtactcggccaacgcccgcacgaagtctcgcgagctgaagaagagcctggatgtggccagcgagctgctcaagcacgactccttcgacagctacaaaaaggccgtcgaggcggcggaccaggcgctggaggtggactccgattccgccgtggcgcacggctacctcgcctacgcctgggccatccgttggggtgagcacggcggtggtgacgatgcgcgccgccaggccgaggagcatctggccgtgggcaagaagagcggcgacctcagctcgcacctcatcgcgtccgaggcgctcatccagacctacagcggcaagggcaaggacgcgctggggcagttggaggagaaggtgaagggcctggacgcgcagggccgctccagctcgttgctgtacctcacgctgggcctcatccagatgaacgcgggcgacctggagcgcggccgcgacagtctggaccgcgcgcagttgctgtctccggatgaccctcgtacctacgcgagcctgggcgcggtgtaccgccgcctggggcaggacgccgccgcctggcggaactacgactccgccctccggtacgggaaggaccacccggagtcgctgctgggacgctccctgctgatgctggagcaggactcgcccaacttcgagctggcccacaccatgctcaagaagctgctggagtccgacccgccgccgtctccgcggcagctggccgcggcgcacatggcgcgctcgctgctcatcagccgcgtgtcgacggccatggtggacctgaagccggacatgcagcagaagctggccgaggccaccgccgtcccccaggacaaggacaaggcccgcacggagatgctcaagagtgaggagaccggcttctcgctcgacaagcagaacccggagctgcacctcatcaagggccgccgcctgctggcggagggcaacttcgacgcggcggcggaggagattcgcaaggccatccgcatggacgcctcgcgcgcccagttctacgtcgagctggccaagtcgctcatgggcaagcagggcggcgagaaggatgccgccgaggcgctgcagacggccctgaagacgatgggcgacagcccgaagctggtggtgatgctgggcaacgcgtaccgccgtcagggcaagctggatgaggccctggcccagtaccagcgcgcggtgaaggacccgaaggccaagaacccggaggcccggctggccatgggcgccatctaccgcgagcggtccaagtgggacctggctcaggagcagttggagaaggcgagccaggagttcctggggcagtcggaccgcgcggccattgcgctcaccgagctgggacgcgtgttccagagcaagggcgacacggcgaaggcggacgagacctaccagcgcgccctcaacgcggatgaggcgtactcgccggcctactacttctacgccacgctgctctcgaaggactcgaagcagggggcgaaggcgaagatgctggcccaggagtacctgaagcgcgaaccgagcggcgagcacgcgtctgcggcccgttcgctggcgggcggctga

SEQ ID NO: 8164 - DNA, 969 bp, Myxococcus xanthus
atggcgtggcacacctggcgcatctccggcgtcttcgatgccggcatgttgtgcgccagcctgggcatggtgctggcgttctccgtggtgcgttactcgtggtggcacgtgctgttatccacggtgctgtccagcggcgcctatgcgctgctcgcgtggatgacggggcacggctcggtggcgcgcaccagcttcgttctcatctgctacgccgccttgggcgggctcatcgcgctgacgaactcggaagtggggggcatgttcctcaatttgcggcgccgcgacggcctgtcccgcttcctgccccggcaggtggtggagcgggtgatgcaactgggggatgcctccctccagccggtgcagcgcgacgtcaccatcctcttcagcgacatccgcgacttcaccacgctgagcgagacgctggacccgggacaggtgctggagttgctggacgactacttcgggcacatggcccacatcgtcatggcgcgccacggcatcgtgaacaagttcctgggcgacgggatgctcgcgtgctggggcgttccggatgcgcgcgagaaccacgcggagctggccatgcgggcggcgctcgacatgcgcgccaagctggaggacatcaacgcccagcgcgtgcagcgaggtctgccgccgctgcgcatcggcatcgggctgcacaccggcatggtggcggcgggcatgctcggcggcgccgagcagcacgagtacaccgtcatcggtgacgcggtgaacctggcgtctcgcgtggagggcctcaccaagtcccacggcgtggacatcctggtgagcgagcggacgtggcagatgagcggcgggcatttcacgggcgagcgcctgggtgaagcgcacgtgaagggccggcgggagtccgtggtcgtctactccctgcacggcccgcgcacccatgaggacgtaccgcccgtgctcaaggccgcggcgggcacgtag

SEQ ID NO: 8165 - DNA, 687 bp, Myxococcus xanthus
atgccggtgaacctgatggacttcgagcccaatcccgaagtcgcctccttcatcccgcccaaaatcgccgagcgcctgtgcgtcgtccccctgtccctggacgggaacacgctgcacgtcgccagcggctacccggtgcccaagaaggagctcgacgaggtcggcttcctcctgggcaagccgctcgagctctgggtggcgaccgaggtgcgcgtccgcgagtgggtctccaccatctaccgccagcccctggccctgcgcttcgcgaagctcgcggcggcgttggatccggaagcccaggcggccaccacgccgccaccgccgcccgccgcggccacggaagaggagtcgctcaccgcggacatggtggagcggttggctcgctccgtcgcgcaagagcccctcgccgtggagaccagcgccgcgccccaggccgcggccccccgtcccgaggcccccgcgagcccccagcggccgcccccgcctccgccggaagccctcacgccgggccctgaaccccttccgccgccagggcctcccgccttcgtccgggcaccgctgcgactgaacatgccgcaggccgaagcgcccgcgcgtccggcgcagcgtcccaccccgcaagccgcgcagattccggtgctgcccttcacgccagccccgggcacggggccgtccagcgcgaacacc

SEQ ID NO: 8166 - DNA, 735 bp, Myxococcus xanthus
atggagcaggcggcgcctcccgcgggcctgccccgcatggagcaggcggcgcctcccgccgcgtccacttccggactgcctcgcatggagcacgcggaagccgcctccacggatctcccggcgatggaatccccggccgcggccccttcggccctgccgcacatggagccgctcctccccggcgtgtccgtgggggtggcgcgctccgaggccatcaaggcgcccccatccaaggcccaggtcaagtccgcctcgggcgtcacggaagtgcgcgcccgcccagcctccctgtggcggcggctgctctccttcaccatcgacacggcggccatcgccggcgtggcggcgctctacatcaccctggcctcatcggtgacgggactgaagacgccggaagcggggctgacggggctcgatgccttcgtggcctggctgcgcgccttccacaccatcctcctgcccgggtttttcctcgttctggtgctcgcgctcgtatactgcgcggtggcggccttcctctggaatggccggacgctcggacggctgctcctggggctgcggctggtggacacacatgggatcgccccggcaccgggacgagccatcgtgcgcgccctgctttccggcgtgtccttcgtcttcttccttggtggcttctggatggcgcttttcgaccggcgcgggcagacgcttcatgacaagctgacgtccaccttcgtcgttcaaccgagctga

SEQ ID NO: 8167 - DNA, 267 bp, Myxococcus xanthus
atggggatcatcgcattcatcgtcatcggcctcatcgcgggtctcatcgcccgcgccatcctccccgggaagcagagcatggggctcatcgcaacgaccttgctcggcatggtcggttcgctcgtgggcggccttgtcggttcgctgttccagcgtgatggtcggctcttcgacgtgaggccctcaggcatcatcatgtcggtgattggcgcaatcgtcgtgctcctgctggtgggcgcagccggacggcgacgggtacatgcctga

SEQ ID NO: 8168 - DNA, 348 bp, Myxococcus xanthus
caccccgaccccggcgctcggtggattcgggagcacgccgccatcgcccggaacctgggcaagcccttgttcgtgggcgaactggggctgcgcaacgaaggcgcgttcgacgtgtcgcagcggcgcgcgctctatcgcggctggctggagtgcatgcggaaggaaggcgtcggcgcaggggcgctgtggatgttctccaccgacgcccggccggaggcctgggacgactacaccttctattaccgggacggcacgcagccgggagacccggtcaaccggtacgcggacctggtcatggaggccgccgccgcggagcgtccgggcgcggcggtctccacggggcgctga

SEQ ID NO: 8169 - DNA, 681 bp, Myxococcus xanthus
accggcgagcgtcgtcactacctcctgcatgtcctgcggctggaggaaggcgacgcgctggaggtcttcgacgggaagggccgggccttcgaggcccgcgtggcccacgtcacgccagatgtcgtgcgcgtgacgttgggcaccgcgcgcgtggcccccccgcgccgcgaggtcagcatccttcaaggcctgcccaagggcgacaagctggagctggtgctccagaaaggcaccgagctgggcgccaccgccttccaccccgtggccacggcgcgaagtgtcgtgaagctcgagcccaagcgcgcggaggagcgcacctcccggtggacgaagattgtcgaggaggccgcgcggcaatgccgcagggacgacgtgccacgcgtggccacgcctgccccactgctggatgcggctcgctcgctgaccgcgggcaccgtgctgctcgtgctcgacgaggaagagtcggccgtgcccttgggcgaagcgttccgggccgcgggcgcgggcaccgccgtggcactggtgattggccccgaaggggggcttgcgcgtgaagaagtggatgccttgatggccctgggcgcgcggccagtcaccctgggcaagcgcatcctccgtaccgagacggcggcgctcgcggcgctggcggtgatgatgcacctggacggcgaactcgggtag

SEQ ID NO: 8170 - DNA, 300 bp, Myxococcus xanthus
  unsure (1)..(300): unsure at all n locations
gggctgctgatggcgctgcccttgccgcccacgctgctccccgcggagcccgtcgtcgcgaggtttccggtgggcaccgcccccncggtggcggtaggcgtcatgcccgtgcgcttcgcgctcgtcgtcggcgcgcacgtcgtcttcgagaagaagacgcatggcctgtccctgggcgggcccctgctcttcttcatcgagcccgtgtacctgctcaccgtggccctgttctcgctgggcatgaagcagacgctgcgggccgaggtgatgacgggccccggcgagtcacagcccgcctga

SEQ ID NO: 8171 - DNA, 990 bp, Myxococcus xanthus
tacttcctctgcctgggcctgggcggcgcggtgttcctggcgctgatgtacgtggccaacgcgggctggttcaccgtgttcaagcgcatccccgaggccttcgcggcctacgtgccctggggtgccgtgacgattctggcgctgctgcccttcgtgtcctcgctgtatccgtgggcgaagccgggcgtcatggaaacggaccacctgctgcacgagaaggccgccttcctcaacgtgcccttcttcgcggtacgcatggtggtgatgctggcgctgtgggtgggcttcacgtggatgctgcggcgcatctccctgcggcaggacgcggagcgctccctggagctggccgggcgcaacgtgacggtgtcggcggtgttcctggtgctcttctcgctgaccttctgtctggccgcgttcgactggttgatgaccctggagccgcactggttcagcaccatctacgcgctctacaacatcgcgggcctgctcagttccacggtgtgcgccatcaccgtgacggcgatcctgctccaccgcgcgggcgcgctgccgcagctcaacaccagccaccttcacgatttgggcaagctgatgttcggcttcgccacgctgtgggcctatctgtggttctcgcaattcctgctcatctggtacgccaacatcccggaggagacggtctacttcgtcacccggctgcacggcacctgggcggtggccttctatgtgaacgtggcgctcaactgggcgctgcccttcgtgctgctgctgccgaggcccgcgaagcgcaatccgtcgcacctgctgcgggtggccgccatcctcctggtgggccgctggctggacctgtacctgatggtggtgcctggtggtcagccggacggtgtcgccctgggggtgttcgagctcgccggcttcgtgggaatggcggcgctcttcacattggcggtgacgcgcaccgtgcgctccacgcccatggtgccggtgggtgac

SEQ ID NO: 8172 - DNA, 639 bp, Myxococcus xanthus
tctaactggtgggttcagcccgcgctgctcacggatgcgtactggggcctgggcgtgcgtccggacggggacgtctgggtcggcggcgccaaccggacgacacgctacttctacggcaccgtcgcgaacgatttctgggagggccagacgcgtacggagtcccgggcctccgcatggaaccgcatcgacatctggaaggacgcggtgggcgaggagcgctactcccgtccggagcagcgcacggatgacctggtctccggcatcgccgtcgtgggcacctccgcgtgggtgggctccttcggccacggcctcgcggagctgaacgacaacggccaggtggtgcgcacgctgaagaacgaactggccgcgccgcacgtggccagcgtggcggcggacctggccaacggcagcatctgggccggtcacagctggggcggcggcctctcccgtgtccggggcggctccgtctcccactacggcctctccgtgttcgggcgtgagctgtccagcatgcgcgtgccggacatccaggtggaccgctccggcccgcggcgccgcatcctggttgccttccagggctctacgctgagcgacggcaccgtgatgccgggcaccatcggcatctactccggggagtga

SEQ ID NO: 8173 - DNA, 951 bp, Myxococcus xanthus
ctggtgggccgcagcctgcccatgcggcagattttcgcgctgctccagcgcatcgcgcccaccgactccaccgtgctgctggtcggtgagacgggctccggcaagggtgccgccgccaaggccacccacaagctcagcccccgcgcgggcgggccgctcgtcgtcttcgactgcgccagcgtgtccgactccctcatcgagagcgagctgttcggccatgagaagggcgccttcaccggcgcggtgagccagcgcatcggctgcctggagcgcgccaacggcggcaccctcttcctggacgaaatcgacgacctcgccctggacctgcagcccaagctgctgcgcgccatcgaggaccgggagtttcgccggctcggcgcctcatcccccatctccttcgacgcgcgcatcatcgtcgccagcaagaaggacttgtgggcggagacgcaggcgggccgcttccgcgaggacctctacttccgcctctccgtcttcaccgtcagcctgccctcgctcagagaccgcaaggaggacatccccctgctggtggatgccttcgcgggcgaaggcctgtggccccggctgccggagaagattcgcgagcagttcaccgggcacacctggccgggcaacgtgcgcgaattgcgcaacgccctggagcgcgcccggcacatggtggacattccggagctggccggggacaccctgctgcgcgagttcacccgcgaggcccccgccgccgccggggactccctgccggtggagttcaccggccccttcaaggtctgcaaggacgagctcatccgcgccttcgagcgcgagtacctcacccggctgttgggccgcgccaaaggcaacatcgcccgcgccgcccgcgaggccgagctggaccggaagcacctgtactcgctgctccacaagtacggactcgttcagagcgagacggactga

SEQ ID NO: 8174 - DNA, 600 bp, Myxococcus xanthus
atgtccatgcacgccaccggctgcttcggccagttccagctcacgcagaagatctggaacttcaacaagaacatctccggcaacaagttcgtgcagtggctgatgttcctcgtgctcaccatcatccccgtctacgggctgggcgcgttcatcgacgccatcgtcatcaacagcatcgagttctggacgggcagcaaccccgtcgccagcatcgacggcgcgccggagaccacccgcatcgtcaagctgagccccaccgacacgctgcgcctgtcgcgtgacgtggagacgggcgtcatgcgcatggagctggcgcgcgagggccaggagacgatggtccgctacttcgagccgctcgaggacggcatggtggtccgcgacgacgccggcgccatgctcatccaggcccaggaggcgacggacggcgcggtggcggtgacggatgccgccggaaccacgctgacggtccacgcccgtgacgcgctggccgtggcccgccgcgtgtacgaagagggtggcgcgcaggcgctcgcgcagcacgccgtggcccaggcctccgtgtcccagggcctggccagcaacacctgcgtggcccagtag

SEQ ID NO: 8175 - DNA, 264 bp, Myxococcus xanthus
atgacggtggagcgcaagcgagtgccgggagatgacgagcacttcctgttcgtcgccaccctgtacagcccggagcaacagcgcgtggtgctccggaacgtgcatttcctccagggggacaaaccgctgcagtacccatacaaggaaggtgtcacccaagtaccggtgcaggtgtatggcaagcccggccaagcgcctatcgtcatcgatgcggggtggggcttcctgctcccggccaacctgacgtacccctggtacaggtag

SEQ ID NO: 8176 - DNA, 525 bp, Myxococcus xanthus
atggccggggcggggctggccgcgtgcggcctcgcggacaactcgctgggcggcagcgtgtccgagctcttcccgctggaggtgtcccgcgtggaggtgctgcgcaacgcggaggcgttccaggtcagctactaccggaacaatgatttggacgtggacctggtcgtccgcctcaccgtgtccacggaagggctggacctgcgtcccgggacaaaggtgaacctcgctggcaccacgccgtcgggacaggcgcgggccacggtggtgcacctcaacgcgggcgagcccgcgcgcgtcttcgggccggtgaacaagggcgacttgcagttggagtctggaggcaacccgggcgagcccacgcgcggagacttctccatgtccttcagccggggtgatggctttggcgctggccgcaacctggaggggacgttctccgtggtggcgcaggatgcgagcttcggcccggacccgggccagttgcttgacggcggcgttcctcccgacgcgggcacgcctcccgaatag

SEQ ID NO: 8177 - DNA, 1005 bp, Myxococcus xanthus
tccgtggccttcgggccggacggtcagccggtggtgacgtacctgggcggcgaccgggaagatccctcgtcgttctggttccagagcgacctggcggtgtcgtatcgcagcgcctccggtgcgtggacagagcgcatcgtcgtgcggcaatcgaatgaggcgcagcccgtcaatcccgcgatggacgtgggcttcctggtggggctcaaccccgccatcgtcttcaacgggagcgaggcgatcgtcgcctaccgggatgggaaaaacgggcagtacgagcgacaagacttccagtccagtgacctggagattgccagcggcgggcccacgaactggcagcgccgagtcgcggtggcctccggtgataccaagatgggttacggtgggcacatctccatggtgatggcggggacccagccagctctggtgcacgacaaggcgccagaggccgcgcaggccaccggcacggacgtgcacttccagcggcgcaatgcggacgggctcacgtggtcgccggtggtgcgcgtgcaggccgttccgaatacgcagctcggggcctcgctcgcgtatgactcggtcgaggggttcggcgtcgccgtgctgaaccggaactcgaacacgttgacgttcacggaatgcgctgacgcctccgcgacatcctgcacgtccgagcgggactggtccatgccggaccccgtgttcaacaacggcacgggcggctggtatccgtcgctggccttcgacccggtccaccatgagccgtccatcgccttctacatctgcgccgccgagtccggccgcaatgacacgagctgcaacccgaacgacgacgcgttggtcatctccacgcgcatccagggcatctggcgggagacgctggtggacgccggcggtggctggtcgccgaagctggcgtacctctccagtggcaagcgcgtcgtcctgtaccgggcgccggtggtggcgcaggacaagggcgtgctgaagctcgcggtggagcgatga

SEQ ID NO: 8178 - DNA, 861 bp, Myxococcus xanthus
cgctccaaacgcgtggtgcgcgaagccagcgtgcccgcccgcatcgagaacctggtggagttcgtctgcgcggacaaggacggcaaggaccaggtactggagcccagccgcccccaccggattccctacgagatgcgcaacacctgtcgcgtcatcgtgcaccgtcagcgcttgaagccggaggatgggaaccaggaggtcctgctccgcatcagcgtcacgaagccggatggctcggtgcgcggggagagcggcgtcgagcagcggatgttcctgcgtccgcagggagagcagcgcgacatccccgtcccgggcaacatggggcagtacgaccgcatcaccgtccaggtctcccacgtggcggacgagtcccgttacgccttgagcacgacggaccgtacgggcctgccttccgcgcagtggacggccatcgtcaccggtggcctcttccggctctacacgacggctgccattcccgcgggcctctaccgcgccaccgagcccaccgggcagctcgccatcaacttcggtgtcgtgtcgcgactggcgttgctgaacaacgaaggccaggaacgcctgctgggaatcgaagcgggtttgatgggactggggctcgtgccgcagtcgggtgacattcaattcccgccgacgctcgcggtcgtcttgggcctgggactgcgcgttccgattggtccgggcgctgccgtcggtgcgcaggcgtggctggcctacgagttccgcggagacatccgacgtcgcacgggaggagaccccacgctggacccaatcgttccgtcgagcaaatggtccttcatcttcggaccgagcatctctgtcggcaacgtgggcttcaatctctga

SEQ ID NO: 8179 - DNA, 1092 bp, Myxococcus xanthus
atggtgcacggcgacgggtggggtttcgaggccgcgttcctctccagcatcggctccgcgttcgtgccaccggagcagtccatcgccgcgtacctggcgaaggagggcgtggacgtgtggggcatcgacctgcggtgggcgggcgtgccgcagaacacgcaggattttcgcttcatgaagagctggacgctggagacgcacgcggccgacgtgggcgtggcgctgggcgtggcgaaactgctgcggctggcgggcggcaacttcatgggcaccatgcacctgctgggctggagccggggcgcggtggtgggctacgcgtacctcaaccgcgaggcccggctgccgcgcgcgctgcgccaggtggacggcttcatccccatggacatggcggtgcgcttctctccgcaggacgcgcagcagcaggcgtgggcgtgtgagcgctatgaggcgctgagcaatgcccgccaggagggccaactggagggtggcctgctcgggccggcgccgggcatcatgttgcaggccattggccagctcgccgcggtgcagccggccgcgccgtcgccgctggtgcaggacgacatcttcgggccgggcacgggccggccctcgaaccgcaagctggccctggtcgcggcgggcgcgacgagcgtgctcttcgcgccgctgcagccggttgtcccggcctaccacctgatgggcagcacgccggataccatgggcctgccggagcggctgtccttcacccacgagggctacctcttcgagttcggccagcgcgccgcgccgtaccagagcatcaacgaggtggtggagacggaggcgtgggcctgcgggaagcacgtgccctacggcgaccgcctgcgtgacgtgaaggtgccggttctgtacgtgggcgccgcgggcggcgtgggccgctacggcgagcacagcgtcacgctgctgggcagccgggacgtcaccctgctcaacgtcagcacgctgccggaagccgcgcgcgccctggactacgggcacgcggacctgttcctggcggacgacgcgcgaatgcgcgtctggaagcccatgctccagtggattcgcgcccactga

SEQ ID NO: 8180 - DNA, 906 bp, Myxococcus xanthus
tctacaggacgcgctcgcgggcgccgccatctcgggccgcggaagaacgccgggccgggctcccccgacctgctgctccaggcgggcttccgccgctcgacgggggacgtccaccgcccctgggcacacgtcgcaacgcccttcccctggagcaccgtgcgcgccacctcacgtgtgcgggtgctcgcctgggacgatgcggcggtccggcgcgtggacctctgggtcaacggcctcctgcgcgccagtgacgacacccaccccttcgagctcgactgggacacccgggaagagctcaacggcccggccaccctggaggtccgcgcctacgacaccgcgctcaaggcctggcgcgccgcgcccatgacggtgacggtgcgcaaccccgacatcgccgacttcgattcgacgctccaggcgccccgctgcgccaccctcgcgttcgcgtgcgacaccggcgtgctcgtgcgcggcatgggcaccgtggggccagagcgccatgcgcccaacacgctcggcgcgagctgtgcggatggcatcgatggcacctacctcatcaccgcgacgctggaggggctgcgcgtctccagccaggacggcggccctctcaccgccggcaagccggtgaaactcaccgcgaccgccttcggcttcttgcccttcctggaagcggtggacctcttccatgcgcccgacgcgcgcagcccccaatggacacatgtcgcccggctcccgctcgaagagacaggggcgcaggagctatccaccaccttcacgctgccagagggagggctccaggcgattcgcggcatcctcggcacccatcccaccccggtcagctgcgccccgggagcctggacagaccacgacgacctcgtcttccccgtggccccctcgagtcgctga

SEQ ID NO: 8181 - DNA, 1059 bp, Myxococcus xanthus
acgaacgaagccctccagaagctgggcatccaacaccccatcatccagggccccttcggaggcggactctccaccgaacgactcgcggcggcggtgtcgaatctcggagggctgggctcgtatggggcgtatcagctcccgcccgaggagcttggccgcgtggcggaccggattcgggcgctgacggacaagcccttcgcgctgaacctctgggtctccgaccatgacgctggcggagacgcactcagccctgaggatttcgaccgcgtctaccgactcttcgagccgtactaccgcgagctcggcgtggagaagcccgccatgcccgagcgcttccaccaccgcttcgaggaccaggtagaggcgctgctcgaagcccgtccccccatcttcagcttcgtgttcggcgtgccccccgcctcggtcctggcggagtgtcggcgcaagggcatcctcaccgccggcgcggccaccacgctggccgaagccgaggccctggacgcggcgggcgtcgacctcatcgtggccacgggcttcgaggcgggcggacaccgtccttcattcctcgcgcgcgccgaggactcgctgatggggacgctggccctcacgccgctcgtcgccgaccgcgtgaaggtgcccgtcatcgcggcgggaggcatcgcggatggccgaggcattcgcgccgcgctcacactgggtgcccaggccgcgcaactgggaacggcgttccttgcctgcgaggaatcgggaacgacggacgcccaccgcgagctcctcttcagcgaccgcgcgaagcacaccaccttgacgaggtccttcacgggccggctcgcgcgaggcatgcgcaatcgttggactgaggaggtggcccatcaactgtcagcgctcgcgcccttccccatccaaggttggttcctgtcgaagctcaagcccgcggccgtcaaggcgggccgcacggacctcgtgtcgctctgggcaggtcaggccacgcccaacctgcggcaccggaccgtgcccgccctgatggactccctcatcaaggagctctcggcttcgtga

SEQ ID NO: 8182 - DNA, 642 bp, Myxococcus xanthus
atggcccaatcggacacgccggtccgcctcgacgtctggagcgattacgtctgccccttctgttacctcgagcttcccgtcctcgagcagttgcatgcccggctgggctcggcgctcgacatccactggcgcgcgttcgagctgcgtccggtgcccgcgcgaccgctcgccccggtgagtgagccccctcggtcggcctgggcccgctccgtctacccgttggccgagcagcggggcctgacgatgaggccgccgccggtgcaaccgaagagccggctggcgctcgaagccgccgagttcgccaaggacgctgggtccttctccccgttccatgaggccctcttccgtgccttcttcgcggacggccaggacatcggggacctgcgcgtgctgggggcgctggcggaggacgtaggcatggaccgcgagtccatgacacgcgcactggaggcgggccggtacaccgcgcgcgtgctcgccgacgaggaggaggcacaacggctggggatccgcggcgtcccggccatgcggctcgcgggcaatgggcccgtgctcctgctgaccggcgctcagccggaagaagccgttcgcgccgccttcgcgcgcgtccggccgggcccctccctgagtgccgtgcactga

SEQ ID NO: 8183 - DNA, 261 bp, Myxococcus xanthus
atggagcaccgcccgacccttgtcttcgctgatggcgcctgttcaggaaaccctggcccgggtggctgggggagcatcatcgtcacgcccgacgggctggtgacggagctgggcggacacgagccggagaccaccaacaaccggatggagctgacggccgtgggcaaggccctgcgccacctggagcgcgcgccgggccccatccacatccacacggactccacgtatgtgattcagggagctaccaagtgggcgctttag

SEQ ID NO: 8184 - DNA, 261 bp, Myxococcus xanthus
atgcagggccagcaggagctgagcggctccgtggtggccctgcggaaggacaaggtcttcatcaaggatgagaacggcgcggtggtggcgatgggcgtgaaccactccacgcaaatcgatgggaagcccatcgagaagcaccgcgacatccacagtcacctccggcgtgaaatcaaggagggggaccaggtccggaccaagttcaacgtggagaagacgaccgagaacatggcgtcttccatcgacaagatgaacaagtag

SEQ ID NO: 8185 - DNA, 2436 bp, Myxococcus xanthus
atgacgatgacccttggccaggacctccgcttcgcgctgcgccggcttcgtggcagtcccaccttcacgctggtcgcggtggccacgctcgcgcttgggattggcgccaacgtctccatcttcagcgtggtgaatgccgtgttgctgcggccgctgcccatgcacgacgacgcccgtctggtgcgcatgtacagcctgaggacgcaggggccggggcccacctccgtgctggacttcatggacctgcgggagcagagccgcacgctgaagggcctgtccgcggtggcgcccgtggcggtgacgctggcggcggacagcgcggacaccttgccggagaaggtgcaggcggggatggtgacgggcgacttcttcccgatgctgggcgctcgcgtgcagttggggcgcgcgcttcaccccgatgacgtccggcccggcgctccgaaggtggcggtgatttcccatgcgctgtggcagcggcgcttcggcgggagcgccgccgtgctggggcgctcggtggacctgggcgctccggagccgtggaccgtggtgggggtgatggcgccgggcttcgacttccccgcacgctcggagctgtggagcccgctgctctgggaagagggcatgacgaagcccgaggggcgcggggcgcactggctggaggtgtatggccgcctgggcccggacgtggcgctggagtccgcgcgcaccgagctctccgccatcgcccaccgtctcgcggggcagtacccccagacgaacgagggcaaggatgcgcgcgtggagccgctgcgcgacgtgctggtgggcaacgtccgtccgtcgctcctgttgatgctgggcgcggtggggttggtgttgctcatcgcgtgcgcgaacctcacgcacctgctcctggcgcgggcagcctcgcgtgagggggaagtctccgtgcgcatcgccctgggcgcgagccgtggccgcatcgcgcgcgagctgttggtggagtgcggcgtgctcgcgggtctgggcgcggctgtggggttgctggtggcgatgtgggcgctggatgcgctggccacgtgggggcctcaggacattccccgcatcgaagaggtgtcgctggatggcccggtgctggccttcaccgcgggactggccgtgctgaccacactgctgttcgggctggtgcccgcgctccaggcggggcggctggacctggttcgtgggttgaagcgggtggtgggcggcgggggtggcggcgcgcaggggcaccgcacgcgctccgtgctcgtcgtggcggagacggcgctggcggtgctgctgctggtgtgcgcggggttgttgctgcgcagcttcgtgcacctgcaacgggccaagcccggcttcgaccccgagggcgtgctgacggtgaaggtggacctgccgccgcttcactatggctttggcaccgccgcgcccgcggcgttctatgacacgttgctcgagcggctgcgggcgctgcccggcgtggagcaggttggtgccgtgaatgggcttccactggatggggcccggtggaccgttcccgtgaaggaccccatgcggcccgttccggaggggacggagccatggcaggccagcgtgcgcatcgtgacgcccggggcgctggaggccttgcgcgtgaaggtgcttcagggccggggaatctcggcggcggaccagggcgcgggtgggcgcgcggtgctggtcaacgcggcggcggcgcgccgcttctggcctggcgaagagcccctggggcgcacgctggacaccggcatggactggggcagtggtgccatgggtgggcgcgtggtgggcgtggtggacgacgtggcactggaagggcttggcgcgccgtccctgccggaggtgtacgtgccctacgtgcaggcgcggaccacgagcatggtggtgctgctgcggacgaagggggcgccgctcgacctggctcccgcggctcgcgcggagattcgtgcgttggatgcgagcctggcgccaggcagtgtccgcacgctggcctcggtggttgaccgcacggtggcgccgctgcgcttctacctgctgctggcgggggccttcgcggcgctggcgatggtgctgtcggcggtgggcctctatggcgtcgtggcctacgcggtgctccagcgcacccgcgagctgggcatccgcatggcgctgggcgcgcgtcaggcgcaggtgctggggctggtgctcggccgctacctggggctgacggcgtgtgggctcctcattggattggggctggcggtggccaccagccgcggcctcacgcacctgctgagcggcgtgcggcccacggacccactgacgtacgtggcggtggcggcggtgctgttggcggtggccgtcctggcggtgctgctgcccgcgcgccgggccgcacgagtctcccccgcggtggcgctccgggcggactga

SEQ ID NO: 8186 - DNA, 2225 bp, Myxococcus xanthus
atgcgggtcctgattgtcacccaggggggaggggcggacctggcgccagtcgagtcctggctgcgtgagcagggacacacggtggtcaccgtgacgcgcgaggcggaggtgcccgccgcgtggcgcagcggaacgtgcgcgctggtgatggtggatgcccggacggacccctcccgcgtcccgctggtgcgcgcacttcgcagcctgcccggcggtgaggaatccgtgttgctcctcctgggccaccggggcgcgctgggcggactgcggcccgtcctggaggccggcgccgatgatttgctcgcgtggcccgtggatgaggaggaactggcgctgcggttggagctggcccaccgccgcttcgtccggcgcgagggccgcaagggcctgcccttcggagatgacctgaaggagacgctgctggccgtcagccccgtgcccacgtccatcaccaccatcaccgaggggcgcgtggtggcggccaacgaagcctacttcgaactcttcggctacacgcgcgaggaggtcatcgggcgcaccacgatggagctggcgctgtggcaggcgcccctgaaccgctcgcaaatcgtggacacgctgcggcgccacggcacggtgcgcggcgtggacgcgcagtaccgcacccgcgagggcgagctgcggcacacgttgctcttcatgggcctggtgccctacggcggcacgccccacatcatcgccttcttcccggacatcaccccgctcaagcgcgccgaggagagcctgcgccgctcggaggtgagcttccgcaccctcatcggcagcctgccggacatggtggccgtcttcgacaccgactcgcgcgtgcgctacgccaacctcaaggtcgccacggccctgggctacgagagtgcgaacgagctgctgggcaagcacttctccgacatcatccccaaggaggacttcgccagcgccaacgcgcgcatgcacgaagccatccgcaccggccgcgcggcgcaccaggagcggcggctgctcaaacgcgacggcagcgtgctgcacgtggagtccaccacctttcccctgcccttcgacggcgaggactccatcgttgccgtctcccatgacttgacggagcgctaccagatgcaggcgcggctgatgctcgcgcagcgcatggcctccgtcggcacactggccgcgggcgtggcacacgaaatcaacaaccccctggcctacctcaccgccaacctggccttcgcacgcgaggagctcaccggcgtgctgcccaccggcacccggaacatggagccccggctggcggaggcggtggccagcgcccaggccgcgctcgccgaggcgcagcagggcgccgaccgggtgcgcagcatcgtccgggacttgaagacgttcagccgggtggactcagcggagagcgaggaagtggacgtccggcaggtgctggagtccacgctgaacctggccaccacggagattcgtcaccgcgcccgcctggtgaagcagctcgacgcggtccccaccgtggtcggcaacgagtcacggttgggacaggtgttcctcaacctgctggtgaacgccgcccaggccattccctccgggacgccggagcgccatgaaatccgcgtcgtcacccgcctttcgggcaacggccacgtctgcgtggaggtgtcggacacgggcgccggtatcgccaaggaacacctgccgcgcctgttcgaccccttcttcaccaccaaggagcccggggtgggcaccggactgggcctgtccatctgccacagcctggtgacggccctgggtggggaaatccatgcgacgagcgagccgggcaggggctccaccttccaggtgctcctgaccccctcccagcgactcgggaccgagcgcccaccgcccgctccgccgcccgcccccacggagaaacggggcagcgtgctggtggtggacgacgagccgctcgtctgcacggccctggggcgtacgctgcgtccgcaccacgacgtcaccctcttcacccgggcccaggaggccttggagcgcatcgaggccggcgagcgcttcgacgtcgtcttctgcgacctgatgatgccgggcatgagtgggatggacttctactccgccctccaggcccgccaccccgagcaggcccagcgggtcatcttcctcaccggcggcgcggtgacgcctcaggcccgcgccttcctggaatcggtaccaagccccca

SEQ ID NO: 8187 - DNA, 3213 bp, Myxococcus xanthus
atgcacaagactcacctcgttggcgcgcgcacgcacaacctgaaggacctgtcggtcgacctctcggaaggggagttcgtctgtgtcactggcgtctctggcgccggtaagtcgagcctggcgctcgacaccctgtatgccgaggggcagcggcgcttcgtggagagcttcagcccgtacgcccggcagttcctcgagcggctggagcggccgcccatggacgccctggagcccgtggccgcgggcgtggccgtggaccggcgcgcgcccgtgaagagctcgcgctccacggtggccacgctggcggacgtggagccgtacctgtccgcgctcttcacccgtgaagccgtgcccgtctgcggcacctgcggcgtggaggcggtgcggacggacgcgcgcgtggcagcggccgcggccattcgcgagcacacggacgcgcaggccatcctcaccttcccgctgcgcatccccgacacggcggccttcctggacgcgcgggcccggctgctgaaggacggctaccaccggctgatggtgcagggcgaggtgaaggagctggagtcgctccgtcccgccgaggcgaccgacccggctggaatcgcgcgcgtggtggtggaccgggtgaagctgacgaacgcgcagttgtcgcgcgtgacgcaggccctggaggacgcgtggaaccgcgcggacggcgaggcgcacctcttcgtccctgggcagagcgtgccccagcggctgcggcgcgggctggtgtgccccaagtgcgcgcgggagttcgaggccgcgcggcccggcctcttcagctaccagtcgccggtgggtgcgtgcgccgcgtgccgtgggttcggccgcaccattggcatcgactggggcaaggtgattcccaaccccgagctgagcctgtcggagggggccatccgtccctggtccggccagtccaccacgtgggagcgcggcatgctccagcgctggtgcaaggcgcgggggattccgtgggacaagccctggggcctgctgacgcccgagcagcgcgagtcggtgctggagggcgagggcgactacgacgagggccgcgcctacccgggcgtgcgcgcgtggttccggtggatggagggccgcacgtacaagatgcacgtgcgcgtgctgctggcgcgctatcgcgcctacacgttgtgcgagagctgtggtggcggacgcctcaacgcccaggcgcgtgcgtaccgagtgggcgggctggatttgccgtcgtggcaccacctggagctgacggatgcgctggcgcggctggacgcgctgcgcaccatcacgggacagggtgagctggcgcggcgcgaactggccggccgcctgcgctacctccagcgggtgggtctgggctacctcacgctggaccgccccgcgcgcacgctgtcgggcggcgaggcgcagcgcgtgtccctgacggccgcgctgggcacgtccctcaccggcgcgctcttcgtgctggatgagcccaccgtgggcctgcacccgggcgacgtgccgccgctgacggaggccatcgcggagctggcggagcggggcaacatcgcgctggtcatcgagcatgatccgctggtcatccgctcggcgcaccgcgtgctggagctggggcccggggccgggaagcagggcgggcggctggtattcgatggcacgccggaggcgctggccaagaagcaggacctgcccacggggcggctgctggcaagcgtggacgaggtgccgcgcacgccgcgcacgcgcaccggggcgttggtgattcggggggcccgcgagcacaacctgaaggacctcacggtggaggtgcccctgggcgtgctgtgcgcggtgacggggcccagcggctcggggaagagcacgctgatggacgaggtgctgtaccggcacctggcgcggcggctgggcgtgaaggacgtggaggcacccggcgcggtggacgcggtggagggcatggaggcggtgaaggccatcaccctggtggaccagtccccgctggggcgcacctcgcgcggcaacgcggccacgtacaccaaggcgtgggaccggctgcgcgagcgcttcgcctccgagcccgacgcggaggtgcgcggcctcacggcggcgcatttctccttcaacgtcgacaagggccgctgcgaggcttgctcgggcgagggctacgagacggtggagatgcagttcctcgccgacgtggcgctgctgtgcgcggtgtgccgcggccggcgcttcaaggaagaggtgctggccgtccgccatcagggcttcagcgtggcccaggtgctggagatgacggtggacgaggtgctccagcacttcggcggcgacacggcgctgaagcgcacgctggggccggtggcgcggctggggctgggctacttgccgctgggtcagccgttgtccacgctgtccgggggcgaagcgcagcgtttgaagctggcgcgggcgctggcaaatgaggcgcaggggacgctgttcctcatcgacgagcccagcgctggcttgcacgcggaggacgtgcgccacgtcatcaccgcgctgaatgcgctcgtggacttcggcgcgagcgtgctggtggtggaccacgacgtggcggtgatgaaggcctcggactgggtcatcgacctgggccccgtgggcggccgtgacggtggccggctggtggcggaagggacgccggaggacgtggctcgcggcaagggcgccaccgcccaggcactgcggggcgagcgcaagccgctgggccgcgcggtgaagttgcgcaagccgggcaagggtgaggtccccgccatcgaggtggagcacgcgcgcgagcacaacctccacgacgtgtcgtgccgcatcccgctggggaagatgaccgtcgtcaccgggccgagcggctcgggcaagagctcgctcgtcttcgacgtggtgttcgcggaaggccagcgccgcttcctggagacgctgagcccttacgcgcggcagttcctgccctccatgccgcgtccggatgtggagcgcatcagctcgctgccgccgtcggtggcgctggagcagcgcacctcgcgagcgggagccaccagcaccgtggccaccgtcaccgaggtggcccactacctgcgcctgctgttcgccaagctgggcgagccgcactgcccggatgacgactcgcccatcacctccctggcgccggacgtgctcttcgcgcag

SEQ ID NO: 8188 - DNA, 192 bp, Myxococcus xanthus
atgaagatgctgctggagccggtgcaggcgggggaatggcgcatccgcgtcgtggacccggacccgctgccggacttcgtcgccggcgtggtggaaggcgtcctgctgcgcaccaaggtgttgccccaggtggaggtgctggagcggcagaccgcggggtacgccctgcgggtgcgctggacgggcgcctga

SEQ ID NO: 8189 - DNA, 1215 bp, Myxococcus xanthus
gactacccgtcgctggagcggaagttccagtccgctctggaggcggacgggaacctcgccgaggccgactacaacctgggcgtgctcgccgagcgtcagggcaagctgaccgaggcgcgcaaccattacaagacggcgctcacgaagaagccctcgctgcgtcaggcctctgagaacctggcggtgatggagcagaacgcgggcaacgtcgccggcgcggtggcgctgtaccaggaggtgctccagcgctacccggatgacgcgcagtcacgcgcgcggctggcggagatcttccggcagcagggggaccacaccaaggccatggacctgacgcgcgccgcgctgatgcgcgacccgcagtccaccaccgcgttgaaggtgatgatccgcagctacctggatcgcaagcagctcgccatggcgaagctggtggccctgcgcggcgtgaagctggacgcggcggacccggagctccaccacgccgtgggcctcatcctcctgcaggaaggggacgtggatgacgcgcgcctgtccttcaagaaggcgctggaggttcgcgaggactacgtgccgtcgcacgtggagctggcgcagctggccctggccgcggagaactaccccaccgccgagcagcacctgcgccgcatcctccaggcggacgggaagaacgccgccgcgcacctggacctgggcgtcgcctacaagggcatgggccagttcgacaaggccatgcaggagtacgacgaggcggagaagctcgaccccgagctggcggccgtgaacctcaaccgcgccatcatcctccacaaggtgaaggacgcgcccgagcgcgcctcggagctgtaccgcaagtacatcgccatggccggcggtgaggtggcgctgcccgccgaggcccccgtgttcgccctgctgcgcgaagtggaggtcgtcgtcaacgcgaagcgcgaggccaagttcgccgaggagcaggcgaagcagatggaggagctgcagaagcagcagcaggcccagatgcaggccgcggagaaggcggccgggacggcgaacccgcccgccaccaccgcgacgccggcttccggcacgggccccgcgccccaggtcactcccgccagcggcaacacgccgccagcgcccgcccccgtaaacggaaactccgaccagaagaatgcaggctcggcggaacccggggagccggaagacgacctgctgtga

SEQ ID NO: 8190 - DNA, 255 bp, Myxococcus xanthus
atgctgtgtgcggtgctcgcggtgacgcccgccctggcccaggacgagggctcgaacccgggtggtccaggggagggcaatgtgcgctactccaagacgaccaacatcgacttcgaggacgacaccatcgagggcgacctcacgaagccggatggcgagtacatcgatgcgcgtgagcgggtgaagcactcgaacctcatccgcatccgcgaggacttcgaggacaaggtgatgcagtccgtgggcgagctgtag

SEQ ID NO: 8191 - DNA, 690 bp, Myxococcus xanthus
atgtccttcgaggatcgtgtcgatgcgggccggcggctcgcccagttgctgcgcgagcgtggctacacgggtgaaggcacgctcgtcctggcgttgccccgcgggggtgtacctgtggcctttgaggtggcaacagcactgggcgcaccgctggacgtctgggtggtccgcaaggtcggtgtgccgggctacgaggaactgggcctcggcgcggtcgcggaaggcggtgtcgcgttcgtcaaccggaggctgatggacgaggtgggcgtcaccgaggaagacatgcaaggcctcgtccgtcagaagacggatgaagtgaaggtccgggtggcgcgcttccgccagggcatcgaggcgcctcgaatcgaaggccagcgcatcatcctggtggacgacggcatcgcgacgggaggtaccgtccgagcggccatccaggcgctccgcatgcaccggcccggcagcatcatcctcgcggtccccgtcgcggcatcccagacgctcgcagagctcgcccccctggcggatgacgtggtgtgcgtgctttcaacgccgtcgctgtatgccattggccagtggtacgccgacttccaacaggttccagatgaagcggtcgcgacgctactggcacaggcccggctcaccctcggtcacgaccgtcacgcgccgcccggcgacacggcccactcctga

SEQ ID NO: 8192 - DNA, 1923 bp, Myxococcus xanthus
atggccgttcctctgacactcaaggtcttcaagggcgactcgctggtcgcctccaaggactacgagcgcgacatcatcaagattggccgtctctcctcggcgcacctgtgcctggaggatgagaaggtcagccgcatccactccgtcatcgaggtcgccagcgacggcgccatgtccatcatcgacatgggcagcgtcgagggcacgtacgtcaacggcaagcgcgtcaccaaggggctcctctccttcggcgatgaaatccgcgtgggtggcaccaccatccgtctggaaaacccggccgcggtggccgcggtgaacctggcggccgcggcggccagctcggaggtggtgacggagaagaatccggtcatcgcggcgccggcgccggccgagagcctggcgcaggccgcggtggccgctccggccgtgggtgccatcgacccgtccttcgccgccacccagcagaacccggtggccgctcccgccgagcccgcgccggcccccgtcgtggcagcgccggaggaagccgcgccgcgcgtgcgaacggttcgccgcacgaagtccagcggcccgttgggcgtgggcctgcgcttcgcgtggggtgaccagcgcgtgggcgagttcttcatggctcccggtaggaagggggccttcgtcgtcggcagcgccgcgggcgtggactttgtcatgggtgacgcccgcctgggcgccccgaagttcgacgcggttcgttcggacggccagtccttcaccgttcgcttcaccgcgaagatgaagggcgagctcacccgcaagggcgagacgctggacctgaaggccgtcatcgagtccggcaaggcctcgcatgagggcgaggcgtactcgctcacgctggacgcggaggacttcatctgggtggacctgggcggcgtgacgcttgaggtggccttccagcccgtgcccaagcgcatcgtggtgccgctgggcgagtccatggactacaccgcgctcaacatcttcctggtgctgttcttcatcgcgacggcgttcgtcatcaccgcgatgaaccgcaccgtcgcgggggacgaatacgcggacgagctgtcggcggacaacgcccgtatcgccaagctcatcatcaagccgccggaggcgcagaagaacaagttcctcgagcgcctcaaccagcagaaggagcagaagaagagcggggagatggcggcgaagaaccgcggcgacgaaggtcagatgggcaagaaggaggcgcccaagaccaacaatcgcaccgcgcccaagggtgacccgaacaagaaggacgaggcgcgcgcgctgacggcgaagatcttcggcggcggcaagggcggcatctccacggtgttcggcaagagcggcctgggcggcgacctgaagagcgccatgggcaacatgttcggcgccaaggcgggcaactccggtggcttcggtggcatggggctgcgcggcacgagcggcggcggcggcggcacgggtgacaccatcggcattggcggcattggcaccaagggccgtggcggcggcaccggcacctacggcagcggcgtgggcgtgctgggcggcaagcagagcgtcgacgtgggcatcacctcgtccgacccggaggtcatgggctcgctggacaaggagctcatccgccaggtcatccatcgcaaccgcggacagatccgctattgcttcgagagcctcctcaaccgcttcccgaagctgggcggcaaggtggcggtgaagttcgtcatcgcgggcaatggctcggtcgcctcgtcgtcggtggcgcagtccacggcggccaacgcggagctggagacgtgcgtggccggacgtgttcgcacctggaagttccccgagccgaagggcggcggcgtggtggtcgtcacgtatccgttcatcttcaagcagtccggcgaatag

SEQ ID NO: 8193 - DNA, 417 bp, Myxococcus xanthus
atggcgcaggtggaggtgggcgtggacctgggcgagcacgtgtccgtcggcctgttcctcatgggctcgagcgtgcggacgggcgctcagtacgtgggcaactccggcggcgcggtgtcgggtgacttctccaccctgatccccggcgcggtgttgcgtgctcgcctggtggggttcgctgacagtcaggaagtgaagcgcacctggttctatctccgtgcaggtgctggctatgcgatgttctcgccgcagcggctcctccccgattccgacattcttgtgtttgccgggcccggagtggagtactacacacggctgcgccacttttccgtagggctcgaggtgacggggcagtacctcgtctccgggggctcgttcgggttcgcggtggcgccgaacattcgctacgcgttctag

SEQ ID NO: 8194 - DNA, 207 bp, Myxococcus xanthus
atggaagcggtgggccgcgcccgggtgggcgtggtcgtgacgggggtgcaccgggccaaggtcctcgccgtgacggaccgggtggttttggtggccgtggcgggcccggacgcggtgacggccgtgggcgtggagatggccgtggccgcgggcgtgatcgcgaagagggccccgtgggccctggccagcgcgtcatctccgagctga

SEQ ID NO: 8195 - DNA, 1560 bp, Myxococcus xanthus
atgcggctgaagtcgctggacgacctggacctgaacacgcgtggccgcctcatcaccacgctgctgcgcgtgcagcgtcagccgaagccggccgcgcccgaggcgcccgccgccgcggaggccgctgctccctccgaggcgccggccccggtggaggccgccgcgcccaccgagggtgaggctctcgccgagggtggggcgcccgccgaggcacctgccgccgccgagggtgaggccgccgcgcccgccgaggccgctgctcccgccgtggacgcggcgcgagagaagttcgatgcgtggacggacgtcatcttcctcgtcggtcaggcctggcgtgccgcgggtgatgccgagcgcgcggaggcggccttcgcggccagcggccgtcagcccggtcccgaggccgaggagcccgtcgcggcgcctcgctccgaggagcgccgtgagcgtcccgagcgcggggagcgccgtgagcgtggccctcggcccgagcgcggtgagcgtgccgcttcgggtgagcgtcgtgagcgtccggagcgccgcgagcgtcctgcccggggtgagcgtccggagcgtgccgagcgcccggagcgtggcgagcgtccgctgccggagctgacgggcacctgggacgagcaggcgaagcagctcgagaccatgggccgtacccgcgacgcgggccggctgcacgagcgcaacaactccttcgcggaggcggctcgcctcttcgaggcgggtggcgacctcaagagcgccctgcgcaacgccctggccgggagcgacaacgacacggcccgccgtctggtggggacgctgccgccggatcagctcgcgcccacgctggagaaggccggcgcctacgaactcctcatggagcacttcgtcggcaagggtgacttcgagaacgtggcccgcctctatgagcgcgcccgtcagttcgaccaggcggcgctcgcctacgagcgttccgggaagctcaccctggcgcgcaagtcgtacgagcgcgcccgggacatcgccagcgccaaccgcatccgtgggctcgaggtgaagagcctggtggagcggggtgatcggcttggtgccgccaccctgttggcggccgtgggccagcgccgcgaggcggtggaggtcctcagcccgctgcctccgcccaaggccttccacttcatgcagcgtctgaagctggacgacgaggcgaaggagctggcgcagaaggagctggcccgggccgagcaggagcagaagccggccggccgcgcccggtggctggagctgctgggtgacctcgccgccgccgccgaggcgtgggagggcgctggccgcaaggacaaggcgctcccgctccacgagaagcttggcaacctgcctcgcgccgctcagctcgcggaggagctgcagcagcgtgacaaggccattgccctctacactcagctgaacgacagcgcgggtgtggagcgtgcgaaggcgcttccggagacgaccgcacctgcccaggccccccgcggcggatgcggcggacggaagcgagggtggcgaaggtggcgagacgccgcctga

SEQ ID NO: 8196 - DNA, 819 bp, Myxococcus xanthus
atgcaacagcccacgccctcgtcgcgtcccacgctgcgcgtgtccgatgaccgcaccttcgtcgaaaccgaagcggcactcgacaaggccggccgtgtcgaggaattgattcgcctctacgaggggcgctcgcgcgatgtcgtctccgatgaagcggtgcgcctgctgtgccgcgccgcggagctcgcgcatgatcggcagcgcaacacgcagcgcgcggaggaactgctcaagcgcgcgttgctggtggcgaaggatccgctccccgcgctccgaggcctgaagcggctgcacgagtcgcggcaggatggcgccgcgctggcggacgtcctggagcggttgggcggcgtcacgcagggcgaggagtgcgcgggccactacctgaaggcggccgacgtctacgagcagaagttgttccggcgcgaccgcgcggtgctgtgcctgcagcgtgcggcgcgcgcgaagccggaccgcgccaccttccggcgcgtgcgtcagttgctgttgtcggaagagcgcttccagccggccttcgaggccttggaacgcgagcgcgcggcgctgggggacgcgggcatggcggaggagtacgccgcgctcgccgagcggctggtggacgaccccaccgagcatgaactggcgcagcgggtggtggatgtcgcccaggcgttggagccgcagaacgcgcggctggagaagaccgcgcgcgcgttgcagcgcttcgagcagacgtggcgtgaccgcgtgcggatgctgcgcagcatgtcgctggaggagcgcgacaggaagagcgctgcgcgcctgtcgctgctcgtggcg

SEQ ID NO: 8197 - DNA, 7553 bp, Myxococcus xanthus; identical to SEQ ID NO: 844

SEQ ID NO: 8198 - DNA, 387 bp, Myxococcus xanthus
accacggggttgctgctcttcaccaacgacgaacgtttggtccaacacgggacgtcgcccgagcggctcctgcccaagcgctacgtggcgggcgtggtggggccgccaccggaggatgcgctccgccggctgcgtgagggcctggtgctggaggacggcccgacgcggcccgcgggtgcccggctgcgcgcgccggacgtggtggagctcaccctgacggaagggcgcaaccaccaggtgaagcggatgctggcggcggtgggacatccggtgcggaccctgcaccgcgaggccgtgggcggcgtgacgctggacgtgcccgagggcgcgtggcggttgctgacggacgaggaagtgtcccaggggttgtccttctccgtctcctga

SEQ ID NO: 8199 - DNA, 1308 bp, Myxococcus xanthus
atggcctgggccgccctgttgtggctggggccggatgcggcggtcatcacccttcacctgctgtgcttcgccgtgctcgccgcggcgctcttctccatggctcccgagggacagggcgcgcgctacatctggacgtgcgcggtgctcatcgtcctctaccgtcccttcgggcacgtggcggcggcggcgtggtccgagcccttgtgcgtcgcattgctcgcgctcgccctggcgcgggaggtccggggcgcggacagtgtcggccgttccttcctggtgggggcgctgctgggcctggcggtgctgactcgctacgcggcgctgttcgtcctgcccgggctcctgttgtggcgcttcgtccgggcgcgtgaggcgggggtaccgcggcggcatgtcgtgcatgcactggcgctgggtgcggggctcggactcgtggtggcgccgtggttcgtccggaacggtgtgttgttcggccgcgccatggggccgccgagggcaccacgtggcgcggggctcttgtcctcgctgctcagtggggtggagaccctgttgggggaggcgtccttcggcgcgttcggtgtgctctgcgtggcggccacggtgtggctgctgatgcccgcgctgcgcggtgttcggggggagcgcccgccggatgcatcgctggagcggctgcggcccgcggcgctgatggccgtgtcgtatgtcgtgggcctgttctggacggccacccgcacgcagatggacacgctggatggccggctgctggcgccgctgggcgtggggctggtgccggtgacggcggcggtgttggtgtcgctcgtggagcgttcccggttgatgtcacctccggtgctcatcatcactggcgtggtggtggtggcgggacacctctgggcgccgctgcacgcgcgcgtccgtcagccccggctagggctgcaacaccttcgcgagcgcgttgccccgctgccggcgtgggtagaggcccacgtcaccgagcgggacctgctcctggggccgcagctctggtggggccatcccttctcacgtgcccccgtggtagcggatggctaccccgagcgaggtttcctgacgcggcagacattgggggcctacctgctgcggcacggcgccgcctacgagcgtttcttctggttcgataccaggcctccgcctgtcgacgcggctgccttcgaggccgtcgaggtcgcccggttggagacgaacgcctactggtccaccgtctgggaaatccgtcccgtgggccgcgcgactcccgtggacggacgcgaggcgatacccgcgccgtag

SEQ ID NO: 8200 - DNA, 825 bp, Myxococcus xanthus
atgttctccacggtcgcggtggacggtgaggtacggcgctgggaagaactgcacctgcgggacttcgcgcagggcttcttcttcggcgcgggcttcttcaccaccttccgcatcgaggccggcgagccctggttcctcgcccggcacctggcgcggctgcgcgcgagcctggccgccttccccggcgccgtccgcacgccaccgtcggagcacctcgcgaaagccgcggtgcgcgaagcgattgagcgctgcctgcgagccgacgccgcgatgggccccgcgtttcgaggtgtgggcaagttgtcggcaagtgatggccgggtgctgctcaccttccgcgagcacgccccagacctggagcggatgcaccgcgagggacgggccctggacagtcaggagccgggggcataccgccgcggcgagcccacgctgaatcacaagggcctcgcctacttccggcagttcagtgtgatggagcgcctgcccctgctcggcaatgaggccggcgaggtctgcgagctgcccacggccaacgtcttcttccagtgcggtggggtactcgtcacgccgcctctgtccgcgccgtgtctccccggcatcatccgcgaagtgcttctggaggccggacatgtggggacgctgcccatcgtggagcggcctgtctcgttcgcccagctcgcgcaggtgagcgcctgcgtcttcaccaactccgcccaggtggccaccggtgtaccgagcctcctcggccggccgctccccaccagcctggcgctggcacagggcatccggagcctcgtcgaggccgtcgcggcgcgcgagcgctga

SEQ ID NO: 8201 - DNA, 570 bp, Myxococcus xanthus
atgattctcgtcatcgacaacttcgattccttcaccttcaacctcgtgcaggcgctgggtgcccagggcgccgagctgaaggtggtgcgcaatgacgccatcactgtcgcgcaggtcgaagcgctccggcccgaccacatcctcatctcgcccggtccctgcacgccccacgaagcgggcgtgtccatggacgtcatccgggccctgggcgggcgggtgcccgtgctcggggtgtgcttggggcatcagtgcctgggccaggtgttcggcgcgaaggtggtgcgcgcaccggtgcccgtgcacggcaagacggcgaccatcgagcactcgggccagggcgtcttccgaggactgcccgcccccttcaccgcggcccgttatcactccctggtcgtggacgcggagagcctgccggcgtgcctggaggtgacggcgtggcaggatgggctcatcatgggcctcaagcaccgcgagctgccgcgcctggaaggcgtccagttccaccccgaatcgttcctcacgccccaggggccccaactgctcgccaacttcctggagccggcgcactga

SEQ ID NO: 8202 - DNA, 177 bp, Myxococcus xanthus
atgcccgtctacgagttctactgccgcaagtgtaaggagcccttcaccgagatcatgagcgtcaaggagcacgatgagcgaacgcccaagtgcccacgctgccaggagacgaaggaggtggagaagcgcatctccaccgttcataccgtgaccaccaagaagtggctgacgctctaa

SEQ ID NO: 8203 - DNA, 1308 bp, Myxococcus xanthus
gaaagccggttcctgctggagagcacccgggtcagcgccgaggggcgctattcgttcctcggcgcgaagcccttcctgcgtttcaccgcgaaagagggacagtgcttcattgatggcgcgctccagcagggtacgccgcaggaggtgctgcgctcgctgctgcgccggtggcgtggcgtgcgtcatcccggaatgccgctcttctgcggcggcgcggtgggcttcttcggctacgaggccgcgcactgtttcgagtccctgccccggcacccacgggacgacctgcacctgcccgaaatcgacctgtcattcatcgacaccttcctgacggtggaccaccacgagggccaattgctcctggtggccacgggctcggactgggaggactgtgagcgcaggttggacgcgttggaggtccacgtccgcaccgcgacgcccacggcgccacgcgtgccacccgcgatggatgggcccacctcggcgtatcgctccaacttcaccctcgatgcttacctggacgcagtcgagcgcgtgcgcgagtacatccgcgccggtgacacgtatcaggtcaatctctcgcagcggctggaggtggactttcccggtgagccgctcgcgctctacgagacgctgtccgccatcaaccccgtccacttcgccagctatctcgaaggtgacggcttccacgtcgtcagcgcctcaccggagcggctggtgcgtgtggagaacggccgagccaccacgcggcccatcgccggaacgcgccgacggggcacgcccgaagaggaagcgcgcttcgtccacgagctgcgcaccaacgagaaggagcgcgccgagcacgccatgctggtggacctggagcgcaacgacctgggccgggtgtgcacctatggctcggtcgaggtgacgaagctgatggacatcgtcgagtacgcccacgtcctccacattgaatcggaggtcgtcggccagctcgcgccgggcgtggagccgctggacgtggtgggcgcgctcttcccaggcgggacgattacgggcgtgccgaagatacgcacgatgcaaatcatcaccgagctggagccacatgcgcgcgggctctatacgggctcgctggggtacctgtccttcacgggtgatttggatttgaacatcgtcatccgcacgctggtggtgaaggacggccaggcctacgcgcaggtgggaggcggcatcgtccacgactcgcagccccgacaggaatacaaggagacgctcaacaaggcgcgctcgcagctcctggccctggcatcggtggggaggccgggatga

SEQ ID NO: 8204 - DNA, 2754 bp, Myxococcus xanthus
atgggcggcctgggccaggcgctcgtgctctgcgtcgaccaggtcgaggacgtcagcgacttcgagcagcgcccacagatggagaactccttccggcgcgcgatgaacagcctggcggccatcgcgagcaaggtgcctcgcgcggtcgtggtcttctgctgcctcgccgactactgggcgaagatgaagcccctgctcaaccagggaacggtggatcgcatcgagaacgaccccgagcccgtgacgctggagcggaccgtgacggccgaaacggccagggacctcgcggcgcggcgacttcatgacctgtttgaacagcgaggcttcgcggtctccccgtcggacccgacctggcccattccggcgaacggcttcgacgcgctgggcggccaccgcgcacgcgatgtcctggatgagtgccgccgctaccgcgaccgcgccatccaggacggcaagctgcccgccaacttcccgctgcaacgtccccagggcccgggcgtggcgaagacacctttggctcagcagcagcaagtctccaagctggatatggaccaactgtggacggacttccgcgccaccctgcgaattgacccacccgaagagcccgcgcgtgtcgcggaactgctggcctgggccattgaagccggcggcaaggagctcggagacgcgaagcgcttcgacgtcaagcccaaggacaaggagatgctggacgtccaggtccacccggagggaagcaagctcctcgtcgcgctgtgtgagcgggactcgcgtggcggcggcctcggcaggcagatgaccgaagcgctcaagaaagccgcgggaaagacacctgtggtggtgcggaccaccgacttccctccagcccgccccggcggtgtcgtcgccgagcaattgggcgcgctgctccgcaagggcggacgccgggtcgtcgtcggagacacggagcttcgggacctcatggccctgcgcaatttccgtgagaggcatgcgggtgaagccgccctcctggaatggagccggacggctcgccccatcacccggctcaagtccgtgagcgacatcctggggctggagaagccggacgccccgcccaagggtggcacgggtgtcccgatgggcaatgtcggagcccggagcaccgcaaccaaggcacagacggagctgttcaacagcccaccgacgttgccgtatggaacgcctgtcccggcccaagtcctctcgggagcgaagtccacccctccggcccgcgccgaaacgagcgcactggaggcgagaggcgtgcgctccgcccgcgagcccatcgccgcccagcgggccaggcaaggccgggccgaatccctttcggatgacccgttgcaggacatcaccatcgaatcgccgatgctgacgggccgcaccatgacaccgccccagggaatgaagccccccatcggattcaggggcaacgcgagccccgccgctccgacgccctccccacgtcccccggaaacactcacaggaccgctgcggattggctcctcggaaggtgtgttcagccaggtggtgaccgtggacccgtccgagctgacccgccacagcgccttcctcggcaccacgggaagcggcaagacgacgctggcgctcaacgtcctggagcaactgctcctccgcggtgtgcccgccatcctcgtcgaccggaagggggacctcgccgcgtacgcacgtgacctctcctgggaggaacatctggacgaccccgccctcatcgagcggcgccgcctgctgcgcgagcgcgtcgaggtcgcgctctacacgccgggccgctccgacgggcggccgctggccatccctgtgattccacgcggccttgaaagcctgtcgccggaagagcgtgagcaaggtgtgcagcaggccgcggacgccatcgcgggcatgctcgaatacaagaccagccccaatgacaaggcagcccgggcgctgctcacgcaggccttgcgcctgttggtccagcggcctccgggcactgaactgaccctggagatggtccagaagttcgtcgcggagcaggacgagtcgctccggcaggaaacggggggcctgccaaccaagacgttcgccaagctcgcccaggacctcgaagtgctccggctcgacctccgccccctgctggcaacgggtggagaacgtctggacatcagcgaactgctggggctcggcgccgcgagcacaccgggcaagacgcgcctgagcatcatcagcaccaagtacctgggagacctcagccgcgtccgcttctgggtgtctcaactgctgctggaggcgaaccgctggaccagccagcaccccgcctccaggctccaggccgtcatgctcttcgacgaagccgacatctatctgcccgcgacgagcaagcccgcgacgaagcagccgatggagaacctgctcaagcgcgcgcgctcggcgggcgtgggcgtcatgctgggtacgcagagcccgggagacctggactacaagtgccgggagaacgtgcgcacctggttcgtcggcggggtgaaggaagacaacgccctgaagaagctcaagcccatgttcaccgaggcccgcatcgatgccgaaacccgcctccccggccagaagccgggccagttccatgtcctgcgcgaagggaaggtccagcaactgaaggcggaccgctccgcgattcgcaccgaccagctctccgaggacgaaatcctcaaggaggcacgccgcacgctggaacgcggctcacgctga

SEQ ID NO: 8205 - DNA, 1059 bp, Myxococcus xanthus
gccgagcgtactccccttgagcaaatccttgtccacacggggcaacactatgacgccaagatgagcgacgtgttcttcgccgacctcggcctgcctgccccggacgtccatctgggcatcgggtcgggcagccatgcgcagcagacggcacgcatgatggtggagctggaaaaggttttcctggcccaccctccggcgctcgtctccgtggtgggcgacgtgaacagcaccatcgcggcggcgttggtgacgtcgaagctgggcatccccctggcacacgtcgaagcggggctgcgcagctactcgccacaccaaccggaggagatcaaccggctcgtcaccgaccgcctgtcggacctgctgctgacgccttcacgtgacgcggacgccaacctgctcaaggaaggcaccgacccggcccgcatccacttcgtgggcaacgtgatgatcgactcgctcttcgcctcgcgcgagaaggccgacaagctgccggtgctcaaggacctggggctcatcccccacggctacgcggtgtgcacgctgcaccggccctccaacgtggacgaccccaagactctgggcggcctcctgtccgcggtggcccacgtcgccacgcgcctgccggtcatcttcccggtgcacccgcgcacgcggaaggtgatttcggagcatggcctgaacacgtggttcgagcgcacgccgagcctgcggcccgtggagcccatgggctacctcgacttcctggcgctcacgtcgaaggcgcgcctggtgctcaccgactccggcggcctccaggaggagacgacggccatgggcgtcccgtgcctcaccctgcgcgagcagaccgagcgccccatcaccgtggaggaaggctccaacgaggtggtgggcaccgacccggtccgcatccgtctggccgccgaccgcgtgctggatggtgaaggcaagcagggccgcgtgcccgagttctgggatggccgcgccgccgagcgcatcgcggacctgttcgcgagcttcctgggcgtcgaggaccggccgattcaggcggcctcggcctga

SEQ ID NO: 8206 - DNA, 990 bp, Myxococcus xanthus
atgcacagcgcaccgcaggaagaagcccccgagggctacgtcgacatccgctacgtcgtcgagccgaactacgcgggttggcggctggatgagtacctgggggagaagctccgccggatgacgcgggagcggctccagggcgtcatcctgaggggtgtcatctgcgaggagcggcgcctgaagccgtccacgccggtgtacccggggctggccttccgcatccgccgccgcgccagcgaggagccggacacgcccacggaattgcccgtggtgttccaggacgactggctgctggtgctggacaagcccgcgggtctgcccatccaccccacggcgcgctaccacaagggcaccctcgtcacgctcctgcgagagcgcttcggtgagcgcttcgccgagcccgcgcaccggttggacagggagaccagcgggctggtcgtctgcgggcgcaccacggagtcctgccgggtgctggggcggctgttcgtctcgcgtgacgtgcacaaggagtatctggcgctctgcgaagggcacccgcccgaggacacgttcaccgtggatgcgcccatcgcggagggcaccgagctcatccgcatcgccgtgcgcatcgacccggtggagggcaaggagagccgcacgcgcttccaggtgctccagcgcttcacgcgggatggcgcgcccttcgcgttgctgcgctgcttcccggagacggggcgccagcaccagattcgcatccacctgtgccacgcgggcttcccgctcgtgggcgacaagatgtacgggcccgaccccggctacttcgaccgcttcagcaagcactgtctggagcccgaggcgtggccgcggctgcgcctgccccggcaagcgctgcacgccgcgcgcatcgccttcccccacccgggctctggccaggcggtggcgttcgaggcgcccctgcccgcggacctcacggacttcatcgagggccggcccgtggccttgccggcctga

SEQ ID NO: 8207 - DNA, 450 bp, Myxococcus xanthus
atgccacgtccggacgcttcgcggctggtgccggcgctgacgcgggcggcgggggacaacctgctgtgtgaatccgcgccgcgtctggcggaggtgggcgcgctggtgctggggccgctgaagctggtggcggtgccgggtgagcccagcgtggccgcgggcatggagttgctgcagcggaccggcgccacgggcgtgctgagcctggcggatggctacgtgggctacgtggagacggcggcgaacgtgcagggtggactgggggagtccaagcgccagtacttcgggcccgcgctgctggaccggctgagcgtggcggcggagttcgttgccggggcggcgggcttcacgcctttaggcggccgggcgccgcggaggactttccgcggcgcggccggcttgaggctggctagaacttctcgaacttggagtccatcttgcgcttattga

SEQ ID NO: 8208 - DNA, 1401 bp, Myxococcus xanthus
aggcagcgcgccatgtgcggcatcttcggaatcgtggggcacgccgaggcctccaacctgacatacctggggctgcacgccctccagcaccgcgggcaggagtccgcgggcattgtcgcctctgacgggatggggctgcgcgctcaccggcagatgggactcgtcgccgacatcttcgatgcgccggtgctcgccgacctgcccgggcaggcggccatcggccacgtgcgctactccaccgctggaggcagcgccctcaagaacgcccagccgctcttcgtgcagtacgcgggcgggcagtgcgccatcgcgcacaacggcaacctggtgaacgcggcggagctgaagcagcagctcgaggccgacggcgccatcttccagtcggacgcggacacggaagtcatcctgcacctgctggcgcgctccaagcaggcgaccttcgagcagaagctcgtggaggcgctgcgcaaggtgacgggcgcctacagcctcctggtgctcacggagaacaagctcgtcgcggtgagagacccgcacggcatccggccgctggtgctggggcggatgaaggaaggtgcctacgtgctggccagcgagtcgaccgcgctggacctcatcgaggcggaaaccgtgcgcgagctggagccgggcgagctactcgtcatcgagaacgggctgctgcgcaccagcaagcccttcgcggagcctccgcgtcaggcgcgctgcatcttcgagcacgtgtacttcgcgcggccggactccacgctgttcggcagcaacgtgtacgaagtgcgcaaggaaatgggccgtcagctcgcgaaggagcagccggcgccctccgcggacctggtcatcgcggtgccggactcgggcgtgccggcggccatcggcttcgcgcaggccagcggcattccctacgacgtgggcctcatccgcagccactacgtgggccgcaccttcatcgagccgcagcagtccatccgccacttcggcgtgaagctgaagctgtccgcggtgcggcaggtgctcaagggcaagcgcgtggtggtggtggacgactccatcgtccgcggcaccacgagccgcaaaatcgtgaagatgatcaaggcggcgggcgcggtggaggtgcacctgcgcatctcctcgccgcccacgaagtggccttgctactacggcatcgacacgccgagccgccaggagctcatcgccgcgacgcacagcctggaggagattgccacgtacgtgaccgcagactcgctcggctacatctcccaggaaggcctgggccgcgcggtgggcgacccggagcgcggcagcttctgcaccgcctgcttctccggcaagtacctcatcggcgacttcggcgaagaacgcgccgagcccagcaagctcaccgcctga

SEQ ID NO: 8209 - DNA, 147 bp, Myxococcus xanthus
gtcgtgcaggtgccacccaacgcgcgccagctcaccctgaagctgaagtgccacaacgaggccgaggtggacgtcccggacgcggcgccaggcaatgagccggccaccgcgagcgtttccctcaagcggcagccgcgctgccgttag

SEQ ID NO: 8210 - DNA, 2340 bp, Myxococcus xanthus
ctggcggatcttcctcgctgggcccagcagttggcccggaagtactacacgaagacggtcagcgccttcctgctgtacggggccgtgcgggacttgcagcccctgcagctcgaggagggcggccgcggcttcggcacgctgaagacgttcctctccgaggagctcttcggcggccgggaccacgtcatcttctatgaccggtcgtccggcatccgctccgcgacgccggagacgcagaaggacctgcagcgggccatggcgggctacgacgccatgtacggcacggactacgccaaggtcatgccgagagacccgggccgcgcgctccagattctggagaacttcatgcgcatgcgcctgagcgagggccgctcgctggcgctcatcgtcgacttcgcggagacgctcgttcccggcggagagatgagccacctttccagcgaggaccgcttcgtggtggccacgttggacaagtgggcgcacgatccgcagttcctcgcgtccgacgtgtccgtggtgctgctggcggagaacctggcggacgtgtcgccgcgcatcagccgcaacccgtacgtggcgcccatcgagctgccccttcccaccgaggaggagcggctggagtacgtgcgctacaagctggagggcaagcggctccagtccgtgtcggacgtgccgctggcgggcctggcgaagatgacggcgggtttgtcccgcatcaacctggaccgcgtgctcaccgaggcgctcgagcgcgaggtgcgcatcacctccgagctgctcaaggagaagaagcgcgaaatcatccaggcggagtgccacggcctgctggagttcatcgagccggtgcacacgctggacgccgtggcgggacacgccaaggccaagcagatgctgcggcaggccgccggggccctgaagaaggggcgcctggaggtcatgcccatgggctacctgctgtcgggccccgtgggcacgggcaagacgttcatggtgagctgcttcgccggggagattggaatccccgtggtgaagttcctcaacttccgcagccagtggcagggcgtcaccgaggcgaacctcgagaagatcttcaacctgctcaaggccctgtggccggtggcggtgatgattgacgaggcggatacgttcctcggcaaccgtgactccggcggagactccgggacgagcagccgcgtgttcggctccatcgcctcgttcatgggcaacacgttctaccgcgggaagattgtctggttcctgatgacggcgcggccggacctgctgcccatcgacctcaagcggcaggggcgcgcggaggagcacctggcgctcttctatccgcagacggacgcggagcgggacgagctgttccaggtcatgtccaagaagacgggcgtgtccgtggaaggcatcgaatccttctccacgctgattccggagggcgtgcgcgccttcagcggcgcggacatcgaagccgtcatggtgcgctcgaagttccgcgcgctggcggagggccgcgaggcggtgacgaaggacgacctggccgcggtgctcgcggacttcgtgccccccagctacccgctggaaatcgagctgcagaacctggtggcggtgcaggagtgcaccagccgcgagctgctgcccgagggcttccgccaactggaccgggactacatcacccggcgcgtgcgcgagctgaaggcgctgctggagtcgcagtatccggtgctgccttacgcccaggcgcttgtcctgggcgcacggcccgctgagacttgggacatggctgatggccccactgctccgcgttcctggttcgcgtattccctcgacctggccccggtgattgcgcacgagcgcctcccggggctcccgcccattcccgacgtgctggagggcgagctggccgaggcgctcgacgtggacgtcgtctacgacgtggcgtcggcggcctggggcgggaaggtggcccggctggtggatgcgccaggccacaagctccccggcatgctccgccgcgttcccgcggacgcctgggacgcgctggtccgcctggagtcagcaatggcgagcgccaccgaggtccggcaggtgaaggtgcgcaccttcaccggggccgtgctcagcgcccatgtcttcacgcccacggctcccgcgacgcccgctcaggggctcgtgagtgaggcgttcctcgtcaccctggcgctatcagccgaggaggccgggttgtccccggaccacgtggagcggctccaggccgaggcccgtatcgtccaggccctccagaaggcgggccccgaggccctgaacccttcgaaagccccaggaaagaagggttag

SEQ ID NO: 8211 - DNA, 1194 bp, Myxococcus xanthus
atgcaggccgctgacgcggcgggcagcaagacgcgcggtggcaacgggcaggtgtccgcggcggagctggagcgctacctggccgcgcccgaggacgggcagtacctgacgtccaccgcgcttcagcagaagcgctcctcgctggacgcgaagctcgcgcagggaaatggctccgcggtgggcgtggacgccttcgagagtggctggcaggccacggtggcccggcgcgcggacctgctggggggcaatggagacggccagctcagcgcggaggaactggacgcgttcatccaggcgtcgaaggcgggcaagcacgcggacacccgctgggtgccggaccagcagatggccgcgttccagagccgcgtggccgaagcggccggagagctggacccgatgcgtcccgccggagcgctgggctcggaggggctcagcctggtgaaggagtactcgcgcctggcgctggaccagggggcgaacgtccccaccttcgtgagctacatgctgtccgcgtccgacatccaggagacgcccgcgacggtgtcccggctggagagcaccttcgttcgcgaccccgagctggggcgcaccggcgtcaccgactccgactacacgcggacgggcttcgaccggggccacatgaagccggcggaggactcgcccacgcaggaggcgatgaacgagagccacctgatgaccaacatcgccccccagcacggcaaccacaaccagcaggtgtggcgcacgctggagcagggcgtctccggtctcgtgaactcgcagggcggcaaggcgtacatcctcaccggcaacctgtacctggatgacaagggacagccgctgcctccggagaagcgggagacgacgggggcgggggagcgccgcatcgccgtgcccacgcacaacttcaagacggtcctccacgagctgccgaacggcagcctcacgatgtacgcgtacctggtgcccaacacgaaggacgggccgtcgaagaaggaggacatcctcccgctgctcgattcgcaccgcgtacccgtggaccgcatcgaggaactgctggggcaggacctctacgcaaacctgcccaagcgggtgcaggacaagctggagaagggcacgtcggccgaaggcgtcttccagcgcaacagcctgtacttcgccgccagcctgttccgtttcgcgcccggcaactga

SEQ ID NO: 8212 - DNA, 153 bp, Myxococcus xanthus
atggacctggaagttccgcagcgctcgggtggtgtgcgggccgtggtgtccgtctgcgccgccgtgcagggcgaagcccatgtcgagcagggtggcctgtacggcgcggaggccctcgccctggctgccggggccgaggatctgggcccctga

SEQ ID NO: 8213 - DNA, 1107 bp, Myxococcus xanthus
gtgctcaccctcctgctatgcggagatgtgatgacgggccggggcatcgaccaggtcctgccccaccctgctccgccgggcctccacgaggactacctgaaggatgcgcgggactacgtccggctggcagaggaacgcaatggccccatccggacgcccgtcggcttcggtgagctctggggtgacgcgctcgacgagatggagcgagccgcgccggatgttcgaatcatcaacctggagacgagcgtcaccacaagcgaggcgtggtggccagacaagggcatccattatcgcatgcacccggagaacgcggcttgccttacagccgcccgaatcgattgctgcgcgctggcgaacaaccacgtgctggactggggctatccggggctcctcgaaacgctggcgaccctccggtgcctgggcatcgccaccgcggggctcggggaggaccaggagcgagcacggcggccggccatcctggatgtgaccgggggccgggtcaccgtgttttcgttcggtgatagcagcagcggaatcccacccgtctgggccgcgacggaagaccggcccggcgtggatctgctgccagcgctgtcacccaccgcagtgcggcaactgggcgagcgcgtcgcggccgtcaaacgcacgggcgacatcgtcgttgcctccattcactggggcggcaactggggctatgcagtgccggacgcgcagcgggccttcgcgcgagcgctcatcgatgaggccggcgtcgacatcatccatggccactcgtcacaccacccccgcggcatcgaggtccaccggggccacctcatcctctacggctgcggagacttcctgaacgactatgagggaatctctggccacacggccttccgtccggacctgacgctgctgtacctggcgtccatcgccccggccaccggtcagctgacgggcctccgcatgctcccgatgcagctgcgccaactccgtccccatcatgcttcacgacaggacgctgagtggctgggcggcgtcctggaccggcaggggcgggaccttgggacccgcacgcggctggcatcagacggcaacggtgcgctcgtccttcagtggacgtga

SEQ ID NO: 8214 - DNA, 213 bp, Myxococcus xanthus
atggagttcgtggggctcatccaggcccttcccgaagaggcgcgcgcggcgtgggacggttgtacccagcggcgcttcgatatcgggattcatgtggggctggagccccattcgagcgccttccccgtgccggaactcgtcgtccagcagctcgccagtgtgggtgcggagctcgccttcaccgtgtacgcgccggagactacggggcgctga

SEQ ID NO: 8215 - DNA, 219 bp, Myxococcus xanthus
atgctcgacctctcctgggcggatggccggcactctggtgaggagctgcacggaacgaacgcccccgccctcctgggcacggacgtctcgcacggctgcatccgccactcgaacgaggccgtgcgcgtgctgcacgacgcgctctccgtgggagaccgcgtggccgtcgtcgagcacgtggatgacccacacctgggggtaccgcgtcccgtggcgtaa

SEQ ID NO: 8216 - DNA, 1788 bp, Myxococcus xanthus
atggtggccgaggacgcctccgagcaaggcgaggccacgcgcgacgcggttgagtccgagtccgctgagttggaggaactgcgtgcactggaaggcgccgcgctggacccggcgtcgcgctccaccgcggaggtgatgcagtcgctgcggcggctcggggtcgccaacccgctgcggatgcgcatgctggacgcgctcgacgagcacaccttccgcgaggacgaagagctgccggagattccgctcatcacggacctggccactttcgacgtggggcagattcaggaccgttacgacatcccagtggagatgcagccgctggtggcccagtacgtccagttcttccaggggcccgggcgacgctggttccgcaagtggatgtcgcgcgcggcccggtacgtgccggtgatgcaccccatcctggagcagtacggcctgccgaaggacacggtgtacctggcgatgattgagagcggcttctcggcgcatgcctattcgtgggcgcacgcggcggggccgtggcagttcatctccagcactggcaagcagtacgggctgaagcaggacttctgggtggacgagcggcgggaccccatcaaggccacccacgccgcggcgtcctatctgaaggacctcaagcgcgagctggggcactggtacctggcatgggccggatacaacaccggctccgggcgcgtccggcggatggtggagcggcacgggacgacgaacttctggctcctgtccgaagagcgcggcctggcgaaggagacgaagcactacgtgcccaagctgattgccgcggcgctggtggccaagcacccggcggcgttcggcttcaacgagaacgagttcgaccccgagcccgtgctcgacttcgatgaggtgcagctcaccgacgcggcggacctggacgtcgtcgcccgcgcggccggcgtgcccgtcaaggtggtgcaggacctcaaccctgagctgaagcgctggtgcaccccgccggcgacggccaagaagccctacacgctccggcttcccaagggggcagggacgcagttcgcggacaactacaagcgcatcagccccgcggagcggctcaccttccgcatccacaaggtgaagcgcggcgacaccctgtcccagatcgcggagacgtacggcacggcgtccgaggccatcctccaaatgaaccagctgaagtcggcccggacgttgcgcgtgggtggagagctggtgattccgattcccgccggcaagagctcgggcggcgcgctggcgacgaaggtggcgcaggcccgccgcagcggcgtggtggtgcggcccgaggacgaggtaccagcgggcacgcccaaaggcccggtggccgcgggccccgtgaagaaggagaccatcaacgggcgcacgcgcgtgacgtacggcgtgatgtccggcgacagcctctgggtgattgcgaacaagttcaacgtgtcggtggactcgctgaagcagtggaacaacctcaagcggcgcaacccgacgctccaggtgggctccacgctgttcgtctggcccgatggcaacacggccaccgccagcgtgcaggagcgcggcggcacggtgctggcgaagcactcggtgagcgtcgccaagcccgcgggcaaggctggcaaggtccacgcgctggcggagggcgagacgctctggtccgtcgcgcagcgctacggcgtcagcgtggacgacatcatgcggtggaacaagatcaaggaccaccgcaccctccccacggggaaggtgctcctcctcagcgccccgtag

SEQ ID NO: 8217 - DNA, 291 bp, Myxococcus xanthus
gaacaggtgtgcgggcagttccacctcaactgcgtggggtgccacgtcaccggctgggagcagcccggcggcgtttgccggctggacaaggtggcgggccgcgaggacgtgggctgtgagagctgccacggtccgggctcggagcacgcggacgcgccgggcacccacaacatcatcgcctcgccgggcgagagcgtgtgcgtcacctgtcacaacccggagaactcgcctcacttcgatttcgcgacgtacctgccgcgcatcgtggggccgggacacgggaagccctag

SEQ ID NO: 8218 - DNA, 678 bp, Myxococcus xanthus
catgacctgggcaacccactcagctcgctccaactgcggctgcggcgcctgtccatgcagagcgccggcacctccgacacgcggatgcgcgacggcctggccggagccgagggcgaaacgcggcgcctgggccggctggtgcacaacctcctggacctgtcccgcctgtcagcgggccgcatggtgctggacacggagccgctggacctggcgcacctggtgcgcgaggtggtggaacgtcaccgcgaccaggccagcgccgcgggctgcgccctcggcatccgcgtggaggaaggcgccaccggccagtgggaccggcagcgcctggaccgcgtcatcaccaacctgctgagcaacgccctcaagttcggccgcggccaccccgtggagctgcgcgtccaggccgacacccgctgcgtccgcttggccatccgggacggcggcatcggcattggcgtggaagcacagcagcgcctgttccgccgattccagcgcgtccatgccggcgggcagcaccccggcaccggcttggggctctacatcgtccgccagctcgtcgaggcccacgggggcaccatccacgtccagagccgaaccggggaaggctcggaattcacgattgaacttccccgcaggacaaacaaggaatcctgttcagtgaatgaagtgcaggtatga

SEQ ID NO: 8219 - DNA, 1359 bp, Myxococcus xanthus
atggacctgcccagccacttcatcgtggagccggtggactcgcgcggccggctcaccggcgtccccatcctgctcaacgcgggcaccgagcatcagcgccgtgcgggcatggatgacttcttcatccgccgcttccgcggcatccagacggcctccggctgcgccacgcccgacgactgctcggcctccacccagttcgaggaagaggccatcctggagctgcgcaacgcgtacgagcacgcccagcgtcagacgctcacgctgcgctccgacacccgcacgctgcgcctgcgctggagcctgcgtccggccgcgccctacgaaatcccggtcgagcaggtgcgcgacgcgcgctacacctacggcttccgcattggcgtggaggccctcaccccgcctcgcccggacggcacctatgcccccggcacggaaatcagcttccagctcaccctgcgggacggtgcgggcaaccggctccacgacaagggatacctgccgccctacaacgaagtggcccccgacggcaccgaatccgggctgcagtactaccgggccttcttcgacgcgacgaccacctactaccggcgcaagcaccgcgagcgcatgctgatgacgcaaatcatcgggccggcgcagaacatccagcccatccgctccatcgtcgcactggaggcgttcctggaccccgaagtggacgagcaggtggtggccacgcccgagcgcgacggcgtcttctcgcagttcgccaccctgcccttcgccaacgtcctcttcggcggcgccttcatcgacccgaacctctggaaccaacccaacacggacacctggcagttcaagctgccggacaacgcggcccccggcacctacctggtgacggtgaagggccgccgcgtgtacctgggcgaggacctccccgggtcgacgaccattgaaatccaggtggggaccccgcagcgcacccagcccaagcacaccaccggcccctgcacctcctgccacagcaagggcggtgagctgggcgtggtgctgcacgccaacgacaaccgcgccgcgtgcgccgggtgccacgccccgctcgccttcgagctggagggccccatcttcgtgcgcacccacttcatccactcgcggtccaaccgctttgacgcaccgctccagcagtgctcgtcatgccacctgacgaaggagagcatccagcgcaccagcaaggccgcctgcctgtcctgccataagagctatcctgacagtcacgtggcgcaattcggacccatcgagagcatgtatgtggggggcggcgctgagtctttccagcagtgcaccggcgcctgtcatactcggcaccctggaagcggcctctaa

SEQ ID NO: 8220 - DNA, 1146 bp, Myxococcus xanthus
atgcagacggctcgcaccacgctgagggagccagatgccgccgcggaggacctcctgagccaactgggcagcgacacgccccgcctggtgacgatgttcgcctcgcgggagcgtgaccagctcgcgctcaaccgcgccgtgcgtcagcggctgccggcggacacgcgcctgattggcgccaccaccgcgggcgagctggacaacaccggcatccacgagggcagcgtggtgatgagcgccctcttcggcgacttcgaggtgggcctgggcctgggcaccggcctgtccgtggacgccatcagcgcgggcgcggccgccatcaagcgcgcgtgcgaggacctgggcgtgcggcagcaggacctggacccgcgccggttcgtcggcctcgtgattgacgacggcttccgctacaagaaggaagagctgctgctcggcatcctggagaagtgccagacgctggtgctggtgggcggcggcgccagcgacgccaaccgcgacccggccaagcagtccgccatggtgcacgtggatggcgaggtcgccaccgacgcggtgctggtggccctcttcaagacgagcgcgccctgggccgcgctccgctcccactggtacgtgcccaccggtgagaagctcaccatcaccaaggtggatgaaagccacacccgcgcgctcgaaatcgacgggcacccggcggccaaacgctacgcggaaatcctgggcgtgggcgtggaggagctggagttcggcacgccccggggcttcgccgtgcgccccaccgcgctgcgcgtgggccgggagtacttcatccgcgccgcctggagcccgcaggaggatggctccatcctcttcgccaacctgctggaggaaggcaccgagctggagctgatgaagctgggggacatggccggcatgacgcgcagcttcttcaccgacgaggtaccccgcagggtccagaacccccaggccgccctgctttttcactgtggtggacgcatgtggtacgccagcgccaccaacaccgcgcagcaactggcggaaacgctgaaggccgcacccaccgccgccgggatgaacgtgcacttcgaaatctattcggggttccacatcaacaccacgctgaccgcgctggtcttcggggcgaactga

SEQ ID NO: 8221 - DNA, 643 bp, Myxococcus xanthus
atgggcttcgccgaggtccaggcgttgtggagcaagcacggcaaggagctgcccttcgtggtgctgtcgcgcgactggtgcgaggccacgctggaggccagcgtgcgcgccggagcgctcgactacatcaccgaggaccgcttcagccgcctggcgcccgtggtgcagcgcgagctccggatgacggcggaccgccgccgccacaccgccaccgcggtgcagttggagcgcaccaactacctgatggagaacatcatcgacgcgattccgttcgtcctcttcgtgaaggacgcggacacgcgccggttggtggtggcgaacaagacgttcgcggacgccttccgcgtcaccaaggaatggctgctggggaagctggaccacgactacttccccaaggagcaggccgagtcgttcatcgccatcgacacggagattctcgaaaccaagcagatgaagtcctttgaggaggtggcccgcgccgacggcgtggaccgcatcttcgccacgcgcaagctgcccctgctcgacgagcacggcgtggcccgctacgtgatgggcgtcaccgaggacatcaccgagcgcaagcatcacgaagagatgctgcgcgcgtccaaggcggagctggaggcggccaactttagag

SEQ ID NO: 8222 - DNA, 1557 bp, Myxococcus xanthus
atgggggcactgcttgcactgctcgccaccacccagctcgcgtgcgtcgtgggcccgcgcttcaccacgtgtccgggtgaaggcggccggccctggctgcgcctggacagcgaccactacacgctgcacacggacctcctcgccgaagaggcccgcgaggccatgcagcgcctggagcggacccgcgccgccatcctcacgtcgatgtggccgcagtccctgcgccaacagatgacgaagctggacgtctacgtgattcagagcccgcgcgagttcgaaggcctctacccacgccgcgtgcgcgcattcttcttccgctccgacagcgaggctctcatcgtcctgtcgggacggcccggcacttgggagcagaccttctccggcctctccctggcatcctcgtcgccgctgaaccatgagctggcccactatctgagcgcctatcccctgtcccgtcagccccgttggctttctgaggggatggcggagtacctggagacgttgcgaatctccaaggatgggagaacggcggtcgtcggagcgccgcactggacggccatcgcgcatatccgacccaggctcaacaaagtcctgcgagacgtggcgcaaggatggtcgatgcaacaagtccttcaatgggaccgcaccctggaggcccgcgagcaggacaaggaggtcgaggcgaactacgcgggaagctggctgctggtgcactggctggtgaatgaacgcccccagcccttcgccgaatacctggcactgctccaccagggcgtctcgcccgatgaagcgctcacgcggacgttgcccgaactgacgtcgccgtcgctcgacggcttgctctatcaatacgtgcgcaaacgccacttcgtggagcggaccgtctccgtgcctcccatcggaacggcgttcgtcgaggagtacctcgatgacgcccaagtccatgccatccgcgccaggctcgccgcgctgggggcacacctggcgcaccgggagcccttcatcaccaaccgccagaaggtggcgagggacgaactcgatgaggcgctccggctgaaccccacgggactcctggcgctgtccgcgaagctgcgcggcgcggcgccgtccgaacaggtggccattggccgaagcatcgtggaggcccatccccacgagagtgaggcctggctgctgctgggcatggcgatgcggcacgcccccgccgcgacagaggagcgcgaggccacctatcgcgaagccctgcggctcgatccgcgcaacgccaacgcggcgcgtgaactggcgtggatgctcatcaaccaggaccggagcgaagaagccctgccgctggcgcgctgggccgtggcgctcgcgccgtggagccccaacgccctggacacgctggccctggcgctggccggcaccggcgcctgcgaggaggcacggcaggcggagcaccgggcactggatttcatccaggaggacggcgcgccagagctggagtacctgctccgccagcgcatcgccgggctcgaggacggcaccctctgcgtggcgagcccgcccggcccctga

SEQ ID NO: 8223 - DNA, 1392 bp, Myxococcus xanthus
atgagccagtgcactcacatcgtcgacaatcccttcaccggagacgtcgccgcttcggtcgagcccacgtcccccgtgaagctggacaccgtgctggagcgagcccgcgccgcgtcgcgcgcgctgcgcgccctgagcgtggcggagcgcgtgaagctggtgctgcgcgcgtgcgaggcgatggagaagaacgccgacgccatcgcacgggacatcacccggcagatgggcaagccgctgtcccaggcccggggtgaggtgggcggcatggcgggacgcctgcgccacatggccgccatcgccgaggaatccctcgcggacatcgtcctgccgcccaaggacggcttcgagcggagaatcgcgaaggagccgctgggcgtggtgctggacctgcccgcgtggaactaccctctcctcaccgcggtgaatgccatcgcgcccgccgtgctcgcgggcaacgcggtcatcgtgaagcactcgccgcgcacgcccctgtgcggtggccacttcgcgcgcgccttcgccgaaacaggcgcgcccgacggcgcggtgcaggccatcttcctggactacccggggacggagcagctcgtcggtgacgcgcgtgtggaccacgtcctcttcacgggctcggtgctcggcggccacaagatgcagacggccgcgcgcgagcgattcctccacatgggcctggagctgggaggcaacgacccggcctacgtcgcgccggactgtgacttcgacaagtcggtggagaacatcgtcgacggtgccatgtacaacgcggggcagagctgctgtgccgtggagcgggtgtacgtgcaccgctcgctgtacgagcgcttcgtcgccgccgcggagccactcgtgcgcgcctacgtgctgggcgacccggagtccgagcagacgacgatgggccccatcgcccagccctggcaccccgccgagttgcagtccttcgtccaggacgccacgaacctgggcgcacggctcgtcacgggtggccgcgcggcacaagtgggaggacggggccgcttcttcgaacccaccctgctccgcgacgtgagcccccaggcgcggctgatgcgtgaagagtccttcgggccgctgctgcccatcgcgccggtggactcggatgaggaggccctggcgctgatgaatgcctcgcggctgggcctcaccgcgagcgtgtggacgtccgaccgggagcgcgcggaccggctggcgcggcaactggaagcgggcaccgtctacatgaaccgctgtgacgcgctggaccccgctctgccatggagcggcgtgaaggactccggacgcggcgtgacgctgagcgcgctgggcttcgacgccctgacgcgacccaaagcgctccactaccgcctgcgcttctga

SEQ ID NO: 8224 - DNA, 1806 bp, Myxococcus xanthus
atggtggcgttcatctccggcttcatcggcgcctcgcgggcgcagcggctgtcgctgcccgaggccaccatcggcgtgctgtacctgggcctgcccatccccatcgtcctcacgctgatggagcggctgcctgggctccagctcgcgctgggctaccggctgcgcgaggtgacgtacgtcgcggggcttatcggccgcccggagctggggtactggctcgtcttcatgttcctggtgctggcgctggtgctgggcgtcaacaccggcttcatcgccgccggcagtggccgcgtcgacctgaagatgggcttcgagctcttcgtcgcgcgccggcacgtggcggtgttccgcccctcgctgctgctggggacgctggcggtactgatgctcggcatcattcctccgctgctcatctacttcatcatccgctcggcggaagccgcggtggagcgcacccgcatccgcaagctggggctgaaggacccgctggcggccgcctccgacctcaaccgcctcaagcagcacgagcagtcccccaccatgatgatgacggccctgtcggtgggcggcgtgggcgtgggggtgatggcgctcatcatcgtcctgtcggtgatgagcggcttcgaggcggacctgcagcagaaaatcctgggcaccaacgcgcacgccgtggtgtccaagtacgcgggcgacctgcccgagtacgccaaggtcatggagtccgtccgcaaggtgcccggtgtcgtgggacagacgcccttcatcatcaaccaggtgatgattgcgtccgagggcaacgtggacggcgtcatcatcaagggcatcgacccgggcacggtgggcgaggtgacggacctgcccaagaacatcctcggtggcggctcgctcgacaccctctatacgccggagaagatcgtccaccgcggcctgccggacgaggagcccgccgaggagggtggggtggaggaggacgaaatcatccgccgatccggtacgcccaagaagccgcaggtgctgcccggcatcgtcatcggccgggagctggcggcgtcgctgcgcgtggtggtgggagaccgggtgaacgtcgtgtccccgctgggcaccgagctggggcccattggcccgattccgaagagccgcgccttccgcgtggcggccatcttctactcgggcatgtacgagtatgactccaagttcgtctacatcctgctcaaggaggcccaggacttcttcgacatgaagggcgccacgggcatcgagttgaaggtggcggacatcgacgacgcgcggcgcatcgcctcccaggtggtgaaggcgctgggtggctacccctaccgggcgagggactggggtgagatgaacaagaacttcttctccgcgctgcgcctacagaagctggtgatgggcatcatcctctccatcatcatcatcgtggccgcgggtctcatcgtcgccaccgtcatcatgctggtgctggagaagcggaaggagatctccgtcctcaaggcgctgggcgtcccggatggtggcatcgtgaagatattcctcgcagagggcctgcaaattggcgtcgcgggcggcctcctcggtctgctgtccggcctctcctcgtgcttcttcatcgagaaggttggcatcaagctggacccgggcgtgtatttcatgtcggcgctgccggtgcgcatcgagccggtgcagaccgtgctggccgtcgtcatcgcggtgctcgtcacctacctcgcctccatctacccggccctcaaggccagcagcgtggagccagtcgaaggcctcaaggcggagtag

SEQ ID NO: 8225 - DNA, 924 bp, Myxococcus xanthus
atgttcatcgacctggaacgggatgcctggcgggcgctgcgtgccgcaacgcctctgccgctgaagtccgaggacattgacggcctgcggggcctgggagagcacctcgacctggacgaggtggtggacgtctacctgcccttgtcccggttgctgaacctgcaggtggccgcggcgcagcggctgtgggcggagcagcaagccttcctgggaggttcgacgcagaaggtgccgtacatcatcgccatcgccgggagcgtggcggtgggcaagagcacgacggcgcgcatcctccaggcgctgctgaagcggtggccggaccacccgcgcgtggagttggtgacgacggacgggttccttttccccaacgacgtcctcaccgagcgcgacttgatgaagcgcaagggcttcccggagagctacgaccggcgcgccctggtgcgcttcctggcggagctgaaggccggacgcgcggaggtggcggcgccggtgtattcgcacctcgtctacgacgtggtgcccggtgaggcgcaggtcgtccgccagcccgacatcctcatcctggaagggctcaacgtcctccaggccggggcacaggaggggaagcagatgccggcgacgttcctctccgacttcttcgacttctccatctacgtggacgcgcacgagcacgacatccgccgctggtacgtcaaccgtttcctcaagctccagcagacggcgtttcgcgacgagcgcagctacttccgccggttctccgagctgaaccacgagcaggcgattcagctcgccgagtcggtgtggggcgaaatcaacgggcccaacctggcccagaacatcgcgcccacccgttcgcgcgcgcgcctcatcctcctcaagggccccgaccacaaggtgaagcgggtgaggctgcgcaagctgtag

SEQ ID NO: 8226 - DNA, 669 bp, Myxococcus xanthus
tggctgggctacctcgacgcgcgcgtgcccttcttccgcaccctctccccggagctgcggcagcccttcctggacaagctcaaggtgttcgcgtgggagaaggagttcatcggcgccggcggcctggaggtcaccgacgagattcgcgtggtgatatccgccaccgcggtgcaactcgtgttgcacctgggcctttcgtattacgaccggctgcgggaggtcatcgtctatcccagcgccttccgaatcccggaccgcacgggcggggtgctgggcgaggcgaagaactggggctccgtcatcctctcgtgggagtcggtgctcgcggggctgcgcaacccgggcgatggtcacgacaccgccacgcatgagttcgcccacgtgttggaccgggccgacggcgccttcgatggcacgcccaacctgcgcgcgtattcgcattaccgggcctggagcgcggtgatgagcgagcacttccacaaacttcagcagggccagcgccgggaacggcaggtgctggatgactacggtgggctcaacgaggccgagttcttcgcggtggccaccgaatcgtttttcgagaaaccccggcaaatgcaggagaagacgccggacctctatgaggaactgaagcgcttctacgggtgggatcccgcggctggcacctga

SEQ ID NO: 8227 - DNA, 309 bp, Myxococcus xanthus
accgcagatgatggcgtccacagtcgcgagctgtggaggagtacgggcaccggcggtaaacaacgctggaggaagcctgccacggcccaggacggcaggttcggcccacatacccggccggccaaccggctttccgagctggagcggcggcgcattctcgccgtggccaacagcaaggagttccgcgacatctcgcccaagcagattgtccccaggctggcggataggggcgagtacgtggcaagcgaggcgagcttctaccgagtactgcgcgaagcggggcagctcgcgcaccgaggctgcgcctag

SEQ ID NO: 8228 - DNA, 1065 bp, Myxococcus xanthus
atgaaacagaagacgtggattgccgtcatcatcctgggcacgctcgccgccaacgcggtggcctaccgcgtggtgcgaagccgacgcgacagcgcccccgaggccacgccgggcgccatcacccacacgccgcccaccccgccgcccaccgcgcccgaggaacctccgcgagaggacccgaacgacggcctggcccgggcccgtcgcgccgcgggactggccgccctggaggaccgcgactacgacgcggccgtctccgacttcacggaggcgctgcggctgcgcaaggacgaccagggcgacctcgtggaactgctgcgcatcgcggccgaattgcgaacgcgcgagcaggcgcgtcagcaaggcgagcaggcccgcgcccaacgcgagcccacgccggctcccgcccgctccgtccagcgcacgcgtccggcgcgcggtacagcccgggcccagcctcgccaggagtccccttccgcggacgaggcacgcggcgggttgctgctggtgacgtccacgccccccgggctgatggtgcgggtggacggcaagcccatggacctcacgccggcgcggctgccgctgcgcgcggggacgtaccgcgtggcgctcgcgcagggtgagcgcacgctggccgaggagacggtggcgttgggcgaggacgacgtgcgctccctcaaccgcgacctcaccgccgagctcgctcccgcgccaaggcccgccgcgaccgcaccggcctccgtggaggcgccgcctcccgccgccgcgcccgcggccaccagccccgctgccaccgcgacgcgcgccgaatcgcctcccaccgccgagccgtccgtggcccccgccgcccccacggcgacgggcaagggccgcctggatgtgacgtctcccggcctctacggcgaggtgtggatcaacaaccggccgtatggcttcccgccgctcgtcgcccagggacttcccgcggggcccgcgcgcctggaggtccgcgtcaatggcgtggtgaagcggaagctgaccgtcgacgtcgtggcggaccagagcaccgccgtccgcatccgctga

SEQ ID NO: 8229 - DNA, 591 bp, Myxococcus xanthus
gacgaggagcccgaggttcacagccaggtggcctccttcgccgtcacccggctccaggagtcccccgccgtcgtcacggcgatgaacgcggaggagattcgcaactccggcgcccgcgacttgatggacctgctgctgcagattccgggcttcttcttcggcgtggacacccagggcgcggtcggccccggattccgcggcctgtggggctacgagggcaaggtgctgctcgtcgtggacggcaaggagatgaacgagcagctctactccacgatgcagttgggcaacgagttccccatcgagctcatcgaacgcatcgaagtggtgcgcggccccggctccgtcatctacggcggcaacgcggagctcgccgtcatcaacgtcgtcacgcgcggcgtccagggcagcacggacctgatggtgtccggcatgtacggacagatgggcaacgtgaacggccggcgggggctcaccgtctccggccgcaaggtcttcgagtccgcgccgggcctgatcatcttcacgtccgccggactgtcgcaggcccagcgcaacaacggcgtcttccaggacttcttcggcaactcctag

SEQ ID NO: 8230 - DNA, 1284 bp, Myxococcus xanthus
atggtgcaagcgggcgtgggctacaaggacttgcatctcagcgtgctgtaccagcgctatgggacctcccccatcgtcgccttcgacgaggtgttggaagcgcccgcacccaccaactttgattccctccacgcggagctgagcgacaggttccgcccggacgagcgggtggaaatcatcccccgcctcaacctcaccttctccaagcccttcagtgactcggaccaggattcgcccttcttctacgacaagcaggtgctgcgcctgcgagggcggacgctggcgcgctgggcggcgctggactggctgcagctcaccggcggcgtggatgtgacgtccgaccaggggtgggtcaacggcccggtgggcgtgggcctccagacgggcttcggccccgaggaggccgacagcgtctcctacgtgaacctggcgggcttcgtggaggccttctccgtcaatccgttcgtcaacgtggtggctggcgcgcgcgtggagaaccacagcgccttcggcgagtccttcgtgccgcggctggtgctgctgcgcagcgtcgggccgttcagcggcaaggccctgttcagccgcgccttccgcgcgccgagcatcgagaacatcagcctgggcgccgacgtccggcccgagcgcaccaccgtgctcgagttggagggcacgctgcgcatgggagaaggccacgcactgagcgccaacgccttcgacatgggcgtggcggaccccatcatctattcatacgacgcggtgacgaacacggaggcctaccggaacctcggacgcctgggcagccgcggcgtcgagctggactaccacgtgcgcggaagctggggccgcgccgccctcaactattcgttctacacgccgtcaggccgcaatgacgtggaggactaccaggtccccggacagcccaacgccttcacgggcatgcccactcacaaggccgcgctcaccggcagcatcaaggtcctgccctggctcaccgtcagccccaccgccgtcctcgtgggcaagcgctacgccgtggatgtgccggatgacgagggcaacgcggcggtggaggagctccccacgcagttgctgctcaacctcttcgtgcgcgcgcaggacgtgggcacgcgcgggctggagattggcgcgggcgtctacaacctgaccggcacgaacttccgcatcgcccagccctacaacggcggccacgcgcccatgcctgtcttctcccgcgagttcatggtgcgcatcagctacctgctggaccctgtcagcgacgaatag

SEQ ID NO: 8231 - DNA, 183 bp, Myxococcus xanthus
atgaacgccgccgacggtttcgaggtgaaagaagcgaacgtggcgctcaccaccaccccgacccagtacacaatcgacatcagccgcgtccggtatggacaggtggtgggtggcttcggatggaccgccgatggaaggacgactccgctcgtcttcttcatcgacgacatccactggcactga

SEQ ID NO: 8232 - DNA, 1185 bp, Myxococcus xanthus
atgcgcgcgcagaacagcagcctgctgctcaacatgatctggcgcgagcgtcagatttcccgggcggagatcgcccggcggacggagctcagtccgtcgaccgtctccgccatcgtggcggacctggagcgctccggcctggtgcgcagcattggcgccggggtgtcccggggcggccgtcgccccaccctcatcggcttctgcgatgacgcgttcagcctcatcggcgtggagatgggtgccacccacgtgacggccgcgctcaccgacctgcgcggccgggtgcgcgcgtaccggcacgccagccatgcagtccgtgaggaccccaagggcacgctccagaaggtgcgcgagctggtccaggaggtcctggacgccgaacgcgtaccgcgccgctccgtggcgggcatgggcatcgccgtgcccagccctgtccacccgtccgcgcccggaaagctgtccccgctgctggtgccggcctggcgcgactacgacgtgcaggagtcactgcggagcgcgttcggcctgccagtgttcgtggacaacgacgcgaacctgggcgcgctgtcggagtgctactggggcgcgggcgtcaacggcgaggacctggcgtacatcaagctggccacgggcatcggctccggccacatcatccacggcgacgtctaccgtggcgcgggcggcaccgcgggcgaaatcagccacatggcggtggactcctccggaccgcagtgcgtgtgcggcctgcgcggctgcctcgtcacgctcatcgggtccgcggccctgctggaacgggcgcgggagctgatgggccgcaaggacaagcgcgccctcacggtgcgcgagctggtggaaggcgcgcgggcgggtgagcccgccgcacgtcaggtcatcgacgggctcgggcactacctgggcatcgccgtggccggtctgctgaacctgctcaaccccgccattgtcgtgctcggcggcgaaatctcgtcggtgggagacctgctgctggacccgctccgcgcgtcggtgcgcaagcgggcgctgtccacctccatggcggagacgcgcatcgtcacctccgcgctgggagaccgcgccatcgccgtgggcgcggccaccctggtgctccaggcggcgctgcgtgaccgaaccctcttccctctccaacacataggcaaacctgcatga

SEQ ID NO: 8233 - DNA, 688 bp, Myxococcus xanthus
atggccgtggccctcacgggcctcgcctgtgacccggccgccaaccgggtgaaccgccctggcaccccgccaccccacaccaacccgcagcccagcacggactgggagctggtgtggcaggacgagttcgatggaccggaggggacgccgccctcacccgagcggtgggtgcacgacgtgggggggcacggctgggggaacgagcagcaggagttcaacaccgaccggaccgagaacaccgcgcatgacggcgccggcaacctggtcatcaccgcgcgccgcgagcgctacaacggccgggactacacctccgggcgcatccggacgcagggccgctacgaaaccacgtatggccgcatcgaggcgcgcatccagctccccgtgggccgcggcatctggcccgacttctggatgctgggcgcgaacatccacagcgtcgattggccggagtgcggcgaaatcgacatcatggagtaccggggccagctgccgtccatcctccggggctcgctgcacgggccgaggtactccgccggcaacaacctcggccaggactacgtcgtcagcggcgtccggctgaacgaggacttccacgtctacgcggtggagtgggagccgaaccgcatccgttggttcctggacggcaccgccttcttagaggcgacgcccgcccagctccccgagggcg

SEQ ID NO: 8234 - DNA, 1803 bp, Myxococcus xanthus
gctttcatctgtttcgtgcccaagtcgttcgcgcgccggaagagccggtcggccatgctgcaacgcttctcccatttcgctcggccggacctgcgcgcgcagctgtcgttgcagcaggtggacatgctgcaggacgccgtgacgaaggtggtggtgcccagccacgtcatggaaggcgtggagttgctggcggatgcgctggagcgcgcgctcgcggcccaggtggcgaagctgccggactacgtgccgacgaagtacttctcccagcgctccgtggtgaaggcgctgtgggcgctgaaggccgcggtggtgcgggaccaaatctaccggcgccccgagcgggcgttggaggccactgtcgaggacctggattcgctgcgctggttcttcctcctgggcgggccgccagcgggggagacggaggcgctgctcaagtccgtggtggaccctcgggagcgggcgcagctcgaaatcgtccgcctggagcagcgcgccttcgacgaagcgctggcccagatacagcgggagctggggggcggcgtggagcgcgaggcgcaggcgctcgggtcctccgaagaggtgagttccgtcgagtccgtgagccgcaactggcagcccggcgttgtctccaccacggcgcgggccttgttggccaagctggtgcctgggccgcgccatgcgcagaaccggataccgctggtggcggcggcgcgggctctggtggcggcgcaggagcagcggctggcgcgtggcatggcagggcacggtgaggggcggggcggcatcgcactgctggtgtcgttcggcgacgtgctgacgctctgtcgcggcgtccccgaactgcggccgggctacggggcgttgtgcgaggcaacggcccgctttctggaaggcgcccaggagatgatcgccctgtccgcggagagcgtggacttcgaggacgggctcaagctggagggcctggtcgggctggcggacaacctggaggaggagctttcccagacgggggatctggcgggacagctgtcggacggcgcccccgccgcatcggagcgcctgcgcacgaccgaggctgaggtccggagccgggtcgtgtccgcgctgcgccggcgcgctgtgttctcgttccagggcaacctggcccggggacgtcgagagccgctcgaagcgctggcgggagattcgcgccgcctgacgcagttggagaatgccctggctggcctggaccccacgcaacagggcctcaagcaggagctgctgctcccattgggcatcgcctacgcccgggaggtgctgtcctccacgcccttcgaacgcatcgagcagtacgggcgcgcggtgcagtcggtggcggagaacctccggcgcgagggagtgtccagcgacgcggtgttcgccgagtgccgggagattatcgagtcccggctgcgcgagcatgcccatctcctcacgcgcgatgtgcccagcccgccgcccgcgtccacgtcggtgctcaacggggacgcctacgtcttctaccggggcgacttcgcggcgaaagcgcctgatggagagctggccgcgctgctggggttggatgggcaactggccgcgaaccacggtggcgtcgcgcctggcttcctgtcggaggccgtgcgttcggcggtggcccaggcggagctcgggttcgtccagacgcgcgtcaaatacctgcggagctggctgacccaactgctcacttcgcttccaccgcccgaatccatgacggagcgcgcggatgccacgcccgggaccggtgggcgcaccgcttccgatgctccttga

SEQ ID NO: 8235 - DNA, 453 bp, Myxococcus xanthus
tccgccgaagaattcatgcgcgaggccatcgccctggctcgcaccaacgtcaagtccggtggccgtccgttcggggccttgctcgtgcgcgacggccgggtgattgcgcgcgcggtcaacgaggtcaatcagacgaaggatcccaccgcccacgccgagcttctggccattcgcaatgcgagccagagcctcggtagcgccagcctgagcggctgcgtcgtctatgccagtggtcatccctgcccgatgtgtctggccgccatgtacctgtgcggaatccagggcgcctatttcgcttactccaacgaggagggtgaagccttcggcctctccaccgcgccgatctacgcgcagttggcccgcgagccccaagcccagtccctcgccttgcggcctctgcgcccggcggacgagcacggactgtacgacgagtggaagcgtcatcagggatga

SEQ ID NO: 8236 - DNA, 2145 bp, Myxococcus xanthus
atgctggcctcgctggaccgggacctggaccgggtgggcgtgcacacgtcggcggacgcacggctcctcaaggagctgggcctgcggaagggcagggcgggggcactggcgcaggggctgctcgacagggcccgtcaagcactcgaggaggtggaggcgtgtctggtgctcgtggagcgggcctggcgcacgggagcgccgcttcccggcgcggtcgcggtgctggagaagggcttcatccaactggcacgcgtggtgaaggtggcggacctcttcgcccgtcctccctcggagccggaggaggacgacgcggagctggaaatctacgggcgcaccgatgggagcactccgcgtcttgcgccctccagtgcgcgtctggccgtggcggagttcttcgcggagcgggcccgggccaaccccacggacgtcaagcagaagcgccgggacctggacctggcgcacgaactgctcatccgcctgggcgcggaccacgaccgcgagcgaggcatggtgctgcggcgccaggtggccgaggcccgcgagcgggtgcgggccgttccggccgtgcgctccatggaggagttgctgcggcacgtgcgtcacacggcccggcgcgagccccaggtggcctaccgctcgttgaaggggctctacgagcgggccttggaggctggggacgcggcgctggcggacgcggcccgggcggcgctgacaccgatgttgccggcaccttctcagctgtcgtcgctgatggagcgcgcggagctcgatggtctgtcgcactggttcggcgaagcgcccacggcgcctgacgaagtcccgggccctccgaaggccgatgagctgctgacggacctggccttctcactggagcccgagcagctctccacgttcgagctggcggcgggctgtgcccgctacttcgacgtggaggacgcgctgtcggaggaaatcgtcctggcggatacgcgcaccgcgcgggcggtgtcccggcgtgtcccgtacccgacgcagacgatgacctacgagacgacgggcagcctccatgaggtgaacaacttcgtcttgacggacccgcggatgctgctgcgcgacctggccgccagtcaccagttggtgcgcgcgtacctggacgacgagccgcccccgcgcccccggaaggtgaagcgcaccgcggtgcgggtctacgtctgcgacgcgtcgggctccatgcacggcgcgcgagcccgcttccgggatgccattgtcatcgcggagctcaacaacctgcgcgtcaaggcccgccggggcgagcacttcgacccgctgtacttcagcttcttcaatgacgtgcccaccgagctggcgcgcgtggactccgcgctggaggccacccggcagttggagaagctcttccgcgattcacccgcggaggggcagacggacatcacgctcgcgctgatgtccgcgttcgactccatccgcgccgcgcaggggcgggacccgtacctcgctcgggccacggtggtgctcgtcactgacggcgaggaccgcgtggacctggagctcatccgccgcacgcgcgcgcccatgggcgcgctggacatcgcgttgagcttcgtatccctgggcgaggagaacccggacctccgcctcctcgtccgggagcagcgggccgccggaggccgcgccttctaccaccacctctccgacgaggagattctgtgggcgcgcacggagttcgacacgccctggcgcacgttgctgccgcgtgacgtgccggcgtccggtgatgcgctggagcagctcacgccgcacctggaggcgctggaggcggtcgccgccgggcgggccgctccgcggaccgtggcggtggacgcttcgttcgatgcgctcttcccggagaagcccacgccgccccccggggccgagccgactggcaaggacgtcacgcaccgcgtggcggacatcctgggcgcgctggtggaggcggcgtcgctggcccccgcggatcggcgcgcggcggagagcttgctgctgcttcaacacctgctgggtgtgtacggattgaccccggcgcgctacctgtccgcgttgtccgcgggtgggcaggccacgcaggaggcattgcagcgcgtgcggctgttgtgccggcccttcgggtag

SEQ ID NO: 8237 - DNA, 144 bp, Myxococcus xanthus
atgggcgggctcgtcaccgagtccctgcgcgagcgcgtggcccgcttcgaccaggcgctggtggtggacgcggctcgggatgaaatcgagcgcgcgcacgcattggcggacatctaccgcgaggagaagtcgcaggaggaataa

SEQ ID NO: 8238 - DNA, 330 bp, Myxococcus xanthus
atgctcgaggacagcaaggcgagcctgctcgagagcgccaagaagaccctggtggaggagtccagtttcgacacggacgaccttcccgatgagatcgacctggcgtcttccgagtatgcgcagtcaatggtcttccgtctgcgggaccgggagaagttcctgttgcagaagatcgaaaaggcgctggtccgcatcgaggacggcaccttcggcgtctgcgagcggtgtgaagaggacatctcgcccaagcgactggatgcgcgcccggtgacgacgctttgcatccgctgcaaggaggagcaggagaagaaggagaaatcctacggctga

SEQ ID NO: 8239 - DNA, 153 bp, Myxococcus xanthus
atggagacctgcgggcgcgaagcgacgctggcgacggccatcaccatcgttccggagcgcagcggcgagccgcaagcccggcagacggaggcgtcccgaggattttcggtgtcacagcgggggcagtattccatcgcgtccatggagggctag

SEQ ID NO: 8240 - DNA, 1644 bp, Myxococcus xanthus
gtgcgtacgcccgatacggacgagtacgtcggcaagacgattgcctacaagtaccgggtcgaagccctcattggcgagggcggcatgggcaaggtgttccgcgcccggcagctctccctggacaatgtgggggtgctgaatgtgctgcagcacactctcctgtgggacgatcgcaccgaggcacgcttccatgacgaggacaaggacggcagacgcctcaaccaccccaacttcatcactgtgcttgaattcggccaggccgaggacgaggccttgttcatcgccatggactacttggcggggtacgacctgacccatattctcagccgtgagtggcccctgaacgcatggcgcgtggtgcgcatcgtcagtcatgtgctgagcgcgctgtcagacgcgcacggtgctcgcgtcatccaccgcgacctcaagccagagaacatcatggtggagccgcggcgcaacgagcccgacttcgtcaaggtgttggacttcggcatcgcgaagatcaccgactccacggacgacggtccggcgctcacccgcgcgggcttcgtgtgcggcacccccgaatacatgtcgcccgagcaggcgcggggctcgcagctcgaccaccgctcggacctgtacgcggtgggcgtcatcctctaccagttgatgacgggcttgctgcccttcgagtcggactcggcggtgggcttcgccaccaagcacctgaccgaggagccgccgccgcccacgcgccgccggccggatgcgcgaatctctccggccatggagcggctcatcctccgggcgctgtccaagaacccggcggaccggcccgccagcgccgaggccttcaaggccgagctgcaggccgtggacaaggaacgccgccggatggactcggcgccgcggcgctcggccaactcgtcggcggtgctggcgccgttgccgcgcaagtccgccgccagtccgcagagtgatgtccgggatgccacgctgcccgggtggggcaacgaagtgaccatggaggccacggtgcgcgccctgccgggtgtgctcgagccgttgcccgcgaacgccgacgcgatggccaccacgcgtgagcacacggactcgctggtccacacgcagccgggggccggcggcagcagcggggtggcgttcttcttcaagtcgctgaccatcctgctggtggtcgccgcgctgggcttcttcgcctactacttcttcatgggcgcgggcagcgggggcgcgcaggacctgccctacgcgctgcccacgaatgcgccggtgccggcgggggccaacaactccgccgtgggcgcgagccccgacgtgccgctctacgaccgggccattgtctcgggcgcgcgcaacgtcgagcgcgcgctggagctggcgcgagagggtgacaaggcactgcagcgcgcggacgtggggctggcggcgacgaagtaccgcgaggccttcagccgcagtggtgacccggagctggccctgaagctgggcgaggtctactggcaccggcagaatccggacaaggaagaggcccggggctggtggaatcgtcacctgcgcgagcagcccgcctccaaggcgcgtgccctcatcgagcagcgcctgaacggcgccgtggcgcagcccacgtcgccctga

SEQ ID NO: 8241 - DNA, 726 bp, Myxococcus xanthus
gtcacgatgcccaagctggcggaggagcacctcgccaagaaggtccgcgcgctcgtcatccccgcgtacgactactcccgcaccgagcgcgtaaaagtggcgctcgtgtccgcgctgtcccagggagcgttcaaggaaggcgacctggtcctgtgcatgacgggcaaggtgggccgcgcgccggacacgctgatgcagacgcgcatcggcggctcgctcgatgaccgcgtcgccatcgaaggcgtgaagctgggcgacgagttcaactcccaggtggtggacgccctcatccagttggcgctgcagattggccaggaaggtttcgagggccaccccattggcaccatcatcaccattggcgcccacaacaccgtgatggagaagagccggcagatgaccatcaacccgttccagggcctctccgaggcggaacggaacgtgctcgacccgaagattcgcgaggccatcaagaacttctccgtgctcgacggcgccttcgtcatccgcgaggacggtgtcgtcctggctgcggggcgctacctgtccgcggcggatgaggccgtgaagattccgctcggcctgggcgcgcggcacgctgccgccgccggcatgacgtccaccacgggctgcatcgccctggtcgtgagccagacgtccggcgcggtacggctcttcaagggcggcaacatcgtcctggagctgcaccagacggcgcgccggacctga

SEQ ID NO: 8242 - DNA, 666 bp, Myxococcus xanthus
atggccgtcgccagcgtcgcttcgcgcccgcaggtctccatccgcgtggtgcgcgccgatggcggccccgagtccgtcgtccgcatgcagcgcgacaccctcacctgcggccagcaggcggacatctcgctcacggacgaccccttcatcatgccgctccaggtccgcttcttcttctccggcatccggctggccgtggaagacgtgggcggcgccaacggcgtcttcgtccgcctgcgccaggagcgagagctgcccccgggcggcgagctgcgcctgggacgccagcggttggtgctggagcccattcccaccgcggccacgggaccgggtggaacccaggtctggggttcaccggatcccggctaccggctgcggctggtgcaactgctggagggaggcctgcgaggcggcgctttccccctgcgcgaaggcgacaatctcctgggccgcgagcaaggcgacctcaccttccctaccgacggcttcgtgtccgggcggcacgccgtgctgcaggtgcggcaggaccggctccaggtccgggacgtgggctcatccaacggcaccttcatccgcctgtcgggccccaccttcgtggacaacggggaccacttcctcattggccgtcagttgctgcgcgtggaaatccaagcgcccacgtcctga

SEQ ID NO: 8243 - DNA, 459 bp, Myxococcus xanthus
cctcggggcgtcttcgtcaccgttgggggcacggaagccctcacccggcgcacccacttcagcgcgggccagcgcctgttccgcttcacgggccggctggagccccagccccccgtgacgggacgccccgccatctacggcgccccggtgccactggggcaggccgtctacggtgtggaggaaatgctcgtcggtgcccgtgcgggacgcgcggtgatgacggcggcgccgctgctcaccatcggcctggcccactgtgacttgagcttccccggcgacgagggcctcgcgggccgccactgcgagctgtccccaacgcccaccggtgccctgctgagggacttgtccgggggcctgggcacctatgtgcgcctcgcgagcggcgtcgagcgtccgctgcggccgggagaccgcgtccgcctgggacagcatgtgcttcaggtggagacgctgggctga

SEQ ID NO: 8244 - DNA, 1206 bp, Myxococcus xanthus
ctgatgtaccttccccgcattcgcgcccaagtgttccgcgaggacgacgcggagctggtgcgtctggattacggagagaacgaagggccgcttccgcctcccttggtggagggcctcatcgccgccggtgtcgcgccgcgcgagcccgcaccgcagacagggctggccgaggcggtgtcggccttcctgctggagtcgcgcgcggtgcgctacgcgccggacgagctggcggtggcgccgggcgtgtggccgctcatccaccacctgggcgtggcgctgcgccagcggctgggacgcacgccgcgcgtctatgtgtcgacgccgtgctacggcgtgttgccgcccaccttcgtctccgcggggtgtgacgtggagcaggggccactgtcggggctgttggcccggcgagggcagggcggtggcgtgccggatgccatcgtcgtgtcgcagccgtcgaacccctccggtgtctacctggcccgcgaggagctggtggccctggccacctatgtggtggagcagcgctgtctgctggtctcggacgaaatcttcggactggtgaacctcaccagccccactgcggagacggttcccagccccgtgacgctggaaggcgcggtgcccggcatcggcgcccgcacggtgctgctgggaggactgtccaaggagttcgcggccggtgggctccgcgtgggatggctcgcgacgaaggaccgggcgctggccgcggcggtgcgtgacagcggccctggggtgctccacctgatgacggcgcgcgctgcggcgtacctgtatgcggcatatgcccgcagtccggatggccaattgctgtactccgcacggcaccgcaccctgcggtcctacctggtgaagatgcggcgggaactggcggagaagcgcgagctgctggccggggcgctgccaggggatgggcgctcggacgcgggggacgcgggcggactcttcttgtcgcctcggatgacgacatggctggggcaggaggtcgacggggtgcggctcacgccggagaaccttcctcgcgtggtgtacgagcacacgcacgtcgtcctgaatggaggctcgtggtgtggggatccagagcgggtgcgggccgtgttctcgattccacgggacgcgctgctccgggcgcgtgagcagctcttgcgcttcggcgcgaagctgcgcggcgggccgtccgagtcctga

SEQ ID NO: 8245 - DNA, 795 bp, Myxococcus xanthus
atggccgagccggcgcagcgcaatgccatcgagttggtgaacgtccacaagtccttcggcgcccagcacgtgttgcggggcgtggacctggtggtgcccacgggcaccacgtgcgtgctgctgggcgtgtcgggctccgggaagacggtgctgatgaagcacctggacggcctgctgcgtccggaccgcggcacggtgcgcgtggacggcgaggacctggcctggctggatgccgcggggctcgagcgcgtgcgccgcaagatgggcatcctcttccagggcggcgcgctcttcgactcaatcaccgtcgaggacaacgtcgccttcccgctgcgcgagcgactccatctggtggagagcgaggtgcgtgagcgcgtgcagcgcgtgctggcgctggtgggcctggaggacgcggcgaagcagcgcccgggcgagctgtcgggcggcatgctcaagcgcgccgcctttgctcgcgccgtggtgctggaaccgaaaatccttctctatgacgaccctaccgcggggttggacccgctgaggacccagtccgtggtggacgtcatcctcaccggcaagcaccggctccatgcctcggcgctcgtcatcaccccggacgtggcctccgccttccaggtgggtgacaacctggcgctgctccatgaaggacgcatcatcgaacacgccccgcccgaggccttccgccaatctcaacaccccgcggtccaggccttcctccatgactggctggcgcgccgtgcgcgcgcttccgggcacacgtcaccgccgctgcattga

SEQ ID NO: 8246 - DNA, 660 bp, Myxococcus xanthus
atgctcatgacgctgttcacgatggcctgctcagcttctgcgggagcgggggacggcggctctcccgtgccgcccgaggccctcttgcgggccgcagagaagggtgatgcggcgacggtctccgaactgctgcgccagggggtggccgtacacgcccgggactccgcgggcaacacgtcgctcttgctggcgactgacggcaaccacgtggctgccgcccgctccctcatcgaggcaggagcgaacgtgaacctccagaaccgccagctcgatagcgcctacctcctggctggagcgcgggggtacctggagatcctgcgcctgactttgaagaacggcgccgacctgaagagcaccaaccgctatggcggcactgcgctcattccggcctgtgaacgcggccatgtggaggtcgtgaaaacgttgctgcaagccggcgtcgatccgaaccacgtcaaccgcctgggctggactggactgctcgaggcgatcctgctcagcgacggcgggccacgtcaccaggcgatcgtacgtctcctgattgacggcggtgccgacgtcaacctggcggacggaaacggcgttacgccgctccagcacgcccgcgagcgcaagcaagacgcgattgccaagatgctcgtagccgccggaggtcgctga

SEQ ID NO: 8247 - DNA, 960 bp, Myxococcus xanthus
atggacctgcgttcacggctcagccattcgacgctcgtgtcccagctaccgcgcaacgtcgtgccggacagtctgtccctgtccagtccggcgcctcaggatttcgcgctcgcggacccggagcgggtggagggatggcggagagcctgcgaacggtatgtgcggcccgggcaggtcgtcatggatgcatgcaccggaacgggcctgcggaccttcctggcggccagccgtcagccgaagaagctgtacgcggtggatggctcgcggctgctggacacggcgcagtgggtggcgcgtcgcaacgggctggagaacatcgacttcgtgcgcgcgcagccctggcagtaccagatgccggagaaggtggacgtcctgctgcatgagttgctgggcgacgccctcttcgacgcggggctggtccctcgcatcctggacctgcgcaaccgggtcctgaagcccgggggccgcatcctgcccaaccgcttcgaggtcttcgtggagccggtgcaactgcgggacgaggcgtgcatccccttcatctggagccagcgcttccccagcgtggactacagttgcctccagacgctgcgcgaggcgatgaacccgtcctacttcacgcgcgtcatccgctcctacgaggtggaccacctgttgtgcgacccggagcccgccttcgccttcgacctggagacgatggtggccgacggcctgccgcaccgcgtgcgcttctcccggccagtggtggacgaggggcgcgtggacggtttctgcctcttctacaaggtggccttcgacgcggagctgtccttcaacgtgtcgccgctgcgagggcagaactacgcggggatgatgctcttgcgcgtggactcgcgggagttcgagcgcttcgacacgctgtccttcgagctggacatggtggagcacgccgacgtgcgcacctggcgctggcagttcacctga

SEQ ID NO: 8248 - DNA, 639 bp, Myxococcus xanthus
atgcgtcaggactgtgagcaggcgctggagcggctcaagacgtgtacccagaaggcgggctgcgcgccgaacgataccgaatgtgggccgaaggcctgcctgcccatctgccagcgctccttcgagcccgccccactcagccccgagaaggaagtcccggcgccgtgcgagggcgtgacggcacccggggcggcgcctcccaaggcgttggtggggacctggacgctggtggccgccagcctgccggaagacgaaaccgtgcgggaggagcgcatcgaggccaggcctcgttcggactacgcgcgctcgttgcaggtgacgccgtcgggctgcttcgtgctgcgcacctcgctggaggccgcgacgctggggcagggcaactcgctggtggtccgcgcctggggcacgctggacgtgtcgggcaaggaccgggtgcggcttcgcacgcgggacggccaggcggtgggcccggtgtgtggcgacaagcgggtgattcccctgacgggaccgaagctcaagtttctagggaacgcctatgtctgggacctggagaaaggcgtcctcacgttgatggtggacgacgagacgaagcagaccttccagttcgaacgtgcgaccccggagagcggaaagaagtag

SEQ ID NO: 8249 - DNA, 1356 bp, Myxococcus xanthus
atgtcgagtgtggacgcgctgtggttccacatggaggaacccgccaacctgatgatgattaccgccgtgctctggttcgagggccggctggacttcgagcggctgcggacggtggtgcgggaacggctggtggagcgctacccccgctttcgccagcgcgcggtggcgggactcgtgggcctgccgcagtgggaggaggtcgccgagctcgacctggactggcacctgtcgcggctcgacgtgcccccgcccggggaccgcgccgcgctggagtcgttggtgggggagtggatgagcacgcccctggagcgctcccggccgttgtggcagttccatgtcatgtcggccgcggacgggcgcgacgtgctgctggcgcggctgcatcactgtctcgcggacggcatggccctggcgcgggtgctgctgacgctcacggatggggcggaggcggagatggccgccgaggcgcccgagcccacgtcgaggccctcaaccggtgggctcgcgagctgggtgcgcggggctcgggcggtggcggggaccgcgcgcgcggtgtggcgcaagggcgcggagctggccgcggagccgattctcgtgggcgacctgctggtgcagggggctcggggcgccgcggccatgggcaagttgttggtgattccgccggacccgcgcacgtcactgcgggggccgctggggacgcagaagcgcgccgcctggtcggacccggtgccgctggagcgagtgaaggccgtgggccgcgcgctgggcggcacggtgaatgacgtgctgctggcggcggtggcgggcgcgctgcggcgctacctggagtcgctgggggagccacccgaggacctgcacgcgctggtgcccgtgaatctgcggcctctcgacgtgcccgtgcctcgcgaactgggcaaccacttcggcgtcgtcttccttcggttgcccgtgcaactgggcacgcctcagcgccgattgcaggagctggtgcggcggatggagcggctgaagcgctcgccggaggcggtgctgaccttcggcgcgctggagttgctggggtacacgccagcggcgctggagcggtgggtggtggataccttcggctccaaggcctcgttgattgccaccaacgtgcccggcccgcgtgcggcggtgtccctggcgggcagccggctggagggcctgacgttctgggttccccagacgggccatctggggctgggcgtgagcctcttcagctacgccgggcaggtgacggtgggcgtggcggcggacgcgggccgggtgaccgacccgcatgcgctcatccaggccttccacgaggagctggatgcgctcgcgacggagcgtgactga

SEQ ID NO: 8250 - DNA, 1107 bp, Myxococcus xanthus
gcgggcgccgtggacttcgtgctcaagcccttcgaccgggaggagattctcttcaccgtccgcaaggcgctgctgcgcgcgcagggcgaggaggcgcgccagcaggtgcggcccacgggtggcttcatcggccggagccgggccatggcggacgtacaggccgtgctggcgaaggcggccgccggtacagccacggtgctgctgcgcggcgagtccggcacgggcaaggagctggcagccaaggccgttcacgacgccagtccccggcgggatggccccttcgtgaagctgcactgcgcggcgctgccggacaccctgctggagagcgagctgttcggctacgagaagggcgccttcacgggcgccgccacgcgcaagccggggcgcgtggagctggcccatggcggcacgctgttcctcgatgaggtgggcgacatctcccccgcggtccaggtgaagctgctgcgagtcatccaggagcgcgaactggagcggctgggcggcacgcagacggtgaaggtggacgtccgcttcgtggcggccacgcatcagcccttggaagagcgtgtgaaggaaggccgcttccgcgaggacctcttctaccgcctcaacgtggtgcccgtgtggataccggccctgcgcgaacgcccggacgacatcgagccgttggccctgcacttcctggaggtccacgcgaagacgaacgggcgcccgcccttcaccctcatgaccgacgggctcgcggcgctgcgggcccagccgtggcccggcaacgtgcgccagctccagaacttcctggagcggttggtggtgctctccgacacgcaggtgattggcgggcgggaagtccttcaagagctggcgcgccagccaggcctggcccccgcccccttcgccgcgacaccttccgtcagcgccctggaagcgccaacggtgcctgtcacggactccgcccggacactggagtcccagcgcaaggagatggagcgccaggcgatggcggatgcgctcaagcgcgcgggcgacaaccggacgctggcggcgcggctgctcggcatcagccggcgcacgctctacaacaagctggaggagtacgggctgctgtag

SEQ ID NO: 8251 - DNA, 435 bp, Myxococcus xanthus
atgctgcgctttgtctcctccgctcttgtcgtcgtcctgtccaccggctgcgccagctcgacggtgattcgctccagtcccagcggcgcgaaggtccggtcgcgctcgggcgaagtgctcggccggacgccgtacgagtacagcgactcggccaccgtcaacaacacggagagcttcaccttggagttggacggccacgctcccgagtacgtcaccattcgacgcgatcaatggagcggggcgcgcaccgcgggcggcatcgtcggaggactgttcgtcttccccgtcttcgccaccctgttctgggcggcggactaccgggagtcgtaccacgtagagctcaccgcgctgcccgacagcgagccagaagcgcccgcgccgcctgtccgggcgcgccgcacgagcagcgagaagtcgcccacctcccgtcgctga

SEQ ID NO: 8252 - DNA, 876 bp, Myxococcus xanthus
atggcaagcggtggtgacaacaagctcacggcgcctccggccgcgaagcagaagctgttcgtcgacaagccgggcagccccttccagaaggacgtcttcggcggaacggtgagcggcaacgtgggctcgatgcaggcctccacctcgagctacagcggcagtggcgtgcaccattactcggcccaggcggagctgcgtgggcctcacgtcggctacgaactgcagaagacgcacgcgggccggctgggtgtgaccagcggccaggtctccgccgaggccaacactttcaaggcgcaggcccaggcaggtgtgtcgctcgacaggaacgagcacgcctacacggccgcgttgatggccaaggcggagacgggagtgggcgtcacggcgagcgcgagccacgacttcaaccggcacgtgggtgggtacgtcaagggtgaggccaaggcctccgcctccgcctacgccgagggcgtggccagcctggacccgaagatgggcacggcgatgctctcggggcaggtgggcgcggccgccacggcgggagcgtatgtcacggcgggtggccacgtgggccggctgcatggctcggtcaccgggggcgcggtggcgggcgcggcggcccaggcgggcggcaagctcggcctggagaatggcttcctcaagcactccgcggacgtcaacgccgccgtgggcgtgggcacccacgtgaaggccgacgtggcggtcgacctgcgtcaccacctgaagccgggcattgcggcgggactgcgcccggcgctcgctggcgccacgagcgttgcctcgcccgcgagcaccatcgagccggagaagtcgcgcgtcgagaagttcttggccaaggccttccacaaggcctga

SEQ ID NO: 8253 - DNA, 1155 bp, Myxococcus xanthus
atgctcatcgggattcccgcactcgacgcgacggactggtcacggctggtacatgcctatggccgcgccactgacacgcctgaacaccttcgtgccctactcaccgaggacgcgcgggcccgcggcgcagccatgcaacacctgtggtcggccatcatccatcagggcaccgtcttccccgcgacggctccggttgcgctcgtgattctcgggttgctcgacgacgcgaggctggatgcgggcgaggagcccgttcgcgcggagttgctcttgttcctggcgcgtgtggtggacgccttcgagcggagcggcgcgacgatggaggacctggagtcgatggcccggttcgacctggggccgctcctggacgcggacgacgatgatgccatctacgaggacgaggacgcctcgaacgcgctccatgcgcagtccgtgctggcgtgtgcccgggtggcgccgttcctgacccgctcactgctggccaacctggaccatccggatgcccgggtgcggatgcacgcggcgatggccgccaccgcgcatgccgcgtcaccggcgtcggacgtgcggccggacgaactggtggaacggctgacggagatggcgatgcggacggtggatgtggcggagcgatgctccctgctcctggcgctgggagagctcaacgtgtccctggagaacctcctgtcggatgcggagccctcggtgcgcctctgcgcggcgatggctccgtccctggcacggagcgaggtcgcgacacgcgagttgcgcaccgcgctggagcagcatgccgcgcacatcaacgactggttcccggtgaagccgccgcagcttccgatgcagccgcgcttcacggtcgttcagcgactcctggagcgcgtccccgacttcgacctcgtggtggacgcggccgtggcggtcgcgcggaccaccaagaagtcctgggtggacttcgagtggggccccctcctcgtccacgcctttccgagtggagatggggtggtgaggacagaagcacagcggcgcttcctcgccgcgctcgtggacacctcgcacctctgggacccgcgcttcggcaacgcaggggggcacttccggaaggcggggctcccctatgagcgcgaggcgtgcgcgaggctcgtgagcacggcgtga

SEQ ID NO: 8254 - DNA, 1160 bp, Myxococcus xanthus
atgctcgaggaattggcgcccttcttctcccggctgcggttctacccggtcccccacacgccctccaccgaggacgggctccacgtccatctccagtccgtggcggaaaccacgaagcaactccagcgggtccgcctgcccctggacatcgagcggggacgcgagtccgccgaggtctggaccccgctgtacgacgaactcgtccagttgttcctcgaaacgcgaacctccgaaggggtctgccggcactttcctgccacgtggagcgaacgcggctcgaagctgctcgaaacggtggcgcgggcccgggcgaaacaccttctttgcaagtggccccaccactcgaagagccacttctcgaagctgtgcgacgtgctcgcccaggcggtgaaggagccggccgcgttgacaccggggcaacagcgacgcgttcagcatgtcctcgacgacatcgcccgagcgcgcgggctgcccggcagtgaccggttgcatgcacttcgtacggcgcagcaacgcctcgcgtcgcggccgacacaccaggacctcgcgagggtcctcgtggcgcgacttggcgcttactccagcggcgagggtctcgatgacctggagcaggtgacggcctcggtcaccgaggtggaggcatctcgtcagggtgtggccgcgggcgcggagttcccttcatccctgatacgaaaactggtgcgctgcgcgaacgcatcgctcgaggacctgatcgcacgaaaggtcgtcacctccagcgaggtgctggccagggtgctcccccaggtctccgcgcacgtggcggcacagggtgtgaatgaccccgaactccggcggctgtacgggcatatctacgcggctttccgccggcggcggtccctgctgctgctcgaccttcaatcgcaggtcaagctccaggaactgccctggtgccgcgccatcgacgcccaccgcacgccggacctgggccagcaggaggtggcggcccagacgttcgagcgcatctcctcgctggccatctcggcgttccccgccgtgctcattcccaacaagttgctgcaagagttgagggcgctggcgcaagcggcgggacttaaagtcccactggtggaggaactggcggcggacatcttcatgaatgcgttctcgccgaagttcga

SEQ ID NO: 8255 - DNA, 636 bp, Myxococcus xanthus
atgcgcggcatggatgacttctacgcggacgtcctcgaccacgtcggacgtccaccccgagagttcggttccgtccacctgcacgtggagcccgtgattcgcaatccactcgggcaggccaccgccgtcgtgtggttccaggctgccttcgagcccctcgccaccaccccgtcgtccgtgctggtgatgggcaggcagaaacagggctccgcgcaccggatgctgggccagttcccgctgccacctcttgcgggaggccgcgtggtgcggtggcggcttccgctcgagctgcccccggagttcgatgaagtccacttccaggtggagtcgagtcttcaccccaacgccggacgcgtgcggcccgcgtggaagctcttcgacaccctggagattcccaaggagagtgacatgaaggcggtgtcgagcgaggtctccatgggaatcgacctcggtgaatcgctgctcaacaccgtgatgtctgggggcctgagtgtcaccgcctacatgaagatgggaccccaggtttcaccgggcagcctggctgtgaagcgccacgcggcggccacgcttccgacagccttcatcgcagccgtggtcgacggccccttggaaccactgtccgacctgcaatgcgag

SEQ ID NO: 8256 - DNA, 111 bp, Myxococcus xanthus
atgaagctgcgcttggatgctcccgaggccaaggctcctgccccgggcgcgttccacatgatggagattcgcgaccacaagcgcctctacgtcgagggcgacacggcctga

SEQ ID NO: 8257 - DNA, 1464 bp, Myxococcus xanthus
atggagacacttcccgaggtcccgcagcagctcgagccgctcatccggcagatagggcccgccctgtatgaactgggccagggcttccgagaggacatgcgggtaccggcccgcatcgtcgcggactcggagttgctccagcagatggtccaggaccggagcgtgcctcagctcgtcaatgtcaccacactgccgggcatccagggcttcgccatcgggatgccggacatgcacgagggctacggcttccccgtgggcggcgtggcgggtaccgcgttgccggatggcgtcatctcgccgggcggcatcgggttcgatatcaactgcggcgtgagattgctggcgaccgggcttcggcacgaggacgtgaaggaggtcctgccgaaggtggctcacgacctcgctcggagcattcccacaggcttcggccggcatggccgcctgtcgttggcgcccgagcagatggatcgggtcctcacggagggcgtcccctatctggtggacgtgctgggactgggaacaccggaggacgtcgactacctggaggccagaggctgcctcgatggcgccgacacagccaaggtctctgtccgggcccaggagcgggggcatgaccagcttggaacgctcggtggcggcaaccacttcctggaagtgcagcgggtggagcgcgtcctcgactcggaggcggccccggcgctcgggctgttcgagggccagctcaccgtgctcatccatacgggctcgcgcggactggggcaccaggtctgcacggatgcggtgcgcaccatggaccgcgccctggcccgcgagggcatccagctcgtggaccgtcaactcgcctgtgcgccgctgtcgtcggcggaggggcaggactacttcgcggccatgtgcgccgcggccaacttcgcctgggccaaccggcaggtgctcacctaccgggtgcgagaggtgttccgccggtggttcggagaccgttccgctgcgtggcctcgcatcgtctatgacgtggcccacaacatcgcgaagttggagccgcatggaggccagcgcctctgtgtacaccgcaagggcgcgacgcgggccttcggtccagggcaccccgagctgcccgcggcctaccatcaggtcggccagcccgtgttcatccccggaagcatgggcacggcgtcgttcgtgctggtggggaaggaggctgccgaggccatctcactcagcagcgcctgccatggggcgggacggcggctgagccgggccgcttccaaacgccaggtggtgggaagtgagctgcgcgcggcgctgaatcgtcagggcatcgccgtggagtgtccctccaatgcggagctcgcggaggaagcacccctggcctacaaggacgtggatcgggtggtggacgtggtcgaggcggctggcatcgcgcggaaggtggcgcggctggtgccgctcgccgtgttgaaaggctga

SEQ ID NO: 8258 - DNA, 261 bp, Myxococcus xanthus
atgcgcacccggattccatacctgacgcttctggtccccgttctcgcgttcgcccagtcacgggcgcgggcgcccatcgccggggagcccgcgcctgcctcatccacgtggctgtgggtcctgctgctggtcgtggccgccgctgtcctcgcctggggcgcggtgcgcatggcggggcgcaaggggccgccgacgtccggctccggggggattggcgtggggaaggggacggggctgccgcagaagccgcgctccctctag

SEQ ID NO: 8259 - DNA, 5673 bp, Myxococcus xanthus
atgttggtgagcgccacgctcgcaggctgcaagaaggaacaggagtccaccgagccacccgcgccgcagccccaggcgcccgtcgccgcgcagccggcggactcggggacggccgtggcgcaggcgccgacgccccccgcgcccgagctgctgacgcccgtcgtccgcgcggtctccaccagcgacgtgctgccgcaggacatcgtcatcgagttcccgcgggaggtgcgccccaacgatggctcggtgttgaaggacaccgtcgtgaccatcactccggaggtgccgggcagcctctcctggtcctccccgtccacgctgaccttcaagccgtcgggcgcgggcttcgccttcgacacgaagtacgccgtctcgctggcgtcggtcgggctggattcgggcgtggtgaagccggccgcggtaggggactggtcgcacacgttcaccacgccgcccttccagttcgtccggatggtgccgcgtcagctcgacacggtgaagggccgcgtggaggtggaggtcgtcttctccggtcccgtggacatcgccgcggtgcgctcgcgggcgggcttccgggtgggtgggcaggctgtgggtgacgtgaagtggcgcaccctgcccaccacgcgcaacgtcgtcagcgcacagctgaccagcgggctgctcaagcagggccgcacggtcgacttcagcctccaggcgggactgcccgccgcgtcgcaggcgaaggcgacggcccccgccgcgcgcagcgcgttcgagctccgcgccggcaagcgcatggacatcacccgcgcctcggtggagcagggcaccacgggcttctacatcgaggtgagctgccgggacgtggacggcgccgagccgccctccccgcgcgagacggaagggtatgacccgtactactgggaccaccgcaacaagggctgcacgctggatgacggcgtcgccgcggaggccatccacctgacgcccgccgtcaaggtctccgtcgcgccgtcccgccgcggcttccgcatcttcggtgacttcaagcgcggctcctacgcgctgcgcatcgacgcgggcacgtcctcggtgggcggcggcatgctgctggccacctacgaggaggccttcgccgtccccgcgcgctcgccgcagctgtccttcgccacctccggccgctacctgccgcgcagcgcgtggcgcaacctgccgttgcagcacctcaacctggactcggtggagctcaccgtccgcaacgtgccgccggagaacctcgtcttctggatgagcgacgactaccgcgagcgcgcggacgagcgcacctccaacgtggtggcgaagcggacgctggcgctcaagtcgcagccggatacgctggcgaccacctacgtggacgtggccagcctggtgccggcgaacacgaagggcctggtggaaatcaccgcgaggcagagtcaccacgcggcggccagccgcatcctcctcaccaacctgagcctggtggccaagcgcggtgaggccgcgccgggctccagcggcgccggtgaagtctgggtgtgggcgctgggcatcgagagcaccgatccgctgtcgggcgtggaggtctccctggtgaagaagagcggcgagtcggtggcccgctgcaccacggtggcggcggatggctgccggctccaggtgcccgcgcccggcgtcgacgacagcgcgcccttcgcgctcatcgcccgtgacggcgaggagctgacgtacctcaagtacagcgagctgaagacggagattgccaacgcggacgtgcatggcgagccctaccgttcggagaaggcctaccgcgcgtcggtgtggtcggaccggggcgtgtaccgcccgggcgacacggcccacatcgccgcggtgctgcggggccaggatgacaaggcgccgccggcgggcatgcccgtggagttggtggtggtggacccgcgtgagcgcgagctgaagaaggtgtcgctgaagacgaacgaggcgggcctggtgccgctggacctgcccttcgactcattccaggacacgggcagctaccgcgtggtgctgaacgtggcggaccgcgaagtggcaatctactccgttagcgtggaggagttcgtcccggagcgcatgaaggtggaggcgcgcacggagcaggccggctacctccagggtgacgaagtcccggtgggcgtggaggccgcgtacctcttcggcggctcggcggagggcagcccggtggagctgacgtgccggctgattccgtccgccttcaagccgaaggagaacgcgcagtacgcctacgggctgtggcgccaggacggccgcgagccccgccccgtcacgctgggccaggtgcagggcacgctggacgcgaagggacaggccgtccttcgttgcccggcccagggcgccatgggggccctgcggggcgccggggcgctgagcgcgctggccagcgtcttcgagtcgggcagcggccgttccaccctgggcagcgtgacggtgccggtgcacccggaggcgtactacgtgggcctccagggcagcacgggcaaggtgaaggccggcaagcccttcacggtgaagggcgtggtggtggattgggacggcaagctgctggccgcctcggacaagacgcccaagacggtggacgtggagttcctgcgcctggaggaggagtacggctccttctatgacgagaacgagggctacgagcgttaccagcgctacctgcgcccggtgcgtgagggccgctccacggtggcggtgaaggatggccgcttctcgctggacgtgacgccgggcgcggactccgcgggctacatcgtgcgcgtgcgctcgggtggggcccagacggacctggagctggaaggggagggccgctactactggtggggggaaggctcgcgcgtggaccagacgccgcgcccgctcaagcccacctcgctggaactggcgctgccggcgaaggggcgcgtgggacaggccatcaccgtgaaggtgaagtcgccctacaaggggcgcatgctcttcaccgcggagacggaccgcgtgctcgcctcccactgggtggcggtggagcccggcgaggtgacgtggagcttcacgccgtccgccttcgcgcccaacgtgtacgtgagcgccttcctggtgaaggacccgcacctggagtccgccgaggccttcatgccggaccgcgccttcggcgtgggcagcgtcacgctggagccggtggagtacacgcagtcggtgacgatgaacgtgcccaaggaggttcgctccaacgacaccctcacggtggacctggagctgggcccgcaggaaggccccaccttcgccaccatcgcggtggtggacgagggcatcctctccctcacgcgcttccagagcccggacccgcagaagcagctcttcacccggcgggcgctgggggtggagacctacgagacgctgggctggacgctgctggtgccgccgggcggcgcgtcccgctccacgggtggtgacggcgagggcggcgcggatggccgtgtgcagcccgtcaagccggtggcgctgtggagcggcctgctgccggtgccggccaacggcaagctgcgcgtgcccttcaagctgccccagtaccgcggcgcggtgcgggtgatggcggtgacggcgggcccgcagcgcattggccgcgccagcgcgcaggtgttggtgcgcgatccgctggtgctccagacgacgttgcctcgcttcctcgcgcagcacgacgaaatccaggtgcccgtcttcgtcaccaacctgtccggcaaggcgcaggacgtgaaggtgacgctcaacgcggagtcactgccggtgccagggctggtgatgcccgcggcggccacttcgccgcttcagctgctgggcaagagcgagggcacggcgcgggtggcggacggcaagtcccacaccttcgtcttccaggcccgcgcggtgcaggcggtgggcgcggcgcggctgtcggtgacggtggagggcggcggctacacctcgagtgagtcgctggacgtgccgctgtctccggcgggcccgcgcgagcgcctggtgcagcagattgaactggcgcaggggacgacggacgtctcgcagtacctccagggctgggtgcccacgacggagcgctccacgctgtgggtgacggccaatccgtacgcgcgctcgctgcagcacctcgcgtacctggcgcgctatccctacggctgcgtggagcagacgacgtccgccacccgtccgttgctgtacgtgtccgagctggtgaacgacgtggaccccacgctgacccagggcgggaccgtgggcgacatggtgctgtcgggcatcaaccgcatcctggccatgcagacgccgtcgggcggcttcggctactggccgggcgccacggagccggtgggctggggctcggcgtacgccgcgcacatgctgctggacgcgcagaagctgaagtaccccgtgccgcaggaccggctgaacgacgcgctcacgtggatgtccaccgagctgaacaagctcgagagccgccagggccgcgacgacatgtacacggacagcgcggaggcctacatgcactacgtcctctccgtggccggcaagggccgcaaggcgcgtgtgcagaagatggtggacgcgctgtcggagcgggcgaagcagaaggcgctcacgggcgaggagcaggagcgtgactacatgctcaaggcctcgttgtggctggcgggcgaccggcgctacgagaaggagctgcgcaaccccgacctgtcgcccgtcaccgaggagcggaagaacgactggtccttctactccgaccggcgccgccgtggcttcatgctgagcacctaccaggacttgttcggcaaggacgcggcgggtgagccgctggcgcgcatggtggccgaatcgctccaggcgcactccagcggctggtacacgacgcaggagttggtgtggggcatcaccggcctgggcaagcggctgcaagggacgtccacccagttctccgcgccggtgctcaaggcggacggaaaggtcatgacgccggtgcaggacaagacggtgcgttcgtcggaccggacgtggtccctggcccgcgccagcgagcggcagggccttcagttggaggtgacgtccaaggacgagggccggctgtacctcgtgctcagcagcgagggcgtgcgctcggacagcaagccccgcacgggcggcgagggcctggcgctcacgcgcacctggcgcaagctggacggcacggtgctggccatggggcaggcgccggtggcgttggcggacctcgtctacgtggagctggagattcgcaacacgacgggcgagcgcgtgcagaacatcgccctggtggaccggctgccggcgggctgggaaatcgagaacgcgcgcctgggccggggtggctccaccgactgggtggaccctgcgtcgctgtggtccgcggactacgtgaacatccgcgatgaccggatggaggtcttcggcagcctggggcctcgcgagtcgaagaaggtcgtctacgcggtgcgcgcggtgacggcgggttccttcaccctgccgtcggcggaggcggaggccatgtatgacccgcgcctgtgggctcgtgagccgggccggacgattcaggtgtccgggccgtggaaggacaacctgctgtag

SEQ ID NO: 8260 - DNA, 483 bp, Myxococcus xanthus
  unsure (1)..(483): unsure at all n locations
cccctgccggcccgtctcttcgcgcccgcatcggtggtgatggagtaccgggacggcacgccggcccacgtcttcctggccccggacgagcgctggcgcatccccacgcaactggagcgcgtggacccggactatgtccaggccctgctggccctggaggacaagcgcttcttccaccacccgggcgtggacccgctggcggtgctgcgcgcggcgacacgcaacctggccacggggcggcgagtgtccggtgcctcgactttgacgatgcagttggtccgcgtgttggagccgcggcctcgcaccttcacgtcgaaagtcatcgagtccttccgggcgatgcagttggaggtgcggctgtccaagcaggaggtgctcgcggcctatctccagttcgtcccgtacgggcgcaacgtcnaaggcgtggaagcggccgcgctggcgtacttcggccacacggcggcgaacctgagccccgcggag

SEQ ID NO: 8261 - DNA, 213 bp, Myxococcus xanthus
atgtctcgcaagcccgacaagccgaagccgccgccgcaacacaaacgctgggagggcaaggagaagccggactggctgtcgcgcgcgctggcccgcgcgggcgtctttccccagaaggaagccgaggacgccatccgcgccggccgcgtcagcatcaacggccgcgtggcgaagatggcgctgacgcccgtgccgccgggcgcccttagagca

SEQ ID NO: 8262 - DNA, 723 bp, Myxococcus xanthus
atggtgctgcctgtccgattcgtcctcatgcgcccccgcaacgcggaaaacctgggcgccgccgcccgggccttgaagaactgcggcctgtccgactgggtctgggtccgcccggaggtggaggatttggagccggcgcgaaggctcgccgtccacgccggggacgtgctggacgcggcgcggcgcgcggacacgctggaagaggccgtggcggactgtgtctgggtggtggggaccagctcgcgcaaggtcgaaggcaagcgccggcttccccctcgcgcggtgggtgaggagctggtggcccgggcgccccaagggcccgtggcgctcgtcttcggtgacgagcgcagtggactcaccaacgcggaggtggagcgcgtgcacgacctgtccgccgtgccgaccgcgcccgaacagccctccatcaacctggcgcaggccgtgctgctgtacgcctacgaggtccgcgtggcgatgctggaggccgccgccacgccgcccggcccgctgcccgcggcggccacggacgcggagctcgcgcaggtggagtccacgctggaatccgtcctcacgacgggaggcttcctcgtggacgcccagccgggccgcacggcggtgcgggacttgttcgcaccgctgcggcgctcacggctgacgcggaaggaagcccgcttgtggctggccgcgctgcacagcctccgcaagcgtcagcccgcgccctag

SEQ ID NO: 8263 - DNA, 669 bp, Myxococcus xanthus
gtcgacgccatcctgacgtccattctcgacgaccggcggctgacccccaccgagcggcaggcgttgcaggccgtcctggcggagcggcgggctggcgaggccctgctcaccctcttccgctcccgggccttcgccctggcgcgagcgtcgatgaaggacgcacgctcccgggagatcatctcctggctggaggagacggtgcaggcgctgcacgcgccccagcccgagctgacgtcgcgcatggaggcgcacttctctccgggcgaggggccgctcaacgccatcgtccagcaaatccagtcggcacgcggctccatcgacgtctgcgtcttcaccgtgacggatgaccgcatcacccgcgcgctgctgtacgcccaccggcgcggggggcgggtgcgaatcgtgagtgacgatgacaaggccatggacccgggctccgacatggagcggctgggggacgccggcatccccatccgcctggacaggacgtccgcgcacatgcaccacaagttcgccgtgttcgaccggctgaggctggtgacgggcagctacaactggacgcgctcggccgccgagtacaaccacgagaacgtcctggtatccgacgacgcgcggctggtgcagcccttcaaccgcgcgttcgacgcgctgtgggagacgctcgactag

SEQ ID NO: 8264 - DNA, 297 bp, Myxococcus xanthus
gcgtgctctcaaggcagccggaggatgatgcagttccagcaggagcacggcacgggcggcagcggcatggcccaaccaccgggcgtggactacgacgagatgggcggccgcgaggagccgggctccgcgggcgcgccgtcggtgccgtccatcgccagcgtgcatgactcaccggagggtgtcgtcatcgtctacaccgccgtcgacccggcccggcaggacaagctgagctccgaaatccaccggaacgcgaagtacctggccacgggcaaatgcccggggatggcggcggactga

SEQ ID NO: 8265 - DNA, 873 bp, Myxococcus xanthus
cttggcattgctggctgcgagcctccgccgccagacgccgcgtccccgaccggcgcgcggacgcaggcgcaggagtcgttcaacgggctgtccttcaatggcctgtcattcaacggcctgtccttcaatggcctgtcattcaacggcctgtccttcaatggcctgtcgtcggaagccttcaacacctggttccaggccaatccctcactggccgacatggcgatgcgctacgtggtccgctgcgccgtgcccgcggggcagacgcgaacctacacagagcccgcgatggagcagtcgtacacgtgggaaggcggcctggggttggcgccagactgggctagcggaagcccggccacgctggccgaacagcaggtcgtctccgcgtgcctggcggcccacgccaaccggctgggagaggagttgctcatctccatcctcggcctggacggcgctggcgccgtcattccctacacggcgcaggagctcgccacgcattcccggcaggagtcgtgtttcttcggcaacctcttcaacgccgaaggcatccacgtgggcgcggagcgcgctccgctgggccctcaggagagcacctcgcgcgcctgcgcgggcctgctccacgatggcacggagacgctcgtgccctgcgcccccatggtgtacgtgggcgcctgcacgtcccactgcgcgctggactcgagcggcctctactacgagacgtgcacgctcggcggtgtcacctaccgccccatcaccacgcggctgtctcccacgaatgtgaatgtgtgtggagacagcgtatgtcaggccacggagcagtgtggcacctccaaccggtacgacagttgcgcacaggattgcggcccctgcccgtga

SEQ ID NO: 8266 - DNA, 584 bp, Myxococcus xanthus
atgcacctcaccccatcccgccccatccccctgggcctgccccgcgcgctgctcgtcacgagcgtgctgctggcctcgacgtcccacgcccaaaccacgccgctggaggacaacaaccgcatcaccgcgggctacatcgaactggcctatgaagtcggcgggctgctggaccccaccctctccccgggtggcaccagcgccgtgcggcccaactggttcgtcttcgcgccgcatgcctctcgcaccggcggcgaaggccttctcggcgcgtcactggcccggagcgtcatccgcgccgcccgcggccagccatccctgtcgcttcagcaggcgctggggcgcgtgggcctcacgggcaccctgcatctgtccgtccagcaactgggcctgcaactggtgctgtcgggcctgcccttcgacgtggcggcgtcgctcgcctcgctcaccacggcgctcaatggcgcagccctgctggacgcgcgcacgttgctcaccaccacggcgcgcttcgccgcgctctacgcgagcgcgccaggtgtgctcccgctcgacaaggcggagcgcatcgtggacacactcagcgc

SEQ ID NO: 8267 - DNA, 621 bp, Myxococcus xanthus
atcctcttcgacctcgacggcacgctggtggactcgctgccggacatcatcgacagcttcctccacgccttcgggcacctggggcttccggcgccgacctacgagcaggtgcgtgcgctcatcggccatccgctggactggatgtacagccagttcgcgccggaccacgtccccgcgttgtgcgtggcctaccgtgagcactacccgctcaacttccaccggcgctcgcggccctatccgggcgtggtggaggtgctgcgcgcgctgcgcgagcggggctacctgctggcggtggccaccaccaagcgtcccgacatggcgcgcaagttcgtggacgccatgggcctgggcccgctgctccaccacgtccagggcacggatggctttccgcacaagcccgcgcccgacgtcatccaccacgcgctggcagccctgggcacgggcgggttgtggatggtgggggacaccgcgttggacttgcgcgcggggcaggccgcggggctgcggacctatgccgtcacctggggcacgcatccggtggacgtgctcgcgggcgcgtcaccggacgagcttcagccggacctgcagcggctcctgacgcacctgccgccactggcgtga

SEQ ID NO: 8268 - DNA, 309 bp, Myxococcus xanthus
atgctcggagaggcaccgttgccgcagccctcgccagcatcggcggtggagcacgtcgcgctcgtggcggcggacaccgaggccctgcttgtcgactggctcaatgagctcatcgcccgctcggacctggcgaagcgcgtctacacggacctcgtggtggacgagctccaagagcggtcgctgcgcgcccacattcgcggcgtctcgcctcctgtgctgaagaccgctgtgaaggccgccaccttccatggcctggagttgcacgagcacgacgacggcttcacggccacggtcgtcctcgatgtctga

SEQ ID NO: 8269 - DNA, 1734 bp, Myxococcus xanthus
atgaggcccgccctgcccgagcggctgcggcgcatccaggacacggttgcatcgttcatcgtggcgaacgcgggcccgctgggggccgccggagtggggctgttggcgttcctggccatctacggtccggcggcgctgaatcccacccgcctggcctggctcatccgtgacgacttcagccagcacctgctgggctggttgttcttccgcaacgagccgctccgcttcccgctgggcgccatcgacggctacctgcatccgctcgggacgacgctcggctacatggacgccatcccctgggtggcgctgctgctgcggccgttctccagcctgctgcccgccgacttccaatacatcggtccgtggatgtgcatgtgcctgatgctgcagggcgcctcctccgcgtgggtggcgcggcggatgggcgcgacggtgccgcagcagtggctggtgggcgcgctgctcgtgctgtcgcccacgctgctggcgcgcatgagcatggcgcacgaagcgctgtgcgcgcactggaccatcgtgctgctggtagggctcaacctgattccgcagcgggacgcgcgcgaggcgaagcaggcgctgggcatcgcgctggcgctgtgcgtgttcgccgcgggcgtgcaccccgtgattaccgccatggtgctgccgctcgcgctggcgctgtgcatgcggaccgcgctggagcagcggctgccctggcggtggcccctgctgggcgccgtggtgaacgtgggcgtggtgctggtgctcttctacgtgctgggctacctcggcaccgtccgcaccctgggcgccgacgccttcggtgggttctccgcggacctcctggcgttcgtcaatccgatgggctaccgggactcctggtcgcgcttcctggggccgctgccgaggcagggcgcccagtacgaaggcttcggctacctggggctgggcgtgctcttcgcgctctgggccgcgctcatcctgctcgtgcgggacgcgccgctcgtcgcgcggcagtggcgcaggctggtgccggtggggctggtggcgctgggcctgggcttcttcgcgctgtcctcgcgcatcaccctgcaaggcgagctcgtcgcggacctgacgggcctctacgcgccggtgatgcggtgggtggagcccttccgctcctccggccgcttcgtgtggccgctgtactacctgctggcgctgggctccgcgctcgcgctcatccgcctgcctcggcccgcggtggcaccgtcgctgctggccctggcgctggtgctgcaagccttcgatgtgaatctggggcggggccatcaagcgaaggaagggccggcctggaacacacagccgtccgatgcgctgcgcgaggccgctgctggacgcaagcacctggtgctctacccgccgcagatgcatgacggctccgggcggggctgccgcgccgggcccatggacttccaccgctgggcttatcgcgcctacttgctggggctcaccttcaacagcggctacgtcgcgcgactggatgacgcgcgcgcgcagccctactgcctggggctcgacgacgatatccgggcgggcaagctcgacccggagaccatctacctctccattccgcagcggctccatgagttccgcgccattcgcggtacgcgctgtgtgcaggaggagcggctgtggatgtgcgtcctggagcaggcgcccgctgctccgctggagcacgcctcgccctga

SEQ ID NO: 8270 - DNA, 3168 bp, Myxococcus xanthus
atgctgagggcactgcccggccaggagtcccagccggcctccgcgacgcctcccgagggctccgtggcgctggtcttcaccgacgtccagggctccacgcggctgtgggagcgttgtggcgcgggcatgcgtgacgcgttggaggtgcatgaccgcgtcctgcgttccctgctggtcggcagcaccggctacgaggtgaagacgcagggggactccttcatgattgcgttcccctcggtgctggatgcgctgacgtggtgcctggaggcgcaggacgtgctgctgcgcgcgccctggccggtggacatcctctcccagcccgaggccgccgaagaggtgggacccggaggcctgttgttccggggcctgcgggtgcgcatgggcgtgcacgtgggcgagccggagtgccgcgtggacgcgcgctccggacggacggactacctgggccgcatggtgaacgtggcggcgcgcgtggcggccgcgggccatggaggtcaggtcctggtaagtggcggcgcctgggcgcaggtcgcgcaggtgttggagccgctgggccggcccgcggtgcgtcccctgggcgcgttccgattgaagggcatcgatgatgccgtggccctggtggaggtgctgcccgcgcacctgtcggagcggcgcttcggagttcctcgtgcgccgagagatcgccaggggaacgtgcccgtgctccaagagggactggtggggcgaggcaccgaactcgggcagctccgccgctggctcgcggatggcgcgcggctcgtcacgctgctggggccgggtggcatgggcaagacccggctggccacgtcctttggtgcgctggaactagagtcgggggaatgggagggcggggtgtggctgtgtgagctggccgaggcccagacagcggaggcgctctgcctgtcggtgggccatgcgctgggaatccccctgcgcgcggatggcgacccgaccgagccggcggagcggctgggacgcgcgctgaacgactgtggcgacgtgctgctcatcctcgacaacctggagcaggccgtgcagcacctgcccgccacgctggggcgctggctccaactggcgcctcgcgcgcgcttcctggcgacgtcgcgcgaggcactgggccttcccggtgagcgactgctggacctggcgccgctctcggtgccggaggaaggcgagtcccggctggaggaactggtccggtcggacgcggtgcgcctgttcgcgcagcgggcgcgtgaagcccgaggctacttcgagctgacggccggcgaggcgccgatggtcgcggacatcgtgcggcagttggatggaatcgccctggccatcgagctggccgccgcgcgcatggcgctgttgagcgtgagccagcttcgggagcggctcacgcgtcgcttcgagctcctgcgcaagggacggcctgatggccgcgcgcggcaggcgacgctgcgaggagccatcgactggtcctggaacctgctggaaccggaggagcggaccgcgctggcgcgctgctcggtgttccgtggcggcttcacgctggaggcggcggaagcggtgctggggctgccgccggacgggcccgccgtgctggacgtgctccagtcgctgcgcgtcaagtcgatcttgcgcgtgctggaggcggagttgcccggcggtgactcccggctgggtcagtacgagagcatccgtcagtatgccgcggcgcggctggccgaagagggcgtgggcaatgcggccgcgttggcggagcggcacgcggattggtacctgtcgctggcctaccggctgcgcgcgcaggtgcgcaagcccagggcggtgcggaggcccttgcagcggctggcactggagcgggagaacctcctggcggcgtgtgacaacgccctggccgtgacgcccgcgacgtcacgctcggtggagcgggcgctgcaggcgttggtggcgctgcagccggaggtggtgacgcggggcccggtgcgactgttgctcgaacggctggacgcggcgctggcgctgacggaccgggtgatgggcgcgcccaggctggtggccgaggccgtggcggtgcgtggccgcgtgttcctggaggcgggcgacctggtgtcggcccgcagggatttggagtgcgcacgcgcatcactgaggacgctgggcgcggtggcgggcgagaagcgcgtgctggtggacctgtcgattgtggcccgtcacgaaggtgagctgtccctggcctgggcgctggtgcgcgaggcgcggctgttgtcgtcggagggcgaccgctggttggacgcctacaccgtgggcaacctgggcctggtggagcaggcccgctgcggcgcggaggcggccattccccatctgcgcgcggcgcaggcgctcttccacggcgtgggcgacgtgacgttcgaggtgggcttcctgtccaactgcgcggtggccatcggggagatggggcgcacgcgcgaggcgatgagcctgctggaggacgcgatggcgcgctcggccagtgtgggagaccgggcggggcatgcgctggctcgcctcaacctgggctgctacctgctggaggaagggcgcccgcaggaggcgcgcgagcacctgcttgccgctgcgcgcattggccggcagcttgggcagcggctgctggagggcaccgcgctgggcgagttggggcgcgcggagctggccctgggagcgtggagcgaagcctgggcccggctgtcggaggcggtgtccgacctggggcgcgtgtcgcgcgggcaggtgctgcgcttcgcggtgtaccgggccgtggtggaggcgtgcgtgggagacgcagcggcggcggaggcgagcttcgtcgtgctggagggcgcgccggagctgcgggacgacccggtgctgcgcgagctggccgcgctgcttcgcgcggcggtggacctggcggaggcacgggcggcccgggacgacgtcgcgcgggcgcagcgggctttcgagtcggtgcgtcggcgcatcgcgcgagcccggagcgccccgccagaggccgcctcgtcggacctgcgcggcgcgctgggctttctggaggaagccttgtggcggctcacctcggagccggaggacgtggaggcactggaggtggagggccggggcgcccctgtctgcgccggggctgcttga

SEQ ID NO: 8271 - DNA, 1140 bp, Myxococcus xanthus
ctctcaggggggccccgggccccggtcatgcgcaagcaactattgcgctcgagttctccgtcgccggaggtgacaccgcgtccgcactggccgagggctgacccgtcagtcaccaaggcccatcccacgcacctcgatacgtcagagcgcgcgggcctggccatccgcgcggacgtggaggaatgggggctggatgaaggcgtgttctcgctcctgttcgacgcgggcacggaggtgggcgcctcgctcgtgagtcaccccgccatccgcgccgtcggcttcacgggctcgcgtggcggaggacgcgcgctgatggcgctggccgccgcacggcctgtccccattcccgtcttcgcggagatgggctccatcaaccccatcttcctcctgccggaggcgctggccgcccgtccccaggcgatggcggacgcgctggccacgtccatcctccagggcgcgggccagttctgcacctcgcctggcctgctcgtggcggtggagggcccggggtacgaggccttccgcgcgcggctcgcggagaagctgggggccgcctcggccgcgcccatgttgacgcccgccatcgccgagcgctttcgcgagggcgtgagccgtctcgccgctcgcacggacacgcggacctgtgcacggggtgagtcgagggccgcgctgggcgccgccgcgctgttcgaggcggaggcccgcgtggtgctcgccgagagcgcgctcacggaagaggtgttcggaagctgcgcggtgctgacggtggcgcgtgacgcggcggagctggtgcgcgtggcctccaggctggaaggccagctcaccgcgacggtgatgatggacgcgggagacacggcgctggccgccgagctgctccccacgctgtcggaccgcgtggggcgcgtgctgatgaatggtgtccccacgggcgtggaggtctgcccggccatggtgcatggcggtccctttccggccagttcggatggccgcttcaccgccgtgggcacgggcgccatccgccgcttcgtgcggccggtgtgctaccaagatgtgccggacgcgctgctcccgccggagctgcgcgatgcgaatcccctgaacctgtggcgaacggtggagggggcactgaagcaggagtga

SEQ ID NO: 8272 - DNA, 762 bp, Myxococcus xanthus
atgggcttcatggggcgggtggcgaatccgctgttcgcggaggagctgttcgaccgggtgccggacatcgtcttctcggtgaaggacatccgggggcgctacgtgtgcatgagcgaggcatgcgcggagcgctgtggcctgaagagcaaggcggcggcggtggggcacacggcgcacgagctgtttccccagcacatggcggaccggtacgtgcgacaggacgagaaggtgttccagacgggacgcgcgctcgtggacaacctggacctgacgttgttcaacaaccgcaagccgggctggtgtctgacgagcaaggttccgctgttcgatgccacgggcgaggtgatggggctggcgtgtctgtccaaggacgtgcacgagccggggcgcgcggggctggtggacgagcgcttcgcggggaccatcgattacatccaggcgaactatggggagcggctgcgcatcgactcgctggcgcggcgggcggggatgtccgcggcgcagttcgagcggcggatgcagcgcatcttccagctctcagccgggcagttcatcatgaagacgcgcatcgacgcagcggcggagcggctggtggaggatgcgcagcccatcgccgccatcgccctggcggtgggtttctgtgaccagagcgccctgtctcgccagttcaagcaggtgacggggttgagcccgcgacagtaccggcagctcgttgttgccacgtccgtgccgggagcgccacggggcaagcaggctcgctga

SEQ ID NO: 8273 - DNA, 676 bp, Myxococcus xanthus
atgcaggcttccaactccttctcctcccctgattcgctctccacctacctgtcggagatcaaccagtacccgctgctcacccagccgcaggagcaggagctgtcgaagcgcttccgcgcgggagacctggccgcgggccaccagttggtgacggcgaacctccgcttcgtggtgaaggtggcctacgagtaccgctcctacggcctgaagatgtcggacctcatccaggaggcgaacatcggcctgatgaaggccgtgcagaagttcgatccagacaagggcatccgcctcatctcctacgctgtctggtggattcgcgcgtacatccagaactgcatcctgaagaactggagcctggtgaagctgggcaccacgcaggcgcagcgccgcctcttcttcagcctggcccgcacgcgccgcgagttggagaagatgggcgccggcgacgcgaacgtcgtcaacgccgaggagattgcgcgcaagctgaacgtgaaggcctccgaggtgcgcgagatggagcagcgcatgggtggccgtgatttgtccctggacgcgcccatgggcgaggacggggacgccacgcacctggacttcgtggagtccgagtccgtcttcccggtggacgaggtcaccgaccggaaacaggccaacctcaccctcgtagctattgcacgcg

SEQ ID NO: 8274 - DNA, 2016 bp, Myxococcus xanthus
tcgaagcgccttctgctggcgtgtgacacggcggccttcgggtccgccaccggcacggcgctcgtcacgctggtgaagggctccacgacggagtgcatcaacacgctgttcagcgtcacgggcacgctcgcccggcaggtgttcatcgagagcaagatggtcaccatcgccaacgcgctcacctccagcgcgcaaggctatgggggcaacaacaacggccagacgctccagctcatcatgttcctgcgcgcggggtactacgtgcagtactacgccccggacgtcgtgggcagctacggcacggcgttggccaacgccatccgcccggccctggccgccttcgtggccaacagccacttccgggacgtcaacgacgaccacggcgcggtgctgcaggagttcgtcacgctcatcgacagcgcgggggagaacgcgcggcacctgggcaccttcaagggcctgctggaccgcttcaacgacaccacccaggccttctggtacatgcgcagcgccaccaacaacgtgttcgtcggactgttccgaggccactacaacgacgacttcgtggcggccgtgcagcaggacccgtccatcatcgactcgctggactccttcggcctgcgcaccgagcacctgctgggcacggacaaccagtacctctccgtcaacgcggcccgcgagctgtcccgcttcctccagtacgcggggacgctgcagacgaagacgcgccccaaggtgaaggcgctcatcaccagccactcgatgacgggccccaccgcgggcgtctgggtgggcgctgcggagatggccgacttctacgacggcgccaactgcgcgtactacggcatctgcgacttccggcggacgctggagcaggcggtgctccgcgtgacgcacaactgcggcgccacgctgcgcatgcgcgcccaggagatgacggccacgcagctcgcgcagagctgcgaccagctcgcaacgcaggagtcctacttccacgacaagctgaagacgggccgcctgcccgtcgccagtgacaacaacacgtcgctggagatggtcatcttcgacagcagcctggactaccagacgtatgccggcgcgctgttcggcatcgacacgaacaacggcggcatgtacctggagggagacccggcggcgtccggcaatcaggcccgcttcatcgcctacgaggcggagtgggttcggcccgcgttcgaaatctggaacctgcgccacgagtacgtccactacctggatggccgcttcaacatgaagggcggcttcggtgacagcatcagccagcccaccatctggtggattgaagggctgggggagtacgtctccaagaaggacgacaacgcgtccgcggtggagctgggcaccagcaagcgcttccagctcagccagattctgcgcaacgactacaacagtggcaccgagcgcgtgtactactggggctacctcgcggtgcgcttcatgttcgagcgccacccggcgcaggtggacaccttcgtcagccagttccgcgcggggaactacaccgggtatcgcacgtcgctggacagcctgggctcggcgaacgacgcggagttccaccagtggattgactgcgtctccaccgcgaccgacccgagcacctgcgcgaatccggacccgggcccggggcctggcaccggcacgcagtgcacgggcgcggacacccggatgctggacaacggctgctaccggggcccgctggctggcaacgacatccagtacttctacctctgggtgcccgccggcgcgcgcaacctgcgcttccagatgagcggcggcacgggcaacgcggacctctacgtccgcgccaatcagtggccgtcgacgacggcgtatgactaccggccgtatctggccggcaacgacgaggtggtggacatcccctcgccgctgaccggcgtctactactacgccatggtgagggcccgcgcggcgttcgcgggcgtgaagctggaggcccgcttcgacactgcgccgtga

SEQ ID NO: 8275 - DNA, 597 bp, Myxococcus xanthus
atgacgccgacgtcggggcagttgagtgagatgcaggccatcgcggagacggcggacgcgaaggtggtgggcatccacaacgcgacgcagggcctggtggcggacctggcgcagtgtgtggcggacaagctggacaagggccacaaccccgcggtggatgcactggcggacacgctctacagcgagttgaaggcgggccgagaggtgcacctcatgggctacagccagggcggcctcatcaccgcgcgggcgctggatgacgtggcgaagcggctgcgcatcgaggatggcatgtcccaggcgcaggtggagaagacgctgggcaagctgagcgtggaaacgtttggcgcggcgtccacgcggtatgtggatgggcccaagtatgtgcactacgtcaacaacgcggacccggtgcccacgctcacgggcctgggcgggagcgtggacccgacggccttcctgaaggacgcgggcaagggcgcggtggtgcaccggttcacggatgggaatgccaaccccatcagcaaccacatgctggatacgctgtacatgaagcaccgcgtggacttcgaccaggctcgggcggggcggttctaa

SEQ ID NO: 8276 - DNA, 456 bp, Myxococcus xanthus
atgggggacctcttccagctcttcgcagtctccgccgtggtgatgggcgtgtcgcagacgctgtcccgggagcgcatcttcgcgccgctgcgcgcgcggctggggggcaaggactcgtggctgggctacctggtgtcgtgcccctattgcgtgtcgcactacgtggctttcgtcctggtgccgctcacggggacgaacgtcattcgggtgtccgtgggaggctggcccggctacgtgctcagttgggtgctgtccacgctgctcatcacggtcatctcggctttcttccgggtggtgttctggttcgtggatgagacgcagggcctggtgaagcggcgtcagcggacggaagaggaggagacggccacgatgcgcctccatcgcgagcaggcggagcagacgctgaaccaccatgaccccgaaacgcgtgagccctcaccgcccgtgtcgcattga

SEQ ID NO: 8277 - DNA, 405 bp, Myxococcus xanthus
atggacctgacggcccccaacctcatgtcagagggcgacgcgtccagaacacgctccacctccggactccgcacggcctcgtatgtcgcgctgggaacgggtgtggccgcattcagtggcgcaggcatcgtccgccttcttgctcagaaggatgtgaacgcactggagaagcggctcgacaacggccggattctgtccagcgacaaggaggcgatggggcttcgcgactcgctggttcagaagagcaacgtcctcaatggattgctcatcggtgggagcgcggcggttgtcacgggcgcggtgctctacctcctgtctcctgattcgaactcggcgccgcccgtgtcggtcggactctccgcggacagccacggcgcggcggcctcactgtccggttcgttctga

SEQ ID NO: 8278 - DNA, 1419 bp, Myxococcus xanthus
atgatgcgagccctcttcgtcctgctgctggccacgagcgcctccgcggcctctccccgaaccctccgggtcgactacttccacaccgggaacgccaccgaggaacggttcagcctcgacaaggtcgtcatcgagccgctgccctggcccggccacccggaacgagccatcgacgagacgaacctcggcaagtacctcttcgaggtccgaggccgggagaacaaccggctcctgttctcgcgaggctttgcgtccatctacggcgagtgggaggtcacgaacgaggcgcgcagcagcaaccgcaccttccatgagtccctccgcttccccgcgccggagcgccccgtgcaggtgctcctcaagaagcgggatgcccagaatgccttccgcgaagtgtggtcgctggttgtcgacccgaaggacatgttcgtcgacgcctcgtctccccccgcacccgggccgctgctgaaactgctggagaacgggccgtcagcgcagaaggtcgacctgctcatcctgggggacggctacacgaaggccgagcacgccaagttcgagaaggatgcccggcacatggtggacatcctcttcaccttctctcccttcaaggagcgcaagtcggacttcaacgtgtgggggctcgtccccgccgcggcccagtccggcatctctcgcccttcaacgggagtccaccggcgctctcccatcggtgccacctacgatgcctttggcagtgagcgatatgtgctcaccttcgacaacaaggccttccgcgaggcagcggccttcgcgccctacgagttcgtggagatcctggtcaacggcaacacctacggcggcggcggcatcttcgggctctacggcaccgtcgcctcggacagcctgtgggcaccctacgtcttcgtgcacgagttcggccaccacttcgccgggctggcggacgagtactacacctccgaatccgtctatgcgcccgccgcggaccgcctggagccctgggagaagaacgtcaccgcgctccactccccggaaggcctgaagtggaagcacctggtgtcaccaggaacacccctgcctaccccctggaacaaggagggatacgaaaagcatgccaccgccgtgcagaagcagcgcggccacattcgggcgcagcgaaagcccgagtcagacatggacaagctcttcctggcccagcgggactgggaggaaaagttcctttcctcacagaagtattcaggccgggtcggagccttcgagggggccatgtacgagtcgaagggctactaccgaccacaggtcgactgcgtgatgttcactcgggatcgcgtcccattctgcgcggtgtgtcagagcgccatctccgaagtcatcgacctgtattccggccctccggccatgtctcctcaggccaatccctga

SEQ ID NO: 8279 - DNA, 1786 bp, Myxococcus xanthus
atggccaccgtgctcaagggcgcgggctaccagacagccttggctgagacggcggctgacgcgcagcgtgagctggagaagcgccgaccagacctggtcgtcctccgcgcggagctgaaggatcagtccggcttcgtcctctgcggcaacatcaagaagggcaagtggggtcagaacctcaaggtcctgctgctctcctccgagagtggcgtggatggtctggcgcagcatcgtcagacgccgcaggcggcggacggctacctcgccatcccgttcgagatgggcgagctggccgccctgagccacggcatcgtgccgccgggcacggatgacaccggcgcgtcgctggatgccgcgctgaacgggacgcgcgaagcaccgccgcccatgcctccgtcgctcaaggccgccgcggggggcccgccgaagctgcccaagcgcgagcgccgcagcgcgatgacggaagaggaccgcgcgttcctcgaccgcacgttccagtccatcgcggaccggaaggcggagctgctcgccgagtcccgccagctcaagcgtccgccaccgcggcgcgagctgatgggcacgcccgagggcaagattcagatcctccgcgacgagctgaagacgcgcgaggcccagctcgcccgcctctctgaaatctggaacgtgcgcgagcgcgagctgctctccggcgaggaccgcatccacgagaaggacgtggagctgcagggcctgaagatgcaggtggacgacctgctgcgccgcttcaacgaggcccagcaggccaccatccagaaggagcgcgagcacggcgccaccgtcgatgacctgctcctccagaagttctccgcggagaaggacctcatcgaggtcgtcgcctccaaggagaaggacatcaacctcctgcgccgggaagtctcccgcgccgaggaggagctgagccgccgcgccggcgagctggagcacggccgcaacgagtacgacaagctggagaagcacctcggcgtggtcacgctcgagttcgaggtcaaggagcagaagctccaggacaccgtcctcgcgaatgaaggcgaaatcgcgcggctgacgaagcgcggtgacgacttcgaggccgagctgaaccgcaccatcagcgagcgtgaccagcgcttcgccgagctggacggtgaaatccaggccctccaggagcggctgcagcagactgagcaggagcgcgacaccaccgtgcgcggcctggaagcccgcgctgcccgtgccgaggagcacggcacccaggctgacgcggaaatccaccggctcaacgccgagcgcgatgcgctggaggcgaagctcagccagcaggtcgcggacctggaggcggacctcgcgcgaaccatgggcgagcgcgaccagctccggctggacaaggacgcccaggaggccgagctcacccagcgcatcgaagagcgtgacgcgaagctcggcacgctcgagcgcgagctgtcggagaccatcgctcggaacgagcacaccgaggcggagctcaacgccaacatccagcagcagctggagcgcatcggcgagctcgagggcgaagtcgaggccgtcaagacgcacctggaggaccgcgagaatgagctgaccgcggagctccaggcgctgggacaggccaaggacgagttggagacggacctcaacgaccggctccaggccctctcccaggcgaaggacgcgctggaggcggacctctcccgtcagttggaggagctgcgctccgccaaggccgagctcgaagcggacccagagagca

SEQ ID NO: 8280 - DNA, 786 bp, Myxococcus xanthus
atggagcgggagttggacttcacggtggaggctcgcggcttctacatccaagggttgccgtcggggcggacgtatcgcgtggaggcgcactttgtcggtcgtgatgggcggagctgccgcatcggtgcttcgagcaaccgcgtgacgctgcctcccgcgggtgtctccacggatttgacggtgcgtttccttcgggttcctccgctcgaggcggcgctgcccgcggcggtcgtggaagcgccgccggaagaggagcgcgagtacgtgtcatggcgccgggtgaacctgccgggcagtggtggcgtgctggatgtgccggaagtccacagggagcgtcgtggcagggacatgacggaggcgcacctggagggccccgcgcgagcgccgggcgcttcggaccagcagtacgtggagtcggtggagcgcgtgcctggggcttcggaccaacggtacgcggactcggtggggcgagcggcgggggcttcggaccagcgctatctgtcggttgcggcgctgcggaatgcgcgcgaggtgcgtggacccgtgactgctcccgtgtcgcactacctggagaccctgggccgtgcaccgggggcttcggatatgcgtcatgcggaaggggacgctcacgaggcggggagggggccagggccccgtgcgtatctggatgtgaagggcgtcccgggtgcatcggacctgcgctacgcggaaggcggcgcggcacgccaggcaggccgtgacacgtcaccgcaccgctacctggacatgaaggggcatttccgggcg

SEQ ID NO: 8281 - DNA, 636 bp, Myxococcus xanthus
tgccgcatacccatcccgctgctggcggacttcgagatgccggccgaggagatcgccgagggcatcgcccaggccagccgcttcgcggaggcggacccgtaccgcgcggccacgcacaacaagggcgtgatgaacggcattgactcggtggccatcgccacggggcaggactggcgcgccattgaagcgggcgcgcacgcgttcgcctgccgcaacgggcagtaccggccgctgtccacctggtacctggaagagggccacctggtgggccgcatcgagctgcccatggcgctggggacggtgggcgggcccatcaagatccacccgggcgtgcagatggcgctcaagctgatgcagaccacgtcggtgcgagagctcgccatggtgttcgcggcggtgggcctggcgcagaacttcgcggcgctccgggcgctgggcagcgtgggcatccagaagggccacatggcgatgcacacgcgctgcgtggcggtgacggcgggcgcgcgaggcgactgggtggagaagatcgccaacctgctggtgaaggcgggccacgtgaaggtggagaaggcccgcgagctgctggccagcctccccgccgaggatgccgcggccgcgaccggcaccacggtctga

SEQ ID NO: 8282 - DNA, 909 bp, Myxococcus xanthus
tcggcctttggcgccggcaaggtcatcctgttgggtgagcacagcgtcgtgtacgggcacccggccctggccgggccgttgtcgcagggcgtgacggcgcgcgccgtgcccgcgaaggcgtgtcagctcgcgttgccctccacgctcagccgcccgcagcgggcgcagctcacggcggcgttcgcccgtgcggcggaggtgacgggcgcgccgccggtgaaggtgtcgctggaggcggacctgccgctggcggtgggcctgggaagctcggcggcgctgtcggtggcgtgcgcgcggttgctgctccaggcggcggggaaggtgcccacaccgaaggacgcggcgcgtgtggcgtgggcgatggagcaggagttccacggcacgccgtccggcgtggaccacaccaccagcgccgcggagcaactggtcctctactggcgcaagccgggggccgccaaggggacggggcaggtcgtggagagccccaggcccttgcacgtggtggtgacgctcgcgggtgagcgcagccccacgaagaagacggtgggcgcgctgcgggagcggcaggctcgctggccgtcgcgctacgagcgcctgttcgcggagattggacgggtgtcctcggagggcgcgaaggcggtggcggcgggagatttggaggcactgggcgacgcgatgaacgtcaaccagggcctgctcgcggcgctgggcctgtcgtcgccgccgttggaagagatggtctaccggttgcgggagctgggggcgctgggcgccaagctgaccggagctggtggagatggtggggccgtcattggcctgttcctggagcccaagcccgtggtgacgaagctcacccggatgggcgtgcgctgcttcagcagccagctcgcgggaccgcgggcgtcgtga

SEQ ID NO: 8283 - DNA, 987 bp, Myxococcus xanthus
atgaaagccacagctctggcgcatcccaacatcgccctggtgaagtactgggggaagcgggatgacgcgttgattctgccgcaccagtccagcctgtccctcacgctgtcaccgctgtcggtgacgaccacggtggagttcggcgccgcgagcgaccaggtggagctcaacgggcacaccgcgaagggcagcgagcgcgaccgcgtgctgcggcttctggagttggtgcgcgcccaggcgaaggccgacctgggccccgcgaaggtggtgtctcgcggggacttccccatggcggcggggttggccagcagcgcggcgggcttcgcggcgctggcggtggcgggacgcgcagcggcggggttgccgtcggagccccgcgcggccagcatcctggcgcgcatgggcagcggctcggcgtgccggagcgtgcagggtgggttctgcgagtggcagcgcggcgaacgtccggatggagaggacagcttcgcggtgcagcgcttcgacgcggcccactggccggacgtgcgcatggtggtggcgattctcgaccgcggcgagaaagaggtgaagtcgcgggacgggatgaagctcacggtggacaccagcccgtactacccggcgtgggtgaaggacgccgaggtggaggtcgtgcaggtgcgcgagcacatcgccaggcgcgacctgcaggccctgggtgagctgtgtgagcgcaacgcgtggcggatgcacgcgacgtcgttcgccgcgaatccgccgctgagctacatgagccccggcacgctggcgctcatcctgcacctgaaggagcagcgcaagaagggcatcccggtgtggttcacgctggacgcggggccaaacccggtgctgctgacggacgccgcgcacgaggtggccgcggaggcgctggcccgcgcgtgcggcgcgctggatgtgattcgctgcgtgcccggcggtgacgcggagctgaaggcggagcacctcttctga

SEQ ID NO: 8284 - DNA, 2766 bp, Myxococcus xanthus
atggggaagacgtatgaggcgctcggcgtccttgcggcccggttgcatgtgctgccggatgcccgggcgctgattctcaccccggggcccgacctcaatacgaagtggtccaaggagctgcgtgccttctgtgacaccagccgccccatgtaccggggcttcgcgggtcagtccaagaccgcgagcaccctggctgagctggtcgcggccactcgcgagacgcgaatcaccatcgcgcccgtgaacatcttcgcgggaagtcgctccttggcggaccaggcctggctgctttcgttgtgggcggatgcacaggggctcgccggcaatcaggtggcggccatctttcgtcgctaccgggagggcgcggtggcgcgcgtggacgtcgagcagcaggcgttcctcgataccttcgagtggtcggtcatcagaccccatgtccgagaggcattgaaaagacacaaacagcgcgcgggagagggctcactcgacgcgctctggaaaagcgaggagtacgacggcttcgcgaaccagaggtgggtcgatgatgcgctgatggacctgcgctttcgtctggtcgggcagctcatccccgacttcgacctgctcatcgttgacgaggcccataagctgaagaacgtggactcggtacgggccaccggggtgcgcactgttttcgaggggcgcttcgacaaggcgctgttcctcacggccacgccgtttcagctctctgtcgacgagctcaagcaagtgctctcgctcttcgccctggcccggtccgcgcctgcggacctgatggagcaggcccagcgattgttggacgacgtgggggactacaagcaggcctataacgagcttgagcgcgtctggtcacaagcggacgaggccgtcgtctcggacttcggcgcgttgtttgccagggacccccagctggtggaggagccggcagatgcgtccctgcgggcggtggtcctgtgcgcgcgccggttgctgtccctgaagacggagcgcatcgagccgggcttccggcggtggatgattcggagcctccgggaggacaagcgtgtctaccgcaggagccaccgcccccgactgcgggcccagggtggggcgggcgttcccttcatgctttacgagcggttcatcgcggagctcttccgggggaagagccgcactcataaggcggcggttcagatcaacatggtctcctcctatggggccgcgcgcgagggggcgctgctctccagtgagcggcaggccctgcccgacggcgacgccgaggcctaccgcgggctcttgcggagcgtggtgggggaactgcgcgtggagcagggggggcacccgaaggtggaccacgtcgtgcgggacgcgctggaggctgtcgcccgcgacgagaagacgctcatcttctgcgcccgcatcgagacgctccgtgaactgaagcggagaatcgaggcggaatgggagcatcacttgctggagcgatggaggaaggtgtttccggccgcgagccacggcgacatcttcgagcacgagctggacggcaagcgggtggatggacatcactctcgcctgcgtgatcggttcggccgcgcccaggatgcgctctacctcgcgctgcgagagcggtataccggtacgctgttggagggcgtcgtggtggagggggcccaccttgaactcgtcatcgagcgggcgaacggcctcctgcgccagcaacgcgtttcgaagacgcaagcggagcggatggactggtccctggtcaaacgctgtgtcgagcaggccgtggccctcttcgtgcgagacggagtattggcgggggatgtcgacccggaggtgttgaggcgcctgacggacgcgcgcttcgtggcgctcggcttcgatctcgtcgccgacgacgtcgaggactccgccgagggagacaggacgccttcctggacgattgacgcaggggacgcggccctcgtgcttcgccgcgagcatctctggtcctacctcaagggtgccctgttcgaggtacctcccgagctgcgggtccgcaccgtcgagcggctcgccagctacctcgtcgctcgcaatgtccccttccttccggagctgctggcattcgcgaaggagcagggcgttgacgtggaggcggtggagtcccgggcgctgtcgtcggtggtggaccgcttctggaccacgcctcggggacggccctggttcgagttgctgaagcgcttcctgatctatgcggggaagctcgacgaggagcggcggcgcgaagtgctcgatgatgcggttcgcgcgggggcgctcgtccgccacaccgtggagggcgagagccgggagcggctccgcgaggccttcaacacgccactgtacccgatggtcctcgtggccaacgaggtcatgcaggaggggctggacctgcatcatcactgccgtcgggtggttcatcacgacctggcgtggaaccccgcacagctcgagcagcgcgtgggtcgcgtcgaccggctgggctcgctcgtccagcggcttcgcgcgcgacagccggacaccaccctggacgttcaccttccgttgattgccaacaccatcgacgagcgcctggagcgaacggttcggctgcgggagcgctggctggagttcctcctgggggcggcgccccgcatcgaggagtacggcttggcggatgaccccctgaagcctctgccagatgctttcgcacaggcgctccgcgtggagctggggccggtggcgaaggcacggctgccagacgggtga

SEQ ID NO: 8285 - DNA, 1230 bp, Myxococcus xanthus
atggagcgcgccctctccgcgccggggaagctgttcctctccggggagtacgccgtgctgtggggcggcgtggcgcggttggccgcggtggcgccgcgcaccgccgcgtatgtccgccgccgcgcggatgcccgggtgcacgtgtgcctggaagaggggacgctggcgggaagcacgacgccgctgggcgtgcgctgggagcgtgaagtccccgcggggttcgccttcgtggcgcgggcgctggacgaggccctgcgcgcacatgggcgcgcgagccaggggttcgacctggcggtggcgccgtccgcagtggggccgaacgggcagaagctgggcatgggcggcagtgcgtgcgcgacggtgctggcggcggaaggtgcgcgctatgtgctggaagagcgctacgacgccctgaagctggcgctgctggcgcacacgcaggggcagggcgggaagggcagtggcggggacgtggcgacgagcttcgccggtggcgtgctgcgctaccggcgctacgacgtggcgcccttgattgaggcgagcaacaccgggcggttgcgcgcggcgctggcggagtctccgtcggtggacgtgtggcggctgccttcgcctcgggtgtcgatggcgtatgccttcaccggcgagagcgcctcgacgcgggtgttgattggacaggtggaggctccgctggaggaggcgggccgccggagcttcgtggagcgctcggacacactgggccatgcgattgaggacgggctgagcggcggagacttccggggccttctcggaggccgtgaaggcgcagcacgccctgctgctggagttggggccgctggagacggaaggcatgcgccgcgtgctggcgctggcggccacgtacggcgccgcaggcaagctgtccggtgcgggcggaggggacggctgcatcctgttcgcgccggatgcgcaggtccgtgcggagatgtgcaagggattggaagcccggggcttccacaccctgccgctggacgccgagtctggcgtgcgcggcgaggctcaggcggaggtccgtctccggacctgggtgcgcgcgctgagctgagtgcgtttctcctgggcttgtcggctatctggcgcgctaccccgggagtctacgccctggaacccggttgctttctccgcactgcttgggcggtgaatatacttggcatgggcagtctctctgcggtttggttttccagaaagaaatga

SEQ ID NO: 8286 - DNA, 156 bp, Myxococcus xanthus
atggcggcggttatccggatgcttgacgaactgttggccatcatcgtgcagtccatgtcggcggcaggtaagatgagcttcatggcgggggtgctggtgcccgaggaggaccgcgtgaagtacagcgccgtcaccggtctcaggtggaacacatga

SEQ ID NO: 8287 - DNA, 180 bp, Myxococcus xanthus
atgctctacacgttcgccgccagcctggagctgcgcacgcctaccagcgagcgatggattgtgcagaccgagcgcctcgaggaggcgaatcacggccgcgtctacctggagctgtccaagggggaccatgccgaagccatgcggggcatggcgctcctcaacgccgtgctgccgcgctga

SEQ ID NO: 8288 - DNA, 342 bp, Myxococcus xanthus
atgagccgccccatcgtgattgtcgagagcccttacgccggtgacatcgagcgcaacgtcgcgtatgcccgggcggccctcagcgactgcctccggcgcggcgaggccccctacgcgagccacctgctctacacgcagcctggggtgctgcgggatgaggtccccgaggagcgcaaccacggcatcgaggcgggcttcgaattccgccgcgtcgcgcaggccacggtggtctacacggacctcggctactcggaggggatgaagctgggcatccgtcacgccgaggccctcggccaccccatcgagtaccgctcgcttcccggctgggccacccaggcgtaa

SEQ ID NO: 8289 - DNA, 279 bp, Myxococcus xanthus
atggtaggacagcgcaccgcgcgccatggaattccccagccgtacatcgaggtgcgcttcccgaaggacacgcgccagcgcacgctggacgccgccctccatcgcctctacgccgatatcgagctggcaaccccggaaagcgagagctgggatgttcgcatcgaacaactcccggatgtgttcagcttctccggaggccgcgtgtacctggagctggcggagggcactccggtcgaagccgagcgcgcgatggcgctgctcaaacgcctcgtgggttga

SEQ ID NO: 8290 - DNA, 960 bp, Myxococcus xanthus
tccatgaagacgctccggtttggaattgaaattgagacggttggcgccagccgccagaagctggcccatgcgattcagagcgcggtgggcgggcacgtttccggcgactaccggggctggcaggtgacggacacccagggccgcatctggagggtggtatcggacgcctcgctgagcggaggcgagtacagcggcgaaatcgtctcccccatcctcacctaccaggacatggacgccttacagcaggtggtgcgcgccgcgcgcgaggccggcgcacgcgccgacgcctccaccggaatccacatccacgtcgacggcagccgcttcgacgccaagggcgtcaccaacctcgtgaagatggtgcacaagcaggagcgcctcctggagacggccctcggggtgagtgcggcccggctcgcccggtactgccgccccatcgatggggccttcctccagcggctggaggcccggcgcccgcgcaccctgcaggatgtgaatgaggcttggtacgggcgccgcaacagcatgcccaaccgctacgactccagccgctaccacggcctcaacctcaacagcctcttcttccggggcaccatcgaattcaggtacttcaacggctcggtgcacgcgggagaggtgaaggcctacgtccaactggtgttggccctcgccgcccgggccctggcctcgaaggccgcctctagcaagcgccgcgacttcaaccccgccaccgccaagtacgacttccgggtgttcctcctccacctgggactcatcggcgaggaattcaagacggcccgcctccacctcctcaagaagctggagggcagcgcggcctggaagggccagcgccgtgacaggcgcggctcgggcgggggcgaggacggctcgaccggcagcgagggcacacagggcggcgcagggggcagcgcgcccaccgaagccttggctgccgcgtga

SEQ ID NO: 8291 - DNA, 441 bp, Myxococcus xanthus
atgctctacttcgcctacggctccaacctcgacagggcccagatgcgcgcgcgctgccctggcgccaccgtcgaggcccgagccaccctttccggccacaccctggtgtttggcggattcagccaccgctggggcggcgccgtcgccaacctccagcgcgtgcgcggcgcccacgtcgaggggctgctgtaccgcctcacccccgaggacttgcgcgccctcgacgtcttcgaggggcaccccttcgcataccggcgcgccattcggctggtgacggacagggccggccaccgccgccgcgcgctggtgtacctccagcccgagggacgcttcgaatcctggccgcccgctgtccgctacttccgcgtcctctggcacgcctacgggcgcctgggcttcaaccgcgccgccctctcgggcgccctgggaggtgcggcgtga

SEQ ID NO: 8292 - DNA, 363 bp, Myxococcus xanthus
gtcttcgtgtacgggacgctactggggggcgagcccaaccaccgcctcctgcgcggcgcacgccttatcggcccagcgcggacgcagccccgcttcaccctctatgactacgggcccttccccgccctcgcctccaggggcaagcacgctgtcgagggcgaggtgtacgaagtcgacgctctcatgctggcggcgctcgacagactcgagagccacccgcgcttctaccgacgcacgcccattaccctcgacgacgtcggccgcgtcgaggcatacctgtttcccaaggagcggttggctggccgccccatcatcgagtccggttgctggcgtcgacacctacaggagaggaagccatggtaa

SEQ ID NO: 8293 - DNA, 180 bp, Myxococcus xanthus
atgcaggacatcgccttcggtgtggagcgcttgtctctgggcgagtacatcgactgggtggtaggcaatgcccagcgtttcgagtccgtcgcgctgcgtgtccagggtgaaaccgacgaggagaaggccgcctcgctggtggacgagatgctgcgcgagggcctggcaacgaaggggtga

SEQ ID NO: 8294 - DNA, 375 bp, Myxococcus xanthus
atgcgcaggctcgccgaggcgggccgccaggccgcgctgggcatgggcgggtacaacagccagggcctgtgcgccacgggtgtgagccgggccatccagaacgccttcggcatcaaggtctggggcaacggcaaccagattgacaacaacctgccgcgcgacaagttcaagcaggtcaacatgtcgctcgagcaggcgctgaagattccgggcctcgtcctcacctgggagagcacctccactcgactgggcagcatctacgggcacacggccatcaccaccggcgacggccactcgtccgccagcgacttcatcgagcgcaacacgaccaacagcggccgtaccgggttcaaggtcttcatgcccctcatctag

SEQ ID NO: 8295 - DNA, 864 bp, Myxococcus xanthus
atgcggctggcacccgagggcgccgaggtggcctccaccgagcaggagctgttcggcacgccccgtgagcgctccgtccgcctgcgcaccggcgtgacgctgcgctacgtggagcaaggcctgccgctgggccccgcagtggtgttcctccacggcttttcggattccaaccacacgtgggacctgaacctgcgcaccttcccgcgcaaccaccacgtctacgtgctggaccagcgcggccacggggattcgacgcgcccggcgtgctgctacacgcagcagtccttcgccgcggacgtggacgccttcctggaagcggtgggcgagcgcagcgccatcctcgtcggccactccatgggcagcttcatcgcgcagcaggtggcgttggacttcccgcggcgcgtgaagggattggtgctcgtcggctcggcacccaccgtcgccggcaacccggtggcgctggagctgaagtccatcgtggacacgttcgagggcacggtggatccggagttcatccgcgcgttccaggagagcaccttcgtgcgccctgttccggcgtcgtacatcaacacgatggtgtcggagagcagcaaggtgcccgcgcgcgtgtggcaggacgcgctggacggcctgctcgcggaggaccactcggcgcggctgaaccacatccgcgtgccggtgctcgtcattggcggagaccaggacggcttcttctccgtcgctgaccagcaggcgctggtggacgccctgccggacgccgagttcaagctgtacccgaacaccggccatgcgccccacgcggagcagccgcggcgcttcaaccaggacgtgcaccgcttcctgcgcgaagtgacgcgctggtag

SEQ ID NO: 8296 - DNA, 516 bp, Myxococcus xanthus
atgcgactcgacaagcatgcactcctgggccagctcgcggaccgcctccagcagagcgaccggctggcccaccgcgccgaggcggaggcccgcgaggccgcccgcagtctggccacggagtccgagaagaaagaggacggccgcgccgccctggagttcggcagcctcgccaccggacaggcccagcgggcccgccgggtccaggaagaactccaggcgctgacgaagttcggtcaggcggaggtcccccgtttcccccggcaggggccggtggcgctgggcgccatcgtggacgtcagcaccgaggacgaggagggcttctccgagcggaccttcttcgtcctgcccgcgggcgccggcaccgagctgacggggccgggcggtgacggcttcctgtccgtcatcacccccgcctcccccgtggggcgcgccctcatgggccgaaaggcgggggatacagtggaagtgatgctcgcgggcgaggtccgcgagtggacggtgctcgaggtcgcgtga

SEQ ID NO: 8297 - DNA, 1500 bp, Myxococcus xanthus
atgttcggcgtgctgatgacgtacgtcccatacgagttccgggtggcctccttccggccgctctacccgtatgtgcgcatgctgggcctcacgtacctgacgggcagcatcatgctgatgggcgcgctgctgtacccgcgcgcgccacgctggctggacgtcacggggcgcctgctgctgggcgcggccatggcgctgtactggtgggtgctcaacgtcctgccgggcagcttcacgggcatcattctctacccggtgctcttcggcggcgtggtgctggaggcctggcccgccatgcgccagcggcccgtgctgcgcaccttcgcggcgctcaccggcgcggcgttcggcgtggccatgctggtggtgcccgagcgcttcccgctctccgtctacgcccacctcgcgccccttcggcccctggtgggcctgctcttcgccgtgtgcggcgtgggcctgctgctgccttcccactggctccaccgccggctgccggccctgttcatgggcgggctggcggtgcccttcgccctgctcgcgtacgcgctgggccggggtgcttcatggctgggcgccagcgtgtatgcggtgctcaccctggcctgtgtcgcgcaggccctggactggcggccgcgcgcgcctcgcacggtggggtggaagctgctgcgagggctggccttcgcggggctggtgccgctgctggcgctgggcgggctggcggcgtacctggcgcagaacgcgattgaacagcaggtgcgcgacgacacgcagcgcgccgccgcgggcgaggccgacttcctgcggcgctacctggacgacgcgggcgagtccctggcgctgatgctggagtccccgggcttccgcgccgccttcgccgcggccgcgccggagcggctggagccctacctggtcaacctggcggcccaggagcgcgccttcgacgcggcgctcgcggtggacacccagggccacatcctggccgcgtctcccagcgtggaggggtggaacctggagccgcgcgacttcctgcccccggccttcacccggggcgccgaggtgtctccgcccttcatccgtccgcccggccagcccctggtcgcggtgacgcagcccttccgcgaggacggcgaggtgcggggcatgctggtgggcctgctgtccctggagcgactgagccaggccaccacgcccgcgtcgcggcgcttccacgtgcaggtgttggacaggcgcggcctcaaggtgctgcgcgacaccgcgcccggagcgccgctgctgggtgaagcccacctgccggacgcgctcagcctgaagctgctgcatcccggcatcggcgtgctggaggccttcgacgcggaggaccgccgaatactcgccgccgagagctcccgtgcaaggcacagagtggaacgtgctggtgactcacgagctggagctggtctactcgacgattacgcgcatctgcgccagcgcggaggggctcgtgctgctaagagtcctcat

SEQ ID NO: 8298 - DNA, 858 bp, Myxococcus xanthus
atggaccgctccgcgcgcgaaggactggcgcaggccgtgcgcgagcacgagcgcttcctgtgggggctctgctaccgcatgacgggcgtgtcggcggacgcggaggacctggtgcaggagaccttcgtgcgcgccctggcctcgccgcccgcgcgaacggaggcgctgcgcccctggctgacgcgggtggcggtgaacctggcccgggacacgttgcggcggcgcaagcgcgagggctacgtgggcccctggctgccctcgccgctggacacgggagaggaggagctgccgccccctggcgtggaggcgcggctgccgggaggcggctccacggagggtcgctacgcgctgctggagagtgtctccttcgccttcctgctcgcgctggaggtgctgtctcccaagcagcgggcggtgctgctcctgcgcgacgtgttcgactactcggtgcgcgaggtggccgaggcgctgaacctgcgcgagtccaacgtgaaggtggtgcaccaccgcgcgcgggcggcgatggcggcgtacgaccgcgcccgctgcctgccgacgcgggagttccaagcgcgcgcccgcgccgcgctggagggcttcctgggtgcgctgctgacgggggacgtggcggcggcggaggcgctgctcgccagcgacgtgtgcgcgctgtcggacggcggtggccagtaccgcgccgcgcgcgtgccggtgctgggacagtcgcgcgtgctgctgctctaccggcggctgatggagatgcggggggcgccctccgccgtggagctgcggatgctcatcggcctgccggcggtggtggacgtgtttcctccgccccagcgcgacccgcaggcgggcacc

SEQ ID NO: 8299 - DNA, 1215 bp, Myxococcus xanthus
gcggtgacgctcttcgagcgctcgaagcacctgggaggccggggacagacgtcggacgtggagggcttccgcttcaacctcggcgctcacgcgctgtaccaggggggcgcggggatgcgagtgcttggcgagctgggcgtgaagcccgcgggtggcatgcccggcgcgggctcgtatctgctgagtggcggacgcctgcacacgatgccgcgcgggctggtctccctgctgaccacggacgcgctcggactgccggggaagctggagctcgcgaagctgctcgcggggctgggacgcgtggacctggcgccgctggcgaacatcaccacgcgcgactgggtggagcagcacctgtcgaacgcggacgcccgcgccttcatcctggcgctggtgcgggtgatgacctactgcgcggacgtggacgcgatgagcgcccagtccgccgtcgcccagctccaggcgaagccggcggtgctctacgtggacggcgggtggagcacgcttgtctccgagttggagacccgcgcgcgcgatgcgggcacacggctggagctctccgcgcgcgtgagcgcggtcctgctagcggatacgggtgcgcgcgttcgtggcgtgcggctcgcggatgggacggagcacgcggcggacgcggtggtggtggcgggcgggccgggtgacatcgcggcgctgctgcccgctgacgcgctcctggcgcacgacgcggcccgcgccgtgccggtgatggcggccacgctggagctggggctgtcccggttgccccgtccggacgcgctgttcgcgctcgggactgatggcccctggtacgcgtcggtgcactccgcggtggcgaagctggcgccggaaggcggcgcgatggtgcatgtgatgcaatacctgggcggcaggggcccggaggcgagcgaggcccgcttggaggaagtgatggatgcgctgcaacccggttggcggacgtccgtggtggcgcgccgttaccggccctccctgctggtgtcgcactggctgccgacggcggagacgggcggcctgcgcggacgcccctcggtggaggtgccgcacgtgcctgggttgtaccgcgtgggagattgggtggggccggagggcttgctcgcggaggcgtccttcgccagcgcggagtcggtggcgcgcgcgctcgtcccgggccagcaggtggcgtcacgccgggcagtggggcgctga

SEQ ID NO: 8300 - DNA, 915 bp, Myxococcus xanthus
atgagccgcacggctggcttcctcatcgtggcgttgtcgggcgtgtgtttcggcgcgctgggcctctttggccgcctggcctatgcggcgggcacggacgtggccacgctgctgttccttcgcttctcaatcgcgggggcggtgctcgccagcgtcatggtgctgcgccgccagcggtggcctcggggtggggtactagtcgtcctgatgttgctgggcgccgccgggtacttcagccagtccggggtctacttcttcgccctgcagcacgcgcccgcggggctggtggccctgctgctgtactccttccccgcgctggtggcgctggtgcagcgagtcgtcttcaaggagcacctgggccgggtgaagtggctggcggtggtcctgtcggtgggcggcacggtactgacagccgacctgtcccagggcggcgccacgctgccgggcgtgctgctgggcctgctgtccgcgctgttctacaccgtctatgtcgtcgccagcggccgggtgtccggtcgggcggggccgctggcctccagcaccgtcatcctgtgctcggcgggtttctccttcggcgtggccatgctggtgcgtggccctgccttccccggctccgtcacgggctgggccgcggtggtggggttggcgctggtggccacggtggccgcggtgctcctcttcttcgtgggcatccagcgcatcggcccggtgaacacgtcgctggtgtccaacctggagcccctgacggcggtggtgctgggggcgctcttcctggacgagcggctcaccccacgccaggtcctgggaggcgttctcatcctcggggccgcggtgatgctggcccgcgccgatgtgccccgcgcctccccggagccgcccgcgggaggcggtgctccgggggcggtgcccggttaa

SEQ ID NO: 8301 - DNA, 282 bp, Myxococcus xanthus
atgacaccccaggaactctcggagaaggcccggcagctcgtcgctgaaggcgcggtgctgctggatgtgcgcacgccgcaggaatttcaggaagggcaccccgagcccgcccggaacatccccgtgcaggagctgccccgccggctggccgaggtgggcccgcccggcacgcccgtggtggtgtattgcgccgcgggtggccgcagcgcccaggccgtgcagttgctgcgcgccaacggcttcccggacgtcttcgacctcaaatccgtgaagaactggtag

SEQ ID NO: 8302 - DNA, 2253 bp, Myxococcus xanthus
aggcccgagctgcgcagcaccaacgaggagctccaggagaaggcgaagctgctctccgttcagaagacggaggtggagcgcaagaatggcgaggtggagcaggccaagctcgccctggaggagaaggccgaacagctgagcctcacgtccaagtacaagtccgagttcctggccaacatgagccacgagctgcgtacgccgctcaactcgctgctcatcctcagccagacgctcagtgacaacgtggatggcaacctcacgtcgcggcaggtggagttcgccaagacgattcacgcgtccggcgcggacctgctggagctcatcaacgacatcctcgacctgtcgaagattgaatccggcaccatggcggtggacgtgggtccgctgcgcttcggcgacttgcgcgagttcgtggaccgcaccttccggcaggtggcggacaaaaaggggttggagttccacatcggcctgggggattcactgcccggcgagctggagacggacgcgaagcgcctgcaacaggtgctcaagaacctgctgtccaacgccttcaagttcaccgagtccggctcggtgtcgctgcacatcggtctggcgaagggcggctggtctccggaccacgccatgttgtcctccgcgccctcggtggtcgccttcaccgtggcggacacaggcatcggcatcccgaaggacaagcatcaaatcatcttcgaggccttccagcaggcggatggctccaccgcccgcaagtacgggggcaccggcctgggcctgtccatcagccgtgaaatcgcgcgactgctcggcggcgaaatccggctggagagcgacgtgggcaggggcagcgccttcaccctctacctgccgctggccttcatggcggagcgtccgccggaggagcatgcgcgctgggactacaacccgctggccaccacggtgctccccgcgcccatcgcggagccagtctccgagtcgcgggtgtcttcgctgagccggatggacatcgacgatgaccggagctccatcctgcctggagacaaggtgctgctggccgtgacgcacctggcggaccatgccgcgcgcctgcgtgccgcggcgcagggcacgggcttcaagctgctggtgtctaccgaggtggaggacgcgctggacgccgtccgcaacacgcggccagcggccgtggcggtggacctggacctgccggagatggcgggctgggtggtgctggaccggctgaagcacgacgcgtccactcgcgcgctgccggtgtacacggtgtcggtggaggaccaccgcgagcgctcgctcaacctgggcgccattggccacctgcgcgcggcggcggacccggaggcggcggtggccgcgctggagtccctcaagcgcttcgtggagcgcaagggccgcgggctgctcgtggtggaggacgaccccgtccaccgccagacgctgacggagctcctgggcagtgatgacgtgcagacggtggcggtggggaccgcggcggaggccctggccgcgctggccgagcgccgcttcgactgcatggtgctggacctggggctgccggacatgcccggcacggagctcatccgccgcgtccatgaggcgcacggcgcgggcgggccgccgctcatcgtctacacgggccgcgagctgacgcgcgcccaggagacggagctgcggcgggtggccgaggccatcgtggtgaaggacgcgcagagcccggagcggctgctggaggagacgagcctgttcctccaccgctcgccctcggacctgaccgagcccaagcgccgcatgctggagaaggcgcgcgagaaggaccccttgctggtgaaccgcaaggtgctggtcgtggacgacgacgtgcgcaacatcttcgccctcaacaccgtgctggagcgctacggcatgaaggtggccttcgcggagagcgctcgcgagggactggaccagttggagaaggacgccgacatcgagctggtgctgatggacgtgatgatgccggagatggacggctaccaggccatgcgcgccatccgccgcatggagcgcttcgtccatctgcccatcctggccctcaccgccaaggccatgaagggggaccgggagaagtgcctggaggccggtgcgtccgactacatcaccaagccggtggacatcgagaagctgctcagcctgctgcgcgtgtggctgcacgcgccgcggggcatgccgccgcgcggttcgcgcacggaggtctccggatga

SEQ ID NO: 8303 - DNA, 837 bp, Myxococcus xanthus
atgacggggcccggcgcgcgcggcgcggagctggaggcgctggaggtggacctgctgctggagggcgtggcccggcaatggggcttcgacctgcgcagccgctcccggccgcagctcttgcggcggctgcggcaccacctccgcgaggagcggctggacagcttctccgcgctccaggcccgcgtgctgcacgacgccgaggcgttggacgcgctgctgcgcacgctgtcctgcacaccgcccgccctgttcgcggaggccgccttcttccgcgacttccgcacccgggtggtgccggtgcttcgcacctggccctccgtgcgtgtatggcacgcgggctgtggaaccggcgaggacacgtacgcgctggccatcctcctccatgaggaagggctgtggggcaagtgccggctgtatgcgtccgacgcgagtgaagggctgctggcggacgcgcgcaccggcgtgctgccgctgcccacgcaggaggacgcgcagcgctacctggaggcgggcgggaagggcgcgctctccgactactacacgcgcgatggcaactgggcgctgctccagccccggctgcgcgacggcatcttcttcacccagcacaacctggccacggatggctcgttcaacgagttccacgtcatcgtgtgccgggacacgttgctgaccttcaatcgtgcactgcacgaccacatccacggccgcctcttcgagagcctcgcccgcttcggcttcctgtgtctggggcgcaaggagtcgctggcgcgcacgccgcacgcgggggcctacgagatgctggatgactgtggtcgcatcttcaggagggtggcatga

SEQ ID NO: 8304 - DNA, 558 bp, Myxococcus xanthus
atgaatcccttggggctgctggtggtgggggcgccgcgctgcgcggcggcggacgtggagtcggtgctggcgctgttgcctccgcacctacccgtgccggtggcgttggcgctgcaccggggccctctggacgcgctggccgcgccgctgggccgccgctgcgcgctgccggtggtggagccggacgacaaggacccgctgctgcccggcgccgtgtacctggcgcccgcgggctaccacttgctggtggaccggggctgcgtgtccctgtccgtggagccgcccgagcatgggcagcggcccggcctggacgcgctcttcgaatccgcggcggacagccatggccccagggccgcggggctgctcttcgcggggcacgaggatggggtggcgggcttgcaggtgctccatgcgagaggcgcccgggtggccgtggtgagcacgctccagacgggcggagcgggtgaggagggagcgatggcgcaattgacgttgggttccgtgggagggtggctcgcgcggctggcctatgtgccgcgttctaaggtgctgccttga

SEQ ID NO: 8305 - DNA, 426 bp, Myxococcus xanthus
atgaactggggcaccttgtcgggctatggcgaccccgttgactggctggacgccttctattccgcctatcgcgccgccaacgggaaccgcgacccgcacatcgattacctcgggttccactggtacgactatggcctggattacaacctggaccggctcacgaagtacggcaagccgttctgggtcaccgagttcgccaactgccacagccagccggatggcgcgcagattgactcggtcgccaagcagcgggtgcagatgacggagatggtggccgtctgcgagcggcgcgaggacgtgttccgctacgcgtggttcacggggcggtggacgaacgacccgtgcttcgcgagcctgctcggcgccgcgggcacgttgaccgagctgggtgagcactacgtgtcactgcccacgggcgcaccgtag

SEQ ID NO: 8306 - DNA, 927 bp, Myxococcus xanthus
atgccggacatggacggcttcgagacggcccagctcatccgcgagcgagagcgcagtcgcggcacgcccgtcatcttcctcaccgggctgtcgcgggggccacatccggagctgcgcggctatgccatgggcgcggtggacttcctgctcaagcccttcgagcccgccatcctgcgctccaaggtgagcgtcttcgtggagctgtaccgcaagacggagctggtgcggcggcaggcggaggcgctgcgcgaggcccagcagcgcgagcacgcgcgggagttgctggaggcgcagcggcgcgtggaggccgaacggcttcgttcagaaaccaaccgaaaccagcagcgctggctggaggcggcgattgccgcgctccccatgccgctggcgttggtggagccgggaagcggccacaccctgctggccaaccgggcggcgcaagggctggcggggggctgtctggcctaccgcgaggcgcgcgcgctgcatgcggacgcatgcttccgcggcgcggatggccggctgctcgcggatgaagacctgccgctgatgcgcgccgcgcgcggtgaggtgttccaggcgttccccgtggagtggaacgtgggcggccagcgcggttcggtgctcgcttccagtgagcggctgcctcgcatgcatggacgcccggagaccatggtgctgggcctcttggacgtgacggcgctccgagccgccgctcgccacgactggctccccctgccgctgacggagcacatcgctacactggaggcgcagggggaggacacaggcccgctcactcggctcatcgaggtgctgcggaaccttccgggcttgagcaccgggagccccggacaggagcgcgaggagggctccttgctagcggaagagggcagccaggcgggcaaccctcctcggcccgcgcgctga

SEQ ID NO: 8307 - DNA, 207 bp, Myxococcus xanthus
atgctggtgagcgatggtgcctcacctccgtcgtatcgctacggtcctgagtcgtcggaggatgtgcaggcggtgacggagctggcggcggtgtacagcgcgaagcgcgtcagcgtcatctccttcatcttctcgaggccgctggacaaggtgcggggctttgccgaggcattcatcctgaagaaggacaaggacggccatggctga

SEQ ID NO: 8308 - DNA, 261 bp, Myxococcus xanthus
atggctgaagcagtctacatcctgtgtgcgttgacgagcgtggcgtgcgcggtgctgctgctccgggcctacaagcgtacgggcatgcggctgctcctgtggagtgggctgtgcttcgtgggcttggtggtcagcaatgtgctcctcttcgtggacctggtgctgctgcccgccaccatcgacctgtacatgccgcgcgccatcgccacgttgtccagtgcctctgtcctgctctatggcctcatctgggacgcgtcctga

SEQ ID NO: 8309 - DNA, 240 bp, Myxococcus xanthus
atggcgtggctggcgagcgcgctgttcttcctgcgcttctgggtccagtcgaaggaccggctcttcgccttcttcgcgctggccttcacgatgctggcgggcaactcggtggtggcggcgttgctggacgtggatgacgagcggcgccactacatctacgtggtgcggctcttcgccttcctgctcatcctctacgccatctgggacaagaaccgcgcgaaccgccacggctccgggtag

SEQ ID NO: 8310 - DNA, 469 bp, Myxococcus xanthus
atgtcgcgccgcccttcttcatcctcgcggcccgcgtccgtggacgagcgcgaacccgagcggtccgtctccacggaaccggacgcggtgtgtccgccgcgagggctggagtcccaggtgggtgggggtggggccgggaatgccgtccgcttgcgcggcagtgacgacgcggaggagcgcctcgcgttcctggccagcgcgggcgagctgctgtcgtcctctctggattcgggcacggtgctcaagcggctggcggagttggccgtgccgctgttggcggactggtgcgcggtggacgtgctcacggcggacgggcgggttgagcgggtggccgcggcgcaccgcctggcggagcaggtgccgctggtgcacgagctggcacgcctccagcccctggacctgacggccgagggcggtatcccggaggtgctgcgcaccggcaaggccgccctccttccctttagagcac

SEQ ID NO: 8311 - DNA, 162 bp, Myxococcus xanthus
gacgacttgaagcgcctgttcgccgggcgcgaggcgcaggtcatccccaccgccacgcgctcggtgctggaggcggggccggacaccgccgccctgcgccaggcgctggagcggcacctggcgccggcgcgcgccttccgcgctactgcgcgcccatcatga

SEQ ID NO: 8312 - DNA, 891 bp, Myxococcus xanthus
atgggcgtgcccccgctgtgggtgctggacgtgccgggcctgcgcccgctcctgccgcagcggctgcccccgggcagctcgatggagacgctctaccgtgaggcggtgaagacgcggctggagaacaagaagcccgcggcggatccggcggtggtggaccgcgcgcagaaggcgctccgcatgggcgccaaggacgccccggtggcggccatgtacctgcgcgaggtgggcgtgctgcccctgttccgcttctccgcggcgcaggtgctgaagggtgcgctgcgggaagaggtggaggtggatgacctgacgggctccatcgacccgcgcaccacgggcgcgctcctggagctgcgcttgacgcacgaagtcgtggagcacctgcaggaggcgcggcgccggctggcggccacgcagctctacacgtcgctgctggaggcgggcttcaacccggagaacaactgggacgaggcgctggagtcgagcgacgcgtcgatggagctggcgcagctggccacgggtgaggaccgcaatgccctgctggagggcttccaggtcttcgcggcgctgccggacgaggcccggctgcggcggctggcctacctggccgagtccgtcaccaacctggagctggtgagccggctgccggagggcatggagccgtcatggctcacgggccccgagacgcgcgagtgccacgagcgggagatgacgtacgtccagtcgctgaaggcggaggagattcccgccaaggtggcggcgctggcgaaggaagagctgggcgtgcccgagggtgaagttcccgaggaaagcgacggcgaccttttcgtccacctgcgctgtgacgtgtgtggcaaggagaagctcatcgtccaatcaccggaggagtaa

SEQ ID NO: 8313 - DNA, 2493 bp, Myxococcus xanthus
ctcctgaagaccgcgggatggctttcgctgaccggggccacgggcgccgtgattgccgtgacggccgtgtactacgtgtacgcggatgggttgcccgccatccccaaggtggacgagtactggccgcccatcgtcaccgaggtctacacggatgacgcggtgctggccggcgagttctacgaagagcgccgcaaggtggtgccctacgagcggattccgaagcgcctggtgcaggccttcatcgcgtcggaggactccagcttcttcgaccacttcggcgtggacgtgctgggcaccgcgcgcgccggcttcaagacggtgagctccaagctggggctgcgctcgggcggcatccagggtggctccacgctgacgcagcagaccgcgaaggcggtgctcatctccgcggagggctacaagtccgccaccgcgaagacgctcacccgcaagattcgcgaggccatcctcgcccggcgcctggaggagtcgctgacgaaggaggagattctctacctctacctcaacaacgtcttcctcgggcaccacagctacggcgtgcagagcgcggcggagaactactaccgcaaggacgtgcgcgacctgacgctgggcgagatgacgctcatcgcgggccttccgcaggcgcccagccggtactcgcccttcctgcgcccggaggcggcccgcaagcgccgctcctacgtgctgcgccgcatgttggtggagggcatgatttcgcaggaggagcacgacaccgccaacgccgaagaggtgaaggtgtacccggtggaggacgtgttccacgagttcgcgccgtacttcgtggagcaggtgcgcaaggacgtggtggaccggtacggcaaccccgtgctgctcaaggccggcctcaaggtcttcaccaccatggacagcgagcgccagcgcgccgcgcaggacgcggtgctccacggcctgctgtcggtggacaagcgccagggctggcgcggcccggtggagcagctcgcgtcgaaggaggccatccgcgccttcgtcgaccgctcgaagaagctcatgggcgcgaaggagctggtggagaaccggctctacgtcgccgtcgtcacgtccattgacggggacggcaagggcgcggacgtgcaggtgggcggtcacaccgggcggctgccgctcctgggcatgcgctgggcgcgcaaggtgaacccggagggctactacccggcgatgatgattacctcggtgaagaaggccatctccgagggcgacgtcgtcgtggtgcgccacgtcacgaagagggacctgacggacgacaaggagcagtgggacaagaagctcgcggacgaaatccccagcgagggggtgaagctcttccgcctggagcagacgcccgaagcgcagagcgcgctcgtctccatcgacccccaccgccagtacctcaccgcgatggtgggcggctacgacttcgacgacaacgagttcaaccgcgccttccaggcgtgccgtcagccgggcagctccttcaagcccttcgtgtactcggcggcgctggagcagttgaactggacgcaggccaccgtgctggtggactcgccgattgtggagcacgacccggacaccaaggtgtcgtggaagccggccaactacagcgacaagttcgaaggcgaggtgctgctgcgcacgtcgctggtcaactcgctgaacgtgcccgcggtgaagacgttcggcgcggtgggcgtgaagaacatggccgcgtggaccacgaagctcggcatcaccacgcccatgaacatggacttctccgcggcgctgggctcctcgtgcgtgtacccggtggacctggccaacgcctacgccaccttcaaccgctacggccgcaagaagcccacgtacttcatccgcaagattgaggaccgctggggccgcacgttggaggaccacacggccttcgacgacgcgtgggcgcccctgcaggaccgcgtggccgccggctacgcgcgcctcttcgagccgggcgagcaggtgatgagcccggaggccggcttcatcctcacgcacctgctgcgcggcgtggtgctccagggcaccggtggccccgcgcagcgcctgggcaagccggcggcgggaaagacgggcaccaccaacgactccttcgacgcgtggttcgccggctacacccgcgacctggtgacggtggcgtgggtgggctacgacctgaacccgcatccgctgggccgctacgagacgggcggccgcgccgcgctccccatctggctcaactacatgaagagcgcgctggagggccggccgcagtccgagttctacccgtggcagtccatggacctggtgcggctccacatcgacaagaagacggggaagattgcccccgcgggctccagggattcggagctgatgttcttcaagaagggcaccgagccgaaggacgcggtgcccgacaagaacacggtcgacgtcgatcagttcatgatgggcgcgcagtag

SEQ ID NO: 8314 - DNA, 957 bp, Myxococcus xanthus
atgatcgagtatcgaatcgaagccgacaccgccgggatgcggctggacaagcacctgcgcaaacggctccccaatgttccggtgagccacctcttcaagatgattcgcaccaagaaggtgcgggtgaacgggaagcgtgcgcaacccgagcagttgctgtcagaaggagacgtgctcaccatccgcggcgacgagcagcagctcgtgggggcggaacgtccgaaagtggacccgcctccgccgccggtggaccccagccggttggtcatccttcgagaggacgactggctcatggccgtggacaagcccagcggaatggccgtccataccggcagcggcatcaccggcggaacgctggtggactacgtgcgcgcctacctggggcccaaggccgtccgcaacgacttcgcggcctcgcccgcacaccggctggaccgggagacctccggcgtcatcctggtggccaagcggcgcccggccatggtgcatttcaccgaggtcttcacccacggcctgtcccgcaagcgctatctcaccctggtgaaggggaagatgccccgggactccggggtcatcgacctgccgctgtcagaacaccaacagacggccgagtccaaggcccgtcgaggggtgaacatgcaggcggccgtcacccggtggaaggtcgtgaagcagtcgagcgaggcggcgctcctgtcctgcgccatcgagaccgggcgcacgcatcagataagaaggcatctggcggccatcggacatccggtggctggggacaagaagtacggtgacttcgccttcaaccgcgacgtgcgggcgcgctgggggctcaaaaggttgttcctgcacgccgagcgcatcgaattcccgcatcccgaaggcggcgcgaaggtggctgtcgaggctcccctcgccgtcgagctccgagatgtgctcaagcgggccgcattggtgccctga

SEQ ID NO: 8315 - DNA, 594 bp, Myxococcus xanthus
atggcacgcaagacgccgcagtgggaaggacgcatcgtgcgcgtcctcgtgtgtaccgagcgcaagagcttcgtcacgaaggagctgcccgaggcgcgggtgtccttcgagggcttggagggtgaccgccacgcgggcctgacgcgggcggcggacgtgcgcacgccgtggttccccaaggggacgcccatccgcaacacgcggcagttctcactggtgtcgagcgaggagttggcccaggtcgcggagacgctcggcattccgcgcgtgctggcgtcatggctgggggcgaacctggaagtggcgggggtgccgcggctgacgcacctgccaccgggcacgcggctgttcttcccggaggacacgacgctggtggtggaaggggagaacgagccctgtatcggccccgggcgcgtcatcgaggcccatcatccggacgtgcagaagctggcgagccgcttcgtgaaggccgcatggcagcgccggggcctggtggcctgggtggagcgccccggcatcatccgcgcgggagacaccgtgaaggtggtgctgcccaggccggtgacgtacgtgctgccttcgtccggcgtgtag

SEQ ID NO: 8316 - DNA, 192 bp, Myxococcus xanthus
atgttccagaagtcgggcctggcctgcggctccgtggacgaggcctggcagcgctccgagtacctctatcccttgctgggctggctgacggcgcggttccccgagcccatggccttccagatttgtgcggagtggctgcggctggccgcgacacgcgtcgagggcgccgccgccgccgcggctttagagcac

SEQ ID NO: 8317 - DNA, 951 bp, Myxococcus xanthus
atgcacctgacgggcacccccctgtccctggatgcgaagcgcaagtcgccgctgtgcttcgtgagtcatgggcattcggaccacattgcccggcacgagagcaccatcgccacggcggcgacgctgcgtttcatgacgcatcgcctggggccggtgcgtgagccgcgcgaggtgcctttccggcaacccttcgagctggggccgctggtgctggagctgctgccggcggggcacatcctgggcagcgcgcagctccgcgtgacgcggccggatgggcgccgcatcgtctacaccggggacctcaacgtggcgccgtcgctcaccgccgaggcgacggaggtggcggagtgcgacacgctcgtcatcgagtccaccttcggccatccgcgctaccgcttcccgccgcgtccggaggtgctggggcaggtggagacgtggctgcggatgcagcttgagcgcggcgcggtgccggtgctgctgggctatccgctgggcaagagccaggaggcgatgaagcacctggcggggcgcggcttcccgctggtggcgcattcctccatctacgaggtggcgcagctctacgcggagctgggcgtgccgattgagaacctgcgctgctacgacgggaaggtggagccgggcgaggtgctctttttcccgccgcaccacgcgcggggcggggcgctggcgccgctgtggcctcgggcgacggcggtgctgacgggctgggcggtggaccggggcgcggtgcgacggtacggcgcggacgtggccttcccgctgtcggaccatgcggacttccccgggctggtgtcctacgcgaagtccacgggggcgcgggaggtgctgacgtgccacggcttcgcggaggaactggcgcaggcgctgcgcgacgcggggatggatgcgcgcccgctgggcgggaagccgcagcagctcggactgttctga

SEQ ID NO: 8318 - DNA, 921 bp, Myxococcus xanthus
atgctggggggaggcacggagccctcgtcgcggtcgcagcgacttcgcgcggatggggcgctggcgctcatcacttcgttctggggcatcaccttcgtggtggtgaaggacgcgctcgggcacggcgacccgttcagcttcctcacgctgcgctttatcgtgggcgcggtggtgttgagcgtcctggcggggaggcaggtgctgatcgcgcgcaacctgcgcatcggctcgatgctaggcaccttcctcttcctggggttctcgcttcagacggtggggctcaccaccaccacgccttcgcgctcggcgttcatcaccgggttgtgcgtgctgctggtgccgctgctgtcgatggtgctctatcggaaggcgccgaagttcacctcgctgctgggggtgggcgtggcggcggtggggctctacttcttcacgcagccggacggggggcttggcagtggtggcctgtcgtccggagatgtgctgtcgctgggcggcgcggtggcctacgcgtgccacatcctcatgacggagcggcatgcgccgaagcagggggtgatggggctggtggcggtgcagctctggacggtggcgctgctgtccgcgctgtgcctgcccttcgtggagcggcgcgtggcgtggcatccgtccttcgtgggggcggtgctcgtctgcggtgtgttcgccagcgcggtggccatcagcctccagacatgggggcaggcgcgcaccacggcggtgcgcgcggcgctcatctactcgttggagtcggtgttcgccgcgctgtactcggtgctgctgggctacgagacgctcgggcctcgggagtggctgggcggcgcgctcatcctgtcgggcgtgttgatgtcggaagtgggtgcggcggcctgggtgtggtggcgtgcgagggcgccggcgcggtag

SEQ ID NO: 8319 - DNA, 1377 bp, Myxococcus xanthus
ctcgcgcggagcaccggtgcgcgggtcacgcatcggcgggagttgggcggtaccgccgtgctctgggaggcgctgcgccggggcgaactcgacgtgtaccccgagtacacgggcacgttgcgacaggagttgctgtccgggcgccacctgccggacgacgcggcgctgcgtgcggccctggctgagtctgggcttcggatgagcgagccgctgggcttcaacaacacgtatgcactgggcatgaaggaagcggaggccgagcggctgggcattcgccgcatctctgatttgcgtgcccatccttcgctgcgcttcggtttcagcaatgagttcatggaccgcgcggatggctggcccgccttgcgagacagctaccggctgccgcagcgggacgtgcgcgggctggaccatgatttggcgtaccggggcatggagagcgggtcgctccagctcacggacctgtactccactgatgcggagattgaggcctatgggttgcgtgtgctggaggacgacctgcgccacttccccgcgtatgacgcggtgctgctgtatcgcgacgacctggaggcgcgggcgcccgaggccctggccgcgatgctgcgtctggaaggccacgtgtccgaggcggacatggtgaagctcaacgcgctggcccggctggagcgcgtgtcggagggccgcgtggcgtcgggtttcctcgccacggcgctgggggtcacttcggaagtgcgcggggacgggctggcttctcgcgtgtggaagcggacgcgtgagcacctgttcctggtgggggtgtcgctgctggcggcgatggcgctcgcggtgcccttgggcgtgctggccgcgcgacggcctcggctggggcgcggtgtgctggggctgacgggggtcatccagacggtgccgtcgctggcgctgctggtggtgatgattccgctgctgggaatcggctcacgtccggcgattgccgcgctgttcctctacagcctgttgcccattgtccggaacacagcggccgggctcgcgggaatccctcccgaggttcgcgagtccgcggaggcgctgggcctgcccgcgctggcgcggctgtggcgcatcgaattgcccatggcggcgccgtccatcctcgcgggcatccagacggccgcggtcatcaacgtgggcactgccacgctgggcgcgctggtgggggcagggggctacggtcagccgattctcacgggcatccggttggatgacgtgcggctcatcttggagggagcgattcccgcagccgcgctggcactgctcgccagtggcctgttcgacgccgtggagcgtgtggtggtgcctcgagggcttcggttgggcactgcggtgcgttcgacgcgttag

SEQ ID NO: 8320 - DNA, 1683 bp, Myxococcus xanthus
atggacatcaagggtgagcagcgaccgattcaaaaggtgttctgcgacgactttgtcttgcgagtgccgcactaccagcggccgtacgcctggaagctcgagaatgctcaggaactcctctccgacctgttggcgttcatgggcggcggctcgaccaaagttgacgagctccccccgtactttctcgggagcattgttctcgtaaaggacgacgcgtggcccgaggcggaggtgatcgacggccagcagcgcctcaccacgctgacgatcctcctcgcggcactgcgtgcgtcgacgggggctgcgttcggcagcgacctgaccaagtatctgtaccaaccgggaagcctcgtggaaggtacgccggaccagtaccgtctccggctgcgcgaccgcgacgccgagttcttcagggagttcgtccaggccgtcgatgggccagcgaagctgaaggcgctgacgcgcgaaatccccgatgcgcagcaacgtattcgggagaacgcgctgttgttcttgcgcgaactggacgcgctgcccgttgagcgccgacagcgcttggcgagctatctcgtgcggcgctgctatctggtcgtggtgtcgacgcccgacgccgactcggcgtatcgcatcttctcggtgctgaacgatcgcggcctcgacctctcgcacgccgacatcctcaaggccgacatcgttgggaagattgacggcgaggccttgcagaaggcctacgccacgaagtgggaagaggtcgaagaagagattgggcgcgacgcgttcaaggatctcttcgggcacctccgaatgattcatcgtcgggcgaagctcgaggggaccgtcctcgccgagttccgaaagtacgtcgtagacaaggcgcccgagcccaggaagctcgtggacgacgtcatcgtcgctggcgcttgggcgtacgaccagatccgtcggtgcagttgggatggccaatccgatgacgcgacgcaggcgaagatcgaggagctgcttgagtggctcaatcgcctcgacaacgaggactgggttcctcctgcgatccgcgtcatgcagttgagcgctgacgccacgaaggtgctacgccacctcgaggcgcttgagcgtctcgccgcgttcctgctcatcaagcgctccaacgtgaacgagcgcatccacaggtacgcgaacgttcttgaggccatcgagaatgggacagccattgacgcggggggcccgctccttctctccaccgacgaagagaagcaactcgtggacgcgctcgatggcgaggtctacctcgagcagaaggtgcgcgtgtacgtccttctccggcttgaccgagccctgggcgacaagggcgcgaagtacgacgtcgacacgatcaccgtcgagcatgtgcttccgcagaacccgcgtgacaagagtgagtggttgacgaatttccctaggcccgaagatcgggcgtggacgcatcgcatcgtaaacttgctcctgctgcctcgccgtaagaactccgaggcgagcaactgggacttcggcgagaagaagatgcggttcttcacctctaagaagggggtgagcacgttcgcactcacctggcaggtgctgaaggagtacgcttggacgcctgacgtggaggcgcgccaccagaccgaggccatcgacaccctcaagaaggtgtggtcggtcatgtag

SEQ ID NO: 8321 - DNA, 216 bp, Myxococcus xanthus
atggcaggctcccaggtcgcggcggaggccgacgcgccggacgtcgatgacgcccacaacaccaacctgcccgagtggaagcgccgctgcatcgcgacctactgcgagtgcaaggacgacgactggcagggctcctgctacgcctgcttccgctactgcgagggccagcaggaatggcccatcaacaagtgccgcccccgccggggcaagaggtaa

SEQ ID NO: 8322 - DNA, 921 bp, Myxococcus xanthus
cttgccttcacgctggtcgtgattctgtggggcgccttcgtgcgcgccacgggctcgggtgccggctgtggagaccactggccggtgtgcaacggcgaggtcatcccccgggcccccagcgtccagacgctcatcgaatacacgcaccggctgacgagcggcctggcgatgattctggcggtggcgctctacgtctgggcccggaaggggcacgccaagggccacccggtgcggagcgcggcggcctgggccctgttcttcatgatgacggaggcgctcgtcggcgcgggcatcgtgctgctgaagtacgtggcggacaacgcctccgtgggccgggccctgtggatgggcgtgcacctggtgaacaccttcctgctggtgggtgcgcagacgctggtcatctggttctcccggggacgcgcccccctgagcctgcggggacaggggctgccgggcgcgctgatgggcctgagcatcctggggctgttggtgctgggcgtgagtggcgccatcgcggcgctgggggacaccctgttcccgtccaccacgctggcggagggcttgcgccaggatatttcggagacggcacacatcctcatcaagctgcgggtgctgcacccgctgctggcggtgagcgtgggcgcgttcctggtgctggcgtcgcggtgggtggcgcgggtgcggccatcggaggacgtgcgacgcgcggcgtccgccatcaccgtgctctacgcggtgcagttgggcgcgggcgtcaccaacctgctgctgctggcgccggtgtggatgcagttggtgcacctgctgctggcggacttcgtgtggatggcggtcgtggtgctgtgcgcggcgggcctggcggcggatgcgcccagggtggtggctgaagcctcgcccgcttcgagcgccgagcccgtctga

SEQ ID NO: 8323 - DNA, 1155 bp, Myxococcus xanthus
atgcccaccgggctggccgacctcgtcggcgtcgggctgaactgccgggtctccgtcgaggcgggcgtgatgtggcgctacgacgatgcgaccaacacccccaatccccagacgccgtactaccccatgcccctggtgacggccttctcgctgtcggatttctcggtggattgctcgggaacggcgatcaccctgaaggtgcagaccgtggtcccgctgtcgcccacgcagttgcgggtgaccttcgagcccggcatcgacccggtcaccctggtggacgtggagacccagttcaccttcggtgacagcgtgctgaccgtctccgactacacgcttgacgagaagaccctggtgctcaccacgaccgcgcaggagcccggcacgcagtacacgctgtcggtggacccgtcggtgaagagctacaccggcgtcagcgtgagtgggacggccaccttcaagggctaccgggtgccggcgctgctcgtcatcaacgaggtgaacccgaacatcaccacgggcgtctccgcgacgaacaaccgcgacctcatcgagctcaaggccgtgacggcaggggccatcgagggcatcacgctcaccgaggaggccaccagcgtgtcccggctggcgaccctgccggacgtgacggtggccgcgggggacctcatcgtcatccacttccgtccgaactcggccgagctcgctgcgggcaatgacaccctgtccaaggacgagaagacgtacgagacgttctacccgggggcgtgggacgtcgtgacggggaccagcagccatccgaccttcaatgaccgcctgctgcgcctcgcgaatccgcagggcgacacgcaggacgtggtggccttctcccacaagagcatgaccgccgcccgtccgcccaactaccccgtcgtcctccgggccgcccaggaggagggccactggagtccggtggactgccgcggtgagacggccaccccggtgccgtgcgcctacgacagcgctccgctgacggcgctcgacgtctcggtggactggggcgtggtggaggagaacacccagagcgtgtcccgctatcagggggccgacacccactcgatggtggactgggccttctcggagacgtccagcttcggcgaggagaacccggcccggccgtag

SEQ ID NO: 8324 - DNA, 5013 bp, Myxococcus xanthus
atgcagtgccccaactgcgcgctcggcacgatgcgcgacctgtccgtgacgccgccgcgctgcttggaatgcggcgcggtgctggtcccggcgcctcccatcactccccccttccacggctcgattgagaccgaggtcgagcggctggagagcggcgactacgacgacgtcctggacgacttcctggacgacgaggagccgtaccgactctccagcaacgagatgcgtgatgagacgctccgggcctcgctggtcaccgacgacatctcgcccccggagtcgccaccgtccaacacgatgggcgacgacgtcgccgaggagcgctgtgttccgctgggctcggagaccaccgtctccgacaagcccgtcgttccgccgagcttcccgttgcggacgctcctgtggaacatcgcggacctgggcggaggcccgagtggaacgctcccggtgcgcaagccgtggaccattgccgccctggcccatgtcatccgcacggcgaacgccgacatcgtcaccatcctggagctgaagaagaagggtggcatccgtctggtggagcccaagcctccggtccagatgaagcaacacacgggccgcggaggcagcgggacgaagcttccggtgttgatgcgaatggcgtcggcgttcgtcgagcccaatggctaccaggtcaagactgcccccgacacgctggtcggtcagattgcggagcaggaggcggggctcctcaacgacctggcgaagtacttcgcggagcacgtgcggcggaccatctggccacgagacgagcaggacacgggcgccgaggcgtgggacccctcccatatcgagtggagcgagacctcgcaggcgctgggagccgacaagctgggcatcatcgagggccggctcgatgcggcctgggcggcatgtgagccagacctcgtgaatcgcttcggcaggcctccggtgaagaaggcgaagggcgaggacggcgaagaagacgaggaaccacccgaggcgctcgtcgcgacgtcgatcgacgtgcacgggaagaagaaggcgaagctggatgcctactgcctgctctgcgtgcggctgctcgtggaggagggctactacgactggctccagccccacgagaaccgctactcgtctacggagaaggactcgaagaagggaggcgcggaggcgaaggagaaggcgaagcgggacgacctggcgaagcttggcgtcgcgctcctccgcgagcactgcggcatcctgttccaccgctacctggcggtcatcgcgggcctggacgccgaggatgtcccggccaggcaggagcaggtcctcgagaacatcctgcaccgctccaacgacgcgcatctgcagcgcgtctacaagaagaagctcgccgagtacctggagcgcaagagcgaggtggaggacgcgccggagtcgcacgcggggctgcgcgagttccttcgcatccgtgatgcgctgaacgaccagtgcaaggcgcgcggtgaggaggtctatgcgtcgtggcccgcggaggtgcccgacaagcccgtcaaggggctctacacccaggatgaggcgtacggcgtcctgtggcgcaagtccaagctggacgtggacgaatcggccatctcgtacctcagtgcttacgtggcgaagcgctcgccgggtggcgaatcctcatcgatggatatcgacaccacgatgggggacgaggcggaggaagagcaggcgcagaccgtcaagagtctctacagcaagcgtgagcccatccggattccggtgcggctggcgcaggtacggaacgcgcccgaggtgagcgtggtggcatggcatccccccgcgccgggagaccgcaacaagaacgcgcgcggcacggacttccgcgccttcctccagtactgcaaggacgagcgccgcgagaaggtgctcggtgtggtgctctcggacctgaacatcgacaccgcgcggcccaaggccgagctcgcgaaggatggcacgccgtacatcgacacctgtgtggagcgcctgtcgttccaccagttcttccagacgctgctggggccgggggcggatgcgagccatctgtacgccatggcgccccagctctcgaccatcgccaagagcaagttcggcagttgggccgtggacagcgagaaggcgttcggggacggctcgctcaagacgctccgaagcttcgtcaacagccgcgtgaagccggagatgttcgcccccttcaagatgtcgacgggccacgagttgcggccaatgttctcgtccgcggaggacgtgctggcccacatcgagtcgttcatcacgcctccgcagcagcgctacggggcgagcggctacgacaagattctcgtgtactcacggcggaccgatggctggatgctggagcagtcgtcggtctacgtcatcccgtttcccatggcgctcgcggacgagaaggagaaggggctctttttcatccacggcgacctgctgcccaggcacctccagccattctggcggctcatccaactggaggacgcgaagctgcccgaggacaagcggctcttcgaccacctgcgtgccccgggcgtgaagctcacgggctcggaggacgcgcgctgggaagaagtcatggccgccgcgaagaagctgagcgaccacatgccgctcgtctccgacctgcggctcatctacagcggcgaggaggcgctggtcgtagaggaggtggaggtcaccaccgagactgggtcctccgagctgggccacttggcagcgctgtgtgccgcctatcagaagtcccaggccacggatgacgaagccacggaggcgctcggcgcgattctggacgccgcggagaaggtccccgcttcggaccatgcccgttccaacgcgctcgtggcggaggccatgcagtggagggagacgttcgccgcgctgcggagcgcgggcttcgaccgggaggcgtactgggaccatcggcccgcgctggagtcggagatggggacggaccaggggggcggccagggcatctcgctggacagctacctgggctccatccaccaggggcgggtccacaacgcgggcgggggggactgtctgttccgctcgctgtcccagttgttcttcggcaccgaggcgcaccaccgcgaggtgcgccaggcggtggtcaatcacctggaggacctgctcgccgggcagtcgctggacgacgggggaatggtggggcccgcgacggcggcgacgttccggcaggacatggggctgctgctcgactggcaccgtgaggcctggcctcacgagcccgcctatcgccgcgtggcgggcatggacccctggcgccagtacctgcgggccatgagccgggacagggtttggggcgaccacgtggtgctggcggcggcgtcccacctgttccaggtgcgcttcgagatgttcgcccggacgggggcgacttcgtactggacggacctggtggacttcgtgccgcgcaccgagggacacgcggcgcggcccctgctccggctggcgaacctgggcaacgcacactacgaggcggtggggcccacggatgcgccgcttcccgcggccgcggcattccccgccgaactggcggcgctcagcgagcgccgccgccgcgatgaggggccgacacctccgcctggttcgaagaccgtcgagtctccgcgctcagcggcgacgtcgacgaagagcgccaccgccacgtcggctccgcccacggtgggcccggtctgcaagtggcctcacacgtgctacttccagttcgacacacccacccaccacccgcacgcactcttcctcttcggggagaacgccgtcgcgaagaaggccagatacccccagccggacacccaggccgtcatccggatgaactcgaacgcgctcgggattcgcacgtgctgggtgccgggcaaggggatggaggacgcggacctcgcgaagaaccagcaggccatcgatgaggactgtgccgaggccgtccagctcctgaagagcggcaagtacaccacactggtggtgccgtggaaccactcgcgcggccatgtggacatcgggacgggcgtcgccaggttgccgggcaatgcgcccaagacgtgggcgtacctgacgaagaagatcgacgaactcatcggctgggcaaaccagcacctgggtacggtgctggtcgtcccgcaggtgaacgtgctcgtgcctgccgtggtgcggcagcaggcgtcggacctccacgtgcaagaggtctcggacgtgatgagccagtctgcctccatgggcgatgactccagcacgagcgtcttgtggcagccgaacgtggtctcgttgagaacgctgctcttctccggcgcgacttcccctgagacggggctgctgtcggacaaggactacgagaagaacaaggcgatgttcgacgaggacctggacgtgctcacccagaaggtggagagcggccagtaccgcaggctcgtgctcgaacgagacgatgaggggcgcatcgttcttggcacggaattggggaagctcgacaaacacgcgcctcggacgctggattatctgcgcgagcgcctggaggcgttgtgcaggcgctgtacagaggtccacgtcaagagcgcgacgtggaaggggcaggtcgtcgaggagtcgcagtacctggacttcctgtccgccggcgatggccgtacttcctccgagggaatcaagcgcaagaagccaggcgtcgtcgtcgagggctgggatgacgacgacgtcacccaggcgatggacccagcggcctgggggacttcggcgttctcgaactcgggcttcagtggaggcgccccgtcgtcgcagtccttctcgggctcgggacaggttgcgccgtcgaaccataagaagcgcaagttcctggggccgcctgcgagcgccgaagagaacgaagaggtgcagctcatgaatggcgatgacgtgccgccaccgcctcccgtctgggaggagggggatgaggcggaccccaagaagcagaagaaggggccgactgggtag

SEQ ID NO: 8325 - DNA, 411 bp, Myxococcus xanthus
gtgctgcgttacggctcgcaccacccccgagcgcaccagccctacctgttgaaggtgtggctggacgacgaggaggaattgcccgcgcgcgagggcatgacggacgcggagggccgcatggcgcaggttctgcccgcacgcgcggcgcggggcgaggtgacggtgtcgcccggccgcgacgacgagcgcaaggtgacgctgcgcttcgcggcgctgcgcgcgacgagcgctccggagggcttgcaggagcggctggagaacctggggttctcctgtggcggcgagcgtggccagttcggcccgaagacgcgcctggccgtggagtggttccagtacgcgctcgggctgcctctgagcggagaggccgacgaggcgacctgcgccgcgctgggcctgttgcaccgctcgtag

SEQ ID NO: 8326 - DNA, 696 bp, Myxococcus xanthus
gctctaaggctggcgcgctcgtaccaggagggccaggcgcgcatcgacggcttcctggaggactacggtgacctggcctcgggcctcaccgctctctaccaggccaccttcgacgtgaagtacctggaggcggcggacgcgctggtgcgccgggccgtggacctcttctgggacgcggagaaggcggcgtatctcaccgcgccccggggacagagggacctggtggtggcgacgtatggcctcttcgacaacgccttcccgtccggggcctccacgctgacggaggcgcaggtggagctggcggcgctcacgggggacaagcagcacctggagttgccggagcgctacgtggcgcggatgcacgacgggctcgtgcgaaacaccatgggctacggctacctggggctggcggcggatgcgctgctggagggcgcggcgtccgtcaccgtcgcgggcgcgtccgacgacgtggcgccgctgcgggccgccatggaccgtgccttcgcgcccacggtggcgctggcctggaaggcgccagggcagcccgtgcctgcgttgctacaagggactttcgaaggacgtgagcccgtgaagggacgggccgccgcctacctgtgccggggcttcgtctgcgagctgcccgtcaccgagccggacgtgctgacccagcggttggcggcgctcaccggcccctga

SEQ ID NO: 8327 - DNA, 174 bp, Myxococcus xanthus
atgcaccgcgccttcgattggcagcctttcgtgaagcaacactgggagaaggcacccgcgcgcctggcactgcccggccccatcctccccgtcgaccaggtcttccaggccgcgatctccgcctgtgcccccttccgccacgggacgcggtttcgcgcccttcccgacgcgcgc

SEQ ID NO: 8328 - DNA, 1299 bp, Myxococcus xanthus
atcatgcgcatccgtgaccccatccacggcaccatcgcggtcagcgaccccgagaaggccgtcatcgacagtcggcactaccagcggctgcggtatgtccgacagcttggcttcggggacctggcctttcccggggccacgcacacgcgccacatccattccctgggcgccatgcatgtcgcctcgcgcgtgttcggcgcggtggctgcccgctcgtcgctgccggaggatgtgcgggagcgcttctgtgcagcggtgcgtctggcggtcctctgccatgacctggggcacatgccgctgtcgcatgcctcggagcgcatcgccccgaagcgctcgctcctgcgcctgccatcctggctggacggcaccgcggagggcgagctggccacgcacgaggactacacggcgaaaatcctcctcgacagctcgctgacgcccatcatcgagaagcacttcggcggcatggggattacgcccatggcggcggtggcgctggtgtcgggagcgaagccgccgaaggacccgggcttcacgcaccagggcgtggactggacgccgctgctacgcgccatcgtctctggtgagctggacgcggaccgcatggactacctgctgcgcgactccttctacacaggcgtcaactatggccggtacgacatggattggattgtcagcaacctcaatcccgcgatgaaggacgggcgggcctacctcgccctcagccgggcggcggccttcgccttcgaggacttcctcctcagccgctaccacatgttcgtgtcggtgtacctgcaccacacctccgtgaacttcgactacatgctgcggcgctactacgaggagtcgcccggtgagttcgagattccttcggatccggaagagttcctgctctgtgacgattcggcgctctggtacacgctgcgccgctccaagaatccgtgggcccagcgcatcagccagcggcagggctacaagctgctggcgcagttcacggagcgggacacgggctacgacctggacgtgctgcgcagcgcgctggtgtcccacaagttcgaccactacgtcgtcgagtcccagaacgtgctcagcaagtacacctccgggccgtctggccgagggccgagcctgtacatcatcgacgcctccaccggccggctgaccgaggtggcgcgctacacgccgctgtatcaacgctacagtggagcggtgcggctcgtccggctgtacgtccggccagaccaggcggacaaggcacatgcgttgatgggccgggtactcggccaggcggtggagtcatga

SEQ ID NO: 8329 - DNA, 1530 bp, Myxococcus xanthus
atgagcgagcgtcttcccagtctgggcctgggcctggacctgctggcccacagtccggtggaggcccgcccttcttccgtggcgctgttgtaccggcgcgcgggggagggcgtggaggtcttctgggtgaagcgcggcaaggcgcttcgcttcgcgggcggcttctatgcctttcccggcggcaagctggacgcggccgacgcggacgtgccggtagcgggcgccagcggagaggaggcggcgctgcgttcggccgcggcgcgcgagctcttcgaggagacgggcgttctggtggcccacggcgccgaggcgctgtccgccgcgaaggtggcgtcgctgcgcaaggcgctcctggacgggacgctggggtggggcgctctgttgaaggcggaggggttgtcgctgagcgcggatgacttccgggccgcgggccggtgggtgacgccgccgtcgctgcccgtgcgcttcgatacgcgcttctacctggtggagatgcccgcccacgcgcgcgcggagtggtggcccggcgagctcgcggagggcgcctgggtgaagcccgctgatgccctggcgcggtggggagatggcacggcgctgctgcacccgcccgcggtgcatgccttccaggtgctgggcaccttcacggatgcgtccgacgtcctggcgcgcctggcgtcgcctccgttctgcccgggttacgtctcgcagcgcatcgaattccagcagggcgtgcgcgtggtggcgctggagacgcccacgctgccgccggccgcgcataccaacgcgtatgtgctgggcaacggcgagctgctcatcgtggacccgggcgccgcggacgtgaagcagtacgcgaagctgctgtcgctggtgtcgggcctgaaggcggagggactgcggcccgtggcggtggtgcttacccaccatcacggggaccacgtgggcggcgcgcgcgcggtgaaggaacgcttgggcatcccgctgtggtgccacgcgcgtacggcggaccgcctggacttccccgcggagaggctgctggaggacggtgacgtgctggagctggcgggcgaggtgccgcagcgctggcgcgtgctgcacactccggggcatgcacaggggcacgtgtgtctcgtggacgagcgcagccgctcggcggtggtgggggacatggtggccggtgtggggaccattgtcatcgacccgccggaggggcacatgcgggactacctgacgcagctcgcgcggctgcgggactggcccgtgagcacgctgtatccggcgcacggctcaccgattccggacgggcccgcgaagctccaggagtacctggaccaccgggcggcgcgggaggcactcatccttcagtccgtgccacccaacggcgccacgctggcgcaggtggtatccctggcctacgcggacacgccgccgctgctgcaccccctcgcggagcgcagcgcgctggccaccctggagaagctggtggaggaaggcctcgtacgtgaggagtcgctccagtacttccgcgcctag

SEQ ID NO: 8330 - DNA, 1500 bp, Myxococcus xanthus
atgactcgcacgcaccgaccgaccttgctggccctcgtgcccctgtgtgccctgctggtgggcgcaccgtccgcgctcgcgagggcgcccgccccggcggccaaggccactgccacacaggcccccgtctccgacgtggtgaaggccgcccggcccaagggcggcgaattcttcggcctgtacctcatggacaagaaggtcggctggctcttcaccgacctggaagtcctgccgggccagcccgcgcgggtgaagacgaccaaccagctcgtcttcaaggccatggtgggctcgcgcgtgtcggagcgcatgcacgacgaggagcgcatctacgaggcgaagcccggtgggcgcctgctgtccttcgtcgtgaagcagacgggtgacggcggcacgcagacgctggtgggcacggccaccgcggacggcttccaggtggtgcgcaagcgcccgggccgccccgacgagacgctgcccaagcggcctccgacgaaggagcgggtggaggacgccgacccgccgcgcgtggcgctgctgcgcaaagcgaaggtgacgggcttctcgctggatggaatggacctggagtcctacggcctctccaccaccgtggagcccgaggagcagcggaccatcaacggcgtacaggtgaagctgggcaaggccgtcaccgtgtcggagaaggagaaggtccccgtcgtttcgtacatcacccagcgcggggagatggtgctggtggactacggcacgacgatgcaggcccggaaggagacggaggccgtcgcgaagcggctggacctggtggaagtcttcggcctcacccgagtggtgctgcccaagccgctgcccgagtccgcgcgcaccgtgcccggccacgtcacgctggtggtgcagggcctgcccgcgaagttccagcagcagacgtaccggcagcagttcaagccgcaggcggacggcagcgtggaagtgacgctgtccgccgccgcccccaaggcgcgcaagcccctaccgctgaaggacccggagggtggagagaatctcaagtccaccctcgtcgtggagagcgacgcgccggccatccgcgagctggcgaagcagattgtggggacagacaaggatgcgtaccgcatcgcccagaaggtgaacacctgggtgtactccaacctggagaaggactacggcgccagcgcggaccgggccacggacgtactgagccagaagaagggcgactgcacggagcactcgctcctgtccgtggcgctgctgcgcgcggcgggcgtgcccgcccggcgcgtggacggcgtcatctacatgatgaaccaggacggcgtgcccgccctctactggcacgaatgggtggaggccttcgtgggcgagtggacccagttggaccccaccttcaaccaggtggtggcggacgccacgcacttcgccttcggcaaggaaggcaacgccgaaatcacgccgctcatcggcgcgctgaaggtgacggccgtcaagtga

SEQ ID NO: 8331 - DNA, 177 bp, Myxococcus xanthus
atggagggcgacctgcgccgccgcaacgggcgcctcatccgcgtggagacgagcgccaccgaggcctacggccccacgcgcggcttctacgcctccatgaagtacggcgaggaggcccgcatccgggacttctacaaggtgggggacgacctcatcatcctcaccaagcggctgtaa

SEQ ID NO: 8332 - DNA, 999 bp, Myxococcus xanthus
cgtgtcgtctcctccatggcggacgccctcaaccggggcgacaccctggccgaaccgctcgccatcgaaggtgaccggctcgacttcatggacaccctgcgccggtgccagccggacctggtcgtcaacctctgcgagtcgttggcggccgacagccggggcgagatggccatcccctgcctgctggatgtgctggggctggcctacacgggctcgagcgcgctgtccctggggctggcgctgcacaagcccaaggcgaaggaagtcctcaccgcgcgcggcgtgtccacgccgcccttccacgtggtggagcgcctggaggatgcattggcggtggacctgccctggccgctcatcgtcaagcccgcgcgggaagacgccagcatgggcgtgacgtcggagtccgtggtgcacgagcgcgccgcgctggtccgcgcctgtgacgcggtgctccgtgagtttcatcagccggccctggtggagcagttcatccccgggcgggaaatctatgtgccgctgctcggcaaccggccgcgccaggcgctgcccctgacggaaatcgtcttcggtcgtacgttcgaggacagacccaacatcgtgtgctacaacgccaagtgggaggcggcgtcggcggagtaccgggacaccaccagcggattgtgccgactggacgcgaacctggagtcccgttgcgtgcaggtcgcgctggaagcctttgcagcactggactgtcaggactatggacgggtcgacctccgggtatccccggagggcgtgccctacgtcatcgacatcaaccccaactgcgaccttcatccgagcgcggggttcgccaaggccgccctggccgccggaatggactatccggccctggcgtcccggctcgtggaggtcgcgctcgagagagcacatggacatccgtcccatcgaagaaaaggatcgggcgccaatcgccgccctgattcgaaagatcgaaaccttctcgccgcaggaggttga

SEQ ID NO: 8333 - DNA, 666 bp, Myxococcus xanthus
atgctctcccatccgaaccgccccatcctgctgacgctcctgctgcccgccctcgcactcgcccagccaacggatgacgcgccgcggatgccagggcccgtgacggccacgcagcagcggcccgcggtgggccgtccatcaccggccgctccccggatacatccgtcccaggatgcgccgttcccgctgggcgcgcgcctggtgggcgaaacggtgggtggcgcgctgattggcgcctctggcctcgcggtgaccttcctcggaggcgtcctcgtgtcggaccaggtgtcctgcggctacagcgagtgccggtccgggaggaacctcagcctcatcagcgcttcgattgggatggggctcggcgcggcgtcaggtgtgtacctgggaggctcgctgatggatgcacgcggcggattcctgcccacgctgctgggcggactggtgggaacggccgcgccattggccgtcgtggcgctgtcggacgaagcatcctgggcggtcctcaccgccaccttcgccgtgcccgtggcgacgtccatcctcgcgttcgagctgtcccatggcgcctacgagcggcgacgccagcaggagcgccccgtggtgatggtgcccacggtgagcctggccccgggaggcggggcgctggggctcgccggccgcttctag

SEQ ID NO: 8334 - DNA, 1131 bp, Myxococcus xanthus
atggcaccgttccccatccccatgtccctgcattccgctcccacgttgcaggcgagcctcgactcgcgtcgcaacaacctggacttcctgcgcttcgccgcggcgacgtgcgtattgctcagccatgccttccccctgggcgagggcaaggggacggtggagccgctggagtccttcacccggggacagttctccctgggacggctgggcgtcgcggtgttcctcatcatcagcggcgtgctcatcacccggagctgggagcggacgcccgacgcggcgcgcttcatctgggcccgggtgctgcgcatcttccccgggctgggggccatgctgctgctgacggtgggggtgctggggccggccttcacccggctgtccctgggcgactacttcacggccccggacacggccctgtacctgctgggcaacttcgccctgaactggccccagtggcacctgccgggcgtcttcgaggcgaacgcctacccccacgccgtcaacggctcgctgtggacgctgaagtacgaggtcggcttctacctgctgacgctgggcctgggcctgacgggcctcttgcgcaagggcatggtcatcttcggcctcgtcggcgcggcggtggccaccttcgtcaccggacggctgggcttctggccggagctgtacctgtacttcggcggcggcgtggcgctgtaccagtggcgcgaacacgtgcgcatgagcccctgggtggcggcggcgtgcgtggtggggtggctcatcacggcccggctcggatacggctgccgcatcgccaccggcctgctgggcggatacgtcgtgctgtacctcgccttccggcccatgggggcgctggcggacttcgggcgccggggcgacctgtcctacggcgtctacctctacgccttccccgtgcagcaggccgtcaccaccctgctgggcgggcccacggcgtggtgggtgaacgcagcggtggccttcccctgtgtgctgctgctggcggcgctgtcgtggcggtgggtggagcagcccgccttgcggcgcaaggacaggctccccgcgtgggtgaggcgtccggcggtctccgtcacagcggttccgaagacgccgtcccggccggctgggccgcactga

SEQ ID NO: 8335 - DNA, 321 bp, Myxococcus xanthus
atgggcgcgctgggcggcctcatgtccggtcaggagggcagcacgggcggcatgctgagcgcgctggggggcgtcgcggggcaggccggtgatgtggccgccgtggtgtccctgctgggccgcttcaacatcgacgcgagcaaggcgtccttggtggcgcccctgctgctgaacttcctcaagtcgcgcctggaccccgcgctcgtgggccgcatcctctccgtggtgccgctgctggccggcgcgggcggtggtggcaacacgcccggcggtggcggccttggggggatgctgggcgggttgttgggcggcggacgctga

SEQ ID NO: 8336 - DNA, 1488 bp, Myxococcus xanthus
atgattacgcttctggtcgccttcttcgtctcgctgctggtggcactggcactgacgcgactggtgcgcgaccgggccctggcgtggggatggctggaccaggcgaattccagccggaaggtccatgtccggccgattccccggctgggcggggtgggcatcgtcggtggatttttcgcgccgctgtgcgcgttgttcctggtggactctggcgtggggtaccacttccgctcccacacggagctggtggtgggcctgttcctgggcggcgcggcgattgtggcgctgggcctctacgacgacctgcggggcgcgggcgcccgtctgaagttcgctgtccagttcgcggtggcgttcggcttgtatgccatggggttccgcatcgacgtcatcgccaacccattcggcccggagttggtgttgggcgcgttgagtctgcctttcaccgtgttgtgggtggtgggcgtggtcaacgcgctcaacctcatcgacggcctggatgggctcgcgggcggcgtggccttcttcggcgtcggcaccaacttcatcctcgcgctgtcgcgaggcgacgtgctgctgtcattgctgttggcggcgctggcgggcgccatcctcgggttcctggtgttcaacttcaacccggcctccatcttcatgggggacaccgggagcatgttcctgggcttcgtgctggccgcggtgtccatcaagacgagcaccaagagcggcacggcggtggccatgctggtgccggtgatggcgctggggctgcccatcatggacacgctgctggccatggtgcggcgctcgttgctggggcggccgatgttcagcgccgaccgggagcacatccatcaccggctgatgagccacctggtgctcagccaccgcgctaccgtgctggtgctgtatggcctgtgtggcctcttcatgctggtggcgctggcgctgaacttcgccaacagcgcacagagcgccatgctgctgtgtggcatgggcgtgctcatcgtgctgctgatgcggcggctgggttacctggacctgggccgcgccaggggcatgcaccaggtacgtcagcgcaacctctggctgcggaccatggtgaaggacgtcacccgcgccgtgcgcgcgtcgccttcgctggaggtggtgtggaacgcggtgcgcccgctggcggatgccctgggcttgtcgcgccaggagttgcacttccagcgcgtccgtcccacggggctcgcggacaacgtcgtcttcgaagcccagcggcccgcgggctcgggggtgccattcgaggtccgcatcacgctcgaggccgacggcgaggtgctgggtgcgatgctgctggtgtggcgagatggccgggccgccatcaaccgcgatgaggaactggcactggagcaggtggcggacgcggtggcggaggtcgccgggcggctccggccccgggccgacgccgagcccggacgcctggtcgcgatgaggaagtga

SEQ ID NO: 8337 - DNA, 1146 bp, Myxococcus xanthus
atgcgcatcctgcttggcatccaccatcccctgaacccggacatgggggcgccgggggtgacgctcgcgctggggcaggcgctggcggcgcggggctgccaggtggactacttcagctacgacgacgcctatcccggcctgcggcaccacacgacggtgcacgagctgcggttcccctggatgctcaccgcacacctgctgcgggccgcgagtcggtacgacgtgctggacatcaccactggggatgcgtggccctggatgcgcttgggccgtccgggggcgcgggcccgccatgccctggtgacgcgcagccacggcctggagcacaccttctccgaacggctgcgcgccgacgcgcgtgcggggcacctggcgctgagctggaagtacccgctgtaccatggcggctatcgcctctgggaggtgcgccagaccctgctgcgcgcggaccatgcggtgctgctcaacacgcaggatgccgcctacgcgacggaacggctgggcgtgcccgcgcgtcagttgagtgtcatcccccatgggctggatgtggccttccaggggctgccttcgcccacgccttccgcgcctggtgcgccgctgcggatagcgtgtgtggggagctggctggcgctcaaggggcgcgcggagatggtggccgtcgccacccacctgcatgccgaaggcgtgtccttcacgctgacgttgtacggcacgggcaacccggaggcggaggtgctggcggcgtttcccgctggggcgcgcgagcacgtgcgcgtggtgcctcgttatccacgcgccgagctgccgcgcctgctgcgggacgaagaggtgctgttcttccccagccattcggagggcttcgggatggcgctggtggagtcgatggccagcgggctcacgccggtgtctacgccggtgggcgtggcgccccaggtcgtgcgtgacggtgagacggggtggttggtaccgatgggagacgtcgccgcgcaggtggtggcgctgcgctcgctggcggaggaccgcgctcgcctgctccggttgcgtgaagccgcgcaggccgcggtgcgggacatgacgtggcgggacattgccgagcgcacgtcaatcctttacgagtcgcttctccgctcgccgcggaccgtctag

SEQ ID NO: 8338 - DNA, 621 bp, Myxococcus xanthus
atgagcctcattgaacgactgcgggactcacgacgccatgaagaacggccgtcccaaaaggcttcgcgagcggcccggacatcgagcgccgcacctcgccccaccgtcaatcgagacctccgcacgcaactgctacggctggaccgcatcgacagcaccttgcgttctgcgtgggtggcgacggagttcaaggaccgtgctcttgaacgcaagctcaatgcgctcaccgaggcgggcatcgactggctgcgtgagacgatcaaggtccacggctggcccgggcatcgcctcgtgggccgaagcggggccgcggccgcctggcggctgattcaacacgccgactgctcgctggccttccagaaacgctgcctgaagttgctgcgggacgcggcggcgcgcgccgacgttcccatccagcaggtggcctacctcacggacgtggtgcgcatgcgagaggggaagaagcagctttatggaacgaagttccgcaaggtgaagggagagctcgtcccctaccccatcgagaaggaggccggcgtcgacttgcgcaggaaggagatgaacctgccgtcgctcgccgcctatgcgcggaagattcgccgcacattccaaccttcgtga

SEQ ID NO: 8339 - DNA, 1677 bp, Myxococcus xanthus
gcggtgacgaaccgggtgggaatctcgggggccctggtggcggcggcgatgctcttcaccgtcaccctgcacatccggaaggtgcagctcatcgaccggccgctgatgccctgggacttcctggagtggcggcaggtgacatcgctggcgcccacgctgctgcccggcggcggcgcggtggcggccattggctcgtgtctgctgctggtggccatgctcgccgtcatgtggcgcgcggtggcgcgcggcacgccccggtacccgttgcccaaggccggacgccgcaacctggcgctggcggcggtggcgtacctgctggtcatcatcttccaacagcacctgcccgtgcggcgcgtcttcaaccgcttcggcatctacgaccaggtgtgggaccagcgctccaacttccagatgaacgggctcacgctgatgatgctctggaactgggaggggctgcggctggagccgggcagtgagtactcccaggcgcaggtgcacgcggccctggggggccctccgggcgtggtgcccgccgcgccccaggagcccgtcgacgtcgtcgtcttcatggccgaatcgctctgggacccgacgcggctgggcatccccttcagcgaggatccgctgcccttcgtgcggtcgctcatggagcgccacagctcgggcaacctcatcagcccggccttcggtggtggcacggccaacgcggagttcgaactcctgacgggcatgtcctcgtcgttcgccccggacggcgcgtttccctaccagcactatgtgatgcgtcccgtggacgcgctgccgtcgctgttccgccgcgcgggctaccagacgctggccatccacccgttccacgcgttctactggagccgcgacgtggtgtacccgttgctgggcttcgacacgttccagtcgctcacggacttcacttccccccggctcgaagggccctgggtgtcggacgaggaggtcgtcgaccacatcctccacgagctctccgacgagcgtcagccgcggttcatcatggccgtgacgatgtccacccacgggccctacaacctgccgctcaccggcgaggagcggatcgaggtgcagggcgagaagctctcgccggacaaccggctgctcttgaagaactacgtgcacaagctgcggcagatggactcggccgtggagcggctggtgcgcaagctggaggctcgcaaacgcaagacgctgctggtgctcttcggggaccacctgccgatgctgggctcggactacgcgacctatcgcgaggccggctacttccaggagccatggacggacgcgcagcgcgagcgcatggcggaggtccccgtcgtcctctggacgaacttccccgtgccccggcaggacatccacctgagcatcagcatgctcaccccgcgcatcctcgagacggcggggctgcggcctccgggcttcttcgccttcgtctccgaattgtccaaggtgctgcccgtggtccggggagacctgctgcgcaacgcctccggcgaatacctgcccgcgggcgacaaggtccccaaggcccaggagccgggctcatgggaggactggatgcggcgctaccgcctgctcacgtatgaccggctggcgggcgacaacttcagtgcggcccagccggccgggacggcgtcttcggaaccgctgtga

SEQ ID NO: 8340 - DNA, 1023 bp, Myxococcus xanthus
atgcgggaggcgaacgcggtgggctcgcgagggaaggcggcggagcgcgacaccctggagtgctggggcggcgtcgacctgggcgggacgaaaatcgaggccgtggtggtggaccgcgccggcaccgtcctggggaagatgcgccagcccacgcccgccgacggcgagcccggcgacgtggtgcgcgccatccacgacgccttggagggcgcggcgcacgcggcgggcctgacgtcccgtcagctcctgggggtgggcgtgggcgcgcccggcgcggtgaacgccaacgagggcacgctgggacatgtcagcaacgtgggccggggctggagcacgccctacccagtggcgggggacctgggcgcgcgggtgggccggcccgtggtgctgggcaacgacgtccaggtggcggtggcggcggagtaccggctgggcgcgggccgcgcatttcgctccctgctgggcgtctggtggggaacgggcgtgggcggtgggctggtgctggacggcgtgccctggcgaggccggggcgcggcgggcgaggtgggccacatggtggtgaagccgggcggtgcccggtgtggttgtggccggcgcggctgcctggaggcctacgcgggccgcgcgtccatggagcgccgtgcgcacaaggccgtgcgccagggcgagacgacgattctcttcgacttgatgcggaagaagggccgcacccggttgaccagcagcatctgggcccgggcgctggcgcaggaggacgcactggccacgtggctcttcggccgcgcggtgcggatgctgggcgcggggctcgcctccgccatcaacctgctggacgtggaggcagtcgtcctgggcggaggcctgggcacgcggctggggcctgaattcgccggccgcatccacgaggccatgcgcccgcacatcttcgtccccgagcgccagccgcccgtgcgcgtcgcggaactgggagaactttccggtgccattggcgccgcgctgctggcccagccacccatgaagtga

SEQ ID NO: 8341 - DNA, 684 bp, Myxococcus xanthus
cggggcacatacgtggccttcctggacagtgacgacgtgtggttcccctggacgctggccacgtaccggcgggtgctcgaggcggaagggacgtcgctggtgctgggcacggcggcgctgttctcccgggccgaaaccctggcgaccgtgagccgcgagccgctccaggtgctgcgcttcgcggactatctggccagcgcggaggaccggacgccgcgcaccgcgtgcgtgctggcggtgcgcacggaggcgctgcggcgcgtggggggcttcaccccgctgcgcatcagtggcgaggactacgacctgctgtaccggctgggcacggacccgggcttcgcctgggtgcgcgcgcccgtggtggtgggctaccggcagcacgtgggctccacgtccacgtcactggagtccggctaccggggtacgcggtatctcctggagcaggagcgcctggggcgctacccgggaggcacggcccgcaggcgtgagcggctggagatgctgctctacagcctgcgccacgtgacgcactggttgttgtcccagcgccgcgtggacctggcgctggacttgtaccggcgcggcctgccgctccacctggcggtgccgcgctggcgctacatgctgggcttcccgccgtgggcgctggccaccaccgtgcgccagcgcgtgtcgggccgctga

SEQ ID NO: 8342 - DNA, 732 bp, Myxococcus xanthus
ctgatgtcgaagctgccagaaggcgcccgccagcagatggtccgcgccctgatgaacggcgtctgggacaccctggcgaacgagaaggtcctggggcgggagaacatcccggaccaaccctgtctctttctctgcaaccacctgtccaacgcggacggcttcacgctggaccgggccttccggccgcgcaaggtcgtcttcctggccggggtgaagctgaagagcacggtgatgacgcgcctggcttcggagacgatggagaccatcgccatcaagcccaactcgcccgacatcgaggcgatgcggcgggcgctggacaccctcaaggccggcaagtcggtgctcatcttcccggaaggcgcgcgcagccgcacgggcaccctcacccaggcgaagaagggcctgtcgctgattgccaagcgcgcgggcgtgcccgtggtgccggtggcgttgcagggcacggagaagctgatgcccatcaacgactcggacatgggcggcgagcggctcttcaaagccgacgtcttcgtgcgcttcggcccgcccttccgtgtggaggcgctggaggccgaggtggcgggcgccgaggacccgcggcaggccctggtggatgcgatgatgcgccgggtggcggagctgctgccgcccgagtaccgcggcttctacgcggatacctccgctccggcggctccagccccggacctggagcggccttccgcgcccgcgtcctga

SEQ ID NO: 8343 - DNA, 1152 bp, Myxococcus xanthus
atggacgctcccgtgacacgcgcccgcaccgacgaacagctctttgtctccaccctccccggcctggagcccgccctggaggcagaagcctccgcgctgggctggaagccccgccgcgtggacggtggcgtggagctggagggcccggccggcctgcaccaggacgccaacctgcgccttcgctgcgccagccgggtgctgctgcgcctgggccacttccgcgcgggagactccgacaccctctccgaccggctggctgaactggacctgtctcacgtctgggatgggcgctcgccaccgaagctgtcggtgagcctgaaccgctcccccgtgccagggcccgacgtggtgttctccgcggcggcgtatgcgtggaacgtgccctcggtggagcgcgcggggccgctcgatgaagagggcggaggcccaggcctgacgttgctggtgcgggtggatggcgacgcgttcaccgtgagcgccgacaccagcggggatgcgctgcaccgccggggctaccgccaggaagtgagccgcgcgcccctgcgtgagacgctggcggcgggcatcctccggctggccggctacgacggcacgcagcccctggtggacccgatgtgcggctcgggcaccttcctggtggaggccgcgtggatggccatgcgccgggcgccaggactgctgcgcgccttcgccttcgagtccttcccctccttcgatgcccaggcctgggccgggcgcaaggcgcgcgcggaggcggacgcgctgcccgcgccaggagcggcgattcacggctacgacatcaacgcgggctcgctgggaacggcgcggcgcaatgcccggcgcgcgggggtgacactcgcgttggagcggcaggacgcgcggacgctgaaggcgcccgtgaaaggcccggggttggtggttgtgaatccgccctatggcaagcgcgtgggcgaagccgaagacctgcccgcgctgtaccgggccctggggaacacgctgcgccagggcttcgcggggtggcgcgcggcagtcatccttccggatgaggcggcgctggtgaaggcgctgggactgacgggtgcgcgaagccttccggtgaagaacggcgggctcaagtgccgactgctgctgtcggggctggatgtgacgtga

SEQ ID NO: 8344 - DNA, 1155 bp, Myxococcus xanthus
atggcctcggactcgctgagtgaggaggcgaaacgagcggcgctgcatgcgctcgaccaggaaagccggggggacaaggcggaactgcggagactggaggcggaacacgacgaggcgcagcgggcgctcgcgccccagcgggaccgcatggagcggcggcttcgcgccatggagcgactgcggcgcatcgtctgccgtgcgctgatgaagcgcctgcacgacacctacgtggtgcccaatgctcgcggagaacaccggcacctgcgcggcctctacgccagaggcgagcccccatcgggcgcggcggactgcgccgggcccaagctcctggcgcatgccctcacccagggcttccgtccgctcgcgctcgccgagttctggtggggggctccgcctcccgcgggaggccgggccgccggcgcgtactaccccgcttgcaaggacaagtgcgggccgctgctgccgtacatgctggacggtctccctgtctccgcgccccggcccttcacggtgcccgtgctgccatcacgagggctggacattgtcttcgaggacgaatggctcgtggtggtggagaagccggagggcctgctctccgtgcccgcgaaggacgtctcggtggaggactccgtgctggcccggctgcgcgcgagagctccggaagcagcggggacgatgctcgcgcaccggctcgacctggacacgtcggggctgctcgtcgcggcgaaggacgcgcgcacctacgcggccttgcaacgccagttcgccgggcgcgaggtgcacaagcgctacgccgcatgggtcgaaggcaacgtccagggcgaacgcggcactatcgactttcccatgcgcgtggacttggacgaccggccccggcagattcacgaccccgtgcacggcaagcccgcggtgacggagtggcacgtgcttgaacgcagccacggccgcacgaaggtggccctcttcccgctcaccgggaggacgcaccagttgcgcgtccacgcggcccatccgcttggccttggcgcgcccatcgtcggagaccgcctctatggccacccggggccccgattgcatctgcatgcggaggccctgtcgttccagcaccctgtcacggggcagcgcctcacgctggagcggccggctcccttctga

SEQ ID NO: 8345 - DNA, 183 bp, Myxococcus xanthus
atgctcatcctcctgggcaagaaggaagaggcggcccaggtgctgtcgaagctgaccacgacgcagccgaacacggcggcggcgcgtcaggccggtgagcgcctggcggtgctggcgtccgaaggtgtgaaggttcctgccccggaggctccggcggctgcacccgttccggacgcggggtag

SEQ ID NO: 8346 - DNA, 2326 bp, Myxococcus xanthus
atggccccccccaagacacaccgcagcggcttcgccgctctcatcgggcgccccaacgtgggcaagagcacgctgctcaatgcactgacgggcgaaaaaatcgccatcgtctcccccaagccccagacgacgcgcaaccgcatcctcggcgtcgtcacccgtccggaaggacaggtggcgttcatcgacacgccgggcatccaccaggccaagggcgagctgaaccgctacatggtcgaggtggcgctccaggcggcggaggaggtggacctggtcctcttcctcatcgagccgccagcgagcgagaagcccgaggtgagcccgggcaaccgcgccatcctcgaccggctgcagaagatcggcaaaccgaccttcctggtcatcaacaagatcgatagcgtccccaagtcgcagctcctgccgctcatcgacctgtaccgccaggagttccccttcgcggaggtggtccccatctccgcccgggagaaggacggcgtggagcggctgttccacaccgtcctgggacacctgccggaaggcgagaacgtcttcgacgaggatatgctcaccgaccagcaggagcgcgcgctggtggccgagtacatccgcgagcaggtgctgcggcactgccgccaggagattccgtactccacggccgtggtggtggacatcttcgacgaatccgagcgcgagccccggccgggcacgccgccgaaccaactgggcgggctcattcgcatcgccgcgtccatcttcgtggagcgcgacagccagaaggccatcatcatcggcaagcaggggcagatgctgaagaccattggcactgacgcgcgcaagtccgtgcagcggttgctgggcgcgcatgtgtacctggaccttcgcgtccgcgtggagccgcgctggagcgagcgccccgaaggcctcaagaagctgggatacgactgaaatgaagcccctggtcgcaattgtcggacgccccaacgtgggcaagagcacgctgttcaatcggctggtgggccggcgcatcgcgctggtgcaggacgagcccggcgtgacgcgggatcgccactacgcggacgcggagtgggaaggccgccagttcaccttcatcgacaccggcggcttcgtgcccggtgacgaggaccaactcctccagcaggtgcgggagcaggcgcaactggccgtggacgagtgtgacgtcatcgtcttcgtcaccgacgcccgggcgggactcaccgccgcggacgaggccgtggccaactacctgcgcaagagcggcaagccggtggtgctggccgccaacaagctggacaacacgtccgggcagatgcaggcgctggccggtgagttctaccgcctgggcctgggcgacgtgcaggccctgtccgccgagcatggcctgggcatgcaggagctgttcgactcggtcgtcgccaggctgccgcccaaggaagagggcgaggacgcggaggcgccgcccgacgacggcatcatccgcctggccatcatcggccggcccaacgtgggcaagagcaccctggtcaacgccatcctgaaggagaagcgggtggtggccagtgacgtggcggggaccacgcgggacccggtggactccgagctcacgtacaaggaccgcaagctgctgctcaccgacacggcgggcatccggcgcaagaagtccattgcccagcgcgtggagcagttctccgtcgtggccgcgctcaaggtgatggagcgcagcgacgtggcggtgctgctgatggacgccacggagccggcggtggaccaggacgccaagcttgcgggcctggccgaggagcggggccgcgccctggtcatcgtggtgaacaagtgggacctggtgggcgcggaccagcgccggcaggagacctaccgcgagtccctcaagcactcactcaagttcgtgggctacgcgcccatcctcttcacctccgcgctgacgggctccaaggtggagaaggtcgtggatgtggcgacggagctcgccgaccagttccgcttccgggcgcccaccccacagctcaaccggctgctggaccacatggtggacaaccacccggcgcccatcgtccggggcaagccgctgcgcatgtactacatcgcccaggtggccgcggcgccgccgaccttcaccatcaccgtgaatcatccggacggcgttccggacatgtacaagcggtacatcaccaaccagctgcgcaagacgttcgacctgcgcgtgcccatccggctcatcttcaagggccggcccgggcaggccaagcgcgaggcccgcaagcggcctcaacgccaggggaagcgctga

SEQ ID NO: 8347 - DNA, 1308 bp, Myxococcus xanthus
atgccccccgcctccctccgaaagacgctcgcgctggtgacctgcctgctggcgggctccgtcctcgccgctgattccggcaaatggacccggaaggccgcggccggcaaggacctctacgccacgctccagacgagcgagggcaccatcgtcgtccggctcttcgccaaggacgcgcccaagacggtggccaacttcgtgggcctggccgccggtgagaaggcatggcgggacccgaagacggggaagatgtcgaaggagccgctgtatgacggcacggtgttccaccgcgtgattccgggcttcatgattcagggcggggaccccacgggcaccggcttcggcgatccgggctaccgcttcgcggacgagttccagagcggccgcacgttcgacaaggtgggcctgctggccatggccaacgcggggcccaacaccaacggcagccagttcttcatcaccacctccacgcccggacacctcgccggcaagcacaccatcttcggtgaggtgctcagcggctatgacgtggtggagaagatcagcaatcgtcctcgggacaaccgggaccgcccgcgcaccgcggtggtgctcacccgcgtggtgctgggcgacaaggctcccgcgggcgtgacggcccccgcggcgagcaagggagcggcgcccaagaaggacgcgggcgcgaagacggtttcaccaaggccgtgacacatgaccgggttcgtcctcggacgggcccccacacgggagggtagcatgggattgttggacgaggcccgcgcgggcaatgacctttacgccaccttcgacaccacgcaggggcagatcgtggtgaagctgttcgcgaaggatgcgccgaagacggtgagcagcttcgtgggcctggcgacgggcgagctgcccttccaggacccgaagacgggtgagaagacgcagcgcccgtactacgacggcatcatcttccaccgcgtgattccgggcttcatgattcagggcggtgaccccacgggcaccggccgcggcggcccgggcttcaacgtggacgacgagtaccagagcggccggaccttcgacaaagtgggtctgctggccacggcgaacatcggccgccccaacaccaacggcagccagttcttcatcaccacgtccaagccgacctacctcaacaacaagcacaccatcttcggtgaggtgctcagcggctacgatgtggtggagaagatcgccggcgttccgcgcgacggggatgaccgcccccgccagcccgtggtcatcaacaagctgaccatttcgacgacccagccgtag

SEQ ID NO: 8348 - DNA, 1047 bp, Myxococcus xanthus
cagaacctcttcttctcgccctacagcgtcacgcaggccctctccacggtctacgccggggcacgggggaacaccgaggcgcagatggcccaggcactgcgcttctccctgtcccagtcgaggcaccaccccacggcgaacgccttggagcgcgccctggcgaagcccgcgagccctcccccggcttcggggacaccgccgacctttcattccctgaactcggcatggggtcagcagggcatgaccttccatgacggattcctcgacaccctggcccggcattacggcgccggcatgcgtctgatggacttcgagaacgacgcggccggtgcgcgcgcggaaatcaaccgctgggtcgaggtgaacacgagagaccgcatccaggacctggtcaatgaagagtccctcccgaacgcgacgcgcttgatgctcatcaacgccgtctatttcaaaggcgcgtggtcgtggccgttccgcgagcaaggaacgcggaacgcggccttccgggccctggatggaacgagccaccaggtcccgacgatgagcggcggcagggggcagtacatggagggggatggcttcgaagccgtcaccctggactatgccggaggcaccttccgcatggtgctcgtcgtcccggagtgggagcgcttcgaggaggtggaatcccggctgtctcccgctttcttcaaagacgtccgcgcacggctcgagaaccatcagatcgacatccagctgccgcgcttccagatcgagtccgagctccccctcatccccgcattgcaggcgctgggcatggaggacgcgttcacggagggcgctgacttttcggccatctcccccacgaagctcaggattgcgaccgtgaatcacaaggcgttcgtggccgtgaacgagcttgggacggaggccgccgccgcgactgccgtgggaatggtccccgtgtcactgccaaagccgatccacgtcaatcggccgttcatcttcgtcatcgaacacgtggcgacgcagaacgtgctgttcctggggcggttcgtgaagccttga

SEQ ID NO: 8349 - DNA, 732 bp, Myxococcus xanthus
ttgttggagtcgcggttggggttgagcttctcccggatggagacggcgctggaggccctgacgcacaagacgtacgtcaatgagacgcgggacaaggagctgaaggacaaccagcgcctggagttcctgggcgactcggtggtcaacctggccgtcagccaccggttgatggcgcgctgcccggggctgcccgaaggcgacctgacgaagatgcgcgcccgcgtcgtcaacgaggacggcctggcccgcgtggcccggaccatcccgctgggcgacctgctgctgctggggcggggcgagctcatgtccggcggccgggagaagaactccgtcctggcggacgcgctggaggccgtcttcggcgcggtgttcctcaccagcggcctggacgccgcggtgacgctggtggaccggtatttcgcggacctgctggacgaggtctccagcggccaggggcggctcgactacaagacgctgctccaggagatggcccacgagcggctcaagctccagccccgctaccgcgtcgtctcggagtccggtccggaacactccaaggtgttcgaggtggagctgatgctgggggagacggccttcgcccgggccaccggccggagcaagaaggaggcggagcagtccgccgcgcaagcgacgctggagaagctgcgggaagacgctgcgtgtcccacctcccccccgcccggaacgccgcgacacgacaccccggcgtga

SEQ ID NO: 8350 - DNA, 864 bp, Myxococcus xanthus
atggacaccgcgcggctggaaggtctcgggctgcagttgcgggaggacgcggccggcaccgaggcggtgctggaccttgagtcgtccccgctggtcaatcccgtcacccgggccttcatcccagaggtgaccttccaggtgatgggggaccgtctcatccccatcgcgccgcccgccgtggtggggctggcccccattctggtgggcgcgctcagcgacgtcgccgacatcgaggcgctgctcgcggacgcattcaacgagcacatcttccacgtccagcgccgctccgcggagctccaggtgctggggctgacgccgcgcgtggagccggagacgctggagctgtccacggaggtcgtggacggtgagctggccgtcacgttggtgtcggaccggctgggcaacttccgcgtggcccgcgtggcccgggggaaggaagacctggccacgggcggcggccacacgctggagctgtcggagttccgcgagcgggcggcgctgacgggctacctggtcgcgctctttggtgagccggcggcccgtcctcaggccgcgccggtgggcgccgggctggtgcgcttctccgacatcgtggagaagttcggcgcggaggcgctcttgcctccccgcagcagcctggagctgctggcgcagttgcaggtggagggccgcccgtaccgcttcgccgccgccagggtggcgggccgcaccttccgggggctgctggcggggccgcagggcaaggagtgggcgggtcggttcgagctggatgagttcccaggcatcgtgcggatggtggcggacctgttgaaggtccctcccgcggccgtgaggctggtgggcccggacgcacctcaggagtga

SEQ ID NO: 8351 - DNA, 1146 bp, Myxococcus xanthus
atggattttgaccttccagaaagccatcgcgccctccagtcctccatccgtgacttctgcgaacggcgggtgaagccgtatgcccgtgagtgggacaaggacgagacgttccccatggaagttgtccgggagctggggcagctcggggtgatgggcatgctcgtcgccgaggagttcggcggagcggccatggactcgctcgccgtggcggtggcggtggaagagatcgcccgctacgacggctcgctggcgctgacggtggccagccacaacggcctgggcaccagccacctgcgcgtcttcggttcggacgcgcagcgccagaagtacctgcccaagctggccacgggtgagtacctgggcgcatggggcctgacggagccggggtccggctcggacgcgtcgagcatgaagaccacggccatgcgcaagggcgacggctgggtactcaacggcgccaagatgttcatcacccagggcacggtgggtgacgtgttcgtggtgctggccgtcacctcgccgcagaagcggcagaagggcatcaccgccttcctgctggagaagggcctgccgggcttcagccagcgcgccatccacgggaagctgggcatgcgctcgtcggacacggccgagctcgtcctggagaacgtggaggtgccggactcggcgcgcgtgggtgagctggaccacggcttcatcgacacgatgaagatcctggaccgcggccgcatcaccatcggcgcgctggcggtgggtctgggccggggcgccctggaggagtccattggctactcgcgcgagcgcaccgcgttcggccagcccatcagcgagttccagggactgcgctggatgatggcggacatgaagacggagctggacgccgcccggctcctggtccaccgcgctgccaagctggccgacgaaggcaagccgtactcgcgcgaggcctccatggggaagctgttcgcctccgaggccgccatgcgggcttgcaacaaggccgtgcagatccacggtgggtacggttacacccgcgaattcccggtcgagcgctacctgcgcgacgccaagctgtgtgagatcggcgagggaaccagcgagatccagcgtacaatcatcgcccgggaaaccttcaaaggggcttga

SEQ ID NO: 8352 - DNA, 1011 bp, Myxococcus xanthus
  unsure (1)..(1011): unsure at all n locations
gacctggtcatcatggtggaaggcaatgcctccatgtacctggncagcccgcgcatggcggagatggtcatcggcgagaaggtcaccctggagaagatgggtggcgcgaagatgcactgctccatctccggcgtcggcgacgtgctggtgaagacggagcaggaggccatcgaggcggcgaagaagtacatcggctacttcccggagaacttctcccaggcgccgccgcgcgccgagcccaaggcccccaaggccggcggcaagaaggtggaagagattgtccctgtcgaccagaacaagcccttcaacatgcatgagctcatcaacgagctcatcgacgaggggagctggttcgaggtgaagaagctcttcgcccaggagctcgtcacgggactggctcgcatcgacggccgcccggtgggcatcgtcgccaaccagcccaagtacaagggcggcgtgctgttcgtggacagcgcggacaaggcggcccgcttcatctggctgtgtgatgccttcaacatcccgctgctctatctggcggacgtgccgggcttcatgattggcaccaaggtggagcgcgcgggtatcatccgcgccggcgcgaagatgatctccgcggtgtccgaggccagcgtgccgcgcatctgcgtggtggtccgcaaggcctacggcgccggcctctacgccatgagcggccccggcttcgccccggacgccaccatcgcgctgcccggagcgatgatcgccgtcatgggcccggaggcggcggtgaacgctgtctactacaacaagatccaggagctgccggaggccgagcggcccgcctacgtccagaagctgcgcgacgagtacaagcaggacgtggacatctacaagctggccagcgagctggtcatcgacgacatcgtcccgggtgaccggctgcgtcaagagctcacccagcgctacagcgtctactcccagcggcatcagccccgtgcggaaaagaaacacggtgtctatccggtttga

SEQ ID NO: 8353 - DNA, 1170 bp, Myxococcus xanthus
ctgaaggcgctcctcctgcccatggagtacacgccgaacgtggccggcggtgtgggcacctatgtctacgagctggcccgcgggctggcgcgcggcgggtgcaaggtcaccgtcctggcgtacacgcccggcgagcccgccgtgctccgcgagcccaacctcaccgtgcacatgatgccgcccagccgcggcagcctctcccaggcgggaaagctctccctggtgggcggcatccgcgtcttcaacgacgacctgattcaccgaggccgcgagctcatccacgaggagaagccagacctcatccatttccaccagtggcacacccaccgcgccgcgcgagcgctggcccatgagaccggtgtgccggtgctggggaccagccactacatctccgagcccgccgagcgatggtggggacagacgcccgacccggagattctcgaggaggagcgcagcttctacgacgggtcgacgaacgtcatctcggtgagcgactccatgagcgagctcatccgggagacctatgggatgccggcgtcgctgctgcacaccatccactgcggcatggacgcgggccccttcctccagccctcgcacgcgccggaggactacgcccggctgcgcgccacagtggccacgccggatgacccggtcgtcctctacacgggtcggctccatcccatgaagggcatcagcgccatcttcgccgccgccgagcgcgtgctcgaacggcgccccaacgtgcgcttcctcctggccggtggcaccgactcgcgagagtccacgcagatggtgcagacgctgacccagcgctacgcgcacctgcgccaccgcatcaagctgctgggcaaactgccacgccagcagctcgggctgctccatcgaatcgcggatctggcgctggtgccttcgctctacgagccctttggctacacggccatcgaggccatggcctccggtctaccgctggtggcaacgcgctccggaggcccgtcggaaatcgtcgaccacgagaagacgggcctgctggtccccgtgctccccggcgcaccgggaggtccgcgcgaagtggacgtcgagtcgctcgctgccgcgcagctcaacctgctggaggaccgcgagcgggcgcggcgcatggggctcgccggccagcaacgcgtgggggagctg

SEQ ID NO: 8354 - DNA, 6828 bp, Myxococcus xanthus
gccgagcgacaggcggaggtcatcgcccgcacccacgccctggcgggcgtgttgccggtctccgtgggttacgtggagacgcacggcaccggcaccctgctgggagatccggtcgaggtctccgcgctgacgagcgccttccgcgccggcaccgaggccaccagcttctgcgcgctcgggtcggtcaagtcgaacatcggccacctggacgcggcggccggcgtagcagggctcatcaagacggccctggcggtggagcacggacgcatcccccccaccctccactgccgcacgcccaacccgaacatcgattgggcgcgcagccccttcttcgtgaatgccgcgttgcgggactggcagccgcatgaccaccggcgccgcgcgggcgtgagttccttcggcattggtggcaccaacgcccacgcactgctggaagcgccgccgcccccagcgccctccggtccgtcgcggccctggcaattgctggtgctctccgcgaagaagccggccgcgctcgacgcgctcacccagaacctgggcacgcacctggaggcgcgccccgagcagtccctggcggacgtggcctacaccctccagattggccgcaaggccttcccgcaccggcgcgtcgtggtctgcgagagtggcgaggacgcggccacggtgctgtccgagatgaaccccgagcgcgtgttcacggacgtggccaaggacggtggccgttctgtcgtgttcctcttccccggcggtggcgcgcagcacctgcgcatggggcaggagctgtacgagaaggagcccgccttccgcgaagccttcgacgcgtgcgccgccagcttccagcgccgcggcggaccgtcgcttcgcacggtgctgtacccggcgggcgacgcggacgcaggcgcgccccttcctcgtccctccgtgggcctgcccgcgctcttcacggtggagtacgcgctggccaggctgtgggagtcctggggcatccggcccgaggcgatgattggccacagcatgggcgagtacgtggccgcctgcctcgcgggtgtcttctcgctggaggacgcgctggcgttggtggccgagcgtggccgcctcttcgagcagcttccctccggcgcgatggtgagcgtggccctgtccgaacaggagctgctgccgatgctgggcgagcacctgtccctggccgccgtcaacggaccgtcgcaatgcgtggtggccggcgacaccgcctcggtggatgcgctctccgccgacctggcgacgcgaggcatcgagcaccgccgcgtccacatcgacgtggccgcgcactcccacctcatcgactccatcctgccggcgttcgcggccttcgtcgggcggctgaagctccagacgccgacgcagcccttcgtctctggcgtcacggggacatgggtgaccgaggaggaggccaccgacccgaggtactgggtgcgccacctgcggcagacggtgcgcttcggtccgggcgtgcgttgcctgctggagaacccgtcgcgcgtgctgctggaggtcggtcctgggcggacgctgggctcgctcgcgcgcctgcaggtggagcgtggccagcccaccgtggtgctcacgtcaatgcgggcgcctcgtgagcccggctccgacatgcgcttcgtcctcaccacgctgggccggctctgggcggcgggtgtgcccatggactggcggcgtctccaagccggagagcagcgccggcgcgtggtgctgcccacctaccccttcgatcgcaagcggcactggctggagccgaatgcagccggtatcgcgatcgccagcgacgtctcgctcgcccggcgcaaggacgcggcggactggttctatctgccatcctggaagcgcacgctcgcaccgcgcgcgaccaccgccgcgccccagaactggctcgtcttcaccgacaccggcgggctgggagacgccttggcgacacggctggcggagagcggcggccgggtcacccgggtatcgcagggctccgacttccgccgcgtggatgacggcgtcttcgaagtggacccaacccgcccggagacctacgcggcgctgctgaatgcgctcgccgaggactcctgccggcccgagcgcatcgtccacctgtggagcgtggactccgcgggagaaggactggcgggcctggagcacgcccagcgcaccggcttcttcagcctgctcttcctctcacaggccctggctggccagagcgcgtccgggcccgtgcaaatgacggtggtctccagcggcgtgcaggccgtcaccggacatgaggtgctggccccggagaaggccacgctcctgggtgcctgccgcgtgctgccgcacgaggtgccgggcctgtcatgtcggtcgatcgacgtggaggccccacgctgtagcaagacgctccaggccctggtggcgcggatggtgggtgagctggccacgggttcctccaacggcgccgtggcgctccggggcccgagccgctgggaacagtcgttcgagcaggtacgcatctccgcgcccgccgcggatgcgccgtcgcgcctgcgtccgcgaggcacgtacctcatcaccggcggactgggtggcatcggcctggtgctggcggagtcgctcgcgcggcaggtccaggcccggctggtgctggtgggccgcaatgccctgccggaacgtgacacctgggacacctggatcaccgagcacggtgagcaggaccgggtgagtcagcgcattcgccaggtgctggcgctagaggccctcggctccgaggtcctggtcctcccggcggacgtgggcgacgccgagcagatggccgaggtgctgcgccaggcgcgacaggcctttggcgaactccacggcgtcatccacgccgccggcgtgcccgcgggcggactggcccagctccgcacgcagaaggccgtggaggacgtcctgcgccccaaggtgtcgggcacctggatcctgcacgcgctgctgcgcgacacgcccttggacttcttcgtgctctgctcgtctcgcaccgcctacacggcggagcccgggcagattgaccactgcgccgcgtgcgccttccaggatgccttcgctcaccaggccgcggcgacggggaacgtgccgatcatctccctggcctgggatacctggcgcgaggtgggccaggccgtaacgacgcagatgccggacggcgccaacccgatgcgggaggcgatgctggcccatgccctgacaccggccgagggcgtggacgtcttcgagcgcgtgttggcgcaggcccccacccacgtcgtggtgtccaccgaggacctccgagcggccatggcgcgcagcgcctcgctgctccaagacttgatgggccccatggagacagacgccgcgccggcggccgagcgcgcggcgcccgccagcatggacgaggcggagcgcgagctggcggacatctggcagcgcttcctgggcgtggagagcgtggcgctgcacgagaacttcttcgagctcggtgggaactcgctgattggcctgaaggtcatcaacgaggtgaagcgccgcttcggcaaggacctgccggtggtgtcgctcttcgagaaccccacgctcagcgccatggcccggctgctgacccgagggcaggaacaggcgtcggccaccaccagtgaccggcgaagccgcggagccaggcgtcgggagctcatccagcagcggcgccagtcggggaactgagcgcaagagggggacagcgtgtcggacagcaacacggggatggagatcgcaatcaccggcatggccgggcgcttcccaggcgcgcgcagcctggaggatctgtggcgcaacctctgcgacggcgtggagtccattgagccgctttcggacgaggcagtcctcaaggcgggcctgcccaccgaggtgctgaaggatccgcacttcgtgaaggtggcctcacggctggacgacgttgcgggcttcgacgcggccttcttcggctacacgccgcgcgaagcggaggtcatggacccgcagcaacgcctcttcctggagtgcgcgctggaggcattggaggacgcgggccatggcgcgccgactcccgagctgttggtgggtgtcttcggcggacaggccctgagcacctacctgctgctcaacctcatggggaacgcggagctgatgcgcacggcggacccgctccagctcaacctgggcaacgcgggcagcttcctcaccacgcgggccgcctacaagctggacctgcgcggccccagcttcaacatcgagagcgcgtgctccacgtcgctggtcgcggtccacgtcgcctgtcagagcctgctcaaccaggagtgtgacctcgcgctcgcgggcggcgtgtccatcaacctccagattcagggcggctaccgctacgtggatggcggcatcctgtcgccggacgggcactgccgccccttcgacgcgcaggccaagggcatcgtcttcggcagcggcgcgggcgtggtggcgctgcggcgcctggaagatgcgctggcggatggcagccccatctacgcggtcatcaagggctccgcggtgaacaacgacggcgccgcgcgtgtgggctacaccgcgccgggcgtcgagggccaggccgccgtcatctccgaggccctgggcagcgcgggcgtatcggccgggagcatcggctacgtggaggcgcacggcaccggcaccgcgctgggagaccccatcgaagtgcaggccctcatccgcgccttcggcgacgaggccgccggaccgcgcacctgcgccctgggctccatcaagcccaacctgggccacctggacgcggcggcgggcgtggcgggcctcatcaagacggcgctggcgctgaagcaccgcaagctgccacccagcctcaacttcgagacgccgaaccccaacatcccctgggacgcgagccccttctacgtcaacacgaagctgcgcgagtggaaggcacccgcccgcgagcctcggcgcgccggcgtgagcagcttcggcatgggcggcaccaacgcccatgtcatcctggaggagccgccctcccgcgctccggtttcgtccacgcgctcgcaccaactcctgatcctgtcggcgcgcacacccacggcgctcgccgcgcaggcctcccggctggaggagcacctccgcgcgaacaagggcctggagcccgcggacgtggcgtacacgctccaagtgggcaggcggcgccacccgcaccgccgcgccatcgtttgtcagggacgtgaggacacgctcacggcgctgggcgacatcagccggcagctctccgccaccgaggagcgcaccagccgccccaccgtgttcatgttccctggccagggcgcgcagtacgcgggcatggcgcagggtttgtacgagaacgagcgtgggttccgcgcggacgtggacgactgcgccacccggctcatcccgcacctcaaggtggacctgcgcgaggtcctcttccccgccgcggaccgcgccgaggaagcccagcggcagttgcagcagacgcggttggcccagccggccctcttcatcatcgagtacgcgctcgcgcggctgtggatgtcctggggcgtgcggcccgaggccatggtgggccacagtatcggtgagtacgtggccgcgtgcctcgcgggcgtcttcaccttgccggacgcgctagccctggtggccgcacggggccagttgatgcaggacctgccgccgggcgcaatgctctccgtcgcgctgtcggaagcggagctggtgtcgtcgctggatgcgcggctgtccgtggccgcggtgaacgcgccgtcgatgacggtggtcgccggccccgacgacgccgtggacgcgctgaaggcccggctggacgcacgtggcgtccagtcacgtcgcctgcacacctcgcacgcgttccactcggcgatgatggaccccatcgtcgcgcccttcaccgagcgcctgcgccggatgaagctgtccgcgccgcagattcccttcctctccaacgtcaccggcacgtgggtgacggccgccgaggcgaaggacccggcctactgggcccgccacctgcgtcagccagtccgcttcgccgcggggctcgcgcagctacaacccgcgcaggtgctcctggaggtcggccccggccgcacgctgaccaccttcgcgtcacagcctggcgcgctccggcaggcgcccaccacggtgacctcgctccgtcatccggacacgcgacaggcggatacgaccgtgctgctcggcgcgctgggacagctctggatgtccggcgtggatgtggactgggaagccttcaacggcgaggcacggcgccaacgcgtcgggctgcccacctaccccttcgagcgcaagcgctactgggtctcccccgacgggcaccgcgccctggccgccgcgccgtccgcggagcgcgtccccgaaacggaggagcccggtgaggcccccgccgcgggctactcccgccccgcattggccgtggcctacgtggctcccgacaccgaggaccagcaggtggtggcgcgcatctgggaggacgtgttgggcgtgcggccggtgggcgtccacgacgacttcttcgcgctcggtggacactcgctgctggccaccacggtggtgggacggctgcgggacaccttcggcttcacggtgccgttgcaatcgctgttcgaggcgccgacggtggctcgactggcggccctggtagccgagcagcgcaagagccccggccatgatgacccggaggtggaggccctgctgcgaatcctggccgagctcaccgccaaggagggcgcggccagccgttag

SEQ ID NO: 8355 - DNA, 195 bp, Myxococcus xanthus
atgcccggtatccgagtgaaggaaggagagtccatcgagagcgccctcaagcgtttcaagaaggccaccgagaaggctggaatcctttccgagatccgtaagcgcgagcactacgagaagccttccgtgaagcggaagaagaaggccctcgccgccaagaagcgcgctgtgaagaaggcccgcaagtcgttctag

SEQ ID NO: 8356 - DNA, 528 bp, Myxococcus xanthus
atgtcaggtgccctggctcccgccgtcgaagtccccctgaacaacgtcttaccctccggagctgcgaccatggccaccctgaaggagcggatcgacgcggacctgaaggacgcgatgcggtccaagaacgagctgacgctcagcgtgctgcggatgctcaagagcgcggtgaagtacaaggaagtggagcccggcgcgtccgcactggatgacgcgggagtcctcaccatcatcgccggcctcatcaagcagcgccgtgattccgtggagcagttcaagacgggtggccgcccggagctggcggagaaggaagaggctgaaatcagcatccttcagaactacctgcccaagcagctgaccgccgacgagctggccgccgaggtccgtgccgccatcgccgagacgggcgccaagggtcccaaggacatgggcgcggtgatgaagaacctgaacgccaagattcacggcaaggcggaaggccgcgccatctccgaggccgtgaagtccgagctcgcgaagctctcttga

SEQ ID NO: 8357 - DNA, 1809 bp, Myxococcus xanthus
attccggagcacaagatccaggaggtcctcgaacgggtggacctcgtcgggctcatctcccggcatgtcgacctgaagaaggccgggcgcgaatggaaggcctgctgtcccttccatcaggagaagaccccctcgttctacgtggtgccggagaagcgcttctatttctgccatggctgccgcgcgagcggtgacgcggtgtccttcgtccagcgctacctgggcaagacgttcctggatgcggtgcgggacctggcgcgcgagctgggcgtggacctggaagccgagcaggaccccagcatgcgggagcggcagcaaatcaaggaggccacggaccaggccgccgagcacttccgcgccatgctgtggcagcaggacgaaggccgctccgcccgcgcctacatcgccagccgcggcgtctccgacgagacggccatggcgttcggcctgggctgggcgccgctcgaatgggcctcactgacggagcgcttccagaagctgggcatgctggagtgggcggcgaaggccggcctggtcctcaagcgcaacagcggcgacggctactacgacttcttccgcagccgagtgatggtgcccatccgcgcgccggagggccgccccatcgccttcggtggccgtctgattggcgcggatgaagggcccaagtacctcaactcgcgcgagtcccggctctacaacaagagcgagacgctcttcggcatggaccagtctcgcgacgagattcgcaagcgcaaggccgccgtgctggtagagggctacttcgacgcccttggcctccaccaggtgggcgtgcggcacgcggtggcgctgtgctccaccaacctcaccgccggacacatgcaggtgctgaagcgcgccgaggcccgcgagctgattctgctgttggacggagattcggccggccttgccgctgtcgaacggctttccggtcccctgctcgccgcgggagcgaccgcgcgagttgccctgctgccgcaaggggatgatccagacaccttcgcgcgtcgagagggccaggagggcgtggaacggctgctggaaggcgcccacccgctcaccagccacctgttcgcctcgctcctcccggagggcaaggccgcgagcttcgaggagaagatggcagcgctcgagcggctcaagccggtggtggggcaggtccccgtgggcctggtgcgcgccaccctcttcagcgcggtggccgagcacttcggctggcggcctgcggacgtggaggcagccctgcgcagcaaggtgcccctgcccaagcccgccggcggggacgcacctccttcgagccccaaccgccccgccccgcccctggagaagccgccccccgcgctggagtgcttctacgtgggcgcggtgttgaaagagccacggttgatggcgcgggacaccttccgcgtgtgtgacgagctgtcccacatgggcctgcgcatggcgctggcgcatgcgacgtcgggacacggcgcaaatgatgcgctctttgaatcctcggaagccgtgaagcgcggcattgaaagcgcgctgcggcagctcccctcggaacctgttcccctggaggcggcgttcctctccatctgcagggaaatcatggtgcggcgcatcgacgagcggctcgtttatataaagcgggcgacggagcagacgccgggggcgttcgacctgacagaggagacgcgccagctccttgtggagcgcgtggaactgttggcgctcaagaagcgtgtcctggaggagctcaagcctgcctcctcgggaacaaaggcgcccatgcaaccggtttga

SEQ ID NO: 8358 - DNA, 2127 bp, Myxococcus xanthus
atgccgacgcagaagccctcgaaggcgtccgtgaagccgaccaagaagaaggtggatccggtgatccgcaagaagaaggctccggacggtgccgcggcgaagggggccaagacgggcgccgaggagaaggaagaactcgtcgcgagggacgtcgtcgccgaggcgacggagaagctcaagaagaagaagaagggcgtggcgccggccatgggcgatgacgtggacccggaggaggccgcggaagaggccgccgccgccgtccaggtcgaccccgacgccgtcgaggacgacatcgaggaggatccggtcgccgagcgcaaggaggtcaaggacctgctcgccgcgggccgtgagaagggcttcctcacgtacgacgaggtcaatgacgcgctccccgccgacatcgtgtcgtccgatcagatcgacgacgtgatgagcatgttcggcgacaacgacatcgagattgtcgacgcgcagaaggccgctcagaacaacgaaatcaagcccaccgtcaccgtcgaggaagagaaggaagacgccgacgaggacgagaaggacgaggacgacgagccgggcggcaagtcgaacgacccggtgcgcctgtacctgcgcaagatgggcagcgtcagcctgctcacccgcgagggcgaggtcgaaatcgccaagcgcatcgaggatggtgagaaggaagtcctccgcgcgctgctggcgtgcaaggtggccgtcgaggagatactcgacatcggcaacaagctgaagacggccaagctgcgcgtgcgcgacgtcatcaaggacgcgccggaggagacgcagtccgaaggtgccgaagaggcgcccgaggaggtcggtgaaggtgacgctccggcgcagctggcgcagagcgagctcaacaagattgagcagatctgcaagcagatcgagcgcttccgcaagttcgcccaggactgcgacgtcttggaggaggagctgtcctccaagaagaagctgaccgaggtccgcaagaaggaagtgaagcaggagatcaaggacctccggaccaagatgatggaggtcctggaggagatgcggctcaacaagaagcaggtggaccgcatcgtcatcaacctcaaggccctcatcgagcgcgtcgacaaggccgaggacgagctgcgtgatttggagcgccgctacgactgctccatgaaggagctgcgcccgcagctgaaggagtcgcgggagaaccccaacatcggcaagaagctgcagaagcagctcaacctcacgccggagcagttggaggtcctggaccgcgacgtgcgcacggcggtgcggaagatcaagaaggtcgaggaggaggccaacctccccgtcgagtcgctgcgccgcaactacgacgccatccgtctgggtgagcgccgcgccgaacgcgccaagagcgagctggtggaggccaacctgcgcctcgtggtgtccatcgcgaagaagtacacgaaccgcggcctgcagttcctggacctcatccaggagggcaacatcggcctgatgaaggccgtggacaagttcgagtacaagcgcggctacaagttctcgacctacgccacctggtggattcgtcaggccatcacccgcgccatcgcggaccaggcccgcaccatccgcatcccggtgcacatgatcgagaccatcaacaagctcatccgcaccagccgctacctggtgcaggagattggccgcgagccgacgccggaggagatcgcggagaagatggagctgccgctcgacaaggtccgcaaggtcctcaagattgcgaaggagcccatctccctcgagacgccgattggcgaggaagaggacagccacctgggcgacttcatcgaggacaagagcctcgtgtcgccggcggacgcggtcatcaacatgaacctggcggagcagacccggaaggtgctcgccacgctgacgccgcgcgaggagaaggtgctccgcatgcgcttcggcatcggcgagaagtccgaccacacgctggaagaggtgggccaggacttcgaggtgacgcgcgagcgcatccgtcagattgaggccaaggcgctgcgcaagctgcgccacccgagccgctccaagcgcctgcgctccttcgtggagagctga

SEQ ID NO: 8359 - DNA, 444 bp, Myxococcus xanthus
gtgggcccccgctccattcgtggaccgggggccttcgtgtttctagagtccggggccgtggcgctccgagcgaagacgaagacaccgaaggcagaagtgaagaaggctcccctccccttctccaaggcggtgtggaaggcggtccgggccattccgcgcgggcaggtgcgctcctatgcccaggtggcgctctatgcgggccgtcctggggccgccagaggcgtgggccgggagatggccaccctgccccagcagcccgagctgccgctgccctggtggcgcgtcacgcgctcggacggaacgctggcgccccaggtggcccaggagcaggcacggcgcctgagggccgagggcgtggaggtgacgcagcgtggggacaccttccgcgtgaaggtgccccgcgaggtgccggcccctggactggcaacgaagcggcagcgctga

SEQ ID NO: 8360 - DNA, 1362 bp, Myxococcus xanthus
atggcggagccggtgtcgtccaacctgacggcgtgtctgacggcggctcgcgccgcggcggaggccggggcttcctccgcgaagttcctgcgagatgccggacctcgcggcgccaatgccgcggcccgcgtgtgggggcggagggatgccattcgcgaggcgctggagctggagctgtacgcggaggacctggcggttcggggctcggcgctcgcccacctggccgggttcctgagccgcaagcccgcacgcgtcctgctggacgccatggcggcgcggccggagagcgtggatgcggtcagcgccagcgcgctcaaggtggtggccgggcgcagccggtcgtcggtgggacggatgctgctggatgaggcgaagcccgcggaggaggcgcgcatcaaccggctcttcgctgtgtattcgaaggagctggagggcatgcagccggagctgaccgtggcggatccacttcagcgccgacgcgcggtggagtcgttgcgagtgtatgggccgctggcgatgcgggagctggagcgggcgctcggcgattccgaccggtgggtgcgccgggatgcggcgcgggcgctggccgaggctgaaggcgtcccgctgcgcacggcggcggagcggcgcatcgagtcgagtgatgcgatgcaggctcggccgtggctggaggccatggcgagggagaaggggtgtgtggcgttcttcctggggacggcgcgggacaaggcgctggccgcatccgtccgaggggccgcgctggcgcaactggcggactgtagcgagggggctcgggaccgggtgtcctcggtggagccgtttctgacagatgcgcagccgttgctgcgggcaggtgccgtgcgggccttgagcggtttgacgacgcggcagccgggagtgtcggaggccaccacgcgtgcgctgagggacggggctcccgaggtggtgagcgccgcactggagttgctgacgcttcaacggcagacgtcccgaggcgatgaggccgcgatgctgctggagtcggaacatggggtggtgcgcaccgccgccgccgaggcactggagcagattggccgcgcgtcacatgtgaaggcgctggccgggtgcctgcgggaggacacggaggcccctgtgcgggtggccgcggcaacggcgctgggccggattggcggagcgcaggcggcggccgcgctatcggacgcagcggcgcgagacccggattcccatgtgaaagcacgtatcgcgcgaggcgctacggcgactgggcttcggccagtaggcgcggggcccgcgcccgaaactcaaagcccgctgatggccttcgcgtccacccggttccgggccgcgcgcttggcccggcac

SEQ ID NO: 8361 - DNA, 195 bp, Myxococcus xanthus
gctctaagctacgggcgcggcacccacttctgcctgggcgcgcccctggcccgggtccagttcgaaatcacggcgaacatcctcctggaccggctgccggacccgaagctcgtccccggccaggacttcggcacctggcagagcctggtgctgcggcagatgaagcacctgaaagtggagtggacccccacctga

SEQ ID NO: 8362 - DNA, 1053 bp, Myxococcus xanthus
atgtacgctcaagtggtggatgaggccgacattcagtacgcgcaccgagtggaccgcaaggcgctggcggccatcacccgggagatgtcgaaggtgaacaatggtcgtgcgctgtgggccatggccgctcagtggctggtcatcgcggcggcatttgccttcgttctattcgtggaccgctggtgggcctggccggtggcggcggtgctcatcgccacccggcagcacgcgctgctggcgctgatgcacgaggcggcgcactaccacctcctgtccaaccgcaaggtgtcggacgtggtcagcgatctgctctgcgccttcccgctgaacatgacgacggcgggctaccggcacgagcacatgctgcaccaccgctacgtgaatacgccgaaggacccgtacctggccggccagctggtggacgcctcctggcacttcccccgcacgccgatgcgcgccacggccgtcttcctggcggatgcgctgggcctgtacgcccccaaccacctgaaggtggtgctgccctggacgtattggggccgcctggtgggccgcgcgcagccccgcatctccgcgggcgagcacctgcgctactggctgtacgtggccacgctcgtcacggtgctggtgacgacgggcgcgtggctgcactggctgctcttgtgggtgctgccgacgacgacggtgatgatggccttcttccggatgcgcgccctgggtgagcaccccatcgaggagacgaagtccggtgacgagacgcgcgagacgcgcgacatcctgggcaccgcgctggagaacttcttcatcgcgccgctcaacgtgaatctgcacctcacccaccacgccttcccctccgtgcccttctacaacctgcccgccatgcacgcgcagctcgacaaggccggcctgctggaagacggcgtgaaccagttcgacacgtacctgggcaaggagaacagcctcatccagtacctcacgcgtgagccggaggcctccgccgccgcggccgccgcggcccagccgtcgcgcctgagccagccgctccactcgtaa

SEQ ID NO: 8363 - DNA, 603 bp, Myxococcus xanthus
atgcgccgacaggcgagcctcgcgctgctcaacaccttgtcgctgacccggctgcccctggcggtggccttcatcctcgtcccggatgcctgggttcgcgcggggctcgtggtgttggccgccttcacggacttcctggatgggtggattgcccggcacaaggggctcgccacgcggctgggcgcgctcatcgacccggtggccgaccgcgccttcatggtgacggccatcctcgtctgctacctcgacgggctcatcagcggggtggcggtgctgctgctggtgctgcgcgacgtcggcaccaccgtgggcttcttcgtcgctcgactggcgcccaggctgcgctcggtggaactgaaggcgcggatgatgggcaaggccgtcacttccctgcagttggtgacgctgctgtgcgtgctgctgtttccccccgcggtggtgcccctggtcgcgctcatcggcgtcctgtccttcgcgtcgatggtggactactcccacgcggtgctgaaggcccggcagcgggacgccggaccgcggcggatgaagccggagtccggcggcgcgacctcttcgggctcctccctgccgcccgtgcgcaagtag

SEQ ID NO: 8364 - DNA, 1320 bp, Myxococcus xanthus
atgtccaagtcgtctgtctgggtgagcctgagtgtcggtctggcgttgggcttcgcgggagggcgcttggcgcgtcccaccgaactggccacgggaacggcccacgcggccaacctcgcggcgaaggcccccgcccccggcgcgcgtccgcgtgcgccgatttcgcccaccgtctacaaggtgccggtcaatgactcaccgacggcgggagcggaggacgcgctcgtcacgttggtggagttctccgactacgagtgtccgttctgctcacgtgcgaacggcacggtgaagcaactccaggagcgctatggccgcaagctgcgcgtggtgatgaagcaccacccgctggccaaccacccgcgcgcgcggccggcggcgctggcggcgctggcggcgggtgagcagggcaagttctgggagatgcatgaggcgctcttcgccaacccgcgggcgctgagcgaggccgacatggagcgctacgccatgaaggtgggcttgaacatctcgcgctggaaccaggaccgcgcggacccgcggctggcggagcgcatccgccaggacgaagcgctggcgatgcggttgggcgccaccggcacgccggccttctacgtgaatggccgcttcatcagcggggcccagccgctggaggtcttcacgggcgtggtggacgaggagctgagcaaggcggaggccctggtgcggacgggcgtgcggccgacggaggtctacgcgcgcaccatctccgcagggaaggacagcccgcccatggagcagatgatgcccgaggagccggccatccagcaggtggacgtgggcaccgcgccgactcggggcccggccaacgcgccggtgacggtggtggcgttctcggacttcgagtgcccgttctgcgcccgcgtggtgccaacaatgaaggcgctggaggccgcgtaccccggcaagctgcgggtggccttcaagcaccagcccctggcgcagcacgcgaacgcacaggtggcggcggaggcggccatggaggcgcacgcgcagggcaggttctgggagttccacgacgtgctcttcgccaatcagcgcaagctggaccgggcgtcgctggagcactacgcgcggcaggtgggcctggacgtgggccgcttcaacgcggcgctggactcgcgcaagcatgacgcgcacgtgtccgcggacgtcgcccaggccatgcgcgtgggcgccacgggcacgcccacgttcttcatcaacggccgtccggtgacgggcgcccggccggtggagcacttccgcgccatcatcgacgacgagctgcggaaggcggcgcggtag

SEQ ID NO: 8365 - DNA, 129 bp, Myxococcus xanthus
atgcccgcgcaggacttccacgtgctctccgctggaggcgacaccggaccctggtttccgctggagggcgaggacgtggtgacgcccttctggaagcccttcccctggtcctcgctgcggcgcttctga

SEQ ID NO: 8366 - DNA, 117 bp, Myxococcus xanthus
atggatgaagtctggatggagatgagcgagggcgaacgctctgccatcgccaccgaaagagcccgggtgctgggccttcccaaagcccaacccgcggactcggcggcgcagccctga

SEQ ID NO: 8367 - DNA, 507 bp, Myxococcus xanthus
atgcggctggagctcgtgctgcgttggcgtgggttggaggagtccaagcgtcacatcgcgtctcccgaggacgcgctggccatgggcaccgcgcaggaggccgtgctcgccgcgttcctcgacgcggtggatggcgcgggccgaagggacctcgcgggcttcctcctcgaagcggcgcgcccgttgctggagcagcccgccacgcgctgggtggagggcctgtcttcctcggcgacgttgtcctcccgggccacggcggctcgtgccgccgccgccttcctgcgcgcgctgggacggctgtcgcgttgggacgcggagcaccgcgccgtgcgcttcttcgacgacgactacgacgccgcccagcacctgctgtccgaatggaacgccttcggtgaagcaggcttccgccgcgccgaggaccacgcccggcagctggccaccgccctcaccagcgccagcggcgcctccgccacacctccaccttcctccgccgggagcgcttcatga

SEQ ID NO: 8368 - DNA, 4632 bp, Myxococcus xanthus
tctaaagggtgcacagacccccgtatggacgtgctggcggacgcgtcgaccgaggagcttcgagacatccggccccgcccggtgcgtgttcccttgatttcgtccatcaccggcgcggagatcgacggcgcgagcgcggacgcctaccattgggtgcggaacattgcgtggcccacgctcttcaccggcgcgctctcccacaccatgcatgagggctaccacacgttcctggaggtcagtccacatgcgattctggggcaccccatcgacgcgacgctgaagcacctggggcgccagggccgcgtggtgccctccctgccgcggcaggaggatgagcgccccacgttgttcgattcgttgggcgtgctctacgcggcgggacagccggtccggtgggacgcactcgccgcgcgtggggtggaccatgacggggaggcggtgcacctgctgcccctgtcggcgcggagcccggaggcgctcaaggcgctggctgcggactggcgcgacttcctggcaggggagccgggcgcgccgctcgatgacgtcacctacaccgcgagcgtgcgccgcggccacttgtcccaccgcttgtcggtggtgggcggctcgcgacgggagctggcggaggcgctggacgccgtcacgcggggggagctcccgccgggggtgagcgagggacgggtgagtcccgagggacgggccaaggtggccttcgtcttcccgggacagggctcccagtggttggggatggggcgtcagctcctgcgtgaggagccggtgttccggtccgccatcgaggcgtgcgagcaggccatgcggccgcacgtggactggtcgctcacggcggagctgctggcggatgagcagcattcgcgtctgcaggacatcgacgtggtgcagccggtgctcttcgccatgcaggtggcgttggcggcactgtggcgctcgtggggcatcgcgccggacgcggtggtggggcacagcatgggcgaggtggccgcggcgcacgtcgcgggtgcgctctccttggaggacgcggcgcgcatcatctgcctgcgcagccagctcctgcgccgcaagagcgggcagggggccatggcggtggtggagcttgggctggcgcaggcccgcgaggcgctggccggctacgagtcgcggctctccgtcgcggtcagcaacagcgcgcgctccacggtgctgtcgggtgacatcgacgcattggagtcgctgctgccgaagctcgaaagccagggtgtcttctgccgccgggtgaaggtcaacgtcgcctctcacagtccgcagatggactcgttgaaggacgacctcctgcgggtgctcgacggtgtcgcgcctcagggggcgcccgtgcccatctactccacggtgacgggccagacgagcgacggcgcggacttccacccggcctactgggtcagcaacctgcgcgagccggtgctgttccacggtgctgtcgagcaactcctggcggatggcttcacggtgctggtcgaggtgagcccacacccggtgttgctcgcgcccatcgaggagacgctgcgcgagtcgaaacagggcgccatcgcgctcgcgtccgcgcggcgacagatgcccgagcgccgctgcctgctggagtccctggcggcgctgtacgcctggggttgcgcggtggactggaaggcgctgcacccggtgaagggccgtgtcgtcgcgctccctcggtacccgtggcagcgggagcgcttctggctcccggacgaggcggaggtggatgcgcagccggagggcgtggtcctcgcggaccggaagggacatcccctcatcggtggttcgctctcttcgtccgtccagcccgggactcacttctgggagcggaccgtgagcacggcggcgttcccgtatctggccgaccactgcgtgtggggggacgtggtcttcccaggcgccggttacgtggagatggcgctgagcgccggcgcggaggtgctgggcgagacggggctcgtgctggaggacgtctccttcagtgagatgctcgcgctggagccgggccagtcgaggcgcgtgcaggtggtgctgaccgaggaggagccaggccgcgccaccttccagattgccagccgcgcggagggcgagatgtcctggcgcaagcacgcggcggggacggtgcggcgggatgcacgtgcggcagcggttgttgaatcacccgaggcgctccgggcgcgcgtcacggtggcggtctccgctgaagcgcactaccagcgccggcaggcgcaaggcctcatgtacggcccgacgttccaggggctgcggggcatctggcgcagtgagcaggaggcgctgggacgcctggaggtctccgacacggtggccttggaggcgggcgcgtaccggctccaccccgcgctgctggatgcgggactgcaggtggcggtggagctccttgccccgctgaccgcgacgtccgctccggcgacgcatgtgccggtgggaatcgggcggattcgtttcttccagcgtcccgggcgcgcggcctgggcgcgagtgaaggtccgtggggaaggggccgcgagcgagcgcgagcgcaccttcgacttctggttgctggatgagcagggccaggtgctgctggagctcgaagcgctgcgcctgttccgcctggatgcgggcgcctccgcccgcaaggagctgggcgcgtggctctaccaggtggactgggaggagcggccgctgccagcggagctggcgtggcccgagcaaacgccgggaagctggctgattctccaggacggcggcggggtggggcagcggctgtccgcgcagctcctcacgcgaggcgagacgtgcgtgctcgtcgcgccccgtgaggcgtaccggctgactggaccgcggagcgccgaggtggacccccggaatccggagcactggcgccggttgctcacggacctgcttggcgccggcgttccgccttgccgcggcgtggtgcacctgtggagcctggacctggcctcgacggaggcgctgacgccacaggcgctggaggactcgcggcggctggggaccaccagcgtgctgcacctggtgcaggcgctttcgggggcgggctggcgggatgcgccccggctctggctggccacgcgtggggcacgttccgcgggcaaggtggcagaacgtgtcgcggtggcgcaggctccgctcctggggttggggcaggtgctggcggtggagcaaccggagctgcgctgcacccgtgtggacctggaaggcggcgcggacgtcgcggcggatgcgctgctgcgggagttgtcatcgacctcgttcgaggaccagaccgcgtggcggggtggtacgcgacgggtggcgcggctggctcgggcggcggatgcgctgtccgcccgtgaaccggcgacgctgctgcgcgaggatggcacctacctcatcacggggggcctcggtggcctgggactggaactcgcgcgctggctcgtctcccagggcgcacgtcacctgctgctgatgggccgccgtgctccctccgcggaggcggagcaggcgctggcggcgcttcgtgaggccggcgctcgggtggggtccttccagggcgacgtcgcgcggctggaggacgtgacgggcgcgttggctcgggtggaggacgcgatgcctccgctgcgcggcgtgttccatgccgcggggctcctcgaggacggattgttgctcaacctcaccgaggcgcgcttcgcctcggtgtcggcaccgaaggtcctgggcagttggaacctgcacgcgcagacgcgacacctgccgctggagcacttcgtcctgttctccagcgtggccgcttcgctgggcacgccggggcagtcgaactacgcgtcggcgaatgccttcatggacgcgctggcccaggcccgccgggcggaggggttgcccgcgctgagcatcaactggggcacctggacgcaggtgggcctcgcggcggcgcagtccatccgcggtgagcgtctggaggcacgtggcctgggaggcatggcgccggacaaggcgctggcggtgctcggcatgctgctgggacaggagcggccacagctcagcgtcatggccttcgagccgcgccagtggctgggcttctatctggccgcggcgcagtctccgtacttcacgaagctggcgcaggagccgtccagccgtccctctgtgagcgcgggcaagagccggattcgagagcagctcgaggcggcccgtgcgtccgagcgccgcggcctgctggatgcgcacctgcgcgagctgattggcggggtgctgcggatggcgcccgcgcgcatcgaaccacggacaccgttggtgaccttcgggctcgactcgctgatgagcatggagattcgcaaccgcctggaggcggcgctcgggctgaagctcagcgcgacggtggtgtggacctatccgacggtggccgcgctggcgccgttcctggcggaaaagctggcgcttccgctggaggactcccgccccgagcccgcgctggaggtggcaccggtgaaggcctcccaggcggatgtgacggccagcgagattgacgacctgtcggaagaggaagtcgagcggctgttcgctcagaggatggcgcaaggctcatga

SEQ ID NO: 8369 - DNA, 645 bp, Myxococcus xanthus
atgctgcgcaaggcaatcttgtgggtgttgggcatcgcggggctgtccattctgctctgtggtggcgtggtgacggcacaaggcacacagcaggtgcccgcgcggacggagcaggtgccaacgggacaggccctgacttcgacggacgccgcggcgctccagcgcgaagtggaccagctccgcgccgagctgttgcagctccgccaggaggtgacgcagcttcgggggcaagtcacgggcacgggcggcgcgggcattcctccaggcgcgagggtggtgagccctcggcgggacacggctgaccagcaggacacgggcacgggaggcacgggggccgcgggtgtcgtcaatgacgtgccacccgagggctcgggcgtgccgtcgcctccggggacggccgcggtggatgccgtctataccggcgtggtgcgctccgtgggcgacacggaggtggccatcgccatcggggacggtccgccgctgacgctgcgtgtggaccctcggacgcgggtgttccgggacgggcgcaatatcgccttgcggaagctcgagcccggcgagcacgtccgcgcagtggtgaacctgctggatgaagagcggacgatggagatttccgtgctcccctccactccggctgggaagtga

SEQ ID NO: 8370 - DNA, 1290 bp, Myxococcus xanthus
ttgcccgacgagacagcgctgacggacgcgtcgggcgtggtgagcttcatggcgcctggcgcgggcgtgatgaccgtctgtgcacggggggccggtcacgccgagcgctgtgagcgggacgtgggcgtggtcgccgggggctcgctcgtcgtggagctgaagcttccgccaggggccatcgtggaggggcaggtcctcctgcatgacgggacgccggcggagggtgttcggctggtcgcgtccggtgacccgatgttgctggagatgacgcctgtctgggccacgacggatgcacaggggcgctacacgctggatggcgtgacgccgggctaccccgtcggcatgacgcctttctcccccgagggagaggggctccaccggtccgtgggcgcggagctggccgccggcgaggtgcggcggttcgacttccagcttggcgcgttcgtcccggtcaccgtcaagccggtgatggggcgccggcgtgggacggactcggtggagtccgttcacgtgaatgtccagctccagccccagcaggacggcaccttcacgggcatcactgagtcggggcgccactccgtctccgtgtggggccgccggaacgggcgggcggtgtcggcacggaaggacgtgacgctggcgcccggtgctccggcggtcatcgcgttccccttctccgcgctcgaggagggcggaagggtgtggcagctgtactccagcgaccctggcgagttcgaggtctccggtcgcgtcttcctcccggacggcacgccggtgaagggggcctggattgggtcgcagaagcccggtccacgggggcggaggtgtggcaactcggccgaggaccacgcgcaggtccgcttcgatggccccgaattcgtggtgacgccccgggtgggcgcggggcgaatcttcgcgtggctgccggatggccgcgcgggcagcgccgtcgtccgaggcgggaagggggagcgtgtgtccgtcgacatccacctggaggagacgggcgccgtcgccgggatgatggatttcggggacgaccacctctggggctaccgcgaggaaatcaccgtcaaccatgagtgggtcggtgcgtcgcactacacgttgttggacggccgcatcttcgtgccggggctgaagccgggtcgacacgtgctgcgcacctctcttgggacggtggagttcaacgtcaacgcccgcgaggtgacgaacgtgggcgtgttgagacggccgccggagccggaggccgcggtctctgattcagaggccgcggcctcggagccgtga

SEQ ID NO: 8371 - DNA, 1356 bp, Myxococcus xanthus
tgggcagccgaggccgcgcgtgacgacgagacggtggcacgggcctggctggagctcatctgggcggtgggcgaggagcagtcccgccccgacgaagcggagaagctcatccggcacgcccgggccgccgtcgagcggctggggcgggagcgcttcccggacatcacgacggaactgcacacgcgcctgtcgtcgctgcgagaggcgtacggccagatcgccgaggcggagcaggaggcgcgccagggactggagttctcgcggaggaggaatcacccggacagcctccgcacgcccaacctcatccatcagttgggacgcatccgcttcggccaaggccgctatgaagacgcgctgaagctccaccgcgaggccctggaactgcgcgagcgcatccttggcgctgacaatccggccctcgtgacttcctacaaccgggtcgccactgcctcgctggaggtgggccggtacgccgaggccgtcagcgcctggcgcaaggccctggcacttcaggaggcatcctccgacccagagaccacccccatggggacggttctgttgaacctcgccgtggtctcgcgcgtcgcgggtcgactggaggaggcacgctccatggctgagcgggcgcgcgccatcttcgagcgggcccggggccccaaccacatcaccgtcatcttcgcgctctcagcgctggcagacatctccagtgaggcgggccagggcgacgaggcgctgggccttgccaccgaggccctggagcgcgtccagcgttcactgggccaggacacgccacgcgccgccctgccgctgacagtccggggacaggtgtacctgaaggcgggccgccatgccgaggcacgacgcgacctgctggacgcgctccagcggctcgagaaggaacatggcccggagggcggtaagacggtgaccgtgctgcttcccctcgccgagtttgccctggcgacccgggcttcgaaggaggcgctcgcgtactgcgagcgggcgaggaaggtcaccgagaaggcgggtggcgcggagtccccggacggtgcgagcgccctggcctgctccggggaggcgcatctggcgctgggtaccgcggcggaggcggtccccctgctcgagcgcgcccggcgcatccaaacccaatggggcgaagtcaaagacccgcgggtcgccggcaagaccgccttccttttggcccgggcgctcatggaaacgcgcgcttccccggagcgggcacgggcgctcgcgctggccgaggaggcccgggcgcggctggagtctgtgggggtccggggccagtcggagctccagacggtgttggcctggcaacggcgtgagacgaaacgatga

SEQ ID NO: 8372 - DNA, 894 bp, Myxococcus xanthus
atgagtgacgaacagcgaacaggctccctggcggcgctgctgcgggcatacgtgtctccgaagctgcgggcggagctggaggccgaggagggattcgaggcgctgctggacaaacacgtcgaggcagcacggacccagtggcccacgttgtcactcccggcagagaccttcgtgaggcacctggcccggcacctgcctgagggaaaggccgcggaggtgatgcgcatcctccaaggtgccgacctgtatctggcgtgcgcctgcaccaccggggatccggcggccctcaaggccttcgaacaacacatcctccggcacgtcccaccccggctcgggaaggtgtcgccgcccctggtggaggaagtgctgcagatgctgcgcgaacggctgctggtgggcagcagcaacacgccaccgaggattgcgagctatggggggcgagggcccctgcggacctgggtgagcatcgtcgccgcacgcatcgcctcggagttgatgggccaggacgagcgccatcagctcgtcgcggaacctcccgaggaactcgcgcggatgctggccccgagcgaccccgagtacgcgctgctgcgcgaagatgcacgccaactcctcgtcgagtcgctccgaaaagcggtggcggtgctctccgagcaggagcggaccctgctgcgcttgcaccatttccatgggttcacgatggaccggctgacgctcatgtacggaggctcgcgctccggcgtcgcgcgcaaggtcgccgatgcccgcgagcagttgctcgagcgcgttcgcatggagctcgcgccaagaatgaagcaggaccaactcgccctggagagcctcctgggactggtcagcagccgactggatatcagcctcctgggattgctggactga

SEQ ID NO: 8373 - DNA, 825 bp, Myxococcus xanthus
atgggttcagtgacagcggtcggtggttctggtgctccgaaagtcgatcccgccgaagcacagcgccgcgcggaggaggcccggcagaaggcggaggcagcgcggctcgccgccgaggccaggcgcaaggccgcgacggctgcccgggacaacctgacgcaggccaagcacgacgcgggtgccgcgcgacggcagaaggccgcggcggagaagaccgccgccgctgcacgcaaggccgcggagaggccaggacagacgcccgcagaggcgaaaaagtcgaaggaagacctcgccgtcgcggagaagaagctcaaagaggtcaccgaagcctccaggatggcggctcagaaactccaagacgcggaggagaaggcagcccttgccgcgaagagcgccgaagaggccatgcgcaaggcgaacgcggtggccgtcgaggaatccaagacgcccccctacagtcagaaggacatcgacaaggtcaagccgacgaagaacgaactcgaatcggccttcgagggcacgagtcgaaaggcggagttggagaagttgctgggattgacgcccccgcccccgcaggaagtcatccagactgtcgggagcggagcagcgcctggggctccgttcgacgcgatgaaaacgatggacgcgcaggacgtcgcccatggcccctttgggcagacacacatggactcgtccaccgacgcctggttccaccagcgacagggctccaacactggggtggtgccttccgacgcgacccgcggaaacaccgtccccatcatgccggatggcagcgccccgtccccggtgacgtcgaagcagtaa

SEQ ID NO: 8374 - DNA, 375 bp, Myxococcus xanthus
atggtgggagcgtatggactggagatcaaacgcaccgcggacgcggggcagttcaagaaagacttggcggagaccatcgcgggtgtggcgttggcgcccttgggtcctgcgggcgaggtcgggaaagtcgcgctgaagaacttcatcacggaggtgctctccagcaaggacacgtcctggacggagcaactccgcgaggtctccgccgcagtgaaggataaagcctcggcggggctccagaacttcgacaagcacaaggatgccaatggaagggacatctcgggcggcaaggattggaacacccagacagagcatcagttcgaactgggctatgacgccatcctcgaacggctccgcatgttgagtgccaattag

SEQ ID NO: 8375 - DNA, 534 bp, Myxococcus xanthus
atggcaccggcctgggcacacggcgcggacgccgctggcagcggccctcctcgtccctctgctccagcccgccaccctcaccagggtccctttcggtctgatgctggcgaggacgtcgtctacctgcaggacggcgaggccaccgtggagggtctgcgcttctgggggagcccctggcagccggcctacaacgactgggccttcaacctgccccgaggcgccgccctcgccagcaagtgggcggccatccccgagggactggatgtgctcatcacccacgggcctccggcgggcttcggggaccgctcctcggtggggggacgtggcggctgtacggacctgcgcgagcgcgtgctcgccgtgcgtccccggctacacctgttcggccacatccacgacgacggcgggctgtggcgcgaaggggacacgtgctttgccaacgtcaccacgtgggagtgcgagcgcgcgcccaccgtcctccaactcgacgcccgaggcgtgacggaggtgagcatccctcccgcccggcgctga

SEQ ID NO: 8376 - DNA, 447 bp, Myxococcus xanthus
atgaagaagatcacaggtcaggtcaagctgcagatccccgccggcaaggcgaaccccgctccgccgatcggccccgcgctcggtcagcagggcgtgaacatcatggagttctgcaagcagttcaacgcgaagacccaggcggaagccaaggaagcgctcatcatcccggtggtcatcaccgtgtatgcggaccgctccttcaccttcatcctgaagacccctcccgccgccgtcctcatcaagaaggccgcgggtctccacacggagaagaagaagggttcgggcgcgaagaagccgggcaaggagaaggtcgggcagatcacccgcgcccagctcgaggaaatcgcgaagaagaagatccaggataccaccgccgcgtcgctcgaggcctgcatgagcaccattgctggcaccgcacgctccatgggcatagacgtcgtcggctag

SEQ ID NO: 8377 - DNA, 537 bp, Myxococcus xanthus
atgaaatggtacgtggtccacacctactcgaacttcgagaaccaggcgaagaagagcctggaagagaaggtccgtttggagggccttcaggaccagttcggtgaaatcctgattccgatggaacaggtcgtcgaaatggtgaagggcgagaagaagacctctcgccgcaagttcttccccggctacatcttcgtgcagatggagctgaacgaccggacgctccacctggtgaagaacacgccgaagatcaccgggttcccgggaacggtgcagaatcagaatccgttgcccatctccgatcaggaagtggcgcggctgacgtcgcagatttccgaaggtacgctcaagccgaagcccaaggtgcagttcgacgacggcgacacggtgcgcgtcatcgacggtccgttcgcgaacttcaacggtaccgtggaagaggtcaatgcggagaagggcagggtgaaggtgctggtcagcatcttcgaccgagccaccccggtggagctggacttcatgcaggtggagaagaccgccggctag

SEQ ID NO: 8378 - DNA, 399 bp, Myxococcus xanthus
atggatccgaagcggctcgtggtcatcttctatcttctcgtcggcatcgtcctggccctcttcctggagcgtctgctcggattgctgtgggcgcgattcagctggagcgacccggtcctcatcgagggcttggactggaaggtgtccaccctggtgagctacgtgctggccgtgggactggctgtgggggcgtacttccacccgcgcacccatgcgctgtccatcgatgtggcttcggagttgatgaaggtcacctggcccacctggtcggagaccaaggcgtcgaccatggccgtcgtcgtggcgtccctggttgccgccgtcatcctcttctgcatcgataccgccgcctacaacctgatggtggagtggctgccagccatgtgggggaagttgtaa

SEQ ID NO: 8379 - DNA, 3810 bp, Myxococcus xanthus
atgacgacgttcgcggagaagattgcgcagtactcccccaagcggctcgcgctgctggcgatggacctcaagtcgcggctcgacgcggtggagggcagccggtcggagcccgtggccatcatcggcatgggctgccgcttcccgggcggagggaacgacccggcgtcgtactggaacctcctgtgcaacggcgtggatgccgtcaccgaggtgccatcctcgcggtggacccgtgaggacatggcgcggatggaccccgaggcccaggagaagctgggcgcgaagtggggtgccttcatcaacgcggtggaccagttcgacgcggatttcttcggcatctctccgcacgaagcgcaccggatggacccgcagcagcgcatcctcctggaagtggcgtgggaggcgctggagaacgcgggccaggacatgtctcggctggcagggagccgcacgggcgtgttcgtgggcgtgtacagcgatgactacgcgctgttgcaggtgggaaatccggcggcgcgcgactccagcagtgtgacgggcgccatcaactgcgtggtgccggggcggctgtcgtacctcctggacttccagggacccagcctgtccgtggacaccgcgtgttcgtcatccctggtggcgctgcatctggccgcgcagagcctccggcagcaagagtgcaccatggcgctggcgtgcggcgtcaacctcatcctgtcgccgctgtcgtcgagccgcgtgtcccgtgcgcaggcgctcgcgccggatggacgctgcaagaccttcgatgcccgcgccaacggcttcgtgcggggcgagggctgcggcgtggtcgtcctcaagcggctgtcggatgcgctggcggcgggggacaccgtcctagcgctcatccgggggtctgccgtcaaccaggatggcaagtcggcgggattgacggcgcccaacgtgctcgcgcagaaggcgctcatccgccaggcgctccagagcgcgaacctggagcccgccgacatcgactgcgttgaggcccatggcaccgggacgtcgctgggcgaccccatcgagctggaggcgctccacgaggtgtacgcccaggggcgcaccgcggagcagtcgctggtggtgggcgcggcgaagacgaacatcggccacctggagtcggccgccggcatcgctggcatcatcaagatggtcctgtcgatgcagcacggggccgtcccgccgctcgcgcacttccagcggctcaacccgcgcatcgacttcggcggtgaggccctcactgtccctacgaagctgcacccctggcccgcgcgggagacgcgcaagcgccggggggcggtcagctcgtttggcatcagcggcacgaatgcccatgtgattctcgaagaggcccccgtggccgcggcggcgcccgctgcgccttctcgcggggcgtacctgctgccgctgtccgcgcgctcaccctccgcgcttcaagcattggcccggaagtacgcggacgtcctcacgtcgtccccggagatgtcgctccgggatgtctgcttcaccgcggcgctgcggcggacccatcacgagtaccggacggcggtcgcgggggactcggcggacgctgtggcgcggcagcttcgggagttcgccttggaggggcctgctccggcggcgacggacacggatacccggcgcaaggcggtcttcgtgttcccggggcagggctcgcagtgggccggcatggggcggcagctcctcgaacaggagcctgtcttccgtgaggccgtggagcgcatcgacgaggccatgcggccccacgtcacgtggcgtctgattgacgtgctgcgcgcccctgccgaggactcccggctccaggacatcgacgtcgtgcagccggtgttgttcgccatggcggtggcgctgtccgcactctggcgctcctggggcgtcgagccggacgcggtggtggggcacagcatgggcgaggtggccgcggcgcacgtcgcgggcgcgctctccctggaggacgcggcgcgcatcatctgcctgcgcagccagctcctgcggcgcatcagcggccagggggccatgctcgcgacggagctgaccctggaggacgcgcgcaagacgctggcgggccgcgaggaccgcgtggccatcgcggtcagcaacagtccgacctccacggtgctgtcgggagagaatgccgcgctcgaatcgattcgcgccgacctggagtcgcgcaacgtcttctgccgctgggtgaaggtcgacgtcgcctcgcacagtccgcaggtggacccgctgcgggacgagctgctctcggtgctctcggcggtgcggcccggacgctccagcgtgcccattcactccacggtgaccggcgcctcctgtgacggctccggcttcgatgccgcctactgggtccgcaatctgcgcgacccggtgctcttctcctcgtcggtgctgcaactcgccgaggctgggcactccgttttcctggagatgagcccgcacccgattctgctgcccgctgtggagcgatgcctgcagcacgcgggccgcgagggcgtgacgcttccgtccctgcgccgcgaggaggctgagcggaccgtgctgctggagtccgtgggcgcgctgtaccgcgcgggactccccgtgcagtggaagcgcttcttcccggggggtgggacgccgctcccgctgcccacctatccctggcagcacaagcggtactggttggacgcggtggccacgcccgtggccgcgatggtcgagccggtgacgtccctcaagggccggccggtgagcgtggctcacggcgtcgatggccaggtcttcgagctggagctggggagcaactcgctgccgtggcttggtgctcaccggttgggtggcgtcgcggtcgttcctgcctcggcgttggtggagctcgggctgagcgccgccgccgatgcgttgggccctgggggacgggggctgtccggcgtcgagttcgagcgggcgctggtgctgccggagaccccgcggcggctcgtgcaggtccacctctcttccgaggcaggaggcaagcacgagttccacatccacagccgcgcggtgggcggggcctcgtccgaggcggggtgggtgcggcattgccggggccatgtccaggtgctcagtgccgcgatgggcgcgttggcgtccatcgacgcggtccgtgcgcgctgtgtggagcacgtcccgggcgcggcggtctacggcgagctggagcgctgcaacgtccagtacgacgagccgctgcggacactggacgaggcgtggcggcggccgggggaggcgctgggccgggtggtgctgggcgcggagcgacttcaggaggcgtcccagtatcagttgcatcccgcgttgctggacgccgcgctccagacgctggcgctcgcgctggcggccgaaccggggcaggcggcgctcttcatgcccctggggctcgaatcattcgagtgcgtccctggcagcgcggacgttcggtgggctcacgtctccatttcgcccgcgtctcgtcctgaggagcggctgggcacattgtccctgtcgccccgcagggtcgtccggtcacggtggcgcgcggtgtacggttgcggcacgtggcggtggagcggctgctcgaggtgttgggggaagtccgcgcgcaggactggttccacgacgtgtcgtgggagccgcggccggcggggacaccccagtcggcccccgcggattggcttgtgttcgcggaccggggtggttggggcgcggcattcgccgaggagctgcggcgtcagaacaccccttttgtcatggtga

SEQ ID NO: 8380 - DNA, 1191 bp, Myxococcus xanthus
atggccaaggagaagttcgagcgtaacaagccccacgtgaacatcggcacgatcggacacgtggaccacggcaagacgtcgctgacggccgccatcaccaaggtgctggcgaagacgggcggcgccacgttcctggcgtacgacctgattgacaaggcgccggaggagcgtgagcgcggtatcacgatttccacctcgcacgtggagtaccagacgtcgaaccggcactacgcccacgtcgactgtccgggccacgccgactacgtgaagaacatgatcacgggcgcggcgcagatggacggcgccatcctggtggtgtcggcggcggacggcccgatgccgcagacgcgtgagcacatcctgctggcgcgccaggtcggcgttccgtacatcgtggtcttcctgaacaaggtggacatgctggacgaccccgagctgcgcgagctcgtggagatggaagtccgcgacctgctgaagaagtacgagttccctggcgatgacatccccatcatcccgggctcggcgctgaaggcgctggagggtgacaccagcgacatcggcgagccggccatcctgaagctgatggaggcggtggacagctacatcccgacgccgcagcgcgcgacggacaagcccttcctgatgccggtggaggacgtgttctccatctccggccgcggcacggtggccacgggccgcgtcgagcgcggtatcatcaaggtcggcgaggaagtggaagtcgttggtctgcgcccgacgcagaagacggtcgtcacgggcgtggagatgttccgcaagctgctggaccagggcatggcgggcgacaacatcggcgcgctggtgcgcggcctgaagcgcgaggacatggagcgcggccaggtgctggccaagccgggcagcatcaccccgcacaccaagttcaaggcgcagatctacgtgctgtcgaaggaagagggcggtcgtcacaccccgttcttcaagggctaccgcccgcagttctacttccgcaccacggacgtgacgggctcggtgaagctgccggagaacgtcgaaatggtgatgccgggcgacaacatcgccatcgaggtggagctcatcacccccgtggccatggagaaggagctgcgcttcgctgttcgcgagggtggccgcaccgtgggcgccggcgtcgtggcggaaatcatcgagtaa

SEQ ID NO: 8381 - DNA, 849 bp, Myxococcus xanthus
atgcgtgagcgttcttccaagggcggccgtggtggtgagcgcgcaagcgaagaagtcccccagcgcgccagccggggcgagcgcggaggcggcgaagcctcccgtttcgtctacggggtgaatcccgtcctggcggcccttcgggcccggccggacgaggtggagcgcttgttcctggtggaggggcagctcggcgcccgagcggcgggagagctgctcagccgggctcgcgagttcggcattcgcgtggagaaggtgacgcgcgagcgcctgggtacgctggcggagggcggcgttcaccagggcgtggtggtcgagctgcgcggcttcaagtacgcggagctggaggatctcctggaggccgcgaaggcactgggacagcctcccctggtggtcgtgctggacggaatccaggacccgcacaatctgggagccatcatccgctccgcggatgcgctgggggcccacggcgtggtgattgccaaggaccgggcggtgcaggtgacgggcaccgtggccaaggcgtccgccggggccgtggagcacagccgcatcgcgcgggtggtgaacatctcccgggctctggaggaactgaaggaagccggcctgtgggtcgccgcggcggacgtcgacgccaaggagcccatgtggagtgcccggctcgacgggccgttggcgctcgtcgtgggggccgagggggcaggcgtccgggacggagtgctcaagcactgcgacttccgcctccggattccgatggcgggtcaggtcggttcattgaatgcatccgtttcggccggcattctgctatacgaggtcgcccgccagcggggcaccgtctccggccggtag

SEQ ID NO: 8382 - DNA, 450 bp, Myxococcus xanthus
atgcttcgtcgccaacgcctttcctccctcgccgccctgctggcggcagtgacctgctccgcgcccgtactggccgcggatgtggatccggcctcactgtatgaggtctccaccgaggggacctcgacccaggtcaaggcgggggagaaggggaccttcgtcctcgccatcaagacgaaggcgggggcccatgtctccgacgaggcgccgttgaagcttgaggtgaaggggagtcagttgactccggccaaggagaagctggtcctggcggactccgtggcgaagaaggccgagggtcaagccttcgcggaccctcgcttcgaggtccccttcacgacggccgccgcgggcaagggctccgtggacgcgaagctcgtcttcttcatctgcacggagaagatctgcgcacgtcagcagaagaccttctcccttcctgtcgaggtcctctga

SEQ ID NO: 8383 - DNA, 1002 bp, Myxococcus xanthus
atgaaagccacgatcctctcgcgctccgcttccatcccgtccactcggcgacttgtcgaggtggcgcgcgcaagagggcaccgggtgcgggtcctcaacccactccgcgtgcagatgcacctcgatgggcgcagcgccacgctctactacggccgcaagaagctggcgcccacggacgtcgtcctcccccgcatcgcccagtccatcagtaactatggcctggccgtggtgaatcagctcggcctggcgcgggtctcgctcgtcaaccacgcgcaggccatcgcgcagtcgcgcaacaagatgcgctcgctgcaactgctctcggcgcacggcatcgacattccgtcgacggtgatggcgcgcgacgcggctcacctcaaggagatggtgggcttgctgggcggcgtgcccgtcctcgtcaaactgctgcaggggcaggagaagcacggcgtcatggtgtgcgagagcctccagtcgctggaggccgcgctcgaggccgtcctggggctggggcacaatctcgtgatgcaggagtacgtgaagagcacgggcatcgacgtccgtgtgctcgtcgtgggtgggcaggcggtggccgcggttcgtcgccgcccgcgccccgggcgcctggcgcacaccctcatcaagggggcccggctggaggcgcacgagctgtcacccgcccagcgagccaccgcggagaaggccacccggctcatcgggctcgaagtggcggcggtggacctgctcgacgtgcagggccaacccaagatcttcgaggtgaacagctcccccgcgcttcctgagatggaggcggtgacgggcgtggacctggcctcgctcatcatcatccgcgcggaagcgctcgtggcgggggagccgcccgtgtccgtgccggacctgtcgcctccgtcggccctgcccgcgtcatctgagcctgcccagctccctgtggaccggaagggcacggggcgccgcgctcggaccggcgaaggcggcgcgtga

SEQ ID NO: 8384 - DNA, 771 bp, Myxococcus xanthus
  unsure (1)..(771): unsure at all n locations
aatgaaatcaacaccntgctgcagggcatccccaatggtggtgaggggcggcctcttggggggacgccgaccagcggaagtctgaacttcgtgggagggcttgaggggcttcaggaccccgaccgggagaacttcgtcatcctcctgacggacggcctgccaaactgcaacgcggcgaaccctaacagcggtgcgaacccggagttgtgcaagtgcaccatcgagggcaaccaatgccagagtggttacctcaaccgtggatgtctggacaccgatgcctccgtgactgctgtaagggagcttcatgaaaagggcattcagaccatcgtgatcggctttggtgcggagactgcggtgggggatgggccggcagtgctggaagcgatggcgcgcgcgggcggcttcaaacgtacgtgtagcgcggaacgcccgtgcggcgagggtgacacgtgcaacccgaccacggggctgtgcaaccgctccttcttccaggccgggaatcaggctgaacttgccagcgctctggaggagatcagtctggcggtgaagatcccggagccctgcctgattcggctggatggtccccagcgcccgaccgaccccaagctgctcgtggtctacgtggaaggcgagcggactccatcgagcgacagcacctggacgctgaatgacgacggtgtgcgcttcacgggacagatctgcgagcgcatcctggcctccaccccggaggcgcccgtgaagattgaagtgcgggccatccgtcagcgctag

SEQ ID NO: 8385 - DNA, 3471 bp, Myxococcus xanthus
atggacgagcagtcctccgccgcggtgcgcgaggtctttgtccggctgtacgaagagggcctgatgtaccgggcccagaagctcatcaactggtgtccttcgtgccacacggcgctcagcgacctggaagtggagcaccaggagaagaacggctccatctggcacatccgctacccggtgaaggacaccgaccgcacgctcaccgtggccaccacgcgcccggagacgatgctgggcgacaccgccgtggccgtccatccggaggacgagcgctaccaggacctgattggcaagcacgtggtgctgccgctcagcggccgcgagattcccatcatcgcggacgccgaactggtggatccgaagttcggcaccggcgtggtgaaggtcacgcccgcgcacgacttcaacgactaccagacgggcctgcgtcacaagttgccgatgctgtccatcttggacgaatcggcccggatgacgaaggagaccggcaagtacgccggcctggatcgcttcgaggcgcgcaagcaggtgctggcggacctccaggagcaggggctgctggagaaggaggagccgcacaagctgtccgtcggcacgtgccagcgcagcaccacggtggtggagccgcgcctgtcgccgcagtggttcgtgaagattgaaccgctggcgaagccggccatcgaggcggtggagcagggccgcacgaagttcgtccccgagtcatggacgaacacctacttccactggatgcgcaacatccacgactggtgcgtcagccgccagctctggtggggccaccagattcccgcgtactactgcaccgcgtgcagccctcggttgggggacgacaccgacctgccgctggattccgcgacggtgaaggtgggcggcgtggacttcgcgcgcgcggagccgattgtcgcgcgtgagcagccctcgtcctgcccgaagtgcggcggcgccacgttcatccaggacccggacgtgctggacacgtggttctcgtccgcgctgtggcccttctccacgctgggctggccgcgcaacacgccggagctccagacgttctacccgacgtccgtcatggagacgggccacgacatcatcttcttctgggtcgcccggatgatgatgatgggcctgcacttcatgggggatgtgcccttccgcaccgtgtacctgcacgcgatggtgcgcgacgagaagggcgagaagatgtcgaagacgaagaagaacgtcatcgaccccttggacgtcatcctcggcgcccccgcggacaagcttgagccgacgctcaggaacaagttcccgcagggcatgcctgccttcggcgcggacgcgctgcgcttcacgctcgcgtcgctcacccagcagggccgggacatcaagctgtccatggaccggatggctggctacaaggccttctgcaacaagctgtggaacgccagccgcttcgccctgatgaacatgggcgagttcacgctggatgagcgtcctctgaaggagcgtccgttgacgctggcggaccgctggattctctcgcggctccagcgcgccaccactgaggcccgcgcctcgctggagacgtacggcttcgccgaggcggcctccacgctgtaccagttcctgtgggccgagttctgcgactggtacatcgagctggccaagggctcgctctacggcaccgatgagcaggcgaaggactccgcgcgcgcggtgctggtgtactcgctggatcgcatcctgcggctgcttcacccgttcatgccgttcatcactgaggagatctggcagaagctgccgatgtcccggtcggtggacagcatcatgatcgcgtcgtacccggagcccgacgcggacctggtggacgaggccgccgaggcggagatggccccggtcatcgcctccatcgagggcctgcgcaccatccgcggcgagagtaacctgtcgcccgcgacgaaggtgaaggcggtggtgcagagcccggacgctcgcacgcgcgagctgctggagcgctggcgcgcgtacctgatgccgctggccggcctgtccgacgtggagattggtgcgcccggcaccaagccgccgcaggccgccgccttcgtgggcacgaacctggaaatctacgtgccgctggcgggtctcatcgacctggacgcggaacgcgaccgcctccgcaaggagattgcgcgcaccgagcaggaggccgccggtgtgctgcgcaagctggagaaccccaacttcgtggccaaggcgcccccggacgtggtcgagaaggaccgcgcccgcgtggaggagttgaaggagcgcaaggccaagcttcaggaccatctgcagcgcattgccccggagcccgccatgcccgcagcgccgccgtccgagagccgcacgccgaccgaaagcgttgagccgaccgaggccgacatcgtgactgaagccgacgtcgcgaccgagcccatcacgccgcccgagagcgctgctcgattagagacgccgcctccggccgaggggggcgctgaatacgagacgctcgccgagtccaccgaggaggaggaggaagccgctgctccggccgaggtgaaggccgcgccggatgcggaagccgaggggaacgtcgacctggcggaggagttgaaggacgagctcgaggccgtgggcggcgtgcccgaagccgcggacccccaggtgcaggacgccctggagaagctgcgcgcggggacgaaggaaggcctgtctccggccgaccatcatgacctcggcgttgcgtacatgagcatgggcctcgtcgacgacgcgatgcgggagttcaacacggcgcgcgccggtggcgacgcccgtgaggcgcccgccgccgccgagcagacggtggcctccaccgcgaaggccgtggtgaaggccaccctggccgccgtgaagaaggcgtcgtccatcgcgaaggagacggtggtggaggctgtctccgcgtccggcgaggatgaggagcctgccgctccggcgaaggcgcgtcccgcgaagaaggctgcgggcaagaaggcgcctgccgtcgcgaaggaggctccggcccagaaggccgcgggcgcgaagggcgctgccaagaaggccgctgcgaagaaggctccggccaagggcgcgaagggcgctgccaagaaggccgctgcgaagaaggctccggcgaagggcgctgccaagaaggccgctgcgaagaaggctccggccaaggtcgccgcgaagaaggctgccacgaagaagtccgccgcgaagaaggcgcctgccaagggcgcggcgaagaaggccgctgcgaagaaggctccggccaaggtcgccgcgaagaaggctgccacgaagaagggggccgcgaagaaggtcgctgccgccagcaagaagccggtgaagaaggcggcgggccggaaggctcccgcgaagaagggcaccggggcgaaacccaaggcgcgggcaaaggcccggcggtag

SEQ ID NO: 8386 - DNA, 813 bp, Myxococcus xanthus
gtcacctcgcaggccctcatccctcctgactacgagggcagcgcggaactggtcgccaaggagcagttggtgctcgcgggactggatgccttcgtccgtgtcttcaagacggtcgacccgaacgtcgaggtggagctgttgcgccgcgacggtcaggagatcaaaccgaagatggtcgccgcgcggtgtcacggacggatgcgctcgctgctcgcggcggagcgcaccgcgctcaacatcgtgcagcgggccgcgggcatcgcgacgctggcgcagcaggccgtcacgtccgtgcgtggctccaatctgcgcgtcctggacacgcggaagacgccgccgggaatgcgcacggtggccaaggaggccgtccgcatgggcggtgcctccaaccaccgcttcggcctcttcgacggcgtcctcatcaaggacaaccacatcgccgccgtgggtggttccatcgcggaggcgctgcgccgcgcgaagctcaacgggcctcggctgacgaaggtcgaaatcgaggtcaccaacctcaagcagcttgcggaggccatcgagcacggcgccgacgtggtgatgctcgacaacatggacgacgcgcagattcgcgaggccgtgaagctggcggcgggccgcgtgccgctcgaggtgtcgggcggcgtcacgctggaccggctgcctcggttggcgaagctgggcatcgacttcgtgtccatgggcgcgctgacgcactccgcgcgggccatggacctgtcgctggaaatcaccgccgcggcgaagcggcccgcgcgcagcaagcagccgaagccggcgtag

SEQ ID NO: 8387 - DNA, 429 bp, Myxococcus xanthus
atggtcgaggcccgccttcgcgtcatctacggcgacactgatcagatgggtgtcgtctactacgcgaattacttccgctatttcgagttcgcgcgcagtgagtacttccgcgcccggggtggcagctacgccgagctggagcgctctggtgccctgctacccgtggccgaggcgagctgccagtacaaggcatccgcgcgctacgacgatctgttggtcatccaaaccaccgtgagtgagttgcgccgcgcctccatcgtgttcacctacgcgctgtttcgtgacggtgcgccacgcacgctgctctgcaccggtatgacccgtcatgcctgcgtggggcgggacggcaagccgacgcggctgccggactccctcatccggctgctcgaaacgaccgggccttccccgggctcttccccttccacctga

SEQ ID NO: 8388 - DNA, 486 bp, Myxococcus xanthus
atggatcgcaacctggcaatggaggtcgtgcgcgtcaccgagatggcggccatcgcctccgcacgactgatgggccgcggcaacaaggacgagtcggatcaggccgccgtggacgccatgcgccgcgccttcgacgcgctgcagattgatggcaccgtcgtcatcggcgagggcgagcgcgacgaggcgcccatgctctacatcggcgagaaggtgggcaagcgtggcgagggtgcgcccgaggtggacatcgccctggacccgctggagggcaccaacctgtgcgcctacggccgtccgggttccatcgccgtggtggccatggcgggcaagggcgggctgctcaacgcccccgacacgtacatggagaagatggccgtgggcccgcgcgcccggggcgccatcgacctgcgcaagacgcccacggagaacctccgctccatcgcggagaagatgaaggtctatgtggaagacctccggtcttag

SEQ ID NO: 8389 - DNA, 1614 bp, Myxococcus xanthus
atgattcgcgcactttccctcgccgtggcgctggccaccctgcccgcttttgcccgacctcccaggctgacgctcgtcatcagcgtggacgcgctcggcagcgacgtgttgctacgcaaccgtccgcgcctgaagggcggcctgcaccagctcctcaaccagggcgcgtactttccttatgcgcgctacggctacgccgaatgccgcaccgcgcccggccacgccaccctctccacgggcgccaacccctggcggcacggcatcgtggacaaccggtgggtggaccgctcgacgatgaagcgcgtgatggccttcgcggacgcggcccatccggtgctggaggtgccgctgaagccgggccaggactccggccccgcccacctcatggtggagacgctggcggaccggctgcgcgtgacgacgcaggagcgtggcaaggcggtggcgttgtccatcaaaccccacgcggccatcgccctggccgggcgtgcgggacaggcgtggtggttcgacaagggcgaggggaagttcgtcaccggcacctggtacacgaaggagttcccggcgtggctgaaggcgctgaacgcgcggaagctgccggaggcgtccttcggcaagaagtgggagctgatgcggccggccgcggagtacgtgggcgaggacgaaggcctcgctgaggcagacgtctacggcctgggcctcaccttcccccacccgctggacggcgggctgccgtcgccgggccctgccttctaccaggcgttcgccctctcaccggactcgcatgacctgctggtggaggcggccaaggcggccatcgccggcgagggactgggccaggacgacgtgcccgatctgctggccgtgagcttcagcagcacggacctggtgttccatgagtacgggccctactcgtgggagatgcaggacacgctgctgcggctggacaaggcgatgggcaacctcatcgccgcggccgagcgcgccgcgggaggacgcggcaacctggtcatcgcgctgtctgcggaccacggcggcgcggcgatgccggagcagtgggccgccaaggggctcgccgcgaggcgcgtgagctcgaaggagctggcggagagcctgacgcaggcgctgcgtcagcagttcggcggcgacgtgacggccacgctcgaacagctggacgtgtacctgggcggcaagacgcaccaggggggctcagtggacgcggcggtgcggcgcgcggcggcggcgtggctggcgaagcacccgtcggtcatcacggctgtggctaatgacgacctgttcaccgcgccggacaccgagggctacctgacgctcatgcgcaagagctactaccccgggcgcagcggcgacgtgctcttcatgctccggcccttccacatgctccactacatccccaccggcaccagccacggcacgccgcattcctatgattcacaagtgcccgtcgtcttcgcgggcaagggcgtgaagccgggcatgtacctggaggagatcgaccccgtggacttcgcccccaccctgtcggcgctgatggagatgggcatgcccgcttcggcggagggcaagccccgcgcggaggtcctcacgggcaagtga

SEQ ID NO: 8390 - DNA, 1254 bp, Myxococcus xanthus
atggtgaccgcgggggacgccttccagcgcctgggaacgcggagcttcgtggtggacccacagcggccggaggacatggcgcgcttgctgcgagagcttccagcgctcgcggctgggcacgaaggccgggcgctcttcctgtggggcctcgacgaaacgttggatgggcagacggcagtgcccgcgtccacggtggcggcgctgcacctggtgaaggccctcatggaggtgtcagggcatgcgcggctttgggtggtgacgcggggcgcgcaggtcacgggcgtgggaaccgaacgtgtgtcgctggcccagtcacccctttggggcatgggccggagcgtctcgctggaacagccgggcgtttggggcggcctcatcgacctgccgccgactcggtcgccggatgaagtcacctcggtgctgcgggaagtctccgcgttcggaacggatggagaggaccagttcgccttccgcgatgggcgctcgctggtcccccggcttacacggggaagggcagggacggccgaggaggcactgcgcctgcgctcggatgcgacgtacctggtctcgggcggcctgggcgggctggggctgaaggtggcgcggtggctggtggagcggggcgcgcggcacctggtgctgctgggccgcagtggggtctccggtgcggacgatgcggcgtcggtgcggcgccgcgaggagctcgagtcgatccgggtgatcggggcgactgtcacgcccatggccgtggacgtagcggaccgcgagcggatggcggcgctcctgcgcgacatggcggcgacgctgcctccgttgcgcggcgtgattcatgccgccgcgctcatcacggagtgccggttggaggacctggatgtcgccgccacgacggcgatgatgcgtccgaaggtgctcgggagctgggtgttgcacgacctgacgcgcggcctctcgctcgacttcttcgtgatgttctcgtcgacgtccacgttgtggggcgcttccggcttggcgcattacgcggcgggcaaccagttcctggaagcgctggcgcatcaccgccgggccgaagggctgcccgcgaccaccattcactgggggacgtgggacgagattggcggagagcgcgccgacaacgcgcggggctacgcccgcttcgggctgaaccccatggcctcggagcgcgcgctcgatgcgatgggacaggtgctgcggtcgggcgcgagccataagacagctgactgcgtggactggtga

SEQ ID NO: 8391 - DNA, 1416 bp, Myxococcus xanthus
atgcaccacatgccgaggacaactggaatgaatgtcgccgtcgtgggaggtgggatttcggggttggccgtcgcgcatcatttgcgctcgcgcggtacggatgccgtgcttctggagtcctccgcccgacttggcggcgcggtgggcacgcatgcgctcgccggctacctggtggagcaggggcccaacagcttcctggaccgcgagcccgcaacgcgggcgctcgcggcggcgctgaatctggaggggcgaattcgcgccgcggacccggcggcgaagcgtcgctatgtctacacgcggggcagactccggtcggtaccggcctcgccgcccgcgtttctcgcatcggacattctgccgctcggcgcgcggttgcgcgtcgctggcgaactgttctcccgccgcgcgccggagggtgtggacgaatcgctggccgccttcggccgccgccacctgggacacagggcgacgcaggtgctgctcgacgcggtgcagacgggcatctacgcgggcgacgtggagcagctcagcgtcgcggccaccttccccatgctggtgaagatggagcgcgagcaccgcagcctcatcctgggcgccatccgcgcgcagaaggctcagcgccaggcggcgctccccgcgggaacggcgccgaagttgagcggcgcgctgagcacgttcgacggcggattgcaggtgctcatcgacgcgctcgccgcatcgttgggtgacgcggcgcacgtgggcgcgcgcgtggaggggctggcgcgcgaggacggcggttggaggctcatcatcgaggagcacggacgccgcgcggaactgtccgtggcccaggtggtactggcggcgcccgcgcatgccaccgcgaaattgctacgcccactggatgacgcgctcgccgccctggtggcgggtatcgcctatgcgcccatcgcggtggtgcacctgggcttcgacgcggggacacttccggcgccggatggctttgggttcctggtgccagcggaggagcagcggcggatgctgggcgccatccacgcgtccaccacctttcccttccgggccgagggcggacgcgtgctctattcctgcatggtggggggcgcgcgtcagccagggctggtggaacaggacgaggatgcattggcggcgctggcgcgcgaggaactgaaggcgctggcaggcgtgacggcgcgcccctccttcacgcgggtgttccgctggccgcttggcattccccagtacaacctgggacacctggagcgcgtggccgctatcgacgcggcgctgcaacgcttgcccggcctgcacctcatcgggaatgcgtacaagggcgtgggcctcaacgactgcatccgcaacgcggcgcaactcgcggacgccctggtcgcggggaacacctcccacgccccgtag

SEQ ID NO: 8392 - DNA, 420 bp, Myxococcus xanthus
atgacgggcgtggccacggagatgtgcatcagccgctatctctcgctgctgtccactgcctcggaaatccaggcattcaaccgcgtcaccacggcgctccaccaacaggatgaagcctcacacgtcgacctgttcgggaccctggcacgtgacgtgttcaatgccctggagcccgtgcagcaagagttcgtgcgtgaaatccttcccttgccatggctctggttcagcgaaggagaagcggatgtctggcgttcggtgctgctgcaactcggcatcccccgcgcggatgtgatgatggacgactgcatcgccaacaagctcctgagcgccaatgaacgggcgatgacggatgcccagaagttctcggaggcgctgggcatcgacaacatccattgggaccgcgccgccgcgttgctctga

SEQ ID NO: 8393 - DNA, 3218 bp, Myxococcus xanthus
atgccccattccatcgccagcaccgtcccggaggcaggtccaccgctggacgtcgtcgaactcttcgtccggcaggcatcacgcaccccacatcgggtcgcgatatcgacgggaaccgtccagctcacctatcaagagctcgagcggcgcgcgcggtccctgcacgcgcggctcgggttgctcggggcagtcccccagacgccggtgggcgtcttcgccgagcgcactcccgaggcgctggtagcggcgctcgccgtgctcatggccggctgcgtctacgtccccatcgatccggcataccccaccgagcgcatcgactacatgctccaggacagtggcgcgccgctcgttctcgggccccacacgcaccgcgacaccaggaacctcgccgcgcgattcctcgcactcgacgaggagaacgcgccccccacctcactttcagaagcccgccaggcgccaccccatcctgagtcactcgcctacatcatctacacgtcgggctccacgggactccccaagggggtgatggtcgagcacggcgggttgctcaacctggtcctggaccacgtcgcagcgttcgatgtcgtccccgaggaccgggacctgctcgtcacgtcgccgtccttcgacgcgtcgatgttccagctgttcatcacctgggcgacaggcgccaccctgctcctccccccggagcacgttgtcacagaccccgatgcgatggtcggctggctcaacgaacaccgggccacgctcctgtccatgcctcccgcgtatttgcatgcactgggccggcggcccattccttcggtgcgcctggtcaacaccggaggtgacgcccccatcgaggaggatgccctccactacgcacggacgtgtcgctatgtcagtacgtacgggcccaccgagacgaccatctgctcggcctatcacgaggtccacgcagacgcgtcattcccagaaggcatccccctggggcgtcctgtccgaaacgcctcgatgttcgtcctcgatgaggcgggaggcatctgcccaccgggccagctcggagagctctgcatcgccggccagggcgtctcacgtggctatcacgcccgccccgagctcacggcgcagaagttcgttccccacccgtaccaccccggcgcgcgggcataccgcacgggcgacctcggctatcagcggtcagacggcgtcttcttcttccgtgggcgcgtggaccggcaggtcaagattcggggttatcgagtggagcccgaggaggtcgagtcgcggctccaggcgctcgaaggcgtcgagcgtgccgtggtgctgcccgtgggcgccaatgccagctcgcggaggctcgtcgcccatgtggtgggacgtccagggttggagcccgtggcgctccggcgcatgctggctcgtgagacgccggcgtacatgctccccagccggattcacgtgctggatgcgtttccccggacgcccaacggaaagattgaccttgcacgcctgcaagtgctcgagccccgaaggtccgcctcccatggcgagccacgaacacccgaggaggaacacctgtgcgcgctgctcgaggaaatcctcggggtcagcgtggaggccgaccagggcttcttcgaggtgggcggcgacagcctgagcgcggcccggttcatcgtcgaggcacgcgcgcggcaccgctacatgctgccgatacaggccttgctgcaaggggccacgcttcgagcgctcgcgcgagcgctggtcactgcgccacaggcacccgctccggaggtggcacgactgccagaggcgcctggatatcccgcctcggacgcgcagcgccggctgtggctggtgcacgaggtaaatggtggctcggcggcctacaacctcgtccatgcgtggtgggtggacggagaactggacgtcgccctgctccgccgcgccctcgatcggctcatccagcggcacgaagccctgaggacacgcttcgacctcagggacggcgtactggtgcaatgcatcgagcaggaagctcgcgtcgactggctggagccccaggggacgccggccccggagctgttcctggaggcagaggccgcccacgcattctctcttcgcacaggtccgttggtccgggccgcggtcctggccgtggccccccaaagatggctcttcaccctcaacatccaccacatcgtctgtgatggctggtcgatgggtgtcatcacccgggaactggagcacacgtatcgggcactgcgcggcggcgcctcgcctcccgtcgtcccgctccccctccagctccgcgacttcaccgcgtggcagcggcaacgcgtggagggccccgctggacgcgatgccgcgcactactggcgcgcccgactggcggaggaagggggctcgcccccgctggacctgccgctggaccggccccggcccgcgcgccccacgcaggcagggcgcgtacaccaggtgcgcgtgccccccgagcaactgcgcgccctggagaacctggcccagcgcacccggacgaccttgttcgtggcgctcaccgccctggtcaagctgctgctgtaccgggagacacggcagagtgacatctccctcggggccccgctggccgagcgagaccacctggacctggcggagcaggtcgggttctacgtcaacaccatcgtcctgaggacccggctcgacggacgggaatccttcgttcaactcctcgagcgcgtccggcagggcagcaccatggcgcagcaccatggcctcctccccttcgaccgggtggtcgaggcgtccgggttgcctcgtgagccatcccgctcccccctctttgacgtgatgattgcgctccagcaggaggagcatcgcgccctgcgcctggcggggaccacctgcacccgcgtggagattccccaccacacgagcaagttcgacctcagcttcgacttcgtccggaccggcgaagcgctggtcatggagctcgaatacgccacggatctattcgacgcggaccgcatcgagcgactcgcgcagcgccagctccagctcctgggcgaggtcctctgcaaaccggatgcacccctggacgcgctgcagcccctgcctccggcggagcagaccttcatcctcgagatgttcggggggcgccgccttcccacgcccgctcccgacggcctgctcgccggcttccgtcacgccgtcgcgaaggacggaggccgccccgcgtt

SEQ ID NO: 8394 - DNA, 780 bp, Myxococcus xanthus
atgtggtgcatccggttaccagcgtgcactccctggtcgtcaacacgcgtgttttgccagcggaaggcattcagcgcgttaatgccatgcatgcgctacgtcatcaccggagcgagcagggggattggtttcgaattcgtccagcagctcctgctgcggggcgataccgtcgaagccggggtcaggtcgccagagggagcacggcggctggagccgttgaaacagaaggcgggcaaccgcctgcgcatccatgcgctggacgtgggagacgacgacagcgtgcgcgcgttcgccaccaacgtgtgtaccggtcccgtggacgtgctcatcaacaacgccggtgtctccggcttgtggtgcgcgttgggtgacgtggactacgcggacatggcgcgcacgttcaccatcaacgccctggggccgctgcgtgtcaccagcgcgatgctgccgggcttgcggcaaggcgccttgcggcgggtggcgcacgtcacctcgcggatgggctcgttggcggcgaacaccgacggcggggcctatgcgtaccgcatgtcgaaggccgcgctgaacatggccgtgcgctccatgtccacggacctgcgcccggagggcttcgtcaccgtgctgctccaccccggttgggtgcagacggacatgggcggcccggacgccacgctgccggcgccggattcggtgcgcggcatgctgcgggtcatcgacgggctgaacccggagcacagcggccggttcttcgactaccaggggaccgaagtgccctggtag

SEQ ID NO: 8395 - DNA, 303 bp, Myxococcus xanthus
atgtggaaatcagcggcaacctcgaggacatcgcgaacagcggggcgttcaccagcatcgccaacgggcgacgtggggcaggcggtgacgcagcttggcggcaaggtcgacatcaaggccaccgtgcaggacaagaccacggtgaagggggacatcggcgtcggggtccacgccggcgtggtcggcgccgaggcgggggtcaccaccgagcgcaccacggtgggcgaggagcacgagctcaccgccgcgcagctcgtggagctgtacctcacgcagcgctggtccgccggagtcgccagctga

SEQ ID NO: 8396 - DNA, 201 bp, Myxococcus xanthus
atggtgacgctccactcgctcccacgcctgcagcgtctggcagtggcggccaccgtcggcgtgggccagcccgagggccggtccgccagcgagcgcaccctcgccgccgagtggcgtgtctccgtggccgaggtgagtcgcctgcgcgagctggggctgcgccgactgcgtaaggctctggagaagatgccatgcccgtaa

SEQ ID NO: 8397 - DNA, 201 bp, Myxococcus xanthus
atgctctacctgcataacacgaagtccgagcgttcctacttcggcggcaagatcaagtcggcccgccaagtgcgcaccaacgaccgcatccccgatcgtatcgtcttccggttcgtcccgctgtctgaagccaggggagttcgctggaggggaattgaccacatcaacgcccatcagagcggtgtggtggaggacgaataa

SEQ ID NO: 8398 - DNA, 1257 bp, Myxococcus xanthus
atggtccacacgccactcacggaggacgacgccgcgcccgtcgagttggacgatgacgatttcgaggaggcagtggttgcgctcgcccgggatgtgcggcccttctccaatcccctgcgcgaggcccgccaacgcttcggcgttcccgaacgcagcggcgtgtacctgtatcagcctcgcggcccccggctcatcccccagggcgaagcgatggactcggacagcccgcgcctgctggattcctacgcggatgacgacctgacacgcgcctatggccgctggtgcgagcgcaagtcccagcccggcgactgcctgcacctgctggccgacggcccgctgctggccagcgacggcaaatactcgctggccatggccatcgccatggactcggtttgggacgagacggccgaggcgctgcgtgacatggccgaccctcaggccctgctcgcgacggtcagcgcctcggtcagcatgtatctgctcctctggtcgcttcccgagccagtgagcaagggcctggccgcgctgctgacggccacagccatcgcctacctgggcgtcgacaccgtgtggcgcatcctggacggctgggtgacgctggtgcgcgaggtggaacgggccaccaccttcgtgcagctcagcgaggcgggcgagacgtacggcgaagtcctcggggagaacgccgcgcgcgtcttcgtcatgctggccacggcggccatcggaaacacggcgggactggcagccaatacgtcgcggctgccgggctccgcgcaggcggccatcgcagtggagacgcaggcgggctaccagtacgtagccatgggaggcgtgcagtcggtggcgatggcggccgagggcttcaccatcgcgctggcccccaatgcggtcgccatggcgaatcgggggatgggcagcggaggctcaaggggaaggagccaagagcaccaccttgccacggacaagaacagtgtctccaccgctcgcggcggaccctggacgcctgaattcaggaggctcttcaggaaggctggaatggagttgaaagaccctgagaacgtcgttgatgttcctggccacaaggggcctcacccgcaggagtaccatgaggcggtttacgaaagactccgcgatgcgacaagaacgtgccgcaccgtggttgcgtgccgcaaatcgctatcggccgcactcaaggagctggccgaggaagtcacgacgaagggaacacgactccacaggctcgtaaccaagggcaagtga

SEQ ID NO: 8399 - DNA, 654 bp, Myxococcus xanthus
atgcccaagcgctacttcaggctcaaagaggacatgcaagccgagaactgggacctgggagaccccctggacgagaaaggccaagaggtggacgacccctacctatttgcggccggacagcctgttcgtgttgcaggccgactgacgattcccgtcgacgcgcccgggaggcgattggacttcggcaccgcgggcatcggcgctgcacctatcgtccatgtccgggtggccaccctcttcgcggagctagcccccgacgacgtgcagctcatccccgtggacatccagggccatccggaccagtacctcatcctggtggccacgaagcgcatccgctgcattgacgacgaagcgtgcgaggaggtgcgctactggaagccggagcatgggcagccagagcggattggcgactacaaatcggtgatggggctgcgcatcgacgcctcgaaggtgggcgccgcgaaggtcttccgcacggaaggctgggacatcgccctcatagtgtccgaggacatcaagaaggcccggagcgcccgaaggctaccggcgcgaagttcacgcaggtgtagcccgtgcaaacggcccccatattctccgaggcgcccatgcacccggaggcagggggatcttggggtcttgacgtcatccacatga

SEQ ID NO: 8400 - DNA, 111 bp, Myxococcus xanthus
atggcctccgcgcccacgctggacgaggccgccaaggtgctcggcatcgacgcgcccacactgtggtgcaagcgcaagaagtacgagtccggaggcaagggcgagggctga

SEQ ID NO: 8401 - DNA, 288 bp, Myxococcus xanthus
atgacgtcccagatgtccgtggagctgcgcaacgtgttgcagcgcggactcgagaaggagctgcccgcgagcctcgcgttcgaccaccccaccgtcgtggcgctggcgaagcgcctggcggggagcgtcaccgcggtggacatcccgttgcccacggtggcggcggctccggtgcagaagtcatccccggtgcctgcggacgtcggcgacctgtcggagcggctggcgcaagtctcggagctgtcggacgacgaagtcgagcggttgattgccctgaagttgagctga

SEQ ID NO: 8402 - DNA, 2439 bp, Myxococcus xanthus
gtgggcaacgtcgaggcggggcggcaggcgcgttacgtcgtggacacggaggcgcctcaggtggccgcgacgccacgggggagcacgttcaccgggacgcgcgcggtgacgctggcgtgtgacgacggtgagggcagcggctgcgcggccatccactacaccaacaatggcgccattccctccctggactcctccgtctatgaggagcccctggtgctgacggccaccactcgcgtgcgcttcatcgcggtggactgggtgggcaatgtctccgaggtggtgtcggagctctacacgcgggagacctccggcgaggaccgcgtggcccccacgacgacggcgacgcccgctggcggtgtctactggagtgcgcagtccgtcgtcctgggctgcgcggatgacgccgagggaagtggctgcgcggggacgtactacacggtcgacggcagcgcgccgacgacatccagcatccgctacacgggccccatcaccgtggcctcctccaccacgctgcgtttcttctccatggacatcgcgggcaacgtcgaaccggtgaagtccgagcagtacacgatggacacggtgccgccggtgacgaccgccacgcccgtgggcggcgtctaccaggacgccgtcaccgtgacgctggtgtgcaacgacggtggttcgggctgcgccgcgacgcgctacacgctggatggctccgcgccggtgtcgagcgcgttgctgtacgagcggcccatcacgatcactcggaacacgatgctgcgcttcgcctccacggatgcggcgggcaacgtggagcaggcgaagcaggagtcctacgtgctgcccgacctggaccggacggcgtccgagcagatccaggccgtgcgcaacgcggcgaatggcccggtgaacctcatcatcaacggagcccgcatcaccttcatcaaggacgccgtgggcaacgcggtgaacgacgcggcgggtttcttcctccaggcggagcggaccgggcccgccgtcttcgttccggtggacccagcgacactatcccccgttccgcgggtgggagaccgggtgcgtgtcaccgtgaatgcgaagagcgtcgtcaacggccagacgcgcgcgagcctctctggcttcaacgtgctcagctcggggcactcggtgtcggagcttctccaggacgtcagcgacgtggacgtcaccatcggtgggacgcagcccgagtatgagtccgagtacatctccatcaccggcaccatcggcgcacctgggttctccgccgcggggctggggcatctgcaggcgccgctgacgacggtgggcgtgccggcgggctccgtggccgcggccgtgctgcgcctgcgcgtggtggagccccttcgcgacagcttggcgttgacgtcgggctgctcgctgacggtgacgtctccgctctggatcttcatgtccggcacgcggatgacgcccaccatccagcccaccgtgtggacggcgagccaggccaccgtgcactcgtgcccggcgccccgggtcatcaacgcatgggccacgacccgcaacacggtgatggtgcgtttcggccgcccgctcgacgcggcgagcctggtggccaacggcagtcagttctccatccccgggctgagcgtcacccaggcccagttgcagagccgcaccgaggtcgcgctgacgaccagcaaccagacgccgcgccagcagtacaccgtgacggtggcgaccaccgtgcgtgacgcgcgcggcgtcgcgctggatccttcggccacgcagacgagcttcccgggctacgtgcagacggcgcggctccgcctctccgaggtggcgcccgccgttccccagaaccgcgacctggtggaactcgtcgtcctcgcgagtggctccgtccagggcgcgacgctgacggatgggaacacggtgctggccacgctccccgatgtgcaggtgtcgacgggcgacatcatcgtcatccacctcaacccggaccgcgtcacgctcgggtgggacgcacccgcgtcggagacgaccagccgggccgaatacccgcggagccagtacgccgcgaaccatgacacggcctgggacttccaagggggtacgacgggtatctttccgggcaaccgggtccttcgcatccgggacacgttcggcaccacccagcacgccctggcggtcatcgagaccaacgacgccttcgcgaactaccccacgatgctccagtcgctccaggcagagggccagtggtggccggcggactgctccggtgtgccctgcgactatccggatgcgtgggacgtctcggtggactggacccaggccttcggcacgccggggctggccacgtcgttggggcgaaacgggcagggggacacggactcggcgagtgactggtcggtgagcatgtcctcgttcggctacgccaacccgttgccgtag

SEQ ID NO: 8403 - DNA, 1164 bp, Myxococcus xanthus
gttcgtttcgagctcctcaccaccgaccccacgggcgcccgtgcaggcatcctgcacacacgccggggttccttcaaaacccccatgttcatgccggtggccacccacgcgggcttccggcacctggccatggaggaggtgaaggaggcgggcgccagcatcctgctggccaacacctaccatctgatgctccggccgggcgccgaggtcttcaagcgcttcggcggcatccaccccttcatgcagtgggacgggggcgtgctcaccgattcgggcggcttccagatcttctccctgccggaggaccggctcatcacggagaagggcgcccacttccgcagcttctacgacaacagccggcagctcctcagccccgagtcgagcatcgccatgcagcaggccatcaactcggaaatcatgatggtgctggacgtgtgcatcgactcgcggaccgacgaggccggcacgcgcgaggccatggagcgcacccaccgctgggcggtgcgaagcctggaggcgaaggcggcgcgggacaccgggcaggcgatgttcggcatcgtccagggcggcgtcttccctcacctgcgtgacgagagcgcggccttcctgacgaagctgcccttcgacggcttcgccattggcggtctggccgtgggcgagacgaaggtggagcgcgagtccatgacgttgcgcgccaccgcgtccctgcccgccgacaagccgcgctacctgatgggcgtgggcacgcccacggacctggtggaagccgtgttgcgcggtgtggacatgttcgactgcatcatccccaccaagatggcccagcaggggtatgcgtacacgttcagcgggctcatccgcatctcccgcagcgtgttccgcctctccgacgagccgctggacgcggagtgcgactgctacgtgtgcaagcgctacacgcgcggctacctgcagcacctgatgcggggcaagcaccacctgggctcgcgcttcctgtccgtgcataacgtccggcactaccagaagctgatggggcgcatccgcgagggcatcctgagtggtacgtacgcgcaggtgtaccgcgagctgaaggcggccatcgccacgcccaaggacttgaaggacgaggccaacgcgcgcgaggtgacgttgaaggaggtcgggtga

SEQ ID NO: 8404 - DNA, 831 bp, Myxococcus xanthus
aacccgcgcgacggcgacttcgagctcatcaccctgcgcaatggcgctcgcgccgtgcggcacctgggccatggcgaggtgatgcacccctccgtggggccgtggcaggaagcgctgcgcctctatgtggagcaggcacggctggcggaccggctgcgccagcccgggccgccgctggtgattcatgacgtggggctgggcgccgccaccaacgcggtggccgcgctcacctgtgccaggagtctgggcgcggagcagcgccggctgctggaggtggtcagcttcgaggtggacctggcgccgctgcggctcgcactggcggacgccgagggctttcccttcctccagccgttccgtgacgcggcggagacgctgatgcgcgacggggtgtgggaggcggaggggctccgctggcggctgctgctgggggacgcggtgccgcacctggacggcacgctgcccgtggcggacctcgtctacttcgacccgttctctccggcgtccaatccggagatgtggaccgaagcggtgctggcccgcgtgcgccggcactgccgcgaggacggggaggggacgctgctgctcacgtacagcgcggccacgcccacgcgggtgacgttgctgctggccgggttcttcgtgggcgcgggtgtgtcgacggggacgaagggcgagacgacggtgggcgccacgcggcgtgagtcgctggaggcgccgctcggtgagcggtggctggagcgatggaagcgctcgtcatcccgggcgccgcatggtgggcagctcacgcccgacatcgaggcgcgcgtgctggcgcacccgcagtggcggtga

SEQ ID NO: 8405 - DNA, 867 bp, Myxococcus xanthus
atgcacgacgcccttcagatggaggactggggcggcaccggtccggtgctgcacctggcccacgccaacggctttcctccggggtgctaccgcaaactcatcgagcacctgaagccgcgctaccacgtcttcacgcttcgtacgcggtgcctcgtgccgggctccgacccgcgcgagctgcggacctgggatgacatggcggatgacctgattcacgccctgcgtgctcacggcgtgcagggggtcgtgggcgtggggcacagcatgggcggcgtggcgacgctgctggcctccgcgaaggcgcccgcgctcttccgggccgtggtggcgttggacccggtattgttcacgggggcgcgggaatgggcgctccgtgccttgacgctgctcgggctgcgaagccgcgtgccgcccgcgagtctggcgcggcggcggcgtgagtcatggggcgctcgtgaagaggccgcgcgaagctacggcaagaagccgctgttcgcgcgcttcgacccggagtgcttccaggactacatcacccacggcctcaccgaggccccgagcggtggcttccggctgaccatccccaaggcctgggaggcgcgtgtcttcgagacgtctccgaaggatgtctggcgcgagctgggcaccgtgaacgtcccgtctctggtgattcgcggcggtgagtccgacacgctgacgcgcgacgcactggagcgggcccgcctcaccttgaatgatccccagacggaggagcttcccggcacggggcacctcttcccgctggagcagccggagcgatgcgcccagcgcatcgtcgagttcctcgatggcctggagtcggcccgcgcggctgccagggccgtgcgttga

SEQ ID NO: 8406 - DNA, 1599 bp, Myxococcus xanthus
atgttcaacgtcatcaacgtctccaaggcctacgggcccaagaagcttttcgaggacgtcaacgtcacgttctcgccgggccgccgctacggcctgaccggtccgaacggggccgggaagtccacgttcatgaagatcctcgccggggacgaggaagcggacatgggcaacatcgtccggcctcgcaagctgggaatcctgcgccaggaccacttccgctacgaggacaaccgcgtcctcgacgtggtgctcatgggcaaccgcgccctgtgggcggccatgtccgagaagaacgagctgctggccaagtccgacatcaccgaggaggacggcaaccggctgggcgacctggagggcgtcatcgccgaggaggacggctactcggcggagagcgacgcggccaccctgctggcgggccttggcatcgaccaggcctcccacgaagagcccatgaagcagctcaccggcggcctcaagctccgcgtgctgctcgcgcaggcgctgttcggcaagccggaaggcctgctcctcgacgagcccacgaacaacctggacatcgactccatccgctggctggagagcttcctccacgactacgagggcgtgctcatcaccatcagccacgaccggcacttcctcaacgccatctgcacgcacatcgcggacatcgactacgagaccatcatccactaccccggtgggtatgacgacatggtccggcagaaggcgcaggtgcgcagccgcgtcgagtccgagacggaggagaagaagaagaagattgcccagctccaggacttcgtcgcgcgcttccacgccggcacccgcgcctcgcaggtgcagagccgcatcaagcagatcgacaagctgaagtcggacgacctcaagcgctccaacatcgcgcgcccgttcatccgcttcgaccagaaggtggtcagcggcaagcagacgctgatggtcgaaggcatccacaagtccttcgagggccaggaggtcatcaagcccttcaacgccctggtctgcaagggcgagaaggtctgcgtcatcggccgcaacggcgtgggcaagtccacgctggtgaagatgattgccggccagttggagccggacggcgggaagattggctggggccaccaggcctccgtgggctacctgccgcaggaccaccacggcgtcgtgcgcaagggcaccacctgcttcggctggctgcgtgacctgcacgacaagctcaccaacgaggagatctccggcgtgctgggccggatgctcttctccggtgaggagcggatgaagaacaccgacaccctctccggtggtgagacggtgcggctgctcctgtccaagctgatgatcatgcaggacaacgtgctggtgctcgacgagcccaccaaccacctggacctcgagtccatcgccgcgctggccgaaggcctccagaagtacgagggcacggtcatcgtcgtcacgcacgaccaggagctcatctccgaggtggccacccgcatctggtcgctccaggcgggcaaggaagtgctcgacttcaacgggccctactcggagttcgtggagaagcactccgacgtcgccgcgcgccgccggtag

SEQ ID NO: 8407 - DNA, 1188 bp, Myxococcus xanthus
atgatcttcttcccgcgtccgccgcatgcgcggatggagttgctcggggacttgttggcttcgcgccccgcgttcatgcggggcttcacagacccttcggcgcgtgcgcgcatcgtgcgttggatttcgtccgagccgcggatggcgcggcagccgtggcccgtgccgtcgctgtcgacccaagccgaactcgcggagtggttgggggtgacaggggcgcaactggactggctggcggatgtaccgggcatcgagcgcacgtcctcgccagggcggtggcggcgctaccggtacacctggattccgaagcgcagcggcggtgagcgcctgttggagcggccgggattggacctggtgctggtccagcgcaagctgctccacgacattctggaccacatcccgccgcacgacgcggcgcatggcttcgtcgcggggcggagcgttcgtcgtttcgcggagcctcacgcacggcaggccgtcgtggtgcgagtggacatcgaggacttcttcttcgcggtgcggcccgcgcgaatctgggcggtgttccgcacggcgggatatccggacggcgtagtgcgcgcgctcgcgggcctctgcacgaaccgcacacccagcgcggtggtgtcgcaggcgcggcggccggattcactcgccgatgcgagcacgcgctggcgtctggcgcggaggctcgaatcgcgtcacctgccacagggggcgcccacgtcacccgcgctggccaacctcgcggcgtaccggctcgacgtccggctgtcggcgctcgccgaggcgatgggcgcgcggtacacgcgatacgcggatgacatggcgttctcgggtggtgacgcattggcccggcgcacgcacaagttgctgcggtacgtgagccagattctccgggaggagggcttcacgccgcgcacagggaagacgcgggtgatgcaccggagcacccagcagcggctcgcgggcgtggtggtgaatgatcatccttcgattcgccgtgtggactacgagcggctgaaggccattctccacctgtgccgcacacgaggccccgcgagtcagaacaccgagggccatcccgacttccgagcgcatctgctgggacgcatcgcctgggtagcgcacctgcatccagcccggggcgcgaaactgcgcgccactttcgaccagattgcgtgggactga

SEQ ID NO: 8408 - DNA, 288 bp, Myxococcus xanthus
atgccgctggagggcatgatggtgaagcggcggttgcccgcagagccaggcgaggtccccatccactgcgacatccatccgtggatgcgcgcgcgcgtgcgcaccttcagccatgggtacttcgcgaccagcggcgcggacgggcgcttccaactggaggtccccgagggcacccacaccctggtcctctggcacgagcggcttccagaacaagcccgcaccgtgacggttcgcgccggcgagcgcgtccaggtggacgcggagtggccggtggccgacctgaagtag

SEQ ID NO: 8409 - DNA, 126 bp, Myxococcus xanthus
atgcgcggcctggaggcgccccgcaaggcggcggttcggcccatcggcatgcaggagatggggccgaccctgtacgagcagctccgccgcgcgctggtggagctgacgcccgtctcgtccaactga

SEQ ID NO: 8410 - DNA, 1383 bp, Myxococcus xanthus
atggtgcgcaacaagcaggagggcccgctggacgaaggcgccctccgtgagctggtggccaccaacaccgtgaatggccgcagcttcttctggcagcagggcatggcggactggaagcgcggttcggacatccccgagctggccggcctcttcgagccgccgcccgccgtcgagccgcccccgccgccgcccgccatcgccgcgccgcctccacccgagcctgcacgcccctcgcgcggcgcgcccgtgcgccgggagccggaaccgcaggccttcatcccggagccagagcccgagccgcggcacgccgagtccgagcagccctggccggacgaggaagaggaagcgccggacaacacgtattacggcgaccccgtgcagcgcgcgcagccgcagcctcagcagcaggcccaggtgacccgccgcgcgcagcagccgcagccccaggccgccaacgccgcgccgctggacgacgcgctgttctccgacctggacctgccgggcaaccgcaacggcggtgacggcgaggagccccaggacgacggcggcgtgccgtaccccgatgacccgcgggccgcgctgggcggcggcgaggatgacgacgaaggcaaggccgtggaggacacgcgccacttcgccaagaagtcgggcgtcacgcgccgcaaccccgtttggaagtacgccctcttcgcgttgctgctgctcatcgtcccgctgggtctggcgtatgtcctgtcggagacgctgggcgtggtgccgctgcgcgtgcagacggtggacgccagcggcaacgcggtggagcagcccgtcttctcgtcggaaggtgtgggcgcgctgcgcgacaagctgatgggccgtgagccgccgcccgcgccccccaagggcaagcgcccggtgcccccctcggagggcaatcgcccggccgccgcgcccgctgacaccggcgcggttgcggacccggaggccgccgcggcgccgtccaagggggcgctggaggccgtctacgtggacccggacaagaaggacgtggacccgacggtgcgcagcggcgaggaagtggccgccgcggacaccgaggaagtcggcggcccgtccgacgaagaggtggagcgcgtgctggcgaagacgcagcccgccttccgtgactgcgtggaggccgaactgcggaagaacccgtccttcaagggcggcaaggtgacgctgacggccaccgtggggaactcgggcacggtgaaggcggccacgttcgaccgcaaggacctgaaccgcaacagccccgtgggcacctgcatccgtgaccgcgcgaaggggatggtcttctccgccttcgctggcgaggacgtggacctggagattccgctggtcctctccaagtcgatgtag

SEQ ID NO: 8411 - DNA, 1254 bp, Myxococcus xanthus
gccattcaggcggtctggagaatcgagtcggcgcgcctcatcgcgggtctcgcgcggatggtgcgcgacgtgggccgcgcggaggaactcgcacaggacgcgctcgtcaccgcgctcgaaaaatggccggagacgggcgtcccggacaacccgggcgcgtggctcatgaccaccgccaagcgccgcgccatcgacgaactgcgcaggggcaagctcctcgagcgcaagcacgaggaactcggtcacgaactggagtcgctgcaaggcacggccgcgccagacctggacgccgcgctcgacgacgtcgtgggcgatgacctgttgcgattgatgttcgtctcctgccacccggtactctccaaggagacacgggtggcgctcacgctccggctgctcggaggcctgacgaccgaggagattgcccgcgccttcctcgtccccgtccccaccgtggcccagcgcatcgtgcgggccaagcgcacgctcgcggaggcacacgtccctttcgacgtccccgatagcgaggaactggccgcccgcttgtcgaccgttctcgaggtcatctacctcgtcttcaatgaaggctacgcggcgacggccggcgatgactggatgcgccccgcgctctgcgaggatgccctgcgcctgggccgaatcctggcggggctcgcgccgaaggaaccggaggtccatggcctcgtcgccttgatggagattcagtcgtcccgctcacgagcgcgcgtcgggccgaagggcgagcccgtcctcctgctggaacagaaccggggcctctgggaccagctcctcatccgccgaggcctcgcggcgctcgagcgcgccgaggcgctgggaggcgctcagggcccctatgcgctccaggccgccctcgccgcctgccacgcccgcgcgcgcacggccgaggccacggactgggcacgcatcgcagcgctctacgacacgctggcccaggtcgtcccctcccctgtcgtggagctcaatcgggcggtcgcccattccatggcgttcggcccggcggcggggctggccctcgtgggcgctttgacctcggagccgtcactccagggataccacctgctgcccagcgtccgcggagacctgctcgccaagctgggccggctcgacgaggcccgcgcggagttcgagcaggccgccgccctcacggcgaacgcgcgagaacgcgcgctgctcctcgaacgggccgccgcctgcgcgcgcggaagcggacgttcctga

SEQ ID NO: 8412 - DNA, 4893 bp, Myxococcus xanthus
atgagcaaggaattctacgagaagatttcgaacctctctcccaagaggctcgcgctgctggcgctcgacctgcacgcggagagcgaagccctcaagcgcgcgcgctcggagcccatcgccatcgtcggtgcgtcctgccgcgttcccggaggcgtgcggacacccgaggccttctggcgcctgctgagccaggggttggacgccatcaccgaggtaccgcgcgagcggtgggacgcggaggcgctcttcgaccccgacccgagcaagcggggccgcacctatgctcgctggggcggcttcatcgacggcgtggaccagttcgacgccgcattcttcggcgtctcgccccgggaagcctcgcgcatggacccgcagcagcggatgctgctggaggtcgcgtgggaggcgctggagcgcgcgggccagccgccggaccagctcgcaggaagcaagtccggtgtcttcctgggcatcatcggcagcgactacgcgcagctccaggcgcggcagctcggcgatgcgccggacatctatcacctgacgggaacctcgctgaacgcggcggcgggccgcctggcgtacacgctgggcctccaggggccgtgcatgtccatcgacacggcgtgctcgtcgtcgctggtggggctccacgtcgcctgccagagcctgcgcaaccgcgagtgcgacctggcgctctccgcgggcgtcaacctcatgctgatgccggacccgaccgttgccctctccagcagccgagggctggcgccggacggacggtgcaagagcttcgatgccgccgccaatggcttcgtgcgcgcggagggctgcgtcgtcctggtgctcaagcggctctcggatgcgctggccaacggcgatgagattctgtcgctcgtcgcgggctcggcggtgaatcaggacggcgccagcagtgggctcatggtgcccaacgggccggcgcaggagcgggtcatcgagcaggcgctggcgagcgcggggctgaagccctcgcaggtctccttcgtcgaggcgcacgggacgggcacgtcgctgggcgaccccatcgagctgcaagcgctggcgcgggtgctgggcgcgggacggagcgcggatacgccactgtacgtcggctcggtgaagacgaatgtcgggcacctcgaagcgacggcggggctcacgggcatcctgaagacggccctatcactgcgccacgaggcgattcctccgaacctgcacttccaccgcctcaacccggacatcgtcctggacggggcgcccgtcgtcgttcccacggcgctccagccgtggccccgcgccgagcagcctcgcctcgctggcgtgagcgcgtttggcatcagcggcaccaatgcccacgtcatcttgcaggagccgccggtgccgtcaccgcggcctgccgtccctgctcgtggcgcggagttgctcgtgctgtcggcgcgcagtccggaggcgctccaggccatggccgggagccacgcgcattggctcgccgcgcatcccgaggtgtcactccgcgacgtctgcgccacggcgtccctgtcgcgctcccaccatgagcaccgcctcgcgctcgcgggccatacacacgctgaactcgaggagaagctgggggcgtacgcgcgtggagagcccgtgccgggcgcggccacgggacgtgcatcggggcagacccggcgccgggtcgtcttcgtgttcccggggcagggttcgcagtggctgggcatgggccggaagctgctggcggaggagacggcgttccgcgaggccatggagcgctgcgacgcggccatccatgcgtgcgcgggcttcagcgttctggctgagttggccgccgaagagggcaagggccgcctccatgaaatcgacgtcatccagcccgttctcttcgccatggaagtggcgttggcggagctgtggcgcgcctggggcatcgagcccgacgccgtggtcgggcacagcatgggcgaggtggcggcggcgcacgtggccggagcgctgagcctggaggacgcggcgaagatcatctgccgccgcagccggctgcttcgaggcgtgagcgggcagggctccatgctgctggtggacctgacgttggaagaggcgaagcaggcccttcacggctgggagtcgcaggtctccgtcgcggtgagcaacagcgtgcgctccacggtgctgtcgggcgctcctggggccctggaggacatcgcccagcagctcaagcaacgggacgtcttctgccgcttcgtgaaggtggacgtggcctcgcacagccctcaaatggacccgctgcggcccgacctgctcgcggcgctccaggacctcgcgccgcgcgcgtcccgtgtgcccatctgctcgacggtgacgggacggatgacggatggcgcggagttccgtgccggctactgggcggataacctgcgcgagccggtgttgttctcgaaggccatcgagaagctcgcggtcgacggccatgacctcttcatcgagctgagcccgcatcccatcctcttgcccgcggtggaacaacacctgcggcacctcgggcgagaggggacggtgctgccctcgctccgccgtgacgaagacgagcgcggggcgatgttgtcgtccctgggcgcgctctacgccatggggcacgaggtggacctcgagcgccagcaccccgtgcggggccggctcgcagcgctgcccacgtacccgtggcagcacgagcgcttctggattgagtcgtccacgcggacccgtcgtgcccgggacgctggccaccacccgttgctgggtacgcacctgtccctggcgggccaggacggcgcgcacctgtggcagacggagctgtacgcggacagcccttcgtatctggcggaccacgtcgtccatggggaggtcgtgctccccggcaccgggtacttggagatggcgctcgcgggggcctccgaggccttcgggccggcgcggctcgcgctggaggacgtcatcttccaggagatgatggtgcttcctcgggaagaggcgctgtcggttcagatgcgcgtcatcccggaggcggatggaacccgtcgcttccaggtctttggccgtccggtggacggcgccggggcttggacactgcacgctgaagggcgaatgtgtgagagcacgagcgcggagcccttcgcgctcgacgaggcgcgggcgcggtgccccgagcttctggagggcgagaagcactaccagctcatgctggagcggggcgtcgacttcggtcccagcttccgcctggtgaaggagatgtggaagggcgagggcgaggcggtggcgcgcctggaattgtcgccttccgtcgcggcggagatgacggcgcatcagctccatccggcgctgctggatgcctgcttgcaagccatcaacggcgcggggctgggggaccgccggggagagacgttcgtcccggtggcggtggactcgctgcgcatgcacgggcggcccggacgtgcgctgtggagtcacgctcgtgtccggccgggcacgggcagtggcccgggctcgattgaagccgatgtgacgttgctggacgcggagggcaacgtcctgatggaggcccgcggcttgatggcgcgccgtctggatgcggtgcggcgccggtccgcggatgaaatcgaccagtggatgtaccgggtggactggcaggaagcgccgcgcgagacgcccacggccgtctcggagtccacgcccggcacctggctggtgctcgcggaccgtgctggtttcagcgggaagctgcgcgcggtgctgagcgagcgcggggagcgttgcatcctcgtctcccacggcgaggagacccggctcgtcgagcccggccactacatggtggacccgtcacgagcggagggtttcacgcggattctcgacgcggagttcggcgccgggcgtcccgcatgcagtggcgtcgtgcacctcttcagcctggacgttcccggtctcgaggctggcacggatgcgctggtgaaggcgcgcacgcttggcgcggcgagcgcgctccacctcacgcaggccctggtcgcgtcgggcttccgggacatgcctcgggtgtggttggtgacggaaggtgtccaggccgtcaagccgggtgagcaggtggcccatgtcgagcaggcgccactctggggcttgggacgcgtgctcgcgttggagcatcccgaactccggtgctgcagcgtggacctgggggctcgcgatgaggcccaggctggggtgctggccgacgagctcctcgtttcgagttcggaagagcaggtcgcgctccgaggctccgcgcggttcgtggcgcggctgtcgcgcatggagcgcagcacggcggcgccggcgaagttgcgagccgatgccacgtacctgattaccggtggcctgggtggcctggacctgaagctcgcagagtggctggtagaccggggtgaccgccacctggccttgctggggcgcaagggcgcgtcctcggagacccagccggtgctgcatgcactgagtgccgtcggcgtcaaagtccgggtgttcaagacgcacgtgaaggcgcgcccggacctggatcgggtgctggcagaggtgtcgccggatatgcctccactccggggtgtcttccacacgtcgcccgtccttgatgacggcgtgctggtgaacctactccaccgagcgtctgcgcacggtgatggcgcccaaggtccacggcgcctggcatctgcacacgctgacggcatcggcgccgttggagcacttcgtgttgttcgccgcggcgggttcgctgctgggctcgccggggcagggcaactacgcggcggccaacgtcttcctcgacgcgttggcagcgtatcggcgtgggctcggcctgccggcgctgagcgttga

SEQ ID NO: 8413 - DNA, 907 bp, Myxococcus xanthus
cgcgccagacttgagcgcggatgagcttgaagcccggttcgccaaggcatatccggaggacaaggaaggcacccgacgagtctgggcggcccaggtccgccggttcatgcgcgatgttgagcaaggcgacagcgcggtgacttacgacccgaacgagcgcgtctacctactggggcgcatcgaatcgggcgtcgaaaaccgcgccgggccgcctccgcttgtccgccgcgttcgctggacgcaccacgtcctgcgaaaccagttgagcgcggcgactcgcaacggcctcggctccatcgccacattgtttcggcccagcgcggaagccaccgcggaactctgggcgcaagccgtggaactggaacgtcccgtagcgtccctggcgcccacgccggcccctgccgtggacagcgacgagggcactgaagcggtgctccgggaggagcagttcgaaaaggccgaacaattcatcgaggaccgtatcgcaaggctgaactggagcgagatgcaggaactcgtcgcgggcatcctccgcgccatgggctaccgcacgcgcgtcgccgcacctggcgcggaccgaggtgtcgacatcttcgcttcgccagacgggctgggcctccaggaaccccgcatcttttgtgaggtgaagcaccgcgtgggcgagtccatgaactcccagtcgattcgtgcgtttctcgggggccgcaagcagggcgaccgatgcctctacgtcagcacgggcgggttcaccaaggatgcgcgttatgaagcagaccgctcctcggttcccctccgacttctcacgctctccgaccttcgtgagcttctggtcgagcagtacgagaacctcgacgcggagacacgggcgctggtccccctgaaaaagctctactggcccgtcgggtag

SEQ ID NO: 8414 - DNA, 480 bp, Myxococcus xanthus
atggaccccgcaggcaacgtggtggcgcggctcgggcggttcctggggcatcagacgaacaactgcgcggagtacatgggcctgctgctgggcctgaagcatgcgcagtcactgggcgcccgcaaggtggaagtcttcgccgacagcgagctgctgattcgtcagctcggcgggcgctaccaggtgaagagcccgacgctgaagccgctgtatgaagaggcgcggaagctgctcaagggcttcaccaaggtgaagctgcaccacgtcccccgcgcgcagaacgccgaggcggatgagatgagcaaccgcgccatcgacgagcggatgtagtcattccagggacggacatcagggggggaattggtgactgccaacaagcgcctgtggttcatccgtgcgggccgcgatgccgcgttcttcgatgccttcaaggcggaagggcacgtcggcatcggatgggacaaggtcggcccgctcgcg

SEQ ID NO: 8415 - DNA, 732 bp, Myxococcus xanthus
ttgcgggagaaattgaaagcgctggcggagctgcagaacgtggacctcgaggtcgcctcgctccggaaggccgcggacgttcacccccgtcagattgccgagctggagcgggaactgggtgtggcccgcagcgccatcgaggcggaacgggcacgcgtctccgacatggagaagcagaaggcccagctcgagcaaaacatcacggacgagaaggacaaggtgaagaagtgggagacgcggctgagcgagcagcgttccacccgcgagtactccgccctggcccgtgaaatcgacatcgccaagaaggccaatctgacgatggcggaggagctgacggagctgacgaagcagctcggcggcgctcgcgaggccatcaagggcaaggaggccgactacgcgacgaagcagcagggcctgtctggccggatgacggagctgcgcggcaagctgggcgaggccgagtcgcaggtgaaggggctggaaggtcgtcgtgccgaagtggcctcgagcgtggatgccaccctgctgcgccgctacgaggtggtgcgcaagaagaagctgcccgccatggtcggcgtggtcgccggcacctgccagggctgcaacatgaacgtgcccccgcagctctacaaccagcttcgcaccgggctgggcacggacatctgtccttcgtgcaaccgcatcatctacgcggtggaagcgctgcaggaaaccccggcggcgtcgaagtag

SEQ ID NO: 8416 - DNA, 246 bp, Myxococcus xanthus
atgacgacccgggccacgctggaccgaatcgaagacgacatcgccgtgctggtggtggagggccgcgagctgacgcgccccctgagcgacctgcccgcgggcatccgcgagggagacgtgctcgacctcgacaccctggaggtggaccctgaggccaccgaggccctgcgcgaggaagtgcgcagggcccgcgagaaggcgacacgcggcaagaagccgccgccggccggaagcttcgacctctag

SEQ ID NO: 8417 - DNA, 879 bp, Myxococcus xanthus
ccttcccccgccacgcccaatgcgctccagcggctgcccctgggcgcgggcgtgtccctcacggtgctgtggccccgcgcgcccaccgagccgctgctcgacgtgcccgaggccgcgctggaggccaactccgtcatccttcggctcacctatggggacaccgcggtgctcttcatggcggacgcgcatgcccggacggtggaccacctgctggcgcgcaacgcccccatgcaggccacgctgctcaaggtggccgcgcacggcaccgaagggcccaccaccgccgccttcctgacggccgtggggcctcgcgccgccgtcatctccgcgggtgaaggcaacctgattggcgcccccgcgccggccatgctcaagcagttggaggccaccggcgcgcaggtgttccgcaccgaccttcacggcgaggtgcaggtggtgagcgacgggaagacgctcgtcgtcacgccgcagcgcctgtcggcgggcgtcccggaggacacgcgctacagctacccgggcctgggcacgcccatgccccgggacgccgcgctcgcgggagattcccagcgcgcgacgggccgctccggcacgcgtgacggctcgggcaagcagcccacggggaagatgtacaccctgagcctcgacgacccgacagacgaaggggcgcccccctctcgcgcgggctcgcgctcgcgaagcgaggcctccgactcaggcgccgtgaaggtgggcgcctacgtcggcagcgtccgcagcgacgtgttccacaggcccacctgccgcaacgtcgtgaagatcaagtcatcgaacctggtgaccttctccagccgggaagaggcctcgcgtggacggcggcctgcccgggactgcaacccctga

SEQ ID NO: 8418 - DNA, 1065 bp, Myxococcus xanthus
atgagcggaggtgctgagattctcggcgtcggaatgatgacgccggtgggagtgaatgccccgtcgacagcggccgccattcgggctggcatcatgcgtgcgcgggagacgtcactgatggacctccgtttccgtccctacctgggggcattcgtctccgaggagcacctgccggctccggatctgccggtcgctcgtggactggccgcacgtgagcagcgcatgttgcggctggcgctgcccgcactgaaagaggcggcggcgggattggagcgcccgctgccgttgatgctggggctccccgaagagacggaattatcagcgcggagcgagccggtgcccttcctgaaggcgctggggctggcttccggcattgcgctggaactacagcgcagccggtgctttcccaatgggcgcgctgcggggttgctggcgctcgacgcggcggtgcggttcctggacgaaagcaaggctccggaagttctggtgggaggactggacaccctgttggatccgacggtgttggcgacactcgaaggcgaggaccggatacgccggtacgggccggcggatgggctgattcctggagaggccgccgtgttcctccggcttggaaggaagggagaggggaagcggctcggccgtgtcccgctggcacgcgttctggcgacagcgacgggaaaggagccggggcatcggtacagccgggagccataccttggggaaggtctggcgcagacctgtcgcttgctcttcgactccactccggctgggctaccgcccgtgcggtgtgtgtacgtggggttcaacggagagaacttctgggcgaaggagtggggcgtgacattccttcgctcgcgtgagcgcattgccgaggcgcatcggttggaacacccggccgagaacgtgggggacccgggagccgcatacgggccgttgatggtgggggtggcggcgctgggattgcggaagggatatcgtgaggggcctgtgctggtgtggtgctcctcggaccgtgagtcacgtggtgccgtactgcttcagcgtgaagatccggaggcttga

SEQ ID NO: 8419 - DNA, 675 bp, Myxococcus xanthus
atggggtgggtggccaaggcgggagcgctggaggaattcgaggtggagattggcgcgaccccacatcacatcattccgggaaaggcctccatggccaagtcgcgtctcgagcagtggacgcgcgcggagaagggcaaaatcaaggaggacattggctacagcatcgactgcgcgcgcaatggcgtctttctcccaaagctcccggacctctatggcacgaagcacaaggtgcccggagtgacgatggcccagttctacggccaaacatggagggcgctgagtccggcctcgaaagagggcgttggcttcctggtgatgaaggatacgtggctgcagttgcattacacggatcatagcaagccatacaaaaccagccccaccatgaactatgacaaggagacgcggctggagtgtgaccagttggcgcacctggcggaacgatttcggattgtctgcgaacgctccaaggatgacgacgggaagcgctatccaccctattccctagtgcacctcattaatcaaaaatccgattttttcaaaatgcgaatcacggggcggcccgatcagtggaaatcatgggtgtcgacattggctgaagacctctccatggcggtcaggcagggccgggagttgcttgtcagtaagctcgctttgacgaagaagacgcgcggttag

SEQ ID NO: 8420 - DNA, 756 bp, Myxococcus xanthus
ctgcccaacggcctcaccgtggtccgcgtgccctacccgtcccgcggaatcatcgcctacgtcaccgtggtccgcgtcggctcgcgcaatgaggtggaacccggccgcaccggcttcgcccacttcttcgagcacatgatgttcaagggcacgaagacgcacccggagggcgaccgcgagcgcatcctcgggaacttcggctacgacgacaacgccttcaccaccgacgacatcaccctctactactcctacggccccaccgccggcctgccccagctcatcgaaatcgaggcggaccgcttccggaacctggagtacagccagccgtccttccagacggaggcgctcgccgtgctcggcgagtaccacaagaacgccgccgcccccttcctcaagatggaggaggagctcaacgccgcggccttcacccgccacacgtaccaacacaccaccatgggcttctacaaggacatccaggcgatgccccaggcctatgactacagccgcaccttcttcgagcgctggtacacgcccgacaacaccctgctcttcatcatcggcgacttcgacgacgccaaggtcatggagctcgtgcgccagcactacggcccctgggaccgcaaggccgcccaggtctccgtccccgccgagccgccccagaagggccctcgcaccgcccacatcgactggcctcagcccacgcagccccggcaggtgattgcgtggcgcacgcccggcgccggcaccagcccggtc

SEQ ID NO: 8421 - DNA, 88 bp, Myxococcus xanthus
atgggaatccgttatccggaccccgtacaagagcccatcccgtgctatctcgacccgcgcaggggtcccgtgatgcccgatctcatca

SEQ ID NO: 8422 - DNA, 1698 bp, Myxococcus xanthus
agaggccacgaagccgagctccatgccgtcgcgttctctcccgatggccggtggctggccgccgcgggcaggcccggcgcgctctggctctgggactggaagcaggggcgcagggtggccttgctgtccgggcacacggatgtcgtgcggggcctggccttctccccggatggtgagtggctggcgagtggtggactggaccggacggttcgtgtctggcgcatccgcgacggcgcggaggtgctcaggttcacgcatgacgacatcgtcatcgcggtggccttctcccccgacggaggacggctcgtgtcgtcgagcatggaccggaccgcgcgggtgtgggagctgacggcgcgtcgcgaactgcaccggctgacgggacacggggacaaggtggagtcctgtgcgttctccgcggatggcgagcgggtgatgaccgcgtccgcggaccgtgccatccgtttctgggatgcccggaccggggccctgctcgacgtgcagcgcaacacgggggcgctttcggccgtggccatcgatgcgggtttccagcagctcgtgcaggcggggtgggaggggcgcgtgcagcgcgtggacgtgcgcggcggtggcgaggtcctggagcggttggatgcgcaccggaccttcgtgatggccgtggccctgtctccggacggacgcacgttcgcttccggtggcatggacggtgtcctgaaggtctggtcgcggccggaggtgcctccggacgtcctgctgcgggagcttcccgcctggcctgaggtgctgacctccgtggggccagacgccttcgtgtcgggtggggaggacggtctgcggagctggtcagtctcggccggaggcgaactccactcccgcctggaggcaccggacgccgtgggggccgtggccgtgagcgcggaccggcggttgctcgcggtgggcacgttgaagggggaggtgcgtgtgcgagacgtccggtccggaaatcagctgatggtgattccggccgcgcgcgaatccatccgggcgttggccttcagcccagacggcgcattgctcgccgcgggagtggcgcaggacgtcgtgctgtgggctgtcccctccgcgacccaggtggcccggctgacagggcacaccgggaaggcgtgggcattggcattcgatgccacggggcaaaggctggcttcgggcgcggcggaccacacggtgcgtatctgggacgtggcgcgaggcacggtgattcgcgtcctggaggcgggcgaccgggtccgcgccgtcacgttcctggcgtccggggagttgctgaccgcgggaatgcgtcagcccatccggctctggagcccagatgacggccgcgtgctgacgtcgatggattcgctcacggtaggcgtcttgtcgctcgcgatggcgcctcagggggcgttcgtggcgtccggcggagtgggaggagagatgaaggtctggcggcttcccgacggggcgctcatgggggaggtgcccgggttgcaggggttcgtctccgccgtgaccttctcttcggatggagcgtggctggcggcagcggcttccgaccggacgttccacctgctgggcttcgacgccttcgcactcccgccgcccgtggagccggacctgacgcggattctgcggcgccatgggctggcctgggatgacttgcggggcgcgttcactctccactga

SEQ ID NO: 8423 - DNA, 555 bp, Myxococcus xanthus
atggcgcccaaggtccacggcgcctggcatctgcacacgctgacggcatcggcgccgttggagcacttcgtgttgttcgccgcggcgggttcgctgctgggctcgccggggcagggcaactacgcggcggccaacgtcttcctcgacgcgttggcagcgtatcggcgtgggctcggcctgccggcgctgagcgttgactggggggcctgggccggtgtgggtctggccgcggcggccgaggcgcgcggggaacgcatcacccagcgcggcgtggacaccatgccaccgtcgcaagcgctggaggcgttgagccgcatcctgggcagccctctgtcgcgcgtggtggtgatgcgtttcgacctgcggcagtggagcgagttctacctgacggcggcgcgctcgcccttcctgtcacggctggcgcgtgagcaggccagcgccgcgaatatccccgctgttcgcggtgccttcgtggagacgctccgggccgcggaggtgctgaagcgcgcgtcgttgctggaggcgcacctgtgcgaacaggccggccatgtgctc

SEQ ID NO: 8424 - DNA, 1092 bp, Myxococcus xanthus
ctcaaggtcggcggtgcgctgcgcctcaatgccttcttcaagacgtggcctggagaagaagacaaccgcaaccgcggtggcgacgtggcgttcgatacattccggctcaatgtcgacgccagactttccaaggtgttgctgtccgccgagtaccgcctctattcggggtactccatgctccaccacggctgggtgggctatgagttcacgaaggcgacccagctccagttcggcgtgcaccgcgtgcccttcggcgtgctgccctatgcctcacataactggttcttctccctgccctactacatgggcatggaggacgactacgacctggggctgaagctggtccacacgcaggggccatgggacctgcaggtcgctttctacaagaacgacgagggcagcttcaccggccggagtacggacagcgcgcgctactcgtatgacgtggtgcaggtgagcagctccaacccgggcgaggcgtacctgggcgtggacagcgcgaaccacgagagcaacaagctcaatgcacgcgcggcgtacacattccagcacggggacctgggccgcacggaagtgggcgtctccgcgcagaccgggcagatctacaacagcgtcaccaagcgcaatggcctgaactgggctggcgcggtgcacctggacggctactacggcccgttcaacctgcgcatggaggtcctcagctacggctacgacctgaagaaccccgagggccacgacgactccatcgtgacgatgggggcctatgacgcgccctacaagatggccacccggggcaccgtctacgcggcgggcctttcgtacgacgtgcccgtgtcgtggggccccatcacgaagctgaccttctacgacgacttcagcctcttcgacaaagccaacgccgcgttcgagacgtcgatgcagaacgtgctcggcatgctcgtcaccgcggggcccgtctacacctacgtggacgtggccagcgggaagaaccagccctggctggggcctgcttatggccacgcgctcgcggagggcgatccgaatgccccgtgggagacgcgcttcaacatcaacgtcggctactacttctga

SEQ ID NO: 8425 - DNA, 1185 bp, Myxococcus xanthus
atggagaagattgaagtccgtggcttgcggaagatctacggcggcaacccggagcgggccattgccctgctggagaaggggcagagcaagcagcagatcctggaggagacggggtgcaccgtcgccatccaggaggcttcgttcgatgtgaaggccggcgaaatcttcgtcatcatgggcctgtccggcagcggcaagtccacggtgctccgctgcctcaaccgcctcatcgagccctccgccggcagcgtgcacgtggacggcgtggacgtcacccgggcggacagggcgggcctgctggacgtccggcgccggaagatggccatggtgttccagaacttcggcctgctgccccaccgcagcgtcatccggaacgtggagtacgggctggagatgcagggcctggagcggcgggagtcgcggtccaaggcgatgcaggcgctcgagctggtgggcctgaagggctacgaggagaagctgcctcacgagctcagcggcggcatgcagcagcgcgtggggctggcgcgggccattgccaccgacgcggaaatcctgctcatggacgaggccttcagcgcgttggacccgctcatccgccggcagatgcaggacgagctgctggagctccagtcccggatgaacaagaccatcgtgttcatcacccatgacctggatgaggcgctgaagctgggtgggcgcatcgtcatcatgaaggacgggcgcatcgcgcagctcggcacgccggaggaaatcctcaggagccccgcggacgactacgtgcgcgccttcgtggagcacgtggaccgcaccaaggtcctcaccgcgcgggccatcatgcggcggccggagtcggtggtgcacccgaaggacgggcccgccctggccgtcaagcgcatgcgcgagtcgggcacctccacgctcttcgtgaccaaccaggcccgcaagctggtgggcctggtgcgcatcgaggacacgctgcggctcatggcggagaacaagcacagcctggagggggcgctcgtcaccgacttgcccaccacgtcaccggacacgccgctggcgaagctggtggcggtggcggccacgactcagattcccatcgccgtcgtcgccgaggaccagtcgttcctgggcatcgtgagccgcgccacgctgctggccagcatcgcgggggagcagccctga

SEQ ID NO: 8426 - DNA, 834 bp, Myxococcus xanthus
atgagcacactgagaatcggcgaaggcttcgaggagctgattgactggatgggcacgcgcggcgcgccggtgttcgacgccatccgttcggggctcacggcctgcatcaacggcctggagagcgcgctgctcctgccgcccagctacgccatcatcacggtgttgatggtgctcgcctggcgcctgtccggcctgggcacggccgtcttcacggcgctgggcatgctgctcatccaggacatgggcctgtggaaggcgaccatggagacgctggcgctggtcctcagctcggcgatggtggcgctggtactgggcatccccctgggcatctgggccgcgtacagccgcgtcgtggagcgggtgctgcggcccgccctggacctgatgcagacgatgcccgccttcgtctacctcatccccgcggtgctcttcttccggctggggaaggtgcccggcgtggtggccaccgtcatcttcgccatgccgcccgcggtgcgcctcaccaacctgggcatccggcaggtgcccactgaagtcgtggaggccgccatcgcgtttggcgcgacgccgcgtcagacgctgctcaacgtccagctccccatcgccgtccccacgctgctggccggagtgaaccagaccatcatgctgtcgctgtccatggtggtcatctccgccatgattggcgcggggggactgggcgagcaggtcctgaagggcatcacccagctccgcatcgggctgggcttcgagagcggcatcgcggtggtcatcctggccatcgtgttggaccgcctgactcatgcgctgggcaagccccggacgcgctcatcatga

SEQ ID NO: 8427 - DNA, 930 bp, Myxococcus xanthus
atgaaggagacccgtcccgtgaagatttcctctctcaatcgtctgcccctgctgctcacggccgtggcggggctgctcgtcgcccccggatgcaagcaggagaacaaggcgcccgccgcgggtgacaccgaggcgcccgcccccgcgaagaagcccgtggtccggctggtgtacgtgaactgggccgaaggcgtggccatgacacatctggtccaggccatcctggaggaccgcatgggctacgaggtgaagaccaccatggcggacgtcgccccggtgttcgcctcgctcgccaacggcgacgcggatgccttcctggatggatggctgcccgtcacccaccagagctacatggagcgcttccagggcaaggtggtggacctgggcaccaactacgaggacgcccggattggcctggtcgtcccggcggacctggacatcaccagcatcgagcagctcaacggcaaggcgaaggacctgaaccagtccatcgtgggcatcgactccggtgcgggcatcatgacgacgacggagaaggccatcgcggagtacaagctggacctgaagctggtgccctccagcggcccggcgatgaccgcggaactcaaggacgccatcgccaagaagcgccccgtggtggtcaccggttggaagccgcactggaagttcgcgcgctgggacctgaagttcctggatgacccgaagggcgtctatggcgccaaggagtccatccacacgctcacccgcgtgggcctggagaaggacctgcccgacgtcgcgacgctgctgcgcaacttcaagctggatgaccagcagctcggcagcctgatgggcgccatcgccgaggccgaggacgcgccggagaaggccacccgggagtgggtgaagaagaaccaggcgctcgtggatggctggattcccaagtcctga

SEQ ID NO: 8428 - DNA, 813 bp, Myxococcus xanthus
atgaagacccaacccttcaagggccgggtggtcctcatcacgggggcttccggaggcattggcaggacggcggcgagggcctacgcggccgcgggcgcggatgtcgtcctggccgcgcgccggctccccgagctcgaggacgcggcccgtgaagtggcgtcactgggcgtgagggcactgccggtgcggtgcgacgtcacggtgggcgacgacgtgacgcggctggtgcgcgagacggacgccgccttcggtgggctggatgtgctcgtcaacaacgcgggccaaggtctctacggaccgctggagggcgttggggaggagcaactccggcaggtcttcgagctgaacgtcttcagcctgtggcggatgacgcgcgaggcactgccgctgctgcgcaagcggcgtggcgctcaggtggtcaacgtcagctccgtgctgggccaccggggactgccgctgctgggcggctactgcgcgtccaaggccgcggtgaatgcgatgacggagtcgctgcgcgcggagctggccgccgagggcatccgggtactgctcgtgtcgcctggcttcaccgaaagcgacttccgggagaaccgccttcatgcggagggctggcgacaggacgccattccgctgaaggccatgtccgcggaagaagtcgccgacgcaatggttcgtgcgagccggagtggacggcgcgacaccgtgctcacgctgcccggccgggtgatggtggtggccaaccggtgggtgccttccctgttcgaccgtgtcgcccgccgcatggcgcttgcttcgaagaagaaggacgcatga

SEQ ID NO: 8429 - DNA, 1059 bp, Myxococcus xanthus
gggccgctgctggactggtacgaccggaacaagcgcgacctgccctggcgccgcactcgggattcgtatgccatctggctgagcgaagtcatgctccagcagacccaggtgtcgacggtgattccctactgggagcggttcctcgcgcgattccccacggcgcgcgcgttggcctcggcgccgctggatgacgtgctcgcgggctggaagggactgggctactacagccgcgcccgcaacctgcaccgcgccgcacaggaagtcgtcgcgcgcttcggcggcaccctgccctccaccgccgccgagctgctcgaactgcccggcttcggccgctacaccgcgggcgcggtcgcctccatcgcctttggcgaagaagcgccgctggtggacggcaacgtcgcgcgcgtcttctctcgcatcttcgaggtcgaaggccttccaggagaccgccagcgagaggccacactgtgggcactcgccaccgcactggtgaagggcgagcggcccggtgacttcaaccaggccctcatggagcacggcgcaaccacatgccggccagagaacccgctttgcctgctgtgccccgtgcgcggagcctgcgtcgccttccgcaagggccgcgtggacgagctgccccccgccaaggtgcgcgccacgcccaagaagctgacgctggccgtcgccgtgtggccccatgccggcaccctcctcttcgcccgccgcgcggacgccgggctcttcgggggcctgtgggagctgccggccgccgaaatcgccgacgacgcaccggacagcgaagcccgtgcccggctctccgccgcgctgggcgtcgacgtgaccctggaaggcgcgctgggcaccgtgaagcggcagctcacccaccgagacctctcgcttcggctgctgcgcgtctccggccctcgccggcccgcgagcacgcccgccttccaggagcttcgctggtgcgcccctgatgacgcggagaagctcggcatgagcaccgcgatgcagcgagcgctcgacatcgcgctgggagcgggcgtgctgccaggcggctga

SEQ ID NO: 8430 - DNA, 198 bp, Myxococcus xanthus
atggacgtgggcaccgccttcgagaagggctggggcgcggaggtgccactcgccgccgggctcgagtaccggcacaacggcgtcaccgccggcctgcgcgccacctaccgcgtgctcgtagcgcgggacttcgctccgaacagcgcggacgtcggaaacctcttcagcgccgacctcagcctgggcgcgcgcttctga

SEQ ID NO: 8431 - DNA, 627 bp, Myxococcus xanthus
atgcggcgcccccctctcagcaacgacttctcctggtccaagagccgccacgagaagttctccgagtgccttcgcgcgtactacctctactactaccgctcctggggcggctgggaggcgagcgcgcccaaggacgtacgcgagctctacgtgctgaagaagctgggcaaccgctacacgtgggccggcagcgtggtgcacgagagcatcaaggacgtgctgttggactggcgcgcgggccgcgaggtggacccggcggcggtggaggcgcgcacgcgcaagctgatgcaggacgacttccggcactcgcgctcgaagaactactggtcacagaagtaccgcaagcagttcaccggcctggtggagcacgagtacgccgaagcggtgccggacgaggcgtggaagcagaactgggagacggtgcgctccgcgctgtcgtggttcttctcctcgcgctggaaggacctggcgcacagcctcaagcccgagcagtggctggaggtggacgcgggcttcgacttcgcccacttcacgctggacggcctcaaggtcttcgcgattcccgacttcgccttcgtggacgcggacggaacgccggtggtggtggactggaagacgggcaagtcg

SEQ ID NO: 8432 - DNA, 840 bp, Myxococcus xanthus
atgttggaacagcgtatcgggacatggttggagctgcaggacgcgctcttcgccgggtcgtggagcgaggtgttggggcgtcaccggtccacctttgtcttccgtggcatgccccaggtgaccaacgacctgtccacggcgctcaatcgcaaggggctgttcgtgcgcaaggagaaggacctgctgagggccttccggaagtacgcgcggagctacagcccgcagcccgtggagtccgtctgggactggctcgccctggcccagcatcatgggctgcccacgcggatgctggattggaccttcagcccctatgtggcgctccacttcctcaccgagaacccggagcggtatggagaggacggcatggtgtggtgtgtggactaccgccagacgaatcgtcaccttcccaggcggttgaagacgctgctccagcgagaaggcgcggatgtcttcacgggggagatgctggccacgacggcgtcggacctttcgaccttcgaccacctcgcgaagcacccgttcgtgctcttcctggagccaccgtcgctggacgcccgcatcgtgaatcagttcgcgctcttctcggtgatgaacgggcccgagcttcgcctggacaccttcctcgaagcccaggtggatggtgtgcgcaagctcatcatccccgccgcgctcaagtgggaggtgcgcgacaagctggaccagagcaacatcaccgagcgcgtgcttttccctggcttcgacgggctcagccgctggctgcggcgctactacggcccacgtgcccccgcgcacgcctcggacgctcccccggtgcgcaagcggcggcgcgtgacgaggtga

SEQ ID NO: 8433 - DNA, 1092 bp, Myxococcus xanthus
atgagcgcgccgaacatccgccgagccgtccagttgctgcctgcctgcgccaccaccggaatcgggagcttgccgcacacgcaagtggagctgggactccaggccgcgctggccctggacattccgttcctgccgcagttgccagtgggcaagccctcggagttgatgattcccgcggccctggaggggctgccgggcctggccttcgatgaggaaggtctgtgcacggtagacctcgcggcctggcaggcggggcgcgctgccttcgaggcgcggctggaggcggcgtttcagtccggccagttcgaggccttcgagccctcgcccgaggcgtgccgggcctggcggcccttcctgtgggaagtggaggcgcggaagctggccttcgcgaaggcgcagctcgcggggcccttcacggtgcgctcggtggcgcgcaccaccgacggacagcccgcgctggaggtgccgggcctggatgaagcgatgtaccggctgtccctggcgcgctcactggccatggtgaaggcgctgcgccgcgcgggcaccacgccgctgttctatctggatgagcctgggctctacgcgctccagcgcacgaatccccggcacctgattgccatgcaggagctgaagttgctggtggtggccttgcagcgcgaaggcgcgctggtggggctgcactgctgcggcaacacggactgggccgcgctgctggacgtccagccggacctgctctccctggacgtgcggctgtcactggacgcgatggtggaggcgggggccgcgctggagcgcttcctcgccgcgggcgcgacgctgagcctgggcatcatccccacggacctggcgtccacctacgaggtgggagagctggtggactcggtggaggccacgctgaaggcggcgctgcccgccggcttcaccttcgcgcaggtggtgtccacggtggtgctgacgcctgcctgcgggctggcgatgcgctcggtcatcgacgcggagcgcatcctggaggagctcaaggtggcgcagcggcggctccggagcgcgctctccgccgagcgtccctccgttgataccgtgaatccccactga

SEQ ID NO: 8434 - DNA, 933 bp, Myxococcus xanthus
ccgcggcctggcggcatcgacgcgaagtacgcgtggacggtccttggcggccaggggcagaacgtgaaggtggtggacatcgagggcgggtggcgcaccacgcacgaggacatgcccgacctcttccacatgggcggcacccagtacaccgaccagagctggcgcgaccacggcacggcggtgctgggtgaaatcgtgggcgcgcgcaacgcctatggcgtgacgggcatcgcgcaccaggccaaggcgggctacgagtccatcggggcccagagcacggcgagcgccatcaccagggcggccacggccgcgggtctgggcggcatcgtcctcatcgagctgcacgcccgcggcccctcggacggcacggcgtgctcgtgcaacacctcccagtgcgactacatcgcaatggagtactggcaggccaactacgacgccatcaagacggccaccgccaacggcgtcatcgtcgtggaagcggcgggcaacggcagcgccgacctggatgcgcccgcgtatgggagcgcgttcaaccgcaacacccgggactcgggcgccatcttcgtgggtggcagtacggcgaccacgcgcttgcccatgtgctggacgaacttcggcacccgcgtggacgtgcacggctggggtgagcgcgtctacagcatgggctacggcaacgtgttcggcgccagctatggcgaggaccagttctacacgtccagcttcagcggcacctccagcgcgtcccccatcgtggtgggcgccgccgccagcgcgcagggcgtggccctggccaacgggcgacgtctgaccagcacgcagatgcgctcgctgctgcgcgccaacggcacgccgcaacccgcgaacacgcgccagattggcccgctaccggacctggccaaggtcctgcccaaggtcatcgccggcgactactga

SEQ ID NO: 8435 - DNA, 879 bp, Myxococcus xanthus
  unsure (1)..(879): unsure at all n locations
cccccgncggcgctggtgacgcgcgggcgcagcgccgaggtgaaggtgctggacgccgtgccgaccgcgccggactgggagcggcacgtgctgaccaacacgccgctggaccacatctggaagttcatcaacccggtgatgctgtacgggcggcacctgggcctacgctcctcagcgcgtgtgctgggtacgccggccgaggcggagctggcgaagacggaggaggggcgcaaggcgctcgccctcaaggaggccgtggaggagctgaagggcttcctgcgcggcggcctcatgcaggcgcgcgccgtgttccagttctacaaggcgggcagtgatggcaaccgggtggtgctcttcgacggcgcgtccggcaaggaggccgcgtccttcgacttcccgcgccaggaccgcgaaggcggcctgtgcctggcggactacctgcgcccgctggagggcggcgcgccgacggacaacgtggccatgttcgtcgtcaccgcgggctccggcatccgcgagctgtccgaggagctgaaggcgaagggcgagttcctgaagatgcacgcggtgcaggcgctggcgctggagacggcggagggctacgcggagctgctgcacacgcagctgcgcagcatgtggggcacgccggaccggcaggacatgacgatgctggagcgcttccgcgcggagtacgtgggcaagcgctactccttcggctacccggcctgcccccggctggaggaccagtcgaagctgttcgcggcgctgcggccggaggacatcggcgtgcagctcacggacggctccatgatggagccggaggcctcggtgtccgccatcgtcttccaccatccgcaggcgtcgtacttctccgtgacgtga

SEQ ID NO: 8436 - DNA, 1632 bp, Myxococcus xanthus
atgcacgtgttgcgcaagacgttcgcggtgacggccgcggccatggccctggcggcctgtggcccccagcccgaaacgtctccggaagaaacagcacctgagtcgcaggttcccgcaggcgcggtggacgacgccgcccgcgcggtggccgacgcggctcgccgcacgcccaacgaactggacgcgcagttcacgaaggccgctggtgagttcaacgttccggtgagcctgctcaaggccatctcctacgcggagacgcgctgggagcacgtccgcggcgaggaggagttcgagggccgcccggcggcctttggtctgctggccctgcgcggtcagctcatcaccgacggcgccgccctggcgggtgtgtccgcggacgcggtgcgtgacgagccgctggccaacctgcgcgccggcgctgcgctgctgtcgaagtacgccgatgaggcgggcatcgaccgcgcggacctgggcgcgtgggccccggtggccgtgcgcctgacggacatctccgacccggacatccaggcgcactacatccacaacgacgtgtactcggtgctgcgcgagggcgcgggcgccttcacgccggcgggcaaggtggctgtgtcgctggagtccactcaggtcaacccaaagttcgccctgccgaatatgcaggcccttgcggccggcccggactacgcggcctccatctggcgcccgtcgcccaactacaacgcgcggcccgctggcatcggtcagcaaatggtcgtcatccacacctgtgagggtggctactcgggttgctggagctggctgaccaactccgccgcgggagtgagcgcgcactacgtggtcaacgagagcggcaccgaggtgtcgcagctcgtgcgtgagtcgagccgcgcttggcacgtggccgctgcctaccgcagcagcctcaacggcggcgtcaagtcgaacctcaacggccggtcgacgaacgacttctccatcggcatcgagcacggtggctacgccagctcggcctcgttctccacggggatgatcaccacctccgccaagctgacgtgcaacatcacccgggaccagggcatcccgcgcgacagctaccacatcgtggcgcacggccggctgcagccggagacccgcacggacccgggccccaactggccgtggtccacgtacatcagcaagattcgcagcgagtgtggtgacggcggcggtggaacgaacccggtcatcgtcgtggacagcaacaacgccaacaacgactccagcaagggctacatcgcggtgccgtccacctgggcgcgtggcaccagcgcgggctactacggcaacgactactactacgcctccacgcagcccgtctccgagccggcggtgttccacttccacatgcctgcggcgggcagccggaccatccaggcctggtgggtgcagggcaccaaccgctctcccgcggcgcccttcatgattacgcacgcgggcggcaacagcacggtgacggtgaaccagcagaccaacggcagcaagtgggtgacgctgggcacctacaacttcaacgccggctggaacaaggtgcagctgagccgctgggccaccgaaggctacgtcgtcatggcggacgccctccggattcagtga

SEQ ID NO: 8437 - DNA, 822 bp, Myxococcus xanthus
aagtcgctgctcgtcatcaccgcgacggaggagggcgggctgcaccgccagcagatgcgggtcctgccgctggatggcaagagcccggcggtaccgctgcacccgccccgggcgcgtgcgcgcaacgcgagctgggcgccggatggcacctggttggtggccgagtccgacgcggagggcttcagtgacgtggtgcgcctggagccccgtgagggggggccggaggtgcgcctcacgcaggtgccacaaggctgcttcgagccggcggtgtctccggatgggaaggaggtggccttcgtatgcagccgcgagggcgaccccgaagtctacgtggcgaacgcggacggcagtggtgagcgccgcctcaccttcttccaccatgaggaccgcacgccgaagtggagcccggacggcaagtggctcgtcatcgtcagcgatcgcgagcgcaaggaccggctgtacttcctccgtccggacggttcggacctgcgcgccgtgtcgggcgagtccttcgagggcgacgagcgtgaggccgcctggagtccggatgggcaacgactggtctacgtgagccgtctgccggatgggaacgcccgcatctggatggtggcggtggcgggcggcgcgccggtggccctgacggacggcaagcaccgggacgacatgcccgcgtggagtccggacgggaagtacctggccttcgtgtccgagcgccagggcgacacggacgtgtacgtcatgcgcgcggatggcagcgggcagacgcgtctgacgaccgccaaggggccggactggctgccgcgctgggcccctacgcgctga

SEQ ID NO: 8438 - DNA, 792 bp, Myxococcus xanthus
atggggctggagggcgccgcgctgtccgaaaaacatcagcgccgcgccccggagtgggacgcggcgccgttcatgtggaagccaggtgttgtcgaaccgtcacccgccccgcggtgtggcctgactcagcgccagcggccgttgccgccggaggaggacgacgaacccgagcggccggacggaggcgcgctggagcccgaggacgacttcccgctgctgctacccccgcgtccccagcccccgctgctggagctggagcccgagctgctgctggagctccggttgctgctgccggagctgctgccaccgcgtccccaaccgctgccgctggagctggagttgctggagctggagttgctggagcccgagctgctggagccgccgctgctgcctccccgcgtgttccagccgctgccgctgttggagttgccgctgttggagttgccgctgctcccggagttgccgctgccccagcggttgccgctgttgttgtcgcgcgagtcgtcgtccttcggcgcggcgttgttcgaggtgcgtcccgcgggagggctgctccatccgctgccggagttgttgctgggcgcggcgttgttcgaggtgcgtcccgcgggagggctgctccagccgctgccagagttgttgccctggccgcgcgacggccggtggttgccgcccgagctggaaccgcgcggcgtggtccagcgcgtacctcccggaggaggccgggttccgctgtacgtgttgccgggcaccacgggacggttggaggggcgcgtcgccgggcgcacgtag

SEQ ID NO: 8439 - DNA, 738 bp, Myxococcus xanthus
atgcggctcttcggaatcggcgacacccacctgccctccacgcgacagaaggacatgcaccgcttcgggtggtccgagcaccccctgccgctgcagcgcgcgtgggatgagcgggtggctccggaggacgtggtcatcgtggcgggggacatctcctgggccacgcgggcccacgaggtgatggacgacctggcgtggctggacgcgcgcccggggcgcaaggtgctggtgcgcggcaaccacgactactggtggggtgactccgcctccaagctgcgcaagctgctggagcccttccgaaccctggagggcttcctccacaacaacgccgtcgtcatgggcccgtgggtgattgcgggcagccggctgtggaccgcgccggaggcgccgcccatgcccggtggggagatgggggacgaggcggcggacaccggctatgtggagcgggagacgcgccggctgacggcctccatggaggacgcgaagaagaaggaggcagccagccccacgccgctggtgcgcgtggtggccgtgcacttcccgccggtgtacgcgaacgagaagtccccccccttcagcgagcccatcgaagccttcggaccgaaggtgtgcgtctatggccacttgcacgcggcgggcattgccgcgggcttcacgggtgagcgtggcggcgtacgatacgtgctggcctcgtgtgacgcggcgggcttcgccccggtgctgctctacggggtgtga

SEQ ID NO: 8440 - DNA, 2376 bp, Myxococcus xanthus
atggcccgcggcatcgcctggctcgcgacgctgggcgccccgctcgtgggcgcgctgtacctcctgggctgggcctgggacgtggagatgctgaggcccggcgtggctggcatccccatgacgccggtgacgggcatcgccatgattttcggcggcgccgcactgggcctgcggctgcgcgcccgcccgttccgccatcaggaatccacggccaccgcctgcgcgctggtgatggtggtcatcggcgcggtgagtctcctgcgcgacatcacgggctgggacgtggggatggagcacatcatgctgcgcctgctcgatggacacgcctcggtgctccctctcccctctcccctctccgccacctgcttgacgctgctgggcgcggccctggccctcccggagcggagccactccgtccggttgcgcgacacgctggtcgtgttgtcactggtgacctcgacgctgggcctcaacggcctgttgatgggccccttgttgacggtgggcaccctgcccttcctcgccgagcgcagcatgggcctgcccaccgcgctgacactgatgttgctggcagtgggcacgctctgcgcatggccggggctgggactgatgggccgcatcacccgcgattcgctcggcggcttcctcgcgcgccggctggtgccggtgacgctgctcggcccctcggtgctgggcatggtgttgatgctcctgcacgaggtgcgcgccatcaacctggaggcgaagctccccatcttcgccaccttcgtgagcgcgggcggcgcggcgctcgtgctcctgtccgcgcgggcgctggaccacattgaagcccaccgccaacaggccaccgcggcgctggaggcctccgaagcacgctaccggggcctgctggagaccacccccgcgccgctgctgacggtggacgcgcaaggcctgctgcgcttcgtcaacacggaggcggagcgggtgttcggctacccgcgcgaggaactgctgggacgcgaggtggaggtgctggtccccgaagggctctttggtggccggagcctggacaccggcttgggcgagcgcgccatccaaggccgccgcaaggacggcagcccgctgtcgctggaggtgcgactgagcccggtatcaggcccggaaggtcccagcgtgctcgccgtcgtccgcgacgtgtcggagcgagagcggtacctctccaaggtccagcgcgcccgtgaggaagcagagatgcagcgcagccaggtgcaggccctgctggaccacacgcccgtgggaatcgtcttcgcggaggcggacggcggcgggctggtggccaatcccgtcgcggagcaactgctcgggcgcccgctgaagggcgtgtcgctggcgatgacggggatcaaccccgtcgtgctcaccaccgacggcaagccggcccgccgggaggacgtgcccatcgtccgcgcgctgctcacgggccagctcgcggggcccgaggagttcctcatcctccaccccgatgggagccggctgccggtgttgatgaccgcggcccccgtcttcggtcccagcgggaaggtgcgcggcgtggtctccacggcgcaggacgtgacgacgcgccacgaactggaccggctccgcgaggaatacgtcagcctcatctcccacgacctgcgcaatccgctccacaccatcagcctgcgcgtgggactgctgcggcgcgccctgcgcgagcagaacctggagcgggaggaatccatgacggaggccatccagcgcagcgtggcctggatgaacaccatgattgaggacctgctggaaggctcgcggctggagtcccagcgggagacgctgcgccgcgagccccgagacctggcgcgcttcctggaagaggtgatggagcgggacgtggcccccgacgtgcgcgagcgcttccacctggaggtcccaggcgcgctgccccccatctggatggacgcggcgaggctggagcgggtgatggccaacctgctgagcaacgccgccaagtacagccccggtgggcagcccatcaccgtgcgagcccagctccagccggaacaggtggtggtgtcggtgaaggacctgggccccgggctgagcccggaagacgccgcgcgcgtcttcgacaagtacttccgcacgcagaagagcggcgcgtcggacgcgaaggggctggggctggggctgtacatcagccgcctcatcatcgaagcgcacggcgggcgcatctgggtggagagcgagcccggccagggctccaccttcagcttcagcctgcccgtggccccgcccggcgcgaacccgctcccgccccaggtcccggatgaccaggccccggcggcgggagacggctcggccgtcagcgcgtag

SEQ ID NO: 8441 - DNA, 522 bp, Myxococcus xanthus
atgcacctgagcctcgcggtgggcgcggaggccgcgggcctggtgcccgcccataccgtcgtctacgacgccggcttcaccggtgcccggccgcgcacggacatcattggtgcgcgcgtgtgggcgctgccggacgccttccatgacgcgctcagggtctgcgtgggggagagcgccatccggggccacaccgacaaccgggcggccaccctgcgcgacgccggcttcgtgctggggcgcgtggtggatgccagcggccatcccgtcgctggcgcgaaggtcgcccccgacggcgaggcgctggccggtcgcatctactaccccaccgccgacctccagggagtgaaccaggagggcaccggcccggacggattgttcgtctacgtccactcgggcgcggacgcggaggccttcctcctgtccgtcacgggcacggacgactacacgccacgcaacgtgggcgtggcgccgggctgggggctggtgctcaccgtccatcccggcctccacccgcctccctag

SEQ ID NO: 8442 - DNA, 993 bp, Myxococcus xanthus
ctgatggcttccggcgtggcggagtgggcgcaggagaagcccgcgctcatcgacgccttcgtggccgccaccctgggcgagtcgctgcgcctgtccatgggcatgtcgaagacgccgttgttcatcagcgcgcgcgacgagagccaggaggcccgggccattcccgagctatccctgctggcgcagacgttctggccgcgccgcgatctgggcatcgaggcctggtgggcgcccaagacgctgcccgtggaggcctgggtgcgcgtgggcaatggctcgcgcagtccgttgggcaatgacaacagcctgcccgccctggacgcccgcgtggatggacgctggggccgcgcccggggcgacgtggatgccttctggggcttccgcgctggcgcgggtgtccatgtggagaacgcctacgaccgggccggcatcggtggcatcggcccccagaacttcgtcttctaccgggcccccccggtatcggggcctcgctcggtggtggaggcgcacgcgcggctggacgttgggcccgtgagggtgctggcggaaggcgccgcggcctgggagcggcgctctcgcgataccgatggcaatcccaacaccccgcgcgaaggactgccacggatggagagccagggggcctcgctggaggtgtcctgggtggtggtgggacgcccccggggcgacggcgctcgctggcccgtggcgccgaacgaccccaccggcatggacgccgtcaacgccgggcaggtgcccacgggcgccgtcgagctcgccgcgcgagtggagcggctgtggcttgggccgggtgcctccgacatccagcccggcggtacgacgggcggcgccctcgcggtccgctggtgggtgacgtccttcttcggtctcggcgccgccgggtacgcccaggggtacgacaccgcgccgctggaggacccgggccggcgcaactcctggctcgccctggcccgagccaccgtgagcgtgccctga

SEQ ID NO: 8443 - DNA, 1164 bp, Myxococcus xanthus
atgcacctccctccgccctcggagcacaccatggtccgcaccgaacgcgtcgctcgtcgtgtcttctccaggctgaacctggccctgctgctcacaggcgccctcgcgggctgcgggggccccatggagccggccccgtccgcgctcgaacccgaaggcgcgcaggacgtccaggcccaggcgctgacgtatcccagcggcagcagccagacggtggtgtcccgccgtgtcgtcttcagaaacggctcgggggcctatcaagcggcggcggggttcgagcacttccgcgcggcgggcgcttttgacatcgcgctccacaacatccgcatcgcggaggtagacgcgcctgccacgcgcgaggccctggtcctcatgtccgcgggccagaagatttcgagcagcggccactccagcggcgtcaccggacaggcctccaactgggatgcgtcctgtgacagcgtctcctgtcccaacgtgagcctggacggccgttcgctggccatgaagctgcgcgccctgggtttgtttcccagcgggaagacgtacctgtccgtcgtcaacgacgccaacttcgaccatctgttcgacagcgacacgaagcagcgcatcgtgaatggcttctcgaactggctccaggcgcaggtccgtccggagactcgtgccatctacctggcgggcagctctcgcggtggatgcttgatgatgcgcatggcgcaagcgctccgcgcgaacacggcgctcgacggcatcgacatctacgtgtcgtcattcgacggcgtgtgccgcaacagccagggtgagctggggaccttcgacagcaagatcaacaaccccgtgcggccctggggtaccttctatggcgcgtgggccacgaacctgacggcccagttcccccgccgcgacaggctccacatcttccacgtggtgggaggccaggaggtcgctcccgccacgggcatccgcgccttctccggctacgcgggcagcaccccgccttcgacgggcacgaacctcgactggggctggtacaagcagacctgggtgaagtggcagcacaaggagattggcaatccctacacggaccccagcgcgtcggaccaggcgcaggcggtggcggagacggtcgacgcgcacttgacgtggctcgacgcgcgcctgccctga

SEQ ID NO: 8444 - DNA, 1164 bp, Myxococcus xanthus
cgcgcccgcgacctgggcatcaccttcggcggccaatccggcccgaacaacgccatcaccgacgtgtccggcgtggaggtgggccacacgacgctgatttcgggtgacacccgcggcccgcgcggcaagggcgcggtgcgcaccggcgtcaccgccgtgctgcctcgcggcaaggacggtgtgtccgaggacgtcttcgccgccatctacgccctcaacggcaatggcgagatgacgggctcccactggctcaccgaatccggccagctcgccggccccgtgatgctcaccaacaccaatgacgtgggcaccgtgcgcgactccgtcatctcctgggcgatgaagcgcggattggagtgggagctggggctgcccgtcgtcgcggagacgtgggatggcctgctgaatgacatctacggcttccacgtgaaggccacgcacgcccaccgcgcgctcgacagcgccaagagtggtcccgtcgcggagggctcggtgggcggcggcacggggatggtgtgccacagcttcaaggccggcatcggcacggcgtcacgcaagctgcccgagtcggagggcggctacaccgtgggcgtgctgttgcagtgcaactacggcgcgcggcacctcttcaccgtggagggcgtgcccgtgggcgaggagatcaacgacctgcgcccctgctacaccgggcccaagaagccgagccccggcatgttcaaggacttgccagcctgctcggcgtcgcgcggcgacacccagccccgcacgcccgagggcgccggctccatcatcgtggtggtggcgacggacgcaccgctgctgccgcatcaactggagcggctggcgaagcgcgtgccgctgggcatcgggaagatgggaggcctggggggcaactcctccggcgacatcttcgtggccttctccacgcagcggctgaagccccccaccggcacggacgtggccggtgtctcgacgctcgacaacgagcgaatgacgccgctcttcgaggccaccatccaggccacgcaggaggccatcctcaactcgatgctggcctccgacacgatgacgggcgcggagagcagccgcgtctacggcctgccccaggaccggctcatccaggtgatgaagaagtacggccggctggcgccccccgcgccgtga

SEQ ID NO: 8445 - DNA, 1575 bp, Myxococcus xanthus
atgtccgccgcgcccctgctgcttgcctggctcacgctcgccagtacgcccgccgccgccccgccgcccgtccatgacgtcttcgccctggacgaagcggccttcgtcgcccaggcccagaccgacctcgcgctgctggagcgccacgtccggggcctgcgcgggctgcaggaggccgtgaagcagtcgcgcgccgtgtaccagcagaagcagagcgtgccatacacgccggaccagaagcagctgctgctcagcacctgggcggccttcttcgactacttcgtgtccgtggaggtcatccgccagcgctactgggacttcgtgaaggtgcccgcccacgcccatccgaagaagcacgcctggggcttcctcctcacccacggcgcgctcaccacggagctggcccacggactcacctacgcggagctcaccctgggcaagaagcagctcgaggtgctgctggacgagcccgcgcccgagtacggcctgcccgcgcgcgccttcgcccggttcaaggacaaggccatccacgtctccaccagcacccagttgctcacgggggatggatacaaggaacagctccgcccgctgctggtgaaggccggcgcgctggacgccccgcgcgtgccctggctgctgcaggagatgaagcacaacagcaaggtggcgaagggactgctcacccggcgtggcgccacgctcttcgccaaggccacggtggacctgacggcggacaccgcgcagcgcgccttcttccccgtacagcgcgcggtggccgaatggatgggtgacacccgcgtgcgccgcgtgggccagccgctcatctcccgcgagcaggccctgtccctgctggagaagatggagcccggcgacatcgtggtcgcccggcagaactggtacctctccaacatcggcctgccgggattctggccacacgcggagctcttcatcggcacgcccgcccaacttggcgcgtacttcgacgacgactcggacgtgaaggcctgggtggccaccctccccggcgcaccgggctcgctcacccggcacctggcgcgcgccttccccgccaagtgggccgagtacaccggcaaggacgcgcatggcgaccccctgcgcatcatcgaatccatcagcgagggcgtgtccttcaccggcctggagcacggcatgcgcgtggactacctgggcgtcatgcgcccgcgcctgtcacgcctggagaaggcccgcgccatcgtgcgcgccttcaccttccagggccgcccgtatgacttcgacttcgacttcttctccgaccagacgctcgtgtgcacggagctggtgtggaagtcctacgctcccacgggcgacatgacgggcctgcgcatccccctggtcagcgtggctggccgtcgcaccctgcccgccaacgagctggtccgcctcttcgacaaggaatacggacgcgaggaccggcagctggacttcgtggccttcctggatggccgggaggcggaaggcaacgccagggaggcggacgccaccgctttccgttacagctaccgccgtgccaagtgggacatcgcccaggagtag

SEQ ID NO: 8446 - DNA, 288 bp, Myxococcus xanthus
atgggccagcgcacatggagcaaccaccgtttcccgttggaagtgtccgtgtcgcagcccttcggggagacgccctcgcagcgggccacgtggaaggctgagttcggcgtctacccccggtggggcgcgggcttcggcgtcttcgcgcggtacgtgaagggacaggactactacaacatcctgttcctggagcccgtggcgctgtggcagttcgggctcgcctttgaactcaaccccggcgcgcgactgcgggcggccgaggaaggtcggccgcccgggtttccttga

SEQ ID NO: 8447 - DNA, 1233 bp, Myxococcus xanthus
atggccctgcgcgccgtcctgccgtgtctcaaggagcggggcgacacgccgacgcggcagcacgcggcgcaggtgctggcggcgatgcaggacccgttgccggacgaggttcgcgtcgccgcgctatcgctgctcggagatgcccaccgcgcggtgcgccgggaggggctccatgtcctcgctcgctttccgcgcgacgaagaggtcctcaccgcgctggaggagcaggccattgtggacgatgagaatcggaatgaggccctgcgcgtgctgtcgctgctggcgccgtcacgagcgattccaagactgctcgaagtggcgagtagcgcgagatcgcgccggcaagaagacgggccgcctccgccttcctggcggggcccgctcggtgagacccgacggctcgaagatgggaagcgagccctcttgttcatcgcccggctgggcgtccggggcgcggaggcgctggcgccgctcgacgcgctccggtccgtcgaggtcctggcaccctatgtggacgccgtcatggacgacatcacgcgcgcggtgctgcgacagcaagcgccgcccttgaggacggaccgtttccaggagccgctctgcgccgcgctcttgacggacgtggcgtggcccgtcgagcgcaccgaggagccgtccctggcgcttcgcccgtggcttgagtccctggccgccttcggtaccgaggtggaggtgcgcgtggcgctcgccgccgcgaggcatgtgctgtggctgtgggagtcccaggacccgaacaacgactggtcacgccgcgcggtcatggccatggaccgctggctctgcgagccctcggaggagcacgcggcgcaggtggccgaggtgggaaacttcacccccagccagttttgcgcgccggatgccttctccgccgcctggtcggtgaactacgcctgcgggtgtgtcccccggccgtccgcgcccgtcgcaccgcgcccgcctgaagtggaccccctgggcgcgtgcgtccatgccgcgtgccgggcgctgagccgccggtcggtcatcaccttcgcgctgggcgccagcgaggagtctccagaaccgctcagcccgcatgcgtcggcacgacaggtccaccgtgccatcgtggacgaggtgctgccctgggcctgtggtgcctgggaccccgtgaaggacacgccacggctgcgcaaggcgctgcgagcggacggctggcgcatccccggcgcgccctga

SEQ ID NO: 8448 - DNA, 1011 bp, Myxococcus xanthus
gtgcccgacggcgcggagctgtatgccttcctcgcgcgcaagttcaccaccaccggcctgggcgcggaggagattcacgcgctcggcttggctgaggtccagcgcctgcgcgcggagatggaggcggtgaaggcccagacgggcttcaagggcacgctggcggagttcttccgcttcctgcggacggatgcgcgcttctatgcgcgggacggggacgaactgctgatgcgctaccgggccttgtccaagcgcatcgacccgtcgctggtgcggctgttcaagacgctgccccggcagccctatggcgtggagccgacgccggaggccatggcgccggacgcgaccaccggcttctattacccaggggcgtcggatggctcgcggccgggcacgtacctggtgaacctgtaccggccagagacgcgccccctgtgggagatggtgccgctcacgctgcatgaagccgtgcccggtcaccatctgcagacagccctggccgccgagcagcccggcctgcccgagttccgccgctacggctactacgtggcctatggcgaaggctgggcgctctactgtgagacgctgggcgacgagctgggcctgtacaccagcccgtatgacaagttcggccagttggcctacgacatgtggcgcgcggtgcggctcgtcgtcgacaccggcatgcacgtgaagaagtggacgcggcagcaggcgctcgacttcttcatggagaactcgccgcgccaggagctggacaccaccaacgagattgaccgctacatcgcctggccggggcaggcgctggcgtacaaggtagggcagctcaagattcgcgagatgcgcacgcgcgcggagcaggccctgggcccgggcttcgacgtgcgcgagttccacgacgtcgtgctgctcgacggctccctggcgatggacatcctcgaggcgcgggtgcaggcgtgggtccaggcgcggcagcgtggggccgccgcgcccacgcctcagcgcgcggactga

SEQ ID NO: 8449 - DNA, 1026 bp, Myxococcus xanthus
atgtcctccaccctgctactgacggacccgctcttcttccagcacgaccctgggcagggccaccccgagtcgccctcccggctgcgccgcatcctcggggtgctggccagcacgccggtgaagggcacggtgatgaccgcgccgcgctccgccacggaggcggagctggcctcggtccacacgccggagctgctggcgtacctccagcgcatcaacgggcaccgcgcgcaaatcgacccggacacccaggtgtcccccgacagcgtggacgcggcgcggctggccgcgggcgcctccgtgcaagcggtggaggcggtgatgaagggcgaggcccgcaacggcttcgcgctggtgcgcccgcccgggcaccatgccgagcccgacaaggccatgggcttctgcctgtacaacaacgcggccatcgccgcggaggcgggccggaagctgggcgccgagcgcgtgctggtcctcgactgggacgtgcaccacggcaacggcacgcaagcggcgttctggtcgcgccgggacgtcatgtaccagtcggtgcaccagttcccctacttcccgggcactggcgccgcgccggaggtgggcgtcggcgcgggcgagggctacaccatcaacgtgggcctgccgggcggcaactcggacgcggactacgggatgattttcgaggagctgctgctgcccgtggcggaggcgtaccggccccagctcatcctcgtctccgcgggcttcgactcgcaccagcacgacccgattggcggcatggacgtcagcgagcgcggcttcgcggccatgtgctcggcgatgaagtccctggccgacagcgtgtgccagggccggctggtgctgctgctggagggcggctattcgctggagggcttgtcccaatccgtgcatgcctgcgtggaggtgctcgccgggcgcaaggacagcttccccacgggtgacacgcacgcggacgcgaaggacgcgctgcgggcgagccgcgaggcgatgcggccgtactggcctcgcgtctag

SEQ ID NO: 8450 - DNA, 784 bp, Myxococcus xanthus
cggcagcacacgggaggactgcatggcggagatgagctaccggacggcgttggtgacgggtgcctccagcggcctgggacgcgggctggcgctgtggctcgccaggcggggcgtccgcgtgttcgccgccggacgccgcctgccgcagctccaggccctgcgggatgaggcccaggcggccggcgtcaccgtggagcccgtggagctggacgtcacgaaggcggacgccaccctggagcgcatccgcgcgctggacgcagaagcgggcgggctggacctggtggtggccaacgcgggcgtcggcggcacgacgaatgcgaagcgcctcccgtgggagcgcgtgcgcggcatcatcgacaccaacgtcaccggcgccgccgccacgctgagcgccgtgctgccccagatggtggagcgcaagcgcgggcacctggtgggcgtctccagcctcgcgggcttccgcgggctggccggccacgcggcctactccgcgtccaaggccttcctgtccaccttcatggagagcctgcgcgtggacctgcgcggcaccggcgtgcgcgtcacctgcatctatcccggcttcgtgaagagcgagctgaccgccaccaacaacttccccatgcccttcctcatggagacgcatgacgcggtggagctgatgggcaagggcatcgtccggggcgacgcggaggtgtccttcccctggcagctcgcggtgcccacgcgcatggcgaaggtgctgcccaatccgctcttcgacgcggccgcgcggcggctgcgctga

SEQ ID NO: 8451 - DNA, 695 bp, Myxococcus xanthus
  unsure (1)..(695): unsure at all n locations
gtgacgacgccacagcccttcgcccaccgtttcagccaactggccgagcagcgctcgccgttctgccttggcatcgacccgtcgagagacctgctgacacgttggggcctgcccgacaacgcgcggggcctgcgcgacttctgcgagcgcgtggccgacgcggcggggagctccgtcgcggtggtgaagccgcagagcgccttcttcgagcgccacggccccgagggcctccaggtcctccaggagctgatgcggcgcttcaagtccgtgggcaccctcacgctgctggacgtgaagcgcggagacatcggctccacgatggaggcctacgccgagacagtcttcggcgagggcagcgcctacgaagcggacgcggccaccttcaccgcctacctgggcctgggcgcgctgctgaagacgctggagcgggcgcgcgcctccggcgccgccgccttcctggtggtgcgctcctccaacccggagggcacgtcactccagatgtcgcgcggcgaggacggccgcaccgtggcggaggccctggcggacggcctgcgcgccttcaacgagaagcccggccaggacgcggcgccagtggcgggcgccgtcatgggcgccaccctccccgactcggaccgcggcgtcatcgagcggctcggcggcgcgctgctgctcacgcccggcatcggcgcnaagag

SEQ ID NO: 8452 - DNA, 630 bp, Myxococcus xanthus
atgaagcagtcccgcaggcacttccgggccaatctgcgctacctgcgggcgctggtgcggcgatttcgcaccacgctggtgctgtccgccgtgctgttcctgggagggccgctgctcttccattggcgcttccgcgggccgggcggcgaccgcatcgacttcggcgaggcgctgcaccacacctacttcctgctctacggccagccgtcgctgccctatgtggacgactggatggtggagctgctcaacctggtgattccgcctgctggtattgcgctggtcgcggatggtgtggtgcgcttcgcgtacctcttcttcgcccggcacaagaacgacaaggagtggatcgaagtggtctccgagacgatgaagggccacgtcgtggtgtgtggagcgggacgggtgggctaccgcgtggtgacgcaactgcgggacatggccaaggacgtggtggtggtgtacaagcgcgaggacgcggccttcgtgtccgcgctgcgtgacgagctggtcccgctgctcatcgacgacacgcgcagcccgctgtgcatgcctcgcaccaacgtgaaggatgtgttcccccatcgtgtgatcgagggcgcccaccacctcaccgaacagcgcgtcctttag

SEQ ID NO: 8453 - DNA, 315 bp, Myxococcus xanthus
atgcacgagcagctctcgctggtgctgctgctcatcctcgccttcggcatcatcttcgagctgccgctcgtcatggccctgctgggcgtggtgggcgtggtgaagtcgtcctggctcttcaggtaccagcgccacgccttcgtggtgtgcctcatcgcggcggccatcatcacccccacgggagacgtggtgaacctgtcgctgatggccggccccatgctgctctgctacgagctgggcgtgttgttggtgtggatggtggagcggcgtcgcgcgcggaactcggcggaaacgggcatcaccccggcgtcgtag

SEQ ID NO: 8454 - DNA, 672 bp, Myxococcus xanthus
gactccgagctgcgcatgagtctggcggatcacctgacggagctccgctcgcgcctcatgcggtgcaccatcgccgtgctcatcctggggacgatttcgctcgtcttcgccaagccgattttcggcctgctgatgcagccggtgctggatgcgctgccgcccgagaatcgctcgctcatctacacgtccggcatcgaagagctgaacgtcctgatgaaggtgggcgtgtactgcggcatcttcctcaccacgcccgtcatcctgatgcagatctggggcttcgtctcgcccggcctgtatccggaggagcgccgcttcgccgcgcccttcgtggcgttcggttccatcgccttcctcctcggcgccgccttctgctacttcgcggtgctgccctccatgttcaccttcctcctcaacgaggaggagacgctcgcgctggagcagcgcctggacacggcccggctgcgcgcggatgacgccttgcgcttcttcgctggcgaacgagagcggggcgctccgaagaacgagccccactgggcgaggccaggccagcaccgcgccgagtgcgcccccgcaggtgagatacgggcggtggaggctgggcggtctgaccggggtggtgggttcgcgccatccccgcgtgtcgcagcggtgaaagcggtgaggccgtga

SEQ ID NO: 8455 - DNA, 525 bp, Myxococcus xanthus
atggtgttcatcctggtggccgcgctgctcattctcgggccgcagcggttgcccgagctcgcgcgcggcatcggcaagttcctgcgcgagttccgccgccagacggatgaggtccgcaacgtcgtggagcgtgagttctacgccatggaccaggaaatcggagaacctcccaccgcgcccttgcggcccgggacgcgcttcgcgccccagccgccgcaggccgtgggtgggcccgaggccaccctgcctcccgccacggatggcgcgtcacctccggccgatgcggcgtctcctcagccctcgtcgcccgcgcaggtgctggaaatggacgcgcaggggcctcgtgaggtggccacctccgacgtgcatgccggggagacgcccgcgcaggacgctgcgacggcggagccgggcgcggagcccaccgccgaggcgccgcccgagcccgctgcttccaccgccacctcgcccacgctgtcgcccatcccggggacggtggcgcgcaacgccccgaaacggagctga

SEQ ID NO: 8456 - DNA, 252 bp, Myxococcus xanthus
atgctgcagctgtccagccagctcttcgagaagatgatttcccagcagcaggccaaggtgctgcgcctggcccgcgaggccgtgcccaacatctccccggaggaggtgcgcaattcccacgacttcccggaactcaaggaacatcctacatttgagttcgaggatggaatcctgtccgggctgattgcggcccagattgccctgcgggcggaaatcaagggacggctgccgcttgaacctccagcattctga

SEQ ID NO: 8457 - DNA, 1278 bp, Myxococcus xanthus
atgccgaatcaacgacaggtctccgagcgcgccgtggtggccctcatcggcgcggtccagttcgtgaacatcctggacttcgtgatggtgatgccgctgggcccggacttcgcgaaggagctgggcatcgcgtcgtcgcacatcggcatcatcggcggcgcgtacacggccgccgccagcgtggcggggctggccggtggctacttcctggaccgcttcgaccgccgcaaggcgctggcggtgtccatgctgggcctggtggtggccaccgcggcgggtggcttcgccacgggcatgtccacgctgatgctggcgcgcgtggtggcgggcatcttcggcgggccggccacgtcgctgtcgctgtccatcatcgcggacctggtccccgtggagcggcgcggacgtgcgctgggtgcggtgatgggcgccttctccgtggcctcggtggcgggcgtgcccatggcgctgaagctggccgagttcggcggctggcgcgtgcccttcttcgcggtggccgccatgggcctgctggtggtgctgggcgccatcttctacctgccacccgtgcgcggccatctggacgcggggccccgcaaacaggccggcgtgctcgagctgctggccaaccgggacatccaactgtcgtacgtgatgacggcgttggtgatgatggcgggcttcgtcctcatccccaacctgtccgcctatctgcagcagaacgtgggctacccgcgcgacctgctctggctgccgtacttcatcggcggcatcgccagcttcgcgacgctccgggtggcggggcccatggtggaccggtacggctccttcaaggtgggcacggtgggctccgcgctggtgctgctgtccacctacgtgggcttcgtccacctgcctcggtggatgcccgtccccgtcatcttcacgctcttcatggtggccatggggacgcgcaacgtcgcgtacaacacgctgacgtcacgggtgccggacaccccggtacgtgcgcgcttcatgtccctccagtccgccgtccagcacatggccgccgccgtgggggccttcctcagcgcccggctgctgacggacctgccagacgggaccctgggcggcattccccggatggccggagtgtccatggtcctgacgctgttgcttcccgccttgctgtgggtggtggagcggcgggtgcacagcagggagcaggcacgggcgctggcggtggctccctcgcaaggaatggcggttccgctctcgcccggggcggattctcacgcgtag

SEQ ID NO: 8458 - DNA, 2694 bp, Myxococcus xanthus
atgacgtcccggcgcgaccagaacgccgcttgcgtgccgttgccgtggtgcacgtcccagtcgaggaccagcacgcgctcggcgcccagcttccggcccgcctccgcggcgatggccgcgttgttgtacaggcagaagcccatggccttgtcgggctcggcatggtgcccgggcgggcgcaccagcgcgaagccgttgcgggcctcgcccttcatcaccgcctccaccgcttgcacggaggcgcccgcggccagccgcgccgcgtccacgctgtcgggggacacctgggtgtccgggtcgatttgcgcgcggtgcccgttgatgcgctggaggtacgccagcagctccggcgtgtggaccgaggccagctccgcctccgtggcggagcgcggcgcggtcatcaccgtgcccttcaccggcgtgctggccagcaccccgaggatgcggcgcagccgggagggcgactcggggtggccctgcccagggtcgtgctggaagaagagcgggtccgtcagtagcagggtggaggacatcgggatgaccttacgcatccgccaggcgggaagtcagcgccccccgggggacaggccgcgttggcgccctgttcttgccctgccggtgtttccctccctacagtgcctcgtcttggctctccggttcaagaaacccggcctgcgcagcctgctgctgggctccttcgcgctcgtcctcaccctcatcctggggacgctcttgttcgtcgtcccctcgcgcgtggaagcccacctggagcagcgcctgcagaagcggggcgaggcccgtgccagtcaggccgtcagcatgctgatggcccagcccgccgcggccctgcccgacagcttggggcggctgcgcgcgggcgacgacgacttcaaggtgctggccgtcctctccagcgagggtcaggtgctggccacccacccggccgagccgcccgcgtggttccaggcggagctgaaggcccggcagggccagccgctggatggcttccgcttcgccaacggtgatcgctccgtggcgcgctcggtgacgctgtcgggcggcgtggtggggcaggcgctgctggtgctcgacaactccgggctggacgcggtcgtcaccgaactccagcgcgtcgtgatgctcgcattcggcatcggcctgacgctgttcctgctggtggccttcttcatctcccgcgccttcatcctggtgccgctggacgcgatgatgggcatggcccggcggctggcggaggcggacctcaccggccgcgtggacgtggggacgcgggacgagctgggccagctcgccgaggcgctcaaccgcatcgcccagagctggcgtgacacgctgggccgggtgcgcggcgtgtcggacgtggtggcgggcgtggtggagcagattcaccgcaccggcaccacggtgtcgtccggcgcgggcacggtgcaggcgcgcgtggaggagacgtcctcctccatggtggagatgatggcctcgctgcgaggcatcgcggagaacgtggaggtcctctaccagagcgccgaggagagcagctcctccatcatggagatggccgccaccaacgacgaggtggcggagaacgtccaggccatggccgccagcgtggaggagacgaccagcgccatcgaggagatgacgttctccatcaaggaggtggccaccaacatccaggagctgtccgcctccacggaggagacgtcctcggccatcagccagatggacgccgccatcggtcaggtggaggccaacgcgaaggagacggcccgcctgtccgagcaggtcttcgacgacgcgcagacgggcgtggagtcgctgcgcaagacgctcaccggcatcgaccgcatcaaggagacaagccgcagcgcggcccatgtcatcgaaagcctgggccggcgcatctccgagattggcaacatcctcaacgtcatcgacgacgtggcggagcagacgaacctgctggcgctcaacgcggccatcatcgccgcgcaggcgggtgagcacggcaagggcttcgcggtggtggcggaggaaatcaaggacctggccgagcgcaccggcgcgtccacgaaggagattgccgagctcatccgcagcatccaggaagagagccgcaacgccgtggtggtgatgaaccaaggcgtgcgcagcgtggaggagggcgtgcaactgggccgggaggcggaaggggcgctgcgcaaaatcaacgacagcacccagaagtccacgcagatggtgaaggccattgcccgggccaccgtggagcaggcgcgcggcagcaagcaggtgacggcctccatccaccgcatcagtgagacggtgcagcagatttccaaggcctccaacgagcaagcccgcggcggcgagcagatcatgaagagcgcggagaaaatgaaggcgctcaccgcccacgtgcagcgcagcagccaggagcaagcgcacggcagcaagcagattacccgctccatcgagagcatcaacgagatggtcacccacctgaaccgcgcccagaaggagcagacgaagggcagcgagcaggtgctcaaggcggtggagaccatcaagggcgtgtccgagcaccagacacgctccgtgaagcagttggaggaggccatcgacaacctccagcgtcaggcggaaatcctccgtgcggaggttcgccgcttccgggtgtag

SEQ ID NO: 8459 - DNA, 393 bp, Myxococcus xanthus
gcgaacctcaacaccgcgaaagacgtgctgggcgtcgcggtgcgcgtgttgaaggcccgcgtggcccaggccgaaggccggccccaggccctgacgctgtggcgggaagccgtcgacgccgcggaccggctctcctacgccgagcccgcggactggttctatccggtgcgccactaccagggcgccgcgctgctggaggccgggcgcaatcaggaagcggaggccgtctaccgcgaggacctgcggcgcaacccgaagaatggctggggcctgtttggcttgacgcagtcgctcgaagcgcagggacgccatgaggaggcggctcgcacccgctccgctttcgagaaggcctgggcgcgcgcggactttccgctcacgacgaccgcgccctga

SEQ ID NO: 8460 - DNA, 375 bp, Myxococcus xanthus
atgtccgacaccccgaccctgctgctcgtcgatgacgacagtttcgtgcgccgtatcctcaaggacgtcatcgccgacacgggcatcgagctgcggctgctcgaggctgcggacggtgaggaaggcctggccgtggccgcgcgggagaaacccgcggtgatgttcctggacctgttcatgccgaagaagagtggactggaggtcctgggcgccatcaaggcggtgtcgcccaccacgcgtgtgttggtcatcagcagcatggacgcggagcccgtcgtggagcaggccatggcggcgggcgccgtgggcttcgtgggcaagcccttccatccgctcgagatcgcctcggccgtgcgccaggcgttggctcactga

SEQ ID NO: 8461 - DNA, 816 bp, Myxococcus xanthus
atgcagagcctgccggcccacgaagtctttggcctcaagcccaccgccagcctggacgagctgcgtctggcctacttccgcatggccaggcgcttcacgccggaccacgtgtccccggacacgcatccggagctgaagaaggtgtcggcggagatcttcgacttcctgtcgcgccgcatgcgcgatgcggaggccaactggacgcaggcggcgcaggcgccccgcccgccgccgcccgtcgtgcccgccgcgccgccccggcccccgccggtggtgcacgcggcccccgcggcggtgcgcgcgcccgtcgtgcccgccgcgcccccgccgcgccccgtgcaggccgcgccggtgatggcgcgggcacccattgccccgccgcccgctccaccgccgcccgcgccgccaccgcccgccccggccatgcgccgggccgcggcggcgcccacctattccagcgcggagttcgtcggcctggagcggcgttcggatgaccgcatccacgcggacgtgaaggtgacgctgcagaacgcgggcatcttcaccgaccaccgcatcatcaacctgtcctcgggcggactgttcatcgccacggacaagccgctgcggctggggaccttggtggaactcaccttgcgcttcgatgagccgccccgggtgctgacactccgcagctccgtcatctgggagaattcgctggaggacggaaagaacccgcgcggctacgggttgcgtctgagccaccttcgcccggaggagaaggagttcgtgcagaagtacctggctcgcgcaaaggacctgaagaagaagccctga

SEQ ID NO: 8462 - DNA, 1629 bp, Myxococcus xanthus
atgaccgtcgtgtccaccgcctccgccgaataccggctgcttgaagcgatgccgctccccaccgccctcatccgcggcgaacaggtgctacgggtcaacgcggcgctcgccaccctgctgggcgttccagcgtcggagctggaagccctgtcgctctccgaaagcatccgccgcttcgtccccgcggaacgcggctgggtggagccgctgtatgaatccctcgtccgcggtgggccgctgcccgaaggtcccgtgtgggtgcgcgtgcagccggtgaacggcccccagcgcacgctggccctgaggcatgcgcccggagcgcacccggacgaattggtggtggtgctgctggaggcggaagcggaggactccgtgcggcgcctcacggaggcgttggtggcggccgccgcgacgatgctgcgctgccgcgacgagcggtcggtgctggagacggccgtggacgccatctaccgccagggcttctccgtgtccgtcgtctacgtggacggcgacgccttccggtacgggcccctgcgacagagccccttcatcgtggccgaggccgagcagctctacggcatgcccctggcggacgtgcgcattccgaacgccgcgctgccgcacttcctggaggtgctcgagcggcgcaaggcggccttccaccacgacatgctcggcgtggcgcgcttcccgccttcggccaacggggagagccccgtgtgccagttgcatccaccggacatgcgcgggctggacgcgcccatcctcgtggacgggcacccgttcggcgtgctctccgtgcagggccccgccctcacccccgcgggcgccagcaccctggagctgttcgcgcagttggtgggcggcgcgctggagaacgtgcgccaccaccagatgtccgcggtgcggctggaggaggtgtcccggctccaggacgagctggtggcgcgcgagcggctggaggtgctgggcgaggccgcgggcgtcgtggcccacgaggtgcgcaatcccctgggcgccatcctcaacgcggtggcggtgctgcgccgcgaggcccacctggggcccacgggacaagccgcggtgggcatgctggaggaggaggccatccggctggaggacatcgtccgggacctgctggacgtggtgcgcccgctggagccgcgcccccgccccgtgcagttgggcgagctggtgcgccgggcgctggggcagatgcatggcccgccggacgcccccacgctgcgcttcagcgtggacgaggccgcggagacgcctccactcgaaggggacgagacgctgctccaactggcggtgacgcacctggtgcgcaacgccgtgcaggcctcacccgcgggcggcaaggtacggatgacggtggagcccgcggacggaggcgtgcgcctggtggtggaggacgaagggcccggcattcccgacgtggacccgcagcgcgtcttccagcccttcttcctcacccgcgccaacggacgggggctggggctggccattgtccggcgcgtggtgctggcgcatgagggcagcgtgcgcgccagcagccggactcgcggcggtgctcgcttcgagctgtggctgccgcgagcgcctagccgtatgtctcccgtttga

SEQ ID NO: 8463 - DNA, 147 bp, Myxococcus xanthus
atggggcgcgtccatgcggcctatgacccggagctggaccgcaaggtggcgctgaagctgctgaacctcgcgaggcttggggaggactcgctggcccaggcacgtcagcgattggagcgcgaggcccgcacgatggcccgcctgtcg

SEQ ID NO: 8464 - DNA, 897 bp, Myxococcus xanthus
atgcatggggcgaacgcggagttcttcgagtgggtgttgcaggccgctggcgagccatcctccgctcgcctccgtgcggcgccgagtgccagggaggccgtggaccgcgccgtctccctggccgccgccctccaagccgccgcgcccgagtccaaggccttcgctcaccacctggggacgctgctttcgcgagcggtggacccggtgctctcgctggagcgactgcatgccagggacgtcgcgctcgcgctctcctgcgcgcagggactgccagcggctcgtgcgctcctggagcaggaggttctcctcaagttgcgcgtccccctggcgcgcatccacccctcgccggtgttcgcggacgaggtgttgcaagcgctccgggccaacctcctgatgcctcgcgcggaggctccgtcccggttgctcggctacgcgggcgcgggcccgctgctgcactgggtgagcatctccgcgacaaggctcgcgctgcggatgcgcaaggcgctgggagaagcgtcccacgtcgaggccgaggtgctcgccgaacaccccgcgccgggcggcctggagctgggcttcgtgcgggaggaggcacgggggcatgtgcgcgcggccttcgtccgggcggtggcctcgctggacgatgaagaccgggagttgctgcggctgcacttcgtcgagcgcctctccctggagcgcatgggcgccctgttcgacctgcacaagtccaccctctcacgccggctcaccgcggtgcagtcgctgctggagaaacggacgcggcgcgcgctcgctgaacgcctgtcgttgcccgagccggaagtggacagcgtgatgcgcgccatccatggacggttggacttgagcctctcgggcctgctggaggggcgcgagtga

SEQ ID NO: 8465 - DNA, 1401 bp, Myxococcus xanthus
atgtccaccgacaatgctctctcacacttcgagtcgaagaagcagacgtacctggaggacctcaagtccctggtccgcattcccagtgtctcatttcctggcttcgatgcgacgcaggtacgacgcagcgcggaagcgactgcacggctgttgaaagaccgtggttttgaaaacgttcagctactcgaaatcgagggcacgcacccctacgtctatggcgaggtgctcaaggcgccgggcaagcccacgctgctgctctacgctcaccatgacgtgcagcccgcgggtgacgaggccgcgtggaagagccctccgttcgagccggtggagcgcgacggccggctgtacggccgcggctcggcggacgacaaggcgggcatcgtcgtgcacacgtccgcggtggagtcgtggctgaagggcgcgggagcgttgccgctcaacgtgaaggtcatcatcgagggcgaggaggagattggcagcaacttcctgggcgccttcctccaggagcacgcggcgctcctgaaggcggatgccatcgtcctcaccgacacgtccaacttcgataccggcctgccgtccatcactaccgcgctgcgcgggctcgtcacggtggacgtggaggtgcgggcgctgcggcaggcggtgcactcgggcatgtggggcgggccggtgccggaccccgtcatggcgctgtgccggatgctggccacgctgacgcacgcggatggctccatcgccattgaaggcatccgcgagcgcgtgaagccgctgacggacggagagcgccagagcatcgaatccctgcccggagacgaggcgcacttccgcgcgcagtcgggccttctgccgggcgcgcaggtgctgggaggcggggcgcatccgtgggagatgaactggcgtcagccgagcatcgccatcaatgccatccaggccagcagccgcaaggacgcgcgcaacatcatctgtgattcggcctgggcgcgggtgggcatccgcatcgtcccggacctggaggcgcgcgacgtggagcagcgcctgaaggagcacctgcgcaaggtgtgcccgtggggtttggaggtccacttcgacacggagggtgcgtccggttggtggtacacggacccgtcccaccccgcgttccaggcggccttccgcgcgctggagaagggctacggcacgaaggcggtcgccattggctgcggcgcctccattcccttcgtggagcccttcgcgaaggagctgggcggcgtgcccgcgctgctcatcggcgtggaggacccgtacacctatgcccattcggagaatgaaagcctgcacctgggcgactgggagaagtccatccgcagcgccatccacctctacgcggagctggccgaggccctgagcgcgcggaaggcttga

SEQ ID NO: 8466 - DNA, 114 bp, Myxococcus xanthus
atgatgaacttcaagaacctgatggaccgcgatgacctggagttgaaggctgtcatggccgtgatggcggtctacgtgatgatgggcgccgtcttcctggggcagatgctgtag

SEQ ID NO: 8467 - DNA, 708 bp, Myxococcus xanthus
atgctggacgtgctcgcgtgccgggtgcaggtggaggcggagcggctgagcgagaagggcgaagtcctggcgccgctgcgcgccttgcgccacgtgctggcggacatcgagggcttccgcggcaacgaggacgactaccactccccggagaacagcttcctggaccaggtgctggagcggaagctggggctgccgattacgttgtccgtcgtctacctggaggtagcgcgtcgcgcgggcatctccctgtacggcgtccccttccccggccacttcctggtggcgcacgacgcgggggaccacaagctggtcatggacccgttccatcaaggggacatcctcaccgagcacggctgcgaggagctgctcaagcgcgtggcgccgcagctcaagttcgaccgcaacatgctggcgcccgcgccggtggagctcattacgtaccggatgctgtccaacctgcggcgcgtgtacctgggcagagaggactgtgagcgcgggctggcggtggtggacctgctgctgctcctggcgccggaccacccgggcgagctgcgcacccgtgccgcgctgctcagcaacctgggggcataccgcgcggcgctgaaggacgtggagcgctgcctggagctttcgcccgatgcccccgaccgcgaccggctggagatgacggcccgcgagctgcgggagcgcgccgcgctgctcaactga

SEQ ID NO: 8468 - DNA, 876 bp, Myxococcus xanthus
  unsure (1)..(876): unsure at all n locations
gcccgcgcgtcgcgcgccagnaagcccgtggaatacgaggtcaccgtcgaccacgtgcggatggacacgcacgacacggcgacgctgttcctggatttcggcggagtcccggtggattacaaggccgggcagttcctcaacatcgacccgcaccagttccccgccttgggccgcctgtcggcctacctccaggagcagaaggggcggaaggagccgcagcgttcctactcgctcgcctccgcgccacacgagccgctggtggccatcaccgtgaaggacgaggagttcgtccccggcctcacccgctatccgccgctcttgtcgccctacctcgtgcatggccggctcaccggcgcgcggatgaaggtgatggccttcatggggccctacgtgctgccggaggacgtggaggagcgcacggagcacgtcgtccatttggtggccggctccggcgcggtgcccaacttcgccatcctcaaggacgcactccaccgggggttgaagctgcgccacaccttcctcttctccaacaagacgtggggggacgtgctgtacggcgaagagctggccgccctggagcgccagcacccggaccgcgtgcgcgtggtgcacacgctcacccgtgagacggatgagtcgcgcttcggcgccgccgtgcggaagggccgcgtccaccagtccctgctggaggagctgattcaggaccgggatacgtgcctggtgtacgcctgcggcccggcgattacgccgtgggaccggcgcaaggcgctggagacgcgcacgccctccacgccgcgcttcatggagacggtgctgggccacctccacgcgctgggcatcgaggacaagcgcatcaaacgggagacatacggctag

SEQ ID NO: 8469 - DNA, 1494 bp, Myxococcus xanthus
atgctggaagccatcctccaggtctcccccctggccatccacctgatggacgtggatggcacggtgcggctgtggaaccccgccgccgagcggctcttcggctggagccgggaggacgtgcttggccaccgcgccccctgggccaccgacgcccgctgggagaagttccgccgccatcaggagcaggccacgcagggcatggagccgccctgtctggagctggagctccaccggcgagatggcacgcccctccatgtggagctgtgggcggcgcccatgccaccggccaccaccggtcccgcccagtgcctgggcatgctggtggacgtcaccgagcggcgccggggcgaggcccaccgacggctcctgtcagaggccagtgaagtcctcggctccagcctggagcaggacgcgacgctggagcacctggtgcggctcgccgtgcctgcctgcgcggattcctgccgcgtgttcctcgaagatgccccgggcgaggtgcgatgcgtggcgtccgcgggcctggatgcacgggagcccctgaatgcgggtacgcctctcgtcccggacgaagcggcggtgtcgcgaatcatcgcgtccggagagccggcgctgcacgacgcggagccgccgtcctggctgggcgtgccgctggcgtggccggggcggaagggcgccgcgcttgtcttctcgcgcaccggacggaccttcgacgcgcgggacgtggcactggcgcgggagttggcgcgccgggcgtcactcgccctggaccacgtgcgccagtaccacgaggcgtgccaggccatccgcgcgcgcgaggagctcttggccatcgccagccatgagctgaagtcccccctcagcgcgctccagctccaggtgcagaacctgcgcaccgcgctggagcgctcaccggacgccgtcccccgggagcggctgcaccgggggctggacctgatgggccggcaggcgaagcgtcaggcgaagctcatcgacgcgctgctggacgtgtcgcgcatccacgccggacggctggagctgaacccggagccggtggacctgggcgccctggtccgcgaagtggcggagcgcctcgagccggagctggcgggcgcgggcacgcgcctgacgttgacactgccgttggaggcccacggctactgggaccggctgcgactggaccaggtgctcaccaacctggtgtccaacgccatgaagtacgggcggggcaaccccgtccaggtgacgctgtccagcacccaggcccacgtgcgcctggacgtgcgcgacgcgggcatcggcatcgcgccggagcacctgcaccgcctcttccaccgcttcgagcgcgccgtgtccggccgggactacagcggcgtcggcctggggctgtggattgtccgcgaggtggtggaggccatgggcggccacgtcaccgtgagcagcgagctgggcgtgggctccaccttcaccgtcgtgctgccgcgggcgcgcgggtga

SEQ ID NO: 8470 - DNA, 957 bp, Myxococcus xanthus
atggcgcccttccaaaaggagcgggccatggcggagacgggcaacacgcggtggggaacggcgaggctggacggaggcaaggtgctgcgctggagcctcctgcacgtgggagcgctggtcgggggcacctgtttcttctcgtggagcgcggtggcggtgttcgccgggatgaccgcggtgacgatgtgcctgggcgtgtcggtgggcctgcatcggggactcatccaccgggcctttcgtgcctcggcgcccgtggagcgcgcgttggcgctgctcggcaccctggccggcctgggcggccccatcgcgatgagccgcatgcatgacctgcgcgacttccaccagaaccagccggaagcggactgtcccccctacttcggctaccgcgagggcttcacgcgcgccatggcctacgccctcttccacacctggcacccgcgaagcggcgccgcggacgtgccagcggcgccccatgtcacgcaggacgtgttcttccgcgggctggagcgcgcgggcctgtggctccaggtgccgctcgccctggcgttgtacgcactgggcggggcgccctgggtggcctggggcatcctggtgcggctggcgctcacccaggacggcttctggtgcgtccattacgtgagccacgtggagggcgagcagccctacgaactgccgggctgcgccgaacagggacgcaacgccggctggctggcgctgctgagcatgggcgagtcgtggcacaacacccaccacgtctacccagcctcggcgcagatggggctcgggtggcggcagccggacccaggctggtgggccgtgcgcggactggccgcgctgcggctggtgcatgatgtgaagtcgctggcccacctgccgccgcgtccgggcgcacgcacgcgccgcccggagcctcatcgaacccggcgcctctgcgtgctcgccctacgccgggcctga

SEQ ID NO: 8471 - DNA, 1268 bp, Myxococcus xanthus
atggattggacgagcggactgcacgaagtcttcggctacgcccccggcaccatccgggacgagcatcgctggtgggaggaacggctgcacccggacgaccgcgcgcgcgtcgtcgccagcctccaggccaccgtggagggccccgagcacgagtggcaggacacctaccgtttccagcgcggagacggctcctgggcctacgtggcggaccgctgccacatcatccgcgacgcgcaggacaacgcgacgcaggtggtgggcgccatgcaggacgtcaccgagcgccacgaggccgaggccgcccgggcccggctgctggagctggagcgcggcgcccgggaggagtcggaccggcagcgcgccatgctggccacgctcttcgaacaggtgcccgcgctgctcggcgtgctgagcgtgccggaccagcgctgcgtggtggccaacgcgcgtctgaggcagcgcttcggccagcggcagttggtgggccgcacgctccgcgaggccctgccggagctggagggccagaacgtcctcgagctgctggataccgtcttcgccactggcgagcccttcagcgcgcgggagctgcccgtgcgcatcgcccaggtgcccggcgcccttccgccggaaggctacttcgacttcatgtaccagccgatgcgggacgccagcggacggctggccgccgtcatcctgttcgcggtggaagtcacggactccgtcctggcgcggcacaaggagtcggagctggcgcagcagatgaaggcccgcgcggacttcgagcggcagctcatcggcatcgtcagccacgacctgcgcaacccactgggggccatcagcctggcggtgtccatgatgctccagcgcggactgctggatgagcggcaggcgcgtcaggcgcagcgcatccggagctcggcggaccgcgcgacgcggatgattcgcgacctgctcgacttcacccgcgcgcgtcagggaacggggcttccggtgtacccgcagcccatggacctgcacgaagtcgttcgcacggtgctggacgaggtgcacgccggctggcccgaccgtcacctggagacggaacgcaccggagatggcgtgggcacgtgggacccggaccggcttgcgcagctcattggcaacctggtgggcaacgccttgcagtacagcccgcccggcacgcccgtgcgggtgacgtcccgaggcgatgacgacggcgtcgtgctggaggtccacaacctgggcccggcgattccccttagagcact

SEQ ID NO: 8472 - DNA, 546 bp, Myxococcus xanthus
atgaagcgcatgctgatgccgctccgccggagcgtgctggtgttgggggtggtgctgggggcgagcgtggcgatggccgaacgaaagcaggacgccatcaacatgaagattgcctaccagtcgttcaacctggagatgacgccagaggcggtgtcgggggcggacttccaggtggctcgctcgcccgggatgctgaagggccgcgggctgaagggcaacttcgccctgacgctgaaggacggggcggtggagggcgccgtcggcggcgcgccggtgaacctgacggtgacgaaggagggggacgccatcgtggccaagggcggatttggcggacgccccgtcaacctgaagctgagccccagcgagctcaccatctacgtccgcgactgcacctaccggctgaaggcggcgaacacgaaccgcttctacacgggccggcgcagctgcgaccgggccatgacgcccgactcggaaatctggctgccggacgagttcctcgcggcgagccccgaggagaaggccgccatcctgttcctcgcgctgtga

SEQ ID NO: 8473 - DNA, 423 bp, Myxococcus xanthus
atgccgactgaagacgactgggtgccgagcccggatgacctgccgtaccaccggctgggcggcaccgacgcggccatggccctggccgaggctttctacgacgccatggacgcccacgagccggagctggcgcgcctgcacgaactggacgccgagggccgggtgaaccgcggcacacgcgagcggttcggcttgttcctcgcgggatggttgggcgggccgcaggactacacggagcgtcacggccacccccgactgcgcatgcgtcatggccacctgtccatcggcgtcgccatgcgtgatgcgtgggtgcgctccatgcaacgggccatggatgcgcggggcatctccgggggcctgcgccgcttcctcgatgcgcgcttcgcccacgtggcggacttcctgcgcaacgtcgaggagtga

SEQ ID NO: 8474 - DNA, 693 bp, Myxococcus xanthus
atggcggcgaacctggagtgcccgaagtgcggcagcgagctcgacgtgacggggcggggcccgggcgccatcattcgctgtgcctgcgggaacctgtcagccgtcccgaagcgctcctattgggcgagcccgcgcggcgtggcgctggccctgggggtgttcttgctctgcccctgtgtgggcatcctggccgccatcgccatccccaactacaacaagcttccggtgcgctccaagcagcaggagtgcaaggcgaacctccgtggcctctacgccgcccaacgcaaccacaacgccgagcacggcaccttcgagccgcgcatcgtgaatgcgggcttcatcccggagcgaggcaaccgctacgcgtacttcacgggcacggggccgctggtgacgcgcgacgcggaaggggatgcggttccggcggacgccggtggtattggcgtggaccgctctcgggacgcgagccgccgagccattaccctggcggaccttcctgcttgggtgtcccggcaggtgggcgtctttggcacgtgcccggactgctacgtcaccatgggctgcgcggggaacatcgacatcgatgacacagtggacgtctggctcatctccacgaagccgctcaaggatgagtacggcgaggccgttcctcctggcaccccgacgaatgtcgtgaacgacgtcgacggttga

SEQ ID NO: 8475 - DNA, 1083 bp, Myxococcus xanthus
atgatggacgccgacgccatggcggacatggcgctgcccgaggaggccgtgggcaccaccgcgtccgcggtggagacggccagtgacttccgctttcgcaccgccaaccgctacgcgggcattcacggctacgcggcgggctacggcaactttcatgaagccaactacggcgcgggcgtggtgcgtggcaccatcctgctcaagccgggcaccgtggcgcactacctcgcagtgccccgctcctcgctgggcaacactgcgctgagcaacatcccggagttgttccgccgcgcgcaggactacggcaacgcgcacgggttgggcatcgcgctgccctcgttcgagcagggcctcaacggctccgtcgtggagtacggcgtccacttcctccaccccagcgtcgtcgagttccgcgacgtcccgggctgggccattggctacccggacgtgacggacgccggggccatgatgcgcgccgccagcgactacgcctcctcgaacggcttcgccgggggcctgcccaccttccactccgccatctacagcggcacgagggtgtatggcatgcacctcatccgtccgggctacgccgattcgcgggacgtgctcgcggacgtgctggcgatgcaggaccgcttcagttccgacaccgccaccgtcacgggcgacaactgggcccggacgctgcggcgccacgaggcagcgcaggactccatccagacctgcacccacctgaccaccctggagaagtccgcgctgcgcagtgcctaccgcaaggccatccgccacacgggcacgaacgaggccggcatcaacgcgcgggcggaattggggggagacgatgtctggatcaacttcggcgtgctcttccctcagggggacacggagattgcccagacgctcatccacgagatgatgcacatcgccggctactcgcacccggaccgccgcaacggcatcgacaccccgtatgacggtggcccgtactacaactccgcgccgctgcgcgccgagctgtgcatcgcgggcttccagagcatccactcgacgcgtgagtccagccgcgagccgcagacgcgctga

SEQ ID NO: 8476 - DNA, 411 bp, Myxococcus xanthus
atggttcactacgccgagcacgacgcctatgagcctgtcttcgcgaagttgaaccatgaaattccgcggggcaatcacttcgccttcctggcgggtgtcgagccggcggatgcgcgtgacacggctggggccgccgcggtggaggacgccgtcgccgtgggcgtggacgtggcgacgaacccggccttgaaggccatccagttcggcgaactgccggtgctcgtggccaagcaggtcggcctttcgggggagtgccctgactgtgccatcacggccgcctgtgtcgccaatctcgaccgggatggcgacctggacgtgtggctcatctcctcgaaggaactcaccgggctggatggacagcctgtgaatcctggtgagcccctccacttcatgaacgacctgaaggactga

SEQ ID NO: 8477 - DNA, 966 bp, Myxococcus xanthus
atgagcctgtccatcgcgaagtccattctgtgcaacggcttctccggcaacacccgtggctgcggccccacggaccgctaccaggcggcttatcagtcgatggacccgtccaaggcggcgcagacggtgctcaagcacttcgacgccatcgagggcgtgggcatgaacgccagcggcaagggtgcgggggacaacaacatcgggacgtcggagctcaagcgcgtggcggacccgaacagcggcttcccgcccgatgtccgcgccgccgcgaagtggatgctcgaccaccccatcgccctgcgctcgctggaccagggcgccagcaaggcccatggcggcaacaatgaggtgcacctgagcaaggcggacctccaggcgcgcgcgggcaatgcgtcggactccggggctccgcaccggcctggcttcccgcagcgtccgccgctgttcggctccgggttcggagggggcttcggcggcggctgcggcggcggactcggtggcccgggcggcctgcccaacccccaccgtcccaacttgccgccgcggctggacctgtgcggcccgcagtcccgcccgccgttcggcgctggccgccacgagcccatggacgtctacaaggcggctcagacgctcaaggaccacttccacttcgccgagggcgtgggcatgaacgccagcggcaagggcgccggggacaacaacatcggcatgtcggagctcaagcgcgtggcggacccgcgcagcggcgcgccgaaggagctccgtgaggcggcgcagttcttgatcaaccatcccacggcgttgcgctcggtggaccagggcgcgagcaagtccaagtccagcaaggaggtccacatcagcctccaggatttggagtccttcacggcgaaggcgccccgccgcgagacgcagtccaaccgtctggacctggcgcagttcatgggtcgggcgagcgtctggggctga

SEQ ID NO: 8478 - DNA, 567 bp, Myxococcus xanthus
atgagccgcgcctaccgagtctccgtctccgagtccctcaaccgcgtggtccaggccgaggacggcctctgctccaagctggagctgctcccgctcctttcgcgcgaggagctggccgggctgctcgcggccgagctggcgaaccggggcttcacgcaagagggcgacgtggcgctgcgcaccgaggcggatggtgtccgcatcgccatcgacgtcaccaccggtgacgtcagcgtcaccctcagcggcgagcaggaggtggagctgaaggcgcgcggcgagctggccgtggagagccctcacgaggtggagcaggcgaagctgcgggcccaggacctggcgcgcgcgcggctggaggacgcggcggacgtcgccacggacaagctgcgacagcaggtcacccagaagctcgaaggccggctgaaagacctcaagtcggagctggactccatctccaacaaggtgacggcggaggcgctcaaggtgcgcgccgggcagctcggcaccatcgaggaggtccacgaggacgcggcgacgggctcactcaccatcaaggtgcgcgtatga

SEQ ID NO: 8479 - DNA, 459 bp, Myxococcus xanthus
atggatgccgcagtcctcaagaaggttgcgctgttcgagggtttgacccagggacagctcgccaaggtcgcccagattggccactcccggacctacccggcgggcgcctttctgttccgtgagggggaaaccggccaggagatgttcgtaatcgccgagggcaaggtccgcatctccaagtccgtgcccggcatcggcgaggaggcgctcgccatcctggagcccggccagtatttcggtgagatggcggtcatcgaggattcgccgcgctcagcggacgccatcgcccacgtgagctgctccgtctgggtcatcgagcgctcccggctggaccagctgatgttcaccgacaaagacctggcgtacgtgctgctctggaccttcgtccgcacgctgagcgaacggctccgcgagacgaacgagaagatcaagggcttcttcgccctctcccgcttctga

SEQ ID NO: 8480 - DNA, 241 bp, Myxococcus xanthus
atggcaaccatcgacatcaccaaagccaacttcaaggaaatcgtctcgaaggagggaatcgtcctcctcgactggtgggccgagtggtgcgcaccgtgccgcaccttctcgcctgtgttcgaacaggcgagcacgaagaatccggacctcgtcttcggcaagctcgacaccgacgcagaggtggaactcgcgggggctttcgccatccgctccatccccacgctgatggtcttccgtgacg

SEQ ID NO: 8481 - DNA, 411 bp, Myxococcus xanthus
atggccctgcgtccctcgttgcaggacgtgttgaacgcgctccaggccgaaggccagctcgagcccgactctgtggaccgggcccgcgtggccctggaagcccatcagcgccagtccgtggccgtgccctggttcgtgaaggccttcgctggcgtcggcgcctggctgtccgccatcttcgtgctgagcttcttcgcctgcgcgggcctctgggaggagcaggtcgtgatgggcgtggtgggcctgggcctgtgcgcgggcgcgacgatgctgcgccgcacgctgcgcggcgtcttcgtggagcagctcgcgctggcgcagtgcctggccggcgccgccatggcctccgccagcttcggcatcgaaacggagaacgaaaacgtcgccgcgacgctggtgctggtcatcagt

SEQ ID NO: 8482 - DNA, 999 bp, Myxococcus xanthus
ctcgaccttgacgcgacgccggagcgactccgggcactcgcggacgctggcatcctgatgccgaccaccctggaacgcgcgctgcacctgtccgtggccaccccgccgcggcaggactggcggcgcttcctctccaccacgctgatgggcctgggcgcgctgctggtgctcgcgggggtcatctacttcttcgcgtacaactgggcggacatgcaccgcttcgcgaagctgggcctcatcgcggcggccatcacgggcacggccgtgggcgcctggaagcaaggcgcgacgctgggcgggcaactgtcgctgttcgcggcctcggtgctcgtgggcgcgctgctggccgtctacgggcaggcgtatcagacgggcgcggacccgtatgagctgttcatcggctgggccgtgctcatccttccctgggtggcggtgtcgcgcttcgcgcctctggggttgctgacgctggtgctggtcaacaccggcatcctcctcttctgggagcaggtgctggatacggagctggaccagacctactggctggcggtggtcctgggcgggctcaacggcttcacctgggccacctacgagcacttcgccaacctgcgcgtgtcctggctccaggcgcgctgggtgccccgggtgctggcggtgatggcggtggccccggtgctcatcgcctcggtgccattcatcatgcacccggcgcgagcccccaccggcgccgtggtggcgctcctcctggtgctggcctcgctcgcggccgagtacgccctgcaccggcacctgaagggcgagctgttcatgctcacgctcggcgcggtgagtgtgatgacgctcctgacctccggcgccgtcagcatcgtcttcgactcctaccaggacgtggaagtcctgggcctcttcgtgctgccgctcttcgtcatcgcccaggtggcgctcgcggtgtggtggctgcggcacgaagcccgcgtcaccggcgccacggaggagtcctga

SEQ ID NO: 8483 - DNA, 1350 bp, Myxococcus xanthus
atggacacggaggtggacgcgctggtccagacggcgcccgtcccggtggcgcgacgcggccccttgcggttgaagctgctgatgctctccggggaacaggcgggacacagccacgtcctgcgcccgggggtggtccggctcggcacgtcctcgacgtgcgacatcgtattgacggaccgcgtcgtgtcccggcagcacctccagttggaggtgacggacgaacgggtggtggccaccgacctgggctcgcgcaacggctccttccatgaaggggtgcgcttcaccgagttggaggtgcggcccggggcgtcgctgacgctgggcaccgtcgtcctcaaggtggtgcccgaggactcacgggagcggccgatgcccctgtcctcgcggcgtaacttcggcgcgctcgtgggcgccagcgtgaggatgcgcgagctgttcaccgtcctggagcgggtggccgcgggcggtggggacgtgctcgtccagggcgagacggggacgggcaaggagctgtgcgcggaggcgattcaccaggaaagcccgcgggccggtgggcccttcatcatcgtggacatcgccgggattccgccctccttgatggagtccgagctcttcgggcacgtgaagggtgccttcacgggcgcgcaaacggagcgcgccggggccttcgagcgtgcccagggcggcaccgtcttcctggacgaggtgggcgagctgcccctggagctgcaaccccggctcctgcgcgcgcttgagcgccggcagctgaagcgcgtgggcgccaacgactaccgcacggtggacatgcgcgtcgtcgcagccacacacgtcgacctggagcaggccgtgcaacagggccggttccgcaagtacctctatcaccggctcgcggtgctcaaggtcgtcccgcccccactgcgggagcgggtggaggacctgcccctgctcatcgacgccatgctggagcggctgggccgtccacccagcgccctgtcggaacagacgcgcgccctgctggcccagtatccctggcccggcaacgtgcgcgagctgcgcaacgtggtggagcaggccatccatctgggcgaggacactctgccgcccatggacgccccctccggttcggtccggtcgccccaaggcacgctcgacgcggagctgcccttcaaggaggccaaggagcggctcatcgaggtcttcgagcgggactacctccagggcctcatcgcacgctgcgaccggaacatctcccgcgcggcccgcgaggcaggtatcgcccgggtgtacctgcgcaagctgctcacgaagcacgggatgatgctcgtggacgacgacgattcacgggattga

SEQ ID NO: 8484 - DNA, 519 bp, Myxococcus xanthus
cgcggcgccgccgaggtctccggcgagtgcgaaaacgccagtgtggagtcacagggctcgggcgccttggtccgcgtctgcgtgcccctccgcaacgacaccggggcgcctgtcgaagtggagttccccccggggctcgtcgtcgtgtccacctccgagggacgcggccagaacgggctgctcatcgagcgcaccatcctcgtcgttccacccactcgcccggggcccggcgggcgggacgatgccggtaccccggacggcggggtggaggagaacgtctacatcgttcctctctacatgtactgcctgaacgaggagcgggacccctccaacgaattcatgacctacgcggtcggccccatcacgtcggatgacgcgctgcaggaactgctgcggctcctcgaggggaaggtcatcgacagctccgaggacgtgggcgtggtgcagaacgccctctatagcatcaccgagggccgcggcctgacgacgccggaccgcgacgccatcaacgacctctga

SEQ ID NO: 8485 - DNA, 816 bp, Myxococcus xanthus
atgctgaagggcaagactccgctcgtcgtcgcgcttgtgctgggcctgctggccggcgtcatcgcgtattccgccatcaagaagaaggaggcggatgtccgccgcggatggaacctggtgcccgtcgtcgtggcggcgcaggacgtccctgaaggcacggtcatcaccttcgagatgatctcccagcgctccgtgccggagcagttcgtgacgtcctccgtggtgcgtccggactccgcgtcctacatcgtgaaccagaaggtgctggtcgcgctgcaggcgggtgatccgctgctgtggagccagttcgagacgaccaaggccgccgagcggctgtcgtcgaaggtgcagaagaaggcgcgcgccctcaccatcgaggcgaagcacaccacgtcggtgggcggctggattcgccccaatgaccacgtggacgtgattggcaccttccgcgacccgcagacggacgagaacgtcgccgtgacgctgcttcagaacgtcatcgtggtggccacgggcaagatcaccggtaccaccaacgtgaacctcatcccggagaaccagcgcgagtacaacaacatctcgctgatggtgctgccggaagaggccgaaatcctggtgctcgcggtcgagctcggccagctgacgctcagcctccgcaacgaggacgacgtggacctcatcgaggagcgtggccgcgcgaccatcagcacgctgctgtcgggtgagcgcacccgcgtgctggagcagaagcgccgcgaaatcatccagatcatcaagggcggtgccgagcgggccgcgggcgctggcgcgccgtga

SEQ ID NO: 8486 - DNA, 681 bp, Myxococcus xanthus
atgttgatcctcaacatcgcgtgcatgtgcttgttggggatcctgacgtacatcatcttcaaccccatcatggcggtggtggccacggtgttcggcttcttcctgccgatgctgatggtcaagcactaccggaagcggcgcatcaagaagttcaacgtgcagttggtggacgcgctgcaggccatggccaacgccttcaaggccggtctcacgttcccccaggccatcgagcacgtggcgcgcgaggcgatgccgccgctgtcgcaggagttcgggctcttcgtgaaggaagtgaagctgggtgttccgctggaggaggcgctcatcaacatgggccgccgcgtgggcagtgacgacctggagctggtcgtcgtgtccacgaacatcgcccgtcagctcggcggcaacatggccgagatgttcgagacgatctccacggtgatccgcgagcgcttccgtctggaaggcaagatcgacgcgctcacctcgcagggcaagctgcaggggtggatcgtcgcggcgatgcccggtgtgctcggcatggtgctcaactacatgcggcccgacctgatggagccgatgatggaccacatcttcggttggatcctcgtgatcatcatcgccatcatggaagtgatgggcatcctcatcatccggcgcatcgtcaacatcgatatctga

SEQ ID NO: 8487 - DNA, 708 bp, Myxococcus xanthus
atgaaccgccgcttcatgtggcccggctacgaggccaaggcgcgccgcaacctcatcaaggcgggcgagccgcaggcgtacaagcccgaggacatcatggcgctgcaggaagtcagcgcggtggtgggcctcatcatgggcctcatcctgctcaacggcttcggcgtgagcctggtgtgggcgccgctgttcctgctcttcggcatgtactacccgctgatgtggctgaacgaccaggtgaagaagcgccacctgctcatcagccgcgcgctgccttacagcctggacctgctgacgctgtcggtggaagccggcctggacttcaccgcggcactggccaaggtggtggagaagggcaagccggggccgctgcgcgaggagctgcagttggtgctcaagcagctgaagatgggcaagacgcgtgaggaaggcctcaagagcatgattgtccgcgtggacctgccgcccctgaccaccttcgtcaccgcgctcatccaggcggacaagatggggaccagcttgggcaaggtgctgcgcatccagtccacgcagatgcgcatcgaccgcacccagcgcgcggagaagctggccggcgaggcgccggtgaagatgctctttccgctcatcgcgtgcatcttccccacggtgttcatggtgctgttcgggcccatcgtgttccaattcatgttcggaaacgtcgcggggtag

SEQ ID NO: 8488 - DNA, 1278 bp, Myxococcus xanthus
atgggcagctcgaatggcaccgtgctcaacggggggctgttgtcgggtgagcagcagcttcgggatggggacaagattggcgtgggccccgtcgagttcaccttcgtctgggtgccgccggagggggacgaggacgccacgcggcccatccgccggggcgacccggtcccagcgctggacccggacgccacccgtcccatccgcctcaacgaccccattcccgccgagagcggcatcgtgctgccggagggccatcccaccgcgcagcagcccgcggtggtgccggtgcgtccgggcaccgccgccgtggcgaaggccgaacctggcgcggggcagacggcggcggagcgcgcgcgccgtcgccgggagctcgcgggcagtcaggcgggcaggttgctcctgtggtgggggcagctatcgacgccggcgcgtctgggcgtgggcgcggtcggaggcggcctggtgctggcgctggtgggcgtgctggccgtcttcttcatgcccaagggcgaaggccgggcgtccggcgtggagccggaggacctgggcttcgaggtgatttcagactcgttcggagtgggcgagggcgtgacgtgggagaacccggagcacaagtcgttcgccttccagttcgtcacgccgacgcgggcggtggccgtggtccactacatggccagtggcatctccaaggaggaggtggcgctggtcgtcaacggcgtggacgtgggctgggtgccgccggacgtgaacgcggtgacggagcgcgggctggagcagattctcccgccctccgcgctgaagcggggtgagctcaactccatcgtcttcgacaacgtccgcaacccgccggggcaggacacctggcgtgtgtggaacctgcgcctggaaatcatcccggtgccggagttgccgcaagacgagctcctcgcgaaggcgcgtcagtacgtggtcgcgggcgcccggttctatgagtcgcgcgacgtcggcgcggagaacctcttcaaggcgtggcagcagtaccgcttcgcttgggtgacgctggaggcgctggacaccaagcctgacatctatcaggacgtgcgtttccaactcggcgaggtagcaaccgagctggaccacaagtgcagccagctgatgctcgatttccaacgcagcgtacagtaccggaatgcgcggacggctcgggccgcgttgcaggaaatgggtcgacgcttccctacggccgagcatcgctgccacaatctaggtttgcagttggcttacgagcacgagctgtag

SEQ ID NO: 8489 - DNA, 1554 bp, Myxococcus xanthus
tacgtcatcggtcgagcgaccgataacgccatctgcatcccggacacctccgtgtcccgcaagcacgtcatggtgcggaagtcgggagcgggctgggcggtgagcgacctgggctccggcaacggaacgctcatcaacggcgacgtcgtcaacgaggagacgccgctggccaacggtgacgtcatcacgttgggcgacacggagctgcgcttcgaggacgtggccaactccacgatgatggtcggcgcgccggcccccgggccgcgtcctcggccgggggcctctggtagccgcggcgcggtgccgccccgtccggggcctcgcgtcgaagggggtcgcgtgcgcagtgcgcgcgcgacggcggccacggcgcctacccccgaggagctgaagaagaagaagctcatcacgctgggggtggcgggcgcggtggtggtgctgttcgcgggcttaggcgtggtgcggatgaacgtccagaagcagcaggcggtcgccgcggaagaagcccgtcagggcaagagccaccgggagcggctgggcagcctgttccaggacgccaagaacctggttcgcgagggcaagtgggtcgaagcgaaagcgaaacctggagggagctccagaccgaggcccccgggctacccgggtgtggcggactacctcgggcacgccgcgcgcgagattcccgtccaggagaagctgacggcggccaaggaggccctggcgaagaaggagctgggcaaggccggtacgctgctggccagcgcgggagagagccagtttctctacgagcaggtgaactcgacgaagcgcgcgctgtcggaggccgcggacacgcgcacgcgcgaggcgcgcaagctgctggatgagaatcagctcgacatggccaaggccatcaccgaagacatcctggtggccttcccggagcatcgcgacgccaagctcatcaacgagcaggcggcgcaggccatcatcgtccgggacacgcccaggcccgtggtccaggggccggcccccaagccgtgggagcccgcggttgaccgcttccgcgacggagacatgtccggagcggtggccatcctcaacgcgtgcatggcgcgcacgccgcagtgcaagaaggtgctcgggcaggtgacggagttcggcaacctctacaagcggctggaggacctggacgcccggggcctgtcgaagctgatgtcgctggacaaggacatcaccggcggccgccctagcaagatggcgcgcaacgcggggacgcgggcggccaccatcttctacaagggcgccaccgcggcgaaggcggcggggcagtggagccgcgccatggactactcgcgcaaggcgctgcaggcggaccccgggcacgcgggcgccaccaacatcatcagtgagctgaaggcgaaggcgaaggacgtctacctccaggcctactccttgaaggacgggagccccgaggaggccctgcccaagttcaaggacgtggtggccatgacgccgccggatgacgagtaccacgagaaggcgaagacctgggtcgagaagctgtcccgatga

SEQ ID NO: 8490 - DNA, 771 bp, Myxococcus xanthus
atggagcaggcggcggcgggagcggcgtgggcgggcgaagggtcggtgagggcgcgaggggtgggaggcgcggaggagtcgcgggagcgcctcttccggttgggggcggcggcactcaccgacccggagctgttgtgcgtggtgtggagctccgggcctcgcgcgcctggagcgtgggcggtggcgggggccctgctgtcggagggcggtgggctgaagggactggtgcagcaggagcccctggcgctgagtctgcggcccggcgtggggcctgtccgggcggcgcaggcactggccgcgctggagctgggccgccgctcgcagcgtgcccgggagcgcaggcccaggctgcgcacgccgaaggagattgcggcgtacctggcaccggtgctgggggcgctgcggcgcgaggtgttccacgtcttgtgcttcaacgcgcgcaacgtgctggtgcatgacgcacgcgtggcggagggcaccatgaacacctgcccggtggacccgcgggaggtgttcgccgcggcgctcacctcgcgcgccacgtccatcgtgctggcacacaaccacccttcgggagacccggagcccagcgtccaggacctgggcctgacgcggcatctggtcgcgggggcgcaactgctcaacatcaaggtgctggaccacgtggtgatgggagacggcggctacgtgtcgatgctggaacgcgggctgatgccggacgaagcacaggagaaacggcgggcgtggagcgcgaatggaggcggcggatga

SEQ ID NO: 8491 - DNA, 970 bp, Myxococcus xanthus
atgacccggcgcaaggtgggaggcggcacgctgccgccagtgggcctgcagggtgacctgtttggcagtggcgcctccacgcctcgtgcaactggcgcggcgcggaaggccgcggcgccgccgaagcctcctccgcctccggtggacgaggacggcacctcgctgctgggtccgatggagggcgcgccgcctccgccgcccaagcccgagcgcgtggtgctgtcggtgggggagctgacccgccagctcaagcagacgctggagtcgcgcttcgctcgcgtcatcgtgcgcggcgaggtgacgggcttccgcgggcccaacgcgcgcggccactggtacttctcgctgaaggacgcgggcgcggccatcgacacgaaggtgtgggcctccatggcggcccgcttgcgcttcgcgctgcgcgacggcatggaggtgattgccgaaggcagcgtggacctgtacgagccgcagggccgctacagcctcatcgttcagcggctggagccggtgggcgagggcgcgctggcgctggccttcgagcagctcaaggagcggctggcccaggagggactcattggtcccgggcgtgtgcggccccccaggccgttgccctacctgcctcggcggattggcgtggtgacgagccggaccggcgcggcgctccaggacttcctgcgcgtgctgcattcgcgcaacccgcggcagagcgtcctggtggcggatgcgcgcgtgcagggcgaaggctccgccgtggaggtggctcgcgccatcgagcggctggctcgcacggacgtggacgtcatcgtggtgacgcgcggtggtggctcggtggaggacctctggaccttcaacgaggagcgggtggcgcgcgccatcttcgcctcgccggtgccggtggtgtccgccattggccacgaaatcgacttcaccatctccgacttcgtggcggacctgcgcgcgcccacgccca

SEQ ID NO: 8492 - DNA, 999 bp, Myxococcus xanthus
atgtcgtggggccgcatcggtcacccgagcgagatgttcaacgtgggtgacgaggttcgcgtcgtcgtcctcaagttcgacccgacgcaggagcgcgtcagcctgggcctgaagcagatccaggaggacccgtggcaccgcgccgacgagaagtacccggtcggcacgcgcgtccgcggcaaggtcgtgtccatcacggactacggcgcgttcatcgagatcgagcagggcgtcgagggtctggtgcacgtgtccgagatgtcctggaccaagcgcctcaagcacccgtccaagatcctggaggtcggccaggaggtggaggccgtcgtcctggacatcgatccgaaggccaagcgcatcgcgctgggcatgaagcagatcgagcagaacccctggacgctgctcgaggacaagtacccgatcggctccgtcatcaagggtcagatccgcaacgtcaccgacttcggcgtgttcgtcggcgtcgaggagggcgtggacggcctggtgcacgtctccgacatctcctggacggtgcgcatcaagcacccgggcgagatgttcaagaagggcgacgaggtcgaggcggtggtgctcaacatcgacgtcgagaacgagcgcttcagcctgggcatcaagcagctccagccggacccctgggagacgctgtccgagcgcctgcccgtgggcagccgcgtgaagggcaaggtcaccaaggtcaccgacttcggcgcgttcgtggagatcgagccgggcatcgagggcctcgtccacgtctccgagctgaaggaggagcgtgtcgagaacccgcgtgacgtggtgcaggaggcgcaggatgtcgaggtgaagatcatcgacatcaacaccccggaccggaaggtcgcgctgtcgatgaaggcgctgatcggcgagggcgaggactaccgcgagtacctccgcaagcaggcggaaggctcgaaggcgcgcctcggcgacgtgatggcgagcaagctgaagaagtag

SEQ ID NO: 8493 - DNA, 1788 bp, Myxococcus xanthus
tcgtggggccccgatggccggctgctcgcggtgttggatcaaaggggcacgcgaggcggcctgcgcatctggaatgcgggccttgggcaggttgcccgcatcatccaccaggactccactgacatccgttcggtgtcctggggcccgcgggacgaggacctagcggtggggctcgcggatgggcgactggccttgatcgacccggcgacgggagcgctccaccagacgtggagcgcccacgctgggcccgtggtggggctggcctggtatgcgagaggaaatgagctggccagcgtcagccacccggagacaggcggcgcggaggtgcgcttctgggccgcgtcctcggggacggagagccgggcgccgttgcggacggcgcgcaccctccggaaaatccactggagcccggacggagcgcgggttgcgttggagatggcgggcgagcaggtggaaatccacaatctggacccctgggtgcaggtccacgaggtggggcatggcgacagcttctcctggagtccggacggcgctcgctacgccgtggggagctaccggaacgtccgggtgtacgaaacggcaacccacgagctccaggcctcctggtttggaccgtggagcgtgtcgtcccgcatggactggagcccaacccaggactggctcgtcatcgtggacctggtccactccctgacggtcctgaacgtcaacaccgggacggtggtcgcaaacggcaccgaggtgccccccaatccgttggacgccctgggcttcagcgccgtgcgcttccacccggtccacgactcgttcgtcgcggtggcccgcaggcccgcgtcggtctccaccttcagcgtggacgcgcagcaatcgcggctgcagcgccacgagttggtggcccattcgtccgcgatcaacgccacgaagtggagtccggcgggggaccggctggcgtcagcgggcgacgacggaaaggtccggctctggggcgccgcgggccaggcgctggcgactttggacggacacgagggcaagtcggtccgcgcgctcggatgggacgcgagtggcgcacggctcgcgtcgggaggtgctgatggccgcgtctgcgtctgggacgccggcacgggccggctgacgcagccgccgctgcagatgatgcaacgggcgcaggggcatacacccaaggtggagcacgtcgcactgagtccggacggccgcacgctggcgagcgcgggcgcgacgctatttctcacgggaagcatgaccagcgtccaggtctgggacgtcgcttcgcgcacggagctgctcaacatcccagagacggacagccccgtcgtagcgctgggatggacgccggacagccagtcgctgatcatcgtctatacccacgcggcatgggatgtctggaaccgcagctccggggtgctcaagcgcgtggagtccgccccggaaatcctgaccaccgcggcgctcagtcccgatggaacccggttggcctgcagcgaccggctgggggtgtccgtcctggacgtggggacgggggctgtcgtcgcggagacccctatgtggatgaggcaactgtccctggcgtggcacccggacggtacgcgcttctccggtggcggtgcgtatcagctcgtcttcgactggcaggtgcatgagcacggccaacttctgcccagcgtcatgggggtccacgacagcacggtcctgggcgcatcatggcgcggggacggcgaggtcctcaccacaggtggcgcggacatggcgctggtcacctggcgcgcccgctag

SEQ ID NO: 8494 - DNA, 1173 bp, Myxococcus xanthus
gacgtcgtcatcgtgggcgcggcccgtacccccattggtgcctttcagggcgcgctcgccaagctgacggccccgcagctgggcgcgatcgcgatcaaggcggcgctggagcgcgcgggcgtgaagcccgaggccgttcaggaagtcatcctgggctgtgtgctcaccgcgggcgtgggccaggcgcccgctcgccaggcggccatcttcgccggcctgcccgagacggttcccgccaccacgctcaacaaggtctgtggctccggcctcaaggccgtcagcgcgggcgcgcaggccattgccctgggtgacgcggacgtcgtcgtcgtgggcggcatggagtccatgagcaacgcgccgtacatcagccacacgatgcgtggcggcgcgcgcatgggcaacgtggaattcaaggacgcgatgatccacgacggcctctgggacgtgtacggcaacgtccacatgggcatctgcgccgaggagtgcgccacgacgcaggacatcagccgctcgcagcaggacgagtacgcgctggagtccacgcgccgcgccatccaggcccagaaggaaggcctgttcaaggcggagatcgtcccggtccagattccgggcaagaagccggaggacgtcgtcaccgtctccgacgacgaggggccccgcaacgcgaagccggagaagattccgggcctgaagccggtgttcaagaaggacggcacggtgacggccgccaacgcgtcctccatcaacgacggcgccgcggcgctggtgctgatgagcgaggagcgcgcgaaggccgagggccgcgccatcctgggccgcatcacgggctacgcccaggcggcgcgcaagccggtggagttcaccatcgcgcccacggacgccatcaacaagctgctgaagaagcagggcatcagcgcgggtgacgtggacctctgggagatcaacgaggcgttcgcggtggtgtccatcgcgaacaaccggctgctcggcctggacgtgtcgaaagtgaacgtgcgcggcggcgcggtggcgctggggcacccgattggcgcgtccggcgcgcgcgtgctggtgacgctgctgcagacgatgcaggacctggacaagaagcgtggcgtcgcgtcgctctgcatcggcggcggcgagggcatcgcgctgatggtggagcgctga

SEQ ID NO: 8495 - DNA, 1388 bp, Myxococcus xanthus
ttcgcacatgcgggagggcggatgaacaaggtctacgcgaacgcggacgaggcggtcgccgacatcccggatggctgcacgctcatgagcggcggcttcgggctgtgcggcaacccggagaatctcatcgaggcacttcaccggaagaacgtgaaggacctcaccatcatctccaacaactgcggcaccaccgagctggggctcggaatcctgcttcagaacaagcaggtgaagaagatggtgtccagctacgtgggagagaacaaggagttcgagcgacagttcctctccggtgagctggaggtggagctgaacccgcagggcaccctggccgagcgcatccgcgcgggcggctgcggcattggcggcttcttcaccccgacgggcgccggcacccaggtggccgaagggaaggagacgcgcgtcatcgacgggcggctgcacgtgctggagacgccgctgaaggcggacttcgccattgtccgtgcgtggaaggcggaccgctggggcaacctggtgttccgcaagacggcgcggaacttctctccgatgatgtgcatggcggccaaggtcaccatcgtcgaggcggagcacatcgtggagccgggcgagctggacccggacctggtgcacatcccgagcatcttcgtgaagcgcatcgtccaggcgaagaacctccagaagtggatcgagcggcgcaccgtccgcaagtcggcctgaggagcccagccatgccactgactcgtgaacagattgcacagcgcatcgcccaggagctgcaggacggcttctacgtcaacctgggtatcggcatgcccaccctggtggccaactacatccctccgggcatggacatcgtgctccagtcggagaacggcctgctgggcatcggcccctggcccgtggaaggccaggaggatccggacctcatcaacgccgggaaggagacggtgacggcggtgcccggcgccgcgttcttcgactcggccctgtcgttcgggatgatccgcggcggccacatcgacatggccgtgctgggtgccatggaggtcagcgaagagggcgacctggccaactggatgatccccggaaagatgatcaagggcatgggcggcgccatggacctggccgtcggtgcccagcgcatcttcgtggccatggagcacgccaacaaggacggcaagcccaagatcctcaagaagtgctcgttgccgctgacgggcctcaagtgcatccaccacatcgtcacggaccacgcgtacatcgacgtgacgccgcagggactcatcctgcgcgaggtggcacccggagtgacggtggagcaggtgcagaagctcaccgagccgaagctgacggtggcccccgacgtccgtgagatgaaagtctga

SEQ ID NO: 8496 - DNA, 93 bp, Myxococcus xanthus
atggcggtggagttcctggacgttgatgaagacaagcgaacgcgtatcgcggagttcgtggagcgcctgcgctcggagctcccgcccgaatag

SEQ ID NO: 8497 - DNA, 613 bp, Myxococcus xanthus
atgctgccgctacccgaacttcccattgaattgaccatcgaacgcctcggccagctcggcgaaggcgtggcctcctggcaggggcgcaccgtcttcatcccggggaccttcccgggcgacaccgtgcgcgtccacctggagacgcaaggccgtgtgctgcgcggcatcctgcgacaggtggtgtcgccaggcccggaccggcgtgacgcgccctgcgtgtacgcgtccgactgcggcggctgtgactggctggcgctggccgagcccgcacagcgcagcgcgaagcaggagatcgtcctctccaccctggagcacctggggcacctggctcgggacagcttcaccgtgcgtccgctgctggtggccccacgcgactggggctaccggcgccgcgcggtgctgcatcccgcgggcaagggcgcgctggggtacttcggccggcgcagccacgaacgcgtacccgtggaagtctgcggcgcgctcacgcccgtgctcacggcgctccccggcaagctggccccgctgctcaagcccctggcgaaggatgccgaggaagtgctgctgctggcggaaggggacaaggccgcgttcgaagtgaatatacttgagagct

SEQ ID NO: 8498 - DNA, 780 bp, Myxococcus xanthus
atggcgacgaagaaggaaacctacacaggcgcggacatccaggtcctggaaggcctggagccggtgcgcaagcgcccggccatgtacatcggcggcaccgacagcacggggtatcaccacctgctgtgggagatcctcgacaactcggtggacgaggtcatcaacggcttcgccaccaccgtggaggtgacgctccacaaggacggccgcagcgtcaccatcgtggacaacgggcgtggcatccccgttgacatcatgcccaaatacaagaagccggccgtggaggtcatcctcacgacccttcacgcgggcggcaagttcgagcagggcaactacatccactccggcggtctgcacggcgtgggcagctcggtggtgaacgcgctggcgcgcaagctcgtcgtggagatcaagctccacggcaagaagcacgtgcagacgttcgcgcgcggcaaggccaccagcacgctgaaggtggatggcgccgcgcgtggcacgggcacctccgtcacgtttgaaccggacccggagattttcggcgagaagctgaagttcgacgcggagctggtgcgcgagcggctggaggccaagagctacctgcacaagggcatgacggtcgtctggaaggacgagacgtccagcccgcccacgtcggtgacgtacaagcacgacggcggcatcgcggagtacctcaccaaggtggtgacggagcggaacaagccgctggtgcccgcgggcagcgcggtcttctaccacgcgcgtgacaacggcgtgcgggtg

SEQ ID NO: 8499 - DNA, 75 bp, Myxococcus xanthus
atgtcgaagcgcgacgccgtgaaggaggtggcgcgtgccgtcaccttcatcccgttgcccgagaagaaggactag

SEQ ID NO: 8500 - DNA, 255 bp, Myxococcus xanthus
atgatggtgagcatggtggggctgtggggagcggtgcaggtggagctgctggaggacgtccgggcgcaagtggtgcggctggacaccggacaggcatgcacggtggagcgcgcgtcgctgcccaagggcgcgcgcgagggtgacgtcgtggtggatggccggctggagccagggcaaacggaggcgcggcggcaggacgtcgcgcggatgcgaacgcggctggctgttccggttccaccagggctcgacctgtga

SEQ ID NO: 8501 - DNA, 2202 bp, Myxococcus xanthus
gtgccggcttcgctcgcggacgaggcgcgccgccggtacatcaactacgccctgtcggtcatcacctcgcgcgccctgccggacgtgcgtgacggcctcaagccggtgcagcgccgcatcctgttcggcatgttccacgaccaccggctgacgcacgaagccaagtaccagaagtccgccaaggtggttggcagtgtcatgggtcagtaccacccgcacggtgacgcctccatctacgaggcgctggtgcgcatggcgcaggacttctcgttgcgctacccgctggtggacggccacggcaacttcggctcgctcgacggcgacggcgcggcggccatgcgctacaccgagtgccgtctggcgatgctgtccagcgagctcctgacggagctgggcaagaagacggtggccttccggccgacctacgacggcacgctgcaggagccggtggtcatccccgcgcgggtgccgcagttgctgatgaacggcaccacgggcatcgccgtgggcatggccaccaacatcccgccgcaccacctgggcgagctggtggacgcgctggtggcgctcattgagaacccgcagctcctgacgaaggacctgctcaagtgggtgaagggtccggacttccccaccggcgggcagatcctcaacgacaagaaggagctgcgcgacatctacgagtcgggccaggggagcatccgcatccgtggtgagtacaagctggaggacctcaagcgaggcggccagcaaatcgtcatcacctccatcccctacacggtgaacaagtccacgctggtggccaagttcggcgacctggtgcgcgagcggaagctgccgctcatcaccgacgtgcgcgacgaatccaccaaggacgtgcgcatcgtcctggagctgaagaaggacgccaaccccgagctggtgatggcgtacctgtacaagcagacgccgctgcagacgaacttcggcgtcaacctcacctgcctggtacccatcaaggacaagccagagttgagcacgcccgagcggctcaacctcagggacatcctctggtacttcctcaccttccgcttcgacgtggtgacgaagcgcttcgagcacgagctgggcgagctgctgcggcgcgtccatatcctggagggtttcgagaaggtctacgacgcgctcgacgagatgatcaaaatcatccgcgcgtcggaaggaaagcaggacgcggcccggaagctcatcgcccgcttcaagctggatgaagcccaggtggacgccatcctggagatgaagctctacaagctggcccgcctggagattctcgtcgtggagaaggagctcaaggagaagcgcgccgaaatcaagcgcatccagggcatcctcaaggacaagaacaaggtgtggggcaccgtccgggacgaactgggcgagatgaaggcccgctacaacgacaagcgtcgcacgcgcattggcggcgcgggctccgaggagatggagttcagcgccgaggcgttcatcgcggacgaggacgcgcacgtggtcatcacccgcgacggctgggtcaagcgcgtgcgcgaggtgaaggacccgtccaccacgcgcctgcgtgaaggcgacgcggtgatggcggtgctggccggcagcctgaaggcgaacctggtgctgttcagcaacttcggcaccgcgtacgtcacccgcttcaacgacgtgcccgcctccacgggctacggcgagccggtgcagaagttcttcaagttcgacgacggcgagcgcgtggtgtccgccctgtcgctggacgcgcggctgccgcgcccgcagaaactggtgggcgtgacgaagcagggcatgggcatgcgcttcctgctggagccgcacctggaggtctccacgcgcgcgggccgccgctacgcgaagacgggcgaaggcgacgaaatcatcggcgtgcagccggtgacggaccgcgacctgttggcggtgctgacggagaagaccagcgccctggtgtgcaaggtggcggaggtcaacgagctggccggcccgggcaagggcgtcaccgtcatcaaggtggacggcggcgaccgcgtggtggacttcctcgccgtgtcgcccgcgcagaaggacgcgaagctggagttcgaaacgcagaagggccgcaagctgcacctgtccccggcgaagtacgaggtgacgggccgcggcgggcaagggccatga

SEQ ID NO: 8502 - DNA, 516 bp, Myxococcus xanthus
atgcgcctgcgcttcgacaaggtgccgtggggcgacgagtgcaagagccgctgcgccaacgccacgctgctgctcgacaccgacaacagcaagcagacgggcctgcgcctggcgacgaagaatgcgcccggcaacggcgccgacgtcgccgtcgtcatccagggcgtgcgcgactacgcgaagcaggaaggcgccccgcccgtgagctggctgcgggtgaaggtccgcctgctcggcagcgaggcctcctccgtggatgacggcgagttgctggccgagttcaaccaccgccaggaccccgagcggctccacgtggacggagaaaccatctacctgctggtggacgccaccagcgccgccctgccctccgctcgcaaggcccgcgtcgtctaccagccgcccggcgcaaagccgctccaggccaccattcctggaatgattggcggcgggagcggcaagggcgtgcgcatcttcaaggacggttcgtgggggaaggcccgcgacgcgacgccctag

SEQ ID NO: 8503 - DNA, 303 bp, Myxococcus xanthus
atgttcggtccctcaatcgtcgggttcggagagtacgcgtaccagtacgcgagcggccaccgtggcaccgcacccgccgctggcttctctccgcgcaaggcggcaaccgtcgtctacctcgctgacggcctcagcgcccacgccagtgcgctcgccaagctcggtccgcacacgaccggcaccggatgcctgtacatcaaggacctcacgaaggtcgacctcgacgtgctcactggcatcgtccgcgcctcgctcaagacgctcaccgcagggacctacggaaagcgcgcccacgaggactga

SEQ ID NO: 8504 - DNA, 771 bp, Myxococcus xanthus
gcccgggcgaaggtgatcgcgaatcgttcgtccagggcccggaaagagggaatcggcccgcgccttcaaaccctggacgttagagtggagcctgaagcggaggaggatatcgcgatgcgtgaaccgtacgtgcggcagctcaagctcgggcccatggacaacttcgtctacctggtggggccccgggactcagacgaggtggtggtggtggaccccgcgtgggacgtggacgccatcgcggaggcggtgaaggcggatggaaagcgcgtggtgggcgcgttcgtctcgcactgtcacttcgaccacatcaacggactgcccgacctgctgtcgatgtgggacgtgcccgtgtacgcgcagcgggaggaggtccagttctcgccggagctacgcgagctgggcggcgcgctgcggcccgtggggcccggcgacgacgtgcgcgtgggctcgcaggtgttccatgcgctgcacacgccggggcacacgccgggctcgcactgcctgctggctggcgatgcgctggtctccggggacaccgtgttcatcaacggctgcggccggtgcgacttgaagggcggcaacccggaggacatgtaccgctccctgtcccaggtgctggcgaaggtgcccgacacggcgaagctgtttccgggccacgactacgcggacgtcccggtgacgtccatggaggcggtgcggaagaagaacccgtacttcgccttcgacaacgtggatgccttcgtcgcgttccgaatgcggccgaggaagtag

SEQ ID NO: 8505 - DNA, 456 bp, Myxococcus xanthus
gctctaaaggtgcggtatggctcggtggtgacgcaggcgcggccgccatcgctgcgcacgcgcatggcggcggggctggacccctacgcacagctcacgcacaccatctacgcgctgatgtacgggcagacgcagcggatgccgctcacggcgctgccgctgcacacgcccgcgcagacggcggcgctggtgcaggcctatggcgcgatgcccgggcccacggcgtgtgacggcatcgtccccacacgctcgcaggtgtatggccgggtactggccgcggtgcgtgcggaccacctggatgcgattggccacttcgaccagcccgcgcaccaaccgccgcacgtggactggctcatctccggctctggttttcgcaggccccagttcgagtcgacgtggaagagcatcgtcgacttcatgctggaggacgagcgccccggcatcacggggtcgtga

SEQ ID NO: 8506 - DNA, 552 bp, Myxococcus xanthus
atgaactttccaagccatgtgaatctccccaccgatgcacgtgaggagctcatcgattcgctcaataccctgctggccgacgccatcgacctgcattggcaaatcaaacaagcgcactggaacatccgcggccggcacttctacagccgccacgagctgttcgacgacctggccaagcacgtccgcaagcaggccgacgagttcgccgagcgcgcgggcacgctgggcggctacgccgagggcaccatccggctggcggccaagaacagcgagctgcccgaatacgacctgaaggccgtggacggtgacgaccacctcaaggccctggtggaccgcttcgcccgctacggggccagcatccgcaacggcatccaccgctccgacgagctgaacgaccccgtcacctccgacctgctcacccagacgctgggcgaggtcgaactggacctgtggttcctggagagccacctgcacggcgagccccgcgcgggggcgcgccgcggaggggacgtccggccccaggacaccaccaccagcccctccaacgcctga

SEQ ID NO: 8507 - DNA, 843 bp, Myxococcus xanthus
atggatgggaaggtgtgcctcatcaccggggccaccggcggcatcggcctggaggccgccaaggcgctcgcgcgcatgggcgccacggtggtgctggtgggccgggacgcgggccgcaccgaggcggccgtggccgccgtgaaggaggccgcccccagcgcccaggtggactggctccgcgccgacctcgcctccctgaagtccgtgcgggagctggcgcagaccttccgctcccgctacccgcgcctggacgtgctgctcaacaacgcggggctcatcatcgaccggcggcaggtgacggaggacgggctggaggccaccatggccaccaaccacttcgcgcccttcctcctgacgaacctgctgctggacgtgatgaaggccaccggcccggcccgcatcatcaacgtctcgtccgatgcccacgccgcgggcaagctcgacttcgatgacctgcagagcgagcgcggcttcatcggcttccgcgtgtacggcacgtcgaagctggccaacatcctgttcacccgcgcgctggcgaagcggctggagggtacgcaggtgacgaccaacgccctgcaccccggcgtggtgcgcacgggcttcggtcacaacacccagggcttcttccgccacctcgtcaagctgggcgcggcgttcatgatttcggcggagaagggagcgcggacgtccgtgtatctggcgtcctcgcccgaagtggaggcagtgtccgggcagtacttctacaaatgccgtccgaagaagccgtcctccgccgcgcggaacgacgcgctcgcggagcggctctggcaggtgagcgagcagctcacgggagtcaagggatga

SEQ ID NO: 8508 - DNA, 627 bp, Myxococcus xanthus
atgatcgacctctacacgttcgcgacgcccaacggacagaaggtatccatcgccctggaggagctgggcctccagtacaagacgcatgtggtggacatcaccaagggcgagcagttcaagcccgagttcctggacatcaaccccaacaacaagattccggccatcgtcgaccacgcgacgcaggaccaccgtccgctcaaggtcttcgagtccggcgccatcctcatctacctggcggagaagacgggccagctgctgccctccaaccagcgcggccgggcggaagtgatggagtggctgatgttccagatgggcggcgtggggcccatgttcggccagctctaccacttcgcccgcttcgcccccaagaaggtcccctacggcatcgagcgttatcacgccgagtcccggcggctcgtcggcgtgctcgacgggaagctgggctccggggattacgtcgcgggccgctactccatcgcggacatcgcgctgtatccctgggtggccggcgcccgcgcgagcttccccgagctgttccgggggaacagcaacgtcgtgcagtggctccaccgcgtgggcagccggcccgccgtggagcgcggcatgaaggtcccccagctcaagtag

SEQ ID NO: 8509 - DNA, 1467 bp, Myxococcus xanthus
atggccacgctcgaacaactccgcttcgacaacacctatgcccgcctgcccgccgggttcggcgcgcgcgtccaccccagtccctttccagacgcgaagctggtgagcgtcaaccctgccgccttgaagctcctggacctgacgcccgaggaggcgcagcgaccggagttcgttgcggcgatggggggcgcgaagcccctgccggggatggagcccttcgccatggtgtacgcggggcaccagttcggcgtgtacgtgccccggctgggcgacggccgcgccctgctgctgggcgaggtccgcgacgccgccggggcgaagtgggacctgcacctcaagggcggcgggcccacgcccttctcgcgcgggggtgacggacgcgcggtgctgcgctccaccatccgcgaatacctgtgcggcgaggccatgcacggcctgggcatccccaccacgcggggcctgggcatcctcggcagccaggccccggtgtaccgcgaggcggtggagacgggcgccatgctggtgcgcatggcgccctcgcacgtgcgcttcggcaccttcgagttcttccactacaccgagcagaccgagcacgtggccacgctggccgaccacgtcatcaccgagcacttcccccaactcgcgggccaggaaggccgctacgcgcgcttctacacggaggtggtggagcgcacggcgcggctgattgcgcagtggcaggcggtgggcttcgcgcacggggtgatgaacacggacaacatgtccatcctgggcctcacgctggactacgggcccttcggcttcctggacgacttcgagccgggcttcatctgcaatcactccgacgaccggggccgctacgcattcgaccagcagccgcgcatcggactgtggaacctcgcgtgtctgggcgaagcgctgctcaccctcatctcggaggatgaggcccgcgccgcgctggccacctaccagcccgcctacaacgcgcacttcatggaccggatgcgcgcgaagctgggcctgcgggagacgcgcgacgaggaccgcgagctggtgagcgacctgttcgcccgcatggccgaagcccacgtggactacacgcgcttcttccgcgcgctgggccacttcgcctcggcggacggcgcggacacacgtcccgtacgtgacatgttccccgcccccgagggcttcgatgcctgggccgggcgctaccgggcgcggctggccgccgagggcagcgtggacgcagagcgccacgcgcgcatgacgcgggtgaaccccaagtacgtgctgcgcaactgggtggcgcaggaggccatctcccgcgcggaggccggggacttctcgctcgtggaccggctgctcggcgtgctgtcggacccgttcgccgaacaccccgacgcggagccctacgcggcggcgcctcccacctggggccggcacctggcggtgagctgcagctcctga

SEQ ID NO: 8510 - DNA, 346 bp, Myxococcus xanthus
atggtgacggacctcacccggttgcccctgcgaggaaaacaaggcgcctttcacgtcatcgtcgagtctccccgaggctccacgctgaagctcaagtacgacacggcgctcaaggccttcagcctctcacggccgcttcccaggggcctgagctatcccttcgactggggcttcatcccctccacccaggggccggatggggacccgctggatgcgatggtgtactgggacgacgcgagctttcctggcgtggtgctgccctgccatgcgctcggcgtgctccaggtggagcagaacaccggtgacggcggacgcgagcgcaatgaccgcatcgtccttgagagca

SEQ ID NO: 8511 - DNA, 1170 bp, Myxococcus xanthus
gcacagcaggggctggtccgccacttcggcctgtcccagttccggccggggcaggaccaggtcatctcctccgtcttgagcggccgcaacacggtggtggtgatgcccaccggcgcgggcaagagcctgtgttaccagttgcccgccacgctgctgccggggctgacactggtggtgtcgccgctgattgccctgatgaaggaccaggtggagcagctcaccgcgcgcggcatcccggcgaccttcatcaactcatcgctgtccgacctggagcgcgcggagcggatgcgcaagctgcgcgcgcatgagtacaagctgctctacgtggcgcccgagcgcttccgcagccagagcttcctggagacggtgtccgcgctgggcgtggacctgctcgccgtggacgaagcgcactgcatctcccagtgggggcacgacttcaggccggactacgcgctgctcggacaggtgcgaaagcggctgcgtccgccgcgcacggtggcgctcaccgccacggccacgccggaggtccgcgcggacatcgtgcgtgtgctgctgatgaaggacccgcaggaattcgccatgggcttcgaccgccccaacctcttcctgggcaagcaggaggtgggcggcgacgcggaccggcacgaggcctgcgcacgactggcgtccgcgggcgggagcggcatcgtgtactgctccacgcggcgcgcggcagagggcatcttctccgaactgcatgggcgcggagtgaaggcggtgctgtaccacgcgggcatggacgatgacgcccgtcgccgcgcccaggacaccttcatgtccgcgaaggaagcggtggcggtggccaccaacgccttcggcatgggcatcgacaagccggacatccgcttcgtcggccacgccaacatcccgcgggcggtggaggcgtactaccaggagattggccgcgcgggccgcgacggacaggccgcgcgcgcggtgctcctcttcaaccactcggatgtcttcacccaggagcggctcatccagagcagccacccggccgaggccatcttcggggacgtgtggaacgtgctccagtcggtggaggaattcgagagaggcgtgcacgcgctcgcgggcacggtgaacgccagcgagttcgaggtctccgcggcgctgcgcatcctctaa

SEQ ID NO: 8512 - DNA, 1077 bp, Myxococcus xanthus
atgctcctggtgtcggggctcctgcacgtcgcgctcttcgtggcgctgtcaggcagcgagcccaacgaccgccagcgccgcgtggaaccacgtgccgtcgagatggaggtcgtctaccaggacgtgacgcctcctcccgagccgccagcgccggagccccgccagccgcctcctgacgaagcgcccccgcgcccgccttcgaagaaggaggacccgcctcggcacgcggagcgtccgcgccccaccacgacggaggcccccgacgcatccgaggaacctccgcccgaggtcgccccaactggctccggcgagccgccgccagccctggcgcaagacgtccctcgcgacgttcctcagccacagcagcgtcccaacctggagtcacagggccttctggggggcggcatgctgcgcggcggccccccttcgacgggacggacgctccgccctggcgaaggcccagactcgaaggcgctggcggcccggcaggccgaggaagcccgggtgcgtgtggacggctgggcccaggacgccgccgccacggcacgcgcgtcgagcggcgccacgcatccctacttcgcgaagttgcgggaaggcttcgcgaagcagttggtgaacccgccacctccagacctgaaggtgttgggctcacgaatgaagcgcgagcaggtggatgccattgcgcgcttcggaaagacaggcactcccatcgccgccgagccccgggaccaccggttggagcagcgcaatcgcatgcaagcggctgtcgaggctggacgcgcggccaacatgtacatggtggacgtcaccacgccggtgctcgcgctcgcggccatcgtcgaggtctggcaggcgcgcgacgggaagctgctcgacctcaaggtgctcgaaggctccggcgacccgaaattcgactcctgggccgtgtcccagctccgggatgcgctcgccagcgcggaggcgccgaagcccggaggcggcctgggcatccgtgatgacggcatgcgcagccgatggcggctggaggaataccttgggaatccgcgcgtgcagattcacctgatgggcgtctactga

SEQ ID NO: 8513 - DNA, 492 bp, Myxococcus xanthus
atgcttgctctcgacctcgtggaacggctgcgccaggtatctcccagcgcggcgaatgcgctgctgacggtggcggtgaagaacatcatcccgctgtcctcggtgatgggcgtccgggtggaggacgcatcggatgctcgggcccaggtgtccgtgccgctgaagcggcgcacgcgcaaccacgtgggcagcgtgtacctgggcgtgcaggtgacggtgatggaactgaccatgggcgtgtggctcttccgccgcttcccgccgggccgttacctggcgctcgtgaatgagttgcaggtgtccttccacgcgaaggccaagggcggcgtgcgcgccatctgtgagccgcctcccgaggtgttcaacaccctggacgccgcgctccggcagaagggggacaaggcccgtgagtggattcccgttcggctggaggacttcgaggggacgcacatcgcggatgcccgcttcctggcggtgctgaagaaggcctga

SEQ ID NO: 8514 - DNA, 2034 bp, Myxococcus xanthus
ccggtcgtggttctcacggaggcgcccttggaggtggcgcggcgcctgggcatccgggcgggcctcatcgtgccgctgttggcgcgaggccgcgtgctcggtgcgctgtcgctggtccggggcgactcggacggtgtgcccggcgcgtccgacctggagctggcgttggagctggcccggcgcgccagcctgtccctggacaacgcgctgctgtacgcggaggcgcgcggcgcgcagcagcgcaccgagcgcctccaggccatcaccgcggccctgtcccgcgcggccaccgccgaggacgtggccgaagcgctgatgcgcgaggagttgcgccccgcgggcccggcgcgcggcgcggtgctcggcatgctggaggatggccggctgcacgtgctgggctccttcggttacgcaccggcggtgctggataccctgcgagggctgtgggcggaccaagtgcccggcgtggaccgggcgctggagcagttggagccgcagtggttctccacccacgcggcggtgccgcgcgccgtgcccgagtgggcgcgggacctcgtccagggcgtggggcccggggcctgggcggtgctgcccttgaaggtggagcaccgcatccggggcttcctgctgttcacgtgggacgggccgcaggtgttcctcgcggaggagcgcggcttcctgtcctcgctggcgcagcagtgcgcgcaggcgctggagcgcgcggcgctgtacgaggcgctgcgtgagcgcggcggcaagctgcacgtggcgctggaggcgggcaaggaggccgaggagcggctcttcttcctgctggaggcgagccgcgcgctggccgagcacctggacgacgtggagtggacgctggagcacctggcgcgagtggccgcgcgaaacgtggccacgtactgcctggtggagttgatgggagcggacggcgtgccgcgcgccgtggccgcgtcccaccgggagccagagcgggacgtgtcggtgctggcctcgctgtcccttccatgggtggagggcacgctgcacccggcgcgcgagtgcttcctgtcgggggagacgcgcttcttgcccgaggtggggccggagctgcgcgagcgcatgtgccaggggcccgagcaccgcgcgttcctggaggcgctgaatccacactcgctgctcgcggtggcggtgcgcatgcgcggacgcacgctgggcgtcatcacgctgggcaccgcggccccctgccgccggctggtcaccgccgacgtggccatggcggaggagctggcgcggcgcgtggcggtggcgttggagaacgcgtcgctgtaccgggacgcgcaggccgcggtgcgtctgcgcgacgagttcctctccgtggccagccatgagctgaagacgccgctcaccagcctgaagctccagcacgggctcatcgaccgcgccgcgctcggagacgtgggggacaaggtgcggccccggctggccacggccgtgcggcaggtgcagcggctgagcgcgctggtggacagcctgctggacgtcagccggatttcgctggggcggctgatgctggagccgtccgacgtggacctgggccaggcggtgcgcgacgcggtggaccgcatggaggaggtgttctcccaggcgggctgtccggtgcgggtggaggtgccgggcccgctgccggggaagtgggatgcgctgcggctggaccaggtgctggtgaacctgctcaccaacgcggccaagtacggcgcgggccggcctgtcctggtggaggcggccttcgagggcgaggagatggtgcgggtgtcggtgcgtgacgagggcatcggcatcgccgcggaggacctgccgcgcctgttcggccgcttcgagcgcgcggtgtccgaccggcactatggcggcctgggactggggctctacatcagccggcagatcgtggacgccatgggcggccgcatcgaggtggagagccggcccgggctgggttccatcttcaccgtgcgcctgccccggtccacggcacaatgcgcgccatggtga

SEQ ID NO: 8515 - DNA, 768 bp, Myxococcus xanthus
atggtgaccgtgggaagggcggacgtgcccaaggcgttgtcggtggcgaagttgcggaaggagtacggcggcaaggccgcggtggagggtgtctccttcgaggtgggacgcggagagattgtcgggctgctgggccccaacggcgcggggaagacgaccaccatcaacatggtgctcggcgtgctgcagcccacgtccggcaccatccacatccaggacctggacctggcggcgcagcgctccgccgcgttggcgctgacgaacttcgccgccgtctactcgccgctgccgggcaacctctccgtgtaccagaacctgcgcgtcttcggcctcatctacggggtgaagtccctgggggcgcgcatcgcggagttgctggagcagttcgacctggtgaagtaccgcgacgtgaagtgtggcgtgctgtcctccggagagcagactcgcgtggcgctggcgaaggcgatgctcaaccgtccgcacctgttgctcctggatgagcccaccgcgtcgctggaccccgcgacggctcgagacatccgcgcccggattcgcgagttcgccgcgcgggacgccggcggcgtgctgtggacgtcccacaacatgtacgaggtggaggaggtctgcgacagggtgttgttcctggcgcgcggccgggtgctcctggaaggcaacccgcgaacgctgcccggcgagcacggccaggcctcgctggaagaactcttcatcgccgtggcgcgcgagccgctcgcgctggagcggagctga

SEQ ID NO: 8516 - DNA, 804 bp, Myxococcus xanthus
atgcacctgcaccgggccgccgccgtcgcgcttcgccactactacctcctgcgagggagcctcgcgcgcttcctgccactcttcgcgtgggtggccatcgacatggtgctgtggggcttcatgagccgctacctcaacaccgtcacctcccaggaatacaacttcgttccggtgctgctgggcgccgtcctgctgtgggacttcttcatccgcgtcatgcagggcgtgacgatggtgttcttcgaggacgtgtggtcgcgcaacttcctcaacatgttcgcgtccccgctcaccatctccgaatacctgggcgggctggtgctctccagcatcgccaccagcaccctgggcttgttggtgatgctggtgctggccagcaccgtcttcggcctgtccttcgccgcctacggcgtgctcttcgtgcccttcctgctggtgctgttcctgttcggcatcgcgctgggcatcttcggctgcgcgctggtgctgcgcctgggcccggcgtcggagtggttcgtctggcccatccccgcgctgctgtcgcccttcgccggcgtgttctacccgctgtccacgctgcccgcgtggatgcaggccgtgtcccatctgctaccaccctcgtacgtgttcgagggcatgcgcacgctcgcggcggggggcgcgttccaggtgtccacgctgctgtggggggcttgcctcgcggtggtggaaatcctgctcgcgtgtgccttcttcacgcgggtacaccgacaggccgtgcgcaccggactcatcgcgcgatacagcgctgaaagcgtgagctga

SEQ ID NO: 8517 - DNA, 636 bp, Myxococcus xanthus
atgtgcaaggtggtggctgaggtcgtcgtggatgaggcccggcgtgggtggcagcaatcgtacacccgtacctggagcataccgatgcgaagcctcaatcctgttttctcgtccgcggtggtgatggccctgtgctcactgctcgcgggcggttgtggcggttcaccgtcgggcggtgagtcggacacgcagacccctcagagcggcgggctgggaggcaaggccggcgaaggaggccctgtcttcggcgacgagccgacgtaccccggggacgatgacgccacgccgggcaaggtcaccatctgccacattccccccggcaaccccgccaacgcgcacaccatctcggtgtccacgtcggcctggccggcgcatgagcggcatggagacacgctgggcccctgcgaagggggcggcgaggagccggatgccggcagtggcgaggagccggatgccggcggtggcgaggagccggatgctggcagtggcgaggagccggatgccggcggtggcgaggagccggacgcgggtgctccggtgtgcgcgcccattggcgaggcttgtggtgagtccgccgcctgctgcctggggctgatgtgcggcgaggacaacacctgcgatcccgtcatcggctga

SEQ ID NO: 8518 - DNA, 1047 bp, Myxococcus xanthus
atgtcccggtcggacgtcaccacctccgttcccgtgttcacccagaccttccggtccccgtgtggctgtgtccccgcgcacgggggggcctgcgagtgtccggcccgggcgggcgcgcgtcgtgtgtccatggggtgtccgccatccttcatggtgccgcccgcgagggaggccccgctcccgtcctcggcggcctcgctggtgggacagcaggtgggccacttccggctgctgcgagagctgggccgggggagcctgggcgtcgtgctgctcgcggagcacgcgctcatccagaagcgcgtggccatccaggtgcttcacacgcacgtgacgcaggacccggcgcaggtcgctcggttccttcaggcggcgcgcacgctgacgctcatccagcacgcgcacatcgtttcgctctacgacctgggcatgcgcgacgggcgtccctacctcgtcagggagtacctggagggacagagcctgaccgccttcgcgaaggggccgctggcgtccgcgctggtggtggacctgctcacccaggtgtgtgacgcgctgggcgccgcgcatgcgcacggcatcgcccacggcagtctcaatcccgccagcatcttcctcatccccgatgcgaatggccgccagcacgtgaagctgctggacttcggcatcgccgggttgctcccttcccccgatggcgccgccgacctgtcggtggccgctgacctcttcgccgtgggcgtgctgggcgcgctgctggtctcgggccggctgtcctcgcgcgggcacgcggcggaggagccgccccatggccacgctcgggaggtgccaccgctgccggcgggcatcccgtcggcgctgtcacgcgtgctgctcaaggccatggcgcgccgcccgggggaccgttatgccagtgcggccgagctgcgcgcggcattgcaggcgtcggtggcgctcgacggcggcgtggcgcatccagaggccctggagctggagcggcttcccagttggtacacgctccgggggccgccgggggccgcgcccgcctccaggtag

SEQ ID NO: 8519 - DNA, 932 bp, Myxococcus xanthus
atggcctccgaccccgacgacaagcttcctccccagggccgcttcaaccgcctgcgcaagctggcaggcctctccgtgcaggtgggcacggatgtgctcaagagcggcgcgaagcgcctgtccgggagcacgcccgacctgctcagcaaggaggccgcggagaagctggtctccaccctgggcgagctcaagggggccgccatgaagatgggacaggccatctccatggacccggacctgctcacccccgaggtgcggcaggtgctggcgcggctgcagaaccaggcgccctccatgtcctacgcgcaggtgtcgcgcgtggtccaggcggagctgggcgcgccgccggagtcgctcttccgcgagttcagcgaggagccgttggcggccgcgtcgctggggcaggtgcaccgcgcggtgctggaggacggccgggcggtggcggtgaaggtgcaataccccggcatcgacgtgtccctggccaacgacatggcgaacctgggcatcgtggcgaaaacggcgtcgacggtgctgcgcgtgtccgatgcaggcgcctactttcaggagttccgcgacgagatgctgctggagttggactaccaccgcgaggccgagctggcccgaggctttccgcccaacgtggcgaaactgcccgagctgtgtgtgccccccctcattttcagccacaacgcgaaacgggtgctgacccttgagctgctggaggggctcaccctcaaagactgggtggcgaccaattccttcaaccaggggcgctttcccgtggggcgcccacttattcttgccacctaccgggcctttttttgggcgggggaaaaacaccccgacccccaccccgggaaatttattgggaatcccgaccggccggttgggtttgttgaattttggttccttaaaggctttttcccccgctt

SEQ ID NO: 8520 - DNA, 351 bp, Myxococcus xanthus
atgttccccgacgcgggcccaggcgaggtggacggccccgtccttcgctacgcggagccgctgtcctgccccgccgcgcccgagggccgggtgtgggtggcggagacgcaggcgtgcgacgacgccggctgcgagtcgctcacgacggtgtgggcgggctcgtggaccgtcgaggacgcggggctggaagtgcgctgtgagacggaccgcgtggtgctggccgcgggcgaatggcggatggtgctcacgccaggcgcgggcggcggcctggaggtgagtgagctgacgccgccggagcccgagtcgctgtcggcggcgcgaccctcggagacaccggcctccgaggactga

SEQ ID NO: 8521 - DNA, 117 bp, Myxococcus xanthus
atgttcgacccgcccaccgccgcgcgagcgctgtcggattccgcgcgcgaagaggagccggagctgctgagcgcctccggtgagctgccgacgctgcgcgagacgagaaaccgctga

SEQ ID NO: 8522 - DNA, 110 bp, Myxococcus xanthus
atgaccgagtacgcctatacggaccgggacaagaagtgccggcgctcggccatcctccgctacttcggccaacgcgacacccacacgtcgtgcggcaactgcgacgtgtg

SEQ ID NO: 8523 - DNA, 543 bp, Myxococcus xanthus
atgttcgccggctgtggagagagcagcgccaacgagaacacgctggggccccagcaggcggccgcgggccatccagtgacgctcacggacggccagattctgggtgtgctcctggtggccaacgcgggcgaggtgatgctgggccaggtgggccaggcgcaggccaccgacccgacggcacgtgacttcaacgcacgcatggtcaccatgcactcagaggtcatccagcgcctggagcagctggccacggcccagggtatcgcgcccgcggagagcccggtgtcgcagcacctcgagcagacggtgcagaagaccgtcgacatggtgagcgccacgcaggcccctgccttcgacgtgtcggtgatggatgcgcaggtcgccgcccacgccggtaccgccctgctgggggattctctgctcgcgatgcaagtgcagaacccggcgctcaaggatgaactgatggcgattcggaagacggtccaggcccacctccaggaggcctcgaacatccagaccaccctctacaacgcgaagcagccgtag

SEQ ID NO: 8524 - DNA, 282 bp, Myxococcus xanthus
atggccagggagacgttcagcgtggtggaggtcaacccggcgcaccgcttcgcgcggctgcggcccgaatcgggcgggccgctcctgcacgcggggctgtacccggaagaggaggccccggagccgcagctccaactgcgtgaaggggaccgggtggaaggccagcggcgcgggcagtcgggggcggactggggctgggtgtcccgcgccgagccgcccgcggacctggtggagcggatgggcgagctgctcccgaaattggagaagtaccagctgcgcgtg

SEQ ID NO: 8525 - DNA, 2670 bp, Myxococcus xanthus
atggcccgactgcgtaccgtggatcagccgctgcgccgggatgtccgcctgcttggccggctcctgggagaagtcctcgtcgaacaggaagggcaggcgctcttcgacctggaagaagaagtgcgccgcctcgccatccagcgccgccgaggccccgtggccggccggcgcgcggtggcggccgagctggcggaggtgctccaacgcctgccgctggaacgggccgagccggtgctgcgcgccttctccgtctacttccagttggtgaacctggcggagcagcaccaccgcatccgccgcgcccgcacccacgcggaggtcgcgtccgccaagccccagcgtggttcgctggaggctacgctgcaagtgctcaaggaagcgggcatccccgcggagcgcgtgcgcgaggccatgcgcaccatgcgcgtgacgctgacgctcaccgcgcaccccacgcaggccgtgcgccgcacgctgctggagaagctctaccgcatggcgggcctgctggaggagcgggaccgctgcgagctgacgccgcgcgagtcctcggtgaacctggcgctgctgcgcgaggaaatcaccctcctgtggcagacggacgagctgcgccgcgagcgccccaccgtgggtgacgaggtgaagaacgtcctctggtacgtggaggaggtgctcgccgacgagctgtccctgctccccgagctgctggactgggccttcgagcgcgcctacggcgagccgctggggccggtggacacgcccgtgcgcatccactcatgggtgggcggggacatggatggcaacccgctggtgacgcccgacgtgttcgcggacacgctgcgcgcgcaccgggcccgaggactgcgacggttgctgcttgacctggagcggttgggcgggcggctgtcccagtcggcgcgtcacgcgaagccgtccgaggagctgctgagctcggtggcgaaggacgcggaggagctgcccgacaccgagcgccgctacggtccccgtaccccgggcgagccgctgcggcacaagctgcgcttcatggaggagcggctgcaccgtgcgctccactacgtgacgcagcagcgcgccgggacgagcgtccccatgccgcagggcgcctaccgcacgccggaggccttgctggcggacctggacgtgctgggccgcgcgctggaggcgtcgaagggcacgcacgcgggacttcgcgacgtgcggcaggtccgggagcgggtgctcgcgctgggactgtcgttggcggagctggaggtgcgcgcgccggccgaggacgcggtgagcgcggcgggctcgttcaacgggggcccggcgccgacggaaggtggggcgcggctcctggaagtgctggcgcggctgaaggaggcccagtcggagtcgggtgagtccgcgtgccgcacgctcatcctcagcatggccagcaccgccgaggacgtgctcgcggccttccgctgcttgaagcacgcgggcctgtgggacgagaagcggggctgcgccacggcgaatgtggtgccgctgttcgagcagttgggcgcgctggactcgggcccggacgtgctgcgcacgctcttcgcggacgcggagtaccgcaagcacctggacgtgcgcggtggccaggaagtgatggtgggctacagcgactccggcaaggaggtggggctcctggcggccagcgcggcgctgtaccgcgcgcaggtggcgctcacggaggtgtctcgtgaggcgggcgtcccgctgcgactcttccacggccgcggcgagtccgtggcgcgtggcggtggtcccgcgcaggaggcgattctcgcgctgccgccgggcgcggtggcgggtggctacaaggcgacggagcagggcgaggcgctggaccacaagtacgcgcgcccggagctggcgcggcgcacggtggagctcatcctgggcggcgtgctgctgcacacgctggatgcgcagccgcgaccggagcccgaggccgagcgcaccttccgcaccgtgttcgacacgctggcggagacggggcgcaaggcgtatcgcgccctggtgtgggaggacccacggttcctggagttcttcaccgccgcgacgccggtggaggagattgcgtcgctgcccatcggctcgcgccccagcaagcgcagggcgggaggcctggacacgctgcgcgcgattccgtgggtcttcgcctggacgcaaaaccgggccatcctcccgggctggtacggcgtgggctcggcgctggaggccttctcgaaggaggagggtggggcggcgcagctcaagcgcatgtaccaggagtggcccttcttccgcgccgtcatcgacaacgtcaccatggtgctggcgaagtcggacatggccatcgccgggcgttacgcgtcgctggcgcctcccgccacccgttcgctgtggcggcgcatccagcaggagcaccggcgcacgcgcaggcaggtgaagcggctgacgggcgagtcgaagctgctcgacaacaacccgcagctccagcgcagcatctccctgcgcaacccctatgtggaccccatgtccttcctccaggtggagctgctcaagcgcaagcgcgagggccaggcggaggtggatcgtccactgttgctcacgctcaacggcatcgccgccggcatgcgcaacaccgggtag

SEQ ID NO: 8526 - DNA, 2550 bp, Myxococcus xanthus
atggccactcctgaaatccaagctccgctcgccgcactgctccccaagaagggcgaaccgcccctggacgcggatgaaatcctcaaccgcttcgtcggctacgtggcggccaatggcttgagcctctattcggcccaggaagaggccatcctggagctgctggcgggcaagcacctgttcctcaagacgcccacgggctccggcaagtcgctggtggcgacggcgctccacttcaaggccatggcggaggggaaggtctccttctacacctgccccatcaaggccctggtgaacgagaagttcttcgccctctgcgacgccttcggcgcggagaacgtgggcatgctcaccggcgacgcgagcatcaaccgcgacgcgcccatcatctgctgcaccgccgaaatcctcgccaacctggccctgcgcgacgcgagcgcccgcgtggactacgtcgtcatggacgagttccactactactcggaccgcgagcgcggcgtggcctggcagttgccgctcatcgcgctgccggacaccaccttcctgctgatgtccgccacgctgggccccacgcacgtcatcgaggagagcctgacgaagctcaccggccgggaagtggccaccgtgcgcagcgccgagcgccccgtgccgctggacttcgactaccgcgagtcgccgctgcacgagacgattgaagacctgattgctcgtgggaagtaccccatctacctggtgaacttcacccagcgcaccgccgccgagcaggcgcagaacctgatgagcgtggacttctccaccaaggaggagaaggaggccatccggctggcgctccaggacgcgcccttcgacacgccctatggcaaggagttccagcgcttcctgcgccacggcatcggcatgcaccacgccggcctgctgcccaagtaccgcctgctggtggagaagctggcccagcacggacacctcaaggtcatcagcggcactgacacgctgggcgtgggcgtcaacatccccatccgcacggtgctcttcacgcagctcttcaagttcaacggcgagaagctgaccacgctgagcgtgcgcgacttccagcagattgccggccgcgcgggccgcaagggcttcgacacccagggcagcgtggtggcccaggcgcccgagtacgtcatcgagaacatcaagctggccgccaaggaggccgcgggcaagaagaagacgcccaaggccaagccgccgcagaagaacttcgtgcagtacgaccggagcaccttcgagcggctccagaacggcatgccggagccgctggagtcccgcttcgcggtgtcgcacggcatgattctcaacctgctccagagcgaccaccagacggaaggcaacggcgggtacaagcggctggtgacgctggtgcagcgcagccacgactcggactacctcaagcgccggcacctcaaggaggccgcgcgcgacttccgcacgctgcgcggggcggaaatcatcgaggtggagaaggggcagggcggctcgggtgccacggtgaaggtggcgggggagatgcagcacgacttcagcctcaaccacacgctgtcgctgtacctgctcgacacgttggagctgttggatccgaccacggacacgtacgcgctcgacgtggtgtcgctggtggaggccatcctggagaacccggacgtggtgctctacgcgcagctcaaccagctcaagggcgagaagatcaacgagctgaaggcgcagggcgtggagtacgacgatcgcatggcggagctcgagaagctcgagtggcccaagcccaaccgcgacttcatctacggcaccttcaacaagttcgcgcagaagcacccgtgggtgggcgaggagaacatccggcccaagtccattgtccgggacatgttcgagcggttcatgtccttcccggactacatccgtgagtacggcctgcagcgcagcgagggcgtgctgctgcggtacgtgaatgacacgtacaagacgctggtgcagacggtgccggagcgcttccgcacggaggaggtggaggacttcatcgaccatctgcgcgccacgctccggcaggtggactccagcctgctggatgagtgggagcgcatgcgcaacccggacgccgccgtcgaggcgaagccggtggtggagctcaagccgaaggagctcaccgacgacccgaaggccttcgccgcgcgcgtgcgcgaggagctgcaccggctgctcaaggcgctgggccagaagcgctacatggacgcgctggccatgctggacaacgcgctgggcgaatggacggcccccaagctggagcaggccatggcgccgtacttcgaggagcacaaggtcgtggtgctcacgccccaggcgcgcaagcccgccaacaccttcctgaaggagtccggcacgcggctgtgggagacccagcagcgcatcatcgacccggaagggcacggcgactggatgattgactgcgagatcgacctgcgggacaggcgcctggatgagggccccatcctgatgctccgccgcatcggcgtgtag

SEQ ID NO: 8527 - DNA, 795 bp, Myxococcus xanthus
ctgaacaccacgctggcgcggcggatgatggagcagacgcgcatttacgaggcattgaagggcgtccgggcccgcccaccggtagacctgaaggcgctggagcaactcatggtgcgcttcagccagttggtggcggagcagcgcttcgtgaaggaggtggacatcaacccgctgctggcctcgcccgagcggctgctggccttggacgcgcgcgtggtgctgcacccggcctcggtgacggaggcagagctgccgaagctggccatcgagccgtacccggaccagtacgtggcgccctaccggttgcgcagcggcgaggagattctgctgcggcccatccgcccggaggacgagccgaagatggcggagttccaccgcacgttgtcggagcagacggtgttcctgcgctacgcggggttgatgcagttgagcacgcgcgtggcgcacgcgcggctgtcccgcatctgcttcaacgactacgcgcgggagatggcgctggtggcggagcgcaaggacggagagctgctcggcgtgggcaggctcacgcggctgcgaggcacgcgcgacgcggaattcgccatcctcatcagcgacccggtgcagcggcaggggctgggcgcggagatgctgaagcggctggtggacgtcggccgggactggggcatggagcgcatcgtcgcggacatcctcgcgggcaaccgcgccatgcagaccatcagccggaagctgggcttctccatcctccagcacgaggagctgtcgccggacatggtcaaggccgtgaaggtgctgtga

SEQ ID NO: 8528 - DNA, 537 bp, Myxococcus xanthus
atggaattcaacagcctcgacgcccagcgcgagtcctgtgtcgcctacgtgcagcgccagcccggctgggtgttggtggaagagagttacgacgacggtggcttcaccggcgccaacatggagcggcccgctttccagcggctgctgcaggacgtggacgcgaggcgggtggacgtcgtcgtggtctacaaggtggaccgcctctcccgcagcctcctcgacttcgcgaaagtcatggagcgcttcaatgcggcgggcgcctccttcgtctcggtgacgcagaacttcagcacggcggacgccatggggcggctgacgttgaacatgctgatgtccttcgccgagttcgagcgggagatgatttccgagcggacgcgggacaaggtggccgccgcgaggcgcaaggggaagtggacgggaggacgcgcgccgctgggctacgaggtgaaggacaagcgcctcgtggtgaatgagtacgaggcggtggtggtgcgggaggccttcgagttgtacctaccaacaccagcaggcctttag

SEQ ID NO: 8529 - DNA, 174 bp, Myxococcus xanthus
atgggccagcgcttctatgagacgacgatgccgcagctcgtccgccaactagggcgtctcaacgacaacgtggagcggctggtggccgtcgcggagcagctcgccgggcagaaggaggcctcgagcgccgagccggcacgcccgacaacgacagcggggacggaggaaccatga

SEQ ID NO: 8530 - DNA, 558 bp, Myxococcus xanthus
atggcgaagaaggggattgcgcgggccgcgcgtaaggagctggcggacgtgccacggcaactggccgcgctggccagcatgtcggtgccggatttggcggcgaagtacctggagctgtacggcgagcccacgcgcagccgcaaccgggactacctgaagaagcgcctggccttccggattcaggaattggccgaagggagcctctccacgcgcgccgtcgcacgcatttcggagttgggcgacaagctgcccgagcggtggcggatgcgacaggtggaggagacgaagccctccgagtcgcctcctccagccgctgtggacgggcgcgcagccgctgcggacgggcgcgacgtgcgcctgccgccgccgggcacggtgctgacgcgagtattcaaaggcgctcagcaccgggtgacggtgcgcgaggagggaatcgaatacgaggggcagcttcaccgcagcctctccagcgtggccaagctgattacaggcacggcctggaatggcttcaccttcttcggccttaaggacggcagcccgaaggcggtgacgcgatga

SEQ ID NO: 8531 - DNA, 888 bp, Myxococcus xanthus
atgcggcgcctctaccgaggagagacggaggagcggggccggccggacttgacggtgtccacctaccgcttgcaggccccgctgtgtgtctgcggagagacgcgggccacggaagcggcactcgtggagcgcattcttcccgtcagcccggagaaggcgacggtgcagcagccggcctaccgggcggccttccgcgaggtgacgtctgtgcgcctggccctctttgcccctcgctacattcaattctgcctgggtcgggacttcgacgcggactaccgcctggcccgcgccgtcgcggacgacttcgtgaaggggcgacaggtgcctccgcgcgtcgtcgacaacgtgacggccatgctgctgggcattcacctcttcgagcagttcgccgaggagtgcggctacccgttgcccgccgacttgggcgcccgtgaggccgtggacgccgtgctgaaggacgtcctcgaggaagaggagggcgtgcgaaacgccctcgacgtcttcatccagaagctgtccaacatggcgattcagggcgagctgaagcaccgcgtgcattacgccttcgtcgagggacggctgtgcctccacctggagtccgcctacgacgccttccggatgtactgcaagcgcaccgactaccgaggagagatggtggacacgaaggcgctgcgacgcctcattcacgaaaaccaccgcgcgggagggtacgtcgtttccccaagcgagcgcgtctgcttcgccggcaagtccctgcgcaggtgtgccctggtgattgacgtcgcgaaggtgcccttcatctccgcggaggaattcccgcacgtcgaggaggcaagccgtgggtggcgcggccagggctatggcttcgcggaggaaggggcgtcctga

SEQ ID NO: 8532 - DNA, 1392 bp, Myxococcus xanthus
atgtgcggcccggtgcagcgcctgtgggagcagggggcggaggaccggagcgtcgccatcttcaacatggtgcgcttcttcgcgcacaagggcttgggcctcgacgaaatcaccgagctcgtcctcgagtacgaccgccggggcctcgggaagctgaaggggagagacggcaaggtgtacatctccaaggcctacgaaaaggtggtggccaccgcccgcgaggatggcgccgtggcgccgccctgccactccctccagggcctgggcttctgccgcgtcaaccgcgagccggacgtgcgctgcgagctgtacgacgtcgtcttcgacatcgagaaggccgtggaggcgctcgccacggtgccggcccaggagatggcgtatcgcctcaagcccattctggaggccatctcccaccgtcctccgtccgcgcaggagaagtacctgggcctgctggaggtgcgcaccggcctggccgcgcagaagcttcggctgtccatggcccgcgccgtgcgcacttccgcagcgggagagggcgaggagggcgcggactccaagggaggcgggaagagcagcagcggtgatgacaccatcgacggcgaggtgtacgaggacgcgtactgctactacacggtgacgcagcgcggagacgcgaaggcgatttcgtctttcaccttcacgcccaaggccgtcgtcgaaaccgaggagggggaggtgttcctcggagacgtccgcacggacaagggcaccagcgtggaaggggcgcggctgccgaggcgggccttcaactcgcgcaaggagctgctacaccacctgccctccatccacacgcagtggacgggcagcgacaacaacgtacaggggttgctgcgcgcggtggcgcggcgtgcggtgccgcggctgccgggcaccagtgtgctgggggacttcaaacagggggcgcaccacgtgtgggtggcgcctggatgcaccattgggaaggagggctttctctccccgtcgcccgtggcgtacctgcccaatggggcgtcactcgagtcgcgtgtccgctacgaggccacggacgacgacagcttccacgacgtggcgcgcacggttttcgagtacctgccgcgaatcaacacgccgcaggtggtgctgcccatgctggggtggttcttcgccacgccgctgaagccgcgcctcttggagaaggtgggctccttccccattctcttctcgtacgggacgcagggcagcggcaagtccagcacctgcacggaagttttctggccgctggccggcgtgccggcctcggacgcctacagcgtgacggagacggaattcgccctcgtgaaactgctgccctcagacgcgctccgtgccgggggtgctggacgagtacaagccccatga

SEQ ID NO: 8533 - DNA, 444 bp, Myxococcus xanthus
atgagctgggagcagaacctcatcgaggacgaagcgggtgtggagcgcgtggtgaagagtgcccggcgggtggcggtgctgggcatcaagacggagcagcagtcagggcagccggcctactacgtgccggactacctggcgcgctcgggcgtcgaggtggtgcccgtgcccgtctactacccggacgtgacacacatcctgggcaagccggtgttccggcggctcacggatgtgcctggcgacctggacctggtggacgtcttccgccggccgcaggacatcgacgggcacgtggacgagctcatcgccaagaagccgaaggcggtgtggttccagtccggcatccgcaacgacgccgcggcggagaagctggcgaaggcgggcatccaggtggtgcaggaccgctgcctgatggtggaccaccgccgctacggcgagcggtag

SEQ ID NO: 8534 - DNA, 870 bp, Myxococcus xanthus
atgacgacaccttctgataccactccaagcactccaaaccccgacgccatccgcgccacctggcggtggctagcgcacgcgccgcatggcgtgagcgaggtccgcgtcatccgcccgggcggcggtggcatcgtcggtctgggcttcttcgacgacgaggaggccttcgtcgcggcctgcgtggcggccaatgccggcggcaacgtgtacgtgggcattcagccgcggccccggcgcttgctcgagctggcccccaacgtcctgcgccccttgaggactggggcgggcagcaaggacatcgaggcggtgacggccacggtggtggacctggaccccgtgcgccccaaggacacggccagcactgaggacgagctctcgctgacgctccaggtggcggaagccgctgcggcttggtgcgaagcgcagggactcgttcgaccgcggctgatgatgagcggcaacggcgcgcagctctggttcgccttgccgccgcagtcgctggagggcgagagccacgagcgcgtgcaggcgggcctgaaggccttcgaagccgaggtgcgtgcccgcttcgcttccgaacgcgtgcacgtggactccatccacgatgtggcccgcatcatcaaagtggtgggcaccgtcagccggaaggggcgcggggacaccggagcggcctcaccgagcagctcgggcgctcgccggcttcgagcgcgtggaagacgcaggactcctggagcgcctgctgcgcgcgccggtgcagcagcccgtggcgaacctggcgcgtccagcccaggtggcgatgccgctggcgccggctgcctcggccccgcaggggacggtgaaggcccgccggacggaggcgggggagtatga

SEQ ID NO: 8535 - DNA, 2850 bp, Myxococcus xanthus
cccccgactgcttatttgaggaacacaagaacggtggaagacttctccgaaatgcgcggggacgggggacgtgttgtctctcgcacccatgactccagcgtgggggccgcgccgtcagcgcctacgcgcaacacgagcacgggcaagcggacgctgcgcgtgcgtgtggatgccgggctgcggctcgcggcgggtgacgtgccgcccaaggtgctggaggccctctgccgcgcgctctccctgcccaaccccgcgtattggaagctggtgcggctgcgcaagcgcccgggggcggaaccccagacgctgtacttcttccgccaggagggacgcgagctggtgctgccgcgcggggccattcacctgctgcgaagggctgcggacggggcgggcctgacgctgtccttcgaggacgcgcgagtgttgccgcccaagcgcctgccgaagctgccggaggtggcgctgcgcgactaccaggccgaggccgtggagcggctggcgaaggccaccccagggacggcggtgctcccatgtggaggcgggaagtgtgtgaaaaatgactccctcatcttcacggaccgtggactggtcaccgccgctgagcttgccgtcggcgttcccgaggaacatgcggccttcacggaagtcggcgtggacacgtcgacgggtcgcgcaaccacgaacgccgtctacaacggggggcgctcaccaacgaaacgggcccgactcgctcttggctatgagttggaggcgacgccggagcatcccattcgagtgctgcgtgatgacgccctcgcctgggtgcgcatggacgaactccacgttggggaccgcgtcgccttgcgtcgcggcagcgaggtgtggggacgctcctctcttcccgaggcattccgctgggtaaagcccaagtatgcggcgaacttgaagctccccaagggcctggtgctcgatgaggtggcggccgaggcctgcggcctcctggtctccgaggggacgctcaccaagcgcctcgtgacggagttcacgaacgcggatgcggacaatgtcgggttcatttctcgctgggctgcctccattggcatcgacctcagtcgcaacgggagtgactcaattcagtacctcctgtgctcagtcgtgttgcgtgagtggttggcgtggttggggctcgactacacgagggccgcggggaagtgcatcccacgggccgtccgcttcggggggcgcgacatcatgcgcgccttcttgcgcggcctgttcgacggtgatgcctccgtcgatcctctcaagggggttatcgaattctgcaccgcctccgagcgaatggcccgagaggtccaggttgctctcctcgggctcgggattctggcgtcgcgccactcgcgcaccgtcgcgggatacgagcagttgtactggcgagtgactgtcaacgacgtcgcgaccttcgaacgtgaagtggggttctcatcgaactggaacagacttcgcctccgcgaggcggtggctcgtgccgaggggcgctgcagaaaccctaacgtcgacactgtccccatcaatgggctggtggagcggctctatcgaaccgcccagaagcagttgtcctggagcagccaagaggggaggattttcggcaactacgtccatggagagcacgctccttcccgtgccgcgctcgagcggatggtgcagcgctggggctcggagtgcccgacggagtgcctgcccatcgaagccttcctcgaacttccggtggcgttcctttccgtcgagtccatcgaagatggcgaggccgacgtcgtggacctttcggtgcccgagacgcacgagttcgtcgccaatggcgttgtgtgccacaacacgatgttggctctcggtgcagttgcgcgcctccgcactcagacgctcgttctcgtccacaccctggacctggccgagcaatggcgagagcacgtgcgcgagcgcctgggcctggaggcaggcctcgtgggcgcgggcgaggaagatgtgcagcccgtcaccgtggccgtcgtccagtccctcacccgatgggaggacgcgaagctcgacgccttcctcggccgcttcggcctgctcgtcctcgacgaagcccaccacattggtgcaagcgctttccaccgaatcgtggaccgttgcccggcgcgctaccgactgggcctgacggcgacgcccgagcgggaggacgggctgacgccgctcttgcgcctgtacctgggtgcgcccctggcggtggtgaggcacgaggaactcgtcgcgcgcggggtgctggtggtgcccgaggtgcgcgttgtggagacggccttcgagtacccctacgtcggctccgcggactacgcgcccatgctgggggcgctggtggaggacaaggctcgcaatgacctcgtccttggcgccgtggcccgcgaagcatgggcaggccacctgtgcctcgtcctcacggggcgggtggaccattgcgagctgctagcgcagcggctgtcggccacgggcattcctgccgctgcgctgacgagcgcggtgccgcgcgcggagcgcaaggccctcctggacaaggctcgtgctggacgcgtccgcgtcctcgtggccaccagcttggcggatgaggggctggacttgccgcgcctctcgcgcgtcttcgtggtgtaccccggctgcgccaagggtcgcaccgtccagcgcctcggacgcctgatgcgcccgcacgaggacaagaagagcgccgtcctcatcgacttcctcgacaggaaggtgccgctcctgcggcgccaccacgtgaagcgccgccagcagtacgccgcggtgctgggagtggcggctgcggccagcgcccattga

SEQ ID NO: 8536 - DNA, 609 bp, Myxococcus xanthus
cacccgggcaccaacatccagatcaacggccagtcgctggacatcaccggcacctacaagatcgccgtcaacgactacatcgccaagggtggctcgggcttcaacgtcctcaagcgcaacaccacccgcatcgagacgggcatctcgctgcgcgactcgctcatcggctacatgcagggcttctgcacctgcgaggacatcctcgcgggccgcgagacgtccaaatcgggccactactgcggcaacctcgtcaacggccgctggacggtgaacgaacaggtggtgggctcctgccgcgccgctgccgacttcaaggccgcgctggacaagcaggtgggcagctgtgactgcaaggatctgctgtcgctcccctcggacgccgcggagcgctgcggcgtgccgggcctgacggccgaggatatccagagccagtgcgacgtgccggagggtccgtacacaggccgctgcagctgccgggatgtgctggcgggcaacaaccccatctgcggcacagtgacgaaccagctgcggaacttctgtgagaaccccacctccgtgtccatcgcggacgcggttgaggattcccgtatcggccggagggtgaagtaa

SEQ ID NO: 8537 - DNA, 166 bp, Myxococcus xanthus
atgaagcgcctgctcttcctgtcggccctggcggcggccggctgttacacccaagaaacgccgcagcctgatggcgtcgcctcgttccgggtcaacctcacgggcatctacacccgcggcacgcgtaccccgctgccggtggtgaatgagtgcgccaccgcgcacg

SEQ ID NO: 8538 - DNA, 1854 bp, Myxococcus xanthus
gaccaccgatttcaagtcagcctccgcggggtcatcgacctcctgtcacatcacctgtacagctccccgggcgtctacgtacgcgagctgctccagaacgcgaccgatgccatccgcgcccgccagctcctggagcccggccacgcgggcaccgtccggctggagctgatggagaagcaggacggcagcccgcccaccctgctcttcaccgacgacggcgtggggctgaccgaggacgaaatccaccgcttcctggccaccatcggtgagtcctccaagcgcgaggccctggaggcccgccgcaacgacttcatcggccagttcggtatcggcctgctgtcctgcttcatggtgtgcgacgagctgctggtggtgacgcgctcggcacgcggcgacgggcgcacgttggagtggcggggccggcatgacggcacgtacgccgtgcggccctccgagcacccgctcgcccagcccggcacccaggtgttcctggtggcccgcccggacatggcgcattggttcaccgccacgcggctgcgaaacctcgccagccactacggcggcctgctgccctttcccatccacctcaccacggaccagggcaccgagcggctggacacctccggcgccccctggcgccgcgagtacgacagcgcctcggagcggcgcaaggcgctgctcgcctacgggcgcgagctgttcgacacggacttcgtcgactgcatccccctgcgctccaccgcgggagacgtggacggggtggcctacgtgctgcccgcgtcgccgcacttcaactcacgccagaagcaccgcgtgtacctcaagcacatgctgctgtcggagagcgcggagaacctgctgccggagtgggccttcttcgtgaagtgcgtggtgaacgccaacgcgctgcggcccaccgccagccgggagtccttctacgaggacgacgcgctcgccgcggcgcgcgagtccctggggcagtccctgcgcggctacctgatggagctggcgcgtgaggacccacgcgcgctccagcggctgattgccctgcacgggctgagcgtgaaggcgctggcgctggatgacgatgacttctaccgcctcatcatccactggctgcccttcgagacgtcgatggggatgatgacgctggcggactaccggcgcgcgcaccccgtggtgcgctacacgtccacgttggacggcttccggcagattgcccaggtggccggtgcccaaggcctgtgcatcatcaacgcggcgtacacgcacgacacgtcgctgctggagaagctgccgcacgcggtgccggacgtgcaggtggagcccttctcctccgcggacctgccgcagagcttcgatgagctcaccctggacgagcgcgaggccaccttcccgctgctgcgcatggcggagaacgtgctggcgccgttccgctgcggcgcggtggtgaagaagttctacccggcggaagtgcccacgctctacagctcggacgcggagggcgcgttccggcgcgacgccgagcgggctcgcgaggagtcggatgacctatacgccggcgtgctggacagcgtcatggcggcctcgggcagcgagccggcgcagttgtgcttcaacctccacaacccggtggtgcggcggctggccgccgtggcggaccgggacatgctgaagctgtcggtggagatgctctacgtgcaagcactgctcttgggacaccatccgttgaacgcacaggagatggtcctgctgaaccagggcctgttgggcctcatctccgcacaactgggcggggatggcgggcgcggcggcgaaggcagcggcggcgcgggtccccgggggctgcactga

SEQ ID NO: 8539 - DNA, 1125 bp, Myxococcus xanthus
atgagtggtgactggcgcgagcaggtggagtcgctcttcgctcaggcggacggcctggctgaaggcgagagcaaggtgcggctcctggaagaggcggtgcgcctggcggacacgcacaaggacgtgggcatgggctaccggatgcgagatgccctcatcgacgcggcgaccttcggcggcttcccggacaaggcgctggtggccttcgcgtggtgccggggacagcagaagaaggacccgaagcgcttcgacccggaggagatgttctggaagcagaagtgggtggtggggcgcatcaaggagttccctcacatcacccgcaagcagattctggacgcgctggacgacgtggagcagtgcttcagggccacggactccggggtgcgcgcggtgctgaagatgcgctaccaggccgcgcgggagatgggtgacgccgccgaggaagtggagcggctgtggaacgcgtggctggagacgcgccgcgaccacctcaccgactgccgcgtgtgcgagctggacgacgaactggaccaccacgccgacaagggcgaatggcagcaggtgctgcgcaaggcgaagcccatcctggacggccgcaagtcctgcgcggagattccccacctgacgctgggcacggtgctctacccgctgttcaagctgggtgagctggagcacgcgcgcgaaatccaccgccgcggctacgccatggtgacgaagaaccgcgagttcctctccaccgtgggcgagcacatggagttcctcgccctgacggacaacctggcgcgcgggctgacgctgctggagaagcacctgggctgggcgctggaccacccgagctaccgggaccgcttcaccttctacgccgccgccgccttcctgctggagcgggtgctggccgcgggagacagggacgtggtgagcctgcggctgcccaagacgttccccaatcaccaggcggatggcggctacgacgtccgggccctgcatgcctggacgctggggcaggcccgggacatcgcgaaccgcttcgacacacgcaacgggacggaccggttcgcgaagctgctggcgcgcaaccaggtgctcgcgggggaagtccgtcccttccccatcgacgcgaagtga

SEQ ID NO: 8540 - DNA, 924 bp, Myxococcus xanthus
atggccgtcgcggccctgctgcaccttcccgcggccacgtgggtcggtatggccgcgctcttcgttgccctggtggaccggggcgggccctactgggaccgcgcgctcaccatgggcgccatgacgctcctgggctccgtggtgggcctggccgcggcgctgcacctgcccgcgtgggccgccgtcatcgccacgctgttctgggtgacggcgtgtggcttcgcccgctcgtatggggacacgcccgggttgatgggcgtggtgctcgccaactacttcgtggtgtcgctcgcgcttcccgccaacgacgtggctgacgcattgctgcgctccggcttgttcctggtgggcggcgcgtgggccatgttcctcgcgctgatgctgtggccgctggtgccctaccggcccgcgcgcctggccatcgcgcggtgttacgacgcgctggcggaccatgcggaagaggtggggcgctggccgctcgaagggggggcgtccgccgccgcgggtgtcctgccggaggcgccctggcaggcccgcatgcgtcagctcatcgaacaagcgcgcaccgtgctggcctccacgcgcatgggccgggcgggggagagcggccggggcgaacagctgctggtgctggtcgaaggcgcggattcgatgatggtgacgctcatcgcgctgacggagatgctggaggtggcgcccgccgagccccgctatcacgcgctccgagcggaggtgcagcgcgcgctggcggagctgaccgcggacctgcgccgcgtccggtttgctctggagaaggggacggaggtgagcgcccagtcggtctggaacgccgagcgggtgaagcgggccctggatgcgctggacccggcgggcggcgtcccggaaccggtgccccccggcatatcaacgtcaccgccggagccc

SEQ ID NO: 8541 - DNA, 1446 bp, Myxococcus xanthus
atgcccctgggttacatcccggtcctcgcgccgcgcatgggccttgcctggcgctccaggggtgttccggtgttggacttcaccaaggcggggtggctcttgccactcctgacggagacggtcgccttcgaggcgggcgcgccggctccgtccgcgccgccgctgggctccgggcgggcccgggctcgcgcgtacctgcggcggacgctgcgcgccagtggcctgctgtacggcacgcccgcggacgcaccctccgcggcggacgtggcgcagcccaccgagctccaggcgcgcgtgctggaggaccagctcttccgcgccgtggtgcggaccctggcgctgatggcgctggaattgggccggctcgtgggggctccagcggccgttcgcaccgagcatctcctggtcctgttcgcggtgctcaccggagagctggagctggcggaggcggtggacgcggcgattgcctcggggcgtccggtgtcccggcggctgacggcgaaggtggaagcgtcgctggtgaagcgctcgcccgtgctggcgggggacccggtctacgggctggtgttgcacaacggcgcgcagtacgcggacgcgcagctgttctgccggcaggccatcgactacttctcgcgcggcacgctgcaccgcgagcgggcgcagcggcggctggacttcgcggcgcggcagaaggcgctgctggtggatgtgctgacggggcttgcgtgtgtggaccgggtgccgggcctgcccgcgcgccgcgccatcctgcggcaggtggagtccctgcggctgccggcggcgatgacgtccgagctcaaggccgcggtgaagcagtccttcgcccgccgccgcccggtgcaggacgtggtgcgccaggtgcgcagcgtggacgtgcgccacttcctgctggagcagacgttgctggcggcgctggtggatggccgcaagacgcggcgtgagcgcgtcttcatccgcgagctggcgcaggcgctccaggtcccggacgcggagctgcaccggctggagctggagatggcggagttctacgcccgccaccgcgccatcgtggacgtcttcaccgtgtcggacgccgcgggcgccatgggcgaggacctggtggccggcatccaggaggcgctggagaagaacttctaccggctgatgcaggaggtccgcgagacgggcgacctggcggtgctgctgacgaaggcggcccggcgtcaggcgctcacgggcgacgagcgccggcgcatgcgcgcgcaactcgtcgatgtggccaaggcgattcccgcgctggccatcttcgcggcgcccggcggcatcctgctgctcgcggcgttggggaaggtgctgcccttcagcctgctgcccagcgccttccaggaggccgcgcccgccgaggaggacttcgagggcgtgggcccggagcgagaggccggctga

SEQ ID NO: 8542 - DNA, 696 bp, Myxococcus xanthus
gtgacgtggtgggggcacgcggccttcgtgattcgcagcccaggcggcgcggtgattgccatcgacccctggctctccaaccccaaggccccgaagggcgccgcgcagccggaggcgctggacgccatcctcctcacccacggccatttcgaccacgtgggcgaggccaaggcgctggccgagaagacgggcgccaaggtctatggctccttcgagctcatcaacctgctggggctcccggaggcccagtccgtgggcgccaacgcgggcggcaccttccaggtgaaggacgtcacgttccacctggtagaggcggttcactccagcagctacgccgcggacccgaagtcgccggcgcagtacgcgggcgcgcccgtgggctacgtgctggaaatcgacaaggggcctacgctgtaccacgcgggtgacaccggacccttcgagggcatgtcgctcatcgccacccagttcaagccctccgtggccctgctccccattggcggccacttcaccatgggccccgcggaggcggcccaggcggtgcggctcctgaaggtcaagagcgtgattcccatgcactacggcaccttcccgctgcttcagggcaccccggacgcgctgaccggcgagctgaagaagctgcgcaatacggccaaggtggtggtcccggagcccggcgcgacgaccgcgctgtag

SEQ ID NO: 8543 - DNA, 969 bp, Myxococcus xanthus
gctctaaagagccgacgtggaccggggctgctcaagaagaagctgggtgaggtggtggactcgtgcgtcaacgcggtgggcgtggacgtcaacaccgcgtctccgcagttgttggagcacgtgtccggcgtggggccgtccctggcgaagaagctggtggcgcaccgcgcgtcgaagggccgcttcaccacgcggcgcgagctgctgaaggtgagtggcctggggcccaagacgttcgaacaggcggcgggcttcctgcgcgtgcgtgggacggagccgctggacgccagcgccgtccatccggagcgctacggcgtcgtggagcgcatggccaaggatttgggcgtggccgtgagcgcgctggtgggcaatgccgagctggtccgcaagattgacctgaagcgctacctgggcccggacctgggcgagatgacgctcaaggacatcctggcggagctggagaagcccagccgcgacccgcgcggcgacttcaccgcgccccagcaccgcgaggacctgcgctcgctggaggacgtgaaggagggcatggtgctccagggcgtggtgacgaacgtcaccgcgttcggcgccttcgtggacgtgggcgtgcaccaggacggcctcgtccacgtgtcgcaaatctccacgcgcttcgtgaaggacccctccgaagtggtgaaggtgggcgaccggctgacggtgcgcgtgctcaccgtggacctggcgcgcaagcggctggcgctctccgtgcgcgcggtgcaggagggtggagcgccgcagccgtcgggccgtccccccgtcggcggggccacgggaccgagccgcatgacggagcgcggtggcggaagcggcgggcctcgtcagggcgcccggcctgcctccggcccggggccgaagccggcttcggggcccggtgagaagaaaggcccggagccgttcaacaacccgttcagcaagctcaagcgctga

SEQ ID NO: 8544 - DNA, 906 bp, Myxococcus xanthus
atgcgtcccggccccctgacgtccagtcttctcctgttactgctcgccactgcctgtagccacaaggcgccgctctccgtgtcgccttcggagccgcggccggcgtcggtgcgactggacttccagccccccgtggaccgcgtgctcacggagacgcagcgcagcgtgcgttcggtggagcggcggggtgacacccttcgcgaggaagtggagctgaccacgcagacgcgcttcacgccctccgaagggggctggctgctggcgcaggcggtgccgcgctcgcgcctgacgcgcaatggtcaggaggtacccaccggcgtggcggacgtgctggcgcgcttcacgctgcaggcgtggctggcggcggatggccccttcgtgaagctggtggcccccgaagccgcgcaggaggcgctccgccaggtggcgccctcgggcacggaggcgggcgtgttggagcgcttcttcgaacccgaggccctggagacgcgggcgcggcgcgagtgggaggtgaagttcgccggcctcttccagcgcaacctcgtggagggccagcagagctgggtggtggacctggtgcccgtgggggacagccaggtggcctacgtgctggagcgcacggtccagggcacgcgggacacgccgctgggagacgcggtggtgctgggcctgcgctgcctggacgcggtgccggaggatgcgccggacgcgctgtgggaggcgtgggtgatggcgggccggccggagctgacgccgggcgtgtcttgcgagggagaacagctggtgggccgggggcgcttcatgcccgtgagccgccaactcacggtgcgggcgacggtggcgggcgaagcgtggactgtcacgacggagtcccgggcagaggggctccaggaggaggcgcgatga

SEQ ID NO: 8545 - DNA, 2232 bp, Myxococcus xanthus
cccgaggtgatccagatctcggcgacggattgcggccccgcttcactcaagagcctgttcgcggggatgggcgccgagctcaactatcgcgtccttcgcgaagtgtgtcagacggacgtcgatggcacctcgatcgtcaccttggatgaagtcgcgaaccagctcgggctcgacgccgagcaggtgatgcttccgctcgatcacgtggtggtccccgaagccaaggcgcttcctgccatcatcgtcacgctcagcgcgggaggacggccgcacttcgtggtgctgtggaatcgcgtcggcccgttcatccaggtcatggacccggcggcggggcgtcactggacccggatttcgacgctgctgagccacctgtaccagcacaccacgtccgttccggcgaccggctggcgcgaatgggctgggtccgaggaggcggtcgcgacgttcgagcgccgcctgctgaacctgggtgcgacgcaggcgcgggcgctggttgcccgggcgctcaaggaccctgggtatctatcgatcgccaggcttgacgccgcgtgccgggcgtccgaagcgatgatccgcgcgggcgccgtccggcgaggccggatggcggcgggtctgctgcaatccatgattgcaaaggacgattccagcgaagtgcccattcccgctgcctattggtccgttcgccccaaccccgaggtggagggcgagctgtcgatgaccggcgcggtgctgatgcgggttcgcggttggcgcgaggctccgcgcgaaggcgaagacgcgccgagagccgtgctcgcgagcgacctggcgacggagctcatcgccaagcaggtgagtccggcgcgaacgctgctccgcctgcgaggcgaagattcgtgggtcgttccgggcctgattgcggtgggactggtgttcgccaccttcgggcggatcctgcaatcgctgatgctccgtggcgtgctcgacctggggcgcgacctcggcacgttcgcgcagcgtgcgacgggcatggccgttcttgcgggcgtcgcgctctgcttcatgctcatccaaatccccatttcattgggattgctcggcatcggccgccggctcgaggtgcggctgcggaaggcgtatttcgagaagctccccgagatggaggaccgctatttccagagccggctcgcctccgacatggcgtctcgcacgcacaacatccaggcgatgcggtcgctgccgcccctgctcgcgcaggccctggtcctgtcgctcgaagtcgcgagcatcactgccgcgctcatctgggccgcaccgcacgcatggcgcatcgtgctcgcgctcgcggcggtcacgctgctcgtgcccctggtcgcgcagaagctgctcttcgagcctgacctgcgcgtgcagatgcacgcaggcgcgctcagcggattcaccctgaacgcgctcgtcgggctcacgccgatccggatccacggcgccgagcggtcgctgcgccgcgcgcaggagaccttgctcgtcagctggagcaaggcgcgctattggctccagacgctgtcggtcgggttcgaaggcgggctgatgctggggagctacggcctcgtcatgctgctcgtctattcgtacctcgcgggcacggatcgggcttcgctggtgttgttggtcgtctattgggcgctgcggttccccatcctcggccagcggctgatgatgctgagccgcgcgttcccgaatgcgatgaaccgggttcgccggctcctcgacgtcatcggcgatatcaaggagcctccggcccggcccgaggcgccagtgcaggagcctgtcgcgcccgcggacgccgcgagcggcgtttcgatcgtgatggagaaggtccgcgtgaaaggcggcggtcacaccatcctcgacaaggtttccttgaacatcgcccccggcgagcacgtggccgtggtcggtgtctccggagcaggcaagtcgacgctggtcggccttttgctcggctggctccggccggcgcgcggcgagatcaaggtcgacgggcaggtgctcgatcaggccgctgtcgagcggctgcggcgcaccacggcctgggtggatccggcgatcagtctctggaaccagagcctcatcgacaacctccggtatggcaacgacggcgcgcacggctggtcactgtcgggggcgctcaagagcgccgagatgctcgacatcctcgaggcgcttccagacgggctgcagacgtcgttgggc

SEQ ID NO: 8546 - DNA, 1218 bp, Myxococcus xanthus
atggcatatcccttcgagcggacccttcgttccctgaactacgagtcggacacgcgcctcgtgttcgtcgctctgatggtgttgtgtgccggcgggctcatcgcatggtcgctgttcgccaaggtcccgctcgtcaaggccagctcacaggcccggatcgagccacacaacgccgtccatcgcatcgagccgcccagcgcgggcagggtcgtgctctcgctgctcaaactcgaccaggaggtcaaggaaggcgaccttctcatcgagttcgacgcacgggccgagcgcctcgagctcgagcggagcaatgcgacgctcgccgcgaccgagaaggagctcgccatcatccgccagcagatcaccaacaagcacgaagaggcggctttgacggcacgggtggacgaggtcgcagtcaaggaggcgctggggagggaacaggagctcgcgcccaggcaccggctcgcggtggaacgcgcggagctggccttcaagagcccggcgggcgcggtctcggagatggagaagctcgagcgcacgaccgatgtcgacgcgctccgcttcgcgcagacggcgcagggcctggcgctcatccgactgcggcgcgagcagaacgtgcgccgtcaagccctcgccgcgcagttgctggaactcgagcgcgaggcgctgggcgccgaggggcggatccgggagctccaggggaccatcgaccgccttgagtaccagatcgagcggaagctgtatcgggcgccggccacgggccacctggtcgacgtggcggaactcggctcgggagcgttcattgccgacgggcagcgggtcggcaccatcgtcgcgagcaatgccgaggtgcgggtgcgcgcccgtttcccgaaggaggtcgtcggattgatccagcccggtcaaacggcgcgcctcaagctcgacggctacccgatgaccatctacgggacggtccccgcccgggtgacggccgtcgggaccgagcccggccagaccgccacgcccgaggccatccccggtacggtgcgcgtcgagctcaagttcgcaccgccggacgatccgcgcatccagctgcgccacggcatgaccctgtcggtggaggtcgaggtcgcgcgggcgtcgcctgtcgcgctgctgatgcgggcggtcggcgaatggaatccgcagcctgaagaacggcccacgaacgtgttccggcccgaagccgaggcccgctga

SEQ ID NO: 8547 - DNA, 204 bp, Myxococcus xanthus
atgctggccctggcgcaccatctggagtccgccattgagagggggctcgtggcgagcgcggcggacgtcgccggtcaactgggctttacctgggcgcgtgtgacgcacctgctggacttgcggttgctggcgcccgacatccaggaggaggtgctgttcctcgaagccgtcgatggggaggagcaggtcgtggcccttctgtga

SEQ ID NO: 8548 - DNA, 204 bp, Myxococcus xanthus
cgcatcctcgccgttcccatcaccccgtcccgcgccggacacctgacggactatcagcaactgccacagcgcgagcgagaggagttggagcacttcttcctcgccgccgtgcgcttcgaggacaagcacgcgcgcatcctgggctggcaggggccgcagggtgtcgagcggatgctccgccaacacgcacgcacggaggaatag

SEQ ID NO: 8549 - DNA, 897 bp, Myxococcus xanthus
atggctcaacccacgcccatccgagggctcgggcccgacagccgcctgggagacgccgcgcgccgcatcctcgcgggccggctcgcggacgttcgcaaaccggaggccggcttccaggacgccgtggatgacgcgtccgtccatgacatgcgcgtggccacccggcggcttcgcgccgccctcaaggtgttccgctccctgggcggcatgaagaagctggagcgcgacgtgaagcgcatccaggacgcgctggggggcgttcgggacgtgcacgtccagtccgcgtggctggagagcgtggcccggaaggcgagcaagaatccccaggtgcgcgccggcatccagaccctgcgcaagaagcgactgtccgagctggagacgcacgagacgcgcttgcacgcggagctggagcgctggatggacaggacggtgccccggctcttgcgcaagctggatgggctcgatgacgggcaccgcttcgccggccgccgcgtccgggacgcgctgcgccaacgcctcaagcgcgtgcagaagggaatcgacacatacgtggacgcggccgacgcggcatccgcccatgagctgcgcaaggagctgaagcggctgcgctacgagctggagatcttccagcctgccatccgccgcaccctggacgcgctgctggaggtgctcgtgccgctccaggatggcctgggcgagctgcacgacgccgacgtgcgcctggagctgttcgagcggctggccgcggagtcggcgccgcgcgagcgcaagtccgcgcgggccctgctccccctggtccgggaggaacgaacgaagcgcgcggcggagactgcccgcgaggtccagcggtggcgcacggaagagattcccaagcgcttgcgccgcatgttgacctga

SEQ ID NO: 8550 - DNA, 1257 bp, Myxococcus xanthus
atgcgtgcgtgcggactcgatttcggaaccagcaacaccgccgcggccctgcctgacggcacggtgctgtccctgcaacccaatacctcggaggcccgtctcttccgctccgtcctcttcttcccggacgacgagcaggacatctacgccggcgccggcgccatccagcgctacctggaggacaacaccggacgcttcatccagtccgtgaagtccttccttcactccagctccttccgcgccacccaggtgaaggggcgcacctacaccatcgaggagctggtggccgtgctgctgcgccgcgtgcgggacgccgccgcgagcgccatgggtggcgcgcccgaagccgtcgtgctcggccggcccgccgtcttcacgccggacccggaggcggatgccctggcccagcagcgcctgctgcgcgccgcggagctcgcgggcttccagcacgtccagttcctcatcgagcccatcgccgcggcgctcgcctatgaggcgcagctcacacgcgacgagctcgtgctggtggcggacttcggcgccggcaccaccgacctcaccctgatgcgcctgggccccagccgccgcggcaacccggaccgccgccaggacgtggtgggctccacgggcgtgcgcatcggtggtgaccgcttcgacgcggaaatcatgcgccacaagctgctgccccgcttcggcgccggctccacctaccaggtgcgcggtttcagcgacaagcggctgcccattccccagcacatcatggccaagctgctcacctggcacgagatgtccttcatccgggagaggtcgacccaggagctgctggagaccatgctcaacacgagcgaccgcaaggccgaaatccaggccctgtacgacctcgtcatggacaacctgggctaccgcctgttccgcgccattgaagcggccaaggtgcgcctgtcccaggaagacacggccacggtggacttcgaggaggcccgcatcaccctccacgagcccatcacccgcgaggagttcgacaccttcagccaaccgctgctggacgagctggacgcgtgcaccgcgggcctgctggagaagcacgcggaggcgaaggacatcgacgcggtgttcctcaccggtggctcgtcacagattcccgcggtgcgccagctctacatgcgccgcttcggcgaggggcgcgtgcgcaccgcggatgccttcacctccgtggccgaagggctcgggcgcgcggcggcgcacctctccgtctga

SEQ ID NO: 8551 - DNA, 693 bp, Myxococcus xanthus
atgcgcacggagaattggctccccctcatcggtctgttgctggtcatcccctgtcacaccgtggaggcccggcccgtccgcgcggaagctcagctctggtacacggtgtcggcgcaggggggcatcggggaacacctcctctattacctggaggcccagccgcgcttcggcaaggacgacgcccgcggcatcctccgctcggcgggaggcgtccggttggcccaggacatgtcgctgtggctggggcagggctggtttccatcgtggcgctgggagggcgacccggccttgcgtcagggcgaaagccggctcttccagcagttcctctacacgccgaagttcgcccaggtccggggcacgctccgcgcccgtctggagcagcgcttcctgcccggcacgacggaggtctcccaccggggccgcgtcatgttgcgcggtgcgcaccccgtggccgcggaggggcggctgtcgttgattgtctgggatgaggtcttctaccacctcagctcggtggcgaatggccccagcgccggcttcgacatgaaccgcgtgttcgttggcgcgggctggaagtacggggaccactcctccgtggaggtgggctacctcaacgtcttcacgcgcaggccctatgcggagaccgagcagctcatccatacgctctccgtcgccatgcccttcaattacatgtaa

SEQ ID NO: 8552 - DNA, 195 bp, Myxococcus xanthus
atggtggatgggcgccaggccagcgctggggaaatccaggagggcagtcaggtccgggcctcgtaccggaccgacgagcagagcggagagccccaggcggtgcgcatcgaggcgacctcacaggtccagcccacggcgccggccgcgccggagagtggccagtccaccccgggctcccagcagcccacgcagtag

SEQ ID NO: 8553 - DNA, 870 bp, Myxococcus xanthus
atgcgttccatcctccccgcgctcgtggtggtgctgctcgccggctgcgggcccgacttcgagcttcagagcgaaatccggcgcgtgcgcgtgctggccatccaggcggagcccgccgagctggtggtggacccggacgcctccacgctgcccgggcccatgacgttcaacgcgctggcggtgacgccggacgcgcgccccgtcaccgtccgctacgcgctgtgccgcttcactggcaatccctatgacgggcggtgcccgggggacgacagcgtgccgttgccggacggcgagttgtcgctctcggacccggacgtgcaggcggtgttgctggaggcactggccgcgggcaatccggggggcggtggaacgctggaccccgaggacccggcgctgcgcgaggcgctggcccggggcattccgctcttcatcggttacgaggccacggacggcagcggcacaccggaaggcacggagcgcggcgtgcgccgggtgacgttgcgggccaccaccacgcccaaccagaacccggtggtgtcggacgtcctgtgggacggcgcgccgctcaccggcccgctgcccgtgtcgcgcgaggtgaccttcacgccggtgctggccgagggcagcgtcgaaatcgaagagacggacgaaggctcgcgccccgagcaggtcttcttcagttggttcgccactggcgacggcgaggtgaaggagttccgctcccaggagcccgtggaaggccggccgggtgacccgacgtcggcgtacgacacccccgccacgccccagcgcgtcaccttctgggtggtggcgcgggatgggcggggcggggtggggtggctcagccgcaccgtggacgtgggcccgtag

SEQ ID NO: 8554 - DNA, 2625 bp, Myxococcus xanthus
gcgcccctcatgaaaatcctcctcgccgtcctctgcttcctcgccgccactggcgccgccgctcagcaggacgcgggcgtcacggatgccgacgccggcgcgccccagggcgtgctgacgaagccccccgcgctgatgcgccaggtggaggcactctatccaccggaagccgcggcccagcagctcgagggcacggtggtgatgtgggtcgacatctcggagacgggcgccgtctccaacgtcgaggtgtcccaacccgccggccacggcttcgacgaggccgccgtggaggcggtccgccagtttcagttcgagcccgccgaggtggacgatgtccccgcgccggtgcgcatcgaatacgcctaccagttcgtcttccgtccaccgccgccgccggagggtgaggacgccgccgccgtggagcccgaggctccagtgaacttcagcggccgggcgctggagcggggcacgcgagacgcgctcctgggcgcggaggtggtgctgcccgcgctggagcgctccaccgtcaccgacgaggaaggccgcttctccttccgcggcatccccctgggcacgtatgaggtgctggtggtgcagagcggctacgagcgcttccgcaccgaggagaccttcacggaaggccaggagacgcgcgccacgtactacgtgcgcaagcgcatcttcggcgcgttcgagacggtggtgcgcagcgaacgcgagcgcaaggaagtgacgcagaccacgctccaactggccgaggtgcagcgcgtccccggcacccagggtgacacgctgaaggtggtgcagaacctgcccggcgtggcgcgccccgccttcaacggtggccagctcgtcatccgcggcacgggcccgcaggagtccggcgtcttcctcgacggccagcggattccgctgctctaccacttcggcggcctcacctccgtctacaactcggagctgctggaggcggtggactacctgcccggcaacttctccgcgtactacggagatatcaccggcggcgtcatcaacgtgcgcagccgcgagccgcgcacggaccggctccacgccaccgtgggcgtcagcctcatcgaatccaacgcggtggtggaggggcccatcaccgacacgctgagcttcgcggtggcgggacggcgttcgtacatcgacctggtgctgggcctggtgccacagggcgacaacggccccagcctccaggtggcgccgcgttactacgacgcgcagctcaagctggtgtggaagccgaggtcgcgccacaccttcacgctgcagggactcacctccagagacaggctggggctcgtcttcgaccggccggcggacgacgaccccaccgtcaccggtgggctgaacgtcaccaccggcttcaaccagttgcgcctgcggcaccagtaccgcgcggacgcgctcaccctggacacgcacggcctggtgggcaacacgctggtccagtttggcatcggcgaccgtggcctgcgcatcgcctccacggacctgaacctgcgctccaccgtggagtacgccttcggggaggcgctcacgctggcgggcggcatcgacgtggtgagcaacttcgcccgcgtcaccgcgcgcatccagggcctctcccgcgagggggagccgcccacgcccaccgtcaccgatgacgtgctcaccgcggacggcgacttcctccagtacttcccctccacctgggtggaggcgcgctggcgccccgtgccgcgcctgctgctggtgccgggcctgcgcgcggagagctacatcttcaccgaccagacccaggcccgtcgcaccttcaacccgcgtctggcggtccgctacggcctgacggacacgctgacgctcaagggcggcgcgggcgtctatcacgggccacccgtgcaggatgagccgagcgtggccttcggcaacccggacctgcgcgcgaagcggtcgctccagtacagcgtgggcgcggagtggcaggcgcggccggagtggttcgtgggcggcgaggtcttctacaacgacctggacgggctcatcgtccgctccaacgccacggtggtgcgcaacggccagcgggtgcccgagcggttgagcaacggcggcgtgggccgcatctatggcctggaggtgctggtgcgccgcgcgctgacggaccggctcttcggctgggtctcctacacgctcagccgcagcgagcgccaggacgcgccgggcgtgggctggcgcctcttcgacaatgaccagacgcacgtgctgacagcgattgcgtcctacaagctgccggcgggctgggaggtgggtgcgcgcatgcgcttcgcttcgggcaatcccacgacgccggtggtgggctcggtgcgcgacgatgggtcggacgtcttcatcccgctctacgcggcggtgaactcgcgccggctgccgtccttcaaccagttggacatccgcgtggacaagaacttcgccttcgagaagtgggcgctcaacgtctacctggacctcacgaacgcctacaacaacccggcggtggaaggcatcgcctacaactacaactacacccaaagcgctttcttcgaaggactgcccatccttcccatcatcggcgcccgggggagcttctga

SEQ ID NO: 8555 - DNA, 321 bp, Myxococcus xanthus
atggcttatggactcgcggaggatccagcgctctccatcaccccgcacctcgacgcggtggagtaccccgtcgaacgggagcaactggcggcggctgccgctgacgcaggcgccccccccgacgtcatcaacctcttcaagtgcctgccgcgtcgcgagtacgccacccgcgaggccgtgcagcgggacctctccgaggcatcccgtcgctccgccctggggggctcgagggacgacgatgacggggtgaaccgggaccgccgcaacatcgggcgggacgcggtggaggatgcaccggacggccagacgcgtcatccgtga

SEQ ID NO: 8556 - DNA, 1710 bp, Myxococcus xanthus
atggccttcgcggcgtcggatgggctgccgccgccgctggcattgcaggtccgcgctggagggctcgcggggcttcgagcggggctgatgacgacgctggcccggcggacgctggcgcctccgcgcagggacgcgcggcgacgtgccttcgtggtggaggcacccgggacatccgtcacgctgcccaagctgtacgtgcagtggacgggagcgcgcgcgtcgctgctggcggggacgtatcggctgggcttcgggcaacggctcacactggacaccacggcgctgccgtcacccgacgggttccttcctgatgatgacgtgcgtcctccggcgggattggagcgctcgtgtctggtgggcagtgcgggttgtgagcccgaggaacgcctgtcggacgtcaccccggacttccgctgggacgagggcttccggggcgtcgctggcacggtgcgaggcccgctggggacgtgggccgcgctgtcgctcaccggcttcggctcgtatcagtcccgtgcgctggcacggcatgcggtgctggaccgctcgctgtgtccgtcgtccgcccgtggcgcgtgcaaggcccctgacgtctgggtgtccgtggcggagggccggtgggagaagctgacggcgcggacgctgtcggggatgttccgagagctggcgggcggtggcaacgcgacgctggcgatgtcgtcgcggagccatgtggggctcaccggttggatggctcgacctatgtgggggcaggagggggcgaagctcgacttccagcccaatgcccgctacccggcgggcggtgcctttggcgcattcgggctcgacgccgcgtgggggcgtggcgcgctggacgtcttcttggaaggcacgcgcagcttcgatgccgcgccgggtggcggcggggacttcggtgcggtgcagcgcaccgtgctgtcagggggggcgcgcgagctggagctgtcgctgcgctactacgggcgcggtttcgccaatccctacagcggcgcgccgtcaggcccggatgcgctggaaggcctgcgcgttcgcaacgagctgggcgcccggctgcgctacctccaccgtgaggaaggcgcatggcggctgcgagggcaggtggacgcctggacgctgcccgcggatggggcggtgtctgggagcgcgggcacgctgcacgcgcgtgcctcggtgcgcggggaccttcgggtgcggccctggttgcagccctcgctccaggtggagttgcgtgacaacggcgtgggcgggatgggggcgtgcgcggatgactcgctctccgcgcaagatgtggcggacctgtgcgccagcgcgcggtacggcgtcaccgcccgggtgcgctccgacgtcgcgaaggggctgacggtttcgctccagtacggacacgcgcgcgtgcaggcccccgagacgaagggacttcgctacgacgcgcaggccgtgctggatgtccgcgcccagccgctctcgtcgctgaagttgcatgggcgattggtgtggaaggaccaggacctctccgagcgcagccggctccaacaggagctgcggaccgcgctggatgtcgcgtggagggtgtcgagcgccgtgtccgcccggggccggtacgcgtgggtgctcgacttgaaggacgcgcgcgtggcgcgtgtgcctcccgacccgccgcgccacctcttccacctggagttggagacgcgcttttga

SEQ ID NO: 8557 - DNA, 702 bp, Myxococcus xanthus
atggccaatccgcgtggcgacgacacgttgggtgagtgggtggagctgcgagccacggcccccgtggacctcaacggcgtgacgctggtcgccgaggcgggtgaggcgacgctgaaggcggggggttgcctgtcgctctcggcgggggagtacgcggtgctggcccgtcgcacggatgccaccctcaacggagggcttcccccgcccgtggcgacgttcaacatggacctgcgcaatgcgggtggtcggttgcaggtgaaggccgggggcgtggtggtcgacgcggtcgattacgctctggcggtggatggcgtggccacgcaggtgtccgcaccgctcgcggatgctgtccagaatgacgcgccctccgcatggtgcgcagccacggccgcctatggctcgcgcggcaacgtggggacgcccggtcgtgggaatcgtgtctgtgagggagacgggggcacgctgggcggcgttggcgacggtggaaccttcgatggcggcgtggatgccgggacgctcgaggacggatgtattgaccggaccactggaaggacgcgtgcgcgcaggggggcccgatgggggctcgcttgtcctcaccgaattcatggcggacccacaggcggtagcggacgccatgggggagtgggtggaggtgctcgcgctgcgcgacgtggacctcaatggtgtgtcgctgtccaatga

SEQ ID NO: 8558 - DNA, 471 bp, Myxococcus xanthus
atggcggacccacaggcggtagcggacgccatgggggagtgggtggaggtgctcgcgctgcgcgacgtggacctcaatggtgtgtcgctgtccaatgagagcggaggccgctcgactttcgattcggcgctgtgtctggccgtgaaggcaggaggccgcgcggtcctggcgcgcagtgaggatgcgtccctcaatggtgggctgcccgcggtgctcggcaccttcaacttcaacctggcgaatacaacgggcagccggaagctcgagctctcggtggacgggcgcgtgctcgacgccgtgtcgtggaccggcgcggccatcccaggtgtgtcctcacagctcgaccccgggcgcagtgatcctcaacgcaatgactggcccgggagcttctgtcccacccccgattcggcccgctatggccggggagaccggggcacgccgggaggggtgaaccgcgcatgcgcgctttga

SEQ ID NO: 8559 - DNA, 474 bp, Myxococcus xanthus
atgaaaggtgcgttggcctgtttgctggcggcctgtggtggaggtgacgcggaagtctcttgcggccccgcttcaggacgggtggcggaggtcctggatggggacacggtcgtcctggagagcggcgagcgtgttcgttacctgctcgcggatgcaccggagcgtacgggcacgggcggtgactgcttcggtccggaggcgcatgccttcaaccggggactcgtcgagggcaggcgggtagcgctgacctatggcgaggcgtgcgaggatcgcttcggccggctcctcgcctacgtgtccgtggaggggcgcgaggtgaacacgctgttggtggagagaggccatgcctgcgtgctccacgttcctcccgcgggccgttcgagacgcgcggagttccaggcactggaggcgcaggcccggctggcgaggcgcggtgtctggggggcctgcgcgcccgtctcctgtcagcggtga

SEQ ID NO: 8560 - DNA, 2268 bp, Myxococcus xanthus
atgagtccaagcgtcacgccgacgctctcgctgccggacgtcttggatgtcctacgggaggacatcacccggcgcctgatggcgggggtgggcgccgcgctcggagcgctcgcacccctggcgatcgcagaggcgggggccctccacaagctcgtggggcggctcggggcgctgctccgaatcccctccatggcggcgcggctggcggaggctcgcaccctgggccgtgactatggacgtgagcgctacctggcgggcttcggtatcagctcgctggtgctcgagtatggcgcgctgcgcgaggccatcctcgagagcctggaatccgtgggctgggtccccgagctcgcggggctgcgcgcgctggcccaggtgctcgacgcggggttggtggaggcggtgggccagtcctccctggaggacgagcgcaccgcgcgggcgacgggggcctggctgcacgggctgctcgaccacgcgccgacgctcatctacgccaaggacacggcgggccggtacctctacgtgaaccatggtttcgagagggcctccggcaagctccgccgcgatgtgatggggcgcaccgacttcgacttgttctccgcggaggtcgccagcaccttcaccggcaatgaccggcaggtgatggactccggccagcaactcaccgttgacgagcacgtgccgctcctcgacgggttgcacgtcttccagaccctcaagttccccctgccggacgcgcaggggcgcgtcgttggcgtgtgtggcttctccaccgacttcaccgaggcgaagcggctggagcgcgagcgggacgaggcccgcgagcacctgcgccgcatcgtcacccagttgcccgtcatcctctgggccacggacgcgcagggcatcatcaccctcttcgagggcgagcggctgagcgcgctggggctggaccgaggcgcctacgtgggacgctccgcgttcgacgtgtaccgcgaccggccggacctcgtggccgccacgctgcgcgcccaggagggccagtccttcaccctggaggtggagatggcgggctcctatttcatgacgggcgtctcccccgtcatcgggcccgacggcagcgtgatgagtgtggcgggcgtgtcgctggacatcagcgagcggcggcgcgccgaggaggtgctgcgccagtcggagatgcgctaccggctggccacgctggcgaccagcgacgtcatctacgactgggacctggacgctgggaccatcgagtggagtgagctggccgccgtccagttccggctggcctcgcgcgccccgccgcgggacatcgcgtggtggacggagcacatccatccggaggaccgcgagcggattgcccgggagatgcaggccgtcatcgaccagggcgcgagccattgggcggacgagtaccgcttcctgcgcggggatggcacctgggccgtggtcgccgaccgggggcaggtggtccgggacgccgagggccacgcggtgcgcatggtgggcgccatgcaggacatcaccgagcggcgggccacggagctagaggcgaagcggcgcgcggagttcgagcagcttctcatcggcatcgtcagccacgacctgcgcaaccccctcgccgccatcagcatgtccgccaccgcgctgctgcggcgggaaggcctggatgaacggctccgcaagggcctgggccgcatcctctccagcgcggagcgcgccacgcgcatgttgagggatttgctcgacttcacgcaggcccggttgggcggcggcattcccatggagccccggtggctggacctgcacgagctgacccggcaagtggtggaggaggtccggctcacccgcccggagcggacgctgaagctggagtgccggggagacggctacggactgtgggacgcggaccggctggctcaggtcatcaccaacctggtcaacaacgcgctcagctacagcccggagcactgcccggtgcgcatccgcacgcatgggctgcgcgacgacatgctgctgaccgtccacaacgcgggtgggcccattgagccggagctccgggcccgcatgttcgagccgatgaagcgcccggagcgcaagggcgcccgtggtggcggactggggctgggccttttcatcgtgaagcacatcgtggatgcccacggcggcgtggtccgcgtccactccacggagcaggagggaaccacgttccaggcccgcctgccccgccagcccatgccgcctgctcgcccggacgtcgacgctccgtga

SEQ ID NO: 8561 - DNA, 831 bp, Myxococcus xanthus
atgaagaaggtcctcatcggactgggcatcggctgcggtgtcttcatcctggcgggcatcggcttgatgctggcgggtggcatctgggccaagaacaagttcggcggcagcatcgaagccatgcagtcgatacaggcccaggagcaggagctgacacagctcaacgccagcaatccattcaaggcgcccccggaggggcaggtgctgccgttggacgagccacggctgctggcctacctgacggtgcgcgagtcggcgctgccggccttcaaggccttcgaggcgaagtccaaggagttcgaggcccagcacgcgggcgacggtgacgagaagccgggcttcaacgcggccgtggacgccgcgagcctgttcatggggctgatggcggacgtgcgcaaggcgtacatcgccggcctcaaggcgcaggggatgtcgcccgccgagttccagagcatcaccaccaccgtctacgcctccatggtggccgacagcctggagcagattggcgccgcggcggagcaggggcggaagatgatggtgacgcagctggccgaggtcgacaagcggctggcggacgactcgctcgccgacgaggagcgcgcgcagttggaggaggcccgggcgcagctccaggatacgctggacgcgattgaggagcccggcgcgaacgaggagcagccgctgtccgaggcatccaagaaggcggccgccgccaacgtggagctgctgaagaagcacaaggagcgcgtggagctgatggccaacgtggccttcgacggcttcgtgctgggtggtgccggcgccgacggtcaggccgcgggcctggagtag

SEQ ID NO: 8562 - DNA, 408 bp, Myxococcus xanthus
atgaacaaggtcatcttcgcctgtgtacgcaacgctggccgctcgctgatggcggaggcgttcttcaatgtgatggtagacccccagaaggcgcgcgccgtctccgcggggacgcagcccggcgacaaggttcatcccgaagtgctcgcggccatgcgggacattggcatcgacctgcacgacgtgaagccccgcctgctcacggacgacctgacccaggacgcgcaatggctcatcaccctgggatgtggcgaggcctgtccccaggtgccggggctccagcgcgaggactggccgctggaagaccccaaggacaagtcggacgtcctggtccaccgcatccgcgacgagctggccgcccgcgtggcgggactgctggagcgcgaagggtggatgcgcgccggctag

SEQ ID NO: 8563 - DNA, 1107 bp, Myxococcus xanthus
atggccgagacctcttcgctcaacatccccactgtcgacctcgccgacctcgcgtcggatgactccgctcgcgtcgagcgcgccgccgcggcgatccgcgaggcctttggcgtctttggcctcgtgtacctgaagaaccacggcgtcgacacccaggcgctgaaccggttctatgacgcgttcgcggcgttcatcgcccggcccgccgaggagaagaagccctacggccgcgcggacatctggtaccagcgcggctggacgcctccgaacaccgaggtcgcggtcgccagcaatggccagccggacttcaaggagtgctatttcgtcgcgccctaccccaacgacgcgcagtccgcgctcgagttcccggagctgtacccggagaacgtgtggccccagaacgcgccgccctacttcgaggacggcatcatgacgctggaccgctccctccatgaggccggcctgaagctgctccgtggctccgcggtggccctgggcctgccggagacgctgttcaccgacctgtgcgaccgggctgcccacgtcacccgcgcgctccagtacctgccgctcaccaacacgcaggtgaacacggacatcgtctggggcgaggagcacaccgacttcaatctgctcaccctgctcccgggcggccgcttcctggacccggacggcagccccgcgcccggccccgacaacaagagcggcctctacctccgcacccgcgcgacgcccgaggccccgaacggactcaaggtgcggggaaccgcgcccgcgggttgcatcgtggcgcaggtgggccagcagttggagatcctcacgggtggcaccttcctcgccacgccgcatgtcatcaccgccccgggcgtgccgggttggcagcgccagtccgccgcgcacttcatgcacgtgcacacgaacaccgtgctcttcccgctggagaagttccgcagcgcggatgccgtccggaactacgcgccgcccgtgctcgctgggacgtatgacatcaagacgctggtggacatcggccttgcgcccgcgagcgcgctcgacaagctgggttaccggcactacgaccggctgaaccgccagcgcgctggcacgtaa

SEQ ID NO: 8564 - DNA, 588 bp, Myxococcus xanthus
atgagtgacctgctgcggcgcatgttgttcctcccggaggcggcctcgtcgctggccacacgcgtggaccagctgcatttcttcatcatctgcaccaccttcgtggtgggcgccggcattggcctcaccggactcttcttcctggtgcgctaccggcgtggacgtgcgccctcggaggcgccggcgatggccgcgcccacctggatggaggccgcgttcgccggcgtgccgctgtccttcttcctgctctggggcgcgctgggcttccgggactacgtgtgggcccgcacgccgcctcgggacgccctggacgtctacgtcactggcaagcagtggatgtggaagttcgcctacccggacgggccggggatggtgggcgtgctgcacgttcccaccggcacgcccgtgcgcctgctgctcacgtcgcgcgacgtcatccactccttcttcgtccccgccttccgcttgaagatggatgcgttgcccgggcgctacacggagatctggttggaggtcctgaggccgggccgctaccaggtgctgtgcgcggagtactgcggcctggaccattcgcacatgcgcgccgag

SEQ ID NO: 8565 - DNA, 363 bp, Myxococcus xanthus
atgagcgagggcttcattccaccgccgccagagccccggatgctccccacgcggcacatcgcaggggtggggtgcgcgtggctgttcgtggtcgggatcgcgttgctcttgatccgatggagcgtgcgcgagtacgcgccctgggcgcccgcgggctttccaccgacgcttggcgtctccgaggtcgcggacgtcaaccagcggctcttcaaacgggaggacgccgcgccccggctgcgcgaggcacagcgggcgcggctgcgggggtacggttgggtggaccgggacgccggggtcatccacattccggtggagcaggccctggagcaggtcctctccacggaggagggggcgcggccatga

SEQ ID NO: 8566 - DNA, 489 bp, Myxococcus xanthus
atggtggacgtgggggagaagccgaagacgggccgcgtggccgtggccaccgcgctgctgcggatgttgcccgacacgcgcgagcgcatcctggcggggaaggtggagaagggggatgtgctggctgcggcgaggctcgccggcatcatggccgccaagcgcacgccggacttcgttccgctctgtcaccccatcgcgctctcgggcgtggaggtgacgctggcgccggaggacgcggggcttcgggtccgcgtgcaggtgaagacggtggaccgcaccggcgtggagatggaggccctcaccgcggcctgcgcggcggcgctgaccgtctatgacatgtgcaagagcgtggaccgcggcatggtgctggacgcggtgcagttggagcacaagtcgggcgggcgctccggcacatggcagcgcgaggaggccacgccggttgaggcggctgcgccgcggcgccggacgcgcgcgaagaaggcccgctga

SEQ ID NO: 8567 - DNA, 1884 bp, Myxococcus xanthus
atgagcggacgtctggcattggtggttttcgggctcgtgggcgtgcccgcatgtgtggacctggacccgatgcgggtgcaggcgcgtgacggggcgttcgtcgccaacccgtacttcgcggatgcgcggtcgatgcggcccctcgtgcccggcacggtggcgcgcgagtggtacttccaggaggccgcgtacatccgccggggctctccggacggaggctgggtggaggtggagcagctccccgtgccgatcacacccgacacgcttcgggaggggcgcgcccacttcgagacctggtgcgcgccgtgtcacggactgctgggagatgggcagagcatcgtcgcgcagaacatgggggcccggtcgcccccttcgctgtatggcgaggcgcactcgcatcccgagcatggagcggtgatgcccgcggatgcaggggagggcgctcgcccggtgtcccctggatgggatgcgctgccgcactcaccgggcttctactactcggtcatcaccggaggttacgggttgatgccttcctacgcggatgcgctcacgcccgaggcgcgctggaaggtcgtggcctggctgcgggtgctcgcgtacagccagcgcgcgccgttgtccgccgcgcccgacgacgcgcgcgagtcgctcatgcgggcacccgagggggggcacgccatgacggccacggtcctgacgcgcctgaacctggggcgacgcgtggtgtggggcgccgtcacggtgggaggcctggggctcctcgccaccctgctggggggcgtggccgcgccccgggaggccgcgtacggctatttgttcgccttcgcgttctggctgaccctcagtctgggggccctcatcatcctggcctcgtttcacgcttcccgcgccaggtggcccaccgtgctgcggcggccgctggaggtcatggccgcgagcagcccggtgttcgtgctgttgttcgtccccgtggtcctgacgatgccccacctgtttccgtgggtggcgattcccgccgacctcagcgcgcatgacgtgcacctgctggcccacaagaagccgtacctcaacgtgcctttcttcctgggccgggcggtcttctacttcgccgtctggagcgtggtggggctcctgctctaccggtggtcggtgcggcaggacgcggagccggccatcaccgagcgggccgtgcgcttcacgctgtaccagcggaagctgggagcgggctcgctgccgctgatggtgctgtgcctgtccttcgccagcctggactggctgatgtcgctggagccgctgtgggagtccaccgtgtacgccctaacgctcggctgtggggccgtggtgggcgcgctcgcgctggtggccgtcgtcgcggccacggcgcggggcgcgggacagttcggcgcgttgatgggaccggcgcacttcctccggctggggaccctgctgctcgccttcgtctgcctgtgggcgtacggcgccttctcgcagctcctgctgatatggattgcgtcgcttccggaggaggtgacgtggtaccgcgcgcgcctcgacggtggctggctcgcggtggcggtggtgctggccgtggggcacttcgtcgtgccgttcttcctgctgctgctccggcgcctgaagcaggacccaagggcactcgccgtcgtgggggcgtggctgctcctgatgcgggcgctggacgtctactggctggtgtttcccgcgcttcatcccgggacggcgtcgttccactggaccagcgtcaccgcgtgggccggcgttgggggctggacggtggccgcgtggtggctgctctcgcgcggcggctacacggtgccggtgagagacccgttcctgcctcattcgctgcgggtgccccggtcatga

SEQ ID NO: 8568 - DNA, 195 bp, Myxococcus xanthus
atgggcgtcatcgtggcgtgtggcctgccgcgggtgacccatccgttcctcggcctggaggcgtttcgaagcgccagcatcgatgggttctggctggcggtcgcggtcgacgacgcggagggcgcggacgcggcgcaaggcgcgctccggcggctcggcgccgaggtcgtgctcgcggtggagggacgttcatga

SEQ ID NO: 8569 - DNA, 1425 bp, Myxococcus xanthus
atgagcgagcctctgcccctggccccggtgacggcggacccactggtcgtccaccccttgctggaggagcgtcgtccggacgcgcagctcagcgaggcgttgctgcgcccggtgctcaccgcgccgggcaaggggtggtgggcgctcgtcggcgtatgcgccgcgctgacggggctgctggtggtggccatcaccatcacgttcgccacgggcgtggggacgtggggcaacaacatccccgtggcctgggcgttcggcatcatcaacttcgtctggtggattggcattggccacgcgggcacgctcatctccgccatcctcctgttgttcggcatgaagtggcgcagctccgtcaaccgcatcgcggaggcgatgacgctgttcgcgctcatctgcgcggcgctgttccccctgctgcatctggggcggccgtggaagttctactacctggtgccgtatcccagctcgttgcgcatgtggccgcagttccggtcgcccctgacgtgggacatcgtggctgtcaccacgtacctcaccgtgtcggtgctgttctggtacctgggcatggtgccggacttggccaccgcgcgggacaccgcgaagcagctctggcaccgccgcgtctggggcgtgctgtcgctggggtggcgggggagcgcccgccactggcgtcactggcgcatcgggtacctgatgctcgcggggttggcgacgccgctcgtcgtatcggtgcacaccatcgtctcgttggacttcaccgtggcgcagctgccgggctggcacagcaccatctttccaccgtacttagtggcgggcgccatcttatccggcctggccatggtgctatcgctgttgattcccgcccggcgcgcgctccacctgtacaccgtggtgacacaggcgcacctggacgcgctggcgcggctgctcctggtctccggcctcttcgtggcctacggctacgtgcaggagcacttcttcggctggtacagcggagacccctacgagatgcacgcgatgggcatgctgcgcaccggcccctacgcgcccgcgttctggaccgtcttcacctgcaacgtgctggtgccccagctcttctggtccgcccggatgcgcacccggccgttggtgctgtggttcgcggcgctgctcgtcaacgtgggcatgtggctggagcggttcgtcatcatcgtgtcttcgctcagcgaggacttcctgccttcgagctggcggcactatgcgcccacctgggtggacctgagcctgctgtcaggcaccgtggggctcttcggcctgggcttcctgctgttcctccgcttcctgccgccggtgcccatcagcgaggtgaaggagcttcagcaccaggtcgaggcctccgaggccttcgcccatgaagtgtcggcgcgggaaggaggggcgcgatga

SEQ ID NO: 8570 - DNA, 2148 bp, Myxococcus xanthus
atgcctccggcgctcaaccgcctgtgggtggtggagacccgcttgagcctcacgggggccttcgcggacgaacggctccgggcgcgcccgtcccgcgtgccgtgggtggcccaggcgctcgcggtggagctggggcggatgctgggacgcgaggaatggacggcgctcggacgtggagcgtcggcgctggaggactcggagcgccgctgggtggtgggagccgcgcgggacctgatggagcaggggcgccgggcgttcatcgtggtgggggagtcccaacccgccgcggtccatgcgctggcgcacctgctcaacgcgacgttgcacggggggaaggtgcggtgcgtggagtcgctcctggcgcccgcgccggatgcagcggccctgccagcgctcgtggcggacatccaggcgggcgcggtggacacgctgctcatcaccgcgtggaaccccgtctaccgcgcgcccacggaccttccgctcggggaggtcctgggcagggtggaggacgccgtgtactgcgcgcgccatgacgacgaaaccaccgcgcgggtgtcctggtccgtgccctccacgcatccattcgaggcatgggaggacgggcgcgcggtggatggcaccgccaccatcctgcagcccctcatcgcgccgttgctggagggcgccgtgccgccgttggaggtgctggcggccttcaccggtgaactggcgaccacgccttacgagcggctgcgcgcccagtggcgtgagcacgcgggcgctacgggacgcttcgaggatgcctgggagcgttggctcgcggagggcgtcatccccgggacgcagctccccgtgcaacaggttgccgtggacaccgcggcggtgctcgcggcggtgcgggcgctgccacccccgggggacggcctggagctgcacttcgccgtggacaccaaggtccatgacggccgctacggcgccaatccctggctccaggaactgccggatccggtgacgcagctcacctgggacaatgccgtgtgggtgagccccgccacggcttcgcgcttgtcgctggcgcgaggcaaccgcgtgcgcgtggagctgcgaggccgcgccgtggatgcgcccgtgctggtggtccccgggcaggccgatgacacgctgaccttgccgctggggtacggccagcgcatgggcagtccagtggcgcgcggcgtgggcttcgacgcacaggcgctgcgcttccaggactcgccctggtgggctgccgggggacagctcacgcgcgtgcagggccaccacgacttcgcgctgacgcaggagcactggcatatggagggccggcccgtggcgctccagacgaccgccgcccggttcgcggcacagggcgatgcgcgactccccgacctccaggctccgaaggaacacctgtatccaccgcggcccgcgccggaagaggctggccaccgctggggcatggccatcgacctgcaccgttgcacgggctgtagcgcctgcgtcgtggcgtgccaggcggagaacaacatccccgcggtgggcaaggaccaggtggggcgcggtcgggagatgcactggctgcgcatcgaccgttacttcatgggggacgcggacaacccgtccgtcatcacccagccgctgatgtgcgtgcactgtgagtacgcaccttgcgagtacgtgtgccccgtggccgccaccgtccactcggacgaggggctcaaccagatggtctacaaccgctgtgtcggcacgcggtactgctccaacaactgtccctacaaggtccggcgcttcaactacctggagtacaaccgcggcggcctgctggaccggatgtaccgcaacccccaggtgacggtgcgctcgcgcggggtgatggagaagtgcacgtactgcgtgcagcgcatcgaatccgcccgcatcactgcgcgcgtggagcagcgcgccatccggcagggggaggtgcgcaccgcctgtcagcaggcctgtcccacggaggccatcgtcttcggtgacctgagccagccggaggaccccgtcacgcggctgcatcaggacccgcgccactatgccctgttgaacaacctggggacgcggccgcgcaccgtccacctgatccgcctcaagaatccgagcgaggtctccggatga

SEQ ID NO: 8571 - DNA, 411 bp, Myxococcus xanthus
atgccaccgctgaccgaggaatatccgctccccgtcctgacggagcccgagccctggcgcagcctggaggagcgccagggcatcgcgcccgcgcccgaaccgggcgagtttccccaggaggccgatgcgcccccccaggggctgtcccggcgcgtgttgctggagttggccgcgtttggcggcgccgccgcggggttggcgggctgcttccgctcgccgccggagaaggtgctgccgtattcccggccgcagccggagatcaccccgggcattccccttcactacgccacgggcatcgcgctgggcgggttcgtgcgcggtgtgctggtgcgcagccaggagggacggcccacgctggtgcagggcaatccctcccatccgaagagcctgggcgcggcgggcgcgcagtag

SEQ ID NO: 8572 - DNA, 594 bp, Myxococcus xanthus
atggtcgtgctgccggtggcaacgtccatggcgttgctgctgctggcccgcaatccgctggggaccggcgccttcgagcccgtgcagcagccggtgcagttcgaccaccgccaccacgcgggggacgagggcatcggctgccgctactgccatgacggggcctggcgggggccttctgcgggcattccgcccaccagccggtgcatgggctgccacgcgcagatttggaacgagagcgcgctcctggcgcccgtgcgccagagctacttcgaggaccggcccatcccgtggaaccgcgtccaccggctgccgcagtacgtcttcttcaatcatgccatccacgtccacaagggcgtggggtgcgtgagctgtcacggccgcgtggaccagatgccgctggtggagcaggtggctccgctcaccatggggtggtgcctggagtgtcaccgcgacccggcgccccacctgcggcctcctgaacacgtcgcggacatgacgtggagcccggccggcccggcccgggaggtagggctcgtggtgatgcggaccctggatgtatcgccccggaccgagtgctccacatgccaccgctga

SEQ ID NO: 8573 - DNA, 1274 bp, Myxococcus xanthus
aagctcgtctccgcctggttccgcattcccttctggcaacgtgtcctgggggcgttcgtgctcggggccgtggccgggtggctcgtgggagagccagcggggccctggttccagccgctgggtacgctctacgtcaacctcatcaagatgatcgccacaccgctggtgttcttcgcggtcatcaacgcggtggcggcgcttcacgggcagaagagcatggcggtgctcggcggcaagacgttcctctggttcggcgtcaccgccgcgctggcggtgggggtgggcctgggcgtcgccgcgctgctgcgccccggggagggagtgggccagctcatggccaccgaaacctacaagccacgggacgtgcccggccccatccaggtgctgctggatgtggtgcccaccaacccgttcgcggcgctcgcgaatgggaagatcctccaggtcatcttcttcgccggcctgctgggcttcgcgctggtgaagctcggcgagaagacggcccggctgcgcgagctggtccgcgaggccagcgacgcgatgattcaggtcacccgcttcgtgctggagctcacgccgctgggcaccttcggcctcatcgccgcactggtgggcacctacggcttcgagcgcctgttgccgctgggcaagctggtgctggcgctgtacgtggcgtgcgcgctgcacatcgtcttcgtgtacggcggcctcctgatgacacacgggctcaatccgctgcgcttcttccggggcgccgcgcccggcatgcaggtggccttcgtcagctcgtcgagcttcgcgtccatgccggtggccctgcgcgccgtgacgaacaacctgggcgtcaacaaggactacgcggccttcgcggtgccgctgggggccagcatcaagatggatgggtgtggtgccatctacccggccatcgcgtcgctcttcgtcgcgcagtacttcagcctggagctgtccgcgtcgcagtacttcatcatcctgctggcttcggtgctgggcagcttcggtaccgcgggcgtgcccgggacggtggtggtcatgggcacggcggtgctcagctccacgggcttgccgctggaggggctgggctacctgctcgccatcgaccgcatcctagacatgatgcgcacgatgaccacgtcacgggccagatgctggtcccggtgctggtggcgcgcgaagagggcctgctggatgccgccgtctacaacggcgcatcccccgctgtcgcgttggaggagaacgcggtgaaggtggactga

SEQ ID NO: 8574 - DNA, 390 bp, Myxococcus xanthus
actggcgcagggggggagacgctggtgttcgtctccgccggccaggtgggctccatgctggcgcgggcggcggccgtgcccgcctggcttcccgtgcccggcgagctcgcggagacgcgcaccgtgaacttcaatctggagggcgcctcgcaccacgtggtgacgggccagctccaggcggactcgccggatgcggcggcacggcgctacggtgccctcttccgtgagcgcggctggcaggtgggaacgctcgcaccggtggcgccgaacggcatcgccttcgaagtgctcaaggagtccgtgagcggccgcgcggtgctgcgcgacctctcgccgggcccgggagtcgaggtccagctcacgctgctacgccggagcgttgccccatga

SEQ ID NO: 8575 - DNA, 135 bp, Myxococcus xanthus
atggtggagtacgccatcgtcaccgcggccctgctgggcttcagcacgatggggtggcccttcctggtgcagttgctcaacgcgctgcaccgctacttcaactccatctactacgtcatccaggcccccatctga

SEQ ID NO: 8576 - DNA, 1185 bp, Myxococcus xanthus
atgagctcgaagcagaagacggtggcggtgcacgccgggacgcggctggctggaagcaaggcagtgccggtgtcgccgcccatctacccggcggcggtgaactggttcgacagcagcgatgacctggacagcgccctggacgggaaggactacgcctacgcccgaatcagcgcgcccaacaccacgttgctggaggaggcggtggccgcgctggaaggcgccgaggactgtgtggcctatgccagcggcatggccgcgctgcgctccgtcttcgaggcccagggcttccgggccggtgacaagctggtgatgccggcggatggctacggcgtcacgcgcgcgctgtacaagagtctgtgcgccacgctgggcgtggagctgcatgcgttcctgatgacggaccccgaggtgcccgagcgcatccgagcgctgaagccgcgcatggtgctggcggagagtatctccaatccgctgctgcgcgtgcccgacctgcgcgtgctggcgcgggcctgccaggacgtgggcgcgacgttcgtggtggatggcaccttcccgtcgcccgtgggacagcgcgcgttggcgctgggcgcggactacgcggtgcagtccaccagcaagtggctcaacgggcacagcgacgcgctgggcggcacggtgagcgcctcgcgtgagcggatggcgccactgcgcgccgcgcgggtgctggcgggggacgtgctggggcccttcgaggcgtggctcaccctgcgcggcctgcgcacgctgccggtgcgcatgaaggcgcatgtcgagcacgcggcgcatgtggcgcggcgcctcatggagtcgcccctgttggagcgggtcatctacccggggctgacttcgcacccggaccacgccaccgcgcaggagctactgctgggcggcggccccatggtggcctttgaaatcaagggcgcggggcggccggagagcatgcgcttcctggaggcgttgaaggtggggcggcccggtccttcactgggggatgtgtgcacgttggtgatgcacgcggccagcgccagcgcgcgccggttcacaccggaggagcgggaggccgcgggcatccgggagaatctcatccgcgtctccgtggggttggaggacccagacgacatcgtggatgacctgctcgccgcggtggcccagggggtgcgccgatga

SEQ ID NO: 8577 - DNA, 519 bp, Myxococcus xanthus
atgctccggatgagcaagatgaccgactacggcatcgtgctgatgaccgagctggctcgcgcggagggtgacacgcgcaccacccgtgagctggcggcgcgcacgcgcgtgccacttccctcggccagcaaggtgctcaagagcctgctccaggcggcgctcgtggtgtcgcaccgtggcgccaacggcggctacggactggcacgcccggcccatgagcttccgctggccgaactggtcaccgcgctcgaagggccggtcgccctcacggagtgtggcgtccacacctccgggggtgcgccctgtgagctggagtccgtctgccaggtgcggggccactggcgcctcatcaacgacgccattcaggaggccctggggcggctgacgctggcggacctcatcgcccccgcgccccgcgtgccagagcgcctcgtgggcctggggacaccctctcgcccggcgccttccccggccgctggccacccccctcccgcttccgcgacaggagtccgctcatga

SEQ ID NO: 8578 - DNA, 1437 bp, Myxococcus xanthus
atgagcaccgaaaccctccaggaactgacgcgccgcccgtatgcggcgggcttcgtcacccagttggaatcggacacgtttccccccgggctggacgaggacgtcatccgccagatctccgcgaagaagggtgagccggagttcctcctcgactggcgcctcaaggccttccgccactggaagacgatgaaggagcccacgtggcaggccgtcacctacgcgcccatcgactatcaggccatccgctactactcggcgccgaagcagaagccggtgaaggccagcctggacgaggtggacccggagattctgcgcacctacgagaagctcggtatcccgctgcatgagcagaagctgctgcagaacgtggcggtggacgccgtcttcgactcggtgtcggtggccaccacgttcaaggacaagctggccaaggcgggcgtcatcttctgctcgttctccgaggccgtgcgcgagcacccggagctggtgaagaagtacctgggcaccgtcgtgccgtactcggacaactacttcgccgcgctcaactcggcggtcttcagcgacggctcgttcgtctacatccccaagggcgtgcgctgccccatggagctgtccacgtacttccgcatcaacgcggcggacacgggccagttcgagcgcacgctcatcgtcgcggaggagggctcccacgtgagctacctggagggctgcacggcccccatgcgcgacaccaaccagctccacgccgcggtggtggagctggtggccttggacaacgccaccatcaagtactccacggtgcagaactggtacccgggcgacgcggaggggcgcggcggcatctacaacttcgtcaccaagcgtggcatcgcgcaccgggcggcgaagatttcgtggacgcaggtggagacgggctcggcgattacatggaagtacccgagcgtcatcctcaagggggatgactcggtgggcgagttctactcggtggcgctcaccaaccacatgcagcaggcggacacgggcacgaagatggtgcacatcgggaagaactcccgcagcaccatcgtgtccaagggcatctccgccggccgcgggcagaacacgtaccgggggctggtgaaggtgctcaagagcgcggagaacgcgcgcaactacacgcagtgcgattcgctgctgctcggtgacaagtgtggcgcccacacggtgccgtacatcgaggtgaagaacgcgtcggcgcaggtggagcatgaagcgtccacgtcgaagattggcgaggaccagctcttctactgccggcagcggggcatctcgcaggaggacgcggtgtcgatgatcgtcaacggcttctgccgccaggtgttcaaggagctccccatggagttcgcggtggaagcgcagaagctgctcggagtgagcctggaagggagcgtggggtag

SEQ ID NO: 8579 - DNA, 789 bp, Myxococcus xanthus
atggcgcttttgactgttcgcaacctgcacgcccgcgtggcgggcaaggacatcctcaagggcatcgacctggaggtcgcgcccggcgaggtccacgccatcatgggccccaacggctccgggaagagcacgctggccagcgtgctggcgggccgtgacggctacgaggtgacgcagggcgaggtgctgttcgacggcaagccgctgctggagctgtcgcccgaggcccgcgccgccgcgggcgtgttcctcgccttccagtacccggtggagattccgggcgtgggcaacatccacttcctgcgcaccgcgctcaacgcgcagcgccgcgcgaaggggctggaggagctggacgccatggacttcctccaactggccaaggagaagtcgaagctggtgcagctcgacgcggccttcatgaaccgttcggtgaacgagggcttctccggcggcgagaagaagcgcaacgagattttccagatggcggtgctggagccgcggctggccatcctcgacgagacggactccggcctggacatcgacgcgctgcgcacggtggcgggtggcgtcaacgcgctgcgctcgcccgagcgcggcatggtgctgattacgcactatcagcggctgctcgactacatcgtcccggacaaggtgcacgtcatcgcggcgggccgcatcgtccgctccggtgggcgcgagctggcgctggagctggaggagaagggctacggctggctggggttggacggtggaaaggccaaggcgccggtggcggaggcgcggcgatga

SEQ ID NO: 8580 - DNA, 1341 bp, Myxococcus xanthus
atgacgacggccctggcgcactacctggatgtggccacgcgcttccaggcggcgcccgaacaggcgtccgcgccgcagtggctcaagcgcctgcgcgcagatgccctggcccacttcgagcggcagggcctgcccacgacgcgtgacgaggcgtggaagtactcccggctgggggccatcgcggaaggaacgttcattccacggacggatgtgtcccgggacaccgcccacctgtcggcggtggtggagcggctgggcttgccggggccccggttggtgttcgtggatgggcggctggcgccggagctgtcgtccgtggcgggcctgccgcgcggactgacgctgaagccgctgcgggacgcggtgcgtgaggacggcgagctgctggagtccgtgctggggcagcgggccctggcgaacgagcacgccttcaccgcgctcaacgcggcgctgctggaagagggcgtgctgttgcggctggcaccgggcgcgctgagcgaggtgcccgtgcaggtggtgttcctcacgcgcggcgacgcgccggtgctgtccagcccgcgcatcctcgtggtggcgggggagagcagcgaagcgacgctggtggagacgtatgccagcgcgggccccgcgggctcggcggcgacattcaccaacgcggtgacggaggtgacgctgggcgacaacgccagcctccaccactacaagctccaggtggaggcggacgcggcgctgcacgtgggcgcgctccatgcacggcaggggcgggacagccgcttcgcctcgcatgccttcgccttcggtggggccatggcgcgcaacgaggtccacgcggccttcgcgggcgagggtggcgacgcgacattgaatggcctgtacgtggggcagggcgcgcagcacctggacaaccgcacggcgctggaccacgcggtgccccggtgcaccagccgcgaactgtacaagggcgtgctggatggtcactcacgcggcaccttccacgggctcatccgcgtgcggcaggacgcgcagcgcacggactcgcggcagcagaaccgcaacctgctgctgtcggagtcggcgcaggcggatgcacggcctcagttggaaatcttcgcggacgacgtgaagtgcgcgcacggcgcggcggtggggcggctggacgcgcaggcgctgttctacctgcgctcgcgcggcgtgccccaggcagaggcggagcggctgctcacctacgccttcgctcgcgaggtggtggaggcggtgcccgccggccctgtgcgcgcgaacatcgaagcgctcctggccttgaagctgccaggcgcggcgcagcgcgaggtgacggcatga

SEQ ID NO: 8581 - DNA, 1224 bp, Myxococcus xanthus
atgagcggcttcgacgtgaatcaggtccgtaaggacttccccatcctcgaccaggaggtgcggggccggccgctggtgtacctggacagcgccgccacggcgcagaagccgcaggccgtcatcgacgcgctggtgcgcttctatcagcacgacaacgccaacgtgcaccgcggcgtccacgtgttgtccgagcgcgccacggaggcctacgagggcgcgcgtgagacggtgcgccgcttcatcaacgcccgggacgtgaaggaagtcgtcttcgtgcgtggcaccaccgaggccatcaacctggtggcgcagacgtacgggcgcaagcacattggcgccggggacgaggtgctcatcacccagatggagcaccacgccaacatcgtcccctggcggatgctgtgcgagcagacgggcgccgtgctcaaggtcatccccgtggatgaccggggcgagctggtgctggacgccgtggacgcgctgctgacggagcgcacccgcatcctcgcggtgacgcacgtgtccaacgcgctgggcaccgtggcgccggtgaaggagctcacgcggcgggcccacgcgaagggcatccccgtgctggtggacggcgcacaggcggtgacgcacttccccgtggacgtgcaggacctgggctgcgacttctacgccttcagcgggcacaagatgttcggccccaccggcatcggcgtgctgtacgggcgcaaggagcgtctggatgcgatgccgccctaccagggcggcggcgacatgatcctctccgtgacgatggagaaggtgacgtacaaccgggtgccgtaccgcttcgaggcgggcacccccaacctggagggcgcggtggggttggcggcggccatccgctatctggaggcgctggggatggagaacgtcgccgcgcacgaccgggagctgctggcctacgccacgcaggcgctggagtcggtgccggggctgcgcatggtgggcacggcgcgcgagaagtccggcgtgttgtccttcatgctggcggatatccacccgcacgacgtgggcaccatcctggaccgcgagggcatctgcatccgcaccggccaccactgcgcgcagccggtgatgcagcacttcaaggtgccggccacgtcccgggcgtcgctggcgctctacaacacgcgcgaggatgtggacgcgctcgtccgtggcctgcacaaggtcctggaggtgttccagtga

SEQ ID NO: 8582 - DNA, 231 bp, Myxococcus xanthus
atgacgggggcggtgaaggaccggacgcgcgcggaggcggaggacctcttcgagcgcgtccacaagctggtgacggaaggtccggagtcggtggacgtggacgcgctgggcaagctggcggtgctgtccggcgtcagtgagtttcccgcgcgggtgaagtgcgccagcctggcctggcacacgctgcgcgcggcattggagggacgcggcgaggccgtgtccacggagtag

SEQ ID NO: 8583 - DNA, 531 bp, Myxococcus xanthus
atggcggtgctggagcgcgacgtgtccgcgacaatcatccccagcggggaccgggtggtgctgcccgaaggcgccgagctgcgggtgacgcagacgctcggcggcaacatcacggtgcaggacccctacggtcagctcttccgcatcgacgagaaggacggcggcgcgctgggcgaggagtacgcccccaaggagaaggccgccggcgacctcagcgagttcaacgaggagcaggtctgggagcaactgcgcacggtgtacgacccggagattccggtgaacatcgtcgagttgggcctggtgtacgcgtgcaaggcggagccgctgccggaaggcgggcagcgggtggacatccagatgacgctcaccgcgcccggctgcggcatggggccggtgctggtggaggacgtgcgcaccaaggtgggctcggtgcctggggtggcggagacgcgcgtggagctcgtctgggatccaccctgggggcaggagcggatgtcggacgtggcgcggctccagcttggttggatgtag

SEQ ID NO: 8584 - DNA, 1170 bp, Myxococcus xanthus
atgctgctcgcgaccctggccctggccgtggtggcctgcgagaagaagaacgcgcccgccgcgccctcgccggaggggcaggcgaccggggtaccggccgctccggtggactcgaacacgattctgctgggagaggtcggcagcctcacggggagcgaggcgaccttcggggtgtccgcgcgcaacggcatcgagctggcgctgaacgaggccaacgaggcgggcggcgtgaagggcaagaagctccaggtgcgcgtctacgacagccagggccggccagaggaaggcgcccaggccgtgacgcggctcatcacccaggacaaggtggtggcgattctcggcgaggcggcctcgtcggtgtccatggccatggcggagaaggcgcaggcgggcaaggtgcccatggtgacgcccacgtccaccgcgccggaagtgacgcagaagggcgactacatcttccgcgtctgcttcatcgaccccttccaggggctcgccatggcgaagttcgcgcgggagaacctgcagctgtcccgcgtcgcggtcctgcgcgacaacaagagcgcgttctccatgggcctggcggacgtgttcaccgccaggttcaaggagttcggcggcgaggtgccgggcgacgagagctactccaagggcgacacggacttccgcgcgcaactgacgtccctcaagcggctgaagccggacgccgtcttcgtccctggctactacacggacgtgggcatcatcgcgcggcaggcgcgtgaaatcgggctcaaggtgccgctgctcggcggcgacggctgggactccgacaagctgtacgagctgggcggctccgcgctggagggcagctacttcgcgaaccactactcgccggacaacccggacccggtgctccagaggttcctggcccgctacaaggccacctacggcggcgtgccggacagcgtggccgcgctggcgtacgacgcggcgcgggtgaccatcgacgccatgaagcgcgcgccggacctgagcggcccttcgctgcgcgacgcgattgccgcgacgaaggagttcccgggcgtgacgggcaaaatcaccctggacgccaaccgcgacgcggtgaaggaggccgtggtgctcaaggtctccggcggcaaggcggagttcgtcaccacggtgacgccgtaa

SEQ ID NO: 8585 - DNA, 672 bp, Myxococcus xanthus
atgaagaagctgaaagggttgcgagtggccgtgctcgcggcggatggcttcgaacaggtggaactgacagcaccggtgaagaaactggagcgtcagggcgccgacgtgacgattgtgtccccccacaagggccgcatccgcgggatgaaccttctcattccagggaaaagggtgagcgtggacgcgtccctgcgtgaggtgaaggcggcggacttcgacgcggtcctcctcccaggaggtttcgtgaacccggacctcctccggcaaagcgcgctcgcgctcgacttcgtccgcgacgccgacgcgctggacatgcccatcgccgtcatctgccatggcccctgggtgctgatttcggcgggactcgtggagggacgggcgctggccgcgtggccgggcatccgcgacgacgtgcgcaacgcgggtggccgctgggtggacgagccggtgatgcgcgatggcaactgggtctccagcccgggaccgcgacagatgttcgcgttcatcaagggcatggtggagctcttcgcggagaagatgccggaggtctctgctcgtgcgccgatggtgcccgtgcgccaggcagcgccttcccggtggccgaagctgctcgcgggaacgctggccaccgcggcgctcggattgggcgcgcggcggctggccctgcgctga

SEQ ID NO: 8586 - DNA, 1074 bp, Myxococcus xanthus
ctctcaaggatgccggtgttgctgggcggcttcctggtggtgctgttcatgccggtgcaggactccctgtgccagaagctggggggccgcaagtctctcagcgccggggtgtccaccgtcaccgtgttcgtcctcatcctggcgccgctggcgctggtcgggtggatggtggcgcgcgaggtgttccagttcgtgggccaggcgcaggtcttgctggagcagcagcacctgcgtcacccgttcctcgccagcctgccgctgggcttggagcgctatctccggctgggcgtggacagcgcggagacggagcgggcgctcctggccgcgatgacgggcggcgcgtcgttgctgcgcgacgtggcggcggcgggcacggacctggtcatcaacctgttcctgatgtccgtggccatgtactacttcttcctcgacgggcgccggctggtggccgaggtcatgcggctcatcccgctggacaggcgctatttcgaggccttcgcgcgcgagttcaccgacgtcgcctacgccatcatctatggcaacaccgtcaccgcgctcatccagggcgccgtgggcttcgtcgggctgctcatcgcgggggtgccgcatgccggcgtgtggggcgcggccatggtgctggtggcgctggtgcccgtgggcggaacggccctggtgtgggggcccattggcgtggtgctcatcgccgccaaccaggtgagcgagggcgtgttcctcctggcctggggcgccttcctggtgggcagcatcgacaacgtcatccggccccggctgtgtggttcgcgcatggcgctgcacccgctgctcgtcttcctgtccatgttcggcgggctggccgtgttcgggatgatgggcctgctggtggggccgctcatcgcctccatcttcatggccatggtccgcatctaccgccgggacttcctgggcatcggccgcgccgagcacctgtcggcccatgatgagaacacgtcggcgcctcccatgtccgagcccgcctcctcccgcatgtctcccgcggcgccggcgatgggacctgccgcgacgctcaacgcctga

SEQ ID NO: 8587 - DNA, 1701 bp, Myxococcus xanthus
atggtctgggtcgggttcaaggacccgtccttcgccgtgccgcgcgtcatcgagaacctcttccctcacaaggagagcatcctcggcgtggggcgcgaccggctgcgctacctcatcacccagcgcgagtgccgcaagttcggaaggggcctgcagccctacgccctctacaagcacgtctccggcatcaacgccgtgcggctgcgtcgcctgctgggcgccatcaccggcgaggactaccccgccaacccgaagcccgcgtatgcgcagttgcgctcggccacgctcaccggttcgctcagcgtgccggagctggagctgcacgcggacatcggcggctacgccaaggtgaagcagcggctccagcaggagattctggacgtcctggcgcacaaggacacgctgagcgacccggaggcggtgaagcgcgtggaggcgctgttgccgcgcgggatgattttctggggccctcccggcactggcaagacgctgttcgccaaggccatggcctcgtcgctgggcgcggccgtccaggtggtgagtgggcccgagctcaagagccgctgggtaggcgagagcgaggagaacctccggcagatcttcgtccgcgcgcggcaggcggcgcccagcatcatcgtcttcgacgaattggactccttcgcgtcggcgcgtggcacgtacacgggctcgggcgtggagcactccatggtgaaccagctcctcacggagatggacggcttccgcaaggaggagctggtcttcgtggtgggcaccaccaacttcgtggagtccctggaccccgcgctgctgcgcccgggccgcttcgagttccagctctgcatcccctaccccaacagcgcggaccggcgcgccatcctgtccatctacaaccagaagctgggcctggagatgacggagcgcgcgctggactacgcggtgaagcgcacgggtgaccgcgtggaaggcactggcacgcgcttctctggcgaccacatccaggccctgtgccgggcactcgcacgtcggcggttgcgcgaaggcgcccagggccccaccgaggcggtggacgtggagcgcgccctcacggagttcctggaccggccggagctcacgcccatggaggagcgcgtcgtggccacacacgaggcggggcacgcggtatgcgcgctcttctgtgagcacgcgcccgccatcgaccgcatcagcatccggggtgacctggcgggctcgctggggcacgtgcagtacgcggacccggcgcaccggtacgtcgtcacgcgaggccagttgctggacagcatctgcatgctcttcggcggccgggaggcggaggcgctgctcctggatgacctctccctgggcagcgcacatgacctggagcgcgccacggagattgcgcgcgagttggtggaggacctgggcatgggcggagacggcgtgcccgtgcggcgctttgatgcaccgggacggcaggcggaccggcatgccctgtccgacgcgacgcgaagcacgctggaggccgcgattcaggaagtcctggccgtccaacgggcccgggcccgcgatatcctccagcgcgagaaggagcgggtcgtggccctgagagatttgctcatcgaacgcaaggtgttggaccgcgaggccttcacccatctggtgcccgcgcccgtggcgccgaagaaggagcccgcgcttggctag

SEQ ID NO: 8588 - DNA, 948 bp, Myxococcus xanthus
atcaacaaggtgaccatcatcggctcggggcccgcgggctacaccgcggccatctacgccgcgcgcgccaacctgcagccggtggtgttcgccgggggccccaccctggagcacccgcagcgggtgccgggcggccagctcatggtgaccaccgacgtggagaactacccgggctttccggaggccatcaccggcccggagctgatggatcgcttccagaagcaggcagagcgtttcggcaccaccatccacatggagaacgtggtgaaggtggacttctcccagcgccccttcctcatacagggggagagcgtcagctgccgctcggagacggtcatcatctccaccggcgctaccgccaagtggctgggcgtcaagggcgaggacacctacaagaaccgcggcgtctccgcgtgcgccacctgcgacggtgccttcttcaagaagcaggacgtgctggtggtgggcgtcggtgacacggcgatggaggaggcgacgtacctggcgaaaatcgtcaaccacgtcaccctcatccaccgccgcgacacgctgcgcgcctccaaggtgatgcaggagcgcgcccgccagaatccgaaaatctccttcatgtgggactccgcggtggaggaggtcctcggcgacgcgaaggggatgaatggcgcggtggtgcgcaacctgaagacgggtgacagccagcaggtgaaggcgaccggcctgttcgtggccattggccacacgcccaacacggagctgttccagggcgtgctggagacgcaccagggcggctacctcaagacggtgccgggctccacgcgcaccaacatcgagggcgtgttcgcctgcggtgacgtgcaggaccactactaccgccaggccatcaccgcggcgggcacgggctgcatggccgccatcgacgcggagcgctggctcatcgagcacggcgagtag

SEQ ID NO: 8589 - DNA, 1035 bp, Myxococcus xanthus
atggttcgctgggggctgtggtgtgccctggtggtggcgctggcctcgccgcaggccctggctgccgcggcgaagcggaaggactcgggaccggcgaagccgagcgtcgtggtgctggaggtggagggagatgcgcggcagcggcaggcccctttcctggaggtggcgctggatacgggctctggcggcacggtgggagacgcgccggcgcgcccgcccctggcgcggctgacgttggggggcacgacgacgtggcgcaacttctgcgcgcggcccggcgtgaagtcctgtggcgaatatgaccggctcccggcgaacgagcgcctgggggacacggtgagctatgcgtcgtcggtgccgtacctgggcatcgccgccgaactggagctgctgccgctggcgaacagcgaatccctgctgcgcggcctgggcctgtcgctggggtatcggcgtgggtattcctccaccaacgtgacgctggtgagtgacgccggccggtcgaccacgcgcgaggcggtggccaccgactcggtgctcaccgcgcaggcgctgtaccgctacttcttcggcatgggggaggcgaacgcgtcgctgggccatgcggggctgcgcgcggggcttctcacccgcgccttcgacgtggacgcgtcctccaacagcccgctcaccgggacgcaccgcttgttccccgccgtggggttggaggtgtcggtgccgctggtgcgctgggtccggctggagggcgcgggtcagttcttcctgagcccgaagccgggcaagggcctgggcgccggcagcgcggcgttggacgccgaggtcagcgactacggcacgtcggtgtccagcttcggctgggaggcggagctgggcgtcgggggcgacatctgggggcccttcggttactcggtccgctttcgcctgtcccgcttccaggacacgttctccggcgccggcacgaagctgggctgggatgagggcggcgtggcggcggagacgtactccagtctgcactggggcatcaccgcgtcctactga

SEQ ID NO: 8590 - DNA, 513 bp, Myxococcus xanthus
atgtctgagcacgtgtccccccaggagctgcgtaggaagtggaagctggcgaacgcggagccgctggagggcggtcaccggctcgaggcgtaccgcgcgctggcgcagagctgtcccgcgttcgttcccaatctcctgtcgttgagccgcacgttgctggccggccggaacgaagcggcggacccggaggccgcggtgtctgaggccgagcaggtgctccgctccgcgtcggacgtctccgcgggggccccggagcccctgctggcgctgggacatttcctcgtctcagtgcgacaggcgcccgatgaggcggagcgcgccttctcctccgcggccagcgccgcgatggccttgctggaggaagcgtgggcgggctggattcacgcgctgggcgcgcagggacaactggaggcggcgctggaggtggaggaacgggcgcggagcctctttcccagctccaaggcgatttctcaggcggtggcgttcgcgcgagcgcagtcgggtacgcgctga

SEQ ID NO: 8591 - DNA, 765 bp, Myxococcus xanthus
atgggggcggggttggtggcaagcctgctggcgggcacggcgacgggactgggcgcgctgcccgtgctcgtcacctcggagctcagccggaaggcccaggaccggatgttgggcttcagcgcgggcgtgatgctggcggccacgtccttctcgctggtcatccccgcgatggaattggtgagagggcagggccatgacgggccttcggcggcactgcgcgtggcggcgggtgtgttgctgggtgggctgttcctgcgcgtgtggcacgacttgatgccgcacgaacacgcgctcaagggccacgagggccatggcggcacgaagtggaacagcgcgctgctgttcgtgctggccatgacgctgcacaacttcccggaaggcctggcggtgggcgtgtccttcgccgcgccgcagccggagctgggcctgtcggtggcgctgggaatcggcgcgcagaacattcccgaaggcctggtggtggcgctggcgctgcgggcctcgggggcgtccgcgtcgcgcgccgcgttcctggcgctgctcaccggcatggtggaaccggtcggcgcgctgttcggcgtcctggccctgtcactcagctccgcgctgctgccgtggggactggccttcgcgggcggggcgatgctctatgtcatcagccacgagatgattccggagagccaccgcggcggcttcgagcgcgaggccaccaccggcctcatgtggggcttcgtgctcgcgttggtgctggacatgtcgctgggctga

SEQ ID NO: 8592 - DNA, 336 bp, Myxococcus xanthus
atgatccaggacccctcactcatcatctgccatgacgtggacggcgcaccggtgcgcattggcgcgaaggtgaaggtcgttccgcactccgaggacggcaccatcagccagcgcttcctgggccagacgggaatcgtcgtggggctggtgttcgacgacccggccacgcagtaccccgatgacccgctcatccaggtgctcgtcgaagggctgggcgaagacctcttcttcccggaggagctggagctggccccggagtgggcccgcaaccggattgcccagcaccgtcaggccgtgcggaccggcggccggagttcgctggagcgcctgccctga

SEQ ID NO: 8593 - DNA, 654 bp, Myxococcus xanthus
atggacctggactcgttgctcacccagacgcccgcgaaggacaacgccgcgctggagcgcgtgctcgccgcggcccggggtgaactggcgcttcgtcgtccggtgcggcgctggcgcacgcaggccgtcgggttgatggcggcgtcggcgggactgggcctgctggcggccgtggtgctgctcgcggtgggcgcggtcaccggccccctgctcctggcgcgcgcgcccctgctggcgatgctggtgggaaccagcgcggtgtgcgcctggggcgcgctgtctcccaagggccgctggatgcgccggctgggcgtggggctggcggtggtcagcgcggcggccctggtgctcgcccggggcgcgccgcacagtcccccatcgttcccgggctgggtctgcaccgtcagtcacctggccatcggcgtggtgccgctggtggtggcgctgttcgcgctgcgcggggccttcttccagccgctgcgcgccgtggtggcgggcctgtcggtgggctcgacgggcgcgctgctcggagagctcgcctgtgagcaggactggcggcacgtcctctcccaccacctgctcgcatgggtcgtcatcaccgtcgtactggtggtcatctcgaagtcgctcaaaccccgttcctacgcgccatga

SEQ ID NO: 8594 - DNA, 525 bp, Myxococcus xanthus
atggaacggtttcgcgacggagcacaggacgccttcgaggacctcttcgcgcggcacgcgccgcgggtccaaggcttcctggcccggatggtgcgcaatggcgcgctcgcggaagatctgctccaggccaccttcttgtccgtcatccgctcgcggggccgctacgagcccggcacccgcttcatcccctggctgatgaccattgccgcgaacgccgcgcgcgacgcgttgaggcatcagcggcacgtagacgcctatgcctcccgggaggacaccgcgacgcccgcatccgcggcgccggatgacagcgacccgtcgctgcgcaggcacctgctggacgccttgcaacaactccacccggaccaccgtgaagccgtggtgctcagcaaggtggagggctggtccttcgaggagattggcgcgctgcggggcatcagccctggcgccgcgcggctgcgagcgcaccggggctacgagaagctgcgcgagctgctgggcgagctggagctggaggtggcgcgatga

SEQ ID NO: 8595 - DNA, 1323 bp, Myxococcus xanthus
atggcgaagcctgccccggcgcggcggcgtgggaaaggggccaggggtgtgcccatgccgccttcccgcctgcccccctggaatcctggagcgcggcgggaacgcattcgttatgcaggattcccgatgccacgctgggtcagcctgctcctcttcttcattcccgtgctcgccgtactgtcggtgggccatgtctatctctaccgtcggctcgtccgtgacgtgacgaagcgcaagtggctgcggcgcaccgcccagggtctgttcgccgtgggcttcgtcggagccctgagcgcgcgggccattggctccgtgctgccctcggagggcgcccggcgcctgggcatcgtcttcctcctgtggattggcctggtcctctacctgctcatgttcaccctggcggtggacatggtgcgggccctggccgcgtggcgtgagcgccgcaaggcacgcgcggagacgacggcccccaccgcgcccgcgtcgccggagcgccgggcgctgctgggtcaggggctcgcggtgggcgcggggctcgcgggcgtggcgacgagctcctacggcggctggcgcgcataccacccacccgatgtgcgagacatccccgtgcggctgccccacctgccgcgcgagctggaaggcctcacgctggtgcaactcaccgacatccacatcggaggggtgattcagcgccgcttcatggatgagctggtgtcccgcaccaacgcactcaagccggacgtcatcgccatcaccggggacctggtggacggctccgtgaatgcgctggggggcttcgccgccagcctggggaagctgcgcgcgcggtacggcacctggttcgtcaccggcaaccacgactactactcgggcgccgattcgtgggtcgccttcctggaggggctgggcatccacgcgctgcgcaaccgctccgtgtccattggcgacggcgcggcctccttccagttggcgggcgtggacgactggagcgcgcaccgcatgggcgagcgcggctatgacctggacgcggcgctgcgcgacgtgcggcccgaccgtgcctccgtgctgctggcacaccagccgtccaacttcgacgaggtggcccggcgcggcgtggggctccaagtctcagggcacacgcacggcggacagatgttcccgggcaacctgatgggcgacctcatctggggagaccgcaacgcgggcctgagccgcacgggcgactcgctcatctacgtcagccggggttgtggcttcgtcggcccacccatgcgcgtgggcgcgcccccggagattgcccgactggtgctgctgcccgcgtag

SEQ ID NO: 8596 - DNA, 1782 bp, Myxococcus xanthus
atgcgcgcccggtgtctccgccgggtgccgttcgagaaggagcggctcatgaagcggtggggactcatggggctgttggcacttgcggcatgtgggccggacgacgcctcagacaagggagcccagagccaggtctgcccgaacatcatcgcgggctccctgtccgaacccgtggagacacggcacgtccgggcccccctgacggatgacgacggccggcagcgggtcatcatccgctatcggaatcagggggtgatggccaccgcccgcgtgcatcaggtgggtggacaggtgacagccaccttccgctccacgcccgcggtggcggcgcgcatgtcgctccaggaacagcgagcgctcctggccgaagacccgacagtggagagcatcgaggaggaccaggagtggcacgccctggcccccgccaccgcgccgattcatcccgtcctggcctcggtggcgcgaggcgccacgccgcgcgagttcacccccgggctgcgcaaggtccaggcgcacgaggtgtgggacgtggatggggacggactgccggacccggaccggcccacgggcgcgggcgtgcggctgtgtgtcatcgacagcggcttggatttggagcacccggagctgcgcgacgcggtggtcgccggccgcgacctgctggagaacgatgacgacccctccgacttcagcagcgacaacggctggggcaccggccacggcacgcacgtggcgggcatcatcgcggcgcggccaggccacggcgggcgcggctcgccccagttgtcggacaccggggtgatgggcgtggcaccgggcgtggagctgatcatcgcccgggtgctggacatccacggccgcacgcacatgagcttcgtcctggcggcggtggagtactgcgcggagcagggcgccaaggtcatctccctgtcgctgggcggcggcgtgccctccaaaacgacgctcgaggtcttcgcggcggcccacgctcagggcatcctggtggtggccgcgtcgggtaacagcaacgcccagcgggtggactaccccgcgtcggacccgcacgtgctggcggtgggcgcggtggattccctggaccagcgggccaccttctcctccggcggaagccaactggccctggtggccccgggcgtggacgtgctgtccaccttcccgcgcggacagggcgcgttctccacggtggacgtacgggacacccggccgctgtcgcgctcactgctctatgcccccatcgagaacaagtggggcaagctggtggattgcgggggcggcgcgacgctggactcgtgcaagggcagcacgtgcagcggcttcgtcgcgtacgtgcggcacggcgaggtgcccaccgacatggccatggtcaacgtgatgaagcagggcgcgcgcgccgtcatcttcggtaactcgagctgggagggcggcgtggacatcctcgccatgcctcggcgagggcagtgggtgcccgccgtcaccatcacccaggcggggggcaccgtgctgcaccggatgctgggagagctggcccgcatcagcatgagcccggcggactacacctatatgtccggcacctccatggccgcgccctacgtgagcggcgtggccgcgctgctcttcagcgcccgcccctccgccacgccggaccaggtcaaacacgccctgttgtcctcggcgaaggacctggggccttccggccatgacgaggactttggccatgggctggtgcaggcccgaggcgcgctggaggtcctcacccagctaccctga

SEQ ID NO: 8597 - DNA, 678 bp, Myxococcus xanthus
atgaaggcactcgtacgtggcgcgctgtgcgcggcggcgctctggggcggcgccgcgctggcccaggcggaggaccgccccatcgcggagccgcgcatgcggtccgcggagacggtggagttcaacgccagcgggcggaagcgggccgacaccggcatctatgcccagttgggcggcggcctggagggctacaccggtcagctcgccccggaggttacgccgggcttctcctatggcgccgcagtgggctaccggccgcacgccttcttcgccgtcgagctgggctacagcggcggcctgagcgacatcgacagccgcatggggctgctcgacgacggcgagggcggaccggacatcgtccgcaacgccggccaggccgtcgtcgtgggcagcttcaccgacacccggctccagccctacgtcctgacgggcatcggcctggaccgctacaacgtccgcaacgacgcccggggcgccatccgcggcttctccgatgacaccagcggctacgtgcccgccggcgcgggcctgcgctaccagatgggcaacctcatcaccgccgacgcccgggtgaactacaacttcctgttcgaccaggacttcgccccgggcggccgggctcccggtgcgctggacggccgctactcggcgatgctctcgctgggcggaacctactga

SEQ ID NO: 8598 - DNA, 411 bp, Myxococcus xanthus
atgtatcgcattgccgtagccgccctggtccttgccgcgtccggttgcgccaccacgggcggtggcggtggccgtgagggcaacgccaccatcgccggcgtcatccgcctgccggagagcgggctgcgtgccgatgacgcttgcgggcagctccaggtcatcgtggcctcgccggacgcgcccaccaacgggctgggccggacgatggtgaagccgagccgcggcaaccgctgctccttcacggtgtcgggcgtgcccagcaacaccgacctccaggtcgggctcgcggcgggcggcggcctgaagtgcgagacgggcgccacgccgaccatcaccccggagccttccacggtgaaggtgagcgactacggcacggccacgcgcgatttcgccctgagctgcggcgcctga

SEQ ID NO: 8599 - DNA, 1314 bp, Myxococcus xanthus
  unsure (1)..(1314): unsure at all n locations
gtcgacacgcgggacatgtccaaggcgaacaacccctggccgcgcgcggagttcgtgaagcgcgcgcccggtctcgcctggaaggagttctttgacgccgcgggcctgggcacgcaggagcaggtcatcgtctggcagccgagcgcgctgacggtcctgtcgaagctcgcccagagcgagcccctgcaggcgtggaaggattacctggccttccacgcggtggctcgcgcggacccgtacctgcccaaggccttcgtcgacgagagcttcgccttcaacggcaagacgctgagcggaacgcccgcccagaaggagcgctggaagcgtggcgtggacgccaccaacctctccatgggcgaggcggtgggcaagctctacgtcgcgaagtacttcccgccggaggtgaaggcggaagcggaggccatggtccgcaacatcatcaccgcgttcgagaagcgcatcgacgcgctgacgtggatgtcgcccgagacgcggacccgcgccaaggagaaggtgggcacgctccaggcaagcatcggccacccggagaagtggcgtgactactcggggctcgacatcgtggccggtgacgcctacggcaacgccgagcgcgccgtccgcttcgagtaccagcgcaacgtcgccaagctgggtcagcccgtggaccggaaggagtggtacatggtcccgcagttggtgaacgcgctgaactcaccgcagcagaactccatcatcttcccggccgccatcctgcagccgcccttcttcgacgcgaacgcggacccggccgtcaactacggcggcatcggcgcggtcatcggtcacgaaatcgtccacagcttcgacgacgtgggcgccaagttcgacgcgcgcggcaagctggagaactggtggacgaaggaggacgaagcgaagttccaggccgcggggaaggccctggcggnccagtacaacgactaccgcccgctgccggacctgtctgtgaatggcgagctgacgctgggtgagaacatcgcggacatggcgggggtggcggtggcctatgacgcctaccagctctccctgggcggcaagcccgcgcctgtcatcgacagctacaccggtgaccagcgcttcttcctcggcttcggccaggtatggcgcgccaagtaccgcgagccgtacctgcgccgcatcatcatgacggacggccacgcgccgggcccgtaccggaccgccaccgttcgcaacctctatgcctggtatggcgcgttcgatgtcaagcccgggcagacgctgttcctgactcccgagcagcgcgtccgcatctggtag

SEQ ID NO: 8600 - DNA, 1143 bp, Myxococcus xanthus
atgaatccgtaccgcttacgcgccgtgacgctcgccctggccctgggcgggtcgggcatggcgtgtgaatccgaagagccgttccccaacctcgacgagctggaccagctccgcagcctccacagcctggggcggcagccgccgaaggacagcaccaaccggatggacgggctcgctcgcgccgaggcgctgggcgacgtgctgttccacgacagcggcctgtcacgctgcggcacggtgtcctgcgcgagctgccatggcggcgagggcctgacggtgcccaccgccaaggccaagggctgcgacggacacctgtccgagcgcaacccgcccaccctgctgaacgtggcctacaaccgctggttcatgtgggacggacgggcggaccggctctggaaccaggccatcctgccgctgctcaacccggtggagatgaacgcggacgcgcaggtggtgcgcgcccggctcacctcggtggagtcgtacaccacggagtaccaggccctcttcggcaaggcgcccgcggacgagacggactcggcgctgctggccaacgtgggcaaggtgatggcggcctaccagcggacgctcgtgcgcatcgacgcgcccttcgacacggacgtgcgacgcttcatcacggcggccgaggccggccaggcggaggcggacccggcgtacctggggctgaagacgttcctgcgcaagggccagtgcatcgtctgccacaagggaccggcgctcaccgacgacctgttccacaacatcggcgtgcaggacagcagctcgggcgcgggcgggcagtggagcgcgctgacgccgctgctggactgggagttcaacgccgccagccgccacagtgacgcgcccaccggcaccatcgcgacgcggctccagacgatgcgcacccaggcggacccggcgacgctggaaggcgcgttccgcacgccgtcgctgcgcaacgtggccctgacggcgccgtacatgcacaccggcgcccaggccacgctggagaaggtcatcgacttctacaacgagggctggcatgcggcacggagttttatgggtcagaagacagtgaccatggcgacgctggagctgacgaacgatggagagcgtgcgctggtgacgctgctgaatccatga

SEQ ID NO: 8601 - DNA, 336 bp, Myxococcus xanthus
atgacgttcatctaccgggtgacgaccaacgtctgcctcaacatgctccgcacccgggccctgcgggatgtcgccccggaggatgccggaagcgaaggcgctgtggacgcgctcgccgccaccgagtgccgcgacttcctgatgaagctggcgcgcgagctggacgagcgggccctcacggtggcgacgctgcactacctggacgggatgtcccaggaggagattgcccaggtcctggggctctcccggaagaccattgtccgcgacgtccagcgcatcagcgccctggcccgcgcgctgggtgagcccgaggggattcgaagaggtgccggatga

SEQ ID NO: 8602 - DNA, 498 bp, Myxococcus xanthus
cttgggcgctatgagctcgtccaccccctgggccaggggggcatgggggaggtgtacctggcgaaaatcagcggcgcggccggctttgagaagccgtgcatcgtgaagacgattctgccggcgctgctgaaggaccgtcagttcctggaccggttccaccacgaggccaaggtgctggtgcacctggtgcactcgtccattgcccaggtctacgacatgggtgaggcggacggcacgtacttcatggcgttggagtacgtggccggcgtggacctggcctacctgttggagcaggcgcgctcgcagggcgtggcggtgccggtgccggtggcgttgttcctcggtcagcgcatcgcggagggtctgggctacgcgcaccgcaagacggggccggacggctcgccgctgggcatcgtccaccgcgacgtgtccccgcacaacgtcatggtgtcctacgagggcgaggtgaaggtcatcgacttcggcctcgccgagtcc

SEQ ID NO: 8603 - DNA, 459 bp, Myxococcus xanthus
atgtcgatacaaaagcaggagcgcacgccttcgtggacgggactgggcgtggggacggaccgcaaatcgtttctggacgcaatatcctcccagattccggattacgaggcggacaaggccgccgaggcggtgttctgtgcgttgtcggagcgcctgtccggttcgtgggtggcgcacctgcgcgagcagctctcgccggacgtgcgcgagctgttacgcggttgtcacaggcaccgcggcgaggcgcccgcgaagctggaccgcgacgacttctacttgatggtggccaaccacctgaacgccgaaccggagaacgttcggctggtgctccacggagtcttctccgcgctccatgcccaaatcaccgaaggggaggcgaagaagttggagcagcagctccccgcctggctccaggggacgtgggccgccgcgcggatgcatgtcgaccggccctactga

SEQ ID NO: 8604 - DNA, 153 bp, Myxococcus xanthus
atgccgaaggtcctcgattcgcagcggtggcctgacctcacggtggacgagttggaggggctcctcgtagccatccagatggaaggaggttcgcaggatggcgtgacgcgcaatcagttcctgaaacgcctgacgcagcagcggctcgtctag

SEQ ID NO: 8605 - DNA, 249 bp, Myxococcus xanthus
atgcagcttgcgctcgacgacttcctgcccctggacgtgaagccccacgacggcgcgaccgacgtggagcgctgtctctaccggcgtgaatcgtacgaagtgattgcatccccgggccccgaaggcgtgacattcgtccgtgtgacattgcgtccggatgtctgtgaaaagcagaacatcatcatggacatggaagcgacctacgccatcgatgtcgaagggcggcgtatcctcgcgcggcagcggtaa

SEQ ID NO: 8606 - DNA, 441 bp, Myxococcus xanthus
atgcaactgcctcgcgcgcagggccgcgagtacgggcaggagtactgcggcgccatctactccctgggcgacggcacctactacgcgagcctgccgtctacgctgggcccgttgctcaaggcgacgccggagccgcagaaggcctgtttcgcgccgcgcttcgtgaatgattcgcgtgggcgcacggtggtgttggccgactatcacagccattcgtgggccaactcccgtatgtcgagtgcggaccgacggcagtcccgccagcgtttcagcatccggattcaattcgacacggggtgccgggtgatgaaactggtaccctacattggcgaggcccgacccggtgagttgttcgagcggcgcgagcggaaatgggtgcgaatcggtgtcatcaagcccgagcataaggccgcgggcatcgtgacctggatggatgggtag

SEQ ID NO: 8607 - DNA, 2007 bp, Myxococcus xanthus
atgcgcaacaccctgctcggcgcgtgggtgcggcagcggaagtcggagtacgtgcgccgcctcttcgacatgttcgaggagggcaacctcgacgaggctttgcggcacgccattccactgagcaaggagctgagcgaggacgcacgcgaggccttggggctgccagggcctcgtgcgcaactcaccctccagacggaggcgcggggagcggcggggtccgtgttcgggggaggagctaacctctactccgcgctccagcagcgctaccgcgaggccttccgtcgcttcgagcgcgagggacgcatcgacgaagccgcgttcgtcctcgcggagctgctgggcgccgtcgaggaagccgtgtccttcctggagcggcatggccgcttcaagctggcggcggagctggccgaggggcgcaagctggctccagggctcgtggtgcgtcagtggttcctggctcaggacgtagcgcgcgccgtcgccatcgcccgacgcagtggtgccttcggggacgcggtggcgcggctggagcgttcgaatccaccggaggcccttgcgctccgcctgctgtgggcggagacgctcgccgaggccggcgactacgcgcgcgccgttcaggtggtgtggccggtggcgaagaatcgtgccccggcgcgcgaatggctggagcggggcgtggcgagtggtggcgcgacgggcgctcggctgctggcgatgtgggccacggcgttcgcggatgggctgacggtggcgggtgcgcgggtgcgtgagttgctcgacgatgacgcgccggaacgcgcgtccgagcgcttcgtctttggactggcgctcgtggaagagcctccttccgccaaccgcaccgcgctggtggtgcccacgctgcgcgcgttgcttcgggaccgggcggcgggcaatgcccgtttcacctcggacctgagcctcatcaagcgcttgttgggcgccgcgcccgacggcaccttgcgcacggacctgccgtcgctggccgacaatatccaccgcgcgtggcgcgatacccacgaacggccgcgcatcgacgtcacggtgcgggcctctgaagcggggaccttcacgcttcatgacgtggtggtgctgccagacggccggctgctgtacgcactgggggaagcgggggcgcggctggttcgcgaggacggccggacggtggcgcacttcgacgtgccggccttccacctggtgccttccatccatggggaccgggtcctggcactcgcgcggcgggacgaggtgtggcgcctgtcccggctggacctggtcgcacgcaggtgcagcccctgggtcgatatgtcattgacggactggtcccgcagctacgacggcaatgtctggtttgtgtcctctgaaaacatggtgatgatggtggatgcgctcgccgctgactgccgcgcgctctggcgagtcccggaacttgcaagccgtgcgtttcccattgcggcggatgccacacacatgagtttcatcgtcggaacacaggagcggtggacgtatacgctcgcggacgggcccacattgcgcgaccgttcggagctgcctccagaggtgtcggacccgaaaatggtgagctggcatcagtccgtggtcccggatggtgaggctgctgtcctgtgcatggaatatccctccaaccccgaggatgtggcacgcggatggaataatctgaggagttcgctggcttgggtgcagcccgtgacacttcgcaatcgggttcggacggagcgcgaccacgagacgctcaagggcatctttctctcgagggaatggtttttggagttgatggatttggggacggattggcagcttcatttgacagacaggcgcggattttcccgcgccgtgttgacgttcgaagggaatgtccgcccgagggtgcggcttacggacagcatcttgctggcattcgacgagggtggccggggcgtgtggctggatttggagagcggtgaggtccggcacttgccggtgccttga

SEQ ID NO: 8608 - DNA, 576 bp, Myxococcus xanthus
atgccaaacacaaaggcgcttgaaatgtctcacctggcaagcaatggccccgtactcgaaacacagcgtctcatcctccggccgcccctggccgaggacctgtatggcttcgcggcgctatcggccgacccggagtcggcgcgtttcatcggaggggtccagccgcgcgcgatggcgtggcgcaccctgtgtgtgatggcgggctcgtggtcgctccagggcttcgcgatgttctccgtgctggagaagtccacgggcgcgtgggtggggcgagtgggcccgtggcagccggagggctggccaggaacggagattggctggggcctgctccgcgagtactggggccggggctacgccacggaggcgacggcggcgaccatggactgggccttcgaccacctcggctggaccgacgtcatccactgcatcgtgccagagaacaccccgtcccagcaggtcgcgctccggctggggtcgcgcgtgctgggacaggcacacctgccaccgccgcacgacatgctccgcgtcgaccgctgggggcagagccgcgacgagtggcgtgctcggcggaagtag

SEQ ID NO: 8609 - DNA, 1932 bp, Myxococcus xanthus
ttgtccgcaaacatgccgctgacccgtatggactcctcgcgggccgcgtataatgttaccactactgtgttctgtgtggacacggggacttcgggggacaggccgcgtgcacgtagccttatgcgctacagcccctgggaggccatcctagctaagatcccgctggaggcggcgctgaacctgggcccgctggttgcccggttgtccgtggcgctggggccgctgcgggcgccctcggagagggagggcggtgagcctcaagggtatgacggcctgtcgcgaagaggctccttcgaccggctgctggtgagtgaatggctgtgggccatggaggcacccgacgaactggtgcgccgtgccgccttcggagagctgtcctatctcaagccctcgttccgccagccccagcgcgcgcatcgcacggtgatgttgctcgatgcggggccagaccagcttggcgctccgcgcatcgcgcacctcgcgttgctcatcgtcatggcgcgcagggcggaggccgcgggcgccacgttcgcatggggcgtgcttcaggcagacccgcggcgtggctggttcacggaagtgacgcccgccacgctgggcgcttggttgaacgcgcgtgacaccgcgccgccctcggctgagcggctctcggcctggtgtgaggcactcgagctcggcgcgcggacggcggacgcctggctcgtggggtcttcccgcctgtcccggctcgtgggggcggagacgctctcgcgcatcgaggtctccgaagtcctggcgcccgaggtgcgccagctcgcggtggaggtgcatcccgccgcgcgcgctccgcgctccgtgttgctcgacctgccgtctccggacgacagcgtgcgtctgttgagagacccgttccgcgcgcgcgtcgccgtgcccgtgaagacagtccagcactcgcgggtgtcggggtttgccttctccgcggatggccgccggttgatgctcttctacgaggggggaggcgttggcgccatggcgctgcccaattctcctcgcgccaccctcgctcggccccagcggatgatgcctcggagtgatgagaccttcctgggcgcgggttggcggcggcagggggggctgctcgtgctgatgcggcggcagggcgcctatgcctatgccttccgggggcaactgcaacatcagtcgaggactcgtgggcccaaggcgttcccctggacgctgcgcgatacgcaggcgcatccacccaatcctgctcgtggacagccccccggccggctgacgacgtatctcgatgcattcaatcgggagtgcgtgctcctgtccggcctggacgacaggctctatttcttcgaggaggacgcctcctcccgccgcgtggtctccgcccaggtggctcagcgggtcatcgccgccgctcacgtgaagggctccagcatcgtcgtgacgcgcgacgaaaatgggggggctgcgagttgcatgcggctgggcatcgtgagtgcgaaggaggtgcgccaggttcgcctgcaggactcgaggggcgacaccctctggttcggtgcatcgcaccattcggggcatccggatgctgggttgctcgcggtgaacaaaatcccaggcatgtggtgtttgcaccatcgggactcggtgcaactcgtggcgctgcgctcgggattgcgagccgtgggcgtcggggtctgtccgcaggcgaaaggggatgccggactgttggcgctcgacgcggaccagcggaccttctggaacgtggggctccagcaccagttcaggctggcggtggccgccgctgacgtggtccacgcggaggccagccatgcggtgcctgtgctcgggtggctgacgacggaaggcgagctggtgttgtaccacctggagcatgaagcggtgctgtgccgtattcatacggggggcgggggatga

SEQ ID NO: 8610 - DNA, 108 bp, Myxococcus xanthus
atgctctacccgacgctcgcgagcggaaaggcgtggtacgcgcagtgggattccaccccccgttccttcaacggagtggacccgaaggactccggttctttagagcac

SEQ ID NO: 8611 - DNA, 723 bp, Myxococcus xanthus
atgatcgaggtccagcacctcacgaagcgataccgagaccgggtggccgtggacgacctcaccttccaggtcgaggcgggtgagattctcgggttcctgggccccaacggggcgggcaagtccaccaccatgaaaatcctcaccggcttcctcccgccgtcggagggggtggtccgcgtcgggggctatgacgtggaggcccagccgctcgaggtgaagcgccgcatcggctacctgccggagatgccgccgctctatgtggagatgacggtgcgaggctatctgcgcttcgtcgcctcgttgaaggggctgtcggggagcgccctcaaggccgagttggagcgggtggccgcactcatgggcgtgacgcacgtcatggaccgcgtcatccagaacctgtccaagggctacaagcagcgtgtgggaattgcccaggcgctgctcggctccccgccggtgctcatcctggacgaacccaccgaaggcctggaccccgcacagcgcgccgagctgcgcgccctcatcaagggcctggccggcaagcacaccgtcatcctctccacgcacatcctcccggaggtcacgatgacgtgccagaaggtgctcatcatccaccagggaaagatggccgcgtacgacgacatctcccaactggcccgcatccacgggcaggcggagaacgcgtcgctggaagaagtcttcatcaagctgaccgccgcctga

SEQ ID NO: 8612 - DNA, 804 bp, Myxococcus xanthus
atgcgcaccgccctggcgattgcccgcaaggaactgtccatctacttcaccacgccgtgggcctacgccgtcttcacggcgatggcggcgctgacggccttctacttcatggacctgctgcaggcgttcaacgacgtccagggcgtggcgcgccgggtgggctgggcgcagatgtccccggacttcaacatgtaccgcaacctcacggacggggtggtggtggagctgtggggcagcgtcctggtcatcaccctggtcgtcacgccgttcctgtccatgcggctgttcgcggaggagaagcgcaaccgcaccttcgagctgctgatgacggccccggtgcggcccattgaaatcgtgctgggcaagtacctgggcggcctgggcgtcatctccgccacgctggcgctcacgctcgtcttcccgctactgctgtccgtgctgggccacagcgagtccgggctggcgctggagtggtccaccgtcctgctgggctacggcgcgctgctgctgtggggcgccacctgcatggccgtgggcctgttcatctccgcgctgacggagagccagatgctggcggccttcctcaccttctgtgtcctgctggcgtggatgctgctgggccaggtggcccgccgcgcggaggagccgctgcgctccgcgctgtcctacgtcgcctgcgacctccagttgcaggggatgatcaagggcgtgctggacgcgcagtcgctggtgttcttcgcctccgtcatcggcttctcgctcttcctcacccaccgcacggtggatgcgcagcggtgggcctga

SEQ ID NO: 8613 - DNA, 1572 bp, Myxococcus xanthus
atgaaggcggctcatgtcggcaaggtcctgggcgcgttcggactgctgctgttgctgtcgagtccgttcaccctgttcatcacctcggacagcgccgtcaccgccgccgtgaaggcgggcgcggggctggtgctggtgggcatctacggcgcgacgaactaccggcagttcggccagttcgccacccgccgctccagcagcttcttcgccaccacggtgctcaccacgctgggcgtgttcgccgcgctggtggcggtgaactacctggccttcaagcagaaccggcgctgggatttgacgcaggcacgcatccacacgctggcgccgcagacggtgtccacgttggccgccattcccgaccaggtgcgcgccatcgcgttcatcaccccggcgcatgcccagtacggccagttggaagcgctcttcgcgctctaccatgccgaagcgccggggaagttcgagtacaccttcaaggacccgcgccgaagcccggacctggccgcgaagtaccaggtgcgtgagggccagacggcggtggtgctggtacgcggcgagggcgagtacgccacgcacacgctgctcgccaccgtgtccgagcaggagctgacacacgcggtcctcaagctgaacgcggtgggcacccagaaggtctatttcgtcaccggccacggggagtggccactggacaaggagcaggcgccgccccaggacccgggcgccagcctgtccgaattccggaggcagttgctccaggagggctacaccgcggaaccgctgaacctcgcgggtgtccaagacgtgccacgggacgccgcgctggtcatcatcgcgggggcccgggggccctacaccgcgccggagaaggagctgctccagcgctatctcgcctccggaggacgcatgctctacttcgctgacgccggcctccgtgatggcctggacggactgctggcggagcacggcgtgcaggtggatgagggcatcgtcgcggacgcgcagtacaacagcggcaatcccttcgtggtgctgtcgctcttctacagcgaccacgagattggcaagccgctgcaccagcggggactcaacgtggagttccccaccccacgcagcctgaccctgctgcgcatggggatggcgccgggcgtccaggtgcagccggtggtcctcacgtcccagtacggatgggtggagagcacgccagaggagaacgcggtgccttcggatggcgagaagacgggccagttggtgctggtggccgccgtgacgcgtgatacccaggcctcgccgggcaagcgctttgatgaagcgcgcctggtggtgatgggagactcggagctcctcctggacccgaactggggccatgagcccaaccgcaacctggtgatgaacgcgctgggctgggcgtccaaccagctcacgaaaatcaccatccgcccgccggaccgcgaggtgtccacgctggagctggacgcggcgacgctcagccgcatccgattcttcgccacggacctcatgccgctgacgctgctgggcgtgggcctggccatctggctgtcgaggcgcaacaagtga

SEQ ID NO: 8614 - DNA, 1539 bp, Myxococcus xanthus
atgccggcccgcggacggtggcggtggaacatcctcaccgtcgtcacggtgggcctggggctcaccgcatgcaccggtgagaaggcgtccgaagcgagcgaggcccggcggaaagccgacgcccagcagcgcctcttcatcacggggatggaggagacgcgcggacaggacaacggggcgcctgccgcgaagcctgtcttcacacacttgacggtgcgggcccggggcgacaccacagagctggttcgcgagcaggacggcacatggaagctgacagcgcccgtgtccgctcgcgcggaggcggccgtggtggagaccatcctcggcacactggcgtcttcgagcttcagcgccaccgtgaaggaggcgcccaccgacgccgacctggacgcgtacggcctgaaaccgcccctcttcaccgtcacggcccaggccttcgtgccagatgcccaaggccagggggcgcaggaccccgctcgccagcgcacggtgacgctgcactgtggcaaggagaacacctacgacggctccgtctacgtacaccgagacacggagccggcggtccacgccgccgcggggacggtgcgctgggccctggaccgggacaccttcgccctgcgcgccaaggacctcctgacacctttggacgagcgtacgctgaagggcatcgaggtgaaggcgccgcagggtgcgtatcaactggcgcgagacgcggacggcgcgggctggcagctggtcgcgccggtggccgccaacgcgaacgcgatgcgtgtcgcggagctgctgaaggccctggtggagcagcgggcactgtccttccccgaagacacgccggagtcccggaaacgcttgggtctggaggccccggtggtggacgcccgcttcaccggtggcccgggcgagccagtgcgcgtgcggatgtcccgcgtgacggacgacggcgccgtgcgcgcctatgcgttgcgcgagcaggggacgcaagccgtgttgggtgaggtgcccgaggacgccctcggcgtgctggacgtgagcgtccgggagctgaaggaccggcgcgtgctggagttccggcgccaggacgtccgccgcatcgtgttccacccgggcggtggcgcgcccgccatcaccgtggtgagcgcgtcggaagccaacgaaggcgccgggcactgggacatggaggccccgcagcggggcaaggcccagcacttcaagctcgcctcgctgctgcgcgcgctggaaggactgaaggccacgggctacggcgagacgaaccccaagaattgggcccggtatggcgtgacggaggactcccccggcgccgtgctgctaggcgcggacggacgcgaactggcgcggctctggctcggcactgaagtccccgacgaacccggcacgatctacgcccgcggctccggccccgacgtcctcaaggtgcccgagtcacgactgacgttgcccaccaggcccgaggacttgcaggaagcagcgaaggcccccgacgcaccgaagccgcccgcgaagacggagcaggctccctga

SEQ ID NO: 8615 - DNA, 573 bp, Myxococcus xanthus
atgccaatcgtggtccagaagtacggcggctcgtcggtcgccggcgtggagaagctccgcaaggtcgcccagcgggtgaaggacaagcgcgaggcgggctatcaggtggtggtggtggtgagcgccatgggcgacaccacggatgaactgctggcgctggcgaagggcgtttcggtggacccgccgcgccgcgaactggacatgctgctcacgtgtggcgagcgcatctccatggcgctgctctccatggcgctccaggagatggatgtgccggccatcagcttcaccggaagccagagcggcatcatcaccacggacgcgcacgcgcaggcccgcatcgtggaggtgcggccgtaccgcatccacgacgagctggcgcgcggcaaggtcgtcatcgtcgcgggctaccagggtgtctccttcaagaaggaagtgacgacgctggggcgcggcggctcggacacgacggcggtggcgctggcggcggcgctggacgcggaggcgtgtgaaatctactcggacgtggacggcgtgttcagcgcggacccccgggtggtgccggaccttagagca

SEQ ID NO: 8616 - DNA, 1513 bp, Myxococcus xanthus
atgggtacggacgcgcagctggcagagcgtgagcgggccccggacgaaatcaacgcccgggccagggccgtcgggttgcttatcgacgccggggtgcccttcgtcgtgggcggtgcctacgcctatgcgacgtacaccggcatctaccgcgacacgaaggacctggacctcttcccccgcaaggcggacgcgctccgggcgctgcaagtcctggagaaggacggttggcgcaccgagcgcgcggacgaggtctggctctacaaggccttcaagggcgactacttcgtcgacttcatcttctcctccggcaacggcgtggcggtggtggacgacgagtggttcgaacacgccccgcgcgccaccatcttcgggcacgagtgtctggtcgctcccgccgaggagatgatctggtccaaggcgttcgtgaacgagcgcgagcgttatgacggcgcggacgtgaaccacctgctgctgaaggcgggccggaacatggactgggaccggatgatgcgccggttcgaccggtactgggaggtcctgctcagtcacctgatgatgttccgcttcgcctatccgtccgagcgggacgccattcccgaatgggtgatggcggagctgatgagccgcacgctgcacaccctgcgcgaggggtgctgggaagagaagctgtgccgcggcaacctgatttcccgcgtgaactatcacgtggacatccaccactggggcttcagtgacgggaggtcctgggacgagaacgaacgacagcgaggggacgagagtggcgcgcgatccgggctcgaaaattcggttggcggcggtcggtgacctgcactgccgggaggaccaccacggtcgcttccggcaactggtcaagcaggtgaacgccacggcggacctgctcgtgttgtgcggcgacctcaccgaccgcggaatgattgaagagggcaaggtgctggcggaggagctgtccgcgctccgcgttccctgcgccgcggtgctcggcaaccacgactatgagcacaaccaggtgaaggagatttgcagcgagctggccaaggtcggcgtccacgtgttggacggggaccacttcatcttcgagaaggtcctgggcgtggcaggagtgaagggctttggcggcggcttcggcaacgcgacgctccaggcctttggcgagggccagacgaaggccttcgtgcaggaggccgtcacggagtcgctcaagctggaggccgcgctgagccacctcgacgtggagaagaaggtggtcatcatgcactacgccccggtgccggacacgctggagggggagaacatcgagattcgcccctttctgggcaccagccgcctgtccatgcccattgaccactacggcgcggaggcggtgttccacgggcacgcgcaccacggcgctcgcaacggaaagacgaagagcggcatccccgtctacaacgtggccatgcccctgttggcgaagcacaccccggaccagcggtatgtgttgctggaggtgtag

SEQ ID NO: 8617 - DNA, 342 bp, Myxococcus xanthus
atgctgcgcaagagcttgctgtgtgccgccctgctggtgacgggctgcgacaacgcgacgagcgacgaaggcaccttccgggaaggactgccctcccaggcgatggtggagatgcgctcgccctccaggaacaacgggcagggactgacggccttctacggtgaaggcccacaggccgagtactatcctgaaggccatggcgggcaggaggccatggagacgccggacctggtgcgccggttgctggtgcgcgtggacgtggagacacaggcggccgccatccactcccacgtcgatggaatgacgttggaagaagtggccgcgctggtgagccgctcggtg

SEQ ID NO: 8618 - DNA, 5001 bp, Myxococcus xanthus
atgagcgagcgcaacgacgtcccgaggaccactgttcccgtggcccccctgcctgtgtctggcgcgcccgcgagcccgaatgctccggtcacggagacgcaggcccaggccgcgaccaccgccccctcgactgccgccaacacccgcgccgaggatgaagcgcgcgagcgcatcgcatccctggagcgcgaggccaaggccctcagcaccgcggagccccacacggcggcgttgctcttccacgaggtgggcctgctctgggaggagccgctcaagaatccgcgcaacgccgcggtggcgttccagaacgcgtacaagctggcgccgcgctacctcgtcaacatccgcgccgcccgccggctcttcgcggacgtgggcaactggcagatggtgctccagttgatcgacgcggagctggcggccaccgacgacgcgcgccaccaggccgcgctgctcttcgagaagggcatcatcctccaggagcgcctgtcgcgggacgaggagtccgccgcgtgcctgaagcagtgcctggagcgccggcccacggacgtcgtcgtcctcacccagctcgagtccgtctacgccgcgcgcaacgacgcacttgcgctggtggaggtgtaccggctgatcgccgccaccgtgcagcagccttcgctgcgcgcgcactacctcaccgccgcgggcctgctgctggaggagcggctgaagcagaaggaaggcgccgcggccctgttccgcgaggccttcgcgctggaccggtcggacctccagctcctggctgccatgaagcggctggccgagcgcgaaggccgcgtggatgagctgctcgccgcgctgggggcggaggcggccgcgctgggcgcgcaggcggcgcccgcgtacctgcagatcgccaaggtctacgagcgcaacgaccgcaaggacgacgcgttggccgcgctgctcgccgcgcggcaggtgtcccccaacgagccgctggtgctgagcgagctggccggaatctacgagacgcaaggccgcttcgaggagctgtcggacgtgctgctggcacgcgtgggttcgctcaacgacgagagcgagctggtggccaccaacctccggctggcggcgctgtacgaggaggtcctcaagcgcgagtcggacgcggcggcgcggtatcaggccattgtcgcccgcattcccggccacgcggccgcgctggcgggcctgggcaagctgtactaccgcatgcaggactgggagcggctggtcgccgtcttcgacgcggaggtcgccgccgccgaggacgcgaagcagaaggccgcgcgcatgtacaaggcggccgaaatcctggaggagcggctgggacggcaggaggacgccatctcccgctacaacgcctgcctccagttgcagccgggctacctccccgcgcagaaggccctcacgcgcctctacgagcgccagggccgcttcgcggagctggtggcgatgtatgagcaggacctgctccagacaagcgaccgggatcagctcatcaccacgttgaacaagatggcggtggtgtacgaggaccgcctgggcgacctggaccacgccatcgagtgcatgaagcgcatcctcgaccttgcgtcggaccacctgcccaccatccgcaacctcgcgcggctctatgagcgggccagtcgcttccgtgagctgctggagacgcacgacctggaggcgtcgctcgcgggtgacaccaagcaggtgctgtcgctgctgcaccgcaacgcggagattctcgacgagaacctcaaggaccgcgcgggcgccatctccgcgtatgagcgcgtgctggcgctgtccccgtcctatctccccgcgctcaaggcgctgggccggctgtacgcgcaggatggccggtgggagaagctggtggacatgtaccgggcggagtcggagagctccgcctccaccgagcaggccgccgcgctcatctacaagattggcgagctgtacgagcagcggctgaaccaggacaacgaggccatcgcttcgtacaacgaggcgctgatgctggcgcccagctacttcccggcgctgcgcgcgctggcccgcatctaccgcgcgcaggccgcgtgggagagcctggtggaggtgctgcgcgccgaagccgccaaccgcaccgacccgctggagcgcgccaacgccctctaccaggcggcggccatctgggaggagcagctgcttcggcccgagctggccatcgacacgtatcaagaggtgctgcgcctgacgccgggccatgccgccacgcttcgcgcgctggagcggctgtacctggcgcaggacaacgtgaaggagctggtcggcatcctggaccgcgagacgcaggtgggcagcacgtccgcggcgaaggtgacggcgtacctgaagctggcgcggctgtacctggaccgcttccaggagccctcccgcgcggcccagtgctgcgaggccgtgctggcgctggacgccggcaacctcaccgccctcacgctactggagcgcatccgcgcctcggaccggccgcgccgcgccgagctgcgccagcgcatcgccgaccgggtgaacgacccgcggttggccatggccctgcggctgtccgccgcggtggacttggacaagagccccgccgagggcacgctggaggcctacaagcgcgcattcgatgccgacccgggcgatgcgcggctggccttcgtgctggagcgaggcctgcggcaggcgggtgacgccgcggggctggcgcgcctgtacaccatgcggctggcatccgcgcaggacgccgacgaggccctggagatgctgctgcgcaccgccgagctggcggacacgcgcttcaacgacttggagcgggcggcggcgctgtaccggcaggccctggagctccagccgcagtgcctgcccgcgatgcagggagctcgccgcgtggccttgaagcggggcgacttcgcgggagcccgcgccgccctggaggccgaggcccgggtgtcgcgcgatccgcgtggcgccatcgaggcgctcatcggcgcggcgaagctggccgtgggccggctgaatgacgcggacggcgccacggcgctgtaccggcaggcgctggagaaggatccgctgcacgcgggcgctcaggcgggcttggaggaactgctggcgcagcgcggtggctccgcggacctggcggccctgcaagagcggcgcgccgaagcgaagcttgcgcaacgggacggactggcggcggccacggcgttcgtcagcgcggcgcggctgcaccacaccgcgctgaatgaccgcgcgcgggcgctggccctgctggagaaggccctgtccgcgcagccggggcacccggaggcgctggagctgcgtggcgcgctcttgctggaggcgcagcagtaccccgaggccgcggccatgctgagccagcgcgtgcagctcggcggcgacccgcgcgtcctggcgcagttccacatgacgctggggaacctgtacgcgtcgcacctcaatgacccgagccgggccgcggcgcactaccagacggtgctggccaccctgccccgtcacctggaggcgctggagcgcctggccgggctgcacacgcaggcgcgcaactgggcgggcgcggtggactgcctgcacaagctgctccagcaggagctgccgccggagccgcgcgcccgcttcacgctggagctggcgcgtacgtatgacgaagggctgggcgacgcgggcgcggccaccccgctctaccgccgcgcgctggagctgtccccgggcaaccccgccctggtggaccggttggtggtcctctacgagcgcgctcggaacctgccggagctggcgcagttgctggaggcccaggccacgggccagttggccgtggagcccaagcgcgccgcgacgctgcggatgcgggccggggacctgtacgcgggtccgctgtccgagcctgctcgcgccaccgcgctgtaccggcaggtggtggatggtgatggcaccaacctccaggcccgcgcggtgctcgcggagctgtacgcgcgggactcgtcatcggtgccgatggccatcgaggagcaccggcagattctccggcaggacccgacgcgggtggacagcctgcacgcgctgttcaagctctgggagggcctgaagcagctcgacaaggcgttctgcgcggcggcggcgctgcacttcctgcgctccgccaacgaggtggagctggccttctacatggaggcccgcacgcggctggcgcaggaggcgcgcgaggcgctgacgcagacggatgtggactcggtgctgatgcacccgggggcccggggcccgctgctcgaggtgctgcgcgcgatgggcgagcacctggagaaggtgtacccgcccaacttcgaaatcgtgggcgtcaatccgaaggcggaccggctcaagccggactcggccgtgtacaaggccatccgcgccgtggcgcaggtgttcggcgtggaaaccttcgaggcctaccaggcgcggcgcgggctcacggtgctggagaccacggagcccatgtcggtgtgcattggccaggacgtggtgcggcgcttcaacgcgcgcgagcagaagttcctcctgggccgcgcggcgctggggctgctcaacaaaaccgcggtgctggagaagctgtcccagggcgagacggcggacctcttcggcagcgccgtccgcctgcacgcgccgcagttcagcgcgctgggccggcgcaacgacgagtcggtgaagcagctcaagcggggccttcccgcgcaaggcgctcaaggcgctggagagtccggcgatgtcgctgggcgacgcacagaaggtggacctggcgccctggctggaggccctcgactactcggcggaccgcgcgggcctgctgatgtgcggcgatgtggcggtgggcctgggcatggtgctgcgcgaggacccgaacttcgcgggtgcccggctggatacgcccgagcccatgatccaggccgtgcgcgaaggtga

SEQ ID NO: 8619 - DNA, 900 bp, Myxococcus xanthus
atgctccgctacgccctcatcgccgagcccgacccacagcgagccgctggcctcttgtccctgatgacggaggaaggcctggaaggcgtcgtcgccaaggatggagcggatgcccaagatgtcgtgcgccagcgaggtgcgcccctgctgctcgtcacggacctggcgctgccccggctggacggcttcgcgttgctgacgtggcttcgggaacaggaggactccgccgcaacacaggtcgtggtggtcactgccttcgacgagctccgcgtccgcgcatggcagctcaaggaggcgctgggcatccatgcgttgctcagtcgccgggcctccgcggaggtgatgcgagacacgctgcgtcgcgtactcgcagggcagctcgcaccacagccgcctccggcggagggggccgcggagcaggagcggcaacggctggcgagcatcgcggccatgcacctggtcgacaacggaccgcccgaggcggagctccagcagctcgtgaaggaggtcgcccaggccttcggtgttcccgtggcgctgctgacgctggtgctgggcgagcgccagtggttcaaggcccacgtcggcctgccacccaccctcgcgaaggaccggggcacgccgcgcgactgggcgttctgtcatcacgtggtgcaggggcgcgagccgctcgtcgtaccggacgcccggcgccatccctactttcgtgacaacccactggtgcgcgacggcattgtgggcagctacgcgggcgcaccgctgctgacctccacgggcgaagtcctgggctcgctgtgcgtcatcgacacgcgcccgctcgtcttgggagccgaggacctggccgcgctgcgggagctcgcgaaccgtgtcgcggaggacctggaacaacgggcccggatg

SEQ ID NO: 8620 - DNA, 804 bp, Myxococcus xanthus
gcgcccctgcgcatggcggctcggggcagtggaacactcaacatgctggtggacggtgacggcgtcatccgtcgatatccctacgccgtgggcgtgagcggacaggcctggccttcgctggcactggccaccgcgctgcacctgacgcccgaacgggcggagcctctgcgtgagctggcggcatgggaccacggcgcgccgttgatgcggctgcccgcacccaactggcttccccgggtgagtctggcggacctgctccacgcggacccgcgctcggtgggcttggacctggcgctgcgaggcaagacagtcttcgtgggtgtcaccgccacggggctgcatggccagagcaccctgcccggccaggtggcggtgcccggcgtggagattcacgccttcgccctggacaacctgcggtcgggccggctgatgcgctcgtcgggactggtggcgctgctgggcgttctggagaccgcggcggtgctcgcggctttcgtctggctttgccggcgcgcgcgcacgtccggcgcggtcctccgatgggcggtgacgctggcggtcctgcacacggcgctggtggcgtggctggcgtcggacccaggctgggtcattccgctggtcccctcgtgggtgggcctcctgctgatgctggtggtggacgcggcgtcgcgcgcgcaggagatgggccggcagcgaggcgccctccgtcggctcttcatccgctacccccaggcatccgtggagccggcggcgccacagcgagatgcccagcgcgcccgcgccgacgcaatgcaccaggactag

SEQ ID NO: 8621 - DNA, 1137 bp, Myxococcus xanthus
atgctggcgggtccacccgcgctcgccgcgcagacgcaggcgccgtgcggcgggctgcgcttcgacagcggccggatcgtgttcggccggccgctggccccccagggcgcggagacggacgcgtgcctggcgcacgtagcccaagcgctcctggcgcgccccgccatccgttccgtgacggtggcggcgaagcttccggacgcagaacggctggacggccagggcctggccgcggcgaaacgggccgcggatgtgctggtggcggcgggcgtgccccgcacgcgcgtgtccgccatggcgccgccgtccgtggagggcgagcccgcacagctccagttcgcctacgtggagcggcccgcccagcccgcggtggcccggctacgggcggccagcggcgcggtggaggccggcgcgacggaagcccaactcctcgcgcggacggtgggtgacgcgctctacccgggcgagctgctgcgcaccggcgaggacgcccgggccgagctggccctggcggacggcagcatggtgcgcgtggtggagaacagtctcatcaaggtgggcgccatcgagctgatggcgaacctccagcgcaaggtgcagttggacttgctgcgaggcaccgtggagacggacgcggcgccgggtggcgcgggctccatcttcgaggtccgcacgcgcggcgcggtggccggtgtgcggggcacccggttccgcgtgtcggcccaggacgacggcaccagccggctggaaacactggaaggcaaggtggccctcagcgcggagcaggccgaggtcgaggtgtcgggcggacatggttcgcgcgcgaagccgggctcgcctccggagccgcctcgcccgctgctgccggcgcccacgctggtgggccctcggggaggcgcgttcgccacggccccgaaggtgtcctggcggacgctggagggcgccgcgacataccgcgtggaggtggctcgcacggcggacttcgccgcgagcgtccagacgtatgacagcgccagcccggagctggcgattcccgggccccgccagggcaagtggttctggcgggtgatggccgtggacggagacggcttcgtgggcttcccctcgaagatctacgccttcgacgtccagccctga

SEQ ID NO: 8622 - DNA, 1635 bp, Myxococcus xanthus
atgcacggcgcgcgcatcgcgccgcacctttcctggaacctgggcgcgtcgctcaactacgcgaatgatccgctcaacctcgtggacccgcgagcggaccggttcctctaccgcatcgtggacagccagctcacgctggacctgatgggcgccatctccctgttcgaccgggtggagcttggcgtcgcgctgcccatctcccacacgacgtcggaacccgccgccgcggtggcgccggacctgtcgaacggcgtggggaccacgggcgtgggtgacctgcggctggtgccgaaggtccgcctgctctccaccgacagcgggatccacctggcggtgacggcgcccctgacgttgcccacgggcggcggctcgaagttcctgggctcggacacggtgacgttccagccgcgcttcgtggcggagtgggccaccaccgccgtccgcctgctggccaacgtgggctttaacgtccgccgcgaggagcagttgcgcaacctccgcgtgggcaacgagttcgcctacgcggtgggcgccgaggtgcccctcacgcaggccctcacggcgcaagccaccctggcgggcgcgctgggcctgaaggagacgagcgccgaggagcggcccatggaagtcctggccgcgctgaaataccgcttcaccccggggttggctgcgcatgtgggcgcgggcccgggcctgtcgcggggctatggcaccccgtccttccgcgtgctcgcgggtgtggcctggacgccgtttgaatccaagggcggccccgcctccaccgcgccggtctgcgacctggggcccgaggacttcgacggcttccaggacgacgacaactgcctggacccggacgatgacggtgacggcatccccgacgtcaccgacgtgtgccccaccgagccggagaccttcaacagcttccaggacgaggacggttgcccggatgacccgaacgcccaccagccacccaccgaagcgggccagcccgcaccggccccggcgcccctggcgctgccgcccgcgccggtggataccgacaaggatggcgttgtcgattcggaggacctgtgccagaccgagccggaggacttggacggcttcgaggacgaggacggttgccccgaccccgacaacgaccaggatggcatcccggacgccgaggaccagtgcccgctggaggcggagaccatcaacggcgtgcaggatgatgacggctgcccggacaagggcaaggcgcaggtgcgcgtggagggcgcgcgcatcgtcatcctggacaaggtgtacttcggcacgggccaggacgtgattctggccaggtcccacggcctgctgcggcaggtggccgccacgctcaaggcgaacccgcggatcctgatggtccgtgtggaaggccacacggatgaccagggcaacgacatgaagaacctggacctgtcccagcggcgggcgaggaatgtggtggccttcctggtgaaggaaggcatcgcggcgcagcggctggacgcggtgggctatggtgaagcgaagccggtcgacaccaacgagacggccaaggggcgcgagaacaaccggcgcgtcgagttcaacatcgtgaaggtcgccgagccttcgacgggaggaggcacgcgttga

SEQ ID NO: 8623 - DNA, 186 bp, Myxococcus xanthus
atgctggcggacttcgtgcgccgctacacgccccagacgcgggtggtgctgctgacggcgttcgccacccaggagctcaccgaccgcgcgcaggcgctgggcgtggacctggtgctttccaagccgcagccgctgcccacgttggctgagcacgtctcacgcctgctcgccgccgccgccgtgtag

SEQ ID NO: 8624 - DNA, 1368 bp, Myxococcus xanthus
atgacgcgcacccgaatccttctcgtggacgacgagcccggcatccgcctgggcatgagaggcttcctcaccgcccatgggttcgacgtggacgaggccaccagcctcgccgaggcgcaagaggcgttccgcacctcgcgtcccgacgtggccgtggtggactaccggctcacggacggcaccgcgctggagctgctgccgcgcctcaaggacatcgacgcctcggtgcccctggtggtgctcaccggccatgggtccatcgagctggccgtccaggccgtgaaggaaggcgccgagcagttcctcaccaagccggtggaactggccgtcctcaaggtggtgctggaccggctggtgtcgcagcgccgcgagcggcagcggctgctggcggagcgttcgcgcatcctccgtgggacggtgaatcccttcatgggtggcagcgccaccatccgcgcgctccaggcgcaggccgaacgcatcatcgaaagcgacagcccggtgctcatcaccggtgagacgggcagcggcaagagcgtgctcgcgcggtggctgcatgaaggcggcccgcgcaaggacgcgcccttcgtggacctcaactgcgcggcgctctccaaggacttgctcgactcggagctgttcggccacgagaagggcgccttcaccggcgcggtggccgccaaacagggcctgctggaggtcgccgaccgaggcaccctcttcctggacgaaattggcgacatggactcggccgtccagcccaagctcctgaaggtgctggaggagaagcgcttccggcggctgggcgacgtgagggaccgccgcgtggacgtgcgcctcatcgcggccacgcaccaggacctggccgtggccgctcgggacaagcggttccgcagcgacctctacttccgcgtcagcacgctcatcctccatgtccccccgctgcgtgagcggcccgaggacatcgtcgggatggcgcaccaattcctggcagagctgggcgcggctcgaggccgcggcagcgtggggctgcgacccgacgcggagatggccctcacctgctacgcatggcctggcaacatccgcgagctgcgcaacgtgctggagcgcgcggtgctgctgtccggcggcgggcccttgtcccggggagacttgcgcttcgaggccaccgccggcgagcccgcctccgacgccgacgaccacctcaccctcgaggagttggagcgccgccacatcgagcgcatcctccgccgcgagcacggccacgtggagcgcgccgccgcgcggctcggcatcccccggtcatccctctacgagcggctgaagcgcctgggcatcaaccggtccggattccagaaaccggatccgtag

SEQ ID NO: 8625 - DNA, 420 bp, Myxococcus xanthus
gtgaatgtgaatcgcgaattggcggcggagctgccccgcgttcgaatggacgcccggcgtttgtttcacgtgtttcgcaacgtggtggagaacgcggtgcagcattcaccggcgggcagcgcggtgcgggtggcgacggaagaagtgaaagaggcgggccgggcctgggtgcggtgcaccgtgcgcgacggtgggccgggctttcgcgcggaggacctgtcccacgtcttcgagcccttcttcagcaagcggcgcggcggcacggggctgggcctgtccatcgtccaacgcatcctggaggagcatcagggtatcatccgcttgcgcaatcacccggagggcggcgcggaagtcacactgctgcttcctgctgtttcttcgcgtgtatcaacccagcacgtagactccctgacttcatga

SEQ ID NO: 8626 - DNA, 1752 bp, Myxococcus xanthus
atggccccgtccgccgctcccgccaccgccaatgcgccgcccgccttcccggcgttcacgcgctcccagaaggtcttcacgctgctgggcgcggtgctggggctcttgctcgccgcgctggaccagacgattgtcgccaccgcggggccggccatccaggcggacctgcgaatccccgcctcgctctacccgtggctcaccacgtcgtacttcgtcgcgtcgacgacgatggtgcccgtgtggggcaagctgtcggacctgctgggccggcgcgcggtgttggccgcgggcatcctcatcttcctcgcgggcagcttcctgtgcggggtggcgcgctccacggtggcgctcatcctcttccgcgccgtgcaggggctgggcagcgcggcgctgttcaccgccgcgctggcggtggtggccgacctcttcgagccccgtgagcgcggcaagtaccagggcctcttcggcgccatgttcggcctgtccagcgtggtggggccgctggccggtgggttcatcaccgaccacctgggctggcactgggtgttcttcatcaacctgcccgtgggcgcggtggcgctggcgctggtgctgtcgcgcatgccgcggctgaagccccagcgtgtttcccggggcgggctggacctggtgggagcgttcacgctcgcggtggcgctggtgccgctgctgctggcgctcagcctggggcagacggacggcggcgactgggcctggacgtcgtggcgcatcctgggactgttcgcgctgtcggcggtgggcctggtggccttcctctgggcggagcggcgcgcgcccgagcccctgctcgacctgacgctgttccgcctgcgtgccttcagcgcgggcaacgcggcggtgttcatcgtcggcggggcgttcctgtcgggcatcgtcttcctgccgctgttcatggtgaacgtggtggggctgtcggcgacgcgctcggggctgacggtcatgccgctgacgctgggcgtggtggcggggaacgtgctgagcgggcagctcgtgtccagggtgggccgctacaaggcgctgctgctgggctcgctggtgctgctgatggcgggcttcgccgtcatggccttcacgctgacgccggactccacccaggcggaggtgacggcgaagatggtgctggtgggcctgggcctggggccttcgattccgctctacacgatggccatccagaacgcggtgccaccggaccagattggcgtgggcaccgcggcggccacgttcttccggcagctgggcatgacgttgggcgtggcgctgctggggacggtgttcgcgtccacgctgtcctcggagctggaggcgcgcatggcgcaggccacgtcggcgctcccggactccgtgaaggccgaggtgacacgcgccgcgccgggcgtcagtggcgaaggcggtcccaccggacaggtgttccgcgcggatgaggtgaaggcgcgggtgcgcgcggagttcgacgccgagcggcgccgtgcggagacaacggccgctcccgaggcccgggcgaaggtggacgcggacgagagacaggcactggcagcggtggacgcggcggaccgggcgctgaagatggcgttcactcgcggcgtctccgccgtgtaccacgtggccctgttcatcgccggcgcggcgctgctggtgacactgttccttccggagcagcacctgcgccgcaagcgccggcgcatcgagtcgcgtgccagcgccccggagcagtag

SEQ ID NO: 8627 - DNA, 699 bp, Myxococcus xanthus
atggctcacgacgcggaacagtcacccgcgctcacggacgcggaggccgccgagcgcatccacgcgcgctttcccgcgctcgcgacggcgcgggtcgtccgcctgggggaaggcacggaccatcaggccttcgaggtggaggggcgctacgtcttccgcttccccaagagcgacgaagccgccgagcacctgaagtgggaggcgcgcctgctggcgtggctcgggccccggcttcccctgccggtccccgactaccgtttcctcgcgcaccctgccgccgacctcgctgcgggcttcgcgggctacgagaagctcccagggacgcccgcgctcctcgtcgagcctgagcggctggacctgtcggacctcggccgcaggctcggcgccttcctgagagcgctccatgcgctcgaccccgccgaagccgctgcgctcggcgtgccggcggacgacgacccggaactcgaagcgtggtcggccgccgccgtggacgatttgcggctcgccgtcgaacacagccatatggagccgcaccgggctgcggactgggagcagcggctcagggtgcgccccacggagggacgcggcgctccccggctggtccacggcgacttcgccgcggagcatgtcctggtcgattcccacggtgctcccacgggggtcatcgactggagtgatgcgtgcgtcggagaccccctt

SEQ ID NO: 8628 - DNA, 2455 bp, Myxococcus xanthus
gtcgatgtgtgggagggggcgcgcatcgcgctgttctcgctccgttccaaccgcctgcggaccgtgctgacgacggtgggcattggcgtgggcgtgtgcacgctgctggccattgtcggcatcatccagggcatcaaccgctccttcgaggatcagctttcgagcattggcgccaacacgctccaaatctcgaagttcccctggacgctcaacggcgactggtggtcgtaccgcaaccgcaaggacctgagtgcggacctggtgccgcccatcctcaacgcgtccgagcacgtgctggccgcggcgccgctcttcttcgagcgcgtggagggccgcttcctggaccgcaaaatcggctcggtgctgctggtgggcaccacgccggactacgccacggtgggctcgttcgccctggagcggggccgcttcctcacccacgcggacgtggacaaccgggcgcaggtggccgtcatcggcgcggagctcgtgcgctcgctcttccccggagtgaacccggtggggcagcgcatcctcttcgagggcaagcccttccgcgtggtgggaaccctggaggccaagggcaccatcctgggagagaaccaggacctggtggtggtggtgccctcccgcaccttcctggcgcacttcggcaagaagcgctcgcccaacatcgcggtggccctcacgtcgccggagcatgcgccagcggtggtggacaagctcaccgcggtgctccgccgggagcgcaacacgccgccggggctgccggacgacttcgccatcaaccggccggaccagctggccagcatgtacgcgcagctcaccggggcgctctatggcgcggccatgggcgtgggcctcatcacgctgttggtgggcggcatcggcatcatgaacatcatgctggtgtcggtgcgcgagcggacgcgggagattggcgtccggcgggcgctgggggcccgcaagcgcaccatcatcctccagttcctgatggaggcctcctgcgtgtccgccctgggcggcaccctggggaccgtggtgggcctggggctggcgcgcatcgtgtccttgattacgccgctggcggcggcggtggagccgctgacggtggtggcgggcgtggggttcgcggcgatggtggggctgctgttcggcatctggccggcggcgcgggcggcgaacctggacccggtggaagcgcttcgccacgagtgacggacgggagacggcggcgatgatggcaatctgggacaccctgcggctggcgttcggaacgttccgttccaacctgctgcgctccttcctgacgctgctgggcatcgtcattggcgccaccacggtggtgtcgatgatggggctcatcgagggcctgcgcatccaggtgaacgagagcatgtccgagctgggctccgactgcttccaggtgcagcggctgcccttcggcggcaacctgtccctggcggagctggcgcggcggccccggctgaacgagggcgacttggaggccatccggctgcagccgtcggtgctgctggcggcggcggaggactccaagggtggacagaaggtgtccacgcagcagcgcgagtcgcgtcccaatgtggtcatctgggccggcacgccggagtacttccagacgaactcggtggtggtggagttcgggcggcccttcacggacgcggagtacctggatggccgccgcgtggcggtgattggccaggacctggcggacacgttgttcccgggcgtgcagcccttggggcagaacatccgcatcctggggcgcagcttccaggtgattggcacgctcaagcgccgcggcagcttcatgggtggaggcagccaggacaaccaggtgatgatgccgctgtccgtctacaaggcgctgttcggggtgcgcaactaccgggtgagcgtccaggcccagtcggcggaggtgctccagcgcgcgcaggacgaggtgacgctgctgatgcggcggcgccacaacctgaagccgttggaggaggatgacttcttcgtgttctccaacgagagcgccacggagatgttcaacaacatctcgaaggtgatttctgcggccagcttcggcgtgtgcatgctgtcgctgctggtgggcggcatcggcatcctgaacatcatgctggtggcggtgacggagcgcacccgggagattggcatccgcaaggcgctgggcgcgaagaggcgccgcatcctcgcgcagttcgccatcgaggcggtggtgctgtcgctggtggggggcgcgttgggcgtgggcctgggcatgggcctggcgcaactggcgaagtggatggtggggcttcccgcgcaggtgccggcctgggcggtgatgctgtcgctggccatgagcagcggcgtgggcctgctgttcggcatctacccggccgcgcgcgccgcgaagctggaccccgtggaggccatgcggacggactga

SEQ ID NO: 8629 - DNA, 1590 bp, Myxococcus xanthus
atgacggtgagcacgggcgacgtggacggggatgactccgcggacgtgctcgtctccggccagtacggcgcgctcgtcttcaagggccagacggacctggccagcgtcttcaccgagcccgcgttcgtggtgcccggcggcggcgtgtacaacaacgccgtcttcgcggacgtcaacggggacggcctggatgacgtggtcagcgtgaaggggctggtgctgtccgtcttcctggccacgcccggcgcgccgggagggcccttcaccctggtggagcgcacggagccgctctacaccggcgctgtccatcgcgcgggcgacgtggacggggatggcgcacaggacctcctgctattggattcgatgggagacgtctattcgctgctccatggctgcaaggccggcagccccgggccgtgtgacggcgggctcgcggcgcaacccttctggacggtggacagccggacgctgagcctcttcccggacgtgaatggggacggggtgccagagcgcttcacggggccgggcggtggcacggtgcggctccacctgtcggaggcgggcggcggctatgcctccgcgcccacgtggaccgccatgggtgaccccgtcttcgcgaacttcggtgccaccatcaccgcggtaggggacgtggacggggatgggcagcgccaggacttcgtcgcgggctccgaggggcggctgtacttctattcgccggcggagggggtgtcctcggcgctgagccccgtgtggtcctggccgcgggcggacgccctgccgcaggggtacgaaggcttccaccgcttcaccgtcatcgcgccgggggacctgaacggcgaccgattcgatgacctggtggcgggcgttgcgccttcgccagggctcgtcgacgggccggggggccgggtcgtcatcttcggcggtggccgggtgcccgcggagccgactacggcgccgcacctgccgcccgtggcgggctgtggcctgacgctggacccggtgcacggcaagccggacctctccgtggacgcggacgtgctggcccgcacgctgtacgtggagcgccgcaccttcgccgcggactcctgtgagatgttggagggctgcgtgcccgcgcccggtgagcggcgcctgctgcgcttcagcacctccatccagaacctgggcgcggcggcggcctcggtgcccaacatggacgagcggccggacctctacgtctgggacgagtgccacggccacgaacacctcaccaacttcgcccagtacgtgctgcgggacgcgcagggcaacgaggtcgtggagggccgcaagcagggcttctatctggtcgactaccagcgccagtgcgatgacgcggcgcccttccacttcccgctggaccgaatgagcatctccgccggctgggcggacatctacgtcgccgacatcccctgccagtggattgacatcaccgacctgacggacggcacgtactccctgcgcgtgggcgtggatgagcaggacatcatcgaggaagcggacgtgctccccaacgaggccatcctgaacgtccgcatccagggcgattccgtgaccgtggtcccgtaa

SEQ ID NO: 8630 - DNA, 1272 bp, Myxococcus xanthus
atccaggccttcttccgcctggaggcggccagcggcatcctgctcgcgctgtgcgccgtggccgccatggtgtgggccaactcgccgtgggccgccacctactccgccgtgttcgacgcccgcatgacggtgggcctggcgggcgtccacgcgggcttcaccatccgcgagttcatcaacgacgggctgatgacgctgttcttcttcgtcgtcggcatggaaatcaagcgcgagctgagctcgggtgagctgcgcaccttctcccgcgcggtgctgccgctcatcgccgcgatgggcggcatgattgtccccgccgcgctctacgccgccttcaaccaggggacgcccgcgcaggcgggctgggccatccccatggccaccgacatcgccttctccattggctgcctcacgctggtcaagacgcgcgtgagccacgggctggtcgtgttcctcacggcgctggccatcttcgatgacatcggcggaatcctcgtcatcgcgctcttctacggctcggggctccacgtcagctggctcgtgggagccctgggcgtgcttgccgtgctggcgtgcctcaaccacttccaggtgcgcaacggcgtggcgtacgcgctggcgggcgcggcgctctggtacacgatgcaccacggcggcatccacgccacgctgtcgggcgtggtgctgggcctgttcatgcccgcccggcccctgcgtccgggccgccacgtgctggaggaactgcgcctctacgtggaccgggcgctccagacggcgatggacgaggcgacgcggggcgcgcagattctctacctcgaggagcgcctggaggagctggagccgccgctcaaccgcttcgtccacctgtggcacgtgcccgtggcgtacggcatcgtccccctcttcgccctggccaactcgggcatctccctggagggcatgggctgggcggacctgctccggccgctgccgctgggcatcatcgccggcctcttcgtgggcaagcaggtgggcatcttcctgttcacctggggctcgctgaagctgggcgtggccgaccggcccggcggtgcgacgctgccgcagcttcacggcgtcgcggtggtggcgggcattggcttcacggtggccctgttcgtggcggggctggccttccccacccagccggagctgctcacggaggccaagctgggcattctggtgggctcgctgctttccgcggtggtgggctacgcactcttgcgcttcgtggcgaaaccggccgtcccggcgtaa

SEQ ID NO: 8631 - DNA, 1554 bp, Myxococcus xanthus
cagcgcgcctccaccgcgcggcgcttccgcatgctgctcaacgacctgggccccaccttcgtcaagctggggcaggtgctgtccacccgcgccgacctgttgcccgccgagtacatcgacgagctggccatgctccaggaccacgtggagcccatctccctggaggatgtccgcgcgcagattgaaggttcgctcggcgccagcgtggagagcctcttcgccaccatcgactcggcgccgctggccgccgcgtccatcgcccaggtgcaccgcgcgctgacgttggagggcgaagaggtggtggtgaaggtgcagcggccaggcatcgccgagcgcatcgactccgacctgggcgtgctgcgcagcctggcgcgcctgctggaggccgtggtggaggagacgggcgtgtacacgctcaccggcatcgtggatgagttcgaccgggccatccacgaggagttggacttcatcaacgaggccaccaacatccgggccttcctggagaaccaccgcgagcggccctacctcaagattccgcgcgtctactccggcctgtccagccgcacggtgctgaccatggagttcatccgcggcgtgaagctcaaccccgcggagctgagcgagcccgagcgcaaggccattgcccagaacatcctggacgcctccttccggcagctcttcgaggacggcctgttccacggcgacccgcacccgggcaacctcctgctgctggaggaccaccggctggcgctgctggacttcggcgtggtgggccggctgtcgcgccccatgcaggagacgctggtcatgctgtgcctggcggtggcgctcaaggacagcgaatccgtggcgcgcatcctctaccgcgtgggcgtgccggacgcgcgcgccaacctggtgggcttccgcaacgacatcgaggcgctgctcggccagcacctgaccacgacgctgggacaggtggacacgcgctcgctgctgagggacttgctggacctggcggtgaagtaccgcatccgcatccccaaggagtacgcgctgctcagccgggcctccgtgtccacggagggcatgctgcgcagcctgtacccggagatgaacatcatcgaggtggcgctgccgtacgccaaggagctgctcgccgggcgctacgatccgatgcagctccagggcgggctgatgcgcacgctgctgcgcttccaggccatggcgcaggacctgcccacgcagttgtcgcagatcctgctggacatggagtccggcaagttcaccgtcacggtgcgcgcggaccagttcgaaaagctgaatgagaacctgcgcagtgcggcggtgattgccttcatgggcctgtgcgcgtgcgggttcatcgtgggcgcgttcatctccttcgcgcccaagccgtggatgtacggcaacgtgccggtgctcggcgtggtgggcatcgcggtggcggcggccttcttcggcgcggcgattacctggtacctcttcggcggccggggcctgggcaaggtgcgcttgagccgcttcctcaagaagcccaagcgcaagtag

SEQ ID NO: 8632 - DNA, 441 bp, Myxococcus xanthus
atggcgctcggcgtgctgctcgccgcgccgcccgcctgggcggagaagccggccaagcccacgagcaggcccgcggaccggcactacatccggaagatccttccatccaagctgccccccaaggacaagaacaccgtcatcgagtcacgaatcgatgtcagccgggatgtgaaggagatcaacgagggcaaggccaagaagggaaacgagtccgggaccgtgacctggaccatccacaagcggacctacggtgcccacacgaatggcacgctgtttcccatccggggcgtcgggttccatgaactgaatcgcggtggcttcaaagcgctggaggtctacaaccagttcaaagacacgccacgcgccacggaaatcatggacaaaatcggcatcccgcccgcagatagaaaggcagcgctcaaggctcacaaagccgggtga

SEQ ID NO: 8633 - DNA, 427 bp, Myxococcus xanthus
atgcatcccgaacgactgattcttggatttctcgtgcgcggcgacgtgagcgaagcacgcctcttcgagggcatcgcgcgcgcgcttggcgttcctcccgacggaacagcccgcttcgacatcgaccgcccgtccgacgcggccgtgctcgtcgatgtcacgctccggcccgcgggcttccgcaccgatgtgtccctctacgtggatgtctcccgcgccagcggcgcccgtgggctcacctccgtggcggtggcgacgcgggtagctgccctgctcggggaggaggtcatcgtctcgcctcccgcggacgaccccgctgtcgccagcacctggttcctcgtcacccccgacggcaagcgcttccgggccactgaagcctcgctgggcgaggatgaggacgccgtcgatattgaccgagccaccggcg

SEQ ID NO: 8634 - DNA, 2703 bp, Myxococcus xanthus
atgacgcccgaggtggggccggtgaacgagggtgcgggcgcccgggagattgcctccctgacccccatgatgcgccagtacatggaggtgaaggcgctccacccggactcgctgctgttcttccggttgggtgacttctacgagatgttcttcgaggacgcggtgaaggcctcggagatcctccagatcacgctcaccgcgaggtccaagggcgcggacaaggtgcccatgtgtggggtgccctatcatgccgcgcggcgctacatcggccggctcgtgtcggaagggctgaaggtcgccatctgcgaacaggtggaggagccgggcaacgggccgggcatcgtccgccgggaagtcacgcgggtgattaccccgggcatggtgctggacgaagaggtgctggagccgcaggccagcaacttcctggccgccgtgtcctggaacgacaagggctggggcgcggcgctgctggaggcgtccaccggcgagttcatggccctggaggccccgggcatcgcggagctggcggagtcgctgtcgcgcgtggagccccgtgaactgctggtgccggacgggaagcgggacgcgccggaggtggcgcagctgctcgcccggctggtacgcacgccggcggtagcggagggcgaggccgcgtcattcgaacccacgcgggcggcgggctacctgcgcagccatttcgcggtgcagtcgctgtccgcattcgggctggatgacgcgcccctggccgcgggcgccgcgggcgctgcgctgcgctacctgaaggacacgcagaagacggcggcggcgcacgtggaccggctgagccggcaggagcgcggcggcaacctcctcatggatgagtcctcccgggccaacctggaggtactgcgctcgctgcgggacggtgggcgcaagggctcgctgctgggcgtgttggacaagacggtgacgagcctgggcgcgcgcaagctggcgcggtggctggcgtctccgctgggctccctgccggaaatccacgcgcggctggacgcggtggaggagctgtccgggcgcagcgtgtggcgcgaggagctcgctggcatcctcaaggaagtaggagacctggagcggctgtgcggccggctgtcgctgggcgcgggcaatgcacgggacttgcgcgcgctgggcttgtcgctggcgcagcttccccgggtggtggcggtgctggcgcggtgtgagtccccgctgctcaagtccctgacggggcccctttccgcgctgccggagctggcggagctgctgtcgcgcgccgtggcggaagagccgccggtgacgctgaaggacggcggcatgattcgcgccggcttccacgcggagctggacaagctggtggcgctgtccacgtccggaaaggacctgctgcttcagatcgagcagcgggagaaggagcgcaccggcatctcctcgctgaaggtccgctacaacaaggtcttcggctactacctggaggtgacgaagtcgaacctcgaccgggtgcccaaggattacatccgcaagcagacaacggtgaactccgagcgcttcgtcaccccggagctgaaggagtacgaggagcaggtgctcaccgccgaggagcggcggtgcgcgctggaaattcagctcttcgaggagctgcgcgcgcaggtggtgtcggcggcgccgcgcatccggtccgccgcggaggcggtggccactggggacgcgctgctgtccttcgcgcggtgcgcggcggagtacggctacacgcggccggaggtggacgcgtccgtggcgctcagcatcaccgccgggcggcacccggtggtggagcgcatgctgggggcgggggattcgttcgttcccaacgacgtccgcctggatccggcggaggacgcgcagctgatggtgattaccggtccgaacatggccggcaagagcacggtgatgcggcaggtcgcgctgacggcgctgatggcgcaggcgggctcgttcgttccggcgaaggcggcgcgcatcggcctgtgcgatcgcatcttcacgcgcgtgggcgcggcggacaacctggcgcgcggtcagtccaccttcatggtggagatgacggagaccagccacatcctccaccacgccacgaacaagagcctcatcatcctggatgagattggacgtggcacgtccaccttcgacgggctctccatcgcctgggcggtggcggagcacctgcacgacacggtgggggctcgcgcgctgttcgccacgcactaccacgagctggtggacctggcccgcgagcggccccgggtgaagaacctgtgcgtcgccgtgaaggagcagaacggcaaggtcatcttcctgcgcaagctggtgccgggtggggccagccgctcctatggcatcgaggtggcgaagctggcgggcctgcctccggaggtcgtggggcgcgcgcgtgagttgctccagaacctggagtccggggagctggatgacgcgggccggccccgggtggccgtgcggcagccccagggcggccggcgtggggcttcgaccgggcagcttggactgttcggcatggagccggcgcagggtggcaccggggtgacgcccgcgcagcagaaggcgctggacgcgttgaagggggcgagcatcgaccggatgacgcccctggacgcgctcaacctgctggcgaagctccagcgcgagctggagtag

SEQ ID NO: 8635 - DNA, 465 bp, Myxococcus xanthus
atggctgagtacaccgacccccccatcaacaacgccacgccggtcaaggagcgcgacgaaccccaggaccttcagggcttcctggacgagctcggcaacagccgcgagttccaggtgaatggcgtggacgcccggaagggcgcggaggcggtgttctgcacgctcgcgcggcgcctgtccgacggagaggacctcaagctgctctggtcgctggggaagggcggcattggcaccctcctcgggacgtgcaacatccaccggggcccgtcccacgcgaagcgcatgggccgcgcggagttcatcaccgacgtggcggaccacctccgcatccccggggatcaggcgctgcgcgtcctgacggtggtgttcaccgccatccgggatcggattccagacgacgaggtggcggccgtggcctcgcagctcccggcggacctcgccgacctgtggcgccggcccgtgtag

SEQ ID NO: 8636 - DNA, 1119 bp, Myxococcus xanthus
atggtccagaggctcagcgaggcggtgcccatcgagcgctgcgaggtttctgcgtacgaggtcccaacggacgcgcaggaggcggacggcaccatcgagtgggacagcacgacgctcgtggtggtggagttgacggcgggaggcacgcgcgggctcggctacacgtacgcggacgcgtcggcggcgagcctcatccgctgctcgctcatccgggcgcttgagggacacgacgtgatggacgtgccggcgcggatgcgctcattgctgaggcaggtccgcaacaaggggaggccggggctggtggccatggcgctctccgcggtggacgtggcgttgtgggacacgaaggcgcgcttactggacgtgccgctggtgcggttgctgggcgcctcaagggatgcggcacctgtctacggcagcgggggctttacctcgtactccatcgagcggctccaggcgcagctcgccggctgggtggagcaggggattccacgagtgaagatgaaggtgggcagccaccccgaggaggacccagcccgggtggaggccgcgcggcgcgccatcgggccacgcgcggagctcttcgtggatggcaacggtgcatacacggtgccgcaggccctcttgctcgcggagcgcttcgtagcgcacggcgtctcctggttcgaagagcccgtctccagtgatgacctggaggggctccaccgcctgcgagctcgcgtccccgccggcatggccgtggcggcgggcgagtatggggacagcggcctctacttccggcgcatgctggaggcaggcgcggtggatgttctccaggcggacgccacgcgctgcctgggcatcagcgggttccttcaggcagacgcgctgtgcgatgcgttcggcgtgcctctctctgcccactgcgcccccgcgctccatgcccatgtggcgtgcgcggcgcggcgactggtgcacatcgagtactttcacgaccacgcacgtttggagcggatgctcttcgacggcgtggcttcggtcaggcatgggacgctcgcgccggacctgtcacgtccgggcctggggctggagttgaagcgggcggacgcggcccgctacgaggtgggcgccccctcctga

SEQ ID NO: 8637 - DNA, 1407 bp, Myxococcus xanthus
atgagcgccaccgtcgccgattatctgctctaccgcctgacccagtggggcatccgccggctctatggctatccgggcgatggcatcaacggcatcatcggcgcgctggggcgtaccaccgagctccggttcatccaggcgcgccacgaggagatggccgccttcatggcgtgcgcgcacgcgaagttcacgggagaggtgggcgtttgtctggctacctccggccccggtgccatccacctgctcaatgggctctacgacgccaagctggaccaccagcccgtggtggccattgtcggccagcaggcacgctcggccctgggcggccattaccagcaggaggtggacctcaccacgctcttcaaggacgtggccagcgagtacgtcaccatggtgacgaagacctccgccgtccgccacgccatcgaccgggcagtgcgaatcgcgctgaaccaacgctctgtgacgtgcgtcatcatcccgaacgacttgcaggagctggagtaccagaagcctccgcggaaacacggcaccgtccactccagcgtggacttcagcccgccgtacgtcattccccaggagaaggacctgcgccgcgccgccgccgtgctcaatgccggcaagaaggtgtccatcctcatcggcgcgggtgcgatgaacgccgccaacgaggtggtggaggtggccgacctgttgggcgctggggtggccaaagcgctgctgggcaaggcggtgctgccggacgcgctgccgttcgtgacgggcgccatcggcctgctggggacgaagccctcgtgggacatgatgatggactgcgacacgctgctgatggtgggcacgagcttcccgtactcggagttgctcccaccagagggccaggcgcgcggcgtgcagatcgacatcgacggtcgcatgctcgccatccgctaccccatggaggtggcgctcgcgggggacagcaaggagacgctgcgcgcgctgattcccatgcttcagcgcaagcaggaccggagctggcgcgagcagctcgagaagggcatccgccagtggtggaagatgctggaggcgcaggcgatgaattcggccgaccccatcaacccccagcgcgtcttctgggagctgagccccaagctgcccgacggcgtcattctgaccgcggactcgggctcggggacgaactggttcgctcgcgacttgaagatgcgcaaggggatgctggcgtcgctgtcgggcaacctcgccaccatgggctgcggcatgccgtacgcgattggggcgaagttcgcattcccacaccggccggtgctcgccatggtgggtgacggcgcgatgcagatgaacggcaacgcggagctcgtcaccgtggcgaagtactggaaggagtggaaggacccgcgcttctttaga

SEQ ID NO: 8638 - DNA, 633 bp, Myxococcus xanthus
atgcaccccacatcagtgtttcactggaaggaccgcgccgaaatgcttgcgttcgtgcgcgctcggagcttcgcgacgttggtcgatgaatccctgcgggtggcgcaggtcccgttcatcgtcgacgaggccgcgagtcgtctgctttgccacttctcacgcggcaacccgatgtcgcgggcgttgccgatgcgagtcgtcgcagtggtcaacggggccgacgcctacgtgagcccggactggtacaagagccacgatcaagttccgacgtgggattacgagagcgtcgagatcgtcggctcgctcacgcccgtcgacgacacgctcctgcgcgatatcctcgccgcgctgagcgcggagcacgaagcacgcatcccggacaaggctccgtggacgatgaacaagctgcgccctgcgacgctggacaagatgctcacaggcatcgtcggcgcggcactctcgatcgagtccatccgcggcacccagaagctctcgcagaacaaatccgacgacgacttcgacggcgtcgtcgccgcactggagcggagcccgtcgcagcacgatcgcgacgtcgcggcgcgaatggcactcgtgcggcgtcgccgtgcggaggcactcactggacgcgcttga

SEQ ID NO: 8639 - DNA, 414 bp, Myxococcus xanthus
atgtccgcggaggggtcgcccttctcgcgcgtcgcggcctacgaggtgctgccttcgggcttcagcgccgtgggcgacggcatgccggagcgattgccgggcatgcgcgtgacggcggacttcttcgagaccttcggcgtgaggccgaggctgggacgcggcttcctgccggaggaggatgtggtgggcgggcctcgcgtggtcgtcctcagcgagagcctgtggcggcggcgcttcggcggcgcgccggacgtggtgggccgctccatcgtcctcaacgacgagccctatacggtggtgggcgtggcgcccgcgtcgttcgcgtaccccacgggcgtgcacctgtggacaccgctaccagctcgacctcacggaccggaccaactcccacttcctcttcgtggccggcaggct

SEQ ID NO: 8640 - DNA, 321 bp, Myxococcus xanthus
atgaagcctattgactggcatggcctctgggtgccggacctgcacccctttgaggtcatcatccgcgtctcgctggtgttcctcttcgtgcagttcgtcctgcggttggttggacgcaaggagctgagccgctacgtaagcttcgaccttgccctggtgcacggcaacctgcgcaagacgcgcatctcccacaaggagcttctcagccacctgcgcgcgcatggccgtggcgacctgagtgccgtacacgcggcattcctcgaaccgaatggcaaggtgaccttcctcttccgcgaagagggaagcgccacactcaggtaa

SEQ ID NO: 8641 - DNA, 3090 bp, Myxococcus xanthus
ctggaggcagcgctgcgccgctccgtggagggcgaggtccgcttcgacaatgggagccgtgcgctctacgccacggacgcctccaactaccggcaggtccccctaggtgtcgtcgtcccccgcagcctcgacgacgtcctcgccaccgtgcgtgcctgccgtgaatacgacgcccccttgctgtcgcgcggcggaggcacgagcctcgccggccagtgctgcaacgtggccgtcgtcatcgactggacgaagtatctgggccgggtgctggaggtggatcccggcacgaagacggcccgcgttcagcccggcaccatcctggaccacctgcgcgacacggccgagcagtaccacctcaccttcggcccggatcccgccacgcacaaccactgcaccctcggcggcatgctgggcaacaactcgtgcggctctcatgcccagatggccggccccgtctcgcacaacgtgcgggcgctggacgtgctcacccatgacggcctgcgcctgaaggtgggtcccaccagcgacgcggagctggaagccctcatccgcgccggcggccggcgcggggacatctaccgcaagctgcgcgagctgagagacaggtacgcggaggagattcggcgccgctacccgccgattccgaggcgcatctccggctacaacctcgacgcacttcttcccgagcacggcttcgacgtggcgcgcgccctggtgggcaccgagggcacgtgcgtcaccatcctggaggcgacgttgaagctcgtgcccagcccgccgcaccgggtggtggtgatgctcggctatccggacatctacatcgccggagaccacgcccatgagctcgccgagcgcttccacccgctcgcgctggaggggctggatgacgaactcatccacaacgtcgtcctgaagggccgcaccagccagatggagtccctccatcccatgagctcgcacgccgagttcctcgacatcctcccacagggccagggctacctcatgctcgagctcggcggcgacacgcgggaggaggcactcgagcgagcccgcgagctgatggatgcgctgcgcacgggccgcggcgctcccgtggacatgcggctgttttcggacagggaacacatcgaacacgcgtggaaggttcgcgaggcgggactgggcgccaccgcgcgagtgccaggcaagccagactccggtcccggttgggaggactcagcggtgcctcccgagaagctgggggcctacctgcgcgccctgcgcaagctgtacgacaagtacgggtatgatgcttcgctctatggccacttcggccaggcgtgcgtccatacgcgcatcgacttcgacctcacctcatccagaggcatccagcagtaccgcgccttcatcgaggaagcggtggacctctgcgtgtccatgggaggctcgatgtccggcgaacacggcgatggccagtcacgcgccgagttcctcccgcgcatgtttggcctggagctggtgcaggccttccgcgagttcaagagcatctgggatccgcaggggaagatgaacccgggcaaggtggtggacccgaaccccatcgaccaggagttgcgcctgggccgggacttccgggcgcgcacctggaagccgcggacgcacttcaagtacccggacgacgacggcctgctgtaccgggccaccgagcgctgcgtgggcgtgggcaagtgccggcgggacggcggcggcaccatgtgccccagctacatggtgacgaaggaggagaagcacaccacgcgcggccgcgcccacctgctcttcgagatgctccagggcgaggtcatcaagaacggctggcgcgacgacaaggtgaaggagtcactggatctgtgcctggcgtgcaagggctgcaagggcgactgcccggtgcaggtggacctggcgacgtacaaggcggagttcttgtcgcactactaccaggggcacctgcgcccgcggcccgcctacgccatgggcctcatcatgctctgggcccgcgcagccatgcgggcccctcgactggtgaatgtcctcaccggtttcccaccgacccgtatgctgctccagaggctggccggcatgtcgacgcagcggaagatgccgcgcttcgcgcccgagtccttccagcgatgggtggcgcgccggccggtgtcgaaccagcatggccaccagcgggtgatgctgtggccggacaccttcaacaaccacttctttccggagacggcggcagcggcgctggacgtgctggaggacgcgggcttcgaggtggtggttccccaggggttcctgtgctgcggccggccgctctacgacttcggcatgctgacgacggcgaagtggatgctgcgacgcacgctggagagcctccgccgggagattgaggcgggcgtgccactggtgggtctggagccgagctgcgtgtccgtctttcgagatgagctgcgcaacctcttcccggattgggagctcgccacacagctccgccgtcagacgttcctcttcagcgagttcctcacccggtacgcgaaggacgtgcccctgccccacatggcgaagaaggcggtggtgcacggccactgccatcacaagtcactcttccagatgacggacgagaaggccgtgctcgacaagctggggctggattacgaattcccggagacgggctgctgcggcatggcgggctcgttcggctttgaagctggagagaagttcacggtctcccagcaggtgggcgagcgcgtgctgctgcccaaggtgcgcgccacgccccgggacgcgctcgtcatcgccgacggcttcagttgccgggagcagattgcgcagaacacgaaccgccgggcgctgcacatcgcgcaggtggtgcagatggccaaggcgtacgggagcacgggcccctcgggcgatttccccgagcgcggctgggtgacgaaggggctggggcggccgccgcttcggcgcccacgcaccgcggtggtgctggggggcctgctgctcctgggcctgcggcggctgagcacctcgcgcgcccgtccggcaccacggcgccgtctgagccgtgtctacagcgggtag

SEQ ID NO: 8642 - DNA, 879 bp, Myxococcus xanthus
ctctatgccgctggcacgcctgtcaacggcagcgaggcgtcgctgcccggcctgtcccgcgaggacgtgctcgcgtacgcgaagaaccacctgggcgcggaccggctcgtcctgtccgtggtgggtgacttcgacgcgaaggcgctcgcgaagaagctggagtcctcgctcggcggctgggcgcgcgccgccacgcccgcgcccaccgtgcccgccaccgccgcctccaagggccggcgcgtgctgctggtggacaagccggacgccacccagacgtacttctggattggcaacaccggtatctcccgcgatgacccggaccgggcctcggtgcgggtcgcggagacggtgttcggtggacgcttcacctcgctgctcaacacggagctgcgcgtgaagtccggcctcagctacggcgccaactccgtgttcatccgtcacacgcgtccggggcccgtcatcatcgcctcgtacacgaagacggagtccaccggccgcgccatcgacctggcgctggagacgctcgccggctaccggaagtccggcatggatgacgccatgctcgcctccgcgaagtcgtatgtgctggggcagttcccgcccacgctggagaccgggacgcaggtggccggcaagctgtcggagctggccttctatggcctggatgccagcgacgtggatggtttcgccagcgccgtctccgccacgacccgcgagggcgtgcacggcatcatccagcgcaagctccccgcgccggaggacctcaccttcgtcctcatcggcaaggcgtcggacatccgtgaggcggctcgcaagtacggcaccgtcacggagatgaagatttccgacaagcacttcgcgccgcccgcgaagcgctga

SEQ ID NO: 8643 - DNA, 882 bp, Myxococcus xanthus
atggacgcggggacgctgccggacgggaccccgctggcatattcggccctggtgcgcagcgtggagatgggggcgttcgacttcgtcccggatggcatcacccccatgccgttgacgggcgtcatgcgctccgtgccgatgacggagttccccatcgagtggcgcctgccggacttcacccggtacgtacacgcggtgcacccgctcgccacggccagctacccctccttcttcgtcatgcccgcggcccacggcctgagcgacggctgggtggggtactcgggggaggcgctctccctgacgttgccgcggggcacttcgttcgacttcacccggcgcttgtcgtacggaaacccgttcccatcctcgtgggagatggtgggcggagcgcagtactcattccgcgtccaagcggaggtgccggggggctccgggctccggctctacctatccggcagcatgtatacctacgagcgactggatagcctcgtcgcaggacccatcctgccgcgcgtgtctccgcctcgtgagctgaccattgacggtctgcccgccagtgattcccgtgaggtgggctccgcgagtcccgtcatcgcgtggctgcctcccacggtggggtcacccgccgcctaccggattgccatctaccggttccgggaggacttccgtaccacggtgctgcatggcaccgtgaacgtgcccggctcggtcacccaggtgcgtctgccgcccgggacgctggcgccagagggcatctactacctgcgtgtctcggccgtggatgctccgcactacgagatggagcgcttcccgttcagcaccgtggaccggttgcctcaggcgcgcgcggacactctcagctcgttcttcaccaccccgtga

SEQ ID NO: 8644 - DNA, 420 bp, Myxococcus xanthus
gtgctgcgcaccgacaagggggacatcaccgtgcggctggacgtggacgaggcgcccctcacgtcgggcaacctccacgcgctggcgcgcaagggctatttcaacggcgtcaccttccaccgcgtggtgccggacttcgtcgcgcagggcggagacccgcgcggggacggtgagggcgggccggggtactccattcgctgcgagatgacgcgtcggccctacggccgaggcaccctgggcatggccctggccgggaaggacaccggtggcagccagttcttcttcacccacgccccgcagccgcacctggacggccgctacacggcctttggcgaggtggtgtccggcatggacgtggttgacgccctcctggaaggggacgtcatccgcgaagcgcgcgcggtggagctggcgccctga

SEQ ID NO: 8645 - DNA, 1002 bp, Myxococcus xanthus
atggcaaaagccccggaagggcccgtgccggtggtggtgatggggctggggttcatcggtcaggaaattgcccgggctgcgatgtcttcacctgaggtggagctcatcggggccgtggacgtgcaatccggcctggtgggccgccccttgggtgatgtcctgggaagtcccgcccctcgtgtgaaggtctccgcgtcgctggcgcaggccgtgggcaagcgcaagggcgtggtggtgctgcatgccaccggctcgcggctgcccaaggtgttcgaccaggtgatggaggcggtgaagctgggactgcccgtggccagcacctgtgaggagctggccttcccgtatctgaagtacccggagctggcggacgaactggaccaggcggcgcagaaggcgggcgtcgccgtggtggggaccggcgtcaatccgggcttcgtgctggaccgtctggtggcggttgccggacaggtgtgcggtccggtccgtcgtgccaccgtcacccgcgtggtggatgcgcggacccgccgcccgtccttgcagcggattgtgggcgcggggctgtcggaggaagagttcttcgagctggtggacagtgagcaactgggccacgtcggccttgttgagtccgcggcgctcgcggccctcggcctggggctggattgcgacgacttcgaagaagaagtagcccccgtgttcgccgaggaggacatctccggcggcgcgtttcccgtcaggaaggggagggtggctggcatgttccagtccgtggtggggttggaggacggacaggagcgggtgcggctggagctgaccatcgcgatgggggcggatgaccccaaggaccgtatcgaaatcgacgctgacccgaagctggtgttggaaatcccggggggagtggcgggcgaccgggccaccgcgaatgcgctggtgaatgccgcgccacgcttgacggccgccgaagctgggctcctcacggtgctcgagcttccggccggacgctag

SEQ ID NO: 8646 - DNA, 446 bp, Myxococcus xanthus
ctggacaagaacgcgatcggtcgcgcctcgccgccgacgctgaacgaggtcgaaaaggcgccatccgtcggttcttttaggtcatcggggattacaaccccatctactacgatgaggagtatgcccgggcgtcggggtatcccaccatcatcgcgccccccacgttccccgcgtccttccactcggcggcggacctgcgggagctgctgggcgtgggcatcaagagcctgctccacgcggagcagggcttcgactacgagcggcccatcttcgcgggggaccgcatctacgtctccacgcgcgtctccgacgtcttcgagcggccgggcatgtccgggaagatggacatcgcggtcatcgaggacgaaggccgtgacgaggaaggcaacctcgtgttccgcgcccgccggacgctggtggtccgcgccgccaaggagaccccgtga

SEQ ID NO: 8647 - DNA, 585 bp, Myxococcus xanthus
  unsure (1)..(585): unsure at all n locations
atgcccgcgcgcaagttgtacttcgaagccatccgcgtcggggacgagctgcccgcgctggccaaggcgcccgtcgaccgcgtccaactgtcgcgctacgccggggcgtccggagacttcaacccggtccacgtggacgagctctacgccaagagcgtgggcatgccgagcgtctacgcgcccggcatgctcgtcatgggcatgctcggccagctcatcagtgactgggcccggggcgggcagatgcggcgctacaacgtgcgcttcatcaagatggtgtggccgggtgacaccgtcgtctgcaagggccgcgtgagcgaccggcacggctccgggggccgctacttcgtcgaaatcgacctctgggcggagaaccagaagggcgaactgctgatgaagggctcctcgcagatccagctcttctattcgctggaggacgagaaccggcagcgctccggccagtcccccatcgtggtggaggtgcctcgggagagcctgagcagcgccgncgcgcccgcctccgccaccagcgccgttcccagcgaggggggcgaccaggcggacgagcgccgcgagggcgtcacc

SEQ ID NO: 8648 - DNA, 1185 bp, Myxococcus xanthus
cgtggccgcgcatggctgggcatgctggtggcactgggttcgatgactgcatgcgcgccgcgcggagcgggctcggcccagccgtccattccaccaccgccccggctctccgcgtctcaggtcgcgaagctgatgccgccgcagctccaggaccgcgagggctgggcgcgcgacgtgctggccgcgctggaggtggaggagattgccccgtcaccgcccgcggtgtgctcggtgctggccgtcatcgaacaggagtccggctacaaggtcgacccggctgtcgcggggcttccgaagatggtccgcacgcgcctggaggagcacgcgaacaagctgggccccctgggccgcaaggtcctggcgtcggtgctggaagggcgggcgaaggggagcaagaagacgttcgacgaacggctgcgcgcgctgcgcaccgagcgcgacctggaccggctcttccgcgacatgctcgcgtactacgagaacgaattcccgagcgccttcaaggtcgtggacttcgccagcggcgtcttcgcttcggggaacctgcacgagttcaatcccgtcaccaccgccggctccatgcaggtgagcgtgcgctatgcgatgcagaaggcgggcgaggacgcggacccggccgaggtgcgcgagtcgatgtacacccgcgcgggcggcgtgcgctacggcaccgcgcggctgctgggttacgaggccgcataccccgagcccctcttccgcttcgcggactacaacgcgggcgtctatgcctcccgcaacgccgcgctccagtcacaggtgagccgtctcaccggccaccccctggcgcccgacggagacctccagctctacgacaagcaggggcagccgcgcagcgaggacagcaagtcgctgctggcgctgctcgccttccgtcagcgcttcgccccggaggagctcagcgagcgtcaggtgcgccgcgacgtgcgcaaggagaaggagccggacttcgaatccaccgacacgttccgcgcggtgaaacgtgtctaccagcgggaaacgggcgaatcgccgtcctacgcccagcttccccgggtgacgctccagagcccgaagctgaagcgggagctgaccaccgcgtggttcgcgcgctcggtggaccagcgcttccagaagtgcatgacccgctaccgcgcgctgacggcgaagtag

SEQ ID NO: 8649 - DNA, 945 bp, Myxococcus xanthus
atgtacgtcgcggcgagccccgaccagtccgtctacgtcgtcgccatcgcgggaaccaacgcgtcttcccaatatgacaagaatatcgaggacaacagcgtcaacaccaccaagctctggacgactgcgttcccgaacctgccgtcctacggagtgccttcgggaatcaatccctggcccgttctctcgacggggaccgcgctgggcgtcaacaatctgctgggcatgaccgacacgctgatgacccagcaaaccttggtggaatttctacgctcggtgagcgcgacgggttcaaagacgctcatcttcagtggccacagtctgggcggcgcgctggcgccgacgctcgcactcgccctgttcaatccatcaggcgggccactcagcactggggactgggaccacgtctacgtgctcccggccgccggtcccacccctggcaaccagggtctctccgagttcttcgagcgggtgttcccgccggtcagcctgaacctgccccagccccaatacgcctggaaccagaacatctggaacagcctcgacgccgtgccacacgcgtgggtcgtcgacagcctcaaggagattcccaccctctatcccgcgaactgggagggtggacaggtcccctcggacatcacgaaactggtcaacctcgccgtcgcggcctcggaacttggcggcgcccttcctggcccctacacgcaactccccaacgtcaaggtgccaggcaccttccacggcaccaatcccatcacgaccgaagcccaattctgggccgaagtcgggtaccagcacctggatgcctatcaaatcctcttcggtgtccaatcgctggtttccgaaggctcccagtccgcactccagaagatgttcaagcggtggctgggctccttctcgcgaatgaccacccagagcgtgagtcgcgccgcggctgcacgctga

SEQ ID NO: 8650 - DNA, 1116 bp, Myxococcus xanthus
atggatcgcatcctcgtcgtggacgacgacgtcctcatcctggccgccctgtcacgcatcctccaggcggaggggtacgacgtcgtcacccacagcgacccggcggtggccgcccgggaggtcggcttccaggtcgtgctgacggacttcatgatgccgtacctcaacggcatcgaactgctcagcgcccttcgggagaagaaccccaaggcggtgcggctgatgctgacggcggcggcggacttccgcaccgcctccgaagcggtcaaccgcggcgaggtcttccggctgctgggcaagccctggtcactcagcgacctgacgaacagcgtccggcaggccttcgcgcactaccgcctggtggacgccaacgagcggctgtcgcgcgaggtcgcggagaagaacgcggagctggtggccatcaaccgcgacctggagcggcgggtggtggagcgcaccgcggggctgctcgacgggctcatcagcgccctggactaccgcgatacggagacgcagtggcactcgcgccgcgtgtcgctctactcccgccggctggcccaggaggtggggatgacgggcgcagcgctggacgtggtggagcaaggcgcgctgctgcacgacatcgggaagattggcgtgcgcgactccatcctgctcaagcccggtccgctcacgccggaggaatgggtggagatgcgcaagcacccggagttcggctaccggatgctggcgaagatgccctacctgcacgaagcggcgctcatcgtgctccagcaccaggagcggtgggacggcaagggctacccgcagaacctggcgggcgaggacatcgtcctgggcgcgcgcatcttctgcctcgtggacacggtggatgcgatcacgtccgaccgcccctaccgcaagggccggcccatgagcgtggcgcgggatgaaatccgccgctgcgcgggcacccagttcgacccggcgctggcggaggccttcctcaacattccggagacggagtggcagcgcatccgccaggaagtcgaggccttggaagcggcggagaacgagcgctggaacagcgacccgctcggtcctcccgcgcccctggcccgtgccagcggcgcctga

SEQ ID NO: 8651 - DNA, 282 bp, Myxococcus xanthus
ctccattcgggcttcatcgccgacgcggaggcagtggacgcccgcaccggtggctggcccgacgtgcgcgtcccgacgctcatcatccacggccgtcaggatgacacctgtgacgtccaaaactcgcgccagtggtcggagggcaagcgccacgtccggctggtggaggtggacgatggccacgagctcaccgcgtcactgccgctgatcctggaggagacggaggtgttcctccaaccctggggcgcccggggtcctcgtgctcaaagctcgatgccgtaa

SEQ ID NO: 8652 - DNA, 1029 bp, Myxococcus xanthus
atgacgactgcgctgaacacgctgttcatcaccgcggaagggactcgcctgaacaaggaaggcgagtgcgtggtggtgacggttcaagaccagaagaaggcggaggttcccttgcggcacctgcgctcggtggtgtgcctgacgcgcgcgtggctgacgccggagttgatggagagctgcctggaggcgggcatccatgtctccttcttcgggatgacggggcgcttcctggcgagggtggagggcgtgccgggcggcaacgtcttgttgcggcggcagcagtatcgggcggcggatgatatcgctcgctcggtggccatctcccgggcgctggtggtggggaagctcgggaatgcgcggcagtttgtgttgcatgcgcggcgtgacgcggcgcccgagcgacaggaggccctgtcggagacggcgcggcggctgtcggagcacctgcgcgcgctgacccgcgtggaggacttggtgcaggtgcgagggctggaaggcatcgcggcgcgcgactacttcgagtcctttcccgcgctgctgaagaagagtgcccagggcttcgagttcgatggccgcaaccgccggcctccgaggaatccgctgaacgcgatgctctcgtttggctatgcgttgctggcgcaggattgcgcgggagcgctcacgggtgttgggctcgaccccgccgtggggttcctgcatgaggaccgccctgggcgcctgtcgctggcgctggatttgatggaggagttccgtgcgccggtggtggaccggctcgtcttctcgctggtgaaccgggggcaactgaagcccggggacttccgcacggagtcggcgggggccgtgttgctgaaggacgatgcgcgcaagacgttcctcgtggcgtaccaggaggcgaagcaggtgggggtgcggcacgcgttcctggggcaggagacgacctggggcatggcgcctcacctgcaagcgttgctgttggcacgccatctccgaggggagctggacggctaccctcccttcgcgatgcgctga

SEQ ID NO: 8653 - DNA, 642 bp, Myxococcus xanthus
atgagcacggaccgcgagacgtgggtggcgctgtcggcgctccagcacctgctgtactgcgagcggcaggcggcgctcatccacgtcgagcggcaatggcgcgaggacgtcaacaccgcctccggcagactgctgcacgagcgcgtggacctgccgggacatgacgcgcggctgggacggcgggtggagcgggccgtgttgctgggctcgcagcggctgcgcgtgtccgggcgcgcggacatggtcgagtaccagcgggacgcgaagggggcgggctggcggcccttcccggtggaggtgaagcgcggccggcgcaaggcgggtgaggcggaccgcgtgcaactctgcgcgcaggcgctgtgcctggaggagatgcacggcgtggatgtcccggaaggggcgctcttctacggtgtggagcacaagcgtgccgcggtgcgcttcgacgcggagctgcgccagcggaccgaggacgccatcgcgcgcatgcacgaggtgctgcgccggcaggaggtccctgtcgtggcgcgcgcgccccgatgtgacaagtgctcgctggagccgctgtgcctccctggagtgacggcggggcagcggagcgctcaggacttcctgatgcagtggatggccctggacggctga

SEQ ID NO: 8654 - DNA, 915 bp, Myxococcus xanthus
atgaccgacctcaagcaacgccatgacttcgtgctgttcttcgacgtgttagatggaaaccccaacggagatcccgacgccggcaacctgccccgcattgatgcggagacgggccatgggctggtgacggacgtgagcctcaagcgcaaggtgcgaaacttcgtcctgctcacgcaggagggaaagcccgggctggacatcttcgtcaaggagaaggccatcctgaacaaccgcatcgcggatggatacaagagcctgggcatcgacctgaacgagaaacccgctcgcgcggaggatggcaagaagcgcaacgacaagggcagggcccagggctccgaggtggagaagggccgcgcgtggatgtgcaagacgttcttcgatgtccgcacatttggcgcggtgatgtccacggggcccaatgcggggcaggtgcgtgggccggtgcagctcaccttcgcccgctcggtggaccctatcgtttcgcaagagcattccatcacccgcatggcggtggcgactgaggacgaagcggaaaagcagggcggtgacaaccgcaccatgggccggaagaacaccgtgccctatgggctctaccgggcccacggcttcgtctcgccgcacctggcgaagcagacggggtttggcacggcggacctggagctgctcttccagtccttcacgcacatgttcgagctggaccgcagcgccgcgcgggggctgatgtccatgcggaaggtggttgtgttcaaacatggctcggagctcggcaacgcgccggcccacgcgctgttcgaccgcgtccttgcggtgcgcgcccagccggagaagccagctcgaagcttctccgactacgaggtccgtgtggacaaggcagggctgccccagggcatcgaggtgctggagctggtgggatga

SEQ ID NO: 8655 - DNA, 1404 bp, Myxococcus xanthus
gacgcggaggcccgggccgtggagtccttcctggacagcgaggccgagcggagcaaggcgctggcggacaggggggccgaggagtggacgggctccgagatgctcgcattcgtcgttggtgaggccacgacgcccgtgcaccagaaccccgccatccgtgcctgctgggagcgtcgcgcgggtgcgcagcgcgcgttgggtcggagggcgttgtgtctggtgacgggccgcgagggcgtggtggccgtcacgcaccccaagttgaagaacgtccccgaggcccagccgtccggggcgtcgctggtgtccttcaacgcgcccgcgttttcgtcgcatggtttggagcagggggagaacgcgcccatctctcaggaggcgtcgctgggctacgtgctggccctcaacgacatgctgcggaggacggagcagcgccgttttcgtcaaggcattcagttggcggatggctcggtgatggtgttctggacgcgcgcctctccttcggaagagagcttcctgctgtctctcctggacccgacggaggatgacctcaagcgcttcgttgagtctccgcgcaagggcgtcgagccaggagaactggatgaccgcgccttctacgccgtgacgctggcggggaacgcgggccgtgtcgcagtgcgtgattggttcgagtctcgcgtgggcgaggtgaagcagaacatccggcgctatttcgacgacctgcgcatgggcgacgcgcccgcggggccgatccccgtctatcgcctgctcaaggccgtggaggcgccctcgggacggggcctgacgccggacatcgccgcacggatgctgggggcggcgttgcgaggtcagcccttccctcgccagctcctggtggccgcgctggaccggctgcggttgccgcccgctgacggcggggtcgagcgcgagcagctccggctccgcgtcgcgctcatcaaggcgtacctgttgcgagatcgaaatcgtggatccactcccctggaggtcaccgtgtcattggacaaggacaatccttcgcagccctatgtgctcggccgcctcttcgctgtgctggagcggctgcagggcgtggcgctgaaggacctcaacgccaccatccgcgaccgctacttcggcgccgcgtctcgaaaccccgtcaccgtcttcccccggctgattcagctctccgttcaccacgcctccaaggcgggggagaacggcaggtggctggagcggacgaagggggaggtgatggccctgctgccttccaaggacccatttccgcctgtgttccagcccgagcagcagggcctcttcgccgtgggttactaccaccagcgcgaagcgttcttcacgaagcgcgaggccgccgcggctccggctgattcgacagcgtcctccacgtga

SEQ ID NO: 8656 - DNA, 783 bp, Myxococcus xanthus
atggcctccgcgctcatgaccctgtcggcgatgcccgcgctggctcagctcaaactgccggcctccagccccgccgcgaaggtgacgcaggaggtgggcgtctccgagatttccgtcgaatattccagccccgcggtgaagggccggaaggtctggggcgagctggtccccaatgacaaggcctggcgcagcggcgccaactcggcgacgaagattaccttcagccaccctgtcaccttcggcggcaaggccgttccggcgggctcctacgccatcgtcagcctgccctcgcagaagggttggaaggtgatgctgaacacggacctgggcctgtggcggggcggcgcgccctacgacacctccaaggacgtggcctcggtgagcgccaccaccacggagattccgtcgcgtgagcgcctgacgtacctcttcaccgacaccacggacaacagcacgcggctggacctggagtgggagaagctgcgcgtctccgtccccatcacggtggacacggcggccatcgcgaaaggccaacatcgaggacgcgcagaagggcattgccggcatgcacgtgagcgccgcctcctacgtggcggaggccaccaaggactacgccgccgcgctgaagcacgccgacgcggccgtggccgccaacggcacctggtacaaccactgggttcgcgcgggcgtcctgtcgcagatgggcaagtacagcgaggcccgcaaggccgcgcagaccgcgtgggacctggggcagaaggacaagaacttcttctaccgtga

SEQ ID NO: 8657 - DNA, 126 bp, Myxococcus xanthus
atgggcaagtacagcgaggcccgcaaggccgcgcagaccgcgtgggacctggggcagaaggacaagaacttcttctaccgtgaccaggtctccaaggcgctggcggagtggaagaacaagaagtag

SEQ ID NO: 8658 - DNA, 456 bp, Myxococcus xanthus
atgggactgtccttgattggcgccgaacgcggcgagcccggtgggccgacgttcaccggatggaatcccgcggagggcgtggcgctcgagcctcgcttccacggcgcgcggccccaggaggtggagcgggcctgcgtgctcgcggagcaggccgcccccacgctcgcggcgctgccctcgcgtcagcgcgccgtgttcctggagcacgtcgccgaggcgctcctcgcggcggaggcggacttcctcgccgtgacaccaaaggagaccggacttccccccgcgcgcatccagggagagctgggccgcgcggccggacagttccgtcagtacgcccggctgctggcggaaggcagttgggtggatgcgcgcatcgaccgtgccttgcccgaacgccgtcccttgccgcgtccggacctgcgctccctgctgcgcccgtggggccggtgcccaattcgg

SEQ ID NO: 8659 - DNA, 882 bp, Myxococcus xanthus
tggactggtgtcctccccgccatcaccacccccttcaacacggacctgtccgtcgaccacggcacggtgcgctcacacgtgcgctggctggtgtcgcagggatgcactggcatcatcccctgcggctcactgggcgagggcgcgacgctgagccaggaggagaaggccgcggtgatgcgcacgtgcgtggacgcggtgaaggtgcccgtcatcccgggcatcgccgccctgtccacggcggaggccgtgcagctggctcgcgccgcggaggaggcgggctgcgccgggctgatggtgttgcccccgtatgtctattccagcgactggcgcgagatgaaggcccacatctccgccgtcctgcgcgccacgaagctgccgtgcctgctctacaacaaccccgtcgcctacaagacggacttcacccccgcccatctcgcggagctggccgccgagcatgacaacgcggtcgccgtgaaggagtcctccaccgacgcccgtcgcgtcaccgccatccgcgccctcctgggagaccggctggccgtgggcgtgggcgtggacgactgcctcgtcgagggcgtggacgcgggcgcgcgcttctgggtggcggggctggtcaatgcgttccccgccgagtccgtgcgactgttcgagctggccctcgccggaaagaagcaggccgcgttcgagctgtaccgctggttcctgccgctcttgcgcctggacaccgtcaccaagttcatccagctcatcaagctggtccagcaggaagtcggctggggccacgagcgggtgcgtgggcctcggctggagctggcgggtgccgagcgcgaggagtgcctgcgcgtgctgcgcgaggccctggcgaaccggcccgcgttgtag

SEQ ID NO: 8660 - DNA, 417 bp, Myxococcus xanthus
atgggactcgccgagcgtcggcgcatcgccgccatcaaagactctcactccgcccgatttcagtcggaactcaacgcggcgattggattcgaactgccgtttgagattgatgttgcgagcttccccgaggacaagacgatcctcgactgctacgacagctactacgagtcatatggcccgggcctcgtcgtcactgtgatgaaggaaatctgcaaggatgacatgggccgtgaggccgtcagagccaagttcaacaggattgttttcctgaatgtcgccaagagtgccgacgacccgggcacgaagagtattgaaatcaaagaccaaaccctcttcgtgcgcgagagcttctacggctactcagaccagctttatggcgactctgaacttcagtcggccctcgaggcgatcctctag

SEQ ID NO: 8661 - DNA, 1278 bp, Myxococcus xanthus
atgcgtgaggcctgtgacctcgtggtcgtcggcgccggacctggcggactcgctgccgcttgccgcgcggccgaggcggggctggaggtgctcgtcctcgacacccagcccgagcccggtggtcaggtctggagaggcgaggcccgaaagggcgcgaatcgcctcgcgcgtcggtggctcacccgcttcgcggcgtcgggcgctcgcttccgtccaggcgcccgcgtcgttgccgcgcccgagccgggagtgctcctggtcgaagagggctcctcctcgttcgcggtgcgctacagccgcgcggtgctcgccactggcgcgcgcgagcgcttcctcccgttccccggttggacactcccgggcgtgctgggcgtcagcggcctccaggtgctcatcaaggatggcctccccattcgcggcaagcgcgtggtgctcgccggcacgggcccgctgttgctcgccgccgccgcgacgattcacgcccacggtggcgaggtcctctacatcgccgagcaggcctccgccgagagtcactggggcttcgccctccagctctggcgacacccgaccaagctgctccaaggcgccttgatgtccgcggcgctcatccgcgtgcccacgtccacggacgcttgggtcatcgccgccgaaggcgagggccgggtggagtcggtccgcctgtccgtgcgcggtcgcgaggaacagttgcggtgcgactacctgggcgcggcctacgggctcgtgcccaatctggaagtggcccggctgctgggctgtgagacctcggccggcacggtggtcgtgaacgagcgcatggagacgcgcgtccccaaggtccacgccgtgggcgagctgctcggcatcggcggcatggaccaggcgctcgtcaccggagagctggccggactcgtcgccgccgagcaacccatccccgtcgagctggagcgcacctggcatcgcgtccgcgcgttcgccgcccagctcgcgcggcatgacgcgccacgcgcggagctgcgacgactggccacgcccgacaccctgctgtgccgctgcgaggacgtgcccctgtccgcgctggagggctgtcagaacctgcgagaggcccggctgtacgcccgcctgggcatgggcgcctgtcagggccgcacctgcggcacggcggcgcaaaccctcttcggctggtcgggcgaggacgtgcgcccaccatgtcttcccgcgcgcatcggcagcctgcgccttccctcggacgtttcctctacccacacgagagagtcatga

SEQ ID NO: 8662 - DNA, 1137 bp, Myxococcus xanthus
atgagcgccttcgactgcgtcatcgtcggcggtggcatcgtcggcgcggcgctcgcggatgtgctcagtgccgacggcgtgtcggtggcgctcgtcgaggcgcggtccatcggtgcggggacgacggcgtgcggcatgggccacctggtcgcaatggatgacaacgcggcggagctcgcgctgacgtcgtggtccgtgtcgctgtggcgtgagctcgcggatggattgcctcgcgcggtggagtacgacgcgtgtggcaccctctggctcgccgccgatgacgaggagatggccgctgtctccgcgaaggtggccaactaccgcgccgcgggggtccgtgccgaggtgctcgacagcgcggcgctccatgaggccgagcccgcgcttgctccgggactcgtgggggcgctgcgtgtcgtggatgatgccgtgctgtatccaccgctcgccgcgcggaccttcgcgctgcgtgcccaggctcggggtgcgcggctgatgacggggagtccggttcgggagttgcgcccgggaagcgtcgtgctctcccatggggaggtattgacggcacggcacatcgtgctcgcggcgggcgtggctagtcccgcgctctgccctgggttgcccatctctccgcgcaagggacacctgctcatcacccggcgcggggctcccgtggtgcatcaccaactggtggagttgggctacctcaagagcgcgcacggcacggacggcgcttccgtggctttcaatgcccagccgcgtgtcacggggcaacttttgctgggctcgtcgcgacagccgggcgatgcgacgcgcgaagtggacgcggcgctcctggagcgcatgctgaagcgcgcggccatgttccttccggggctcgatggcttgcaggcgctgcgcgtctggacagggctgcgtccggcgacacccgatggtctgcccttgctggggcctcatccggagaagccgtggctctggctggcttgtggccatgaggggctcggtatcaccaccgccacgggcagcgcgcgactggtggcggaccaactgctcgggcacaccagcgccatcgatgcgcgtccgtattcacccgcgcgcttcctgacggtgtcctctcgggagctcgctcatgcgtga

SEQ ID NO: 8663 - DNA, 936 bp, Myxococcus xanthus
atgcggcgcattcgtgtcatcgacagtcataccgggggagagcccacgcgcgtggtgacggacggaggcccggagctgggaacgggcgacctggcgagcctgcgcgagcgcttccgcgagaagttcgacgcctttcgcaaggccatcgtctgcgagccccgtgggtccgacgtcatggtgggcgcgctgctgtgtccgcctgtcagtgcgtcgagcgtcgccggcatcatcttcttcaacaacgtcggctatctcgggatgtgcggccacgggaccattggcgtggtgaagacgctggagtacctggggcgcatcggtcctggcgtccactcgctggagactcccgttggcgtggtgaaggccacgctgcatccggatgggcgcgtcagcatcgccaatgtgccgagctaccggtgggcgcatgacgtagcggtgtccgtgccgggacatggcgaggtgcgcggcgacatcgcctggggcggcaactggttcttcctctcccgcgccacgcacctgccgctggagctgtcgcggactcccgcgctcctggcgtacacctccgccatcaagcaggcgctctcggaccagggcatcaccggtgagggcggcgcggagatcgaccacgtcgagctgtacgccccctctccgacgccgggggtggatgctcgcaacttcgtgctctgtccagggctggcctatgaccgctcgccatgtggcaccgggacgagcgcgaaggtcgcgtgcctggccgccgagggtgtgctcgcggaaggcgcgacgtgggtgcaggagagcatcctcggcagtcgcttcgaggcgcgctacgtccgtgacggtgcgcgcatcctgcccaccatcaccggcaccgcgtccgtcaacgcggaggccacgttgctggtggacccgacggacccctttgcctggggcatcggatga

SEQ ID NO: 8664 - DNA, 1293 bp, Myxococcus xanthus
  unsure (1)..(1293): unsure at all n locations
atgaagctcacgcggctcgaggtccatcactaccggaacgtcgtccctggcacctccctggtgttcagcccgtcgtacaatctggtgctgggggagaacggcaccggcaggacgacgctgctggagctcatctccacggtgctcggctcggacttctccggccgcatccacgagccgttcgcgctggagtacgacctggcgtttccgggcatgaagctgcacgtcttcgtccggaacgaggagaacgcgccggcgccggacacggaggcaccgccgagaaagggctccgcgctgatgccgctgcgcacgcccgcgctggactcctcgctgcacccgcgcatcgaagtggacgtgcagctccattcgccgtcggcccggttggtgatgcgtgcggacgcggcgggcatggactgcaaggtggacggcgaggccgtgtggtcgcggagcatgcactggtcgctgctggaccggtcggtgtggaccctgctgttcatgacggcgcagtacatcgacgcggggatgaaggagcggctcaaggagctgctgcgccgcacgttcctgctggcgccccagcgcttcgatgaagcgctggggatgtttgaacgcatcggcgccatccgctacgccatggaggtgcgggacggcgaagtgttcccgctggggttgatggcgctgcccacgtggatgccggggtggctgcgtgagcagatggagcagccagccgttacggacgtgctggagctgacgcacgacgcgcgcgaaggcagcttcctggcgaagttcgtggcgctggcgggctttgaggcgggccgcttccgcgtggaggtgctggagaagcggtcgttcgagaacggcgggcgcgtgggctttgggggctttggcttcgagttcacgcggcgcgatggccgggtcctgacgcacgaggcgttgggcttcgggcagaagcggctgctgtcactgctctattacctggacgtgaacgaggacttcgccatcgcggacgagctgggcaatgggctgcatccgcgctgggtggaagcgagcatgcgagagctgggggcgcggcaggtatttctcaccagccagaatccgctccttttcnagcacacgctgtttccgtccgccgaggcactgagggcgtcgctcctgctgtgtggcaacacgcgagaggacggaccggagcgcatcgcgtggaagaatcccacacacgaggtcgcgggccggctcttcgacgcgcacgggctgggcgcacacccgctggcggagctgctgcgccagcagggcctgtggtga

SEQ ID NO: 8665 - DNA, 948 bp, Myxococcus xanthus
tatcccatcgcgctggcctccaagatgatcgaggtcgccagctacgagcgcctggacatcctgcacgtccactacgcggtgccccacgccaccgccgcgtggatggcgcgcgaggtgctgggccacaaggcgccgcgagtcgtcaccacgctgcacgggacggacaccacgctggtgggaatcgaccccagctacctgccgattacgcgcttctccatcacgcgaagcgacgcggtgacggtgccgtcggcctacctgcgccgcgcgacgtggcggggcttcgacattcccgagagcgtccccatcgacgtcatcgccaacttcgtggacaccgcccgctatgccccggtgcgagaccgcgcctgcctgcgcgcgctcttccccgccctgcgtgaccacgagccggtgctcatccacgtctccaacttccggccggtgaagcgcatcaccgacgtggtcgccatcttcaccgaggtccaccgtcaccgtccctgccgcttggtgatggtgggagacggtccggagcgctcgcccgcggagcggatgctgcgggagatgggcctggagggccgcgtcgcgttcctcggcaagcaggaccgcttcgaggaactggtcgccgcctccgacgtcttcctgctccccagcgagcaggagagcttcgggctcgccgcgctggaagcgctcagctgcggcattcccgtggtggccagcgacctgggcggaatcccggagctcgtcacgcatggggagacgggcttcctggcgccgctgggtgacgtcccggccatggcccggcacgtgctcacattggtcgaggacgcggagcgttggcagggcttctcacaccgcgcgcgggcacaggtcctggaacgcttccagaaggaacccgccatcgaccgctacgaggcgctctaccgccggctcctgacggggcccctccgtcgctga

SEQ ID NO: 8666 - DNA, 609 bp, Myxococcus xanthus
ctgaagtcgatcgagggcgcggagcgtctcgcggtcaagagtgacttcgtcctacgaggcatggaggtgacgtccgacctgggcgaagcgctgaaggactgcgtgtacgcggtgggcacgacttctcgtacccagctcaagggacgcaccgtgctgacgccggaggaggccatgcagcggctggcggaggagagcgtgcgcggacgcgtggcgctcgtcttcggtggcgagcagcgcggcatgtccgacgaggacctggcgcggtgcacggacgtgctcgcgattcccacgtcggcggtgcagccgtccatgaacctggcgcagtcgtcagcggtgctgctgtacctctgtcaccgtcaggggctgacgcccacggccgcggtggaggaggcgccaggcgcgaagctgggcacgctgggggcgctggcgaagcgaatgagggacgtcatgctgcgcgcggagttcctcaacccgcaggcgccgcagcatgtgctgaacgagctggagcagacgttgatgcgtgcgcggctgacccagcgcgaggcggagctgtggctcacggccttcaagcacctggagcgcgcggtgacgcggggcgcctctacctga

SEQ ID NO: 8667 - DNA, 573 bp, Myxococcus xanthus
atgtccgcgcgcttgcaacccgaagaactctttcaggcggcccgtgagcgggcggcgcagttggacgtagggcgtggcgacgcggcggtggagcgggtgcgcgcggcagcctcggcccttttcgttcgtatccccgaaccgccggtgtaccgccgcgcggaggacccttcccgcaaggcggcccaggccctgctccccgaagtcgagcgggtgctggcggaggcgctggccgcggggcgggatgtctcggcggtggccccgctggagaagctggtggccgcgctgctggcccacggcgaggcgctctgccacaccgcggccggacgtctggaggccgcggagacggcctggcgccgggcgcaggagctggagcgcgccgcgcacccgacgcgccatctggtgacgtcgccgccgcgtccgccgccggtgttcgacaagggctcgcgtgtgtcgcgctatgacccgcggcccgcgcctcaggcgagcgtgaagctggtgtgcccgaacatgggctgcaagccggtggaggactacgcgtttgtcaccagtcacgcctacaaccggtgcatctga

SEQ ID NO: 8668 - DNA, 258 bp, Myxococcus xanthus
atgtgggtgagcccggcgtcctcgtgcttcgtggccacggtggcattcggcgcgggcgcgccggagctcgtggccttccgcgcctaccgcgacgacgtgctgcggaagagcgcgccgggtcgggtgttcatccggggctactatcggtggggccctgacgtggccgcgtgggtgtcgaggcgcccggcggcgcgtgagggtgtgcggtgggtgctgcggcgggtgcatggccgcctgaccaggagtggattcgagtga

SEQ ID NO: 8669 - DNA, 429 bp, Myxococcus xanthus
gggacgaccgcgccgaccatggagatggcgcgccatggcggcggcacgatgaagctggaggacctgaagggccaggtggtgatgctggacttctgggccacctggtgcccgccgtgccgtgaggagatgccggcgctggtgaagctggccaaggagtacgagccgcaggggctcgtcttcgtggcggccagccgggatgacggcgaccgcgcgcccaagctggtggaggccttcatgcgcaaccacctgccggaactggcgccgtacgtggtgtacgcggacgacaacgtggcgcgggccttccaggtcagcgcgctgccgacgctctacttcctggaccgcgacggcaaggtgatcgacgcgcagcgcggcgcgctgtccgaggacggcatccgccgccgcatcgagcgcgcgctgaagcagccctga

SEQ ID NO: 8670 - DNA, 603 bp, Myxococcus xanthus
atgtcctggttcctggcgctgtccctgctcgcggccacgccggagggcggcgccgcgaagaaggcggaggacgccgagtcgctgcgtctgcgcgccacgaagctctaccgggcgaagaagctcggcgaggcctgccccttgttcgagcgcgccgcgaagctcgcgccggagcacggcccaacgctagcggacctggggctgtgcctccagaagcagggccgaaaagagcaggccctggccgtctacctgcgcgcgctcaaggcgagcggcgcggacgccaagacgcgcgccaacgtctacttcaacctcgccgcgttccatgacgtgacgcctgaagccctgacgctggagcaccagccgacgccccggggccactacctggccatccgcggcgccgggccgtgcgcggacctgccctcctcggagccgagctgcggcaccgtgctgcaggcgtgcctcagcgaatgggtggcgcccgtcgaggctgtctacgcggagacaccaccgatgttctacgcggagacgggcttcaacatgcaagtcaacaggaccggagcgcggaagaaatcgtccgtccccactaggcgtggagaggcagggtag

SEQ ID NO: 8671 - DNA, 727 bp, Myxococcus xanthus
gcagcggcagtcatcatcggcaacgaggtcttgacggcgaaggtccatgacctgaacgggccgcacctcatcaagcgcctgcgcgaggtgggcatcccgctgcactcggtggagacggtcctcgacgacgtggacgccatcgtggacgcggtggcccgggcccggcgcaaggcgcggtacgtcttcaccagcggcggcatcggccccacccatgacgacgtcaccgtgcgcgcggtggccctggccatgggacggaacgtggttcggctgcaggagatgctggacctcatcatgtcccgtgccaccgaggagcggccggtgacggcggaagggctgcggctcgccgatgccccagagggcgccgtgctgcttccccaggccgacatgtggttccccgtcctcacggtggatgacatcttcctgctgcccggtgtgccgcagttgttcaggatgcagttggagaccgtgctcgcgcggctgagcgggtcgcccgtggtccgtgagctgcctctacctccggatgggcgaaagcgacatcgccgccgtgctggaccgcgtggcgctcgacatgccgcacgtagccatcggctcctacccggagttcgacacggacaaggactaccgggtgaaggtgacggtggagtccgcccagcgcgggcccgtggatgacgccctgacgcgcatcctcacgggcctgccggaaggcgcggtggtgcggcgggagtag

SEQ ID NO: 8672 - DNA, 267 bp, Myxococcus xanthus
atggccgagacccagacgacccagaagcgcaccagttggccgcgtttcgccaagagcaatggcaagaaggcgtgcaccgtggagggctgcaagcgcccgtaccgcgccaagaactactgctacttccactacaagcagtggcgccagggcgacctgccgcacagccgttaccgcacctgctccaagccggattgccgcgtgaagacgttcaagggcggcctgtgcgagaagcaccacggcgaggccttcaagaaggacgcggcgtag

SEQ ID NO: 8673 - DNA, 1260 bp, Myxococcus xanthus
atgggcagggcgcgaggcaagagtgtcatcctgttcgccgcgctggtgtgcgcgctggtgctgccagcgcaagccaccggccgcgagcgaaatcggttgtgggtggagtcacagaaccgcgccctccagaagcaacgctccacgctgagcgacgtcgcccggcgcgccatgcccgccgtggtgtccatcaccacacagcaggctgccgacgtgcaggccgtcgccgctggagaagaagcgcagaagggcatcggctccggcttcatcatccatccggacggctacatcctcaccagcgcgcacgtggtggagggcgcggcggaggtcatcgtctccgtcctgcacccgcgcggctacgtggaggagttcgaggccatcgtggtgggcgaggacgcccgcaccgactgcgcgctgctgaaaatcgccgcgccccgcaagctgcccgtgctgaaactggcctccgcgtcgcacgtgcgctcggcggattggattgtcgtcatcggcaacccgttcgggctgacccactcggtgacggtgggcgtggtcagctacatgggccgcacggacgtgacgcccaacgggcgcgacggcgacttcgactacatgcagatggacgcctccatcaacccgggcaactccggtgggccggtgttggacctgcacggtgacgtggtggcggtggccaacgcggtcaacgttgcgggccagggcatcggcttcgccatccccatcgacatcgcgaagacggtgattccgcacctcaagtcccacggccgcgtgcgccgcggatggctgggcatgagcgtgcaggacttctctccggaggtggccgaggccttcaacctgcggcgcggccgcggggtggtggtgacggacatcgtcgaaggcggcccggccgagcgcgcgggcctgcaggtgggcgacgtcatcgtcagggtggaccagcggagcgtgcgccgggcgcatgcgctgcgctggcaggtggccgcccggggcgtgggccgcgacgtgaagttccaggtccaccggttggggcgcccgatgaagctgaccctgaagctggacgagatgccctccgaggagacgcccctgcccaccgtggcgagcaccgcgcctgggcggcacgcgggggcccctcagccggtgttggacgacctgctgtcgccggtgccccgctcgaagggccgccgggcgactccgccctccggggaagcagcccccgggacggggggttctggacaagacgcccccgcgccctga

SEQ ID NO: 8674 - DNA, 183 bp, Myxococcus xanthus
atggagcgagcatggagccgctcggtgagcccttccacggttgatcggctcaaggacgggctggaggacgcgtacgaggacgccaaggacgccgtcgccggaaacaaggattcgtcgcctcgtgagcgcatcagcgccgaggaccgtgaagcggtgaaccgcatcatcgcgcagaagaagtag

SEQ ID NO: 8675 - DNA, 1029 bp, Myxococcus xanthus
atggagctcaacgtcggccgcggcatcaacctgtccagcggctacggccgtgaggccctgcgggtgatgttcgcggtgcgctacgacgagacgttcatcgactcggacggcgacggcgtgcccgacatccgcgaccgctgccccaacgagcccgaggacatcgacggcttccaggacggcgacggctgccccgacccggacaacgacggtgatggcatccccgacggcgaagatggctgcgccaacgagaagggccccaagcacaccaagggctgcccggacccgaactacgacacggacggcgacggcgtcgtcgacggcgaggacgcctgcgtcgacaagccgggccccaagtccaacaagggctgcccggaggacgagaacgacgcggacggcgacggcatccccgacaagctcgacaagtgcccggacaagcccggcccgaaggactacgacggctgcccggacaccgacggtgacgaggtgcccgacaacgaggacgactgccccgagcagttcggtccgccggagaacaacggctgcccgtacgactcgccgccgtatgtcgtcgtcgagtccgaccgcatccgcatcaagggcaacgtgctcttcgagacgggctccgccgtcatccagaagcagtcgtacccgctgctggacgaggtggcgacggtgctgcggaagaacccgacgctgggtccggtcctcatcgaaggccacaccgacaatcgcggctcgcgcgccctcaacatgggcctgtccgaccgccgcgcgaagtccgtgctcgagtacctggtggccaagggcatcgcgcgcaagcgcctcagctccaagggcttcggcttcgacaacccgattgccaccaacgacacggcgcttggccgcgcgaagaaccggcgcgtcgacttccggctcgtgcgcgccgagctggagacggagaagaaggagaccgttgtccctgcgggccagccgccgccgccgggaacgacgccggccaacgcggccccggacaaggacggcaagccgtag

SEQ ID NO: 8676 - DNA, 1809 bp, Myxococcus xanthus
cgacgtgggcatccagctcggctggtacgccggtgtcacgggctcgcccgacggattccagcgccacctgcagagcctgcccaaggtgacgcccgcccagttgtccgacttcgccaagcgctacctcaccgccaacaagctcatcctgctcagcctcacccccaagacggacgcccagggagggacgaagtgatgaagacccgagcactcctgtccctcaccgccctgctggggctcgccggctgcgccaccacgccccaggcgccgcctcccgacgagaacgcgccgccgcccgcggtgcccgcccaggcggcggcgcccgagcccgctccgcagcccacgcgtccggagtccgtgcccgcgacgccgctgcgccagcccaagcccatggagttggtcgtcctggcgcgtccggacacgcccatcgtctccttccggctcgtgttccacaccggctccgtggacgacccgaagggcaaggagggcctcaccgccctcaccgcgcagctcatggcggagggcggcacgcagaagctttcggcctcgcagctcctggaggccctgtaccccatggccgcggagctggacgtcttcgtggacaaggagctcacgacgttctccggccgcgtccacaaggacttcctgacgcgcttccaggacatcttcaccgacgtgctcctggctccgcgcctggacaaggccgagctggagcgcctgcgcgccaacgccatcagcgacgtggagaacggcctgcgcagcgccaatgacgaggcactgggcaaggtcgcgctggacgccctgctctaccagggccacccctacgcgcacttcaccggcggcaccgtacagggcctgaaggcgattacgctggacgacgtgaaggcccacgcccagcgcgtcttcacgcaggaccggctcgtcatcggcctggcgggcgcggtggatgacgcgctcgcacaggcgctcagctcgcgcctgtccgcgttgcccgcgaagggcgctccgcgcgtggagctgcccgccgttccgacgacggccggccgcaccgtcatcatccagaagcccacgctctccaccgccgtcagcatgggctttgtcagcaccatccgccgcggcgacccggacttcttcccggtggccttcgccatgtccaacctgggcgagcaccgccagtccattggcgtgctcttcaccgagctgcgcgagaagcgcggcctcaactacggcgactacgcctacgccgagcacttcatcgagtcgcccggcaccacgtacaaccgcaccaacatcgcgcgcacgcagcaggacctgtccctgtggattcgccccgtggtgcccaccaacggcgtgttcgccacgcgcggcgcggtgttcttcctggaccagatggtgaaggagggcatcccgcaggagcgcttcgagctgatgcgcggcttcctccagggctacacccgcctgtgggaacagacggaccaacgccggctgggctacgccattgacgggctcttctacggcacgcccgacttcctggagcagtaccgccaggccatgtcgaaaatgacgccgcagtccgtccaggaggcgctccgccgccgcgtgcagcccgaggccctcaacttcgccttcgtcaccgaggacgcggaggggctcgcccaggcgctgcgctccggtgcgccgtcgcccatcacctacgcatcacccaagtcagaggagttgctgacacaggaccaggccatctcctcgtccaagctgcccctgcgcccggaggccatccaggtcatccccgcgcagcagttcatggagaaataa

SEQ ID NO: 8677 - DNA, 597 bp, Myxococcus xanthus
ggggtggcgccgctgtggccgttgctgtccttgggggtcaccaccgccacggccgccgcacggttcaccttgcacggcctcttcctcttcttcgtcaaggtgggctctgtgctgtacggcagcggctacgtgctgctggccttcctccgcaccgggctggtggagcgctacggttggctgaccgaagcccaattgctggacgcggtggcggtggggcaggtgacgccggggcccgtgttcaccacggccaccttcatcggctacgtgatgggcggcccatcgggcgcggtggtggctacggcgggcatcttcctgcccgccttcgtcttcgtggcgctgagtggaccgctggtgccacggctgcgccgctcatgggtggccggcgccttcctggacggcgtcaacgtggcgtcgctcgcgctgatggcggtggtgacgtggcagttgggacgggccgtgctggtgagtccgttgccggtggccctggcggccgtggccgccgtgctgctcatccgctatcgcgtcaattccgcgtggttggtgctgggcggcggctgcgtgggagtgctggccgccgggggcctcagcgcggggtga

SEQ ID NO: 8678 - DNA, 327 bp, Myxococcus xanthus
atggatgtgaagcacctgtcgtccttccaggacttctcaccggagaagctcctgaagcacaatgtcttccagtccggccgtttcttcctggacgtgtactgcctccagccgggacaggcccagaagccccaccgccatgccacgtcggacaaggtgtatgtcgtcctcgacgggcgctgccgctttcgcgtgggcgccgaagaggaagtccacggccctggcgccgccattttcgcccccgcgggcgccgaacacggcgtcgccaacgacggccccgatgccgcccgcctcctcgtcctgatgtccccgcccccggagcatgcatga

SEQ ID NO: 8679 - DNA, 609 bp, Myxococcus xanthus
ggaccggtggatgcgccggtgaagattgtcgagtggacggacagcaagtgcccccactgcaagatgctggtggaggagctgtccgcgctgaagaagcgggttcccgaagggaagatgtcgctggaggctcgccagttcccgctggatggtgcgtgcaacccggcgattccgcgccggggcccggatgcgcccagcgtgcgctgcgtggcggcgcgtgcgcagatctgcctggagggcgcaccggactactgggagctgcgggagaagatgttcgccgcgcaggccgtgctggacacggagcgggcggtggagattgcgtcgtcgggctcggtgccgcgctcgcagttggaggtgtgcatgaacagcccggccacggcggcgaagattcaggaggactcccgctacgccatgcgccaccacatccagggtacgccgctggtgctggtgaacggccgcgagacggcgccctccgcgccgttcctctacgcgctggtgatggcggaggggaatccgagcgcccctggcttcgacgtgctgcctccgccgcgcccgcgcccggtcggtggtcatggccacggccacgacgaccacgcgggccacaaccactga

SEQ ID NO: 8680 - DNA, 380 bp, Myxococcus xanthus
atgggcaagcgcgacaagaagggtgagccgccggcggcaccggcggctccgttcaacaatccgttcgccgcgctcgtggcgcagcgggaggccttgccccaggctcccgccgcgcccgtggctcatgcgcctgtgaaggccgagcccaagggccccgcgcgcgcggtggttcgcatggagcgcaagggccgtggcggcaaggaagtcacggtggtggagcacctggagctgcccgcggcgcagcgcgaggtgtggctcaaggcgctgaagaattcgctcggctgcggcggcgtggtggaggacgacacgctggtgctccagggcgaccagcgtgaacggctgcccgcgctgctccaggcgccgagcgtgcggaaggtcac

SEQ ID NO: 8681 - DNA, 471 bp, Myxococcus xanthus
atgaacctcgcggccacgggcgcgctcgccaccacggcggtgctgctcgtcgcggactcgggagagaagggctgccaccagcccgcccagagcgtcaccttcgacgtgggccacaacacgtgcggagcgccgggcatcctccgggtgagcaccccccaagacacctgccgcctcgacgtggaggcggaggaacgaacgggcctgcccatgacgggggacgtctacgacggcagcgtggacctccgccagggcgacaactggtacctggcggacatgaacgtcgccatcatcgtggacgcggatggtgggactctgcctggcgatgcgggcaccggaacaacggtcgaggtcaaccgcgcgtgcgaagtcctgcgcgaaggcgaggtcctccggctgaagtgcaccgcgcgcagggcggacctcgccaacgagccggtgagcgcctgcgaggccgtgctcaccccgcgctga

SEQ ID NO: 8682 - DNA, 441 bp, Myxococcus xanthus
atgccggagttcctcgcgccgctgcccctgttcgccgtggcgctgatggcggtgaatgaccgctggctcaagcccaccttccacaacgccctcaccggcaagctgtccgacgtcgccatctgcttcttcctgccgctctacgtgtccgcgctgctggcgctggtgacgcgctggcccagggcgcgcagggtggcagtgggcgcgggcttcaccgcgtgcctctacaccgcgctcaaggtctcccagcccgcggcggacctcttctgtgagctgctgcgccccttgggcttgccgctcggcatccggagcttccgagcctgggccgaccccaccgacctcgtcacgttgccgcttgtctgggcggcggtgcgttacagccgcgccgccgcccgtgaaccgtcgtccctccccgccgcaccctccactggagtcagcacgtga

SEQ ID NO: 8683 - DNA, 1152 bp, Myxococcus xanthus
atggtggtggcaatgccgcccctgctggtgctgggcgcggtggggccgtacgtgctgcgcgtggggctggcgggagtggagtcagcgggcgcgcacgccggacggctgtcctccgcatccacggtgggcagcatcaccggaacgctgctggctgccttcgtcgtactgccgctgctgggcaccgcgcgcaccatggcgctcttcgcggcggtgctggggctcacggcatcctggcgcctgggatggcggtggcggctgcccgccgtgggcgtgcccatggtggcgctggccctgggcgcccacgccctgccccgcgcccccaaggccgtggacgtggccgagtccccctatgccttcatccaggtggtgaaggacgaacacggcacccgctcactcgtcttcgatgagggctacgcggtgcagagcgtccaccggcctggcctgcctgtgcgcggagaagtcttcgggcactacctgctggtccccgccatggcccaggcagcgccacgagcgccccgggtgctggtcctgggcctgggcgcgggcacgagcgccaggggcctgcgggagacgtaccccggcgtggaggtggtgggcgtggagctggacgcggaggtggtgcggctgggccgtgcgcacttcgacctgccctccgaggtggaagtccacgtcggagacgcgcgcgccttcctcgcaagcgacacccgccagtacgacgtcatcctggtcgacgcgttccgcttcccctacgtccccttccacctgacgacgcgcgagttcgccgccgccgtggccgcgcgcctgaatcccggtggcgtggcctgcttcaacgtggggcgctacgcgcaggagcgcgcggtggtggaggccgtgggcgccacgctggccaccgtcttcccggaggtccgggccgccgacgcgcgcaaccacagcaacacgctgctcttcgccggggcccccgggctcgcagagcggctcgcggaacgcacggcgtcgctccccgcatcgctgcgcccgctggcggagcgcgtggccggagagctgaagccggtgcccgcaggcgagccactgacggacgacaaggccccggtggagtggctcacagacgccatcctcctgcgggccctctcgagtggggagaagctccaatga

SEQ ID NO: 8684 - DNA, 687 bp, Myxococcus xanthus
atgggagtgcccaggtccctgacggccctggcgcggctgggcaacgcgccggtctccaaggagcaatggctcgcgagcgcgcgcgcggtcgaacaggcgctgcgccaggacccggaagtctcccaggtgatgctccgggactacgagaaggacggccaggtccatctcgtctacgacgtgacggtgaaggacgtcacccagctcccggagctctaccgccgcgccgccgagcagcacacccagggccaaccgtcttcgccgaaggatgcgtgggatttccgcatcgagcgccagggcggggactacgtctacacccagcgtttcaacccggaaaaggccttcgccacgccggtcggcatcggtgacgaggccgcggagcaggccgcccaggagctcgcgaagggcatggtgaaggccatgctcgtcaacaaccgcctcaccctccgcatccacggccctggaattggcgagacgaacggcacggtgaacgagcagaaggacaccgtggagtggaagctcaacctcgcggagctgatggacgcccccgccgagggccgcgagttccgcgccgtcatccacggcggcgagccgctctggctgtggccactggtgctgggcgtccccatggtggtgctgctgctgacggtcaccgccgcccggaagcggcggggcgtcgccgcccgataa

SEQ ID NO: 8685 - DNA, 1077 bp, Myxococcus xanthus
acggacatggaaccgctgtctctgcattttcttcacgagaaggcgggcgcccgctttggcgctgtgggcggccgggaaaccgtggccgggtatggagactcggagggagagtaccgggcggcgaaggcgtccgtggccctccatgatgcctcctaccgcgaaaccctccgaatcactggagaagaccgggcctcttacctacacgggatggtcacccaggaggtgaacaacctgccagtgggcaccgcggcctatgccgcgatggttaccgtcaagggggccatggtggcggatgcccgcatcctcaagcgggagccagacctcctcctggacttggagcccggcaccggcgccaaggtgcgggagttcctggataaatacctcatttccgaggacgccgagctgcacgaggccacgggggagctggccctgctccggctgctcgggcctcggacggaggacgtcctgtcggccgccctgggcagcccccatgcgccgctgtcgcaccatgccgcccgcacggccacgctggccggccaggaggtgtggctgctggggagcaccgccatcgagccccatggggtcgacgtgtgggtgccgcgcaccggcctggaggacgcctggcgggccctgtccgaggctggcgccgcccacggcctgaagcccctgggcttggaggccctggacctgctccgagtggaggccggcgtcccccggtacggccaggacatggtggacaccaccattccgctggaagccaacctggcgaacgccatctcctacaacaagggttgctacatcgggcaggaggtcatcgcccgagccaccttccgcggccacatgaaccgcaagctgacggggctgctgctgggcgacgcggacgtggcccccggcaccgagctgcggcgcggggagaagaaggtgggctggctgaccagcgtggtgcagtcgcctgtcgcggggcagcgggtggccctgggctacgtgcaccgggactcgctggagccgggcaccgagctgacgctggcggcgggccccgccacggtgaaggtggcgtccctccccttctccgcgtga

SEQ ID NO: 8686 - DNA, 585 bp, Myxococcus xanthus
atgactttcgacgatcttcagcttcacgacaccctcctgcgcgccgtcaaggcagagggttacaccacccccacgcccatccagcagaaggccatcccccacgcgctggccgggcgggatgtactcggcgtggcccagacgggcacgggcaagacggcggccttcgcgctgcccatcctccagcggctgtccgccaaggcgcccgcgggcggggcgcgcccggtgcgctgcctggtcctgacgcccacgcgcgaactggcgggtcaggtgggtgacagcttcgggacctacggcaaggggcttcccctgcgtcacgccgtcatcttcggtggcgtgggccagaatccgcaggtccagacgctgcgcaatggcgtggatgtgctggtggccacgccgggccgcctgctcgacctgatggagcagggcttcgtgtcgctgcgctcgctcgaggtattcgtgctcgacgaggcggaccgcatgctcgacatgggcttcatccacgacgtgcggcgcgtcatcaaggcgctgccgcccaagcggcagacgctgttcttcaatcggccgcttcataacaacacgcagcat

SEQ ID NO: 8687 - DNA, 969 bp, Myxococcus xanthus
atgcgtcgcatcatcgccctgcttgccgcgctgaacctggttgcatgtgcccacggtggtggcgccgcgccggaagccgcctcggtcacgaagcccacggcgccaaagcccgtcgccacgcccgaagcgaaagcggctgcctccgaggcatccggactggccatgaagggcgacaacgcgcgcgcccttcccctgttccgaagcgcttgggaaggcggggggcgcagcaggaacctggcctacaacgcggcctgcgcggcgtccttgctggcggagcgcgaggaggcgctggtctggctggagcgcgccgtggaggagggcttcgatgacgcgaagcacctccagaaggaccctgacctgagcaacgtccggagcctgcccggctacgcggcgctggagcagcgagtcatcgccgccgaggcgaagcagtacgaggccgcggaccctgtgctgcgggacgagttgctcaagcgcatggaagaggaccaggcggcgcgcggtgccctcgtcgcctcgaacttccaggatgaggccgccaaggcgaagatgatggacgtcgatgcccgcaacaccacctggctcaagggcgtcatcgcgaagcatggctggccgggaagcgccctggtgggccggcgcggtaccttcgccgcgtggttgctggtgcagcacgcggaccaggatgtggccttccagagcgaggtccttccgatgctggagaaggccgtggcgcgaggggagggcaccgcgaaggacctcgcgtacctcacggaccgggtgctggtgaataccggcaagccgcagcgctacgccacccagttggaggaggtggatggaaagacggtgcccaaggcgctggaggaccccgagaaggtgaacgagcggcgcgccgccgtggggctcgatacgctggaggagtacatcgcggccttcgagcggatgaaggccgcggccacccagcagaagccctga

SEQ ID NO: 8688 - DNA, 330 bp, Myxococcus xanthus
atgaagagtcaacccaagacagatggcgagtcggcctcgaagctcatcagcgacaggatcgccgagctgggtgactggcgaggcgaggcgctggccagggtgcgtgccctcatcaaggaggccgtcccggatgtcgtggaggaatgcaagtggcggggcaccccggtctggtcccacggagcaggcctctgcacgggtgaggcatacaagtcggccgtgaagctgaccttcttcaagggcgcttccctggaagatccttcaaagctcttcaactcgagccttgaaggcaatgtcaggcgcgccatcgacattcaggagggtgagcgttta

SEQ ID NO: 8689 - DNA, 1176 bp, Myxococcus xanthus
atggtgtgccagggctgcaagaacgccaaggacggcagcgagcagtatgagatgccggaggacaccgcgtccgccgtcacggtgaccgacgaggccctgctgaggatggccaccgccggtcccaactggcgatgcgcctattgcgagagcgaccagcgggccctggacggcggctgcaagcactgcggcgcgtccgccgtcgaaggctcgattcccgccgagcccacgcgccccacgccagacgagaagaagggggcgaagagcaacaggcgcctgggctgctacatcctctccatcatcgcgttcttcggctgctgctgtcccatgtggatgtcctccggcaagaaggggaccgcccccgcgacggcggccacgacagcgcccaagacggagccggagaggacgcggacgctccaggtcaaggaggtctcctgggagcacacggtgagcgtggagcgctaccgcctggtgaatgacgagggcttcgaggaggaccggccagaaggcgccctcctggtgaaggcgcatggcaagcgccaccaccatgacgaccaggtgctcgccggctacacgaccgtccgctacacggagcgcgtccagcggggcttcaccacggagacctaccgcgccaaggaggcttgcggtgaggactgcaccacgacgcccaagaagtgcagcgagcagtgcaccagcaacaggaacggcttcgcgacctgcaagacgacctgcaccggaggaggtcggagctgcaccacccgctactgctccgtgacgaagaagcgccaggagccgcgctacgtggacgagcagcgctcacgccaggagccgcgctaccggagcgtgccgcgccaggcgacctggtacacctggaaggagtggcgatggatgcacgaccgggacgtgaaggcgaacggcaccacgctcgaggcgcgctggcccaccgacgccgagctgcggcccgccaaggccttgggcaagggcgagaaggaacgaaacgcgcgcgacgcgcggtacagcgtggtcttccacggcgacgaccagcccgccatcacctacacccctgaaacactcgaggagttccagcgcttcgcgcccggcagcacgcacacccttcagcaggagcagggcaaggtctccgtcgtgccccagacgcccccggcgcaggccaccccataa

SEQ ID NO: 8690 - DNA, 1341 bp, Myxococcus xanthus
ggcatgtcccacgcccaggaagtgcagcggcgtggcagcaccagctacatgcccgtggcccagacggagcccttcgctgacgtcatggcgcggatgaaggcggagaagcccaaaatcaccgcgcgccaccagcagctcctggaacaccgctatgacctgggaaaccgtccggcccggggcgtcacgatgtcccgggggaaagccgtccaggaaggcgtgcgggtgaagctcccacagggcgtgacctgggagtccctcgccgccatgagcccggaggcgattcgagacagggggctcttccccgcgggcttcatgccattgccccacccgaatcatccggaaggcggcatggtcttccccaagttccacatcgatgaaatcaagcggcaggaagggagggacctcacacggttcgacctcgacttcgacctgccggaccacctgctgccggagttcccgccgcccatcttcctcaccacgcgcccggacctgggggatgtctcgcaggggaagctggtgaccatcatgaacgtccaggagctgttcaacggcctcctgaatccgaagcaactggaaggcctccggctgctcgtcacgccctttccccagcagcagttcaatcagaccgccgaccgccgctccgagctgcccagccggggcgtgagctgcttcgactgtcacgtcaacggccactccaatggcgccacgcacctggtgggcgacatccggccccaggagttccgccaccgcatcgatacgccgacgctccgcggagtgaacatccagcgcctgttcggctcacagcgggccctgaagaccgtggaggacttcaccgagttcgagcagcgcgcggcgtacttcgatggcgacccggtcatcgcgacgaagaaaggggtcaacatcctcgagcggggtagccaggtacacttcatggcggaggtccaggccctcctcgacttcccgccggcccccaagctccgcttcgacgggaagctggacccgaagaaggccacccagcaggagatgcgcggacagacgctcttcttcggcaaggcgcagtgctccgtgtgccacctcccgccctattacacagacaacctgatgcacaacctgcaggcggagcgcttctacaagccccggctggtaaacggcgcggtgatgggctccgatggccccatcaagacgttccccctgcgaggcatcaaggactctccgccctatctccatgatgggcggctcatgacgctggaggacacggtggagttcttcaacctcgtgctggagacccggctcaacgcgcaggagaagaaggacctggtcgcgttcatgcgcacgctctga

SEQ ID NO: 8691 - DNA, 174 bp, Myxococcus xanthus
atggagcacgaggacgagcaccggcggctcgtggactcgctcatccagggcggcacgctgaaagcctccgaactgggccgcgtcatcgtccagcgcgacacgccgtcgggcaaggcggccgagcccacctccaccgccgaggacgcctccgaaaaggtcagccagaaggcctga

SEQ ID NO: 8692 - DNA, 834 bp, Myxococcus xanthus
atgcgccgacgttcgggcgccgtcctcgtcctcgccgccgtcgtgctgctcagcggagccgcgccggagagcgcccaggagcaggtgctgggttcagcgggaagcgacccgcgcatcgaggccgtggcgatgccatgcaaggggggccagcatgcgctgcgcgttcgccgcggcggcgcgaagagcacggcgacactgtccgagccgtatgatgcgctcacgtgcaacgtggcgaagtcgacggcgcctggatggagctggactggtggcgatgagtcgacctcctgggacctccatctccgggccgtggagctccagggagggccgacggcgcttctcatcacccacgcggccggctacgaacatgtgcaccgccagcatgccctgttcctcgcggacgcgaagggcgtgacccgggcctgggaggggaccgaggggcagggccccacctcctccagcgtggaggtccaggacggccggctcctcttctcacgcacactcgacatcggcgtgggagagtcggcggaccgttgggccctcaccgagctgcgctgggacgcaggacggaagaaggtggtggagcggcctgccgaagcctgggccgtcatcctccgtacggaggactcggtgccggcggcccgcgtggccgaggcgcagttggaagcggactgcaagggcgcgacgctgctcatggtggacaccaacgacttcgcgcggctcacccgagacaagtgggtggtggccagcttcctgccgacacgccagggcgccgaggcagcgctcaggcggctgcggccgtgcgcaccggatgcgtacctcaagcgcgtccagtga

SEQ ID NO: 8693 - DNA, 1356 bp, Myxococcus xanthus
gacaagtgcacgtacatcaaagaggtcaaagtcggctcgcgcgtcgtgacgccgacgtataccgatggctattggtattccgcccaggactcctcgtaccaacccgcggaccccagccgctacggctacaacttgtggatattcttcccctatctgggagatggctccacgaaccaggtcaccatcaccgtggggcgcaccttcggcagcggcaccgcgacgtacagcttcccgatggtgcaagtcgatagcgtcgaggcgagctacgtccccgcacccatcggattctctcgtgccgagctgttgaacatgttcggcaaggcgctctacacgaagttcaatggcgctacgaattcgaccgtcctcaggtcgtcggacggctccacgcgccgcatctacggctacgacccgaatagcctccagctctccgtcacctcgagtggcgtgggcttctcgttcaaattcaagacggatatcaacaattggtgcgacccgacgattcgcgcctatggcaccttcaagctgaatgcgaacttctccggcatttcggtgcaatgggtgaatgcgccccaggcgagcctcgattggccgttcctgtgtcaggcggttcaggtcgttcccattctcggcctcattcccgccctcatctacgacatcatcgagagcgaggcggcgaacagcattacttccaccatcgaaagttccatcatcgattcgctgcccgagacggcagacgtgcagctgttcctcgatggctcgacgacgcgcaacaacgaactgctcgtcaatctcaagctgccggcgccttccatcaagatcaacgtcccgtacgacgcgttcgacatgaaccggagcgcgacgctcttcccctcgggcgaaaacctgacgctgctcgcgagcggcttgggcgtgaatgactacgtcgccggtgtgacgccccagacgacgctctactcgggccccaatggcgttccgcgctacggctccaccatgtggccgaatgcacagacgttgagccgtgcgaccaaccccgtttggaatggcctgcccatcgcccgcttgctggcgcgcatgtcgccgacggtcgtctccacgtcgacgtaccagtacacgcccggctgtacgttcaaggcgaacaacaagttcggccaagcgtccgtgcgcttcggtgtgaatgacacggccacggatgcgcagcgccttcgcggcatcttcggcgccgccccaggctactcgctgcgggtcgtcttcctgaacgacttcagcacctcgatcgcggataacgcttcccgctgcggtgtcacgacgtacagccccgtctatggctcggacgggcccgtcctggcgaatccgtag

SEQ ID NO: 8694 - DNA, 1332 bp, Myxococcus xanthus
tgctctaaagtgcctgtcgtcctgccgcccgaggcgcccgaggcggtggccgcgctcaacggcagcggcggcacggtggagttccgctgggcggcgccgccggccaacccggatgaggagggccgcgacgcgcccacgggttaccgcgtctaccagagcgcggacgggctgggctgggacgacggcacggatgcagcgggcacgtccttccgcaccacgctggcgccgggcaccgtgcgttacttccgcgtggccgcgcacaacgcgggcggcgagggcttcccgtccgtcactgtgggcgttcggacgccgggcggcgcggagtccccggtgctggtggtcaacggcttcgagcggctggatgcatcccaggcgtgcgccgagccgctggacgcctatgacctccatgcgcctgtccgcctgctggtggagacgatgaacgatggcacctacgtgcgccgccacggcgccgcgctggcgcacgcgggcaccgccttcgacagcgcgacgcgcgcggcggtggcggcgaacctggtgacggtgggcgcgccgtaccggctggtggactggttcaccggtcggggtggggcgggaggggcccgtcctacccgtgaggagcaggacgccctgcgcgggttcgtgatgcagggagggcacctcctcctgtcgggcagccatgtgacgtcggcgctggccgtgggttcggcggaggaccaggccttcctggcggacattcttcgcgcggcgccgggcagcggaacgcccccgttctccgtggagggcatgccgggcgactggctggcccagctcaccggggtggcgctggatgacggcacgcggggcggctacgcggtgggcgtgacggacgtgctgacgcccgcgtcgggtggcacgtccgtgcttcgctatctgggaactgacctggcggcgggcgtgatgtcggcgcccaacgggcgggtcctgctgctgggcgtgcctttcgagggcatcgtcagtccggtgcagcgcgccgggctcatgtcctcgttcctggtgcaggcgggcctgctcacggagctgcctcctccgccggccgaggaatccggcgccgcgagcctgctctccgcctgtgtggcggcgcggggcgtggacccgcacccgccaccggagcccgagccggagcctgaacccgagccccatgtggtgggggtgctgccgcagttctatccgctgggagattccggctgtggctgcggggcgggtgggggaacgggcaccgccgtctggctgttgctcggggtgattgttcagcttcggcgtgcgcgtcgtcgcggggatgtcgccgggcgttga

SEQ ID NO: 8695 - DNA, 1011 bp, Myxococcus xanthus
atggctacccggattgccatcaatggttttggccgcatcggtcgctgcatcctccgcgcggtgctcagccgcaaggaagacctcgagattgtcgccatcaacgacctcgacaagcccgcggcgctggcgcacctgttcaagtacgactccgtgcaccgcacctggccgggtgaggtgaaggcgacggagaagggcatcgtggtggacggcaaggagatcaccgtcaccgcggagaaggacccgacggcgctgccctggaagagcctgaacgtggacgtggtgctggagtgcaccggccgcttcaccgcgcgcgacgcggcggagaagcacctgaaggcgggcgcgaagaaggtcatcatctccgccccggccaagggcccggacatcaccatcgcttacggcatcaaccacaacgagtacgacccggccaagcaccacgtcatctcgaacgcctcgtgcaccaccaactgcctggcgcccatcgccaaggtgctggtggacaacttcggcatcgagaagggcctgatgaccacggtccacagctacaccaacgaccagcgcatcctggacctcacccacgaggacatgcgccgcgcccgcgccgccgcgctctccatgattcccaccagcaccggcgccgcgaaggccattggtgaggtgattccgcagctcaagggcaagatgcacggcctggccgtccgcgtgccgaccccgaacgtgtccctggtggacctgacggtgaacaccgagaagaaggtcaccgccgaggccgtcatcgaggccttccgcaaggccgccgaaggcccgctcaagggcgtgctggagttcagcgacgcgcagacggtgtcggtggactacaacggcaacccgcactcggccatcttcgactccaccaactgcttcgtgatgggcgacaacctgctcaaggtcatggcctggtacgacaacgagtggggcttctccaaccgcatggtggacacggcgaagttcctcgtctccaagggcgtctag

SEQ ID NO: 8696 - DNA, 1998 bp, Myxococcus xanthus
atgatccgttacatcgatgatctgcagctgaccgggaagcgcgtcttcatccgcgtggacttcaacgtcccgatggaaggacggcgcgtgaccgacgacacccgcatccgcgaggcgatgcccaccatccggcgcgcgctcgaaatgggcgggaaggtcatcctggcctcccacctcggccgccccaagggaccggacccgaagctgtcgctggagcctgtcgccgtgcggctcgccgagctgctcggcggcaagcacgaagtcatcctcaccgacgactgcgtcggtgacggcgtgaagaagcaggtgaaggagctcaaggacggccaggtggtcgtcctggagaacctccgcttccacaaggaagaggaggccaacgacgagacgttcgcccgcgagctggcggcgctggcggacgtctatgtcaacgacgccttcggcaccgcccaccgcgcccacgcgtccaccgcgggcatggtgcccttcgtgaaggagaaggcggccggcttcctgatgcggaaggaaatcgagtacctgggcaaggtgctcaagaacccggacaagcccttcgtggccatcctgggtggctcgaaggtgagcgacaaaatcaaggtcatcgagagcctgctgcccaaggtggacgcgctgctcgtcggtggcgccatggcgtacaccttcctgaaggcgcagggcgtcgaggtgggcaagtcccgcgtcgagggcgacaagctgtcgctggccacgcgtctgctggaggctgcgcaccggttcaagacgcagctggtcctgccggtggaccacatcgtgggcaccgagcccacggagaacagccccgccacggagacgccggacaacgcgattccgccggacatgatgggcctggacatcggtcccaagacgcgcgccatcttcgcgcagcacatccgcgatgcgaggacggtggtgtggaacgggcccatgggcctgttcgaggtccccaagttcgccgagggcactcgctccgtcgccgcggccatggccatcaacacgcaggccaccaccgtcatcggcggcggggacagcgcggcggccgtggagcagatgggcttcgcggacaagatgagccatgtgtccactggtggaggggcgtccttggaattcctggaaggacgcgacttgccgggcatcaaggcgctggagacgcggtaggctccgcgtccgacacaccacacacccctgggggacaccatggccaccgcgcgtcgtcggaagatcgttgctggcaactggaagatgaacaagtcggtaccggaggcgctggccctggtgcgcgacctgcgagggcaggtggcttccctgggggacaccgtggaggtggtggtggcgccgccgttcgtggcgctgcagccgctgcatgtcgcgctggaaggcgcgccgctggcgctggcggcgcagaattgtcactgggagtcctcgggcgccttcacgggtgagatttccgcgccgatgctggccgagctggggtgcgcctacgtcatcgtggggcactccgagcgccggcagctcttcggggacacggacgagcaggtgaacaagcgggcgaaggcggtccgcgcggcggggatgacgcccatcatctgcgtgggcgagacactggccgagcgcgaggcgaaccagacgctggcggtggtggagcgtcaggtgcgcggggcgctggagggcttcggggccaaggaggtggcgggtttcgtgctggcctacgagccggtgtgggccattgggacggggcgcaacgccacggcggcgcaggcgcaggaggtccacgcggcgatccgggggctggtcgagcgcctgtatgacggggagacggccgggcgggtgcgcatccagtacggcggcagcgtgaagccggacaacgccgcggaattgctgggccagccggacgttgacggggcgcttgtcgggggcgcgagcctgaaggcgggcgacttcgcggccatcgtcaaggcggccacttag

SEQ ID NO: 8697 - DNA, 399 bp, Myxococcus xanthus
atgctgaccttcgtcacgatcgtgcacgtcctggtgtgcgtgttcatgatcttcgtcattctgctccagccgggtaaggacgccggtatgggctccgcgctgggcggtggtgccgccacgagcgccttcggcggccggggtgcggtgacgttcctcagcaagctgaccggcgtcttcgccgcgctcttcttcttcagctcgctcggcctgtccttcgtggggctgcgctcctcggtggcggcgggtggctcggtggcttcgcctccggcgcagtcggccccggcgacctcgggtgacgcggctccgggcagcatggagcagccgcgcggcgagcagtcgactccgcccgccgagggtggtggcaacccggcgacgggtgagccggctccggcgcagtag

SEQ ID NO: 8698 - DNA, 429 bp, Myxococcus xanthus
atgacggccacctggcgcgtgccccgtgccacgatgtcccggcgccgtgcccgcctacgcaccgtggccacgcctgcagctcggcgcggccccaagacggcgctgacggacgaggcactgctggaggccatccgcggcgtgctggcggcggcgcccttcctgggcgaggggcaccgcaaggtgtgggctcggctgcgtgcccagggcgtgcgcacctcgaaggcgcgcggcctgcggctcatgcacgaagcggggctgctggcaccaggccgcacccgccggctgctggggccgcacaaccacgacggctcgattaccaccgacaggcccgatgtcatgtgggcgccgatgccacctgcacggagacaaccttggaaggacaggcaaccgtcttcatcgccggcaaccatggcactgccgagtgcgtag

SEQ ID NO: 8699 - DNA, 84 bp, Myxococcus xanthus
atggtgggcgagttgatgatgaagaacgagttgctcgctgagaaggcccgtctcctggagggcaacgcgccgggttttccctga

SEQ ID NO: 8700 - DNA, 1755 bp, Myxococcus xanthus
atggctcgcctcgacccgcactcgtacaacgacagcacgcagcctgagacggaaaccctggactggagggcccgcgtcgatttcaagacgcagcggctgcacgcggaggtcacccacaccctcaaggaagcctcggccgggccgctggacctggatacccgggatttggaaatccgtgacgtcatcgacgccgcgggtcgtcccttgccctacatcctctccccttccgagccgattctcggcagccggctgcgcatcgagctgccggtgggactgcggcaattcaccgtgcgctaccgcacggcgccgcacgccagcgcgctccagtggctgacgccctcccagacggccggggggaagcaccccttcctctacagccagtgccaggccatccacgcccgaagcgtggtgccgctccaggacacgccgcgcatccgcatccgctacaccgcgtcgctgcggattcccaaggcgctcaaggccgtcatggccgccagcttcctgcggcgcgaggagcatggcgtggaggcggaggagcactacgagatgccccagccggtgcctccgtacctgctggccttcgcggtgggcagcctggcgccgaaggagctggggccgcgctcgcgcgtgtgggcggagccggagctgctggaggacgcggcggaggagttctccggcgtggacgacatgctgcgcgccgccgagtcgctcttcgggccctatgactgggagcgcttcgacctgctcaccatgccgccatcgttcccctacggcggcatggagaacccgcgcctgacgttcctcacgcccacgctcatcaccggagacaagagcctggtcaacgtggtggcgcacgagttggcgcactcgtggacgggcaacctggtgacgaacgcctccgcggagcacttctggctcaacgagggcttcaccgtcttcgccgagcgccgcatcctggaggtcctggagggtccggaagtgtcggcgctgcacggcgcgctgggccgccgcgcgctggactccgcgctgcagcacttccgcgcgcacccgcagctgacgtcgctgcgcacccacctggccggcgtggacccggacgaggccttctcccagattccctacgagaagggctacctgctgctgcgcgccatggaggacgcggccgggcggcccgccttcgacgagttcctccgccgctacctggccacctaccgcttccgcgcgctcaccaccgaggagttcgtcgccttcgcggagaaggaactgcccggcgtgctgaccaaggtggacgcggaggcatacctgcaccggcccggcgtgccccccggggcgccgtcaccgcgctccctgcggctggaggccatggacgcgctgcgcggcaaggtgcccacgccggagcaggcgaaggactggacgccggccgagtggcagctctacctggagtcactgccctgggacattccacgggacgtcatccagcaactcgacgcgcgcttcagcctcaccgagagccgcaactcggaggtgctggtggcgtggctggtggtggcgctgcgcgcggactgggagccggccgtggctcgcaccgagacgttcctcggcgaggtgggccggatgaagtacctcaagccgctgtacggggtgctctccgcgtcgcatgcgcaccggagtctggcgcgcgcgctcttcaagaagcacggggagcgctaccaccccatcgcccgtcagggcgtggagctcatcctttcgcgcgcctga

SEQ ID NO: 8701 - DNA, 846 bp, Myxococcus xanthus
atggctggtcgagtcgtgattgccagcgcggtccgcacgcccttcacccgcgcgcacaagggagagttcaaggacacccggccggataccctggccgctgtcgccatcaaggaggccgttgcccaggtcccgggcctgaagccggaggacatcggtgacgtcgtcctgggctgtgccatgccggaggccgagcagggcatgaacgtggcccgcgtggccacgctgctggcgggcctgcccgtcacggtgcccgcgatgaccatcaaccggttctgttcctccggttcgcaggccatcgcccaggtggcccaggccatccaggcggggatgtacgacgtgggcatcggtggtggcaccgagtccatgacgatggtccccatgggcggcaacaaggcgagcgccaaccccgaggccatggagcgcctgccggagatctacacctccatgggcgccacggcggagaacatcgcgtcgcgctacggcgtgtcgcgtgaggactcggacaagttcgccgccgagagccagcgccgtgccgccaccgcgcgcgagcagggcaagttcaaggaggagatcgtccccgtcaccacgacgtactacgacgacgacggcgtggcgcagaacgtcaccgtcacggtggacaccatcctccgcccggagaccacgcaggagggcctggccaagctgcgcccggccttcaaccccaagggcgtggtgacggctggtaacgcgtcgccgctgacggacggcgccgccgccgcggtggtgatgagtgaggccaaggcgaaggagctgggcgtcaagccgctgggctacttcatcgacgccgcggtggcgggctttagagca

SEQ ID NO: 8702 - DNA, 1734 bp, Myxococcus xanthus
atgcgtatcagggttacatcgaggccgtccgcaactactggatggcgcgggccgacctcgagcaactcgtgggtggccggctgcgggagggcagcgcggcacccacgccatcgccctcgcagccttcccaacgcgtaccacctgggccgcccggcccacccgcgcagccagcaccacccgggacgccctcggggcacgggcaggatgtcacccatggcacggagagcccccatgagcacccgcacgactgaaaccgagcgcgcaccgggccgtgaggatgacgcccctggagctcgggagcgcaggggggcccctggaaactctccggcgattggagccgagggaacgctgacgcggcggagcatgcttgccacggcgggagccacgctcacgggaggctcgctgctgctgagtggctccgctgcgcgcgcccagtcagccgtctcaggcgcacgtgggcctcgcgagggctccgcggctgacaccggccagcggtatgcgcggcaggactggttgcgccccggaatgcccgaccgggactaccggcccgtggtggtgcccaatggctccaagctgccgtggaaggtcgtggacaacgtgaaggtcttccacctggtggccgaggaggtggcgcatgagtttgccccgggactgaaagccttctgctggggctacaacggtcgagtccacgggcccaccatcgaagcggtggagggggaccgggtgcgcatctacgtcacgaaccggctacccgcggccaccaccatccactggcacggactcctggtgcccagcggtatggatggcgtgggcggcctcagccagaagtccatcgctcctggcgagacgtttcggtacgagttcaccctgcgccaggcgagtacgaacatgtatcactcgcaccatgacgagatgacgcagattggcctcgggatgacgggcatgttcatcatccacccgcgccgacctgtggggccccgcgtcgaccgggacttcgtcatcctcctgcatgaatggcgcatcgatgtcggcacggagcgacccaatccgaatgagatgacggacttcaacgtgctcaccatgaacgcgaaggcgttcccgggcacggagtcgctcgtggtgcgccagggtgagcgggtgcgcatccggttgggcaacctgagcccgcagaaccatcaccccatccacctgcacgggttccacttccgtatcaccgaaacggatggcgggcgcgtccccgagtccgcgcagcagccggagggaacggtgctcgtccccgtgggcagcacacgtgtcatcgagttcgtggcggacgtgcccggggactgggccctgcactgtcacatgacgcaccacatgatgaatcagatgggccatgcgttccccaatatgattggcgtgaagccggggagcctggacgcgagggtgcgcacgctgctaccgggctacatgacgatgggccagacggggatggcggatatgggccagatggcgatgcccattccgcccaactgcattcccatgctgggggcccagggcaagcacgattacatcacggcgggaggcatgttcaccgtgctcaaggttcgcgaacggttggagagctacgcggaccctggctggtacgacaacccacctggcacgctggcggtggcggccacctcggacgagctgcgccgggacggtatcgacgtgaacgccccggccctggtcgatcccggcgcaccggcctga

SEQ ID NO: 8703 - DNA, 2406 bp, Myxococcus xanthus
tccttcccaacagggagccttttccacatgacgacgcggatccgcaaagtggctgtgctgggcgccggagtaatgggcagcggcatcgccgcgcacctagccaactcgggcgtgcgtgcgctcctcctggacatcgttccgcccaaggccgcgccgggcgaggacacctcctcgaaggcgtttcgcaacaagttcgcccagggcgcgctggccaacctgcgcaagcagaagccgagccccatcgtctctggtgaggtcttcaccaacatcgaggtaggcaacttcgaggacgacctgcaccgcatcgccgagtgcgattgggtggtggaggtggtgaaggaggacctgaagatcaagcaggacctgttcgccaaggtggagaagctcatccgcccgggcaccatcgtgtcgtccaacacctccggcatgtcgattgtggggatgaccgagggccgcggcgcggagttcaagaagaacttcctggtcacgcacttcttcaaccccgtccgctacatgaagctgctggagctggtggccggcaaggagactgccccggaggtgctcaagacgctgcaccgctttggcgaagaggtgctgggcaagggcatcgtctacggcaaggacaccaccaacttcatcgcgaaccgcattggcgtgtacgggatgatgcggaccatcgccgccatggacaaggcggagctatccatcgaagaggtggacaagattttcggcccggccatgggccgtcccaagtccgccgtcttccgcaccgcggacatcgtgggcctggacacgttcacccacgtggcgaagaactgttacgacacgctgacgcacgacgaagagcgtgacgtgttcgccagccccgccttcctccagaagatggtggagaagggcatgctgggcgacaagagcggcggcggcttctacaagaagcagggcaaggacatcctcgcgctcgacctgaagacgctggagtaccggccgcaggcgaaggtgcgctacgagtcgctgggcgccgcgcgggacatcgaggacgtgcgcgagcgcgtggcctcggtgatgaacgccgaggacaaggcggcgaagttcgccgagggcgtcaccctggacgtgctggcctacaccagccgccgcatcccggagatcgccgacgacgtggtcaacgtggaccgcggcgtgcgctggggcttcggttgggacttggggcccttcgaggtctgggacgcctacggcgtgaagaagggcgtggagcggatgaaggccctgggcctgaagccagccgcgtgggtggaggagatgctggccgcgggccgcgcgtccttctacggcgtggagaacggcaaggacacgtactgggacatcccgtccaagtccgtgaaggtggtgccggagaacgcccgcacgcagcgcgtggagtacctcaagcgcggcaacaagaagatcgccggcaacgacggggccacgctgtgggatttgggcgacggcgcgacgctgctcgagttccacaccaagatgaactccatcgatgaccagatcatcgagatgatgaacaccgcgctggacgagacggagaagaaccacaagggcctcgtcatcggtaacgacggctccaacttctccgcgggcgcgaacatcgtggcgctgctgtgggcggccaagagcggcgagttcgagtccatccgcaagctggtgacgggcttccaggccgtcaatcagcgcatgcgctacagcccggtgccggtggtgacggcgcccttcaacctcacgctcggcggcggcgccgaggtgacgatgggcggcaacgccatccaggcgagcgccgagctgtacatgggcctggtggaagtgggcgtgggcctcatcccgggcggcggcggcaacatgcagttgctgcgcaacgtgtacggccctttcggcacggacaaggacttcgacttcttccccttcctgaagaagatcttcctcaccatcggcatggcgaaggtcgccaccagcgccgaggaggcccgcgaggcgggcttcctgacgcaggcggatggcatcagcgccaaccgggacttcctgctgtccgacgcgaaggcccgcgtgctgggcatggcggacgccggcttcaaggcgccccgtcccacgcgcttccgcctgccgggcaccagcggcgcggccaccatcgacatgatgctctacgacatggagctcaacggccaggtgagcgcgcacgaccggaagatcgcccagaagctggcgaaggtgctgacgggtggcaacaccagcccgtcgctgctcgtgacggaggagcgcttgctggagctggaggcggaggccttcctgagcctgtgcggcgaggagaagacccaggaccgcctgcagcacatgatcgagaagggcaagccgctgcggaactga

SEQ ID NO: 8704 - DNA, 819 bp, Myxococcus xanthus
tacgcgaaaggggaggcctatacgctgctgcacggcgacagcctggagctgatgtcgcagttcgagccccagacgttcgacatgattttcgccgacccgccgtacttcctctccaacggcggcaccacctgcaagggcggcaagcgcgtctcggtggccaagggcggctgggacgtgtcgcgcggcgtggaggaggaccacaagttcaccaccgagtggctcgcggcctgccagcgcctgctcaagcccaccggcacgttgtgggtgagcggcacgcagcacgtcatcttcaacgccggcttcgcgatgcagaagctcggctacaagctgctcaacaccgtcacctggttcaagcccaacgcgagccccaacctggcgtgccgctacttcacgcactccacggagctgctcatctgggcctcgccgaagtccggcggcaagctccagcacacgttcaactacgcgcgcatgaaggcggagaacggcggcaagcagatgcgcgacgcctgggcgctgccgccctccggtgacgccgagctgacggcggacggcgagggccggatgtggacgctcaccgtcccgcgcggcggcgaggagaaggccttcggcagccaccccacgcagaagccggtggcgctgctggagcgcatcctggaggcgagctgccccccggacgcgctcgtgctggaccccttcaacggcagcggcacctcgggcgtggcggccctcaagctgggccaccgttacgtgggcatcgacatggacgagaagtacctcgccctgtcggagaagcgcctgaacgcggcggcctcgaagtag

SEQ ID NO: 8705 - DNA, 222 bp, Myxococcus xanthus
atgaagcctgaaatccatcccgtctacccgccgtcccgcgtgacctgcatgtgcggcaacgtcgtggagacgaagtccacccgcggctcgttctcggtggaaatctgctcgaactgccaccccttcttcacgggcaagtacaagctcgtggacacggccggccgcatcgaccgcttccgcaagaagtacggcgcgtcgccgacctccgccaagaaggcgtag

SEQ ID NO: 8706 - DNA, 462 bp, Myxococcus xanthus
tctcaagaggtggagggcgtggacttcgtggtgcagtcccacgagggccgggggcagggcatcgcccagcggcaggccctggccacggtgattccttccggtgccaggggccgcgagctggcgaagctgctgctccagttggaggggacgggccgctttgccgacgcctccgtgcaggagcgcacgcggcagcagctgcgcctgctcgaaggcaacctcacccgggcgaaggcgcggctcgcggggacccaggacccggcggagaagcagcccctggaggcgacgattgctcgcctggaagcctcgcgggcggcctaccagaaggcgctggccggcggcgcaacggacgccgggcgcacgcatctgttgtcgtacatccagcttggcagtgacgtcccggcggatccggtcgtccagaaatgggtggaacgcgtcgagccccccggctcggcggcccattga

SEQ ID NO: 8707 - DNA, 723 bp, Myxococcus xanthus
atgagcctgaacgacatcctccattacctccgcctgggtggcgtcaccctcgccatgctcatcttcgcctcggtcgcggcgttgattgtcgccgtcgagcgcatcatcgtgctctggggcgtgggcgagcgttcacgcgccttgggtgagacagtgaacaaacacctgctgcgcggggacgtcgccgcggcccgcaccgccgccgagcgctccgacgcggtggccgccgacatcttcctggccgggttcgaccggatggagcgcagccgcaccgccgggggcgctggcatcgaggcggcggtggaacgcgagcgcgcccaggtggccctcaagctgcgccgctacctgtggatcctggccaccatcggctcgattacgcccttcgtgggcctcttcggcaccgtcgccggcatcatgcgctccttcaaggacctgggcctggacgtggaagcgggcggcaccggcggcagctcggcggtgatgacgggcatctccgaggccctggtcgccaccgcggtgggcatcctggtcgccgtgcaggcgatggtcttctacaactacttccaggcccgcctgtcccgcgtgctggtggagctgcgcctgattggcgacgagttcgtcgagctgctcaaggagcgggccgccggcctgccgccgtccgagcccatgcctcccgagccgcaggccgcccccgccacgcgcacggacgcacagcccgcctag

SEQ ID NO: 8708 - DNA, 453 bp, Myxococcus xanthus
atgggcatgggaaagactccgggcagcgacgacggctccgaggacggcgtcttcgctgaaatcaacatcaccccgctcaccgacatcttcctggtgctgctcatcatcttcatggtgaccagctccgtcatcgtgcagcagggaccgggcggcggcgccaaggccggcctcaaggtgaacctgcccaagggcggcgccgcggacgtcaccgcgcgcaccacggacctgtcggtggcggtgctcgcggacgggcgcttcatgctggccggcaacgtcgtctcccaggacgagctgcagcaggccttcgatgacgccaggcagaaggacgaagagacggtggtcatcgtccaggccgacgagggcgtgccccacggcaccgtggtgcaggtgatggagctggccaagaaggccgggctcgcccagctcgccatcggcgtgcgcgaaggcgaatag

SEQ ID NO: 8709 - DNA, 375 bp, Myxococcus xanthus
atgaagccgcagaatccgcatgcgcaggaggaccggctgctcgacttcgcctatggcgaactgccggtgcccgaggcccgcctcgtggaagcccacctggagagctgcgcccgctgcacccaggccctggacgacattcgcggggtgcgcgccaccatgtcccagctgtcggtggagcccgctccggacgcggggctggagtcgctgatggcctatgcccagcaggccgctcgccgcgccgccgcgggccccgcgccgaagccgtcccgctggcgccggtggttgttgcccgtgctgggcctggcctctgtgagcacctttggccttctgacgctcgaggcccggtcgcccgacctcacgcggcctgacttgagc

SEQ ID NO: 8710 - DNA, 615 bp, Myxococcus xanthus
tcagacgagcggctgatgctcgccttccaggcgggggacgcgcgcgcgttcgaggcgctggtgcgcaagcaccggacgccggtgttcaacttcatccttcgcttcacggggcaccgggcacgggcggaggacgtgctgcaggagacgtggctgaaggtggttcggagcgccggcgactacacgcccaaggcgaagttcacgacctggctctacacgattgcgaggaacctctgcgtggacagcgcgcgcaaagagagctaccgccaggcgtcttccctggaggcacccgccccgggagcggagcgggacgagtcgcgccccctgggggaaggcctgccggacgcgggggccagcccggagcgcggcgcctacaacgcccggttgcgtcccctgttggagcgagccctggcgacgctcccagacgagcagcgtgaggtcttcaccctgcgcgagtacagcggcatccccttcaaggacatcgcggaggtgacgggagtgtccgagaacacggtgaagagccgcatgcgctacgcgctcgacgggcttcgccgccggctggcggagatgggcgtcgacggcgacctcgccgaggacggaaggacggtggtgggatga

SEQ ID NO: 8711 - DNA, 297 bp, Myxococcus xanthus
atggtgggcctgttcgccgtgcgtgccccgctgaggtgggcgctggacgtgcccgccgtcctggcgctcaccgttcccgcgctggcggactgggcggtgggccgcttccggccggcgtcgggaagcaacgcggtgcgcaccctgacgggcgtgctgctgggggcggcgctcggccgctccctgtacgtgcacctgcagcagccactgccggcggtgctcctggcgcaaggcgcgctcgtgacagcggtggccgtccctgtcattctcgccacttaccagagacctcgccggggatag

SEQ ID NO: 8712 - DNA, 1637 bp, Myxococcus xanthus
atgctgcggcaggtgggcatccccgcgccggccgagcgcgtggacgcgtatccacaccagctctccggaggcatgcggcagcgggtgatgatggcgatggcgctggcgtgtgatccggccttgctcatcgcggacgagcccaccaccgcgctggacgtcaccatccaggcgcagattctggacctgctcgcgcggcttcaggccgagcggggcatggcggtgctgctgattacgcatgacctgggcgtggtggcggagagctgcgacgcggtggtggtgatgtacgcgggccgggtggtggagcgcgccccggtgcgagcgctgttttcccagcccgcgcacccgtacaccgcgggcctgctgcgctcgattccgtccaggcgcgacgtgggtggcgctcgagcctcccgggcgcggctgcgggccattcccggcagggtgccaccgctgcggcagttgcctgtcggctgtgccttccgggagcgctgtgagcgcgcgctggacgtctgtgcgcacgtgaagcccgcgctgacctcgccgcgagaagggcagtgggcggcctgtcacaacccggtgcccgcgccgtgaactccacgccgctgctccaggtccgcgacctccaggtgcacttcccggtgcgaggcggcgtgctcggccgggtgcgcggcgcggtgaaggccgtggacggcgtgggtttcgacgtcatgcgcggtgagacgctggggctggtgggggagagtggctgcgggaagagcaccctggggcgcgcggtgctgcggctggtggagcccacggcgggctccgttcgtttcgacggacaggaactcaccggactgtcccagcgccagttgcggccgctgcgccagcggatgcagttcgtcttccaggacccgtatgcctcgctcaatccccggatgacggtccgggagattctggaggagcccttcgccatccacgggctggcccgagggccgggggagcgggagcgcgaggtggcggagttggtggacgccatggggctgccgcgcgaggccctggcgcgttacccccatgagttctccggcgggcagcggcagcgcattggcatcgcgcgagcgctggcgctgcggcccgacctggtggtggccgacgagcccatcagcgcgctggacgtgtccgtgcaggcgcaaatcgtcaacctcctggtggacctgcaacaggcgcggggcctcacctacgtcttcatcgcccacgacctgaacatcgtcgagtacgtgtccacccgggtggccgtcatgtacctgggccgcatcgtggagctggccccggccgcgtcgctgtaccgtcagccgcgccacccgtacacccaggcgttgttgtccgcggtgcccgtcccggacccggaccacgcccggacgcgcctgttggtgccgggcgagccgccatcacccctggctccgccccccggttgcaccttccatccgcgctgtccgcatgccatggagcggtgccggcgcgagtcgcccccgtcctatgcgctgggcggtggccacttcgccgcgtgtttcctggcggaggccgatgcgcgcgaggccccggccgcagccccttctggaggaagtcccggtgttctggctcagccatcatcatccggatga

SEQ ID NO: 8713 - DNA, 1249 bp, Myxococcus xanthus
atggaagggggaaacccgctctccgaccgtcggtcggtcgagttccgcagccgtgacgcgctgttcaacgtgattccgctgccgcccgccgaggccgcgctggatgattcgggctactccctgcacgggacgggcgcggatgccatcacctgctccgtgggcacgttggatggcgccattggcgtggtgacgcggctgagccccaccgtggtgtgggtgatgcccaagggtgaggtggacacctccgacgcgcgcgccctgcccgtctatctgtccggctgcggcgtgacgctgggtcccatccggggcgccttcatccgcacggacgcagagacggccgggaccccggtggggctgcagttggcgaacgtctcccttgagcagggccgtcaaatcctgacgctgctggcggacgcgctgaagcgtggcgtcgcggagccggccgcgtctgcccttccggtacaggacaccatcgacgaggccgagcgcatccgcgccatcctcctggccatcagcaccgcgggcaacaagggtgtgctgcgccgcatgggccgcaccgtccgcctggtgttggagcgctacaacgcggagacggagcaactggagtggcacgccgaggacccggtgaccgactggggcgaggcgccctacgacatcgacgtcatcggccacaacagcgcgtaccgcatgcgcctggaggcgggaacgccgggcggccagcgcttcacgtcgccgctgcccgacgtcctcttccgcatccgtcaccgctggcaccgccgctcgcccgcgcccgagggcgtgcgcgtcaccttccaccacccgctgtggcgcgagcagggggagatggagcgcgcggtgttggacctgtccttctccggcatgtgcatccgctgccgcccggaggacctgctgttcccgggcctgctgccgcccctgctcgagctccacacgccggacggccagtccatcagcctgcgcggtgaaatccgctacgtcaccagcgcgcgcgctgacggcaccgtgctgtgtggcctgagcgtgtcgccctactcttccgacgaggcgcgctgggtgcgcttcgtctcccagacgaccaatcccaacacttgcaccagtgatgtgcaggaagaggggctctgggatgtcttcacgctgtctggcttcttcagcctggcgaacaagtcctctcaggaattcgacgcgctgaagcaagccttcagccacatggccaagcgcgccgcggggagtt

SEQ ID NO: 8714 - DNA, 1017 bp, Myxococcus xanthus
atgcgcaagaagattggtgagctgctcgtcgaggccggcgtcgtgacggaggagcaggtccgcgtggcattgggacgtcggggcgcattcggcagtcatcgcctgggtgaggtgctggtggcgcaggggctgtgcacgcccacgcacatcgcgcaggccctgtccgcccagcacgcgcttcccttcgtggcgctgccggaggagattccggcgaacgtcgcgggtttggtgtccgtggacttccagtccgagcaccgcatcctgccgttccggatggaagtggaaggccgcagcgagcgcatcctcgtcgcggtggatgacccggcggacgtgacgctcgtggacgagctgcgcttccagctccgcaagcagatgcgcgtcttcgtggcggcttcggacgacctggacgccgcgctggcgcgggctcggggcgagccgctggacatcgtggaagccgtggccctggaggacgaggacggtgctccgcctccgcccgtggccgctggcgcgccgctcgaatgggatttcccggaggctccgaagcccgtgcccaagtccgtaccgccttctccgccccccgctgcccgtcccccctcgctccgaggctcggcttcgcccccgcctccgcccccggaagccaccgacggcgacgccggcgcggacgcgctggatgacctgttgggccggaaggcctcgcccccggtgcggcccccgccgcctccgcctcccgacgcggagggagacggcgcggagggccggccgcgcgtgccggtggtgatgttcggaggggcggcgcagggctcgcgtccgtcggtgccgctcacgcccacgcctcagttctccgacgaggacctggccatcctggacgacatcgagcgcatctcccgcggcgaggatgcctcgctggacacggagaaggtgaagccggcccgcatggtggccagcctcatccgcctgctcatccgcaagggcgtcatccaggaaggggagttcctggaggagctggcccagaagtga

SEQ ID NO: 8715 - DNA, 756 bp, Myxococcus xanthus
atggcacagatcaagcttggtgaattgctgatcaaggcgaacgtgcttcaggagagccagctgaaggccgcgctcgccgaacaggcgaagtggggcggcaagctgggcgaaatcctggtcaggatgagcctcgtctccgaggacatcctggtgcgcgccctgtccaagcaactgggaatgccggcggtgaacctggatgcggtgcagatggtgcagccgcacgtgaaggcgaagattccggcccagacggcgcgggacttctccgtgctgccgctgcaggtgcgggatgacggcaagtcgctggtggtggcgatgtcggatccgctcaacgtgcgcatgctggacgaactgcgcgccatcaccaagtgccgcatcatccccaacgtggcgggccggacctccattgcccgggccttcgcgcgcatctacgagcagaaccacgagttggaggacgcggacaccaacttcaaggtggtggacgcccagggccgcacggtggtgaagaacctcaaggacctggacccggcggccgcggcgacctcgccgcgcggcgctccggcctcggcccgtcccgcccctgcgtccgaggctcccgccgcccgtcccgcggcggcctctggcagcccggcggagctgcttcgcaacgtggaagaagtgcagcgcaaggaagtcgccgccctcaaggcgatggtggagttgctcatcgagaagggcgtgttcacccgcgaggagtatctcgcgaaggtcaagcggtag

SEQ ID NO: 8716 - DNA, 459 bp, Myxococcus xanthus
atgctgccgggcgaggagctggtgcccatcatgctcgggcaggtgccgctcatcccgccggagcggatgacgctggagctggaccgcaagaagggcgtctacgtgctgacgctccaccggggccaggcgacgcaggttctcgacgtccacaccaagtacctgcgcatcatgaagagtcaggtgcggggcatcccggggtacgacctgggcttcgaggacttcctggagcagggcgggctcatcttcccgggccgggtgtcactggaggcgaagcaggcgaagacgaagctccaggtccgctaccagcagatcaaactcaacgcgcgaccggacctcacactctacgagttggtcccccccgagggagcccgggtggtggaggtggatgaggccggccgggagctgcccgccggggcgcccgcctccgggtcgtccgcgcccctggcaccgggttcctga

SEQ ID NO: 8717 - DNA, 192 bp, Myxococcus xanthus
gtcatcgcggagaaggcgaagggctccgtctccgcggaccacccggaccacgccttctacgagggcaagaagtacagcgccctctggtacgcgcggaacgtgctgcccaacgtggagcaggcggcgaagatgctcaccatcgaggacacctcgcccatggacatctcggacgccgccttcgcgtccgtctga

SEQ ID NO: 8718 - DNA, 1113 bp, Myxococcus xanthus
atggtggagggccgccgtccgctggggctcatctccaacatcgcttcatggaactacccactgtcggtgctggtccacgcggtgctggtccaggtgctcgcgggcaacagcgccatcgccaagacgcccacggatggtggtctctactcgctgacgctctgcatggggctcgcgcgccgctgcgggctgcctgtgtcgctcatcagtggctcgggcggacagctcagcgacgcgctggtgcgcaatccggagatcgcctgcctgtccttcgtgggcggcaaggcgaacgggcgggacatcgccgccagcctctatgaccgcaacaagcgctacatgctggagatggaaggggtgaatgcctacggcatctggcacttcagcgactgggacgggctggcgaagcagctcaagaagggcttcgagtacggcaagcagcgctgcaccgcgtacccgcgcttcgtcgtggagcggagcctgatgccgcgcttcctggagacgtacctgcccgtcgtctccgccctgaaggtggggcacccgctgctggcggagtcaccggatggcgagcctcccgcgctcgacttcggcccgctcatcaacagccagaaggtcgaggagcttcacggccatatgagtgaggcagagggccgcggcgccgtgcccctcttcgccgggcggctggacgcggagcgcttcctgccggaccaggacgtctccgcgtacctggccccgcacgcgctgctgcacgtgccgcgcaactgcaagctctaccacggcgagcccttcggccccgtggacacgctggtcgtcgtggacagcgaggaggagctcatcgcggagatgaacgtgtccaacggctcgctggtcgcctccatcgcctgcgacgagcccgacacgtgcaagcgcgtctccaccgagctgcgggccttcaaggtcggccacaacgggccgcgctcgcgcggagaccgggacgaggtcttcggcggcatcggtggttcgtggaaggggtgcttcgtgggcggcaagtacctggtccaggccgtcaccgagggcgaacccggcgagcggctgcacggcaacttccacgactacacgcagctccccgacacgcgctga

SEQ ID NO: 8719 - DNA, 1638 bp, Myxococcus xanthus
atgaaggcggcagacctgttcgtcaaagcgttggaagcggagggcgtgcgcagcgtcttcgggcttccgggagaggagaacctggacgtcatcgaggccatgcgggccgcgggcatgcggctggtgctcacccgtcatgagcaggccgcgggcttcatggcggccacgtatgggcggctcaccggccgcgcgggcgtcgttctgtcgacgctggggcccggggcgaccaacctcgtcacggccgccgcctacgcacagcttggcgccatgcccatggtgatggtcaccgggcagaagcccatccgggccggcaagcagggccacttccagattgtcgacgtggtggggatgatgcgccccctgacgaagctgacgcgcacgctcgtgtcggcggagcatgtcccttcggccgtgcgtgaggcgttccgccgcgccgaggaggagcgccccggcgcgacgcacctggagctcccggaggacgtggcccgggagtcgaccgacgccgtgctgctggcgcccagcgcccatcgccggcccgtggcggatgaggcgtccatcgcgctggccgtggaggcgattgcttccgctcgccggcccttgctcatgattggcgcgggcgccaaccgcaagctcacgtcggagatgctgcgcgtcttcgtggacaagacgggcattcccttcttcagcacgcagatgggcaagggcgtcgtggacgagtcgcatcccctgtggctgggcacggcggcgctgtcggaaggggacttcgtccaccgcgccatcgaggcctcggactgcatcatcaacgtgggccacgacgtcatcgagaagccgccgttcttcatgcgcgacagccgccgcacggtggtgcatctcaacttctcttcggcggcggtggaccccgtgtacttcccgcaactggaggtgacgggcgacatcgcgaacgcggtgtggcgcatcggtgaagggctggggcctcgcgcgcactgggacttcgtgcccttcgagaagttccgcgcaggactcgaggcgcagctcgcgcacggaggggatgacgaccgcttccccatctaccccgcgcggctcgtcgccgagctacggcgcgcgctgccggacgacggcatcgtgtgcctggacaacggcatgtacaagctgtggttcgctcgctactaccgcacgcgccggcccaacacgctgctgctcgacaacgcgctggcgacgatgggggcagggctgccttcggccatcgcggcgaagctggtgcatccccgccggaaggtggtggcggtctgcggagacggcgggttcatgatgaactcgcaggagctggagacggccgttcggctgggcctggacctgacggtggtcgtcgtgcgcgacgacggctacgggatgattcgctggaagcagggggagatgggcctgccggacttcggcatggcgctggggaacccggacttcgttcgctacgcggaggcatatggggcccatggccaccggccgaccagcgcgacggagttcggcgcgacgctggctcgctgcctggcgtcgagcggcgtccatgtcatcgacgtgcccatcgactactcggacaacgcacgggcgctcggcgcgggcgcggaggaactcgccgcgctctga

SEQ ID NO: 8720 - DNA, 1434 bp, Myxococcus xanthus
atgctggctgaacgttatccgtactacctggccaaccggccccggcagcccaacgcggagctggccgtcacccacaagtactcgggcgaggtcgtgacgcacgtcgcggtcgcggacgccgcggctgtcgaggaagccatcgccgccgccgtgcgcgccgccgagcccatgcggaagctggcgccgtacgcgcggcaggcggtgctcgaacactgcgtgcgccgcttccgcgaacgcgcggaggagctggccctggcgctctgcatcgaagcaggcaagccgctgcgcgacgcgcgaggagaggtggaccggctcatcgacaccttcaaggccgccgccgaggaggccgtgcgcggcgggggcgaggtgctgaacctggaggtgtcgaagcgcgccgcgggctaccggggtttcacccagcgcgtgccggtggggccgtgctcgttcatcaccccgttcaacttcccgctcaacctggtggcgcacaaggtggcgccggccatcgccgcgggctgcccgttcatcctcaagccttcggaccgcacgccggtgagcgcgctcatcatggcggagatcctggcggagacggagctgcccgagggggcattctccgtgctgcccgtgcggctggaggacatcgggccgctcatcgaggacgaccggctgaagctgctctcgttcacgggctcggagaaggtgggctgggagctgaaggcgcgggcgggccggaagaaggtggtgctggagctgggcggcaacgcggcgtgcgtggtggacgaggcgccgggcgcgccgctggacttcatcgcggaccgggtggcgcagggggccttcttccaggcagggcagagctgcatctcggtgcagcgcgtgctggtccatgcgtcgctgtacgacgcgctccgggagaagctcgtcgaacgggcgaaggctttgcggccgggtcatccgtcggacgaggccacgacgctggggcccatgattgacgagcccgcggcgcggcgcctggagggctggattcagcaagccgtacagcgtggagcgcgggtcctcgcgggtggcggacggcggggctcggtgctcgatgccacggtgttggagggggttccagaggatgcatcgctgagcagcgaggaggccttcggtccggtcgtcctgctccagccctttgacagcttcgacgaggctctggcccaggtgaacagcgggcgcttcggactccaggcgggcctcttcacgcaggacctgtcgcgggcgatgaaggcgtgggacgaactggaggtgggcggagtcgtcgtgggcgatgtgccgagcttccgcgtcgacaccatgccctacgggggcgtgaagggctcaggcatcggccgcgagggcgtgaagtacgccatcgaggacatgacggagcttcggctgctggtgctgcgtcaggcgtga

SEQ ID NO: 8721 - DNA, 627 bp, Myxococcus xanthus
atggacgagaagcgctaccccatcccggccgggctccaccgggtggagcaggacatccagaagagccgcttcatcaccacggccgcccatgcgcccaccgtggaagaggcgaaggccttcatcgcccgcgtccgcgaggagttcgccgacgccacccacaactgctgggccttcgtcgtcgggcctccgggctccaccgcccaggtgggcatgagcgacgacggcgaaccccatggaacggccggccggcccatgctcaccgccctgctccacgggggcgtgggcgacgtggccatggtcgtcacccggtatttcggcgggacgctgctcgggaagggcgggctggtgcgcgcctataccgctggcgtccagcaggcgctcgaaagcctccccaccacggagcgtgtgcgcaagacgcgactggccgtcgaggtggagtacacccacgtcgatgggttgcgccgcctgctgccgtcctacgaggtgcaggtcctggcggaggagtattcggccaccgtgggataccggctggagctgcccgtcacccaagtggaggccctgcggaccgcgttgaacgacctgaccttgggacaggtgctcgtcgagccgctcgattcggacgattga

SEQ ID NO: 8722 - DNA, 108 bp, Myxococcus xanthus
atggacctgcgaggccgaggtacctacggcgccgtctaccgggcccggcacatcacgggcacgcacaccgtggccctcaagctggccctgcatgaccacgggacgtaa

SEQ ID NO: 8723 - DNA, 534 bp, Myxococcus xanthus
atgagtgcttccgccagttcggagcctgccctcgtcaccagcgcgccttcgcctggcgccgacgtccatgcccaggtggtcgcgctcctcgatgcaacgacgcggactggcgccccatcagatgacgcatggaagcgcctgggaccgggagcggcgcctgtcctgtcggcgctcgtcgtggacaagggcacccctaccgcgcggcggacgctcgccgtgtcctccctggcgctggtggatccatcaggcggcgcggtgaccatccgcgacgtgctcgaggacgcgaaggccccggccgtggtgcgtgcgagcgcagcggacgccctgcgccagtgcctggggctggacgccatccccacgctcatctcccggctgcaggacccggaatcacaggtccgggaagccgtggccgtggcgctcgggcgcctgggcgggcagcaggcccggcaggcgctggaggaccgactccccatcgaggagcgcgccctcgtccgcgaggcactccagcgtggactcacgctcgtcgagccctga

SEQ ID NO: 8724 - DNA, 885 bp, Myxococcus xanthus
atggaactgcgccacctccgctacttctccgccgtcgcggacaccctgcacttcgggcgggccgccaggcgcgtccacgtctcacagcccacgctgtcgcagcagattcgccagctcgaggaggagctcggcgcgcccctcttcgagcgcgcccggagcggcgtgcgcctgacgcaggcgggcgagctgttccgcacctacgcatcacgagcgctggaggacgtggacgcgggcagggtcgccgtgggcgcgctgcgaggcctcaccaccggcgccctgcgcgtgggctacccgcccagcatgcgaggcgtcgtgctgcccgcgctcgccgccgtgctgcgaaggcactcgggcttggtgctgagcgcggaggaagccgtggtgcggcgggtggagcggcggctggcggatggccgtctggacgtggggttgggctacgcccccgcgcgctcaccggacctggaggcggagcccgtcttcgacagcaagctggcgctggtggtcgccaagggacatcccctggcgaagctggagaccgtgggcgcgaagcccctggcccaggagcccttcgcgctgctctcccgagggttgcgcgtgcgagcccgcgtggatgcctggttcgccgccatccggattgcgccgcatgtcgcgttggagtcgaacgccgtggccacggtgctggccaccgttcgcgcggggctcgcggtgacggtgctcccggagcctcaactcgcggacgccgcggggctggcggtgaagcggctctcccctgcgccccgggccgaacttgcggcgctcctgtggcgaaaaggcgcgccgcgcacgcccgccgcggaactgttcgcggccgaggtgcgcggcgccagacgcccgagcagacgatga

SEQ ID NO: 8725 - DNA, 180 bp, Myxococcus xanthus
aacaccgggagccggaatgacgccgaccagtgggacatcgtccatgtcgatacgggcgaccgcgtgacgctgacgatggccagcttctggtccaacaaggtgttcgcgtgggtggacaagcgccggcccatctgggagtcccaggggggcatgccgccgtgcggcgcgagttgccgctga

SEQ ID NO: 8726 - DNA, 1242 bp, Myxococcus xanthus
atgctcaagctccagtggctccaggttcaccagttccgctccgtgaagcccgggacgcggttgctcttcagcccgtccctcaacgtgctgctcggagagaacggcaccggaaagtccacgctgctggacctcgccgccgccgtggtcagctcggacttcacgccgctgcggcatgaggccttcgacctcgaatatgcactggccgcggacaccggccgcatcaccgtgcgcgtgcgcaacgtgccctcgggcgcggaaggcacgagcggcctgtccatggacatcaccgtggccccgcgcgacatggcctggccgctggtcatccaccgcgagggccagcagctccgcgtctctcgcgaggacgacaccaccgacgtcgtgcatgagcgcattgcccccgaagtcggtggccggctctggctcgtcttgatgacgggcggcatcgcctgggtggagaagacgggcgagggcaccgcttccgtcgagccgatgctcgccatggcgcgcgaggtctccgcgcaggccgacctccaccgcttcgacgaggggctcgcccacttcgaccagctctggcgcgccgagctgcggctctcccgtcgaacggagggcgtgctcgccacgggcacgggcgtggcctcggaggacctgctcgacggcctgcgcaaggtcgccgccgcgcagtggggcgcctcccgctacgtgctgtcgtcggagaacgtccccttcctccgtgacgccgcccggctcctcggcttcgcgtccgcggaggcgctcctgtccccgctggagacccaaccccagggcaaatacgaaacgctgtccctgggaaacctggacctctgcttcgtcaccgccgccggccagcgcctctccgcccgtcagctcggctacggacagaagcgcctggtggccttcctccactacctggcccacgcccgcgccgtcgtcatcgcggatgaggtcgcgcacgccttccacccccggcaggtccgcgccatcctcgaacagctcgaaccccggcaggccctgctcaccagccagagcccggagctgctcgacagcctcaccttcgactcgcccgagcaggtgcgctccaccttcgtgcgctgccgccgcgaggaggacaccggccgccttgtctgggagaacctgtcccctgaagccgctggggacttcttcaccgcctggcgcgccgagccccgccgcgtgggcgagctgcttcaagccaaggggctctggtag

SEQ ID NO: 8727 - DNA, 828 bp, Myxococcus xanthus
atgccgatgctgaccgtcaacagaacggacctgtactacgaggactcgggtggaacgggcgtgcccgtcgtcttcagccacggcttgctgtggagctgtcgcctcttcgatccgcaggtggaagcgctgtgcggacgttaccgctgcatcgcctatgaccaccggggccagggccagagcgccgtgcctccggcgcgcgtcatcgacatggagacggtgtacctggatgcggtggcgctcatcgagcggctgggcgtagggccctgtcacttcgtgggcctgtccatgggcggcttcgtcggcatgcgcatcgccgcgcggcggccggacctgctgcgctcgctggtgctgatggagacgtccgccgaccgggagccccttcacaacgtgccgcgctacacgctgctcaacctcaccgcgcgcctggcgggcctgcgcccggtggcggacccggtgatgcgcatcatgtttggccgcagcttcatgaccgaccccaatcgggccgaggagcgcagccgctggcgcacgcgcctcatggagaaccgccgcgacatctggcgcgccgtcaacggcgtcatcgaacggcgcggcgtggcccacgaaatcccacacatccgcgtgcccacgctcgtcgtcgtcggcgccgaggacacggccaccgtccctgccaaggcgcagcgcctgcaccggctcatccccggctcacgcctggtgaccctgccgcgcggagggcactcctccaccgtggaggagcccgcgctcgtcaatgccaccttgggaacattcctggacgcgcaattagagacgcggacctccagggcggtgtga

SEQ ID NO: 8728 - DNA, 3482 bp, Myxococcus xanthus
tcggcacccacaacgtcgactacccactctatttctgcatggcccgagcgtcccattgggacttcggcggattcatcggcacacgcaacggcggtgagcctgtcctgaaccccgtgacggacacggagaactgtccggacggatattcgcggacgcaagtgctgggcacgggcgccgtcgaccaaccgctccacctctgcgcccgccccaattgggacggcaccgagccggagctcgacttcggcggactgtggggcttcgtcaacgacaccgccgtgaaaaatccgtatacgaatgcgcaaaactgtccggcggggttcacggcccagacggtcctcgggacgatggggcaagatcacaacctccacgcctgctaccggccccatgtccccggaacgggcccgacgctcccgtttggcggcatgtggggtcacgtcgagggcagccaggtgccgaaccccgtgacggccaccgcgtcatgtcccaagggattcactccgaagcaggtgtttggcacatccggtgtcgacgcggcgctgcacctctgcgagccgcgttcggatgtcttggatttcggcggagccttcggccgcctcaacaacggcacgctctcaccgaatccggcgaccggcgccgcctcctgcccggacggctatacccagacgcaggtccttgggacctgggggcgcgactgggatgtccacatctgtcagcggccctcacgcgaggggagcccgcccctctacgacttcggcggcatgtgggggtatgtcaacgcgcaaccggtcgtcaaccccatcactcaggcggcccggtgtccggctggctatacagcgcagcaactgctcggcacgtacaaccaggattacgggctgcatctgtgttaccggccgcatgtcccggggcggattcccgagaaccgtttcggcggcatccatggccatgtcaatcagctccccgtggccaaccccgcgacgggcacgacggcatgtccgcctggcgcggtggagacgcaggtactggggacccagggcgtggaccatcccgtgtactactgcatgacgcgcgcgccgaagtgggacttcggtggagtctttggctatctcaatggtggcagccctgtttcaaacccagcgacgggcgccacgtcctgcccggacggatatgtccagacccaggtacagggctccagcaccatggacgccccgctcttcctctgctcccggccgagctgggacaacgctgagcccgcgctcgacttcggcggaatgtggggcatcgtcaacggctcctgggtgaacaacccatacacgaatgagaggtcctgcccggctgggttcgccgcgctgaaaatactcgggacagcaggacaggactcggagctccatctgtgctaccggcaccacgcgcccgggacagtgcctccgtatccatttggcggcatgtggggccacgtcaacgacgctccggcgtcgaaccccacgacgagcaccacctcatgccccacgggcttcatcccaaggcagatactggggaccgcgcacatcgaccacccagtgtacttctgcgaactgccggccaagagcctggacttcggcggagcctttggcttcttcaataacggcacgctctcaccgaacccggcgaccggcgccgcctcctgcccggagggctataccaagacacaggcgtatggcacccatgggcgcgactggagcgtacacttctgtcataggccgtccctggagggaggggctccgctctacgactttggtggcatgtggggctatgtcaacaacaccctggtgaggaacccaatcacaaacagcgccaactgcccggccggctacgccgaccagcgcctgctcggcacgaaccggctcgatcatgaactgcacgtctgctaccggccacatgccgcgaacacaccggagatggcgcggtttggcggcatgtatggaacggtccaggccgccccggtcccaaaccccgcgacggccaccacggagtgcccgagcggcttcgagaagacccaggtgctcggcacctccaacgtcgaccacccgctctacttctgcatggcccacgcgcccggctgggacttcggcggcttcatcggctccatcaatggaggggagacggtccccaaccccgtgacgggcacggcgacgtgtccggacggccatgtccagacgcaggtgtcgggcacggactcggttgactggccgctctccgtctgcacgcggcccaactggggagacaccgagccggcgctcgacttcggcggtctctggggctacgtcaaccacaacgccgtgaacaacccgtatacgaacgcgcaagcgtgtccggcggggttccaatcccagaaggtgctcgggacccacggacaggactacgacctccacgcgtgctaccgcccccatgtccccggacaacgctcgccgtatgcgttcgcggggatgtggggccatgtcaatggcgtccaggcgccgaaccccacgacaagcgccgtgtcctgccctcgcgggtttgcccccacgcaggtgtcgggagcccagggcacggacaacccgttgtacatctgcgagcccctccaatcgaagttcgcgcctcgactgcgctttgatgggtccgcgcgcggctaccccatgtcggcccaggtcttctacgacgcggcggtcgtgaacccgcagcagggcatcatccagaacacggacgcctccacgctggggacgggcacgattcccacctactaccaactcatcgagtgcggccagcaggtgcgcatcaagtactggtggttctacggctatcagtccgcgtgcgacgaatacggccgcggcacccaccacggcgactgggaagacgtcacggtgaccttgagcgaggacaagtccaccatcgcggccgtcaccttctccatgcacgggaagcgctacacgcggctcgccagccgcggaggcttccaggtggaggacggcacgcaccccgtcgtttacgtcgggaagaactcgcatgccgcccactacaagcaaggcgggagcggcgtgggggacaactgcctgccctgggaggagtaccgcaacaactcgaccggcacgcacctggatagctggctgaacctggtgagcctcgacaccgacgcagagccctggatggtggccgaccgcattggcaacttcgtgtgggggtacgatggcgtcagcacccacccgacccgctccggccccagttgccgcatgaacgccgcccactggtccttcacggtgcccacgtggtggcatagccagtgcaaaacgggcgaccgcgatgacggaacgagctgccactccgcgtgccgctccgggtacacggatatggggctgacctgtacgaactggagcatcacctcgctccacacgtaccggcagcacatctacgggtatgactacaccctgccgacgtcggaccgcggcctcatgattggagagccgcactga

SEQ ID NO: 8729 - DNA, 594 bp, Myxococcus xanthus
ctcttgcacctggacctactatcggggctccaggccgccgtggcacgccagccctggtggcttcaggcactcgaagcggtggtgctctgcgacctgctcgtctacggcttccaccgactgtcacaccaggtggacttcctctggcgcttccacgccgtccatcactccgctgagcacctcgactggctcgccgcgcaccgcgagcaccccgtggacggactgctcacgcagttggtggtgaacctccccgcgatgatgatgggctttccgctcgggacgctggcgatgctcatcgccttccgcggggtgtgggccatcttcatccactccaacgtccggctaccgctggggccgctgggcttcctcttcggcgcgcccgaactccaccactggcaccacgcgcgcgaacggcacacacggcacaacttcggcaacctcgcgccgtggacggattggctcttcggcacctactaccgtcccaccgggcccgagcagtatccgctcgggctcgtggagccgtttccccggcgcttctgggcccagctcctctcgcccgtgacgcgggcaactgacagcaggaatacgccacgctga

SEQ ID NO: 8730 - DNA, 1359 bp, Myxococcus xanthus
acggagctccaggagaggagtacacgcgtgaagcgggcggacatcgtcggattggacaaggcgcacgtctggcatccctacacggcgatggaggcctacatcgcggagacggatccgctggtggtggtgcgctcggaaggggcgtacctccatgacgcggacggcacgcgctatctggacgccaacggctcctggtgggtgtccacgctgggccaccgtcacccgcgcttgatgcgcgcgctcgccgagcaggccgccgcactcccacacgtctccctggcgggcatcacccacgagccggcggccttgctggcgtcggagctggcggccatcgcccccggctcggaccgccccggccttccctcatccgagcggctgtcccgcgtcttctattccgacaacggcagcacggcggtggaggtggccatcaagatggcggcccagtactgggcgcagaatggccagccgcgccgcacccgcttcatcacgctgtcgggggcattccacggcgagacgatgggcgccaccagcgtggggggcgttcccctgttccgggaggtcttcggcccgctgctcttcgacgtggtgcacgtcccctctccagcggaggaggggggctgggcgcgcgccttcgagcaagtccagtccaccctgcgggcgcacccggaggtgattgcgggcgtcattttggagccggtgctgcagggcgcggcgggcatggtgatgtactcgccagacttcgtccgggcggtacgtgaggccacgagcgaggtggataccttcctcatcgccgacgaggtcttcacggggctggggcgcacgggcgcacgcttcgcggtggacctggcgggcgtggtgccggacatgctgtgtctggcgaaggccctctcgggaggaatcctgccgtttggcgccaccctggcctcggagcgcgtcttctccggcttcctcggggcgtcgaaccgggcgctgtattacgggcactcgtactgtgggaacccgttgggcgccgccatcgcccgggaagtgctggccgtctaccgggacgaggatgtgatggggcaggtggctcgaaaggccccccgcgtgaaagccgccttcgagcggatggccgcctcgattccgggcctggttcgcccccgcgccgtgggaatggtaggcgcggtggacctgggcggtggtggttacctcgctcggggagggtggcgagtgtacgaggccgcgcgtcgccgagggctctacctgcggcccatgggagacaccgtgtacatcgcgccggcactgactatctctgacgaggcgctcgaggagctgctgtccggagtggaagcgtcactccaagaagtcgccggcggctga

SEQ ID NO: 8731 - DNA, 693 bp, Myxococcus xanthus
cgaatggccgtcctcatcttcttcgtctcgcactggctgctctgcgtgttcttccagagcttcttccagcaccggtacgcggcccaccgcatgtacaccatggggccgaagacggagcgggtgatgcacctgctcacctacctggtgcagggctcgtcctacctgtcacccaaggcgtacgccatcctccaccgtgagcaccatgccttctccgacacagagaaggacccgcactcgccccacttcttcaaggatgtggcgcggatgatgtggcacaccaaggcgcgctacgacgactacgcggccggccgcggtcaacccgaggcccgcttcctgggcggctacccggagtggccgctcgtggacaccacgctgcgcacctcatggttcgccaccctgggctgggtggccttctactccgccttctacgtgatgttcgccacctcgccctggcagttcctgctgctgcccctgcacttcctcatgggcccggtgcacggcgccatcgtcaactggtgcggccacaagtacggctaccggaacttcgacagcaccgacaagtcgcgcaactccctgcccatggacttcctctgcatgggggagctcttccagaacaaccaccataagtacggcagcagccccaacttcgcggcgcggaagttcgagctggaccccacgtggcaggtgatgcgc

SEQ ID NO: 8732 - DNA, 222 bp, Myxococcus xanthus
caagtctacttctgcgacccccacagcccctggcaacgcggtagcaacgagaacaccaacggcctgctgcgccagtacttccccaagggcatggatttgagcggcctgtcgcgcgcccagctcgacaccgtcgccctccaactcaacacccgcccccgccagacgctcgactggcgcacccccgccgaggtattcgctcaaagcgttgcgatgaccggctga

SEQ ID NO: 8733 - DNA, 1245 bp, Myxococcus xanthus
atgaaggccatggacttcgagcccagtgagcgagccaaggactacctggagcgcgtgaagcgcttcatgagcgagcacatcctgccggcggaggcccgctatcacgaagagctccgagccaccgcccagggcggcgactggaagacgtggcgcgtgccccccgtcatggaggaactgaaggccctggcgaagacccagggtctgtggaacctgttcctccccgacgagaagctcggcgccgggctcagcacgctggagtacgcccccatcgccgaggagaccggtcgcagcttcatcgcccccgaggtcttcaactgcagcgccccggacaccggcaacatggaggtgctctggaagtacggctccgaggcgcagcaggagcgctggctgaagccgctgctggccggagacatccgctcggtgttctgcatgacggagccggatgtggcctcgtcggatgccaccaacatggcggccaccgccatcgtcgacggcgacgaggtcgtcctcaatggcagcaagtggtggtccagcgggctggggcaccccaacgcgaaggtggtcatcttcatggcccgcacgcccgacaccggaggggaccgccatcaccagcactccatggtgctggtgccactggacgcgccgggcgtgagcatccgccgaatgcttcccgtgtacggcgactacgacgcgccccacggccacggtgaggtccacttcgacaacgtgcgcgtgccgcgagacaacgtcatcgccggaccggggatgggcttcgagattgcccagggccggctcggaccggggcgcatccaccactgcatgcgctgcatcggcgcggcggagcggtccctggagctgatgattgaccggggcatgaagcgcacggccttcgggaaaccgctcctcaacctgggtggaaaccgcgagaaggtggcggaggcgcgcatcgccatcgaccaggcgcggctcttgacgctctacgcggcctggaagatggaccaggtgggggcgctcggagccatgacggagatttccgccatcaaggtcgtcgcgccaagtgtcctccagaaggtggtggatgacgccatccagcttcacggcggcgcgggcgtatcccaagatacgccgctggcgggcttcttcgcccaggcgcgcagtctgcgcctcgcggatggcccggacgaagtgcacaagggtctcatcgcccgcatcgagctgtcgaagcggggcttctcccggagctga

SEQ ID NO: 8734 - DNA, 681 bp, Myxococcus xanthus
ctcctcttcgatatcgatggaaccctggtcaccactggcggcgcggggcgccgctccatggaagccgctttcgagaagctgcacgggcggcgggacgcgtgcgactcgttccccatgtccggcatgaccgaccgggccatcgtccgcaaggcgatgcacatcatcggcgtggaggactcggccgcggccatcgacgcggtcatcgacgcctacgtcgcccacctcgccgaagaggtccacaaggtggatgaccagcgatacctcgtcttcccgggcatgcgcgaggccgtgaaggaggcccggtcgcggtccgggttcgccgtgggactgggcacgggcaacgtccgtgagggcgcccgcgtgaagttggagcgcgtgagcatctacgaccagttcgacttcggcggcttcggctgcgacaacgaggaccgcaccgagctgattcgctgcggcgccaaggccggcgccgcaaagctgggcgtccccgtggaggaatgccgggtcgtcgtcatcggcgatacgcccaaggacgtccatgcggcccagggcgtcggcgccgagtgcatcggcgtggggaccgggaccttctccgtgcaggccctcctcgacgcaggggccacggtcgcctttcctgacttctcgcatccccaggccctggagattctgctcggcgggcgctga

SEQ ID NO: 8735 - DNA, 825 bp, Myxococcus xanthus
atggcaactcaacgcatcttcatcaccggtggtgccagcggacttggcaaggccatcgccgtgcgcttcgctcgcgccggctggaaggtctgcatcggcgacgtcaacgacacccgcggcgaggaggccttgaaggagctctccgcgctggcgccccaggcccattacctgcgctgtgacgtgcggcgcgaggaggacctgcgcgaggccctggactggctcacggcccagtggggcggcgtggacgtggtcatcaacaacgccggtgtcgcgcaggcgggcgccatcgaggacgtgtcgattgatgactggcagtggatcatcgacatcaacctgctgggcgtcgtgcgtggatgcaaggtgttcacgcctgccttcaagaagcagggccacggccacatcgtcaacgtggcgtccatggcgggcctgctcgatgtgccgctgatgagcagctacaacgcgaccaaggccgccgtcgtgtcgctgtccgagacgctgcacaacgagctggcggagtacggcatcggcgtcagcgtcgtgtgcccgtccttcttcaagacgaacctgggtgactcgctgcgcaccacggacccgaggctgggggccaccatggcgcggctgctggagcgctccgccatcaccgcggatgacatcgccaacgacgtgttcgacgcggtggctgagcgcggcttctacgtcctgccccatgcggatggccgcaggacctgggcgctgaagcgcctgctgccgcgtgagctttattcgtggatgctgcgccggaatacgcgaggcatgcgccccggttcgcagccgaaggcgagctga

SEQ ID NO: 8736 - DNA, 840 bp, Myxococcus xanthus
atggcccgtgagtacacggtgcagcaggcactgaagccggcctatcccgtcgtgcccaccatggtgggcctgtgccaggacccggccgtgctgggctccgacttctacgtcatggagcgcatcgaggggctcatcccgcgcaagcacctgccccgggggctggccctggacgcgaagcagacgcggacgctgtgcctcaacgtcatcgccaagctcgtggagctgcacgccgtggacccggtggcggtgggcctgacatcactgggcaaggggccgggctatcccacgcggcaggtggagggctggtcggcgcgctacgagaaagcacggacgtggaacgtcgccagcttccgctacgtgcgcgactggctcaaggcgaacacgcccgcggacatcgccacgtgcgtcatccacaacgactggcgcttcgacaacgtggtgctcgccccggaggagcccacgcgcatcatcggcgtgctcgactgggagatggccaccctgggtgacccactgatggacctgggcagcgcgctggcctactgggtccatgccgacgacgacttcctgatgcgctccacgcggcgccagcccacgcacctgcccggcatgctccggcgcgaagaggtcgtggcgtactacctggaccagacgaagctgaagcccgccaactggaccttctacgaagtgttcggcctcttccggctcgccgtcatcgcccagcaaatctactaccgctaccaccacaagcagacgcgcaaccccgcgttcaagaacttctgggtgctggtcaactacctgggctggcgctgccaccggctcatccgcaagggggcacgctga

SEQ ID NO: 8737 - DNA, 693 bp, Myxococcus xanthus
atgggcgtggtgtatctggtccggcacggccaggcctcgttcggcgcggcgaactacgaccaactgtcggagacgggcctcgtacaggcccgggtgctcggtgagtccctgcgcgagcggctcccccgtgtggacgccgtcgtcaccggcaccatggcgcggcaccggcagacggcggaggcgtgcctcgccgcgctcggttgcggcaccgtggccgtgcagacggcgggcttcaacgagttcgaccacgaggaaatcgtcgcccggcacacgccacgctacgcagacccggaggtgctccgagcggagttgtcacagacggagtcaccccggcgcgcctaccaggcgctcttcgccgacgccgtggcccgctgggtggccggccagcacgacgcggagtacaccgagccctggtccgccttcggcgagcggtgccgccgcgcgatggatgccctcatccaggagatgggcgcgtcgaagaacgcgctcgtcttcacctccgggggcaccatcaccgccatctgccaggagctgctccacatcctcgacgagcacgccttccgcctcaacctgacgctggcgaactgcggcctcaccaaggtcatctacagcgagcgcggccgttatctgtccacgctcaacgagcacagccacttcgaaggcgcccagcgcgcgctgctcacataccgctga

SEQ ID NO: 8738 - DNA, 369 bp, Myxococcus xanthus
atgcttccagaggaagacttcctggccgcggaggaggcgctgagacgggccatgctctcgagcgatgtcgccgcgctcgacgccctcctctccgacgacctcctctttgtcagccacaccggccgcgtcctcgacaaggaatccgacctggaatcgcatcgctcgggagccctgcgcctcacacgggtggacttcaccgacacacatttccgctacctctccgcgggcgccgtggtcgtcgtccatgccgcgctatccggtgagttccagggaacccgcttcgaagggaacttccgttacacgcgcgtgtggcaggttgtggacaacgcgccccaggtcgtcgcggcgcagtgcacggcggtgggttga

SEQ ID NO: 8739 - DNA, 1005 bp, Myxococcus xanthus
cgcgcgggcagcaagggcggctggtgggagccactcatcggcccgcggcgcgcgctggacccgtcccgcgtgcggctcctgtgcttcaacaacctgggctcctgctacggcaccagcggcccggccgacgagggcttcccgctgcggacggatgacgcgcgcttcggtccgccgttgccgctgcccaagggcgacctgcgccaggacgaacagcgcctgcccgccaccgtcacaccgtgggaccaggcccggagcattctgctggccatggacgcgctggggctggacgacgtggagctcgtcaccggcggctcactgggcggcatggtggtgctctgcctcacggcgttggcgccggagcgcttcgcgcgcctcttccccatcgccaccacggagtccgccaccgcgtgggtggtgggcctcaaccacgtggcgcggcaggccctgctgatggacccgggcttccccgagtccccccaccggggcctggaattggcccgccagctcgcgatgctcacctaccgcgcggagcccggcctggaagcgctccagggccgccccgccgagtggtcctcacgcgcgctgcaccccatgcacagctatctggaataccagggccagaagctggagagccgcttcgacgcgcgcgcgtacctggcgcagttgggcgccatggaccaccacgacctgtcacgcttcccgggaggcggcctggcccgcatccgcgcgagcgcgctgtgcgtgggcatcgacaccgaccagctcttcttccccagccacatggcgacgctgacgcggcggctgcgcgagcacggcctccacgccgagcacgccacgctgtccagtcaacacgggcacgacggcttcctgctggagtgggacgccatggccgtcctgctcgcgcgggcgctcgccctgcccacggccaggggcccggagcacgccttcccgcgctggccggaagtgcgccccgccctcaacccaccttgcgggacgaaggcgtga

SEQ ID NO: 8740 - DNA, 906 bp, Myxococcus xanthus
atgaaccctgttcaggattcggcgcggctcgcccggctggacctcaacctcttccgggtcttcgacgtggtgctccgggagcggaacctgacgcgcgcggcggaggtcctgttcctcagtcagtcggccgtgagccatgcgctggcccgcttgcgcgagcagttgggagagccgctgttcgtccgggaggggcgcggtgtggcgcccacggcgttcgcggagcggctggcgccggagattcgggaggcgctggcgctgttcgaacaggcggttcatcgcggacgcggcttcgacccgcgccgggacgtgggccagttcacggtggcgatgaacgacgtgctggagccgtcgattctcccgctgctcgtggctcggttacgggcgcacgcgccggaggtccgtatctccagcgtccgactcgaccgggcgcggctggagcgggacctcgcgtcggggcggctggacctctccatcgacgtggagcagcagaccggagcggagctgaagcgcacggccctgttgcaagacacgttctgcgtggtgagccgaagcaggcgcaagctggacgtggcgaagtacatggcggcccggcacgtcaccgtgtcctcgcgccgcaccgggctggccgtggaggacctggtgctcagccgcctgggctaccagcgtgacgtcgtcgtccggtgtcagcactacgaggccgcgttcaagctcgtcggggactctaacttgctgctgacgatgccgaggcggcgcgcggcggagttgcacgcgctgctgggcaaccacctcctgccgatgccgctgtccctgcccccgctggagcttcacgtctattggcaccggcagacggatgcggacccgcgcaaccgctggctgcgaggcgaattgctcgcgctgacggggtag

SEQ ID NO: 8741 - DNA, 888 bp, Myxococcus xanthus
cgcgaagcgcatcccaggagcattggcatggcatccagcgactacgcccgcatcgaacaagccatcctctatctcgacgcacatgcgcgcgagcagccgtccctggacgacgtggccgcgcacgtggggctgagcaccttccacttccagcggctcttctcgcgctgggcgggcatcagccccaagcgcttcatccaggtgcacacgctgagctcggcccggcgcctgctcgacgagcgtcgcagcgtgctggagacgtcgctggaggtgggcctgtcgggcagcggccggctgcatgagctcttcgtgacgctgacgtcgatgacaccgggggaatacaagctgggcggcgaagggctcaccgtgcgccacggcgtccacctgtcaccgttcggcgcgtgtctgctcgccgtctgcgagcgtggcatctgcagcctgcacttcctcgcgggtgagtcagaggaggaggcgctcgcctcgctgcgcaagcagtggccgcgcgccacgttcgaggcgtccgccgaggacacggcgccatggatggagcgcatcttccaggcggggcacggtggctcggagtcgagccccttgtcggtgctggtacggggcacgcccttccaggtgcaggtgtggcaggcgctgctgcgggtgccgtcgggcgaggtgacgacgtacgaggacctcgcacgcgccattggcaagcccaaggcgatgcgcgcggtgggctcggcggtcggcgagaatcccgtggggctcttgattccctgtcaccgcgtgctgcgcaagacgggtgtcttcggggagtaccgctggggcgcctcacgcaagcgggcgatgctggcgtgggaggacttgcggtacgacggcgcgccgctcagcggtatgtga

SEQ ID NO: 8742 - DNA, 417 bp, Myxococcus xanthus
cacttgagcggcaaggtgcgcgagacgttcaaggcggaagcgctctccagctcgtcgctggcggccccggccatggcgctggcggccatggacccgcgcatcgtccactcgttccacctggcgaagcacctgatggtcgtctcgctgttcgaggcgcgcttgggtctgccggggctcaccatctccgatgtgcgggaccggttcggctgcctggcgctgtcactgcaacgcaatggcgaggagcggctccacccgcagggggaagaggtcatccggcctggagacgtgctgtcgctccaggcgtcctatccggagtaccggcggctgcgcgccttcacccacgaggccgagccgcccctgtggtcccaccacgcgccggtggcggtggtcacgccttcgtcccgcaaggtgggttga

SEQ ID NO: 8743 - DNA, 189 bp, Myxococcus xanthus
ttcggctcggaggtgtccgggctggcgccggaggtgatggaggggggcacggggacggccgtcaccattcccatgctggaggaccgccggagcctgaacctgtccacgtcggtgggaatcgggacctatgaggccctgcgacaggtccgtttcaccggagcgggcaggcaagcgcccccggcaagttga

SEQ ID NO: 8744 - DNA, 1638 bp, Myxococcus xanthus
atggaggaggccctccgccgctcgaagtccctgccgctcgagccatggctcgcggacgagccgcccctgtcgacaccgcccacgcggacgcaggaccgcgtccccatccaggacgagcagtggcacaccgaggccatctccctcagcgctgcgtccgacaccgagtcggaactcccgctgctggaagtcgaacccgagcccgaactttgggccgtcgccgagccactgccggcgccagcgacccgtcccgccgcgggcgaacctccggtcctcacgcctgtcgccgaagacgacgcggacatcctgctggaggcgacccccgacgaggaggacgacgccagttgggccacccaaccgtccgcgccgccgccgcgcccggccacacccaagaccggggacgaggacctctggcgcatcgtcgccttcgacaaggacgagggcgccgacaccctgacagcgtcgttcgaggccgcgctcctccaagtcgatacgcacctggagtcgctcgtccgctcggatgtcaatcaggcgaacgtcgatttcgacgagcctcctgtcgaggccattgtcgaggcgaccatcgaaccggtagcacccgattcatcgggggccttccccggtgacaactcatggccaactggccagactgactgggacgagccgtccggagacttggacgactgggactttgacgaggacgacttggcggcagatccctccaaccccgacgaggcagcaaagctccggcggcagcgtctcttgcgtcgcgccatggagaacatgggggtcctcggtgggcgcccgccctccgcaccgggcgccacgccctcgcccacgagcgaacccgccgccgccccggcccccgctgcctccgagcctcccaggcccgacgaggcccgcctggcccagcagctcgagcagcgcttcgcggacgtccaggccaagcgagaccacttctacgtgctcggcgtttcgcaggacgcctcgcgcgaccaggtgaagaccgccttcctcaacctggccaagatcttccatccggaccgcctgccgccgtcgctgccccacatggcgccgaagatcaccgccgtgttcgaagccatccgagaggcctacgaggtcctctacgacgacacccggcgcaagacgtaccagcagaacctccaggcccagcagaccctgcccaagccgccgtcgtccgcgccgaccgctccggtactccgcccgcagggccgcgccgacagcaatgccgacgacctctacaagatgggcgaggtcttcttccgcaagcgcgacttcaccacggcctccgaccactacgaccgcgcccacgcgctggaacccaagccgctgtatctggctgctcgggcctgggccatctacatggacccggcgcgcaaggcggacatggcgaaggccaagcagatgatggcggacgcggtgcgcgcggacccgaattgtgatcgggcgcactaccagctcggcgtcatcgcccgggtcgaaggcgacatggaccgcgcggagcgttgcttccgcgaggccgtgcgcgccaaccccaagcacctcgaggcgaaccaggagctgcggctcatcgacatgcgcaagaagaaccctccgaagaagggaggcttcttccgctga

SEQ ID NO: 8745 - DNA, 1404 bp, Myxococcus xanthus
atgtcgtccacgctcgaatcgtacgagctcatccgcttcgccgaagccttcgaggcccgcctcgccacggcgggggaaatgctcaccggcaggcccggcctcgacgccgaaaagggctggctgaccaccgcgctggaactggtgcgcaccgcgcgcgcgcccaccgagggcgtgctcgaccgtgtgaaggacctccccgagttggaagaggctcgcgaggagtatgcgttccaccagcagggcatgtgggtggacgtgctggagaagctgctcgccggtatcaccttcaccgccagcagccgcgcgcccgtcatcgaggccctcttccctcacctgaagttcccgcaactgcggcgagccccccgcgaagccgtcctcgagtacgcgacgtcctacgagcggcgcacgaagagcgcttatgtgacgcgcatcttcgcccgggatgacttcgcactcgtgcggcccgtcatggaacaggtgctgaccgcccataccgcgtggcgctctagccatgagccgtcgcccctgacgctggaacaggaggccctccttcgtgaggaactggtgtcgctcggccggaagctcgagcagtcgcttcgacaggcgcgactgctggccgaagccgcgctcgtgcccgcccccactgtctatgaggccgccgggctgaacctcaagcccaagcgccgcgcgggacgggggctgacgctctccgacgacgcgctggctggcttcgatgagccgaccgactccatggagcccaccgaggccgaactcgccgaggtcgcggcactggattcaggtggcgacatcgcaagccctgctgccgtggcaccgtcggccgctcgcggcgacacggcggcggagggtggcgactcgtccgccagcgcagccagcccagaggtgctccaggactctggcgcagagcgctcggacaacggtggcgactcgggcccagtgggtggcgccgagctgaaggccgagggcttgtcctccacgacagagaccggcgtggcctccgcgagcactgcttctgagtcgaacgatggcgctgtcgcccagccggaagcagctgccgagggcgcggaactcgcggacaaggccgctgtggacaaggcggcccgggtcgacgggggcgatgcgtcccctcaagccacggatggagcggtgacgaacgacagccggcccgcgactaccgacgaggccgccgcgcaagcccgtaacgaggcatcctctaccgcgccacgcggcgcgcgacggggtcgcaagaaggccgatgcagcggagcctgccgcgaccgaggccaccgaacctccggcctcgggggcggctcaggtgcctcgcatccgaaagaagaaggcttcctcgcagtccgccccaccgactcccgacgcggacacgccttaa

SEQ ID NO: 8746 - DNA, 1676 bp, Myxococcus xanthus
ctgctcctggtcgatggtgacgcgaagagcctccgggtcatggaggtcagcctgaagaaggccggcttctccgtgacgacggccattcacggcaaggatgcgctcgagaaggtccagatcagccctccggacctcgtgctcgcggacacgaagatgccggagatggacggcttcgagctgtgcaagacgctcaagtccgacgagcgcttcaagttcatcccgttcgtcttcctgacgagtcagaagtcggtcgagttcaaggtgcgcggcctggagcttggcggtgacgactacctgaccaagccgatctacatcaaagagatcgtcacccgcgtgaagatgatcctccagaaggcggagaaggagaggatcgagaagcgggagacgacgaagggcggtttcgccggcagcctcgccgacatgggcgtggtggacctggtgcagaccttcgagattggccgcaagacgggcctcatcaacatccagggcgagcgcaccggcaccgtctacttcaaggacggacgcgtcatcgacgcggagctgggacggctcaagggcgagaacgccttctaccggatgctgaacaccttcgagggccagttcgaggtgcagttcagcgcgctggaccgtccggagcgcatcgaaatctccacgcagggcctgctgatggagggcatgcgccgcctcgacgagtggggccgcatgctcgagcagttgccgccgctcgagacggtgttcgagattgactaccaccagctcgccgaccgcctgtcggagattccggacgaggtgaacggacttctgcggctcttcgacggcaagcgcgcgttgagccgcgtggtggaggactcggacttcgaggacctggccgcgctgggcatcatcagcaagctgtacttcgagggcctcatccgcgagctgggcaacgcgccgctggagccggtgcagagcagcaagcccggcatcgagcagtggctcaacacggcgccgcccgccagcgcgaccgtggagcccgcgcctcccgcgccggagagcccgccgcagccgattcccgaagccgccgttcccgaagcggcccccgagcccgtggccgccgcgccggagccttctccgcggcccatgccgcagagcgtgctcgcgcctcccgcgggcgtggaggacgagccggccgcgccgtcgcccgccgcgcccgcgcagcccgccgacgtggtcgtcttccacgcgcggcccaagcgctcggacacgcctgagtacacgcccgaagttccggtgaccgagccggtcccggaggcccccgcgcaggaggcttcggcgttcctggtcgagccgccgccggcccaccgtgccgtggagcacgcgcgtcgcagcctgctgctggactggagccgggtggacaccgagggcatcagcgcgcccacgacgtgggggccgggctctggctggtcgcacacgccgcgggcccatggcgccgcctcctccgctttcgccgcgagcgcgcccgcattcgagcccgtgccctcgccgcgtgcgcccatcttcggtggcgcggccgtggcacccaatccgttcccgcccgtgcccccgccgacgccggcgccgccgtcgtccgaggtgacgctggtgagtggcagcggctacgtgacgccgcccatcccgtcagtgcaggtcgatgcgga

SEQ ID NO: 8747 - DNA, 537 bp, Myxococcus xanthus
atgctcttcttcgagccgcgcttcttccgccagccgagcctcttcagcgagacgcgcctcttcggctacgcgagcctcttctgcgagacgtgcctcttccgccagacggcgctcttcttcgagacgtgcctcttcagcgagacgtgcctcttccgccaggcgacgctcttcttcgagacgagcctcttccgcgagtcgagcctcttccgcgagacgagcctcttccgccagtcgagcctcttcagccagtcgacgctcttcttcgagacgagcctcttccgccagacgagcctcttccgccagacgagcctcttccgccagacgagcctcttccgccagtcgagcctcttccgccagtcgacgctcttcttcgagacgagcttcttcggcgagccgagcctcttccgccagtcggcgctcctcttcgagccgctcctcttccgccaagcgggcctcttccgcgaggcgagcttcttcggcgagacgggcctcttccgcgaggcgagcttcttcggcgagccgcgcctcttcagctag

SEQ ID NO: 8748 - DNA, 537 bp, Myxococcus xanthus
atgctcttcttcgagccgcgcttcttccgccagccgagcctcttcagcgagacgcgcctcttcggctacgcgagcctcttctgcgagacgtgcctcttccgccagacggcgctcttcttcgagacgtgcctcttcagcgagacgtgcctcttccgccagacgacgctcttcttcgagacgagcctcttccgcgagtcgagcctcttccgcgagtcgagcctcttccgcgagacgagcctcttccgccagtcgacgctcttcttcgagacgagcctcttccgccagacgagcctcttccgccagacgagcctcttccgccagacgagcctcttccgccagtcgagcctcttccgccagtcgacgctcttcttcgagacgagcttcttcggcgagccgagcctcttccgccagtcggcgctcctcttcgagccgctcctcttccgccaagcgggcctcttccgcgaggcgagcttcttcggcgagacgggcctcttccgcgaggcgagcttcttcggcgagccgcgcctcttcagctag

SEQ ID NO: 8749 - DNA, 426 bp, Myxococcus xanthus
tcccgtgcccagcccccggacaccgtggtcctcttcgacggcgtgtgcaacctgtgcaacggcacggtcctcttcatcatcgaccgggaccccgaggcgcgcatccgcttcaccgccctgcagtcccagcgagccgccgcgctgctggcgccccatggcgtcgtgcccaaggaggaaccggacagcttcgtcctcctgcaggacggcaagctgtacgagcggtccacggccgcgctccgcgtcgcgcggatgctgaaggggccgtggcggtttctctacgctttcatcgtggtgccccggccgctgcgcgacctcgtctaccgaatcatcgcgcgcaaccgctaccgctggttcggccgggaagctcagtgccgcatccccacgcccgagctgcgagcccgcttcctcccggagaccactccgtag

SEQ ID NO: 8750 - DNA, 1392 bp, Myxococcus xanthus
gtcccctccaggaaggtgttggaagcaatggtgaagctgccgatctacatggacaaccacgccaccaccccgctggacccgcgggtgctggaggcgatgctgccctacctgcgagaggacttcggtaacgcggccagccgcaatcacgtgttcggctggaaggccgaggcggcggtgaacaaggcccggcagcaggtggccgagctcatcggcgcggccgagcaggagatcgtcttcacctcgggcgccaccgagtccgacaacctggccatcaagggcgtcatcgagttctacaagtccaagggtgaccacatcatcaccctcaagacggagcacaaggccatcctggacacctgcaagcgcctggagcgcgtgcggcaggagcggttggacgagctgaagctgctgcggctggcgcagttggcgggccaggacgtcaccgaggacaaccagtcggagctgctgtcgaagtacgacgtggactccgacgagacgtaccgtaagtgggccgagctgcccaccggcggcgcgcgcgtcacctacctggacgtggagcccgacggccgggtgagcctggagaagctggccgcggcgatgacgccgaagacggtgctggtctccatcatgttcgccaacaacgagattggtgtggtgcagcccatcgcggagattggcgcgctgtgccgctccaagggcgtgctcttccactgcgacgcggtgcagggcatcggcaaggtgcccttcgacgtggaggccatgaaggtggacctggcctccatcacctcgcacaagatgtacggccccaagggcattggcgcgctgtacgtgcgccgccggccgcgcgtgcgcatcgcgcccagcatcgacggcggcggtcatgagcgcggcatgcgctccggcacgctgaacgtggcggccatcgtcggctttggcgtggctgccgagctggctcgcaaggagctgcccgaggagtcggcgcgcctccttcgcttgcgtgaaaagctgcgcaagggcctcacggacgcgctggacatgaccgtcatcaacggctcgctggagcaccggctgcccggcaacctcaacatctccttcgcccacgcggagggagagtccctgatgatgggcatcaaggacgtggcggtgtcctccggctcggcgtgtacgtccgcctccctggagccctcctacgtgctgcgcgcgctgggcgtggacgaggagctggcgcacagctccatccgcttcggcctgggccgcttcaccacggaagaggaagtcgactacgtggtgaacctcgtagtggacaaggtccgcaagctgcgcgacatgagcccgctctacgagatggccaaggaaggcatcgacctcaagagcatcgagtggacggcgcactag

SEQ ID NO: 8751 - DNA, 402 bp, Myxococcus xanthus
atggcttacagcgacaaggtcatcgagcactacgagaacccccggaacgtcgggacgctcgacaaggaagacccgaacgtgggcaccggcctggtgggcgcgcccgcctgcggcgacgtgatgcgcctgcagctcaagatttccgaggacgggctcatcgaggacgcccgcttcaagacgttcggctgcgggtcggccattgcctcgtcgtcgctcgtcaccgaatgggtgaagggcaagacggtggaccaggcgatgaccatctccaacaaggacgtggcccgcgagctgtcgctgccgccggtgaagattcactgctccgtgctggccgaggacgccatcaaggcggccatcgaggacttcaagaagaagcgcgccgcgcgtcaggccaaggcgtcctga

SEQ ID NO: 8752 - DNA, 399 bp, Myxococcus xanthus
atgagcgaacaggcgacccaggagacgacgcagcgccaggcgcctgccaccgcgcccgtggccaagccccccaagggcatcaccattgccgacagcgcggtggcccggctgaaggagctgctggagcagcggcagacgcccgaggcgggcttgcggctggccgtgaagggcggcgggtgctcgggcctccagtactccatggagtggtcggagaagtcccgcgagcgcgacaagattttcgagaaggacggcgtgcgcgtcttcgtggacccaaagagctacctgtacctcatcggtaccgagctggtgttcgagcagacgctcatggcctccggcttcaagctggacaaccccaacatcaaggcggcctgcggctgcggagagagcttctccgtctga

SEQ ID NO: 8753 - DNA, 549 bp, Myxococcus xanthus
cacttcgacgtcttcggcctgaagcgcgcctatgacgtggacgtgccggcgctggagaagcagtaccgcgagctgtcgttgcagctccacccggaccgcgtggcacaggccagcgcgcgcgagcgcctgcaggccctggagggcaccaccgccctcaacgaggccttcaagacgttgaaggacccggtgcgccgcgccttctacctgctcaagctgcacggcatcgacctggaccgcgaggacgcgggcgcgcagaaggacatgccccttgccttcctggaggaggtcatggacctgcgcgagtcgctggacaccgccatggcgaagaaggacctgggccgcgcccgggccatggcggacgacgtggaggcccggaagaaggcggccctcaccgaggcggcggagtcgcttcgcaccctggaggcaggcgagccgggggacggcgggcaggaacaagtgagaaaggcatcgcacgcgctggggcgggtgcgctacttcacgcgcttcctcgagcaggtggacgcgttcgaggaggagattcaggcgtga

SEQ ID NO: 8754 - DNA, 1794 bp, Myxococcus xanthus
gcggtgggcatcgacctgggcacgacgaactcgctggtggcggcggtggtgaaggaccagcccgtctgcgtcccagtggacgaaggcgacgcgctgttcctcccctccgtggtgcactacgcgaaggacggcggtgtggtggtgggcgcccgggctcggaagctggcgtccgagcacgccaccgacaccatcgcctccgtgaagcgcttcatggggcgcagcccagacgacgcggagacgcgcaagctggggcactacaagttcgcgcccggcgccaaggtggtgcgcttcgacgtggcgggcggcacgccggtcacgcccatcgaagtctccggtgaggtgctgcgcgccctcaagcgccgcgcggaagcgcacttctccaccaaggtggagcaggccgtcatcaccgtgcccgcctacttcgacgacgcccagcggcaggccaccaaggacgcgggccggctggccgggctggaggtgctgcggctgctcaacgagcccaccgccgccgcgctggcctacggtctggacaagggcagccagggcaccttcgtcgtctacgatttgggcggcggcaccttcgacatctccatcctcaagctggtggacggtgtgttcgaggtgaagtccaccggcggcgactccgcgctgggtggcgatgacttcgaccgggcgattgcccagcgcgtgctggagacgctgggcgcgtccgaggcgccggctcccgccctggtagcggaggtgctggcggcctcgcgcaaggccaaggaagcgctcaccgacgcggcttcggtggagttctccgcgggcgggcagacgcactcagtgaagcgcgaggacttcgacgcctgggttcagcccttcgtgcagaagacgggcacggtgtgccggcgggcgatgaaggacgcgggcgtgacggccggggagctggacggcgtcatcctggtcggcggcgccacgcgcgtgccggcggtgcgccgctacgtggcggagctgttcggccgtgagccgctgggcgacatcgacccggaccaggtggtggcgctgggcgccgcggtgctggccaacctgctcaccacggcggaccggcaggacgacgtgctgctgctggacgtgattcccctctccctgggtttggagacgatgggcggcatcgtggagaagctgattcagcgcaactccaccatccccaccaccgcgggccaggtgttcaccaccttcaaggatgggcagacgggcctggacgtccacgtgctccagggcgagcgcgagctggtggaggacaaccgcagcctggcgcgcttcaccctgtccggcattccgcccatggccgctggcatggcccgggtggaggtccgcttccaggtggacgccgacggcatcctctccgtcagcgcgcaggagcagagcaccggcgtcagccagtcgattaccgtgaagcccagccacggcctcacggacgaggagattgagcagatgctgctcgactccatcgactacgccgaggacgacatccaggcccggcaggtccgcgagcagcgggtggacgccgagcgcgtcctggccgaggcggaccggcagttgggcgagcacggctcgctgctccaggagggggagcgcgccaccattgattccgccatcgcccgcgtgcgcgagctgatgaagggcgaggaccacctgaagctgaaggaggccgtgcacgcgctggacgaggcgtcccgccccttcatcgaacgggtgatgaatcaggccatcacccaggtggtggctggccactccgtggaggactactga

SEQ ID NO: 8755 - DNA, 378 bp, Myxococcus xanthus
atgcccaaggtgactttcaagagccccctggccgaggtcagcgccgacgtgcccaccggcaccaccctgctggacgccgccgaggcctgcggcgcccaggtggggcatagctgtggcggggtctgcggctgctccacctgccacatctgggtccgcaagggcctcgactcgctgagcgagcagacggacgcggaggcggaccgcttggacatgggcttcgacgtccgcccctattcccggttgagctgccagacggagctgggcgccgaggacatcctggtcgaaatcaccgaggagtccctcaccgccttcatggacgagaaccccgtcctgcgccgttcgctcgaggccgaaggaaaatggccgctgaagaagtga

SEQ ID NO: 8756 - DNA, 2565 bp, Myxococcus xanthus
atggcggacgtcgcgcttcccatcgatcccctgttgccggacatcgtctccacgctgcgtggcgcgcggtcgctcgtcctggaagcgcctcctggcgcgggaaagacgacgcgcgtgcctcgcgcgctcctgcaggccgggctcggtcaggggaaggaaatcatcgtcctccagccacgccggcttcccacgcggctcgccgcacagcgcgtgtccgaggaactgggcgaacgcgtgggcgagtccgtgggctaccaggtccgcttcgaggacgtgcgcagcgcgaagacgcggctgtccttcgtcaccgaaggcgtcctcggccgccggttgctctccgacccgaagcttcgcgacgtgggcatcgtcgtgctcgacgagttccacgaacggcacctgtccgcggacatctccctggccctgctgcggcgccttcaggagacggcgcgccccgacctcaaggtcgtcgtcatgtccgcgacgctggaggcggagcccatccgggcgtacctcggcgggtgtccctcgctccgctccgagggccggcgcttcgacgtgagcgtggagtacctgcccgcgcccgatgaccgacacctggaccagcaggtgctctccggcatcaagcggctcttcacccaaggcgtggatggcgacgtgctcgtcttcctcccaggcgccggcgaaatccgccgcgcacgcgacgcatgcgccgagttcgccgaacgccacggcaccgacgtgctccccctccacggcgacctgtcccccgccgagcaggaccgcgccgtgcggcggagctcgcgacggaagatcatcctctccaccaacgtcgcggagacgtccgtcaccatcgacggcgtggcggtggtcatcgactccgggctcgcgcgcgtcgcctcccactccccctggtctggcctgcccaccctcaagctgtccaaggtcagccgcgcctccgccatccagcgcgggggccgcgcgggccgtacgcgtgcgggccactgcctgcgcctctacacccagcacgacttcgacggccgcccggagcaggacgccccggagattcgccgcacggacctggccgaaaccgtcctctccctgcgcgcgtccggcatcaccgacctggccgccttccccttcttcgagccgcccccggccgcgtccctggacgccgcggagacgctgctccgccgactgggcgcggtcgaccccgccggcaccgtcacggaggtgggcgaacggctcctgcgcttccccgtccacccccgtcaggcgcgcatcatcgtcgagggtgagcgccggggcgtgggcgccgaagccgccgtgctcgccgccctcatgggcgaacgcgacatccgccgcgaggcccgcgccaacctgggccagggaggacgcccggccgccgttgtcagcgggccgtccgacctgctggagctcttcgagcgcttccgcgaagccgagcgcgcgaacttcgcgtcgggccgcatgcactccctctccctggaggccggcgccgtgcagtccgtggaccgggtccagaagcagctgcggcgcgcggtgcgtggacagggcccccggccccagcggcccgaggacgtggaacaagcgctgatgctcagcgtgctcgccggctaccccgaccgcgtcgcccggcggcgtcggccccgtgcgcccgagctgctgatgttcggaggagggtcggccacgctgtcagacgtgagcgtggtccaggacgccgacctcatggtggccgccgacgccgaaggacggcctggcaagggcgccgtcgtgcggctcgccagcgccgtggagccggaatggctgctcgacctctacccggacacgctggaggaggtggacaccctccagtggaacgccgaggcccgacgcgtggagcggctcacccgcctgtcctacggcaacctcgtcctggaggagacccgcacgcccgcgcccgcctctgaggccacggcgcgcgtgctcgtggaagccgcgctggccgcggggcccggcaagttcgcggacccggaggccctggagcagtggcgcacccgcgtggccctgctggccggggccttccccgaggcgaagttccccaccatcgacgacaccttcctgcgcgatgcgctggcgtcgctctgctcggacgcgcgcagcttcaaggacctggaaggcgtgtccctgctggacgcgctctacgcacgcctcacctccgagcagcagcggttgctggccacgcatgcgccggaacgggtgacgctccccggaggccgcggcgtcaaggtccactacgagccgggcaagccgccctgggtcgagtcgcgactccaggacttcttcggcatggcgcaggggcccaacgtctgcgcggggcgcgtcccgctggtgctgcacctgctggcgccgaacatgcgcgcggtccaggtgacaaccgacctcgcaggtttctgggagcggcactaccccgccatccgcaaggagctctgccgcaagtacccccggcactcgtggcccgaggatccgcagcatgcccagccgcctgccccccggccaccgcgccgttga

SEQ ID NO: 8757 - DNA, 1419 bp, Myxococcus xanthus
atggcggtgctggccggagtggcggtggccgtggtgccatggctgctgcccacgggtcccaacgccaatctggatgcggcccggttcctcgaagccggcagcctcgcggtgggcgcggcggtggtgttcgcgggtgggttgctcaccgcgctgacgccgtgtgtctatccgctcatccccatcaccgtgtccgtcttcggcgcgcgcaagacggagggccggggccgcgcgctgctcctgacgtcctcctacatcgtgggcatgggcgtggtgttcagcgcactgggcgtgctggcggcgaagacgggccaggcgttcgggtcgatgctggggcacccggcggtggtgacgggcctggcggtgtttctgctactgctggccacgtccatgttcggcgcgttcgaactggcgctgccgtcgtcgttccagacgaagctcaacgcggtggggggcgcgggtgtggcgggcgcgttcctgatgggcagcgtgtccggcttcctggcggcgccgtgcaccggcccggtgctgacgggcctcctggccttcgtggcgaagtcggccaacaccacgctgggcgcgtcgctgctgttcgtctacgcgctgggcatcggcgtgccgttcttcctcatcggcgtcttcaccgtccggctgccgcgcggcggcgtgtggatggagtgggtgaagagcgtgctgggcatcatgctagtggccctggccttcagctacctcaaggacgccttcccctgggcgcgggacgtggtgaaggggctgggcctccacgtgggccgggtgccgggagccgtcatcgccgcgctgctggtggcggtgggcgtggccctgggcgcggtgcaccgctcgttcaaggaaggcgcgcgggagttctcgttcaaggcgctgggcgtggcgctcgtcgtcgcggcgctggtgctgcgcggcggggcgctggacgggggcccggtgggcacgttgtgggtgagcctggggctcgccgagccggcgcgcgcaccggcctggcagtggcaccacgtcatgccggcgaagcaggccaccttctccccggaggccttcgaccaggtgctcgcacaggcgaaggcggagggccggccggtgctcatcgacttcttcgcggactggtgtgcggcctgcaaggaactggaccgcgacacctacccggcgcagcaggtcatctccgagtccgacgaggggcgcttcctcaacatcaagattgacgcgacgaacagcgaggactcgctggacgcgctgctggagcgcttcggggtggagggcttgcccaccgtggcgttcatctcgccggagggcaaggtgctcacccagccacgtgtcaccggcttcctggcgcccagccccttcgccacggagatgaagaaggcgcgctgcacggacgccaacgcctgctga

SEQ ID NO: 8758 - DNA, 1902 bp, Myxococcus xanthus
atgagcgcgaagcagacggcccgcacgaaggaggcgcaggagacgggggagggcggcgggaggacgcacctggtccggatggacggcgggggcggaggcaagctggaacagccgcgctatgtggacgggtggcgtgccggcaagcccgcggaggacccggagaagatgaagcgctgggggctcgtcaccgcgcggcccagtgagttcctggtccacatgcggcgcggccgggtgcgggaggtcagcggccagggcgccagttgtttcaagctgccgggggactcggtggccattgtccccaccagcatccagcgacttcagttcaccgcggaccaggtgacgcacgagaaggtgggcgtgcaggtgacggggctggcggtgtaccggatttcagacccgctggtggccttccgcatgctcaacttctccttcccggagcgcgcgcaggagaagctggccgagctgctgcgggagatgttcgtcggcgccgcgcggcggctggtggcgaacatgtccgtggaggagtgcctctccaagcgcaaggagggcatcgccgcggagctggtgcgcgaaatcgcgcccgtgctctccggccgaggccgcctggaggaccagacggacgcgggctggggcgtcatcctggacacgattgaaatccaggacgtgcgcgtcctgtcctccaccgtcttcgccaacatgcaggcgcgcttccgccatgaacaggagcggcaggcgcgtgaggcggagctggccaaggagcgcttcgtccaccgcgaggagacggaagccgagcgtcagctgagcctccagcggctggcggccgaggaggaggtgcgccagaagaagcagacagcggaggagcaggcccggctggaggcgctggcggtggaggcgcgcgtggccgaggcgaagctcgcccaggagcgcacgctgaagcaggagcaggccaccgtggagcgcgaggtggcgctggcgaagatggccgctgagcaggaggtccgccagaagaagcaggtggccgacgaacaggcgaagttggatgcgctggccgcggagtcccgcctggccgacgcgaaaatcgtctccgagcgggcgctggccgtcagccgcgctcaggtggagatggagaagctccagcgcgaacaggacgcggaggtcgcgcgccagcgcgtggccctggagaagctcaagcgcgagcaggacacggaggccggtcgcgcgaaactggagctggagaagctgaagctggcgcaggagtccgaggccgcgcaggcgaaaatcgagctggtgcggctccagcgcgcgcaggaggcggagaacgccaaggcgcagatggagctggcgcggcagcagcgtgaacaggcgctggagctgtcacgccagcggcacgagcaggaggtggagctggcgaagctgcgccgcgagcaggaggaggccggcgccaaggcgcagctggagctggagcgcctgcgccgcgagcacgaacaggccaccgtgtggcacgaggtgcagatggccgcgcaccagcaggaggccgaacggctccacgcggagctccaggtggtgcaggcccggcggtccatcgtggagacagaggtagtcatcgccgagctgagtgtgcgcaaggaccgggcgcagcaggacctggagctgggcaaggcgcgcgcgctgcgcgacatcgagaacagcgttagcccggaggtcatccagatggccctggcgcagcagctcccgcaggtggccgcggccttccagcagaagatgggcgaggtgcacgtcaccgcggtggatggggccaatccgtttggttacatcgccgccgcggtggagggcgtcatggggctggcacgttccgccggactgaagacgcctgcttccccgcttgcccctccagcgcagtag

SEQ ID NO: 8759 - DNA, 951 bp, Myxococcus xanthus
acgggcgtcgtcggacacagcatcgcgcaggcgctgtgggggcaggggcggggctaccgcgtggtggggcgctcccgggagggactccagcgggagttcggggcggacccgcaggcggagatcgtcacctggaatcccgacgacatggcctccatccaggccgcggcccggggcgtccagacgctcatctatctggtcggcgtgccctattggcaattccacctccaccccgtgctgatgaagcgcacgctcgacgccgccatcgccgagggcgtggagcgcatcgtcttcatcgccagcgtgtacccctacggccggccgcgcacggacgtcgtcaacgagtcccacccccgcgtgccgcacacgaacaagggccgcttgcgcaaggctcaggaggacctgttgctcgcggcggacaaggcgggctccatccaagtcaccatcctccgcctcccggacttctacggcccgggcgtggagaacagcttcctccaccgcgccttcgtcgcggcctcacagggcaagcgcgcccagctcatcggccccatcgacacgccccatgagttcgtctacgtgcccgacgtggggcccaccgtgacggcgctcatggaccatccgggggcctacggccgcttctggaacctcgggggcgcgggcgtcacctcccaggcggccctggtggaggacatctacgcccaggccggccaccccgcgaagtactcagtgctggggccggggatggtgcgcctcatcggcctcttcagcccgttcatgcgcgagctcggggagatgcactacctgcacacctcgcccgtcatcatggacgactcggcgctgcgggcgctgctcggcgacatccggaagacaccgtaccgcgacggcatccgccagacgctcgcggcgctcagtccagcccccgttgccacaggtcatcctcatccagccccatga

SEQ ID NO: 8760 - DNA, 243 bp, Myxococcus xanthus
gctctaaagcccctgtcaccgagcatcctcggggtgttccgcggcctggcggtgggcgagcgcagtgtgacgaacgcgttcgaccacgtccccgcgtccatcgtgctgtaccagaagaacctggagcgctttgcccgcacccgcgaggagctcatcgagcagattggcatcaccgtcatgcacgaggtcggtcacctcatggggctggatgaggatgacctgtggcaacgggggctggactga

SEQ ID NO: 8761 - DNA, 1488 bp, Myxococcus xanthus
cacccggccttcgaccccgccgagcgcctgggcccacgcatcaacaaggaccggccccgcctcttcttcaccaaccacgcgcccaagtggcccctgggcgccggttacacgcaactggtgagctgggacacggaagagaaccggctgaaccactggaagctgatggacgcggccacgggtgagccggtggtggcgtcgtcgctgcaccagatcgccgccacgcgggattacgtggtgctgctggactccaacttcccgatcaacttctggcagatcgccgcgcaggcggcggtgcccttcctgccgcgggtgcagcgcgcggtggagtggctgacagcgtcccccgcggccccacaggcggtgttctgggtggtgcggcgagcggacctccagacgtcacccgggacgctggacccggagaatccgccgttcgtgtccgcgcaccgcttccaggccggaggcggcgggctgcacttcgccgccatctacgagaaccccgacgacgtcatcaccctggtcgcggcgcactctcccaccgaagacctgtctcatacactgcagccgggcgagctgctcatcaatggcaaccgcgtgcaggactggcaggcgggaatgcccacggccgttcccgtcacgcgcagctccatgggggtgcaccgcatcgacatgaagcggctgcgcatccagtccaatctgtattcgcatgacgacttcacctggggcctgacggtcttctccaacgccggcctggtgaatggcgagttggaggcccacttccggctgctgggccacgtgatgaacgccaagttgccgacgaaggagctggcgctctacctcaactcggacggcttcacggcggacatggtccccgaggcgctctaccagctctacaagcccgtcgtcggggacaagtccgcgctgcccatccgcgatggccgcgcggcgagcttctgcaagttcttcgtcgactccggccgcttcgagggctacgtgctgcccaccggttggttcggcttcgcgccgcagttcgtccccagcgcccggttcccccaggtgccgcactggaagggctacgtggtggcgctcgtcgtgtcggacccgacgccggacctgcctgagaactccacgggcgacgaggtctggatcttcgactccgaggacctggccaagggccccatctgccggctgggcagccgcaacttcgacgtgggcatgacgctgcacaccaccttcctgccaccgggcctggctgacctcctggaaggccagcccccgggcaacgtggccccgtactgcgtggacgtgcggcaggacctcgacatggacgccatcgaacggacgtacctggagtggccccagacgatgctcccacgggtgccccgcgtgctgttcgccccgtggcgcctgggcgtgaagtgggcgttgaacttcccgaagctgcgtcaggtgctccaggaggacgtgtatccgcacttcccgcgcaagtga

SEQ ID NO: 8762 - DNA, 3508 bp, Myxococcus xanthus
atgatggatgtgcccggctaccgcatcggcagagaggtcaccaccgcaggagccttccagctcttgcgcgccacacgcgaggaggacggcgcctcggtcatcctcaaggtccccgacgcggcgcggctcccctccgccaccacgcggcttcgccatgagtgggagctgacgaacgccctgagtctcgacggcgtcctgcggcccctggcgtgggccgaagcgcgggacggcgcgcccgtgctcatcctggaaggcttcggtgatgcgacgctggcccaacgcctgtcacaagggcgcgtggagccgcgcgccgcatgccgtatcgcgctgtcgttggcgcgcgccctgggtgccatccacgagcagggcatcctccaccgggacttgaaccccagcagcatcctcgtgggaacggatggcgagtccgtgaagctcactggattcacccttgccacgcgcaggccccgcgccgaggtcgctccgctcgcccccgagcggttggagggcacgctcgaatacctctcgcccgaaggcacgggacgcacccaccgcagcgtggactcgcgcggcgacttctattccatgggcgtggtgctctacgagctgctcaccggacgccgccccttcgcggacacggatgcgctgggcctcatccacgcccacgtcgccctcaccccggctccgcccgtcaccgtcgagcccgggctcccccagcccctctccgacatcgccctcaagctcctcgccaagtcccccgaggaccgctaccagagcgcctatgggctcgtggcggacctccagcgatgcctgagtgccctggaggccccggggcccgtcgccccgttcgccctgggcgccaaggacgtccccgagcgcttcgccgtccccgagaaactgtacggccgcgaaccccagcaggcggccctgcgcgaggccttcgagcgcgcagcctccagtcgctccggcttcgtcctcgtctccggggccgcgggcatgggcaagtccgccctcaccgggacactcaagcgccccgtcacggagcggcagggccactttgcgcgcggcaagtacgaccagctcctccgcgatacgccctacagcggcatcttcgaggccttccgtgaggtggcgcgcggactgctcggcgaacaggagcaggacctggagagctggcgacaccgcctcctcgaagccgtgggcggaatgggccgactggtggtggacgcggtgcctcgcatggcactggtgctcggcgaccagccccccgtgcccgagctggggcccgcggagtcggagctgcgcttccaactggtcctgcgcaagctggtggccgcgctcgccacgcgggagcatcccctggtgctcgtcctggacgacctccactgggcggacagcaccagcctccagttgttgcggctgctcctgacggatcgggacatcgaacacctgctcgtggtcgcgggttgccgctccgaagagctgagccccgaccatcccgtggagtcccttgcccgcgcgctacacgaccacggcacgccggtccaccgcatcgacctggcgccgctgtcgcccaaggacgtgacgaggctggtcgcggacgtgttccctcccgccgagggacaacccgacgcgcaactcgacgacctggtgctgtcgctgacggaaggcaacccgttccacgcggtgcaactgctgcgcaccttctacgagcgcgggctggtgcgcttcgacgcggaaggcggtggcttccggtgggatgccagcgcgctgcgtggacaggacttcagtgacggcgtggtggccctgctcacctcccgcatccgagagctgagctctgccgcgcaggcactgctgcccatcgccgcggcactgggccatctgttcgacctgcacagtctggccatcgtcctggagcgtacggatgaggaggccgagaaggggctcgtcgaagtgctccaggcgggcctggtggcgcccattgacgacgccgacctcgacagcgggggcacgtatcagttcacccatgaccgcgtgcagcaggccgcactggagctgattccggcggacgtgcatccggagatccatgcccgcatcggccggctgctcctgcggcacacgcccccggagcggctcgacgaagaactcccggagctcgtcagccacttccacctggcgttgcccgtgctccacgacgagcaggagcgccaccgcgtggcggagctggacctgcgcgccggccgcagcgccaaatcccgaggcgcctggtccgcggccctgcgcctgttgaacacgggcctctccctgctcggcgacgatggctggcggaaggaccggcggctcaccttcgaccttcacgtcgacgcggccgaagcggcgtacctcgacgcggacttcgacctgatggagcggttggcagcggcggcgctggcccatgcggtggacagcgcggaggaagtccgcgtgcaggaggtccggctccaatgcctcgcacaccggggcgagcactcacgcggcgtggacctgggcctggaggtgttgcgcaagctgggccagcccctgcccgcgaatccaaagcaaccccatgtgctggccgcggtggcgaagacgaagctgcgcctgggcctgcgcaagcccgaggacctggctgccctccccgagtgcaccgacccgctcctgctcgccacactgcggctgctggtgaagctgtcctccctggccttcatggcccgcccgctgctctttccgctggtggtgctccgcgtgctccagctcaccatccgccacggcgccacgggcgtggccgcgttcggctacgtgggctacgggctgatgctgagcgtgcacctgggcaaccccgaggaaggtttccgctatggccggctggcgctgaagacgctggaccgcttccaggcggagagcctgcgggccatggtgaccttcgtcttcaacctcttcatccggcactggaaggagccgctgtccgcctgcgtcggcgacttcctcgccgccgcgcagaagggccaggagacgggcgacatcgaatacttcggttatgcgtccagcgcgggctgtgccactgccctcatcgcccgggacggcctggccgacggtggcccgcgcatggaccggtaccgggacatcctggccacccaccgccacaagaacgtgctcttcaccgagtacatgcggcacacgctcgactccctcacgggtgccttcaccggcaacgtggaggcccgcgaggaggagctggtcacgccgtaccggcagctcgactacggcaacggcattgccacctgcgacgtgctacgcaccctgcgccgctggctgtggggcgatgcgcgcggagcgctggagagcgccgcggcggtggacgcccaggtggagctcatcgccgggcagatctacctgccctggtacaagttcttccaaggcctggcgctcatggcggtccacccgacgttggggccgctggaccggattcgctcgtcacgggccctggagagca

SEQ ID NO: 8763 - DNA, 2442 bp, Myxococcus xanthus
atcgaacccctctggcaggcccgttgggaagagcagcgcatcttcgaggcgcgcagacaccccggcaaaccgaaggcgtacatcctcgacatgttcccttacccctcgggagccgggctgcacgtcgggcacccggagggctacacggccacggacatcgtctcgcggtacttgcggatgcggggatatgatgtccttcatcccatgggatgggacgcgttcggcctgcccgcggagcagcacgcgctcgaaacgggaacccacccggcggataccaccgcgaagaacgtcgcgacgttcaagcggcagctcaagtctcttgggttctcgtacgactggtctcgcgagctctccacgaccgacccggagtacgtgcgttggacccagtggctcttcctcaagctcttcgatcgcgggctggcctatcaggccgagctcccggtgaactggtgcgcggcgctcggcacggtgctcgccaacgaggaggtcattgacgggaaaagcgagcggggcagtcacccggtcgtgcggctgccgctgcggcagtggacgcttcgcatcacggcgtacgccgatcggctcgccgaggacctttcggggctggattggcccgagacgcgggagaagcagctccactggattgggcgcagtgagggcgctgaggtcgatttcgccatcgagggcagcgcggaccgcctccgcatcttcaccacccgtccggacacgctcttcggcgcgacgtacatggtcgtcgcacccgagcacccgctgctggagcggttcgccacggcggagcggcgcgccgaggttctggcctaccgagaagcgaccgcaagccgaagcgagttggaccgcaccgcgctcacgaaagccaagaccggcgtgttcaccggctcctatgcgctgcacccgctcacgggagcgcgcctccccatctgggtcgcggacttcgtgctcggctcttatgggacgggcgccatcatgagcgtgcccggccatgacgcgcgtgatttcgagttcgcgcgtgccttcggcttgcccgtcgtcgaggtggtttcggtcgacggcgccctgaacgagactggcacgtggacggaggcattcgtgggggacggcgtcgcggtgcgctcgcgcttcctcgatgggctgcggacgcccgaggccaaggcggccatgctcgcccacctcgagcgcgagggattgggcgcacggcgcgtccagtaccgcttgcgggattgggtgttctcgcgccagcgctattggggggagccgatccccatctatttcccggtcgagctcgcggagggctcatcggacccgcgtattcatccccacaccattcgctacgaccagcctctgcccgtgtccgaggacgagctgccggtgcggctccccgagctcgaggacttcaagcccagcgaggacccggcgggcccgctggcccgcgccttggattggcgattcttccagcgcgacggaaagtggtacgcgcgagagaccaacaccatgcctcaatgggcgggctcgtgctggtactacctgcgcttcattgacccgaagaacacccaggccatcttctcgcagcaggcgtacgacgcctggatgccggtggacctgtatgtcggcggttcggagcacgcggtgctgcacctgctctacgcccggttctggcacaaggtgctgttcgattgcggcctcgtcacgcacgccgagccgttcaagaagctcgtccaccagggaatgatcctcggtgagaacaacgagaagatgtccaagtcgcgtggcaacgtggtgaacccggacgacattgtccggcagttcggtgcggacgccctgcgcatgtacgagatgttcatggggccgctggaggcggtgaagccgtggcagaccaacggcgtcatcggcgtgcggcgtttccttgaccgcgtgtggaacatgctcgcgttcgtgacggaggacgcgggtggtgcaccggcggagctgaccgaggacgcgcggcggctgctgcacaagacggtgaagaaggtgggggaggacatcgaagcgctgcgcttcaacacggccgtgagcgcgatgatgattctcgccaacgcgctggccgagctcccgcgcgtgccgctcgaggcggccagggtctttgcgcggattctctccccattcgcgcctcacctctcggaggaactctggcaccgctggggcgcaagcgagtccatttccctccagcagtggcttgaatacgaccccgcgttaccgtaggacgagctcgtagaaatggccatgcaggtcaacggcaaggtccgagggaacctgcgccttaagctacactccacgaaggcgcaggcgcgcgaggccgtccaccgagagccggagctcatccagcatctcgctgaaaagacccagcgccgattcgtctacgtgccagggagaatcatcaacatcgtc

SEQ ID NO: 8764 - DNA, 1464 bp, Myxococcus xanthus
gcaatcgtgattggcagtggtttcggcggattggccgcggccatccggctggcggcgcgtgggtggcgcgtcacggtgctcgagcggatggacagcccgggcgggcgggcgaacgccttccagcaggacggcttcacgttcgacgcgggccccacggtgattacgtgtccgcacctgctggaggagctgtgggcgctagggggacaacgcatggcggaccacgtggagctacggcccgtggcgccgctgtaccggatgcggttcccggatggctccacgttcgactaccacacggaccgcgaggcgatgcgccagtccgtgcggcgactgtctccccgggatgaggcgggattcctggcgctgtgcgcccgcgtggagcggatgtacgaggcgggcattgggcccctgatgagcacgccggtgccggacgtgctgagtctggcgcccttcacccccgcgttggtgcgggacgaggcgttccggtccatgttcggcctggtgtcgaagcacatccgggacgagcggttgcagcaggcgttgagcttccatccgctgctcatcgtcggcagtcccttcccgaccgcgagcgcggtgtacacgtcgattcaattcgtggagcggcgctggggggcgttcttcccggtgggcggcaccggggcgctggttcggggtctggtggaactgctggagtccctgggcggcgaggtccgttacggcagcgaggtgactgagattgcgttggaggggcggaaggcgacgggcgtgaggctcggggacggtacggggctggcggcggacgtggtggtgtcgaacgcggacgcggcgtggacgtaccggtacctggttccggggcatgttcggaagcactggacggacgagcgcatcaaccgggctcggtactcgatgagcgcgttcctctggtacttcgggacgcggcgtcagtacccggaggtcgcgcaccacacgctgctgttcggcaaggacttccgggggatgttctcaggactggaaggccctggacagccgtcagcggaccccttgctctatctccacaggcccacggcgacagacgcggcgctggctccgtcagggcatgatgctttctatgtattggctccggttccgcacctggggacaggggcggaatggaagcagcgggccgaggctttccgacgagagttggaggcgcgactgtcgcggaccgtcttgccagggctgggttcggagttgatgacgtctcggatggcgacgccggagtatttccgtgacgaactgcgatcctttaaaggggccgcattcagcttcgcgccgacgctttggcagaccacgttccttcgggcacaggcccggagcgaggacgttgactgcctctacatggttggagcaggaacgcaccctggagcggggctccctgccgtgctgtgctctgccaagatcgtggacacagtcattccgccgacgtag

SEQ ID NO: 8765 - DNA, 189 bp, Myxococcus xanthus
atggtggagagcgtgctggccatgtccgcctcggcgcacctggccgacggcttggggggcttcacctacgccgacctggatacaccgctgttcatcgcgagccaccccttccaaggcggcgcccgatacgcgggcgcacggctggagttgccaacggatgcacccgggcacggcgtcacgctggcctga

SEQ ID NO: 8766 - DNA, 369 bp, Myxococcus xanthus
atgaccctggccgtctgcgtgcggtgtggcaactcgaaggtgggcgcgttcaccccctgcacgggttgcggactggcccccgccgcccacggcaccgaacgggaactccaggcacgcagcctgctgctcacggagcgctacctgcctgggggtgagttggaggagataggccggaagattcgcaagggcgagcccgtaacctacgacgcagggctgctcgcgcagattaccgaggacctccggacacagaagctgcccatcgtctcgaagtcatcccctgggtgctccgtcgccttgtgggccgtggtgggcgtgctcctcgtgctcgccgtgggcttcctgctcatgtcgcggctgcgaggcccctga

SEQ ID NO: 8767 - DNA, 1050 bp, Myxococcus xanthus
atgcgcttcaaccgactgctcgcactcgccctggccctgtcggccatgcccgccaccgcccagccagagctgttcttcggcaatggtcaggcccccgtcttccgcgaggaggacctggacaagcgcttcgcccggtccaagctgaaccaggggctcaagcaggggacccaggatgccggctgcgcccaggtgctcggggccatgctgacgctgatgggtgaaaccggtgtgctgctgcacaagcgcgatgagaacttcatgctggacccggtgctggtcaacgccctcaacacccagctcgtcaaccagcgctttcccggcaacgccttcctcgtcgccatggtgcggcgcgtgctcatcgaccggaaactgccccaggagtggctggtgacggcgcaagccctcgcgccctactacccggccatcgacatgggacggcttcgcttcctcgccaacggcgtgcagcccctggatagcttcctggtcaccctgcccgccctgcgcgagcgctacgcccaggaagtccagcgcgccacatccgtgggcgcgtccaccgccgaggccctcttccgcgagaactacctggaccacgaggtcgccttcggcgcgctggagctggtggacgtcaagctcgagaagccaaagaagaagcgcctgaagaaggacgaggagccagaggccccctacatgctggcccggctcttgtgggtggagcccgaggcgccgacgacggagcgcttcgagttcaacttcggcaaggcgcccaagcgcccgcgcgtggagatcaccgcgaagctgcaggacacgcagtacacggacctcaacaagctgctcaagggctcccgcgtcctcgtgcggggccgcttctgggagtacaagaagggcctgacgtccatcgagctgcgcgacgcgctgatcttccccgagcgggactggacgaagacgccctccctggcggacccggccgccgtggcctcgtgccccctggccgtcaacgacctgaccggactggcgcccatgcagcccggcgccttcggcacgcaccgctga

SEQ ID NO: 8768 - DNA, 1536 bp, Myxococcus xanthus
atggccaaccaggactgggtgacgcgcctgctcaccgggcgcgcgacggcggacaagcagctcaatgtccacctctccgagcgcgacggcggcagcctccacgacaagatgcggcaggcgtattggtggatcaccaacaacgccgtcatctgtccctactacgacctggagttcggctcgtccgcgtccctcaagacgcctgcgggtgacgagctccacctccccgaggacaccagctacagctcgttcgtcctcatccccctgctcaccctcttcacctgccggcgcgcgctgctggtgggcggaccgggacgcgggaagacgacgtccgccatcctcatggccctgctgtccggcatgggccgcgacgaggtccaccgcggcatccagcgcgggcacccgcagctctccatcgcggacctgctgggcgcgccgctgccctccgacatgctcaaggcggaggacctgtccgcggtgaaggtgagctggcgcaagtggattggccagcgcgtcaaaatcatcgacgagtacaaccgcatccccaccaagacgcagtccgcgctcctgtccctcatggcggagggctacgcggagatgatggaccagtacgtctacgcgggccgctcgtcctggttcctcaccgccaacgacgaccagggcggcggcaccttccaggtcatcgaggcgctgaaggaccgcatcgacgtggtggtgcgcgcggtgcccttcaactcgggcttcatggaccagctcctccagcgcctggaggccgacaagtcccccgaggagctgctgcccaaggaaatcgtcttcacgcctggcgagttggagcgcgcctacgccgccatcctggaagtggaggtgcccaaggacgtgttggagcgcatcgccttcttcctggggcaactggacttctgccgcatggcctcgccgcgcttcgagttcaagcacaaggacacgctcaagctggccgggcagacggtggccgcggtgtgcaacgagcagtgcccgctggacaagaaggtccacctctgcacgcagacggagaacggcgtcagcgtgcgcgcgtaccagaccatcctccacttcgcgaaggccatggccttcttccgcggccacagcgccgtggagctggaggacttccggcagattgccccctgggtgctgcacgagaagctggtgcccaacccgcgcagcgccttcttcgaggtgaagggccaccgcatgctcctccaggaccgcgtggcctggctgcggaacatgttcgacatggccatgggccactacgacacgcacgcgcccatccggcgcaaggtgacgacgctgcgccatgagctggacaagggcctgtccggcgtggacctgcgcaccaccgagaagcgcatgaatcaggtgacggtgctcatgaaggagctgctcacacggcacgagctgtccggccccgtctacgaggacgtcatccacctcaagtccctgtacagccgctaccggaactacgcgacgtggctgaaggagaacccgggcggtcgcccatga

SEQ ID NO: 8769 - DNA, 828 bp, Myxococcus xanthus
atgagcaccttcaccgacgagctggaagccaatgcccgcgcccggttcgtgcgctgggactccgccctgtggcgcgagctcaccggcggcgcagcgcagcggctgggacaagccctgttcgaggcggggacaccagcggcgcagggcgaggagctcttgcgcgcctacctccagttgggcgcggaggccattggcctgggctacctgtaccccacgagcgcgggccggcagaacttcttcaccctcgcctggtcggacctgattccccgcctgctggccgccgtgccctcggcggagcgctcgcaggtgttcgcccagttgtggaacctgggggagaacctggagtccgcgccgccctgggtgcagcgcatcttctggcgcgtgggccgggagctgacgtcgctccaggacatcgaggcgcggctgcgtgagacctcctccgtggccctggagccgcccgacgcgccgctggccgcgcgggcccaggcgcactgggtggacctgtcgaaggaggacagccgcttcctccccggcccgattcacttcctgtcccccaccgtggtgtgcgtgcatgaccggcaccggcaggccgtggcgggccgcgacgcggccacgcagggcatctggctggcggagacgcccgtccgcctgggcgccatgggctgccgcgaggtgccggagcagacccacgtggagagtccccacctggacgaggcactgcgggaggacccgcgcgcggacgcgtggttcgccaccctgtccaatgactggcgggtggtggccacgctgcacacctcccagcacgtgctggtgttcgtcccggaatga

SEQ ID NO: 8770 - DNA, 1125 bp, Myxococcus xanthus
atggagcagcgctaccccggtgttcgcgccgaggcgcgcatgttcgcgcagaccttctacgcgctgcccagcggcaagctccagttcctctacttctgcgccaccttcatccgctacatcgagaagcccgcggacctggagttcagcctgccgctgggcggggacgtctccgtgccggacgtggacgacctggatgccgccatccacggcagcagtcgctgggacgacgcgctggacgaagcggaggagcggggctggctggcccccttgagcacccgctcgaaggagaaggacgagctggactccatccaccgcgtcaccgaacacctgcccggcaagcagggcggaaggctgcgacaggccctggtggcgaagcactatcggcggctggtggaccagcacatcctgaagctccccacgacgccgtcccagccggagccctacctgcgcaccacgccccaggcgtgggagtacggcgatgacccgtccagcatcgactggacgttgacggtgctgtcccagggccacctggccgcggtgtcaccactgcgccgcgagctggaggcggacctgccgcccccgtccgagctgggcgcgccgtccgtggaaatctacctggacaccagcggctccatgcccaatccggagctgagcctcaacgcaatgacgctcgcggcccaggtgctgtccgcctccgcgctgcggaagaaggccacggtgcgcggcatcgtgtactcgcacggcaacccgcaggtgtcgccgtggatgtacgacgaggagaaggcgcgcgacttcctgctgagctacatcggcggaggcacgcagttccccttcgacgtgatggacgcgctgtcacgcgagcggcccgatgcgctgcgcatcatcatctccgacagcgacttcctcgcgaacgtcaccgcggagaggcccctggcgccggtgctggagtccatccggcgctcgcgcctcgtggtggccatcctcgctcttcccgacgaactccgcgcccggcaggcgctggcgccgctgctgcgcgagcgccgtttccggctggtggtggtgcgctggccctccgacttcgcgaaggcggccgccgacctcgcccaggcattgctggagaattga

SEQ ID NO: 8771 - DNA, 564 bp, Myxococcus xanthus
atggctttcgacatccgcgagattcagacgcagctcgaggcagcccccatcgtgtcgccgtattcgcatgacctggctctcgccatcatctgcgacaccttccggctcgcgaaggtccgccccccgtcccgcgcggactggggcgccctggaggaccaggcccgctccccgctgtggcgggagcaggtggtgatgctcgcgcacgtgctggtgtcctcggcgctgcggcaggagacggtgcaggcgctgaacaagaacgacgacgcgacgacgctcctgcagcgcttcttccaggacgtggccccgctgacggcggagatgattcgctccaacaccttccgccgcgaggagttcattcgcaagtgggtgcgcgtcgtgggcggcgagtgcaagggcgagtccccgaagggctccgtcgcgcgaatcgaacaactggactaccgcaaggcggaagcggagatgcggcgcgcggaggaggcccggaagaaggaggcggacaaacgccagcaggccctccgcgaggcggagcagcgcgccacggaggcgcgtgggtggcgggagtga

SEQ ID NO: 8772 - DNA, 1107 bp, Myxococcus xanthus
ccgtaccacgcccggaggctccacgcggcgggcatccacccgggtgacctccagacgctggacgacctgagccacctgcccttcctggaccgcggggccctggccgcgaactgggacgcggtgcccacgctgccggcggacgccgatgattgcgtggtggtgaagagctccgggtccaccggagcgccggtgaacgtggtgagggaccggcgcgactgcctgcacatgtgggccgtgctgcggttcctcgtggcgcgcgcgggagcggtgctgccctcgcatccccgggtggtgctactggacgcgctgccgggcgggctggagtactcggtgcgcctgcccatcctccacgacggcgcgctgcaccgaatctccgtccttcgcgaggacgcgctccaacgcctgcgccgcgtgcggcctgccgtgctcttctccgacccggaaggactgcggtggctggcggcccagcgcgacgtgccctcgcccgagctggtgctcacctccgcgcaacacctgcccgccggcctgcgcgcagagctggcgaacgcggtgcccgcgcctgtcctcaactactacgcgacgacggagacgggaccgctggcctgggagtgcctgcggcccgaggctcctggccggttccacgtcctggctccggatgtctggttggagcccgaacaggacgaggtggtggtgacgcggctgcgtcccagcgtgctaccgctgctgcgctacctcccgggcgacgcgggcagcgtgcggcgtgacgcctgcgcttgtgggtttcatggatggacgctggagcacttcggcgggcgcggagccagccacttcgccacgccttcgggccgggaggtggatgcctgggcgctggcctgggtgttcaagcaccatgcgctgcgtggcttccgactgacacaagtggacgtctcgcacttccaactggagctggcgggagcgagccatgcggacgtggcgccactgcgcgagcggctcaccggcgccttgcggaacctgggttggacgcaggcgcgcctggacgtgtgtcacgtggaggtatcggcgctggccgtgggcaccaagccacagccgttccgccggctgcgctga

SEQ ID NO: 8773 - DNA, 1290 bp, Myxococcus xanthus
atgtcgttcatcccagccaccccgttcctgttcttcttcggcgcggtgatggtgtccggctggtggggtggctggggccccgccctggcgacgacgctcctgtcggtggtggtggtggacttctacttcctggagccactgctcaacctgatgccgggcacgggaggggctgtctcgctggcggtcttcgtcgtgctcgcgctgctgatgacgaagctgaacgtcatgctgcgcaaggccaacgcggagcgggcgcgactgctggagcgggagcgggcagcccgaagcgaggcggaggccgggcaggcacggctccacgcgctcttccgggacgcgcccgccgccatcatcctcatgcatggcccccggcacatctattccttctccaacacgatgaacaacacactgatggggacggacacgctggtgggccaggaggcgagcaaggccctgccgtgggcggagtcgcgaggcttcatcaccctgctggacgaggtctaccgcaccggcgtccctttcacgggcaatgcggtgccgttccctcgcaagcccccccatgacgagatacaggagacgtatctcaacatcgtgtatcagcccacgcggaacgagcagggtgaggtcgacggcatcgccggcttcggtttcgacgtgacggacctggtccgggcccgacagcgcgccgaggccctgacgcacgagctccagctcgccgaggcacgtgactggctcctcgcggagtcgggcgcggtgctggcgtcatcgctcgacgacgagacgacgctgcggaacatggcgaagctggtggtgcccacgttcgcggactggtgcctcgtcgacgtggcggagccggatgggacgttccggcgactggaggcggcacacttccggctcgaggacgacgcgctggccgaggacatcctccgcttcggaatgcagcccagcggcaatccggggcatccccccacgggcgccctgctgaaggcggagacggttcacgtcgagcggttgacccgggaacggattcacgagctcgcacacgacgcggaacacgcccgggtgctggaagcgatagggcccgtctccttcatcgccgtgcccttgattgcacgcggacaggtgttgggggtgctcagcttcatccacgcccactccggccggcattactcgacgtcagacctggcgttcgccaaggaactggcacaccgggccgcgctctccctggagaatgcccggctctatgcggaggctcgggaggccatccgcctgcgcgatgagttcatgtccatt

SEQ ID NO: 8774 - DNA, 1092 bp, Myxococcus xanthus
gcaggtgcccaccacgacgaccatggcgagccccacgtccgcatcgcgtcggagatgttgagagacttgcgcatcaccaccgcgcccgtgggcgtgcgaccgggcggtgagaatgtcaccgtcctaggagagctcaccttcagcgaggacgcctacgcggaggtggcctcccccatcgccgcccgcgtgagcgccgtcttcgtcaccaccggtcaggcggtgaagcagggcgaaaagctcgcggacctgcgcagccccgagctgggcaaggcgcgcgcggcgctgcaagcggcccaggcccaggcccaggccgcgcgtcaggccgccgagcgcaagcgcacgctcgctgacgagcgcatcatcgcgagcaaggacgtgcaagccgccgaagcagaggccgccgccgccgaggcctcggtcgccgccgcgcgcgcggagctggtggccctgggcgtgagcgaagaagagctgcgcggtggcaacgtccccccgggcttcgtcctgcgcgcccccctgtccggcaccgtcgtcgaacgcaccgcgaggatggggcagatggcggaccccaacctgccgctgttctgcattggtgacgtgtcctcgctgtggctggtggtgcacgccttcgagcgtgacgccgtgcgcatccagcgtggcacgcaggcccgcatcaccttcgcggcctttccgggccaggagttcatggcgaaggtgggccacgtggggcagcgcgtggacgcgacttcacgcaccatccccgtgaggctggagctggacaacgccgacggccaacttcggcccggcatgtccgcgtcggcctacatcccgttgggggacccgggagcgcccatcaccgccgtgcccgcggcggcgctccagcggctggaaggtggctgggtggccttcctgcccactgacacgcgcggcgtcttcgagcgacgcgaggtgggccggggccgcaccctgggcggcgacgtggaggtcctcaccggactgaagcctggcgagcaggtggtggtggaaggcgcgttcctgctcaaggcggaggcggagaagttgagcggcggagggagtgacggccatgcgcactga

SEQ ID NO: 8775 - DNA, 1047 bp, Myxococcus xanthus
aaccccaccttcgagctccaggcgggcccgcgcagtgcccctggctcgccgggaaaccccgccgtgcgtgggttggacttgagcgtgggcatcagccagtccttcgagctgggtggaaagcgcggcgcccgccgggaatccgcgcgcgccggtctggagatggcgacggcccaccagcgcgacgccgagcgccgggtgctgggtgacgtcgccgcgcgcttcctccaggcgctgcatgcgcgggagcggctgagcctcgcgcgagaagccgaggccgccgcccgggagaccgcgaactccgcccagcggcgcttcgaggccggtgatgtgcccgtggtggacgtcaacgtggcgcgcgtgtccctggcccgcatgcgcgcggaggtggccaccgcggagggggacgaggccgtccaactccaccagttgcgcgcgatgttgggccttccgctcacacatccgttggccatccgcggtgagctgcgagtgctcgcgctccagcctgtcacggaggcgaagacagacaccgtggcggcgcggcccgatatcgccgcgttggaagcggagctcgcccaggcggatgccgaccgccgcatgggccgggcgagcgtctggccagacatcaccgcggggtttctgtaccagcgagagattgatgaaatcgcctacctcggcgccctgagcgtgccgctgccgctcttcgaccggggagacaacgcccgggtgacgggcgaggcccgcgtgcgccggctccaatccctgctggcggcggcccggttggaagtggacgtccaggtggaggccgcgcgcgtgcagcaccgcaagcggctggaagccgtgacgctgctggaagccgacgccctgccgctgctcagtgacaacgaaagtctcgctcgccgctcctacgaagccggagagatgggcctcgccgagttcctcctcgttcgccgcgacacgctggaagcgcgtgccgcctacctcgacagcctccttcaggcagccctctcccgcgtccaactggccgtggagaccggagcccttccatga

SEQ ID NO: 8776 - DNA, 255 bp, Myxococcus xanthus
atgcccaccctcactggcgcggtgggcgaggtctgcacgcagagctgcccggacgatgatgaccaggggcagtgcgccccggactgcatcgactgcacctgctgtgcccacgtgcgcaccgtggccgcgcatgccccgccgctttccttcgtgctactcgtgtcgcggcccttgcgcgtcgcctacgagaaggccgaaccgttgtcggccgacgggcgcgacatcctccacgtcccgatagcccccctcgcgtag

SEQ ID NO: 8777 - DNA, 456 bp, Myxococcus xanthus
tcgccgaaccagaactcgcgcggcgggacgaagatcgacaccatcgtcatgcaccacaccgcgaccaacaacggcgcgggcgacctgtcgtggatgcgcaatccgcagagcaaggtgtccgcgcactacatggtggaccgcgacgggaagatctatcagctggtcggtgacgacaagcgcgcctggcacgcgggcaagggcgagctgcacggcgtgccctcggacatcaacaaccgctccatcggcatcgaaatcgtgaacgacggcagcggcaagacgcccttcaccgaggcgcagtacaagtcactcacccagctcaccggttacctgaagcagcagcacaacattccgatgaagaacatcgtgggccacgccgacgtggcggttcccaagggccgcaagaacgacccggcgcccaacttcgattggaaccggctgcgcaagggcatctcctga

SEQ ID NO: 8778 - DNA, 231 bp, Myxococcus xanthus
atggcgctcatcgagcgcatcgaggtgttcgtgaagtcccagcggcccgcgctcagcatgagcctgcgcgggcacctggacgccacggtggaggtcgaacgcacgggcccgcgcgaagtgtcgctgcgcatccagggccggcaccgccctgtggcggccgaggacctgagccggctgcgcgacgcgctggaatcgctcgggttgaagctgagctcgctgcgcgcggagtag

SEQ ID NO: 8779 - DNA, 2970 bp, Myxococcus xanthus
cccatctcctcctccctgctgtcggcgccgaaggtgaaggccgtccgtggccagtccatgttcggcatgtccttcatctacgtcatcttcgaggacggcacggacatgtactgggcgcgcagccgcgtgctcgaatacatggagacggcgcgcggacgcctgcccgcgggtgtgacgcccatgctgggtccggacgccaccggcgtgggctgggtgttccagtacgcgctcgtggacgagagcggcaagcactccctggcggacctgcgcagcctccaggactggaacgtgcgctacgcgctgtccagcgtgcccggcgtggcggaagtcgccagcgtgggcggcatcgtcaagcagtaccaggtgcaggtggaccccaaccaactgcgcgcctacggcgtgacgctgggcgaggtgacacgcgcggtccgcgagtccaacgaggacgtgggcggccgggtgatggaaatcgcgggccacgagcacatcatccgagggcgtggctacatccgctccacgcaggacatcgagaacatcccgctgaaggtgagcgcggacggcacgcccgtgctggtgcgcaacgtggccacggtgagcctggggccggacatccgccggggtgtcgcggagctggacggcaagggcgaggtggccggcggcatcgtcgtcatgcgctacggggagaacgcgctcaccgtcatcgaggcggtgaaggagcgcctggaggaggtgcgcgcgggcctgccggagggcgtggagctggtcgtcacgtatgaccgctcggggctcatcgaggagtccatcagcacgctcagccgggcgctggtggaggagatgctggtggtcagcctcatcatcttcctcttcctgatgcacgcgcgcagcgcgctggtcaccatcttcacgctgcccctggcggtgctgctcgccttcatccccatgtactaccaggggctcaccgccaacatcatgagcctgggcggcatcatcgtcgccattggcgcaatggtggatgcctccatcatcatcgtggagaacatccacaagaagctggaggcgtgggaggcggaaggccgcccgggcgagcggcgcgaggtcatcatctccgcgatgcaggaggtggggccctccatcttcggcacgctgctggtgctcaccgtcgccttcctccccgtcttcacgctggaggccaccgaaggccggctcttcaagccgctggcttacacgaagacgtactccatgggcttcgccgcggtgctggcggtgacactcacgcccgcgctggcggtgctcttcatccgcggacgcatccgccgggaggacgagaaccccctcaaccgctggctggtggccctctacatgccggtggtgcgcttcgtggtgcggcacgccaaggtggtggtggcgctgtccgtggtggccatggcgatgacggtgccagccttcatgcggctgggccatgagttcatgccgccgctcaacgaaggcgccatcctctacatgcccacctcgccgccgggcatgtccatcaccgaggccacgcgcatcctccagtccatggacgcggagctgaagcgcattccagaggtggtcagcgtcttcggcaaggcgggccgcgcggagacggccacggacccggcgcccctgtccatgttcgagacgacggtggtgctcaagccgaagtccgagtggcgcaagggcctcacctgggaagccctgctgacggagatggacgagacgctccagtacccgggcatgcccaacatcttctggatgcccatccagacgcgcacggagatgctggccaccggcatccgaagtccgctgggcatccaggtgtttggcgacaacctggacacgctggagcaggcagcggtggccattgaaaaggccgtggcccaggtgcccggcacgcgcagcgcgttcgcggaccgctccaccggcggcttctatgtggacatcgaggtgaagcgggaagaggccgcgcgcctgggcctgggcgtgaaggacatcaacgaggtggtgatgggcgccatcggcggagagaacgtctcccagacggtggagggccgcgagcgctaccccatcaacgtgcgctacgcgcgtgagtaccgcgacagccccgaactgttgaaggaggtgctggtccccactccggccggcgcgcaggtgccgctggcccaggtggcggacgtgcgcttcgtgcagggcccgccgatgattcgcagcgagggcggcaagctcgtcacctacgtcttcgtggacaccgcgcggcccatcgcggactacgtgaaggacgcgaaggcggcggtggcgcgcgaggtgaagacgcccaccggcgtgcgcgtggagtggagcggccagttcaagtacttcgagcgcgccacggagaagctcaaggtggtgattcccgtcaccctgctgctggtgtgcctgctgctgtacttcagcacgaagtccgtggtggagatgggcatcgtcctgctggcggtgcccttcagcctgattggcgcggtgtggctgctgtacctgctcgactacaacatgagcatcgccgtgtgggtggggctcatcgcgctggccggactcgacgcggagacaggcgtggtgatgctgctctacctcaccctggcccataagaaggcggaccaggagggacggctgcgctccatggctgacctgacggagaccatcgttgatggcgcggcgcgtcgtatccgtcccaagctgatgacggtgatgacggacatgatcggcctgctccccgtgctgtggagcaccggcacgggcgcggacgtgatgaagcgcatcgccgcgccgctggtgggcggactcgtgacgtcgtttttactcgagctgaccgtgtatccggccatcttcgccctctggaagcggcgccaccttccccaggaacagccagaggaaggcacaggagagccacccctgcccgccgaaactcagacagcctga

SEQ ID NO: 8780 - DNA, 615 bp, Myxococcus xanthus
atgagcaagcgtgacaagcttcaggactccgagctggtggttgccgcccgggcactcgacgcggagttggcgcgcttcgaatcccaggccgagcagctcgagaaggcgccacttcaatccgagaagcacctggagcgcgcgtcggcgatgctgcaggggctggcggacctggacgagcagctccgggggcgggtgacggcgctggtgggggccatctcgaaggtgagagatcggcagcaggcgcaggccgaggccatccacctgcgtgcgcaggagctccagcggcgcaccgaggtcttcaaggacctgctcgtgcgttatggcgccctgggacagaacgcgggcgagctgaacgtgcagatgcagcagttcgcgcagcagcggcaggcggcgaagacaccggaggagaacgccgcgctggcggggaccttccaggcgctccaggagcggatgtccctggtcgcggacgaggcccattcgctggcgcaggccgcggaggaacaggcgttcctcgacgtggcccgggaggcggactccctgcgtcagcaactgttgtcggcgcggaacaagatgtcgctgttgcacaacagcttcggcggcggggcggctagctga

SEQ ID NO: 8781 - DNA, 474 bp, Myxococcus xanthus
tcacgctccgtgctcgttaccggcgctactggccagcaggggggtgccgtcacacggaagctcttgcagcgcggccaccgcgtcaccgccttcatccaccacccggactcccccacggcccgcgagctcgagtcgctcggcgccgagctggtcgtcggggactacgacgacctggactccatcgcccacgcggcccaggacatggacaccatgttcgccaccgccacgccctttggcccgggcggcgtgcaggcggaggtccgccacgggaagaacctggcggacgcggcccggctcgcgcgcgtacagcactacgtctactcgtcggtggccggagcggaccgcctgacgggcatcccccacttcgacagcaaacaccgcatcgagatgcacgtgcgccggcagcggcctgccctacaccatcctcgggcccaccttcttcatggagaacttcgccaaaagcatgttcgaaga

SEQ ID NO: 8782 - DNA, 402 bp, Myxococcus xanthus
atgcgctacttcagcgtggaagaagccaatcggctggtgccgctgctgacgcgcaccttcgagcgggtccgcccgtgggtggagcgtgcccagcagctcgcggatgaactgggcgccgcgcccaagcccaacgacccgagcctggcctccctgcgcgacgagcgcgacaccctcctcgagcgcatccgcggcgagctcctccagctccaagagatgggcctcgaaatcaagggcgccgacggcctcgttgacttccgagcccaccggggcggtgagcaggtctacctgtgctggcgcttcggagaccccgccgtctcccactggcacgctctgctcgacggcttctcgggacggcgccccatcgaaagcccggacgacttcgcccccacgtacctcagctag

SEQ ID NO: 8783 - DNA, 504 bp, Myxococcus xanthus
atggcggcctatgcgggccgggcggatgcgcaggcgggcgaggtgctggagtcctacgcgcacgcgcacaacgagcgagtccgcagggagcgtcggccgggaaagccgctgcgcacgcggggccgctgcttcgacctgcaggccatcttcacgcggctcaacgcgagctggttcgacggccgggtgcaggtggacgtgggctgggcgcgcaagccggcgggcacgaagcgtcgcagcatccacgtgggcggctatgacgcgcggctacgcgagattcgaatccacccggcgctggaccggccgcatgtgcccgccttcgtggtggactacctcgtcttccacgcgatgctgcacgcggacctcgacgacggaacgggcaacgagggccgctgcgcacccgagcacacgtcggcctttcgcgagcgcgaagccctgttcccgctgcgtgacacagcccagcgctggctgggcgacaatcacgcatccctgctgcgcggccgatag

SEQ ID NO: 8784 - DNA, 495 bp, Myxococcus xanthus
atgctcgcctgcgtggacgtggactaccgccccgaactcaccgtggccgggtgcgtgctgttccggaactggacggatgggcacgaggtctcgcacctggtggagcatgggcctcccgccgcgccgtacgagcccgggcagttctaccgccgcgagctgccgcacctgctccgggtgctggcgcgggtggaagtgcccttggaggccatcatcgtggatggctacgcgtggctcggcgaggaccggcccgggctgggggcgcacctgtacgaagcgctcaaccgggaggtgcccgtcattggcgtggcgaagaccgcctacgtcaccacggggccctcggtgcccgtgctgcgggggaagagcctgcggccgttgttcgtcggagcggcgggtatggacgcggccactgcggcggagcacatccggcggatgcatggggcgtctcgtacgcccacgatgctgaaccgggtggaccggctctgccgcacgtcctga

SEQ ID NO: 8785 - DNA, 1200 bp, Myxococcus xanthus
atgcggcaggtggaggcgctgctgcgcgccgacccggcggtagagaaggtggagcggcgcacgcaggactacggcctggacatcacccgtgccggaagtgacggcaccttcttcctggacaacctcttcgcggacacgcgcgagctgccgcccgagcaacgcgtccagctcatccagcgctacctgcgcgcgctgtggcaggagtcgccggattcgcttcactgggagcaggcccgcgagttgctcctgcccgtgctgcgcgcgtccaccttcggcatgtcgctgcagaagccggcggaggcggaccgggagatggtgggacggcggacactgcccttcctgcgcgagctgctggtgatggacctgccggagtccgccatgttcgtccagcgccggcacctggagacctggggcgtcaccgaggacgaagccttcacggcggcccacgcgaacctggcccggctcccggacgaaggcgtggagctctacgacgaggagcacggcccgctgtggacggtggagacgcgcgatacctacgagacgtcccggctgctgcgcccggggttcctcgcgtccttcgccagtcgcgtggagggccgacccatcgccatcctcccggagcgctccaccctgctcatcggtggcgacgcgcgtccggagctggtggcacggctgaccgagagcgcagagcgggagtacgcggccgcgtcccgatgcctgacgcccgccctgtacacagtggacgacgcgggacgcgtggtgccctacgtgcatcccggtcaggacgtgctggcgaaccgggtgcggctggcccacgtccgcctggcgctggcggagtacagcgcccagaaggaggagctcgacgcgctccatgcggaacaggaggtggacctgttcgtcgccagctacagcgcgacggcgcgcaagcgggacgagttccccatctcctggtgtgtctggtcgcacgacgtggacgccctgctgccggaggcggacatggtcgccgtgcgtcccgcggcggaaggtgatgagttcttcaccgtgccgtggcgggaggtgcagcgcatcgcgggccgttgtctcacgccggtgccggagctgtggcccccgcgctaccgcaccacggaaacaccgtccctggagatggtgaagcaacttcgcgccgcgcaggtcaccttcgagaacttccaggcgccctga

SEQ ID NO: 8786 - DNA, 525 bp, Myxococcus xanthus
atggactccggctacacgctgtatgactcggcgttccgggagagctggtggggcggcttcgagacccgcctgctggacgcggtgaacttctgctacgtcaacttcatgcggggtgtgacgccgctgccgaaggactcgccgcagagccgggcgctgtacgaatacctggtgagcatcagcccgagcccgtccgctccggcccgtcccttcacggtggtgaaggacatcgtcgaagtcacgcgcggtgacgtgacgcgcggacagcaggtctacgtggaggcatgccagagctgccacggcgagccccacaccggcgcgggccggctgaccgagctggcgtcgattctgccggaggtgacgaacgactacgacacgctgttccccggcgtgcccaagtcactggtcgtcatcgagaaggtgaggcacggccagttcttcggtgtcgggggcaacatgccgctctacagcctggagtccctgtctgacgaggacttgggcgcattactggcattcctggctttgtga

SEQ ID NO: 8787 - DNA, 309 bp, Myxococcus xanthus
atgttcggcgcgttcaccgcggacgggcgcacgctgtacatgccctaccagttggtggacgcgctggccgtcatcgacccggagacgggcaccgtgctgcgcgaggtgcaactggcggacgccggctgtctcaacgtgcatcaagtcacgctgacgcccgacgagcgcatcggcctggtcgtctgcgaaggcgaccacgtggggccgggcacgttgcacgcggtggacctgacggaaggcacggtggtgggcacggtggaggtgggcatcttcccggactcggtgagcatcctgcgggggcagccatga

SEQ ID NO: 8788 - DNA, 675 bp, Myxococcus xanthus
atgtcggacacacgctcacctcaggtccttccgacccgtaagcacacgcaacacctggaacggttctcggaggcggacatcccgaccgagcgcggctcgctgcggaccatcgtgttccgggacaagcgcaacgggcgggagcatgtcgcgctcgtggtgggacaggtttcaggacacgagggtgtgccggtgcgcatccactccgagtgcctcacgagcgaggtcttcggcagcctgaagtgcgactgccgcgagcaactggaccgctcgctcgacttcatcacccaggcgggacagggcgtcgtgctttacctgcggcaggaggggcgcggcatcggcctggggaacaagatcaaggcctacgccctgcagtccaagggcctggacacctacgaagccaaccggcagctgggtttcgcggacgacctgcgcacctacgacatcgcggcggagatgctgcggagcctggatgtgcgctcggtggacctgatgaccaacaacccgctgaagatcgcgggcatggtcgaagaaggcattcccgtccggcgtcgaatcccttcccggaccgagcacaatccgcataacgtcgactacctgaggacgaagcgcgagcgtacggggcacctgattgagctcttcgccgaggacgacgacacggaagccaagacaggctga

SEQ ID NO: 8789 - DNA, 393 bp, Myxococcus xanthus
atggccggacgggtcctcttctttcttcagcacgccacgtacgagccggccttccaggccgccaccatgggaatcaccgccgctgccatgggcgacgaggtgtacttcgtcttcgccttcgatgcgctgcgccagctcgtggggggcgcctacggccagccgtcgagtgcgcgcgagcacgaggagttcgcacgcgcggagtcactcggggtgttggcgccgccgcacatgctggcggaagcgcgcacgctgggcgccagactgatcgcctgcgacaccacagtccgcatctgcggctacaaaccggagtcgctggagggcaccctgcatgaagtgatggggatggcctcgatttggcgactgaccgcgggtgcacgggtgctcaccctatag

SEQ ID NO: 8790 - DNA, 501 bp, Myxococcus xanthus
atggtgccgccgtacttcccggtgacggcggacggcgtgttccgggcgcagctcacgtacacggacctggccgccacgcagacgctgaagctgggcccggcgacggttcacaccattgagctgaaccacccgggcggcaacatgggctaccgcgtcgagtgccagggccgctcggtggtgtacgccaccgacctggagcatggcagcgacatggacgcggccttctacgcgttcgcccaggacgcggacgtcctcatctacgacgccatgtacaccgaggacgagtaccacggccgcaccgggccggctcgcaccggctggggccactccacctggcaggccgccgtacacgcggcggacgaggctggggtgaagaagctggtgctcttccaccacgacccgtcacgagatgacgcgggaatggaccggctgctgcgtcaggtgcgcaagcaccgccccgacgccatcgccgctcgcgagtccctggtcatcaagctgtag

SEQ ID NO: 8791 - DNA, 1074 bp, Myxococcus xanthus
atgaacaccatcaccgtctaccgcctgggccgagtggagtacgaggacgggctcgcgctgatgcacctcttcagcgagtcgcgccgccaggggctctccggcgatgtgctgctcctcttggagcacccgcccatcctcaccctgggccgtgccgcgaagcgtgagaacatcgtcgccagcgacgcgcagttggcgaaggagggcgcggaggtcttcgagaccaaccgtggcggcgacgtcacctaccatggccccggccaactggtgggctaccccatcttcctgctgccggaggaccgacgcgacgtgcgccgttacgtgcgcgacgtggagcgctccgtcatgcaggtgctggcccagtggggcatcaccgcgggccccatccccaagtggcccggcgtctggattggcgcggaaggtgctccggacgcgcggaagatcgccgccattggcgtgcacctgtcgcgttggctcaccacgcacggcttcgcgctcaacgtgaacacgaacctggaccacttccagctcatcgtcccgtgtggcatccgagaagcaggtgtcacgtccatgcagcgggagttgggccgcgcgctccccatggcggaggtggaagaggccatcgccaacagcttctgcaccgtgttcgacagcgagcgcgtggatgcgccgccgccgatgcggacggtgagcatcgcggtggtgaagggccgtggtcccgaagcacgggtgctgctcgtgcgccgtcgcccggagcggggcggtttctggcaggtcctcaccgggaggctcgaagcgggtgagtcgccagcgcaggccgcggcgcgggaactggaggaggagacaggcctccgcgtgccgctggtggacctggactaccgccacgccttcgccctgggagaggcgctgccaccgcaactcgtggaggagaacggcttcgccgtccacgtgccgccggacgcggacgtgcgcctgggcgcggagcacgacgccttcgagtgggtggacgtccccacggccctggagcggctgcccttccagggcctgcgggagacggtgaagcgcgctacagcttga

SEQ ID NO: 8792 - DNA, 1593 bp, Myxococcus xanthus
atggccgagaaccctcgcgagctgatccgcgccgcgcagtccgccgagacacagggagacgtggcccgtgcggtggagtgcctgcagaaagcggcggagctgtgccgacaggcaggtaatccgtcccgcgcgttgcagttgcttcgccatgcgcagcggttggacggcagccgcgcggacatcgcggatgcggtgaaccggctggagtggatgccggagccttcgctcacgcggtctggggcagacgctgacgacgaagaggcattgcctgcgtccggggtggtgcattccctggagtcggaggtgttgccggacgtcgtccaccggcagcggctcatcgaggatgcgctgcgcgaggcggccctgcacgccggtgacgacgcgccgcgcgacgccgcccaggcctgggtcatcgagacggaggtcgcggaagatctgcagcggctcgaagcgcagattgcgcgcatcgcgggggtggtcgcaggggcggaagattcctcgtcgccaccggatgcgactgtggacgtgcggggcggcgttgcgtccataccgggtgatggcgtgggcgagcaggaacttctgggcgtcgaggagcccacgacgcagcttgcgtcatctcgaatggcgggtgaggcagaggaagcacccgcaggagaggacatcctcacggatgcccagcctcggcgtcgcagagaggctcggctcgtcgagcgcggccctacgcgtgcggatgccgcgctcgacgcatggtgctccttctgttgccgtccgcgtacggacacggggggcctggtcgcggggcctgcgggcgcgttcatctgcaagaactgcctgttcgagtcgcaatcgctgctgggcgacgtcactttggtgcctccgcccacggtgtcgcggccggaacggcccgtgacacctgccttggggctcgtggggcagggcgtgacgcaggcgctgctgacgcagtcgctcgaggcccacgcgcggaccctcttggtcatcgggcccgaaggcagtggcaagagcgtctggttccagcagctccagcgagaggccgtgggcgtcatcacccccgtcgcggacctggacctgacggcttcctcgcgcacgctgctggtggaggatgtggaccgcctggacgcgacgtcacacgcggccctgcaggccttcctggcccgggacagccgccccgtcgtcctgctgagcgcgaggggcatgcgcacggaggctcggggcctgagcctgcgcggagacgcatacagtgtttccgtgtccaccaccgccgcgctgactcaggccgtgcgcggaaccgtgcccacggacattctggagcacgtgcaggtgctcctgtcgctccaggtgcccacaccgtctgaattcgtggagattgcccgccagcgcctggcctcgcgagagcccgcggtctccgtctccgaagaagtgctcatggcgctggcccaggaggccagccgctcgccgcgcgccggccatgagctgcatgccctcctcaaccgggtacccacgggaacgtggagcctggcgcccaccgtgaagccctcgcccacgcggaaggctcgaaagaagcgaacgtcatga

SEQ ID NO: 8793 - DNA, 1251 bp, Myxococcus xanthus
atggcgatcttcgaattcaagctccccgaccttggtgaaggcgtgatggagggtgagctggtgaagtggcacgtgaaggcaggggattccgtcaaggaagaccaggtgctcgccgaggtgatgacggacaaggccaccgtcaccgttcccgctcccaaggcgggccgtgtcgtgaagacgcatggcaatgaaggcgacatggcgaaggtgcaccagctcctcgtcaccctggaggtggagggcgctgcgccggcgcaggccggtggtcattccgaggccagcgcgccagcggcggcgcccgtggcgggtggccatgtcggtggtgcgcctgcctcggcgtccaaggtgctggccacgccggtgacgcggcggatggcgcgcgagcacgggctggacctggcgtcgattgccggcacggggccacagggccgcgtgacgaaggcggatgtggtggcggcgctggagggtggcgagaagaacgtcgtcgcggctccggccgagcagaaggcgcgtcccgcggctcctgccgtcagctcgggcgcggcggacgagcgcgttccgcttcggggcctgcgcaagaagatcgcggagaagatggtgcggtcgaagttcacggcgccgcacttcgcctttgtcgaggaagtggacgccacggagctggtggccctgcgcgcgcggctgaacgcgcagttggcggcggccggtgagaacatcaagctcaactacctgccgttcatcatcaaggcgacggtggcggcgctgaagaagttcccgcacctgaacgcgaacttcgacgaggcgtcgcaggagctggtggtccgcggcgagttcaacatcggcatggcggcggcgacgccggacggcctcaccgtggcggtggtgaagagcgcggaccggctgacgctggccgagctggcgcgtgagacggcccgcctgggcgccgccgcgcgtgaccgcaagctgaagatggaggagctgacgggcggcaccttcaccatcagctcgctggggcagagcggcggcctgttcgccacgcccatcatcaaccaccctgaagtgggcatcctgggcgtgcaccgcctgaagaagcgcccggcggtggtgggggaccaggtcgtcgtgcgcgacatgatgaacctgtcgctgtcgtgcgaccaccgcgtcatcgacggctcggtggcggcggatttcacgtacgaaatcatcaagtacctggagaagccggacctgctgttcctggccatggcgtga

SEQ ID NO: 8794 - DNA, 930 bp, Myxococcus xanthus
atggcgactcccgaccggttccctctgccccaggtgactgagaccacccgcaagccggagtggctgaaggtgcggctcccgcacggagaaggttacgagcgggtcaaagccatcgtgaagcgcaccaagctggccacggtgtgcgaagaggcccgctgcccgaacatcgccgagtgctggggcggtggcaccgccacggtgatgctgatgggcgaggtgtgcacgcgcgcgtgccgcttctgccacgtgaaggtcggcgcgcctcctccgctggatccgatggagcccatccatctggcccaggcggtgaaggagatggacctggagtacatcgtcgtcacgtccgtgaaccgggatgaccggccggacggcggcgccagccacttcgcttccgccatccgcgagctgcgccgggagagcccgcgcaccatcgtcgaagtgctcatcccggacttcaagggcgtggagaaggacctgaccaccgtggcggaggccaagccccacgtggtggcgcacaacgtggagacggtggagcgcctcacgccgacggtccgtgaccggcgcgcgaagtaccaccagtccctgcgcgtgctggagtacctcaagaaccgccccgagggcctgtacaccaagacgtccgtcatggtgggcctgggggagacggacgcggagctggagcagacgttcaaggacctgcgcgacgtgggcgtggacgtgctgacgctgggccagtacctgcagccgtcgcagtaccacctgcgcgtggagcgcttcgtgacgcccgcgcagttcgaggcgtacaagacgctggccgagtcctacggcttcctctacgtggcctccggtccgctggtgcggtccagctaccgggccgctgagttcttcatgaagggcctgatggagcgcgagcggctcgagcggctcggctga

SEQ ID NO: 8795 - DNA, 561 bp, Myxococcus xanthus
tgtgttctaaagcgacacatccatgccgagcgcggctacatcaaggtcgactcgatgctgcgcacctccgagccgaacgtctacgccgtgggcgacatcatccccacgccgatgctcgcgcacatggccagcgcggagtgcgtggtggcggtggagcacatcgccgggaagaacccgcagcccatcaactacgacctgacgccgtctgccacgtactgctaccccgaggtcgcctcggtgggcctgacggagaagaaggccaaggagcgcggctacgatgtgaaggggggcatcgctccgatgggcgccgtgacgaaggcctccatctccaacgaggccaccggcatgatcaagatcgtgtcggaccggaagtacgacgaggtcctcggcgtgcacctcatcgggccgcacgcgacggagctgctggccgaggcgtgtgtcgcgctgaagctggagatcaccaccgaggagctggccaacaccatccacgcgcacccgacgctctcggaaatcgtgcacgagggtgccgaggccacgctgggccacccgcgccacttctag

SEQ ID NO: 8796 - DNA, 342 bp, Myxococcus xanthus
cttcgaggaccttcgacggcctgggcaaagcaccgcacggtggagaacggcctgacggtggatgcctccggagccgtggaactctccacggggacgatccccttcacgggcgccgcggcgctggcgcgcgtgctggcgaccagcgacgacgtgggggactgcgtgccgctccagctcttccgcttcgccatgggacgtgacgaatcccccgtcgacgagcacatgctggccgacatgcggtccatgttccgggccaacccggagtggcgcatgggtgaggcgctcgttggcctcgtgcgctccccgtatttcgtccaccggcgtacctcttcccccgagtag

SEQ ID NO: 8797 - DNA, 1218 bp, Myxococcus xanthus
atgctcgcgccgctccagccgcaccgggacaggctcctggtgctggacggcctggattatcaggtcctctacgagcagggcctgacgggccatgaaggcggcccggtgacgttcctcaccggaagcaaggtcaacaccggcagcggggaccacctgccggagagcgcctcgctggaccaggtgctgggcaaccacatcggtggtggcacgcgcttccgctccctgcagctcaacgcctgggagcagttcggcggccagcacgtctacaacagcatcagcttcactgcgaacggctcgcgcgtccccttcgagcgcgacccggccaacgtgtaccagcgcctcttcggtgacgcgccctcgccgaccgccgacccggcgcaggtggcgagcaaccgggcgcgccgcaagagcctgctggacttcctgatgaaggacgccacgcgcctgcgcaaccgcctggcgggcgccgagcgccagaagctggagacgcacctggaggcgctgcgcgacatcgagcggcgtctgggggcgctggccgtggatccgacgccgctccccaagcagcagtccggcgaggccgcttgcggtggtggcgccgcgccgccgtcctacggtttgggcggcctgggcaacctcaacaacatgccgacgctgacgcggctgcacatggacctcatcgcgcgcgcctttgcgtgtgacctgacgcgcgtcgtcaccatgacgattccggggccgtccatgccctggctgggcatccacgaggacacgcacaacgacatcgcccacctgctcgacgtgcaggaggagccccgccggaccaccatccgcgggaagatggtgcaggttcagcgctggtacgccgagcagttggcctacctgatgacgcagctggcctccatcccggagggcagcggcaccgcgctggacaacacgctcatctactggggcaacgagctgggcgacgcgtccggccacatgaacgtgcgcgtccccaccgtgctcgcgggcggggcggggggacgcttccgcatgggccgcttcctgcgcgtgcgccccgcgggctccaacccgctgggcggctgggcgggccccggcacgcggctgagtggcgccgtggcgcacaacaagctgctggtctccattgcccgggccttcggcgtgaatgtgaatacgttcggccaccccgactacacgggggagctgccgggcctcacctga

SEQ ID NO: 8798 - DNA, 672 bp, Myxococcus xanthus
atggccgtgaatgcatggaggaagggcctgcccggccttgtcgtggcgacgggtctcgtggtggcggcgctggtgtacgcgcttcgccaggacccggagccggtgacgccggggtcgcccgccgtcatcgagcaggccgccacgcccctggcgccggcttccgtggcgcgcacgccgccgcctcctccgcaggccacgccgccgccgttggacctgacgcggccgcccgaggaagtgccggacgaaaacgcgccgaaggtgcacccggtggacctgcaggtgattcgcgcgaagctgcccgacaacctctactggcggatgggcgcgcccacgcaggacccggcggagctggagcgccgcgaagcggagtcccgccgctggaatgagctctacggcaaggtgctgtccgccgatgccacggtggagcagattcgcgagtactacggccaccgccgtcaggtgtccgaggacttcatcaccttctccaccgaggtgttgtcccggttcggtgacgtgctgccggagcgggaccgcgggctctacgagctgagcatcaacatgcaccgcacgcggctggcggagctgccggcgcaggagcaggacgcgctggaccggcgggaagcccaggagcgccgccgcgaggcctggcgccagggcctccagtcgccctga

SEQ ID NO: 8799 - DNA, 1272 bp, Myxococcus xanthus
  unsure (1)..(1272): unsure at all n locations
cgggccctctacgacgagatgcgccgggcgcagcggcacgcggccttcctggcgcaggccagcgaggtgctggcgtcgtccctggagcacgacctcatcctgcagcgcatggcccacctcgccgttcccatcctgggagacgcgtgctcggtggacctccccatgccggatgggcaggtgcgccgcgccgccgccgccttctccagacaggagatggtggcgcccgcgcaggacttccagacgcgctatcccattcgcctggagnacgcggcgggtatcggcaaggtgctgcgtactggcgtcaccgagttcaccccggactttcccgccatgctcgccgccgcccaggggggcagctcggcgtaccggcgggacgtggaggcgctgggcatcagcgcgtacatcatcgtcccgctcatcagccggggccgggtgctgggggcgctcacgctgctcaattcggagtcccggcgcagatacacggaggcggacgtgcggctggcggaagacctggcccggcgcgccgccacctcgctggacaacggtcggctctacacggaggcgcaggaggccgtgcgcgcccgggactcgttcctgtccgtggcatctcacgagctcaacacgccgctgacctcgctcatgctcaacatccaggcgttgcggcgcgacatggagccgcgcgccagcaatggccccgcgtcaccggaggcgctctccacgaaggtggtggcggtgcagcggcaggtctcccgcctgtcgagcctggtgcgcgagctgctggacgtgtcccgcatcaccgcggggcggctgcggctggagcgcgaggacctggacctggccgcgctcacccgcgaggtggtgccccgcttcaccgaggacctggcacgcgcgggctgcgcgctgcacttggaggcggggggcgccgccaccggccattgggaccggctgcggctggagcaggtgctgcagaacctgctctccaacgccatcaagtacggccggggccgccccattgaagtgcgggtgggggcggatgcgtcgcgcgcctgtctgtcggtgaaggaccagggcgtgggcattccgccggaggggcgcgcgcgtctcttccagcgcttcgagcggctggccagcgagcggcactacggcggactggggctgggcctgtggatcgtgaagcagattgtggacgccatggagggtcgcatcctcgtggagagcgtgcccggccagggctccaccttcatcgtggagctgccgcgccaccctgcgtga

SEQ ID NO: 8800 - DNA, 1788 bp, Myxococcus xanthus
atgcgtttctttcgactcatcgccctcgcgttggcgtgcggggccacctccgcgtgctccggcttctggacccgcggcgcgccgccggagcccatccacatcaccctggtgggcatcaacgacttccacggacaggtggagcctcatcgcacgccactgaaggacggccaggtggtggaggagggcggcgccgccacgctcgcggcctacgtggcgcggctgcgcgcggccaacccggggggcgtggttctgctggacgcgggcgacatgttccagggcacgttgccttccaacctcacggaaggggccgtcgtcatcgacgtgtacaaccacctgggagtggacgcggccgccattggcaaccacgagttcgactatggccctgtggggccgggttccatggcgcagcggcccggggatgatgcgctgggtgcgctcaaggcgcgcatcggccaggcgcgattccccatgttgtcggcgaacctccgcgacgcttccaccggcgcgcgccccgcctggacgggcaatgacggcacgtacctgatgaaggtcaagggcgtgaaggtgggcatcatcgggctctccacggaggacacccccaaggtcaccaatcccgccaacgtgtcgtccctgcgcttcctgcccctggcgcccgccgcgctggaagcgtcccgttccctgcgcgcgcgcggcgcggaggtggtggtggtggtggcgcatgcgggaggcaagtgcgcggacttgagcaacccccgcgacacgtcgagctgcgacgagggcgacgcggagattctgtcgatgctgaagcgcctgccgccaggcacggtcgacgccatcgtggcgggacacacccaccagacgatgggccacttcttcgcccaggtgcccatcatcgagacgacggggctggcgcgctccctgggcgtggtggagctgttcgtggacccggacagtcgccgcatcctgcccgaacgctcccgcatccaggccgccattcccctctgtgcgaaggtggacgccacccagggaacgtgtgacggccgccgcctgcggaacgagccccaggtgcgcctggagcccgcgtcgttcatggcggagccggtggtgcccgacgcgcaggtggcgccgctgctggcgccagcgctggagctggcacgggaggcgcagaatcgccagttggggctcgtggcggccacgcccctggcccgcggctacacggaggagggcgtgctgggcaatctggtggcggacgtgctgcgtgcgtcggccaatgcggacgtggggctgatgaacccgggcggcgtccgggccgacctggccgcggggccgctcaccttcggtcaggtgttcgaggtgctgcccttcgacaacacggtggccgtggccaccctgacgggccccgagctgtcgcggttgctgcacctggcctatggcaacgacatgggctccgtcttcgccgtctccggcctcgaggtgacgctggagcgctgcccggggcctgggcggctctcgggagtggccctcgccggcggtcagccgctcgtggtggactcccgcaagatgtaccgggtggccctcccggactttctggcgcgaggcggtgacgggcttgagcccctcttgagcaccgtgccaccggagcgcatcgagatgacccccgtcgacgggctcgacctgcgcgaagcgctcgtcgcctacgggaaagcccggggcggcacgctggaggcccccgacttgggacgtgtccgctacacgggtgtagcagggtgtcagcaagaggcgcgctga

SEQ ID NO: 8801 - DNA, 1092 bp, Myxococcus xanthus
atgtccatgctcgtcttcaccagtgaggaggcgctccacctggcgctgacctccggactcgtccccgccgaagtccaggccgcacccgcccgctatcatcggacgcccgacggagcgcttcacgtcctgccggaggtgatgcccgcgaaggatgtgctcgcgcacctcgcgtccctcggcgtgcacgtgacgcggagccgcgcgaaggaggccaccccagtcctctgctgggcggagctggtgacggcgcggcgcgtgccgctggagagcgcaccgaccggcccggtgctgttcctgcccccgagcgccgatgcactcctccccttggcgggcgagatgctgcgcctggggtgcgaccggcaagaggtgtgcttcgcccaagcctcggggggaagcggacagcgcgccttgctgcgcgcgatggcaccgccctacttcaccctcaccagcgcgctggacgcctcgggcccgctgcgtgccttcgttcccgctgtcccagggcaacacgccgtctgggtcgaggtgggctacacgcatccactcgcgcgcacgctgcaagcgcccgcggggacgttgctgctcgtccgtggcgaaggcccctggctgaccgcgccggacggcccgtggacggacctgtaccaacacaccgacctgcggctcccagccccgggcaaggactggacgcccgcgcccaccccgggccggctgacggtgccgctgcgcctcacgcgagccgcacgtacggaacccgcgagcctctgggtgctgctcgagaatgcgctcgcccaggtggagtccctggtccacacggtgccagagccgctgctcgcgcaacttcgcttcgccgtcacggggccaccggaggcgccgtgcatcgtgctccgtgcccgagcgggccgggagcggcccccggagctgggcctgtcgggcatggcgtacgcgccgctgcctcagctcgcggacctcttcctgccgtgtgacggactgctggagccccccgtgcgaagggcccgcctgcgcgcgttgctcgtgccgcaggccgataccgtgacgtggctccaccccaccgggggtggaggcttccgcgcgtag

SEQ ID NO: 8802 - DNA, 477 bp, Myxococcus xanthus
atggcctctcccacggatacatccgcgcccgtcaccatcactcagattcagagtgaggcggagctcatgcaggcgctcgccatccgcgaggtggtgttcatcgaggaacaggcggttcccgaaggcatcgagcgcgacgccgaggacgcgcacgcctaccacgtcatcgccaaccagggcggccacgccatcggcacggggcgcctggtgatgttgacgcagcctccggccaaccaggaaggcacgtggggtcagattggccgcatggccgtcctccaggcgcaccgcaaggcgcgcgtgggctccatgttgctgacgtccctcgaggaagaggcgcgtcggcgtggcgtcaacggcatcatgctgcacgcccagctctacgcgctggagttctacaagaagcacggctacctgccggtcggcggtgtcttcgaggaagccggcatggagcacctggagatgcacaagcgcttctga

SEQ ID NO: 8803 - DNA, 808 bp, Myxococcus xanthus
atgcgcggtgtgacccagcggctgctgctgatggggctggtggtcctggcatgtacggcctccgcgtcccgcaaggtcttgtacgagaaggaatcgccctacaccctcatctcggtgacggaggacgaagaggggcgccggtacctgggcttcgatgcctcgggggcgctgcagagcgtggtccggccgggcaagccgctggacctggtgctgccctacacgcaggtctccatggtggggctggcctatgtgcccgcgcccaagcgcatcctcatcgtggggctggggggcggggccatgcccatgttcctgcgcaaggtagtgccgcgggcgcacatcgacgtggtggacatcgatccggatgtggtgacggtggcaaggcgctacttcggcttccgggaggatacgcacctgcgcgcgcacgtcggagacggccggcgcttcatcgaagccgagcggcccgcgtatgacctcatcttcctggatgcctatggcccggacagcatccccgagcacctggccacgcaggagttcctggcggtggtgcgcgcgaagctgagcccccagggcgcggtggtgggcaacgtgtgggcctttccgcccaaccgtcactacgacgccatggtgcacacgtggcaggtggccttcacgcagctgtatgagttcatcgtgccgcagagctcgaatcgcatcctggtgggcgtggggtacgaggagaaggtggccgccaagacgctggaggcgcgcgcggagaagctggagcgcacccggggcgtgccattcgacttgagcgggctggtggaccggg

SEQ ID NO: 8804 - DNA, 1011 bp, Myxococcus xanthus
atggacaacctcacccacggactgctcgggctcgccattggcgccatgcgcaagcccgacgtgcgccccggcgccccggagcgcgcctcacccacggaccgcgcggtgctggtggcgtcggtgctcgccgcggagctgccggacctggacaccctgctggcacgcggcgacgcggtgacggtggcgctccaggcccaccgggggctgtcccacgcgctcgtcgccgcgccgctggtggcgctcaccgccacgctggccgcccgcgccctgtttcgcggcgcgcggctggcgcccgtgttcctcaccagcctggcctccgtcgtcttcgcgcacctcctgcccgacttgtggacgggctgggggacgcgggtgctgctgcccttctccgacagccgcctgagcctggactggacgatggtggtggacccctgggtgacgctgccgctgctcgccggagccatcctggcctggcgccggcgcgcggactggcggcggacgctgctgtggagcgcggcctgctccgtggcgtacgtgggcttccgcgtggccacctgggcggtgctgacgcagcgggtggaggcggcctaccccgccgcgcaggcggtgcgcgtctttcccctgcccttctccgtgagcacgtggcgttacgtggccacgctgcccggtgacgtgttcgccgcgggagaggtccccctggcgggtccgccctcggaggcccggcgcgcggaagccaccggaagcacgctgccggagcacgtacaggccgtgccgacggtgcgcgaggcgctcgcctgggcccgcttcccactcgtccacatggagccgctggccgaaggaggccagaaggtgcgcatcgccgacctgcgctaccacctgcgcggcgagccgacgctggccttcgtcatccacctggacgcgtccaacgcggtgacccacgcgcagttggaacgcggcggcagcgccagcgagctgctgcgcaagtggcgcagcgcggacaccgcggcgccctga

SEQ ID NO: 8805 - DNA, 1239 bp, Myxococcus xanthus
atgtcctccatcgtcgacgtgctggtggacggtggtaacaactacaactggcagaaggtggagctgccgggaaccaagtgtggcaatggctcccagttcaagttctgggtgcatcgcacgggttcgcccaacctgatgttcctgttcgaaggtggcggcgcgtgctgggattacgacacgtgtagcggccgcgcgggcctgctgggcgccgccaatccgaacggcatcgccgacgactacatcacccagttcacggccaagtatgtgtcgccgctcgtcaacggtgcagacccgggcctgccggggcgcagcaagacggacctggtgacgaagggttggaacatcgtctacgtgccgtactgcaccggtgacgtgcacgtgggcaacaacgtggccacctacgtcgattcgacggggcagaacccgccgctgacgtggcaccacagcggctacaccaacacgctggcggtggcgaactacgcgaagacgcagttccccaacgtccagaagatgctgatgacgggctacagcgcgggtggcacggcgacggcggccggctactacttcctgcgcaaggccatcaacccggcgcgtggctacctgctcaacgactccggccccatcttcctggcgcccaatgcgaacttccgctcgcgcgcgctgcacgacaagattcgccagtcgtgggacctgaactccgtcttctccctgctgccgggcacgttcagccagagcgacttcggcaccatcaaccgcatggtggcgcaggagttccccaacgaccagctggcctacacgggctactcgcgcgactacaactactcgcgcttctcgtatgaccgcttccactcgcccaacgacaaggagtccgtgctgggctactggaagcaggaccaggacgcgctggtcaccgagctgaacaagtgcaacaacttcagctatttcatcccgcacgagcgcgccatcaactccagccactgcagcaccatcatcaccttcatcggcgcgcacgcctgccagcagatggagaagaagcgctactggtacgagtacctcgagttcccgtggagccagacgtacaagtgctacagcgagttcgtgggcatggacacgttcctgtcgcggtggatcaacggcaaccagcgcgtccgcatctacgagcccgccaacggctacaacgccgaggacccgggcatgcagattgtggccccgctcatcaacggcgcgctgggcgggtag

SEQ ID NO: 8806 - DNA, 2121 bp, Myxococcus xanthus
atgagccacgtcgaggcgtcgctgccggaccatgcccgcgccatcatcgccgaggaagaggccttgctggcccgtgttcagtccacgctggaagccgcgcggcgcaagtccgcacgcggacaggacgcccagggacttgtcgcccagttgcaggtgctgcgggacgacgcctccaccgcggccgtggccgacctgccgcacatcttcgcgcagatgaaccagatgcgctccctcctggaacgtcaggagggagtgaagcttcccgacccacaggccccctacttcgcgcacctgcgcctcaatggcgaaggcggcccgcgcgactacctgctgggccgcaccacgttcgcggacgtgggcgccggtgtgcgcgtcatcgactggcgcttcgcccccgtggcccgtgtcttctattgctacgaggaaggcgacgactacgaggagtacttcggtgagcggctcgccgagggcagcgtggagacgcgccggctggtcatcatcgagcgcggcgtgttgacgcgcatcatctccggcgcgctggtgctggagcgcctggcggacggtacatggcgcagcgtgagccgcgacttcgccacgctccagtcgggcggcgcggggacggcggcgcggccggagttcctgggcaccggcaagggcgcgcggcgcatcgaggatgcctttggcgtcaccgccatgctggacgccgagcagtacgaggccctcagcaccggcccggaccggccgctgctggtgctgggcagcgcgggcagtgggaagacgaccgtggcgctgcaccggctggcgaagctggccttcgacgacccgaggacgttcccccaggcccgcatgaagctcatcgtcccggaagaagggctggcgcggctgtcccgccggctgctggcgccgctgggcctgggcaacgtggccgtgcagacgcgggatgcctggctgctcgccaccgcgcgctccgccttcaacgtgcccggcatcaagctgtggaatgacacgccgccgctggtgtcccgcctcaagcgccaccccaccctgcggcgcgcgttggccgcccgggtgggcgtgccaaagacagacgcgggcaccacgctggagcggttgcgcacgcggatggcggacgcatacatggaccggcgcttcttggagagcgtggtcaccgccgccaagggcgagattcctcgcaccgccatcgacgagacgctggagcacacgcgcctccagctcgccacgccgctgtccaaggtgctcaaggacatcaccgacgcggagcggctcatcaccgtggatgggcgctccatcgaggacgacacgccggacgccatggccggcaccgtggacctggacgacctgcccgtcctgatgttcctcaaggcccagcacacctcgctgggcctggagcggctggcgcacgtggtgctcgacgaggccgaggacttctccctcttcgagctcttcgccgtccgccaactgctgggcaagggcaagagctgcacgctggcgggcgacgagatgcagcagacggacgcgggcttcgcgggctggcccgccgtcctcaacgagctcaacatccgtgacgccgccacctgccggcttcaggtctcctaccggtgcccccggcccgtggtggagctggcgcggcaggtgctgggcgcgcaggccccggaggccgccgccaccggccgcgcgggcgctccggtgggcttccaccacttccccgacgaggcccaggcccagctcttcatcggcgaggcgctccgggacctcgtcgcccgcgagccccacgcctccgtgggcgtcatcgccagcagcccagagtccgcgcaggccatctaccgcgtcgtcgccgaccagcgctgggcgcggctggtgagcgacggcgagttcaccttcgagcccggcgtggacgtcaccgacgtgggcagcgtgaagggcctggagttcgactacgtcatcctcccggacgcgacggcgcgggcctacccggtggacgacgagtcacgccgccgcctgcacgtggcggtgacgcgcacctcccatcagctctgggtggtgtcctccggcgtccgctcgcacctggtcacgcagggtggcgcggcagctccacgatga

SEQ ID NO: 8807 - DNA, 3177 bp, Myxococcus xanthus
ggcacactggaggggcacgtggagccggcgcacttcgaggcagcgtggcagcacgtcctcgatcagcacccagcgctgcgcacctcgttcacctgggaggagttggaggagcccctccaggtcgtccaccgcgccgtctccgtgcagctcacccggcgggattggggccacctcgcaccgaaggcacagcgtcgtgagctgacggccctcctcgatgcggatcgccagcgcgggttcgcgctcgatcaggcgccgctcatgcggctgctcctcatacgcaccggccctcggacccacacgttcgtctggagctgtcatcacctgctgctggatggctggtcactcgggctgctcctcgaggagtgcctcgacgcgtaccacgcgctcgtccggggcgagcgcccttcgcgcggcgtcacgcgcccctatcgcgactacattgcctggctccaacagcaatcatccgggcaggcggagcacttctggcgcgagcggctggcaggcttctcctcacccacgcccctgccggtggcgcgggccacgaaggccgaaggctcctggcatgggcgctcctcactcattctttccgaagagacctcggagcagctccgcgccctcgcccggacgcacgcgctgacgccgaacaccttcttccaaggcatctgggcgctgctgctcagccgctatagcggccagtccgacgtcgtttttggcaccacggtgtccggacggcccgccgacctgcctggcgcgcaatccatggtggggatgttcatcaacacccagcccgtgcggacgcgggtcgatccagacggcctcgtcctgccatacctccaacaactccagcgcgagcaggccgaggcgcgccagtacgagtacagctcgctcgtgcagattcacggctggagcgaggtgccgcgcggccagaacctcttcgagacgctgctcgtcttcgagagcttccccttctcccacgccgagacctcgccgggcggtggcgcgaccgtcacggacgtcgagacctacgacttcaccagctacatccttcacatcgacgttgtccccggtcctgccttcaccctcctggcgagctacgatcgccggcagctcgacgacgcgacgctcgcgcggctgctgacgcactacgcgcggctgctcgaggagctggcccatcaccccgagcggcgcctggacgaactctcgatgctgccggacgccgagcgccggcaggtcctgctcgattggaaccagcagcgggcggactacccgttcaacagctccatcccccagctcatccaggagcaggccgcacggaccccggacgcaatcgccgtgacccaccgcgacgcccagctcacctaccgcgagctcaacgcccggtccaaccagctggcgcatccgctcatcgcggaaggcgtggggtcagacatcgtcgtcgcgctgctcggcgatcgaggggtggacttcctcgcctccatcgtcgggattctcaaggcgggaggcgcctacctcccgttggatccggaccaccctgccgagcggttggcgcagatcctcgggcagagccagacccccatggtggtggtgtcccgagaacgccgcgcgctgctcgacgcggcgctggcgctcctgcccgccggtgcccggccacgcgcgttggagatcccggagttgctggagcgccaggccccagcggacgatccgccttgccgcagccacgggcggaacctggcgtatgtcatctacacgtccggctccacgggcgcccccaagggcgccatgctggagcacgctgggaagatcaaccacatccgcggcatgattgatttcctgcggctggggccagcggacgtgatggctcaaacggcctcacagtgctttgacatctcggtctggcagttcctcgccccgttgatgctgggagcacgagtccagatcctcgacaccgaactgacgcgggatcccgccagcttcctggcggagttggaccggacaggcatcaccgtcctcgaggtggttcccgcgttgctgacggcgatgcttgagcagctcgagcggatggaccccgcgcggttgccgatgcagtcgctccactgcctcattcccaccggcgaggtgctcccgcccgcgctttgcagacggtgggtgaaactgtacccgcgcgtgccgctgctcaatgcctacggcccgacggagacctcggacgacacgaacctctacacggtgtcccagccaccaccggacgacgagaagcgcgtgccggtcggctacgcgctgccgaacctgacgatgtacatcctggatccgcggctgcgtcccgtgcctgttgggctcgctggggagctgtacattggcggcatcggggtgggccgcggctacctgaacaaccccgcgcgcacggccgcatcgttcctaccggatccgttctccgccctcagcggagcgcgcttctacaagacgggcgacatctgccgctatcgccccgacggaagcatcgagttcctcgaccgggcggacttccaggtgaagatccgtggcttccgggtggagccaggtgaggtggagtcggtgctcgcccggcacccaacggtcaggcaagccgtggtggtggctcgcgagttgccaacccgcggcaaacaactggtcgcctatgtggtaccgtacgaggggacctggcccggtgctgccgggggcggcccccgcgacggccacgagggcatcacagtcctccgtgagttcctccagggacatctgccgcactacatgatgccctcggtcttcgtcgtgttgcccgcgttgccgctgaacgccaacgggaaggtggaccgcaaggcgttgcccatgccggacgccgccgctgcccaggaagagcgtgcgccctcgcccccccgctccgatgtggaggagcggctcgtggcgctctggcaagaggtgctgtcgcgccagtccattggcgtcgaggatgacttcttcgagctcggcggtcactcgctgctcgctgtccgcgcgcactcccggctgcgggaactcttcggcatcgacctgccgctgcggaccctgttcgagctgaccaccgtggcccggctggccgagaagatcgaggccctccgctgggcgacctcgggccctcccaaggacgagccggaggacgtcgagcgcgaagaggtggagttgtga

SEQ ID NO: 8808 - DNA, 558 bp, Myxococcus xanthus
  unsure (1)..(558): unsure at all n locations
atggctcgggaagagtcctcgcggccattcgacctgacccaggggccgctcgtgcggaccaccctgctgcggctcgctccggacgatcacgtgctgctgctcaccctccaccacattgtctcggacggttggtctgagaccgtgctcgtgcgggaggtggccgcgcattacaccgcggcccccggcaccgggcccgcgctaccggagttgcccatccagtacgcggacttcgcgctctggcaacgaagctggctccagggggaggtgctcaccgcacacgtggattggtggaaggagcagttggccggtgcgccccangtcctggacctgcccactgacaaggcacgggccaatcagcgctcgcagttcggcgagctttaccccatccacctgtcgaaggacgtgggggggccgttcctcgcgctggcgcgccaggaaggggccactccgtacatggcgctgctggccgtatggcaggtgctgctctcgcgttacagccggcaggaaagacctgctggtgggatcgcccatcgcgggccgccgccacggcgaggttga

SEQ ID NO: 8809 - DNA, 5411 bp, Myxococcus xanthus
atgcaggccactggcctcacgctgcgtccggcggacgtggatatcgcgacctcgcgcttcgacctggggctcgccctcatggacgacgccgacggactgcgcggcgccatcgagtacagcaccgacctcttcgagcccgccaccgtggcccgactcgccggtcacctgcgcgtactcgtggagtccgtggccgcgactccggaccagccgctgttcacgctggagatgctcaccccgggcgagcgtcatcagctcctccgggagtggaacgacagcccggcacggtacgacggcgctggcggcaccatcgcggaggtcatcgcgcggcacgcctccctgcgccccttcgccgtcgcgctggagtgcggtgacgagacgctgaccttcgagcagttggacacgcgggccaaccagctcgcgaacctgctccgttcgcgcggggtgagcacggaagtgctcgtggctgtgagcctggaacggggcacggcgtgggtcatcgcgatgctggcggtgctcaaggccggaggcgccttcgttccgctggacgcgtcgtaccccgcgcagcggctggccatcatgctggaggacgcgccaccgcacctgctgctcgcgtcgcgggccaaccacgcgaagctgccgctccccgacggcgggcttcccaccctgctcctggaagagctggacctgtcggagtggcccaccacgtccccggtgtccgacgtgggaccgaatcacctggcctacgtgatgttcacgtccgggagcacggggcgcccgaagggcgtggccatcccgcaccgaggcgtgctccgcctctcgcacagtgagcccttcatccgcttcggcgtccgcgagacagggctcgtcatggcgcccgcctcgttcgacggctcggtgatggagctgtggcttccgctgctcaacggaagcggcgtcgtcctgtatccgccggaggcgcaagccagcgacctggacacgctgtcccgcgtggtggagcgccacggcgtcacgctcatccacttccccgcaggcctgttctcgcaggtcgtggagcaccggagcgacctgctgaagaagctgcgggccatcaacgtggtgggtgacatcctgtccgccccgcacacgcgtcgcacgctgaccaccaccggagtccccgtcaccaacggctacggcccgacggagaactccatcatctccacgagctacacggcttacgaggcctcgcaggtcggggcctccgtgcccattggccgtcctgtctcgaacacgcaggcctacgtgctggattcgcagctccaactggtacccgtgggggtgccgggagagctgtacgtgggcggtgaagggctcgggcgcggatacgtgtcgcggccggacctcacggcggagcgcttcatccccgcccccttcgccacccagcccggtgcgcgcctctaccggacgggagacttggtccggtggcgcccggacggcacgctggagttcattggccgcatcgacaatcaggtgaaggtgcgcgggttccgcatcgagctggcggacgtcgaggccgcgctgcgcacccagcccggcgtactggaagccgctgccgtggtccgcgaggacatccccggtgacaagcgactggtggcctacgccatgggacgcgatgacgcgccgctggatgtcgcggcgctccgcgcgggcatgcgtcaacggctccccgagtacatggtgccgtccgtcttcgtggtcctccccacgttgccgctgagcaccagtggcaaggtggaccggaaggcactccccgcgccggacagcgcgtccacgggccgtgatggccatttcgtggagccatcgagcccgctggcgcagcagctcgccgcgctgtgggcgaaggagctgggcacggagcgcatcggcctccatgaccacctcttcgatgacctgggcggaacgtccctgtcggtcgtgcgcatcgccaagcgcatgcgggagacgttgaaccgggaggtgccggtggtgtggctgttcgagcaccccaccgtggacgcgctggccgccgtcctggagcgcgacgcgaaggtggacgaggtccccgccgcccccgcgcggcccgagcctgcctccgagccgagcgccgaggcgaaacacgccacgggctccggcctggtcgccatcgtgggtatgtcgggtcgcttcccgggtgcccgctccgtccaggacttctggcggaacctgcgcgacggtgtggagtccatctcccgcttcacgcccgagcagttggagcggctgcccggactgcccgagggactggagctgtcacagcacccggccttcgtcccggccggcggcgttctggacggcatcgacgggttcgaccccggcttcttcgacctgtcgctgcgcgaagcgcagtggatggacccgcagcagcggctctttctccagacggcatggtccgcgctggaggacgcgggcatcgacccggagcgcacgcccgaggccatctcgctctacgcgggcgccatcgactccggctacaaggacgcggtccgggccacgctgccactggatggcgcggcgctgttcgagctctacggcaccgccacccatgagagcctggccaccaaggcctcgttcaagctgggcctcaccggtgagagcgtcctcatctacacggcgtgctccacggggctcgtcgccgtccacctcgcctgccagaacctgctggccggccgctcgggtgtggcgctggcgggggccacacgcatcgccgtcccgcagcgcaccggctacgtctaccaggagggcatgattctctctccggacggccactgccggagcttcgacgcgaacgcgcagggcacggtgtccggaaacggcgtcgcgtgcgtggtcctcaagcggctggaggacgcgcaacgggatggcgactccatctacgccgtcatccgggccacggcgaccaacaacgacgggcgctacaagtccggctacaccgcccccagcgtccagggccaggcggcggtcatctcccaggcgctcgcgcgctccggcgtgcgggcccaggacatcggctacgtggagacccacggcaccgcgacgccgctgggcgaccccattgaagtggcagcgctccagcgcgcctacggcctgggcgtcgagcaccggggcaccattgcgctggcctcgctgaagagcaacatgggccacctggacacggtggcgggacttgcgggcctcatgaaggtcgcgctgtccctgcaccacggcgaggtgccgcccagcctgcacttcgagcggcccaatccgcagatcgacttcgacgccagccctttcttcgtcaacaccaccctgcggccgtggccgaggaccgagacgccgcgacgcgcggccgtcagctccttcggcattggcggcaccaacgcccacgcagtgctcgaggagtccccgatggcgcacagcggctccaccacgcgctcgcaccaggtcgtcacgctgtccgctcgctccgccgaagcgctggaagcggcggcgcggcagctcgccgggcatgccgaggcccacgccgcggacctgtccctggcggacgtggccttcacgcatgccgtgggacgcaaggccttcgagttccggcgcaccgtggtggcccgggacgccgcggacctgacggcgcggctgcgcaagccgtacacgccggtgaaggtggccgatgccgacgtgaaccgccgccgggtggccttcatcttcccgggccagggcgcgcagcaggcgggcatgggccgcgagctgtacgaagcggagccggccttccgcgcgcacgcggatgcgtgcctggcgctgctggagcccgcgctccgggagcgggtccgcgaggtgctgttcgccgggccgggaatggacgcggcggcggtggctgatacccgtgccgccctgcccgcgctgttcacggtggagtactcgctggcccggatgtggatggactggggcctgcggccctacgccgtgctggggcacagcttcggtgagtatgccgccgcgtgcctgtcgggcgtgctgtcgctggaagacgcgatgcggctcgccgtggcgcggggcgagctgatgcaccggatgcctccgggcgcgatgctcgcggtggcgatgccggagtcgcaggtgctgccgctgctgacggggcggctgtcgctggcggccatcaatgcgccggaccgctgcgtcgtcgccgggcccatcgccgaggtggatcggctccaggaggagttgcgccgcagtgaggtgggcacggtgcggatgcccgcgccgcatgcgttccattcggcggacgtggagccgctgatgccggcgttggcggaggtggtggcttcactccagcgccaggcgccgacgctccggtacgcctccagcgtcacggggcgctgggcacaggcgaacgagctggctcagccggactactgggcggcgcagatgcgtcagccggtgcgcttcacgaacgcggtgggggcgctgctcgaagagggatgcagcctgctgctggaggtgggcccgggccaggacctgaccccgttggtgcgtgcatgcctggggcgtgacaaggagcgggtcaaggcggtggccacgctgcgccgtggcgggacgactacggagcacgcgagtctgatgaccgcggtgggcgagctgtggaccctgggcgtctcggtggactggagcgtcttctacggccacgagcagcggctgcgcctgcacctaccgacgtacccgttccaggagaagcggtgctgggtggaggcaccggcgcgtccggcgcccgtggccatgccctcgctggcgaatggcgctgggcacggcagcctcgcggcgccccacgccacgtcgccgcggcaggtgcaggtccaggagacgcctgtgcctgccgccacgccagagcgtgaagatgcgccgcgaggcgacatcgaggaacgtctggcctcgctctggcgcgaacggctcggcctgccgttcgtgggccgcgacgacaacttcctggagattggcggcaactcgttgatggccgcccagctcctcaaccaggtgcgctccacgttcggcgtccagctcccgctggccgcgctgttcgaggcccccaccgtggcgggcatcgcgcagcgcatcgagtccctgctgcgtcaggccccggtcgtggagagctcgcgcgagctgcccatcgtcccgctgcctcggaacgagcccctgccgctgtccttcgtgcaggagcgcgtgtggcgcctggagcagcacctgccgggcctgtccgcgtacaacatcccgttcgtcctccggctggaaggcgccgtggacgcggtcctcctggagcgcgccgtccaggagatcatccagcgccacgagtccctgcggacgacctacgacgtggtggacgggccgcccgtgca

SEQ ID NO: 8810 - DNA, 2664 bp, Myxococcus xanthus
atggacgcgaaggggctacggacgttcctggagattccctacgacgagctcgaggagcgcaacctcaaggtcaaggagcagcgcctcaagcacaccgcgtcggagaagctccgtgacgagcgcatcgagtacctgacgaaggaacgcgccatcaaggcggtcaccgtgtgcttcaccgacctcgagggtcggctgcacatgctggactacgacaagaagttcctcatcaagagcgccgacaacctcaccttcgacggctcctccatccggggcttctccgcgcagcaggagagtgacctgcggctgaacatcgactggagcgccttctattggctgccctcggacatcttcggtccgggcaaggtgctggtgttcagcgaggtgcacgagcgtgacggcacgcagtaccactccgacctgcgtggcaggctgaagctgctcaccgagtcgatgtaccagaaagacggcacggtggttcacgcggcgcctgaaatcgagggcttcctcttcaagggccgcgacgccgagcaccacttccacgagaagggccacttcgacttcatctccaccggcggctactaccactcgctgcccggtgacgtgctgcgcacgttcatcgacaaggtggccgaggcccagcgcgccatgggcttccagaacgagaaggaccaccccgaagtggcgcccagccagttcgagatcaacttctcgtacagcgaagccctcatcgcggccgaccagattcagctctacaagctgctcagccgccaggtggccgcgcagttggactgcaccgccagcttcctcccgaagccggtgacgggcgtcaatggcaacggcatgcacatgaacctgtcgctgtccaagggcgggaagaacctcttccacgaccagaacggcccggacggcctcagccccatgggctgggacttcatcgaccgcctcctcaccagcgcgaatgacatctgcctcacgctcaactccagcgtgaacgcgtaccgccgcctggacccgcacttcgaggcccccaaccagatcaaggccagcgccaacaaccgcggtgccatggtgcgcatccccttcggaaacgagcgcagcgcgcgcatcgagtgccgctcggtggcgccggacgccaacccctacctggtgctctacaccctgctgcgcaccggcctggagggcccgcagccgcaggaggacgcggaggccaagcgcagccgcacccgcttcctgccggacaacatcttcgacgccatccgcatcttcaagggcagccagttcgtggcgtccatcctgggtgagggcgtgcagagcaagttcgccgagctcaagacgaccacggccgagcgcagcccgaagcagctgggcacccgtgtgaagtactcggaggtcaagttccaccacgaggtcaccaaccagttcctctggaaccagttctaggaacggacgtccgcaccgccggacttcaggagccgccgccctcccgcgacatggggaggcggcggcttcgtccgttacagcggctcgccgcgaagcgccgctgacggctcggaagcccggggccgcgacagccgcagcagcaccacgccagcgatgagggtgagtgccatggtgacgccttcacgcgggttggcgccgaaggccaccaacgtcagtcccagccccagcgtgggcaccgccagcaaggcgtgaagcggacgcagcccccgctcgcgccgccaggccagcgcggccagcgcagcggacgtgacgccgtactgcatcagcaccgcgatgctggagagggcgaacagctccgacaggtcgcccaggttgacgaacagcaggaccagcgcccaggtgacagccagcgcgcgcaccggcacgcctccggcggacatcccgtccagccccagcagcgtgtgcgcgcccgacgccagcgcggacaggtagcgcggcgtcgtcaccatcatccccaggcagatgcccagcgcggacacgctggtgcccgccttcacccacccttcgagcccgggcccgccccacacgcccgccgccgcggccagcggcgcggcctgtgaggccagctccggcagcgcggccacgcaagcccataccaggcccacgtacagcagcaccgccaccagcagcgagcccaccgtggccagcggcacggtgcgcgacgacgagcgaacctgccccgcaatcaccgggacgatttcgaagccctggtaggcgaacatcaccgtcaaccccgcacgcagccacgacacgtccacgaccgggcccgcggccaccgccgcggcgggaggtggccccgacagcgccaggaaggccaccagcaacgcggccagcggcagcagcttgaagacggtgagcgccgtccaggtccccgccgacacgcggatgccggacgccaccacgcccgccagcgccgtgacgaggacggaggcgagcaccgaccgccccagggcgccctccaggcccagggagggcgccaccgcctgggagaggcccgccaccaccgcggcggtgctcaggaacgcgctgacgtaggccacccaccccaccaggaaggacgcccgctctccaaaggccgcgcgcgcgaagaggacgggcccgccgtccgcgtcaaaacgccggcccagcacggcgaaggccagcgccaccggaatcaacgcgagc

SEQ ID NO: 8811 - DNA, 1488 bp, Myxococcus xanthus
atgtgcgctggctgcgcgacgctgagccgggggttcggcgccacggccaacgaggacacgggcgagtacgaaacgccggaagaagagctggtgtacatcgtccccgccgaggacgcgatgatggtggcgcgccgcatcctggaagagcagcgctacgacgtcatggagaaggaaggcgggctggagatgttctcctcggcccatgagcccggaaagaacatgccgggcctgcgcaccatcgagcgctactacatcaagggcgagcggctggggccgcggcagaccgtcgtgcgcgtcttccggctcagctacaacgagatggagacccaactggagattccgccacaggcggcgggcaagcgggaggcggccatgttcgccgtgctggatgcccatccctttgacgccacgcgggacgccttcacctacgcgaacggtcccaatggcccccgggcggtgcccatggaggacccgttcaagaacgcgccgggcatggagcgcatgcgaatggtgcgcggcgtgcgcgacctggacatcgagcggaccttgctgcaacggctggagatggtgcccgccctggaactggtgggcagcaacgcgcccgtgcccatccgctccgtgacgccagaaggaggacagacggagcaggcgcaacaggcgccggagtgtggcaccccggtggacggcgccggcccgctgatggcgccagggcacgtgctgctgctggcggaccccctgggcacgcgggagttgcccgcggcggcgctgcggatgctctgtgaagccacggcccagggcctgccggtgacgctggcgctgtcgctgcccgcctccgagcagccgctgctggagacctacctggcgagcccgggacagttccaggacctccagacgatgatgagcgagagccccttctggcgccgcacctatcaggacggccgcagcagcagcgccatgctctggctcatcgaacaggcacgccggctgcgcgcctctggcaaggacatctccgtggtggccttcgacgccgagaaggcccagggcaacgagcgcgaggcggagatggcccggcacctgctggcccaccagcagacacgcgcccaggcctggacgctggtgctcgcgggtggcacgcacgtgcggacggcgggcgtgaactgggacagcgactatgcgccgctgggagcgcggctggcccaggtcctcccgtcagtgcgcgcgctcgacgtgggcttcacgcgaggcacgcagttctcctgccgcttcaacgtgtgggacccggtggagtgcaacgtgttcgccatcagtcccacgaaggaggtccggcagaagcccgacatcgcctccggggtgcggctcttcccgcagccgctcgcggaaggctttcacggccgcctctacgtgggggcgctgagcgcgtcacctccggcgctccatcggctggcccccaccaccgccgcccagacaccgcccgccacctcgccgtag

SEQ ID NO: 8812 - DNA, 513 bp, Myxococcus xanthus
atgaagaagtcgctttcgttcgtgtcgaagtccgttgccgcgctcgcgatgctcagcaccctgcccgccttcgcggggaccgcgacctactcgggcgcgctctgcacgtcggtctcgggattccacagcccgaccgtcttccgcagtggccgcctcctcaattccaacgcgaacacgctcgaggtcgtctgcccgattcagcgcaacgtcgccgtgccctccctcaatgaatcactgtccgtcagcgtcaccgcgctggacccgcacctgacggagaatgtctgctgcaccgcgacggtggccgagaaggacggcacttccctggcttcgtcctccgcgtgctccagctggggtgcggacacggccaaccacaactccttctccatcaacctcccgtcggtgttcgcgaacatcaacggctacgtgagcctgcgctgcgttctgccggggcagtacaccagcggctccagcacgtacgcgtccgtcctcgccagcttcgtcgtcacggagtag

SEQ ID NO: 8813 - DNA, 336 bp, Myxococcus xanthus
atggcctacgtcgttgccgacccttgcatcaagtgcaagtacaccgactgtgtcgaggtgtgcccagtcaactgcttttacgagggtgccaacttcctggtcatccacccggatgagtgtatcgactgcggtgcttgcgagccggtgtgccccaccaaggccatcttcccggagacggaactcccggagcagtggaaggaatacaaggcgctgaacgccgacctgtccaccaagtggcccaacatcgcggagaagaagtccgcgctgcccgaggccgaggagttcaagtcgaaggacggcaagcgctccctgctggatccggcgccgggctcgtaa

SEQ ID NO: 8814 - DNA, 612 bp, Myxococcus xanthus
atgtggggggccacgcccgaagccacaccggcgcgcgcggaagccgccgaggcccggcccgggtccccagcggacctgacgtcggaggtgcgggcattgcgcgcggagttggaggcgctgcgccggggacacgggcacctgctgcaacgcgtggagtccgtggggcgccccgcgccgctgcccgggcccgaggaggcggcagcgcccgaaacccgggcggcagcgcccaccgcgcaaaccctggccacgctggaggttgctcgcgaggagcggcgacaggagttggaagccgagctgcaggccgccgcccataccgagccgcgtgacagggaatgggcgggaccgacggaggcgctcgtcacccgtgcgttcagcggtccggacttcgcgggctcacgtctgacgcgcgtggactgccgcacccggatgtgtgtgctggaggtggagcatgacgcagccgaggcacgcgcggaattgctgtcatccctgctgatggtgaacggcctgcagggacaggcggtgatgcggctcgcggacgacggaagccggctggcctcgcgcatctacctctcgcgtgcgggggagtctcttcccatgacgctgcgaccatga

SEQ ID NO: 8815 - DNA, 363 bp, Myxococcus xanthus
atggcccattcacagcccagtgcccgcgacacgcgccctcttgggagcgcgccggaatcctcagactccggcgcctcgtatctcctggtgttggagggagactcgacgtctcggttcgcccttcccgccgaaggcgtggtgctggtgggccgcgacgaacaggccgacctgtgcctgcgcgacgacagcgtgtcacgccgccatgcgcgtctggtgttgacggaggaaggcgcgcgtctggtggacctgggcaggcacaacggcaccaccctcaacggccgccccgtggacaccgcacaggccctgctgtcccgtgacgtggtgtcctttggcgcggtggtcgcggtggggcgcacgcgttga

SEQ ID NO: 8816 - DNA, 318 bp, Myxococcus xanthus
atgccgcagatgaagcgtcacctcatctgggggtgcgccgccatgtgggccgggcccctgctcgcgggatgggttcagttcgagctcttccgtgaccccatcgtgatgttcagccagtcgacgttggtgggaggcatcctgatgacgttcggtgtgtgctcccagctcatggtgcgctggcggatgccgtgggtggggacgatggtgaccgtggcgctcgtgggcctgccgctcgggtggctgagcagcgacctcctcatcgcgcatttcaatcatcacctcaccaccgtggtggtgccgcttccgaaagaggtgggc

SEQ ID NO: 8817 - DNA, 798 bp, Myxococcus xanthus
atgtgggtcctggagacgcccgctcccaccgcggatgcgcgcatggcgtatggcagggaaccccaccagttcggggacctgcgaatgcccgaaggacctgggccgcacccggtggtggtcgtcatccatggcggcttctggcgcgcgaagtacgacctggagcatgccgggcacctgtgcgcggacctgacccggcgcggcttcgcgacgtggagtctggagtaccggcgcgtggggcacgacggcggtggctggcccggcacgctggaggacgtggcgcgcggcactgacttcctgcgcacgctcgcacaggcccatgcgctggacctctcacgcgtcgtggcgctcggccactcggcgggagggcacctggcggcgtggctgggggccaggcaccggctgcggcccggcgatgcgctctacagtgcggcgccgttgcccctgcatggcgtggtgccgctcgcgggcgtcgtggacctgccgcgcgcgttcgcgcaccggctgggggacggcatcgtggagaccttcctgggcggcacgccgtcctcggtgccggagcgctaccgcaccgcctcgcccgcgtcgctccagccgctcggggtggcccaggtgctcgtccacggaacggaggacgacaccgtgcccgtgtcgatgagcgaggacttctgtgcgcgcggccgtgagctgggagacgacgtccgctgcgtcaccttgccgggagcggggcacttcgaggtcatcgacccgcgctcgcgggagtggccccacgtcgtggccgcggtgcagtccttgatgtga

SEQ ID NO: 8818 - DNA, 708 bp, Myxococcus xanthus
atgttcgcctaccagggcttcgaaatcgtcccggtgattgcggggcaggttcgctcgtcgtcgcgcaccgtgccgctggccacggtgggctcgctgctggtggcggtgctgctgtacgtgggcctggtatgggcttgcgtggccgcgctgccggagctggcctcacaggccgcgccgctggccgcggcggcgggcgtgtggggcgggcccgggctcgaagggtgggtgaaggcgggcaccagcgtgtccgcgctgggcatctgcctggggatgatggtgacgacgccgcgctacctgtccgcgctggcgtcgggcgcgcacacgctgctggggctggacgggatgtccgccggaggcgtgccggtgcgcgcgctggctgtcacctgggcgctggtcctgctgttcgtcaacctgggcgacctgtcggagctgttcgccctctccagcatcgcggtgctgatgcagtacggcgtcacgtccgctgcgctggccgcgctggcctggcggcgcgagcgggggctgcgtccgcttcacgccttgctggcggtgcccacgctggggctgggactgacgttggtggccttcggcgccaacccgcgtgaaggcgtcaccatggcactcaccctcatcgctggcgtggtgctgctgcggctgtcgcggccccgggcttccgagccgtcagcggcgcttcgcggcgagccgctgtaa

SEQ ID NO: 8819 - DNA, 6645 bp, Myxococcus xanthus
atgcgtctgacggccgcgctggaggcgaaccccgagggcccgctggccgccgaggtgttggagtcgctggccgagttggagctggagcgaggcgagaagctggaggccgcgcgcctgtacgcgcgccgcgccgcgctgatgcccgaggcccgcgctggcgcgaagctgctgttccgcgcctcgctgctcgccgcggggaccagccgcgaggaggccttcctcgcggacgccctggagcgtgacgcgagctacgcgcccgcgcgccagcgccggggcgagctgcgtctgcccacggatgcccgcgccgctttggaggacttcgaggccgtgctggcgctgccgcccgcggacggcgatgcgcctcgcgagagtgagcgcgtagccctgacgcgcaaggccgccaccgcggcggtgcgcgcgagccgcacggatgccgcccgccgcctgctggccgagtacagcgcccgcgcgccggaagatctggacgcccgggtggagctggcgtcgctgcaccgcaaggcgggtgcgcgcgaggccctggcggacctgctggtggagctgtggccgcgcctgtccggcgagccgcgccgcgccgcccgccgcgagctggccgagctgtcgctgggcctggggcgcgccacctccgcggtggacgcgctgcgcagcctgcgcctggaggagccgcaagacacctgggcggcgcagtcgctgctggacctgctgcctccacccggcaccggcacgccggaagaggagacggagcggctggagttgctgagcacgctcgtggccgccgcctcgggcgaggcgcgcgcggagctgctggcccggcgcgccgtgcttcaccgcgccgcgggccgggtggccgccgcgcgcgatgacttctcggaggccgcgaagggttctcgtcgccccgcctcgttgctgctcgcgctgacggagctggcgcgcgagtcgggcgatgaggccgcggagctggacgtgtggcgccgcgccgtatccgccgacgccaacctcgccgcccgcgctcgcgagcggctgctggccctgtccgccacgctggtcgagaaggacgagcgcgccctcgcgcgcgaggccctgggcgcggccattggactggagctgtccgcggcggagcggtgtgacgccttcttctccctcgccgagctggcgcgccgtgatggccagccggaggacgaggccgccgcgctcgccgaggcggccctccagggacccgcgcctcgccgcgtggaggcactgctggcgcgcgccgcgctgctggaatccagcggccgcatggcggacgcggggcagagcctggaggccgcgctcgcgctggccccgaggcacgcgcaggccaccgccgcgctccagcgcgtgctgcggacccgggaggactgggccgcgctggccgagctgctctccaccgaggcaccccatgtggcgcccgccgaggcggccgcgatgtacgcagagctggccagcctctacctggaccggctgtcgcagccggtgcccgccgaggccgcgctgcggcaggcgctgcgcctgtccccgtctgacgccgccgttcgccgtcgcctcgtctcgctggtggcggagcgtggggagttgcgtgaggccgcggcgctgctggagaccgcggcggagagcgccaccgcgcacgacgcggcgctgctgctgcgtgagggcgcgggttacgcacgcggcgcgcacgacctggacaaggcgctgaagctggcgcgcaaggcccacgcgctggtccccgcgcaggggccggagctggcatcgctggcggagttgctctacctgcgcggcgcggtcatcgaggcgctgccgctgcaagacgcactcgccgccgccgcggatttccgaagcgcgccggaggccgcggagtccacgtggctgcgcctggcggagctggccgagcagaccggagagacgaagcgcgcggtggcggcgtaccggaagctgctcgtggagcggcccctgtgcgaggccgccgtcatgcgtctggccgcgctgctggagaaggatgacccgcgcggcgccttcgacgtgcgcgtcacccacgcgcacgcattggctccgtccgaggacaccgtgcagcggctcgtcgagctgtcggcgcgggcccgcgaggtgctcgcggacgcgggtgtggcggcctcgctgctggcgcgcgccgcgtcgctggcgtcggagccgctgccgctgcgtcgccggttggcggcgctgcaccgggagaccggccgcaccgtggagttgctcgcggagctgcgccaggtggccaccctcagcctcgaggcaggggacccggacgcggcgctcgaggcctatcaggaagaggcccggctcgcggtcgacctgggccgcgcggacgacgcgctgcgggcgctggcggatgcgcgcgacttgttggaggcgcgggggcagcagtccgaggccgcggcgtgcgagcgctaccgggcgaagctgctgcgcgacgtgaagctggaccccgccggcgccgaggtcgcgctggagcgcgcctttgccctggccgtggacctgggcaccgcgaagctgggcgcggcgctggccgagcgtcgcgacgacgcggaggccgaggcgcgttggctggagcgcgcgctgccgctgctggatgacgcgggcgaggccgcggccgtgttgctgcggctggcgcggctgaacctgggcgtgctgtcagacgtggcgaaggccgaggagttgctgcgctcggcgctgcgcaaggaccgggcgctgacggaggccgagggcctgctggagaagctcctggagagcgacggccggctggcggagctggcggcctggtacgaggagtgcgcggaaggcgagcccgacgcggcccgtcgcgcggagctgttcctgcgcgccgccgtgctgtaccgcgaccgggcagggcgcccggagtccgccgccgcggccttcatcgcggcgcgtggcgcgcgcccggacgacctggaactcaccgcgcaggcggcggagctgctacacgaggtgaagcgccacgcggacgccgcggagttcgacgcggtgctgctggaggcggacccgttccgcgagcccgtcttcgctcggcacctcgcctttctggatgaggccgaggaccaccaggcgctcgccgagctgatgctgcgcagggcgcagcgccaggaagccgcaggcgccgcggagagctatctgtccgccgcccgtgccttccgcgcggccggtgcccgcgagcgggcgctgctgtgcgaggaccaggccttcgagctgagccccgcgagcgcggaggccttcgagcgcgtgcgtgagcgcgcggccggtgacgtgcgccggctggcggacctgctgtcccagcgcgccgcggccctgtccacgtcggaggccctgccgctgctgcgcgagcgcgccgctcgactgctggacgcgggcgaggcgctgctggccgcggaggccttcgacgaatacctctccctggcgggggatgacgtggacgccctgtccgcgcgcgccgagctggccgcgaagggtggaggccccgtcgccgcgcgcccctacgaccgccgcttgctggacgtgggcggggacgcgctgccggtgccggtgcgcacgcggacctggctgcggttgggccatgcctcgctcggcgcgggcgcgttccacgacgcggcggatgccttcgagtccgtggtggcgctggagccggaaggcgagcgcggccgcgaggcgctgtcgctcctggccgaggtgcactcgcgcacgggcaacgcgccgggcctctaccgggcgtcgctccaactggcgcgccatgcggaggacgccgccaccgccgaggtgctctaccgccgcgcggcggacctcttcgacgacccgaaggacgccatcgacgcgctgttgccgctggcgcgcctgcgtcccgcggatgcgtccgtcatcgaccgggccgtggcggggctgcacgccctgggacgtcatggcgacctgctggacgtgtacgcctcgggcgcggaggcggcgggtggccgtcgcgccgcggagctgctgttggccgccgcgtcggtggcctccagctcgctggcggatgaagacgcggcctggacgctgacccagcgcgccgcggaggccgcgccggaggacctcaccgcgctccaggcactggtgacgggcctgcgtcagcggggcgactccacgcggctgctggaggcgctggagcagtgggtgccgcgcgtcgaggacgccgacgaggccgcggtgctgcggctggagctggccgagctcgcgcgtgacgcgggccgcgtggatgtggcgcgcgaggcactggaggaagtggccgcgcgtggcgcctcgggcgcgggttacgcggacgcgctggaagccctcgagccgctgctgaaggacgcccccgcccgccgcgccgaggtgcaggtggcgcgcgcggagttggcctccggccgcgagcggcaggtgctgctcatggcggccgcgcggggcttcgagtccgcgggacagcttccggaggccctgaaggcggcgaaggacgccgcctcggtggagccggacgtcgacgccgccctgcgagtggcccacctgtaccgcgcgtcgggcgaggcgcctcgcgcggcgcgggcgctgcttcaggccgcgcggctggcggcgccggaggagcgccccccgctgctgctggaggccgcgggcctctgggagaaggcgggagagcacggtgaggcgctggaggtgttcgagcgcatcgccaccgaggcatcggacatgctcgcgccctcggagctggccgagcgcttcggccggctgggggccttcgctcgcgcgctggaagtgggcttcgcgcccgccatggcctcgggcgacctgaccgacgcgctggccatggccgcgcaggcgggcgacacggcgcgcacgcgagaggcgctgtgggccctggccgcgctggcggacgcggaccccgcgcatgcctcggccctggcggatggcctgcgcgcggaaggcgacgcggaagggttgctggagctcgcgggcctgtccgccgcgcgtgacgccgcgttcgcggtggcgctgcgcgatgaggtgctccgctcggcggcggcctcggtgctgcctcgcctgcgcgcgctggaagagctggcgcccgagccgggcttcgcggcccgtctgacgctgttgctgcccaccctggagaagctcccggaggcgctggcggaggcggtgctgacgcaagtgcatgcgcagccgggcacggtgcgcgtggaagcgctggccatggcggcggacggctggccctcgcgacgcaagtcgctcttgcgcgagcgttacgcactggagctggagctgggccgctacgaggcctgcgtgcgcacgctgtctcaggtggccggcgaagagtcggacgcggtggcgcgcgccgtcctgcacctggagcgcggagagctgctgctcagcccgctggagcaactgcccgaggcgcgcgaggccttcgaacaggccctgaaggacgaccccgcgcagctccattccctgcggcacctgttgtcgctggtggacctgggcgaggagcccgctgtcttcgtgtcgctggtggagcggctggagcaggccgcgggcgtggagtccggcaacacctaccgcgagcggctggcggacgcctacgaggccctgggcatggtggcggacgcggccgcgcagctcgagcggctgccggagacggacgaacggctggcccgccgcgcgaggttggcggaggagcgcggcctcaccggcgaggccctgcgcctgcgcgagcggctcaccgacgaacccgcggtgctggaggccattctccgcggctacctggacgcgcagttggtgtcgcccggagcccggctcgccgcgcgcctcttcgaggccggcgagctgtcccctgaagtcacccgcatggccgccgagcacctctccacggtgcccgagggtgtgtccctggccgtccgcatctggccgcacctgctccgggagcacccgttggacgtggatgggtggacgctctacgcggaggccctgcgggcgctgggccggacggaagactcgcagcgcgcggacggcgtgggcgcggccctgtcctccagcgacgcggcggcgcctcaggcccccgtgtccacgctgccggtgccttcgggcttcgagcaccgggtacccgccggcgcggtgccggtgacggccgagcgcctgccccggctcgccgcggcgcttcgtcccgtcctggcctcgctgggcgcgggctcgctgcaactcgtggtggacccggtgggcggggtggaggcgtacctggccagcggcgacgtgctggtactgggcgcgggcgcgctgtcctgcttcggcgcctccgagctgagttacctgtgcgcgctggcgctggcgctgggtgaagacggcgtcaagctggcccggcccggtccggtgccggccatggaagcggcggcggtggcggccttccgcgccgtgccggcctcgctggcggcggggcgcgtcctggcgcggctggacgcggaggtgcgcggaggggacccggcgcaggtggatgtaggcgccgtgcttgcccgcggcgacaccttccgggcgctggccctttgcgtgctggacggcgtctag

SEQ ID NO: 8820 - DNA, 606 bp, Myxococcus xanthus
atgcacgtgaagcgccttgccctcgccgccctgcccgtcacggccgtcgccgtggcgatggcctgctattccgaaccggtgtacccgggtgaccaggtgctcggttcgttccgcttcgaggcccggctggatgccgcgcgcaccacgtgcgacgcctcggtgccggacttcgcgcaactcaacgacgccggtgtgttcctcttcgagggcaccttctcgcgcgacacggacgcgggcacgggcttcttcaccgtgcagggctactcgcgtgacgcgggctatgaagggcaggtggccacgtccacgctgaaggccgtcgcgccccgtgcgtcttgtggcacgggctgtgaggactcctccatcgaggagacgctgcgggtgacgctcttcagcgacagccaggcgcgcaccctcagccgcgactgccgccagttcgacggcggcatccccgacggctcggtgccgggccccacggagaacggttacgacgtgtcgctggcgtgcggctccctcacggacatcttcttgccggggacccgcaactgcaattgccagccgaccacctgcaccacggtgtacaccgtgcagggagagcggagggattga

SEQ ID NO: 8821 - DNA, 693 bp, Myxococcus xanthus
atggtgaagcgcgcggtggtgttgatttcgggcggtctggattcgacgacgtgtctggccatggccaaggcgaaggggttcgagcccgtctgtctggcggtggcctacggacagcggcacgccgtggagctggagcaggcgaggaaggtcgccgccgccatgggcgtgacggacttccgggtggtgtccatcgacctgcggcaggtgggcggctccgcgctgacggcggacatcgaggtgcccaaggaccggccttcggatgagatgagccacggcatccccgtgacgtacgtgccggcgcgcaacgcgctgttcctctcgctggcgctggggctggcggaggtggtgggcagcacggacatctacatcggcgtcaacgcggtggactacagcggctatccggactgccgtccggagttcatccgctcctttgaatcaatggccaacctggccaccaaggcgggcgtggagggtgcgcacttcaccgtgcacgcgccgctgtccggcctgacgaaggcggacatcatccgtgaaggcgtgaagctgggcgtggactacggcttgacgcactcctgctacgacccggacgcccagggccgcgcctgcgggcgctgtgacagctgcgtgctgcgcaagaagggcttcgaggaagccggcgtgccggaccccacgcgctacacggagtccgcgtga

SEQ ID NO: 8822 - DNA, 495 bp, Myxococcus xanthus
cgctacgcgacggcggacaacttcttgaagcggaaggtgtacccggacacggcgcgctgcctgctgctgcccgagtcggccgagcgcctgaagaaggccgcggacgtgctgcgcgcccggggctaccggctgaaggtgtacgactgctaccggccgcgcgcggtgcagtaccagatgtgggaaatcatgccggtgcccggctatgtcgccaacccgcgcaccggctccaaccacaaccggggtggggcggtggacctcacgctgacgacgctggagggccaggcggtggagatgcccacccccttcgacaccttcacacgcgccgcgcaccatgggtacgagggcggcaccgaggcgtcgcgcaagcaccgcgaaatcctgcgcgaggccatggaaggcgtgggcttcaagcgcaaccgcatggagtggtggcactacgacctgccggacgcgaagaagcgccccgtgctggacgtgcccttctccccgccatga

SEQ ID NO: 8823 - DNA, 95 bp, Myxococcus xanthus
atgatgccctccagcacgttgcgctccgactatgcccgcgccgccccattcacgcgcctggcctacgtggcctccgcgttcgcggagaagctgcg

SEQ ID NO: 8824 - DNA, 1080 bp, Myxococcus xanthus
cttcgtgcggccctcatcggtgccactggactcgccggacagcaattcatcgccgccctgaagaatcacccctccatcgaactgacggggctcgcggcctcgcctcgctcggcgggcaagacgtatgcggaggcgctgaaaacggcgagtggcatgacggcctggttcgtcccggagccgctgcccgccgagctcgccggcatgaaggtggtggccggtgacgcgctcgaggccaaggattacgacctggtcttctccgccgtggaggcggacgtggcacgcgagctggagcctcggctggcgaaggacatccccgtcttttccgccgccagcgcgttccgatacgaagacgacgtcccgttgctgattccccccgtcaacgccgcgcacgcgcccctcatccgggagcagcagcgccggcgtggctggaagggcttcatcgtccccatccccaactgcacgaccaccggcctggcggtgacgctggcgccgctggtggagcgcttcggggtgaaggcggtgctgatgaccagcctccaggccatgtccggcgccggccgctcgccgggcgtcatcggcatggacatcctcgacaacgtcatcccctatattcccaaggaggagcacaaggtcgaggtggagacgaagaagattctcggcgcgctgcgtccagcgggtgacggcctcacgccgcatgacgttcgggtgtcctgcacctgcacccgcgtggcggtgatggagggccacaccgagtccgtcttcgtctcattggacaagaaggcgactgtggccgaagtgacccagaccctgcgggagtggaagggtgccgagctggctcggaacctgccgtccgccgcaccgcgttggattgaagtgctggacgatcctttccgaccccagccccgtttggaccgggacacgcatggcggtatggccaccaccgtcggacgcatccgcgaggatggcgtcctggagaacggcttcaagtacgtgctggtgtcgcacaacaccaagatgggagccgcgcgaggcgccatcctcgtggccgagctgctgttggcccagggcttggtgggctga

SEQ ID NO: 8825 - DNA, 2109 bp, Myxococcus xanthus
atgcggtacgcgctcgtccccatcctgttgctctgtgtcgccctcacgacggtgggggtgggggtgttcaccctgttggagcgcaaccgggaggcgcagtggcaccagttcgcggtggagcgccaggcccagttggatgaggccacacgcggggtggcggagacgctggaggacgtggcggaggacctgcgcttcgccggggagctgatgtcccagcccggcacgttggcggagcaccggcgggagatgcgggccctgttggaggcggtgggccagtacaaggtcctcatcgcctacgacgccaacggcaaggaatggctgcgcatgttggaccggcgcatgggcaagcaagtagcgcgagcgcccgtgttggcgcagatggcggaggcggcccggcgggccctgctgcggccgccgggggacgtcacgctgtcacctcccatggaggatggcggcttggactcgctgcgggtcatggccacggcgctgcccgtggatgagcaaggccggcccgagggcgcggtggcggtgctcgtcgacacgacatccttcttcacgccgctgcgcatcgtgacgtcggacccggacgcgcggctgttgctcctgggcacctatggtcatccgacctccgccagcgacgccaccctggcggactggttccggcgcctggagacggagggcgcatgggtgccgggcttcacgacgctggcggctcgcatgcgcgagggggagcgcggcgcgttgccgctgcgcgcggaggaggccgagcgattgggcctgggccgctcggaggccatcgccgtgttcacgcccatccgcgtccgaggtggcagccattgggccgcggccacgttggtgtctaccgagacgctgcgatcgcatcagcaggccctcatctggcggctcctggccgcggcgctgctcgtggcgctcttcctggtgacgttcgccgtgtacgtggtgctggcgcagcgccgcgcggccgccttgcgagagagccgtcagcacgcggaccaactggcgcacctgcacgacaagacgcagaagattctcgaccacattccttccggggtgctggcgctcaccgtggacgggcgcatcagcgcggtgaaccaggtgctccgcgagcgcatgcctccggacgccattggcgcgccgttggagacggcgttcccccaggcaccggcacccgtggtgtcccggattcgcgccctggtggaggccgccgcgagcgagtcgcgcgcccatggcatcctgggtgagacgctggtgctcttcggcgaggagggccgtttcaatctccacgcggtgccgctggaggcgcgccacccggaggtccagaccttgttggtggtggaggacctgagcaacgtgcgcgcgctggagacgcagttgctgcgcgcggagaagctggccacggtgggggtgctcgccgctggtatcgcgcatgagattggcacgccgctgggcgtggtgcgtgggcgcgcggagtacgtgctgggcaagctgggcagggaacacccgcaggggcctggcattgccgtcatcatcgagcagatcgaccgggtgagccgcacgctgcggcagctcctggacttctcgcgcctccagcccacggcggtgcggccggtgccgctcatctccctgctccaggacgtccaggagttgctgcgcatggaagtggagcggcgcggggttcgcttcgaggtgaccgttccggagacgctgcctccactggccgcggacccggaccagctccagcaggtgctggtgaatctggcgctcaacgcctgccacgcgtgtggcgagggcgggcaggtgacgctggccgcggcggtgccagaggcggagccgtgggggctggtggcgctcaccctccgcgacgacggctgcggcattccccgggagcacctcaatcaggtattcgaccccttcttcaccaccaagaagcggggacagggcacgggactgggcctgacgatggtggctcacgtcgtgcgcaaccatggtggccggctggagctggagagcgaggaggggcggggcacctgcgtcacggtgctttggcccatcgcgaagcccagcgcggaggagcggcatgtcggttga

SEQ ID NO: 8826 - DNA, 1341 bp, Myxococcus xanthus
atcctggtcgtcgatgaccacgtggacatgggcctcatgctgcgggagcccctcacggacgcggggtatgtcgtggacctggctacgggcggcgaagcggccatccggatggcgcgcgcacaggcctacgacgcggtgctgtgtgacttgcgcatggaaggggtggacggcctggacgtgctggaggccgtgcgggcgctcgactcggacatccccgtgttgatgatgacggccttcggcggcgtggagagcgcggtggaggcgatgaagcgcggcgcgtaccactacttcaccaagcccttccgcttggatgaggtgctgctcttcctcgagcgcgccttgaaggagcgcaggctccaggtggagaaccgggccctgcggcgcgccgccgccgagcgcagcgggctgggggcgctggtgggccgaagcgcggcgatgcggaacctctacgagctcatcgaccgcgtggcctacgcccaggcggcggtgctgctgcgaggcccgagcggcacgggcaaggagttggtggcgcgcgcgctgcacttccaggggcctcgcgcctccgggcccttcgtggcggtcaactgcacggcgctgccacatgacttgctggagagtgagctgttcggtcacctcaagggggccttcaccggcgcgacccacgcccgccgcggcctcttcgtggaggcggatgggggcacgctgttcctggacgagattggcgacatgccgctggagctccaggcccgcctgctgcgcgtcctggaggacggcgaggtgcgcgcggtgggcgccgacggcagccgcaccgtggacgtgcgcatcgtcgccgccacgcaccaggacctggacgcccgcgtgcgcgagggccgcttccgcgcggacctgttctaccggctcaatgtcgtgacactgctgttgcctccgctggcggagcggcgcgaggacatccccttgttggtggagcacttcacggctcgcgcccgcgcgcgcaaccctcgctcccgcatgcagtccctgtctccggaggcggtggccgcgctcgcgaccttgccttggccgggaaacgtgcgtgagctggagaacctgatagagcggctggcggtgatggtggcgagcgaagtcgtggggctggaggagttgcgcccacacctgccacccgaggcgccggaggtgcagcccttggtgatggcgcagcacgcgctgtggcccctgcggcggctggaggcggagtacatcgcgtggatggtgacacgctgcggcgggaacaagacgcgcgccgcggaggtgctcggcatcgatgtgtccaccatccaccggcgcgaacgggagcgcgggtag

SEQ ID NO: 8827 - DNA, 348 bp, Myxococcus xanthus
atggacgtgctggccgagctgggcatcgcgctggagtcgggcgcgccggccggtgggtgtccagacctcgtgctcgtccacgtcgagcgcggtgagagtctccagcgccggcttcagcgcgcccgggagctttcgccccaggggcccatcatcgtgctgctgcccttcgccgatgagcggctgatgggactcgccctgcggctgggcgcccgcgactgtttcgcgctgggcgggccgctcggtgagctgcgccgggtgttgctggcccacgttccaggtcatccgagttccgtattcatctctcccggcggggccgtgccgccgtcgaccgagtcgccccatgattga

SEQ ID NO: 8828 - DNA, 498 bp, Myxococcus xanthus
atgattgagcctctcgccgtgtccgcggtgcccgccactcccgcgtttccggaccgcccgctggttgcgccgcccgctccttccgaagtgccgctctttcaggacgccggcctgcgtgtgacgaccgagcggatcgtcgcccggggcaagacgctgctgctcgcggacgtccagcgggtggagacggtgcggcgcacgcctcgcatggttcctgtgttggccacgctgggcctgtgcatgagcgtggggctgccggctctgtccgcgctgtccgtctccagcagcacggcgaaggggggctatgaggcggcgctgatcgccgtcgtcatggtcatcttcggctgcatcgcgcggctcgtcctcgccgaggagtcgtaccggctggtgctgcatacccgcgctggctcctggcgcgtgcgcgcgagcaaggatccgaagtccctcatgctgctcgccgggctcatccaggacgccgtcgcggcgcgggggcagcactga

SEQ ID NO: 8829 - DNA, 792 bp, Myxococcus xanthus
atgaaagccgtcgtactgcgcagctttggtgaagcgggcaacctgaagatggagaccatgcccatgccccgtcccgggcgtggcgaggtcctcctgcgcgtgcatgcctgtggcgtctgctaccacgacgtcatcaaccgccgaggcaacctgccccgcaccagcgtgcccgcgattcttggccacgaggccgcgggtgaagtcattgaagtcggcccggacacgccaggctggaagacgggagaccgcgccgcgacgctccagcgcatgtcgtgcggcgactgcgccctgtgccgcagcggccgcaacagcctctgcaagacggacaaccgcttcttcggcgaggagctgcccggtggctacgcccagttcatggtggcccccgtcggcggactgggccgggtgcccgcgtcgctgccctggaacgaggcggccacggtgtgctgcaccaccggcacggccgtccacacggtgcgcacgcgcggcaaggtgcgcgcgggcgagacggtgctcatcaccggcgccagtggcggcgtgggcctgtcctccgtgcagctcgcgcggttggacggcgcgcgcgtcatcgcggtgacgtccagcgaggcgaaggtgcaggcgctgaaggaggcgggcgcggacgaggtcatcgtgtcgcgcgggctggacttcgcgtcggacgtccgcaagcgcacccagggcgcgggtgtggacgtggccgtcgaaatcgtcggcagcgccacgttcgaccagacgctgaagtcccatggcgcccggatcccgcgtggtggtggt

SEQ ID NO: 8830 - DNA, 741 bp, Myxococcus xanthus
atgagcgcgacgctggacatcaccccagcggagaccgtggtctccctgctggcgcggcagattgatgacggcggcgtggtggccacgggcgtggcgtcaccgctggccatcctggccatcgccgtggcgcgcgcgacgcacgcgccggacctgacgtacctggcctgcgtgggctcgttggatccggagattcccacgctgctgccctcctccgaggacctgggctacctggatggccggtccgcggaaatcaccattccggacctgttcgaccacgcgcggcgcggccgggtggacaccgtcttcttcggcgcggccgaggtggatgccgagggccgcaccaacatgacggccagcggcagcctggacaagccgcggacgaagttccccggcgtggcgggcgcagcgacgctgcggcagtgggtgcgccggccggtgctgttggtgccgcgccagtcgcgccgcaacctggtgccggaggtgcaggtcgccaccacgagagatccgcgccggccggtgacgctcatctccgacctgggcgtgttcgaactgggcgcgtccggcgcgcggctgctcgcgcgacacccctgggcctcggaagagcacatcgcggagcgcacgggcttcgccttccaggtctccgaagcgctgtccgtcacctcgcttccggatgcccggacggtggcggccattcgcgccatcgatccgcacggctaccgcgacgcgctcgtcggcgcctga

SEQ ID NO: 8831 - DNA, 798 bp, Myxococcus xanthus
atgaagacggcgcgctggtgctcgctggaggaggcggtggcttccattccggatggcgcgtcgctggccaccggcggtttcatgctgggtcgcgcccccatggcgctggtgatggagctcatcgcgcagggcaagcgcgacctgggcctcatctccctccccaacccgctgcccgcggagttcctcgtggcgggcggctgtctggccaggctggagattgccttcggcgcgctgagcctccagggccgcgtgcgtcccatgccctgcctcaagcgggccatggagcaaggcaccctcgcctggcgcgaacatgatggctaccgcgtcgtccagcggctgcgcgccgcgtccatggggctgcccttcatccccgcgccggacgcggacgtgtccgggctggcacggacggagccgcctcccacggtggaggaccccttcaccggcctgcgcgtggcggtggagcctgccttctatccggacgtggcgttgctccacgcgcgcgccgcggacgagcgcggcaacctctacatggaagacccgaccacggacctgctggtggcgggcgcggcgaagcgggtgattgccacggtggaggagcgggtggcgaagctgcctcgcgccaccctgcccggcttccaggtggaccgcatcgtcctggctcccggcggcgccctgcccaccggctgcgccggactctacccgcacgacgacgaaatgctggcccgctacctgtcgctggcggagacgggccgtgaagcggagttcctggaaacgttgctgacgcggagggcggcatga

SEQ ID NO: 8832 - DNA, 582 bp, Myxococcus xanthus
atgcaggagatcgccgccgcgtgccggatgacgaaggcgggcctctaccaccacatccagaacaaggagcagttgctcttcgccatcatgaactacgggatggacctgttcgaggagcaggtcctctcgcgggtgcaggacatcgcgaatccggtggagcggcttcgcgcgtgcatgcgccacaacatcctgctggtgacgcgggggtggagcaaggaggtcatcatcatcctccacgagcacgccacgctcaccggcgagacgcgcgccttcatcgacgcccggaagaagaagtacgtggacttcctggaggaggccttttcgcaggcctcgcagcagggcctcatccgccccgtggacccgacggtgggcgccttctcgttcctgggaatggtgctgtggatctacaagtggttcaagccggacgggcgcctcacggatgagcagatcgccgacggcatggtgggcatgttgttcccgcccttcgccgccgctggggacaccgctggacaggcagggccctccccgttgcgcatggtgccgagcgtgtcggccaccggcacggattcggaggacgcatga

SEQ ID NO: 8833 - DNA, 663 bp, Myxococcus xanthus
gctctaaaggacccggcgagcacactgcggcagctcgacctggcctccgaatcgtcccgaggcctccgcctgacgctggtcctggagcgggcccaaccgcaccggctgcgctgggtggcccggcccttcgccatccctggcggcatggcgcagatgctgacgctcaccgacatcggacacacccggccagcccgtgaggagcgggagcagcagcaccgggtggacgcgctgacgggactggtgtcgcggcgcgcgggcgaggaacaagtgctgcgcgagattggccgctgccgcagggatggcatgcccttcagcgtgctgctcgcggacctggtgggactggggcgcatcaacacgacccgaggtttcgacgcgggggacgccacactgcgagacggagcccgcatcaccgaagccctgggagtccctggaggcttcacggtgcgatgggaaggcggggcgttcctcctggcccttcctggtgtggacgcagcgcgggccgaaccattgcggcagaagctgcgcgacacccctggcgctcccgatgtggtgtccgccaccgtcaccgtcgagggtgaggaagaccctcagggaacgctggcccgagcccaggcagcgctcatccgggccaagacggagcaccggccactgcggctggcatga

SEQ ID NO: 8834 - DNA, 810 bp, Myxococcus xanthus
ctgcgggagaatctcaacgtccgctccgtcatcttccgtcacgcgctgcggctgggcgtcgcggccgcgctggccaccgcgctcgtgggggcgctgggattgaatcacggctactgggtcatcatcaccgtcaccgtcgtcctgcagccctacgcaggcctcacgttccagcggagcctgcagcgcatcgcgggcacgctgctgggcgcggcgctggccgcgggtctggtggcgttggtgagggacccggccatcatcctgctggccatcggggggctgttcgcggtggcgatgagcatccagccgctcagcctgtccgcgttccaggtgctgctgactccggccctggtgctgctggcggaactccagagcggggactgggagctggccggggtgcgcatcgtcaacacgctgctgggagggctgattgcgctgacggtgacgcggctcttgtggcccagcccggagcacctgcgtctgccggagcaggtggccttcgcgttgcgcgcggaccgcgaatacctgatggcggtggccgccgcgcactcggactcggagcccgcggtgcgcgaggcccggcggaagataggcctggcgctgctggcggcggaggcgtccttccagcggctgctgagtgagtggaccgggcccgccaaggacctggagccggtgatggcgctgctggtctacgcgcggcgcttcacgtcggcggtgacgacgctggccgccagtcgcgcggacccggcgtccccccgggaactctccgaggtggtgcgcttcgccgggggcgtgttggacgaactggcggcg

SEQ ID NO: 8835 - DNA, 1152 bp, Myxococcus xanthus
atgcttcacggccaagggctgtacctggaagagcatgacgcgtttcgtcgcaccgtacgtgcggtggtggagaaggagattctccccttcgtgaaggagtgggaggcccgggaggcgttcccccgggagctcttcacccgctttggcgagctgggcttcctcggcctgaagtatccggtggagtacgggggctcggcggcgggggagctgtatgaggcggtgttgctggaggagctggggcgctgtggctcgggcggtgtgtccgcggggctgggggcccagttcaccatctccacggggcccatccatcagttcggcacggacgcgcagaagctccgctggctggcccccgccatccggggcgagaagattggcgcgctgggcatcaccgaaccggacgcgggctcggacgtggcggggctgcgcaccaccgctcggcgcgagggcgacagctacgtcctcaacggctccaagacgtacatcaccaacggtgtgcgcgcggacttcgtggtgctggcggtgaagacggatccgtccgcgggtcacaagggcctgtccatggtggtggtggagaagggcacgccaggcttctccgtgggacgcaagctggacaagctcggctggcgcgcctcagacaccgcggagctgttcttcgaggactgccgcgtgcccgcggagaacctgctcggcgtggaagggcagggcttcgcgcagatcatgggcaacttccagtgggagcgcctgtcgctcgcgctgggggcggtgggggccatggagcacatgctggagacggtgctggcgcaggtgaagtcacggcgtgccttcggccagtcgctccaccagttccaggtggtgcgccacaagctggcggagctcttcaccgcgcgcgagtcggcgcgccagctcacctaccacgcgctgcgcctgcacgtggccggtgagtgggcggtggcgcagacgtccatggcgaagaaggtggccaccgagacgtgctgccgcgtggcggatgagtgtctccaactccatggcggcgcgggctacatgatggagtacgacatccagcgccactggcgtgacgcacggctggggcccatcggcggtggcaccagcgaggtgatgaacgaaatcatcgccaagcagctcggactgtag

SEQ ID NO: 8836 - DNA, 723 bp, Myxococcus xanthus
atgtacgtggggccgctcgctccaacggacccgcacgcccaccccacctttcaggtcctgctgtccctggacgcgccggtgcgcctgcgcgacgcccgtcagcaggaggtcgcatgtcaggcggccgtcgttcctccggacgccgagcacgccatcgttgaaggcgccctggcagcggtgctgctccacgtccccgcggaggacctggtgggccgcaggctggcgacgctgggcattggcgcggacgcggccgcgtggggcgcggcgggcgaacgtttgagggcctgtggcattggccggttgccggtgcgctgggcggaggccgaggcgcagacgcaggtcctgctgcgtgagctccaagccgacgcgggcgtcgcgaagcccacccaccccgcggtgaagaagctgctgcggctgctgccagaggcgctggaggaagacgtgcgtctggccacgctcgctccgcgcgtgggcttgtcggtgggccggctgtcgcatctgttcagcgcgcaggtgggcttccccttgcggccctacatcctctggctgcgcctgcaccgggccgccgagcatctgcaacaaggcgcgtcgctcaccgaggccgcgcacgccgcgggcttcaccgacagcgcgcacctgaaccacgccttccgccgcaccttcggcctcaagccttcggagattgccggggtggtggagtgggtgcgcccgccctcgcgatag

SEQ ID NO: 8837 - DNA, 354 bp, Myxococcus xanthus
atgtcgatgaagccgaagctgcgcgccgctttcgaagcggagttgcgcgaggcccatgaagcggagtcgcgttcggagcatgtgcgtacctggcggcacctcgagcgggtccacgtcctcagtcaggcccacgcgggccctcacgtgcgggtgcactggcgcatgctggggttcgggtggcgccggcggaacgccgcggagtgggtggggcaggtggtgcggttgctggtcgccgcgccaggctcatggctcgggcgggcaccgctgggaaacaccggtggcgcgaacgtgggcatcctcacgcccatgcccattcccgacgacctgcgcgccctgctggacgccgaccgctga

SEQ ID NO: 8838 - DNA, 1362 bp, Myxococcus xanthus
ggggagccgggcgcggggaagacgctcttcgccaaccagctctgctaccaccaggggcgcgccggcgcgcggtgcctgtatgtcacgctgctggcggagtcccacgctcgcatgctggccaacatgcgggacatggccttcttcgactcggcgctgctgcccgagggcgtctactacgtcagcggcttccgcacgctggaggagcacgggctgccggggttgctggagctcttgcggcgcgaggtgcgcaaccacaacgccagcatcctggtgctggatggcctggtgcaggcgcaggaggcggccggcagcagccgcgacttcaagaagttcatccacgagctccaggtcgccgccgggctgacgcgcttcacggcgctgctgctcaccagcgctaacggtcccgccgtccatccggaatacaccatggtggatggcatcctggagctgcgcgagcgcacccagggcgtgcgctcctggcgcgagctgcaagtgcgcaagttccgggggagccccacgctgcacggcgtccacgccttccgcatcaccagcgacgggttggaggtcttcccccggttggagtcgcgggtgcagcgcacgccgccgccggacccgggcgcccaccgcctccacttcggcgttccgtccctggacgcgctcttcccggaggggctggcggcggggtccacctccctgctgctcggtccacctggcgcgggcaagacgctgctgggatgcagcttgctggcagagggtctgaagcagggcgagcactgtctgtacatgggcttctacgagccgcccaaccggctgttgggcaaggttgcatccgcgggtatcgacctgggcggcgctatggcggatggacggctcaacttcatctggcagccgccttccgagtgcattctcgacgtgttggcggaccagctcctgtcggacgttcggcggcgcaacgtgaagcgggtgttcgtggacgggctcagcgccatgcaacaggcctcgcccgagcccgcgcgcatcaattcgttcttcgcggccctcacccaggagctgcgttgcacggggaccaccaccctcttcggcatggagacaccgcggctcttcggtccggtgctggacgtcccgatggaggtgggtccttccgctgtggcggagaacctctttttcctgagacatgtcgagctcgaaggccgcctgcgcaggctgctgagcatcttcaagatgcgtgacacccactatgaccccaccctgagggagttcgtcatcacaccccagggaatcgaggtgctgccccccttcagtgtcgctgtggataccctgctcacgggacttgcccggcacccgggcactggccatttctga

SEQ ID NO: 8839 - DNA, 366 bp, Myxococcus xanthus
atggagacggtcctggtggtggatgacgagcagggcatcctggaagccctggcggacctccttcgggaggagggctatcgcgtcctgacggcctctcacggccgtgaggcgctggagcggatggcggagctccggccggacctggtcctcactgactggatgatgcccgttctggacggaccggcactcatcgagcgcatccgggccgagccggcctacaaggatgtctcactcatggggatgagcgcggtggacgtgtccgcgctgcggcatcggtatcctggcatgccgttcctccagaagcccttcgacatccacgcgctgatgcgacaggtccgcaaggccctggacggaaagcaaggctga

SEQ ID NO: 8840 - DNA, 825 bp, Myxococcus xanthus
atgttctacctgctcaagctgggccccgtgccactcagtcagggcaacacgcaggtccaggtgtatctgcgtatctccgattccggagagcccgccgcgcctgtgttcgaatcggacgacggggcggggctgcgggccctgctggaaggggtggacgcggcggaggtgcgctgcgcgccggcgctggccgccgcgggcgcggagctggggctcgccgtggcggagccttcaccgcaagcgctgtcttcctgcgcggccatcgcgaccttcgtggcgtgggggcagcgaggcttgtccgggcttggctcggacaaggcgctgctcttcgtgcaggcgtcgacggagtactgggatgcgcggccctggacgcattgggatgacagccagcccttcgaggtggccgtcaccgggccgatgaaccacaccttcgaggggtgcgtcttccacatgggggacgggcgcgcgggactggcgctgtacttcaagccgggcgcgctgcagatgttgatggagatgcaggcgcgtggccagggtgacgccgccaccagcctgcccgcgattgccgtcacgctggacacgtccccttcgtatgccgtggacgcgctcaccgccgcggggcgcgccccgcgcctgccgctgcccctgaagacggggccggacggcatcagcgtgccgtctccgctggagtccctggtgctggtggcgtcgttgcgcgcggtggcccggctgtcaccggagcagcgcgaggtgctcagcagcgtcgtggccggagacgagcagatgcaggtgcgcgtccgcgcgcccgcgccccgcgtccggcactga

SEQ ID NO: 8841 - DNA, 3588 bp, Myxococcus xanthus
tcgctcgactcgcgccagttgctgcgggtcctcaccgccgtccgcaagggcgacttctccgtgcgcatgccggtggacaaggtgggcagcgccgggaaggtggcggacacgttgaacgaaatcatcgaactcagcgagcgcatggcccgtgagttcgagcgcatcggcaacgtggtgggcaaggaaggccgcatcacccagcgcggcaacgtggtgggcgcgctgggctcgtggggcgactgtgtcgagtcggtgaacatgctggtggccgacctggtgcaaccgacgacggagatgggccgcgtcatcggcgccgtggccaaaggtgacctgtcgcagaccatggccctggaagtggatggacgtcccctccgaggcgagttcctccgcaccgcccggttggtgaacgggatggtggagcagctcggcgcattcgcttccgaggtgacgcgcgtggcccgcgaggtgggcaccgacggaaagctgggcggtcaggccaaggtgaagggcgtggccggcacgtggaaggacctcacggacaacgtgaactccatggcctccaacctcaccgcgcaggtgcggagcatcgccgaggtgacgacggccgtcgccaagggcgacctgtcgaagaagatcaccgtcgacgtgcgcggcgaaatcctggagctgaagaacaccatcaacacgatggtggaccagctcaactcgttcgcctcggaagtgacgcgtgtggcgcgtgaagtgggcacggagggcaagctgggcggacaggccgtcgtgcgcggtgtcggtggcacgtggaaggacctcaccgacaacgtgaactccatggcgtcgaacctgacgtcccaggtgcgcaacatcgccgaggtgacgacggccgtcgccaagggtgacctgtcgaagaagattaccgtcgatgccaagggcgaggtgttggagctgaagaacaccatcaacacgatggtggaccagctcaactcgttcgcctcggaagtgacgcgcgtggcgcgcgaggtgggcaccgacggaaagctgggcggtcaggccgatgtgaagggcgtggccggcgtgtggaaggacctcacggacaacgtgaacagcatggcgtccaacctcacgtcgcaggtgcgcaacatcgccgaggtgacgacggcggtggcgaacggcgacctgtcgaagaaaatcaccgtcgacgtgcgcggcgaaatcctggagctgaagaacaccatcaacacgatggtggaccagctcaactcatttgcctcggaagtgacgcgcgtggcgcgtgaagtgggcacggagggcaagctcggaggacaggccgtcgtgcgcggtgtcggcggcacgtggaaggacctcaccgacaacgtgaactccatggcgtcgaacctgacgtctcaggtgcgcaacatcgccgaggtgacgacggccgtcgccaagggcgacctgtcgaagaagattaccgtcgatgccaagggcgaggtgctggagctgaagaacaccatcaacacgatggtggaccagttgtcatccttcgcctcggaagtgacgcgcgtcgcgaaggaagtcggtacggaaggaaagctcggtggtcaggccatcgttcgcggcgtcggtggaacgtggaaggacctcaccgacaacgtgaacagcatggcgtccaacctcacgtcccaggtgcgaaacatcgccgaggtgacgatggcggtggcgcgcggtgacctctccaagaagatcaccgtggacgtgcgcggtgaaatcctggagctgaagaacaccatcaacacgatggtggaccaactgtcgtccttcgcctcggaagtgacgcgcgtggcgcgcgaggtgggtacggaaggaaagctcggtggtcaggccgtcgtgcgcggcgtcggtggaacgtggaaggacctcaccgacaacgtgaacagcatggcgtccaacctcacgtcccaggtgcgcaacatcgcggaagtcaccacggccgtggccaatggtgacctctccaagaaaatcaccgtggacgtgcgaggcgaaatcctggagctgaagaacaccatcaacacgatggtggaccagctcaactcgttcgcgtcggaagtgacgcgtgtggcgcgcgaggtggggacggagggcaagctgggcggccaggccgtggtgaagggcgtggcaggcacgtggaaggacctcacggacaacgtgaactccatggcgtcgaacctgacgtcccaggtgcgcaacatcgccgaggtgacgacggccgtcgccaagggcgacctgtcgaagaaaatcaccgtggatgtgcagggcgaaatcctggagctgaagaacaccatcaacacgatggtggaccagctcaactcgttcgcctcggaagtgacgcgcgtggcgcgcgaggtgggcaccgagggcaagctgggcggtcaggccgaggtgaagggcgtggccggcacgtggaaggacctcacggacaacgtgaactccatggcctccaatctcaccacgcaggtgcgcggcatcgccaaggtcgtgacgtcggtggccaacggcgacctgaagcgcaagctggtggtggacgcgaagggtgaaatcgccgagctggcggacaccatcaacggcatgatcgacaccctggcggtgttcgccgaccaggtgacgacggtggcccgcgaggtgggcatcgaagggaagctgggtggtcaggcccgtgtgcccggtacggcgggcatctggcgcgacctcacggacaacgtgaaccagctcgccgccaacctcaccacgcaggtgcgcgccatcgccgaggtggccaccgccgtgacgaatggtgacctcacgcggttcatcaccgtgtccgcccagggcgaagtggccgccctgaaggacaacatcaacgagatgatccgcaacctgaaggacaccacgcggaagaacacggagcaggattggctcaagacgaacctggccaagttcacccgcgttctccaggggcagcgggatttgctcacggtgtccaaggtcatcctgtcggagctggcgccgctggtggatgcccagcacggcgtcttctacatctccgagcgcgcggacggcggcgaccagatgctcaagctgctggcgtcctacgcgtaccgccagcgcaagggactggcgaacaccttcaagtacggcgagggcctggtgggccagtgcgccctggagaaggagcccatcctcctgtcggacgtgccggacagctacatccgcatcgcgtccggcctgggcgaggaggtgccacgcaacatcgtggtgctgccggtgctcttcgaaggggaagtcaaagccgtcatcgagctggcctccttccacaccttcagtgaggtccatatgggcttcctggagcagctcacggagtccatcggcatcgtgctcaacacgattgccgccaacatgcgcaccgaggcgctgctgaagcagtcgcaggcgctgacggacgagctccgcaagcagcaggaggagctgacggagacgaacaagcgcctggagcagcaggccacttcgcttcagcagtcggaggagctgctcaagcgtcagcaggaggagctgccttag

SEQ ID NO: 8842 - DNA, 1122 bp, Myxococcus xanthus
ctggtcgacaatgtcgacggcatcgtctgggaggcagacccctccgtccgcttcatcttcgtgagcaagcaggcggagcggctgctcggctatccggtggagcagtggctcaccgagcctcacttctggttggagcacctgcatccagacgaccgggcctgggcctccacctattgccacaccgcggtggagcagtgccttccccacgaattcgaataccggatgctggccgcggacggccgcgtcgtctggctgcgtgacatcgtcaccgtgctgtccaaggacggccgcgcccaccggcttcaaggcgtcatggtggacgtcaccgagcagcatcaggcccaggagcggctggagcagacggtgtccctgctggaggccacgctcgactcgacggcggacggactgctggtggtcgaccgggacggacacatcaccgcctgcaaccgccaattcgagcagctctggggactgacgggactggctgcctgcacgcacgacgcgacgctgctcgcggccgtgcgcgagaagttgaaggccccggacgccttcttgtcgcgggtccagtccctgtacgaggagccaagccaggagagcttcgacatcatcgaactgcgcaacggccgcatcctggagcgctactccctgcctcagcggcggcgcgggctcatcaccggccgcgtctggagcttccgcgacgtcaccgagcgcgtgcacgcacagcgcacgcaggagcggctgctggccgaggcgcacgaggccattcgcgtgcgcgacgacttcctctccatcgccgcccacgagctcaagacgcccctgacgccgctgcgcctccacctggagctgctgaagcgggcgctggcggccagggagcccatcgcgcccgagcgcgtggacaaggccatggcgcaggtggaccgcctgtccgcgctggtcaatgatctggtggacgccaccagcgtggaggcgggccggctgaagctgcaacgcaaacccgtgtcgctcctggaggtggcgaacgaagcgtgctcggagttccgtggcctcagcgcggagcatgccttcatgtgcgagctcccccaggaggacctcctcgtcatgggcgaccggggccggcggtca

SEQ ID NO: 8843 - DNA, 1719 bp, Myxococcus xanthus
caggcaagctcaagtcgtgcgggccacgggcaagctccgcaacttgaaaaccgggtggtggcggaccagccaccaggcaacatcggcatcgggcacacccgctgggcgacccacgggcgtccctccgacgagaacgcgcacccgcacacgtacaaggacgtggcggtggtgcacaacggcatcatcgaaaaccacctgtcgctcaaggagcagttgcgctcgcgtgggcacgtcttctcctcggagacggactcggaggtgttcgcgcacctcatctccgaagagctggagcgcgggctggagctgccggacgcggtgcgcgcggccattgcccaggtgaagggcacctacgcgctggccgtgctgacggccagcgaccccagccgcatcgtctgcaccaaggacgcctcgcccatggtgctgggcctgggccaggggcagaacttcctggccagcgacgtgccggcgctgctcgagcacacgcgcgacttcgtctacatggaagagggtgacctggccgtcatcaccgcggcggccgtggacatcttcaaccgccagggccagaaggtgaaccggcccacccgccgcatcgactggacgccgatgatggcggagaagggcggccacaagcacttcatgcacaaggaaatctgggagcagccccgcgccgtcgcggacacgctgcgcggccggatgctcctgtcggaaggcgacgtccacttcgagggctggaacctgtcggcggagaaggtccgctcgctgaccaagatcaccatcctcgcgtgcggcacgtcgtggcactccggtgtcgcgggcaagcacatgattgagtcgctggcgcgcctgccggtcgaggtggagctggcgagcgagttccgctaccgcgaccccatcgtcgacggcacgcacctggccatcgccatcagccagtcgggcgagacggcggacacgctggcggccttcaaggaggccaaggcccgcggcgccacggccatggccatctgcaacgtcattggcagcgcgatgacgcgcgaggccgacttctccgtgctcaccaacgcgggcccggagattggcgtggcgtccaccaaggcgttcaccacgcagctggtggccttgttcctgctggccgtcaagctgggccgcatgcgtggcaccctgtccgtgccggcggcgcaggagcacctgacgcagctcacgaaggtgccgaagatgattgaggacgtcctcaagtgcgagccggccgtgacgcgcgtgtcgcgtgagtacatggactcgcaggacttcctcttcctcggccgcggccccatgcacccggtggcgctggagggcgcgctcaagctgaaggaaatctcgtacatccacgcggagggctacgcgggcggtgagatgaagcacggccccatcgcgctcatcgacgagaagatgccggtggtggtcatcgcgccgaagcagccgcacgtcgcgtacgagaaaatcatcggcaacatcgaggaggtccgcgcgcgcggtggcaaggtgattgccatcatcgacgaggacgacgagcacgtggccacgctggccgaccaggtcatccggattccagcggcttgcgcgctgctggcgccggtggtggccaccatccccctgcagctgctcgcctaccacgtggcggacctgcgcgggaacgacgtggaccagccgcgcaacctggccaagagcgtgacggtggagtag

SEQ ID NO: 8844 - DNA, 744 bp, Myxococcus xanthus
atggagggcgaggacgaggcgccactgggggaggtcgcgccgtgggaggcgccgcccgagcccgcgccgctggaggccactccggttcctctgctccgggggacgcccacgccgccgttggacctccccctgccggtgctggtgttgaccgagcaggcccggcgggtgccggaggcggagcgtcccctggtggcggcgcggctgaacctccagctgtcccggatggccaggacaggcggagaccggctggtggcggacaccttcctccggctgttggagagcgggcggctcaccggactggtggatgcgaagggacgcacctgccgcgcggccgccgtggaggctctgttgtccctgggcttcccctacgccctggaagtccagcccgaggacctggcgcacctgcgcgccaacaccctgcagcggaaggcgcaccgcctgaagccaggtacgtccatggcggtgttggtgggaggcatcggggtgcaattcgtccatgaagcgctggtccacaaaggggacgccagcctgctcacctcccaggtgggtctgtccctgctggcgatggccgccttgtggcttgctccgccccggacgcccgtgtaccgcgtggggttgctgatgctgtccctggtgtccctggcgggggcggtgtttgcgctcctgggcgtggcgcacacggggctgtgggtgggattggcggggctggtggccgccttcctggctgccctccgcgagggctga

SEQ ID NO: 8845 - DNA, 1092 bp, Myxococcus xanthus
atggccgtgaatcaggagaaggaaaaggcgatcgaactggcgatgtccgcggtggagcgccagttcggcaaggggtccatcatgcggctcggcaacgacgagccaatgatgcgagacgttcaggccatcccgacgggctccatctcgctggacatcgccctgggcgtgggtggcgtgcccaagggccgcatcatcgaaatcttcgggccggagtcgtccggtaagacgacgctgtgtctccacatcgtcgccgaagcgcagaagcgcggcggcatctgcggctacgtggacgcggagcacgcgctggacgtgggctacgcgcgcaagctgggcgtgcgcaccgatgacctgctgctgagccagccggacaccggtgagcaggcgctggaaatcgcggagatgctggtgcgctcgggcgccatcgacgtgctggtggtggactcggtggccgcgctcgtgccgaaggcggagctcgagggtgagatgggcgacgcgcacatgggtgtgcaggcccgcctcatgagccaggcgctccgcaagctgacgggcaccatcgccaagagccagacgtgcgtcatcttcatcaaccagattcgcatgaagattggcgtgatgttcggcaacccggagacgacgacgggcggtaacgcgctgaagttctacgcgtcgcagcgcctggacatccgccgcatcggcgccatcaagaatggcgacaacgtggtgggcagccgcacccgcgtgaaggtggtgaagaacaaggtcgcgccgccgttcaaggaagtcgagttcgacatcatgtacggcacgggcatctcccgtgagggcgacctcatcgacctcgcctccaacgagaacatcgtggagaagagcggcagctggttctccttcaatggtgagcgcatcggccagggccgggagaacgtgaaggagtacctgcgcgagcacccggagatcgcgaaggacatcgaaggccgcgtgctggagaagtacggcatcggcaagtcgggtgcgcccgtcgccgcggcgccggacgagtccgcgccggccgaaggtggcagcgagaagcgcggccgtgtgaaggccgtgaagtag

SEQ ID NO: 8846 - DNA, 441 bp, Myxococcus xanthus
atgaccgaggccggaggcggggagggcacgggcatccgcctggagaactcggcgggcaccacagtggtgaacaacaccgtcacccgcgcggtcacggcgctcatcatcggccatggcaccggtggccccacccagtccccggtggtgcagaacaacatcttcgcggacgcccccatcgcggtgaacatggggccgatggccccggggatgaagatgggcaacaacctcttcccagcaggcgcccagttcaagaaggacggcaagcccgtggacctcacggcctaccagtccacctcgggggacaccacctcacgcctcggctcggcagacctcggggcggcgttcgcgccggggcccatggcgctggactcgggcgtcgacatcggcatcccgttctgcggcggggggccggacatcggcgcggtggagctgggctgctga

SEQ ID NO: 8847 - DNA, 778 bp, Myxococcus xanthus
atgggcaagacgggcctcttcggcatccagggctcgcgctacgtcgtggtgaagcccatcttcgacctgtacgcggccatcaagtacatgggcaccgcgggagcctcggagggcatcttcggcaacgagcagcaggcgtggctccaggagtccgtgcaggcggacaacgcgtggaagatcatcgtctcctcgatttcgctcacctccatggtgttcaagctgagcgagaaggcggacgtcccggaccccacgctgcgccaggacttctacttcaacgtggaccagtgggacggcttccccacgaagaagcaggagttcttgaagttcctgcgcgacagccaggtgaagaacgcgctgttcatctccggcgacatccacgcgtccttcgcgtccgtggagtccggcatccccgcgctgacgacgccggccatctcctccggctccatcaaggagctggcgggcctggccgtcatcggcgcgggcttctccaccggcagcacggtgtaccggtacatcgtgacggagctggacaagtcgctgaaggaagcgcaccccggcatggcgttcgtggacggtgatgcccacggcttcgtggtgctggaggtcggcggcacggaggcgaaagcggccttccacctcatcccgagcacggaaatcgccaaggactactcgctgcgccagccctccgagctgacgggcgaagttcacccgccgcgacttcatcatcaaggacggcaccatcacctccgcctgaggagagaatgcctcacctgttcgg

SEQ ID NO: 8848 - DNA, 1740 bp, Myxococcus xanthus
atgagcgaggcactggccgagtacaccttgggctggcgcagcgtgtgggcggccgtgagcgccgccaccaccaccgccacgccaaggacgacccacttgcggcgccacaccgcgcgcacatactgcatgaggcccgcgggcgtcaggccaccggcgccgccggccgggtcgaaaccggttccatccacgtcacgtctccctgccgtctccagagcgactccacggcctggcggcactccgccgacctacacccacacgcttggggaccgcgacgagcgtgccgtgtccccgcggggttgtccatccttccgcggtcgcctggatgccctccatccacgcttcatcgcggacgctggcgcgcatggccgagccgcctgtgctagtcagcccggcgtgacgccaccgctttccttcgtcctccccttcacgcccgagaccgcggctgccgcttcccgcttcgcccacgcgttgcctcctggcgcggaggtcgtcctcgctggagagggctccgtcgacgccgcctcgtcgcccaacgtgcacgtcctcacggcaccgggtggcaagggcgcggccatccgcgccgcgctggagaaggtgtcgggcgcggtgacggtgctgcaggatccggacacctcgtattcgcaggacgtctatgacgcgctggttcgccccatccaggcggacaccgcggacgctgtcttcggcctgcgcacggcgcaggggctggcgccggagctgctggcggaccgggccctgggccacgtcacccgcttcgtcaccgacgtgccgctgacggacccgctcaccggtctgcgcgccttccgcaccgaggcgctgcgctccgtcacgctcaccagcgacgacgacgcggtggacgcggagctggtggtgaagctggccgcgcagttgttccgcctcaccgaggtgacgctgcctcctggcgcagtgcctcgccggacgcccgcggcgcacctgtcccggctcaagacgctggtccgctacgcgacggtgcgcgacgacgcggacaaccagcatgagggctacaccacgctggagcgcatggacggggccgtccactacaaccagtggctgggccgccgcttccgcgagcacctgggccgccgggtgctggagattggcgccggcatcggcacgattacccgcgagctggagtcgggcctggagctgctcatcgcgctggaggtggaccgcttctacgtggaccgcctgaagaacctcttccgcggcaagccgcacatccggccgtacctgtccgacgtggccctggcggactgggaatcgctcaagacggagcggctggacaccatcgtcctctccaacgtgctggagcacatcccggatgacgcgtccgccgtccggcgcttcaagcagattctggcgcccggaggccgggtggtcatcctggtgcccgcgctccagcagctcttcggcgccatcgacgaggccgtgggccactaccgccgctacacgccctccacgctgcgtgcggtgctggaggagaacggcttccaggtggagaccctggagtggatgaacctggccggcctgccgggatggttcgtcaacagccgcctgctgcgccgccgctcggtccccaagctccagctcaagctctacgacacgctggcgcccctgattgcgcgggcggagtcgcacgtgaagctgccggtgggcatgagcctcttcgccgtggcccgcgccaccgggggcgatgcgtga

SEQ ID NO: 8849 - DNA, 1695 bp, Myxococcus xanthus
atgaactccacgcccttgcccgccgacgcgcccccggagcccaccacggcccccactcccgagcgccaggccctgccgtcccgaggcgcgccgcgcgccgtatgggccgccctggcggcgctgtacgtgttgctgttcccgtaccacccaggcctgcgctcgcccaacgagctgtgccggctgtggcagacgcgcgcgctggtggagtacggcaccctgcacatcaaccaggcgctgaacgactacggcaaggtcggtgacctgtccgtgaaggacgggaagtactaccccagcaaggcgccgctgctgtcgttcgccgccgtgcccctctacgccgcgctgcgcgcggtgggcggcggccaccggcatgccgtgcccgaagtgcccctggtcttcttctcgcgcctgctgctcaccgtgctgcccacgctgggcctgctgtggctggtgcgccgctacctgcgcgcgtccctggagccgctcgtcgcggacgcgctcacagtgacgtacgggctgggctcgctggccttcagctactcgctgctcttcatgagccaccagacgacggcggtgctgctcttcgccagcttctacgcgctgtggcgctgcgcgcgtggcgaatggcgcgagcggggctacgtcctggcgggcgccttcgcgggcgccaccgtggccgccgagtacaccggcgcgctgggcgcgctcggcctggtgctgtacgcggtgctcaccatcgccttccaggacgcgcctgtgcgtgttcgctgggcgcgcctgggccgggccgcggggctggccacgctgggcgccctgcccttcctggtggcgctgatggcctaccaccaggtgacgttcggccacccgctgacgagcggctacaagtacctcaacgacgcgggctaccagccctggcacctgggcggcttcctgggcatccgcacgccggacccgcgcgccttcgccctgtccttcttctccccgctgcggggcctgttcaccctggcgcccttcctcctgctggcgctgccggggctggtgctcgtgtggcgccgccggagccagtcgccggaagcccgcgcgctggcgtggctgagcctggccctgctcctgggctacacgtacttcacctcgtcgttctcctacgactcgtggggctggacgacggggccgcgtcacctcaccggcctggtgcccttcctcctgctgcccgccggcctcttcctggagcgcctgcgcgcggccggccagggcgcgtgggccctgggcgtggccgcgctcctgtgcgcggtgtccatcgtcaccaccggcgtggccaccttcatcaactacatccccgatgacgtctccaacgcggtgggcgccctggcgctgccgctgctgcgtgcgggctacttcccgcccggcgtgctgaccttcctggggctgccggcgggactgacgggtggggtgctggcggggctgctgctgggcaccgccgcctgggtcttcgtcagcctggcgcggaagcccggccagacgtggcccgcggcgcccgcgctgggggcatccctggcggtgctgctgctgctgggtacggcgcatgtcttcaccagccggcatgacaccgcggaccgcaacgccgtgcgtttcctcaagtccgtctggttgaacgccccggaacgcgacgtgacgttctggcctcgcgggcgcggctga

SEQ ID NO: 8850 - DNA, 525 bp, Myxococcus xanthus
atggccgaagggcgcgccgtcgtcctggcgatgatgaacaaccccgtcgcgggaggcgttggcagctacagccaggatgtcctgcagcgcctgcaggtcgtggccgagcagggcctgcccgacgtcgccgcgggcggcgtgccctggcgagagctcattccccagacgccgtacacgctggcgcgtggcacggccatcgacgacaccgtgccgggcgcctccgtcgaaatcaacgacgtggagggcgagcccatccgcgcctatccggaggctcgcagcgtctccttccgcgtcttcgtcgtggaggacgacgacgacgccgaccgcaacgccgacgccaacggccgcatctggctggtgtcggtgggcgaggtccaacccccgggcccgggcctcccctaccgcaccatcgtccgctcactcctggagcacagcagcaccccgggagggctcgcgtgcagctacggcacgaagatgggctgccggggcaccggcacctccagcagcggccttccgacattctga

SEQ ID NO: 8851 - DNA, 1500 bp, Myxococcus xanthus
atggccgcggtggccgtggccgccgcgggagccgtgctcgcccaaagtcccggcggcgacacgggcagtggcggcacagatggtggcgccagcagcctcgcgctgtgcatcgacaccacggaccaggacaagcaacccgacttcagcagggacgcgggcatccccagcgccatcatcgtcacagatgacaacccgcccaagctgcggctcaacaccaacctcaacgtcctggacccggagaaaatcatcctgcccttcgagcaggagctcaccgcgctcatcgtcgatgaccgcgcgggcagcggcgcctccagcacgctgggctggttctattacgacgagctcatcgacgccgaatacatcgacgacaacggcacgcgagagaactccgatgacgaccgcctgctggacaagaacaacaacggcgtgcccgacttccacgaggacctctacaacatcaacccctcgcgctacatcggcgtggcgccccgctgtcccaaccggacgttcacccaccggcgctggggcgatgcggggacggtaacgctgcgcgagcccgacctgctgatgggcccgtgcaactccggcagcaactacaccgccaacacggggcctcgcaggtggcaggggcgcgctgactaccccacgcggccttcgacgggcggcgtggtgggccgcgcggtgcgcgacttcaccagcgccttgttcgcgtatgacccctaccacggacgagacaacctgcagcagagcgcggtcacctccggcatcatcgacacctacttcagcgaccagggcctgttcccgcacatcccgaacctgctggagccccggcatgccctcaatggcaacaggggtatcggcaacctcgtcttcctttccacggacgacgacgagacgtcgtgccacgaatcggaatcggcggagtgcttcgcgccacgtcagggctggacgctcgacggcaacggccagttcatgcgcaccggcacggcctgggacaaatccgatgtggcggacggcatccctgactacaaggccagcgcgttcgacagcgcgggtcgcctcatcaccggcaagagcacgaccgccgccatcaccaaggccgaggaccaggtcgtccccatgggacgcctcgcgggccggcgtgaaatcgtcttcttcctcgtcacctacgtggagcaggtgtacggcccggccacggattcgtgcttcatcacccgtccgacgacggatgggcgcgaggtgcaatgcgacctttggatgcacggcgacatcaacgtcttcttcaccaagacgccgctcaacatggacctgcgccagggcaacgacccgctcgtggtgagacagaagaacctccgcaccaactggggtgaatcccgtggtgtacccccggctggagaacgacccggcctatggcggcgtcgtcttcccgttcgaccagacgcaggatgtcccctccgtgaaccgccgcgcggcgcacacgattgtgggcgcgccgcgtga

SEQ ID NO: 8852 - DNA, 645 bp, Myxococcus xanthus
atggagagcccgggtgagtcctgccagcccaccatccacaacatcaacgtctcctacaaagcgcagcgcagcggtgaatacggccgcgcgtcgctcatccccatggccaacgccgtcatccacggcgtctatgaaacgcccgggcgcgcctgggtcgccgacggaggcgtggaccaggtctccatccgcacctacgacaaccgcccggacaccatcgaccggggccacatctacctgaagaagctctacgagcccgcaacgctggcgccctatgagcccacccaggaggtctgggactccggcaagtggatgcgcgacctgatgcgcacgctggagacccgtcccggcgagccgctcgacacgcgcaggctcgtcacgctcaatccggcgaaccagcaggccatcgacgtgaaggacctgatggcgcgcgccaacaccaccagccccgtcttcccagatacctactgcacccgccgcaacggcagcgtgtacctgtatgacctggatggccgcaacggctgcaccgcggatgaccgtgtggcgctgcgcgactggctctacggctgggaggaccgccagtcctccgtcatccgcaaccggatgcgaacctggccgctgggcggcgtcaacctgtccttagagcac

SEQ ID NO: 8853 - DNA, 729 bp, Myxococcus xanthus
ctgcgggtgctgcacctgggcaagttctatcctcccgcgtcgggcggcatggaggcccacgtgcagacgctggcgcgcgcccaggcggcgctcggcgcgcaggtggaggtgctgtgcgccaaccatgccgcggacggcgcgggcaccagccacgagttccagggccgcagccccacgtgtgagacgtgggacggaccggtgcgcgtgacgcgcctgggccggctggcctccgtcgcgcgcatggacgcgatgccggacctgccgcgcatgctgggacgcgcgttgtcgcggggcgtggacatcgtgcacctgcacacgcccaacccgacctgggtgctggccctggacgtggtgcgccggctgcctcctgtcttcatcacccaccacagtgacgtcatccggcagagggtggcgggcgcgctcttcaagcccttcgaggcgctgctctacgcgcgggcacggcgggtgctggccaccagcgaggcctatgtctcaggctcaccgctgctgcgcgcctttcgcggcaaggtgcgggcgctgccgctggggctcgacctggcgccgtacctccatccctgcgccgccgcgcgtgaggcggaggcccactggcgggcacaggccgcgggcgcgccgctgtggctcatggtggggcggctcgtctactacaagggcctgttcaccgcgctacaggccctgcgccgggtgccggggcggctggtggtggtgggg

SEQ ID NO: 8854 - DNA, 2133 bp, Myxococcus xanthus
atgcagtatgtgcgcgcggtgtggcgccgcaagtgggtcgtccttggcgtggcggtggtggtggcggcgctcacggccgcccacacgctgcgccagcccaaggtgtactcggccagtgcctcgctcatcatcgacgtgatggcgcctcgcttcctggatggggaagtgaaggaggtgatgggcgaggagcgcagcaactactggttcaacaaggagtactacgccacccagagtcaaatcatcacctcgcgcgcggtggcgggccgggtggtggacaagctgggcctgtccacggacgcggacttcctgggcatggcgcacatcaccgacgagaagacgcgcctgcaggcgatgcagggcgcggacgcggtggcgctggtccagtcgcgcatccgggtgattcccgcgagggactcgcgggtgatgaacatcgcggtggatgacttcgacgccaggcgcgccgcgctgctggccaacgaggtggccgccgcgtacatggcggagaacctggccctcaagctccggacgacggaggacgcgcgcgactggttggagattcgtctggccgagctggagtcgcagtccaagacgagcgagctggccgtctacgacttcaagaaggacgcggacatgctgtccacgtcgctcgagtcgaggatgagcatcgtcagtgagcgcatcaacagcttcaacctgaagctgaccgaggtgcgcatccagattgccgctcagcaggcgcgggtggaggccatccaccggctgcgcaaggcatctccggaggatgagacgtgggcggaggcgctgtcgggcgcctcggacggacccatccaggacctgcggcgcagctacaccgagctgcgcatgacgtgcgcggagctgggcgagcgctacctgtccgagcacccgaagctcctggagtgcaaccgcaagctgtcggtggtgcgcgaggacttcctcaagagcctgagcaacgtggtgcgcagcgcggagacgtcgctggcggagtcggtggcgcaggagaagaacctggtgcgcctgctggacgcggagaagtcggaggccttcctggtgaacaagaaggccatcgagttcgaccggctcaagcgcgactcggacaacaaccagcgcctctacgagctggtggccaggcgcctgaaggacatcgagctgtcaggcatgctgcgcaccagcaacgtgcgcgtgctggacccggcgcggcccatcctggtgccggtgaagcctcacgtgcgccgcaacctggcggtggggctggtgatggggctgctggcgggcctgggcgtggtgctgctgctggagctcctggagaacagcgtggccacgcaggcggacgtggaggagcggctggggctggccttcctgggcgtgatgccgcggctggacggcagcaaggcgccgcgcgagcgggacctgcacgtccaccgcgaacccaagtcgacagcggcggagtgctgccgcgccattcgcaccaacctgctgttcatgtcgccggacaatccgttcaagacgctggtggtgacgtccagcgggccgcaggaaggcaagtccaccacctgcatcaacctgggcgtggccatggcccagagcggcaaccgggtgctgctgctggacacggacatgcgccggccgcgcctgcaccgcgccttcggagtgcccaacgagctgggcatctcctcgctggtggtgggtgagggcacgctggacgcggcggtgaagagcaccgaggtgcccggcctcttcgtgctgccgtgcggaccgctgccgcccaatccggcggagctgctgcacacccaggccttcacggacctgctgaaggccgcctccgagcgcttcgaccgcgtcatcctggacagcccgcccatcaacgcggtggcggacgcggcggtgctggccacgaagtgcgacggcgtggtgctggtgctgaaggcggccaagacgaaccgcgagtcggcgcggcgtgcgctgcgctcgctggcggacgtgcaggcgcgcatgtacggcgccatcctcaacgacgtggacctgtcggcgccgcgctacggtgattcgtatctgggctaccagggctacgggcagtacgcggaagactccaaggatggggtggcgcagtcgtga

SEQ ID NO: 8855 - DNA, 4695 bp, Myxococcus xanthus
tacaccttcctggaggatggcggggatgacgcggtcctgagctacgccgggttggatttgcgagcccggcgcattggcgcggcactccaggccctggcgcgagcgggcgagcgggcggtgctcctctatccaccgggcctagagtacgtcgcgggtttcttcggctgtttgtatgccgggttggtcgccgtcccagcctatccgccggacccgatgcggctggagaggacgttgcctcggctgcgcgccatcattcgggatgcgcgcgcgagcgtcgtgctcaccacctccttcatccaggagatgggggaggggctcttcgaaggcgcccccgagctcgccgcgctccgctgggtggccaccgacgcgttgcccgaggggactgaggcggggtggcgccgtccggagccttcgcgggacacgttggccttccttcaatacacgtccggctccacgggggatccgaagggcgtgcagctcagccatgggaacctgctgcacaacctggggctgatctcccacgcgttccaggtccgctcggacagcgtgggcgtcatctggctgccgccgtaccatgacatgggcctgattggcggcatcctccagccgctctacgcgggcttcccggtggcgctgatgtcgccgctcgcgttccttcgccgcccacggttctggttggagtcactgtcccgcttcggtggcaccatcagcggcggcccgtgcttcgccttcgacctgtgcgtgaggaaggtgcctcccgcggagcgtgaagggttggacctgcgtcgctgggagctggccttctgtggggccgagcccatccgcccggaagtcatgacccgcttctcggaagccttcgcgcccgtgggcttccagcgcgaggcgctctatccctgctatgggctcgcggaaggcacgctgatcgcctcgggtgggcgcaagggcgaaggtgtcctcacgcggatgtgggacgcccaggcgttggagcggaacgaggcgctggcggccgaggacggccctggggcgcgcccgctggtggggtgcggccagacgctgcctgagcagacgctgctcgtcgtggacccggagacgcgtcgcgcttgcccgcccgagcgggtgggggagatctgggtctctggtcccagcgtggcccacggctactgggagcggcccgaggagagcgaggccgcgttcggggcacgattggcggattcggacagcggcccccggttcctgcggacgggagacctgggcctgctgaaggacggcgagctgttcgtcgtgggtcggcgcaaggacctcatcatcctccgcggccgcaacctgcatccgcaggacctggagctgacgctggagcgcagccattcggcgctgcggcccggttgtggcgcggcgttctccatcgacgtgggcggcgaggagcggctcgcggtgatgtacgaggtggactcgcgcaagccgtggaccgccgaggacgtggtgggcgcagtccgccggggtctggcggagacgcacgaggtccagctccacacgctcgtcctcatcgagccaggcgcgctgccgaagacgtccagcgggaagattcagcggcgtgcttgccgggctgaattgctcgcggggacggctcgggcgctgctgacctggagcgagtcggaagcagacgcgccccaggccaaggctcccgcgcctgacatcaccgcgtcccagccgctcaccgtggaggcacttgaggcgtggttgctggcgcggatcgcctcgcggcttcgcgtccgtccggaggagctggcgacggatgcgcccatcacttcctttggtctggactcactgggcgccgtggagttggcgaacgacgtcgagaccctgggcgtggtccttcgcatggaggtccttcttcaggggccgacggtgggggcgctcgcgctgaccctcttcgcggcgcgtggggcgtccactggcgccgagctgacgcggggcgaggagaggacgcccgcgccgctctcctccgcgcagcaaagactgtggctgttcgagcaattggcgcagggaagcgccgcgtatcacctgccggcggcggtacggctcaccggtgcactggatgatgtggcgctggagcatgccttcgctgcaatcgttcagcgccacgcggcactccgggcgacgttccgcgacgaagatggcacgccgtcgcaggtgacctcgtcggtgccggtgtcatcacttcgccgggtggacctccgcgacgtcccggtggatgcccgcgaggaggccgcgcttcgtctggcccacgaggaagcgcgggcgccgttcgacctcgagcgcggtccgctgctccgggccacgctgtttcaattggacgcgcacgagcacctgctggtcgtggtgatgcaccacatcgcctcggatggtgcctcgttcgccatcctggcccgtgagctgagcgcgctgtacgcgggtgatgtttcgctgccgccgttggcctttcagtacccagacttcgcgcgctggcgccgcgaggtcgaggcggacggcgccctggccacgtcgctcgactggtggaaggcgcggctggcagggggggccgcggcgctggaactgcccgcggatcggtctcgaccgcccatgccatcctatcgcggtggccgcgtggcggtgcggttcccggaggcgctgacggctcggctggaggcgttgggccggagcgaaggcgccacgttgttcatgacgttgctggcggctttcgaggtgctgctcgcgcgtcattcggggcaggcggacttctgcgtcggaacggccgtcaatgggcgtgagcgggcgggactcgaagggttgatggggtgctttctcgacctgatcgtcctgcgcgcgtccgtgtctggctcatcacgtttccgcgaactgttgggacagacgcgggaaggcgtgctggcggcctttgcccaccggggcgtttctttcgagcggctggtcgacgcggtccaacccacgagggacccctcgcgcgcacccttgttccaggtgctgttcgtgctccagccggagcccggcgcgggactggcgctgcccggcctggagtctcgccgcgtggaggtggacccgggggccacgccctacgatttgacgctgtcgctggcccgagggccggagggactgggagggtggctcgagtacgccacggacctgtttgatgcggacaccgccgcgcgactggtggcgcggctgggcgtgcttctggaatccattgtcgcggaccctgaccagcgcctcgccatgctgccgctgttgcctgaggcagagcagcggcaggtgctggtcgactggaatgacacgcgggcggagttcccggaggcgtgcatccatgcgctcgtggagttgcaggcgcagcgcactccggacgccgttgccgtggtgtgtggcgacggggtcctcacgtaccgtgagctgaaccaacgagccaacgccgtggcatggaggctgcgcgagcagggcgttggacctgagtgcatcgtgggcctcttcgccgaccgctccgcggacctggtcgtgggcctgctgggcatcttcaaggcgggcggtgcgtacctgccgctggacccgtcgtatcccgaggctcggctcgcgctgatgctggaggactctggcgcctcggtggtgctcgcgcaccggcatctggcgggcgcgcttccgttcggcgataggaccgtggttccgctggatgtggctggcgaggccgacgccgcgccaccgggagccgtggggcccgacaacctggcctatgtgctctacacgtccggctccaccggcaagcccaagggcgtggccgtcccacagcgagccgtcgtccgcctggtccggaacacccactacgtccacctggggccggacgagacgctgctccagttcgcgccgctcgccttcgatgcgtccaccttcgaggtctggggggccctgctcaacggcgcccgcctcgccatccatccccccaccacgccgtcgctcgaagagctgggaagcttcatcgcccgccaaggagtgaccaccgtgtggctcaccgcgggcctgttccatcaggtggtggaccacgcgctcgagtccctggcgtccgtgcgacagctcctcgcgggaggcgacgtgctctcccccgcgcacgtgcgacgcgtggtggagcggtacccgggctgccgggtcatcaacggctacggccccactgaaaacaccaccttcacctgctgccacaccgtgtcgccggacgagccgctcgtgaacgccgtgcccattggccgccccatctccaacacgcgcattcatgtgctcaacgcggcactggagccggttcccgtgggcgcgcctggcgagctgtgcgcgggcggtgacggtctcgcgctcggctacctcaacgaccccgcgctgacggcgcagcgtttcatcccagacccgttcagccccgtgccgggcgcacgcctgtaccgcacgggggaccggtgccacgtcctgccggatggggcgggtcgaattcctcgggcgccgtggatgaacaggtcaagctccgcggcttccggattgagccaggggaaatcgaggcggccctcgcgctccatcccaccgtgcacgaagcgcgggtcatggcccgggaggacggccccggagagaagcaactcgtcgcctacctcgtcgccaggccgtcccgggaactcccgc

SEQ ID NO: 8856 - DNA, 729 bp, Myxococcus xanthus
atgagcgaagacaacctgagtgaaggcgacgatctggccattgccatcgtcggaatggcgggccgcttcccgggctcccccgacgtggagaccttctggcggaacctctgcgagggtgtggaaggcatccgcttcttcaccgacgacgaactgaaggcacgcggcgttcccgaggagcgcctgcgacagccgggcttcgtgcgcgccggagccgtgctggaccaggtggacgcgttcgacgcgagcttcttcggctattcgccgcgcgaggcggcgctgatggatccgcagcaccgcatcttcttggagtgcgcgtgggaggccatcgagcgcgcgggccacggactggatacggagtcgcgctcggtgggcgtcttcgcgggcacgagcctgagcacgtacctgctcttcaacctgcgcacgcacccggagctgctcgagtcgagcgacagcttccaggtgatgattggcaacgacaaggacttcctcgccacgcggctggcgtaccacctggacctcaagggccccagcctggatgtccagacgggttgctccacgtcgctggtcgccacccacctggcctgccagtcactgatgggcttccagtgtgacgtggccatcgcgggcggcgtgtccgtggacgtgccccagcgcacgggctacgtgcaccagcccggcggcatcgcgtcgccggacggtcactgccgtcccttcgatgcacaggcccag

SEQ ID NO: 8857 - DNA, 1179 bp, Myxococcus xanthus
atgaaaatccgccacggcaactgcctgaagctgatgttcctggctgcgagcctgctcctgctgagctcggtggcctgctcgggctccgacagtggagggacgcctgagcccgttcagaggctgacccctcgccccgtgcccacacccgcgcctgggccggcggagtcgcccacgcccactcaaaccttcgccacgcgtccgcccgtcggcgtgcaggcggtggcggggactccggtggccgcgctgccggaccacacggaccacgtgaacatcgaggacccttcgccccaaccggccgtcaacgccacggcgatggccgtcgccgccgaggcgcccgtctatacccgtgagtgggtggtgagcacgtcgggcaacgacgccggggacggcagcgccgcgcagccgctgcgcacgctcaacaaggccatcggcgtggccagcccgggtgagctcatccgagtcctgcccggcacctacgcggagcgcgtcatcatcggtgacaacgcgaagccgggcacggccgacgcgaaaatcacgctccagggcgagggcagcccgcgcatcgtcctgggccccggcgagcacgggctgatgcaggtgcgccagccgcattggatcatcgacggcttcgaaatcgatatggagggccagacgcccttcgccgtcacattcgagggcgacgtgacgggctccatgctcgtcaactcggacctgcacggtggtacgggcggcggcgcggtgacgacgttcaacaacgccaccggggccatcatcgagaacaaccacatctacgacttcgtgaagaccaccgacaacgaggactcgcacggtgtcgtggtgcagcccacgtcgcgcgacgtcaccgtgcgcaacaacgacatccacgacaactcgggtgactccgtgcagtgcctggggcccgagggcttcagcaacctgccgcccgcggagaacctgctggtggagaacaaccacttctacggcaaccgcgagaacgccgtggacatcaagacgtgctacggggtgaccatccgcaacaaccggatgcaccgcttcctcccgacctccacggcgcggggtgatgtcgtcgtcatccactactccgcgagcaacgtgctggtggaggacaacgaaatctacgacggcgcgaagggcaatcgcggtgggcggcacccgtga

SEQ ID NO: 8858 - DNA, 660 bp, Myxococcus xanthus
atgaacaacgagaacttccccacgaagctggaggacctcgtcgccttcctgtcgggcaccacgcccgcgacgccggagttcgagaagctgagcctgaagaccatggcgccgggcatgccgcaggtctgggccctgggctcgggcgagcagagcgccgcgctcgcggcccggctgggtctgtccttctgcttcgcgcacttcttcaaccccatccacggtggaccggtgacgcgggggtatcgcgagcgcttccagccctcgcacgtgcaggcggctcccaactccgcagtcagcgtctacgtcatctgtgccccgaccgagcaggaggcccggcgaatagcccggagcagcgacctgctgaccatcaacactcgcaggggccggcccgaagcgcccattccgtccatcgaggaggcggaggcctacgcctacacgcccgaggacctggccacgctcgagttcgaccgcaaacgcgtcgtgtgtggttcaccggaccaggtgaaggaacagctgttgcgcatggccgccgaattccaggcggacgagctgctcgtcaccaccatcgtccacgaccatcgcgcccggatgcgctcctacgagctgctcgctgacgcgttctctctctcgagcacgccgcccgccgcccaggcagccagctga

SEQ ID NO: 8859 - DNA, 1284 bp, Myxococcus xanthus
atgtattacgagctgcaccggtggccactcctcatcgactcgcgccgcgaccgtgagctggaggaggtctcggtcaagctctgccggctcgtcaagcgcgggcctcggctgttgctggacggcgaccctcggcgcatcgccgactactacggtgtctcgcaggaacgggcgcgcgtggcggcggaggtcctggccaacacggaggatgcgcgcggcgcgctcagccgcggggacttcatcgactcggccgacggcctcaagtgccttgaggtcaacatgatggcgggcctgggcggttgggaaacggggctcaaggctcaggtggtgatggaccagcccgtgctccagcgcttcaccgaggagcagggcctgcgcatccagctgcaggacacgctgcgcgccttcctgagtcatgtcgtcgaggacgtgcgacggaccgttgcgtgggaaggcgaatgcaatctggccgtgctcttccctgacaatgagctgcccgaagccgcgggcagggagatggcgacgctgctgctcaacagcacgctgagcgaactgctcgctgctgaaggcgcgaagggcgaggtgctcatcggcacctacagcgaggtgaaggacgcggagggccactgcttcacgatgcgcggccggcggctgcatgccgtgcaggaacatgacgcgagagatcggctcgaagtggtgggcccggacttcgacgctcgcgtccgcgccgcgctcgccgcgcgcaccttgtgtctctacaacggtccagcgcaggagctgctcgacgacaagctcaacatcgcgctgctgtcggagaacgaggcgtcacccgcgcttactcccgaggagcgtgagctcatccgccggcacattccctggacgcgccgcgtgcgcgccacccagacgacgcgcgacggcgcatccgtgtggctgcccgacgagctcaccgcctcgaagcgcgaaggcctggtgctcaaggcgggccgcgcctatggcggcaagtcggtgctgattggccgcgcgatgaccgccgaggactgggacgccgccatccaggaagccctggagcacggcggatggattgtccaggagcgcgtcgagccccgcccctaccacttcctgcgagacgacggcgccgtgggcgcccacatcctcatctggggagcctttgtcttcggtgagcgttacggcggaaccatggtgcgactgaaccccaccggtcagggcaaggacgtggtcaacgcgacccaaggcgcgttgatgtgcgcgctcgtcgtcgtcgagtaa

SEQ ID NO: 8860 - DNA, 375 bp, Myxococcus xanthus
aagcgaagaatcctcctgattgatgacagcgagattacgctcgcgatggagaaggccgtgctcgaagcgcgcggctacgaggtcatcgccacctccacgctcatggagttcgagaagacgctgcagacctggcgcccggacctcatcctcaccgacatccacatgcccgaggccaagggcacggatatctgtcgcacgctgaagaacgagtacggcacgcaggacatccccatcgtcctcttctccagcctcccggacgacgagctgtccaagctggccgaacaggtgggggcagacggctccctgtccaaggtgaacggactggaagccatgggcgagaagatcgacgaactggtgcagagcatcctctggtga

SEQ ID NO: 8861 - DNA, 845 bp, Myxococcus xanthus
atgcggggcggcattgcccgcgccgccgcgcaggtgcagtcggcgcgcaagggctcgctgcccgtcctctatgtggatggcggcaacagcctcttcggcgagcagcggctcaagccgggacaggtgcctcaggaggagcgcaaggcgaaggcgctcgcggacgccatgcggcacatgggcctggcggtgcgcgccaccggtccgctggacgacacgcagggcgtggacttccgcaagggcctggggctgccggaactggcgccgggcgcggtgaagctgctgcccgcgggcgaacggaaggtgggcgtggtggcggcgaccacggccgcgcagctcgcggaggccagcgcccaggcccgcgcgcagggagcagacttcgtggtgggcctgctggacgtcacgctggacgtggcccagcaggcggtggagcagccgggtttgaaggccgacgtggtggtggccactcgcaccgccaccgagttcagtggcgaggagaaccgactggtgcggtccgcggtgccggtggtggcgctgcagagcaagggacgctcgctgctgcgcgtggacctggcctatgcaccccaggctggccccttcgcgttgcataagggtcaggatgatttggagcgtgaggccgccgccctggagcaacgcacggcgctgttggacaaggacatcaacctccccggcacggacccgaagctcaaggcgctcaagcagggcaagcgcgacgaactggtggcgcgccggcaggccctgctggacgctcctcccgtcacctcggacggcgtcaacgccttcacgctgcgcttcgtgcccctggagtccagccttccctccgacgc

SEQ ID NO: 8862 - DNA, 885 bp, Myxococcus xanthus
atggaaaaacgcaccgactggtacgaacacccgcagtactacgaagccatcttcggcacggacaccgtgcgcgaggtggacttcctacagacgctcaacgagcgcttcggcacgggcggcaagctgtggctcgagcccgcctgcggcgcggggcggctcgtggaggaggcatcgagccggggcctgcgggtggtgggctatgacatctccgaggcgatgctggcccatgcgcgcaagcgcctgacgccggcgcagcggcggcgcgtgaagctggggccgtcacgcatggagtccttctccgacccgtcgctggaggggcaggtggacctggcgcactgcctggtgtcgaccttccgctacctggacagtgaggccgcggcgcgccagcacctgctggggacgcggcggctcttgaagccgggcggcatctacgtgctcggcttccacctcacggactacgcgcgcgcccggcccgaacacgagcgctgggtggggcaggtgggggaggaccgcgtcgtctgcaacacgaacgagggccttccggagcagcgggcgcggcgctcgcccatgcgcaaccgcctgcgcgtcaccgggccggacaaggactggctcatcgaaacccagtggtacttccgcacgtacagcaatgcccaggcggcgaagctgttccgcgacgcgggcatgcgggtgctggccgggtacaccttcgactacgacatcaacgcacctgtggagcgcggcagcctccggttggaccgagtcttcgtcctccagccggaccccgagtctccgtccgtggaccctgccgagcctgggcgtgcgtccgcgcggaaagcgcccaagagggcctcgacgccccagaaatcgcgcaagatttcacgatga

SEQ ID NO: 8863 - DNA, 789 bp, Myxococcus xanthus
atgtcgccggtcctggccacggtggccctgtattccctcatcatcgtcctcggcgcgctggctggcgccgtggtcgtcgtcttgaacgaccgacccacccatctggtgcgcttcctggctttcgccgcgggcgtgatgctgggcgccgccttcttccacatgctgccggaggcgtatctgggtggcggatggtgggccttcgccctggtgcccgcgggtttcgccttcttgctggtgctggagcgctacctcgtcgcgcacgcgggcgaggacatctcccacggagacaccatggcgggcaccgggcactcggtgcatccgggccacgtgctggggctcaccgccttcctggggctgtccacgcacacgttgttcgacgggattgccctgggctcggcggtggaggagggcgtggggggcatggcgctgctggccatcgtcgcgcacaaggtgccctccgcgctgtcgctggcctccatcctcaagacggaggggcgctcgaaggtctccatcctgtcgctgtccacgctgtacgggatgatggtgccggccggcgcgctgctctacttcctcttcgacgcgatgctgcagttcgaaagcctcgcggccaaggccctggctttctccgcgggcacgttcctctacatcgccgtgtcggacctgctgccgcatgtgcaccggcacggcaaggaccagccgggccgcaacgtgctggcgctcttcgcgggcctgctgctgatgttcctgctcgcgcggctgatggggcaccccgagcaccccggccactga

SEQ ID NO: 8864 - DNA, 1257 bp, Myxococcus xanthus
atgtccatccactcccgcagcccggtccgcctgagcgggtggggcgcgctcgcgctcgcgagcgtgctcctcctgtcgtcgggctgcgcgggtgactatgtcgcgcgcacccggggcgtgcggtccgcataccagcaaggggactattcgcgcgcgctgtcctcgttggaggccgcggcgaaggaagggcccgaacaggaccgcctgctggtgttgatggacaagggcatggtgctgcacgccgccgggcagtgggcggagagcaacgccgtgctcgaggaggcggagcggctcagcgagcagatcgacagtgtctccgtcagcgaggaggcgaagacgctcgtcaccaacgagcgtcagcgcacctaccggggggaggacttcgagaagctgatgatttccgtcctccaggcgctcaactacgcggagctgggcgacgacgaagccgccatggtggaggtccgccaggtcaacgagcgcctggagaagatgatcgccgaggagaagaagccctacgagcagctcgcgattgcccgctacctgggcggcgtcatccgggaggaccagcgggactgggactcggcctacatcgactacgcgaaggcctatgaaatcgcgccccgcgaggacgcgctggccgagcccctgctgcggctggcgaagaaggtgggccgcgacgacatgtacgcggagctgctggcgaagtacccggacgtcccgcacgcgccgctggcgccggacgaagggcagctcgtcgtcgtggtggaggcgggcctgtctcccgagaagcagcgcggctccagggacccgggcggcggtggcgacctgattgaagtccccacctaccggaaccgggggctcgcgccgcccgtgagtgtcgccctggagggccagtcccagcaggcagtgacggtgacgtccctggcggacgtggccgtggtccacctgaatgaccggattggccgcatgctggcgaagcagctcgcgggcgtggccgtgaaggcgggcgtggcggcgggcgtgggcgcgctgacgaagagtgatgaactgggcgtgctgaccttcctcgttctcaacgcgatgaatgcgccagacctgcgttcctggctctccctgcctgcggagttccaggtggcgcgcttccgcgtgcccgcggggaatcacaccgtgcgtgtgacgagctgggggcaggtgacggagcatccggtggaggtgaaaccgggccgggtggagttgttggtgctccggcgctactga

SEQ ID NO: 8865 - DNA, 609 bp, Myxococcus xanthus
atgaacacccgccgcctgattctgtccgcctgtctcgccgcttcgctgtccgcctgcacgggcccgcgcgccttcacgcgtggcacgtacgaggacccgaacaccatcgagatgctgtcggaccgcttcaacgagaacgacctgcagctcatcgcgaagaagatggcggagtcgctcgccacctcgccgcgcttctcccagccccggccggacggctcgctgcccattgtcctggtgggcaagctgaagaacagcacctccgagcacatcgacatgcgctcgctgggcgacaagattcagacggcgctggcgcagacgggccgcttcgccctggtggaccagcaggcgcgccaggacatcgcggaggagtacgagtaccagcagtccggctacgtcgacccgaacaccgccaagggcccgggtcagcagacgtcggtggacttcctgatgacgggcgacctcgcctccatcatccaggaggtcggccgggacaagctcgtctattacaagatgaccgcgaagctcagcaacgtgcggaccggcctcatcgaatggacggacgagaagcagatccgcaagaagttcgagaagcgcggcgtgagctggtaa

SEQ ID NO: 8866 - DNA, 828 bp, Myxococcus xanthus
atgattgcccagctgcttgccgccacgctggcgttgacctccagccaggcgcccgtctctgtttccggccggggaagcccacaggtgaacctgccgtttccgtccggagacgtgcagacctacaacatcatccagtgggaccccaaccagctcccgcgcatctacgagcgctccgaccagctccctctcaccgacgaagagctgacgaagctgtcccaggctggcttcgagcccgcccagctcgtgaagatgattgaagagcgccgctgcgcctgcgacgccagcgcggacggcctcatccggctcaagaaggccggcgtggacaaggacgtgctggccgcggtgtctcggcacggactggcgcccaaccgcgggttgaacctgctggtgacgctggacttcaccggtgagagccgcaacgcgcgcgaggcgttcctctacttcttcgtggacgatggggacatcacccgcgtcttcaccgccaacatcccggagctgctgcgccgccgcaacagccacgagacgacggtggaccgcagcgacatcctcgtcgcgcgcaccgttcgccgtgtccaactggcgggccaggtgccgctgcgtacctatggcaagcacaacgtgctggtggtcgccagcgccagccccacgctcacgcatccgtcccagctcaccgcgcaggagctgtcgcggtcgcagcgctacaccttcgactaccctcgtgcgtcgctgcagaacgtctgccgcctgacggccgggtaccgccgcgacgcggtgctcgcctacaagtggaacttcgaaggcagccgcttcgaatgcgaatggaactag

SEQ ID NO: 8867 - DNA, 531 bp, Myxococcus xanthus
atggtggccgccaccgtgccgctgaccgccagtgcccaatcccgaggccgcacggacggtccagaggagtccgagtacggcaagggtggctacagcggtcccggaggccggagcgtgtcgctccagctcgactggggcgcggccatcaactcccgcaagccgcctcggggcgcgccggaaggcccgccgctgttcgtgggcgccacgctgtcgctgtggggcgcggactggtaccagttggacgtgagtggtgcctacgtgttcgacgggggccgcttcgtcggcatggtgggcccgcgcttccggacctggggctggccgttggtgttcaccgcgggcctgaaggccggcgccatcgtcatcccagagggagagggcctgcgcttcggcatctcgccgcagctgggggccgaaatcctcctgggcgaccgcgagaacatcctcatggccctcaactacaccccggacatccccattggcggtggcggcgtcacgcaccggctgggcatgtccgtgggctacaagttctag

SEQ ID NO: 8868 - DNA, 717 bp, Myxococcus xanthus
atgatgagctctctcgacttcacttcctggcgtggcctcgcggcgacgctgaccagcctcgtgctggtgtcgctggtcgtcgtcagcatccgcctgctggtgatgcagaccgtgcagcgccggcgcgaacgcgagaaccgccagatcaacgagcggctgaagacgctgatctccgcatacaagacactcggcggctcattcaccggtgagctcgtcgtggacccgactcatctgcgggacatgcgccgtcggctcgcggctggagagccactcgaacaggagcccgaccagggcctcgtgcttgcgtcgtcgctcgaccacccggcgctcgaacgccgtcggcgcacgcgcgacgcggtcgaggcggcgctgtcggatgtgatgctgctcggcaccgaggagcaggtgcggctcgccgcggaggctgccgcggacatggtcgccgggcgcaaggtcggcaccgcgcggctggtcgtatcgctgcgcgatttcatccgccgggcgctcgatctcgagcccatccctcacggactcgcgattcccgaccagggccccgtgcgtcccagcggcggaggagggggcaagggcggcgacaagggtagcggaagagggggcggcggcggaggtgccggcggtggtggcgctggaggcgtcggaatgggcggggccggcgtccatgcggacaccgacgacactgaagacggccatcgcgcttga

SEQ ID NO: 8869 - DNA, 1236 bp, Myxococcus xanthus
atggtctgggtcttcagcgagtccacggtgcggcaggtggacccgctcttcgcggagtatggcccccggctggtgggcctcctgccggccttcttcttcagtgacacggtgctgggactggagccctggcagtggctggggctgctggtgacggtgctgggcagcctgggcctggcggtgctgctggagcgcctggtcctggccttcgcccgccgtgtggcgcggtggacccggttcacctgggaggagaatgtggtctcctcggggaaggggccgctgaagctgctcaccttctccgcgctgctggtggtgggcacgctgctcttgcggctgcctcgtccggcgcagggcgtgttcatccggatcggctactcgttgagcgtcgtggcgctggcttgggccgtgctgcgcatcctccacgtctccgtcgccttcgtgcagagccgcgtgtcgtcggagatgaaggacgcggcacgggcgcgcagcgtgagcacgcagttggtggtgctccgcgccatcttcgaggtggccacgtacgtcatcgccgcggcgctgctgctcatccagttcgaggtggtgcgcaacgtcggagtgtcactgctggcctctgccggtattgccggcctggtgctcggtctcgcggcgcagaagtccattggtacgctgctggccggcatccagctctccatcacccagcccatcagcattggcgacaccctcatcaccgagggcgagtggggcacggtggagaaaatcacgctcacctacgtggtgctgcggacgtgggaccagcgccggctggtcatccccattgtccagttcctggacaagcccttccagaactggagcaaggggaacccggagatgctggggcccgtcatcctccaggtggacttccagacagacatcgacgcgctgcgcgcggagctgcgccgcatcctggagaacgagggcaaggccctgtgggacggccgcgtggcgacggtggtcgtcctggacgtgctggaccgcaccctcacggtgcgcgcgctggtcagcgtgtcggacttcagcaagctcttcgacctgcgggccctggtgcgcgagaagctggtcgccttccttcgcgcccacccgctgtggctgcccgtcacccgcacggaggcgcgtcccttcccgccgcccgagctggatccggcgcggctgtccacttccccggactcgccgcccgcgccgcccacgccgcctcgggtgtga

SEQ ID NO: 8870 - DNA, 768 bp, Myxococcus xanthus
gacgtcagtgcgctgcacctcatcctgctgtgcgtggccgcgctgattgccggcatggtggatgccatcgcgggaggcggcgggctcatctccctccccgcgctgctggccgcgggccttccgccccacgtggcgctgggcaccaacaagggacagtccgtcttcggctcgttcgccgcgctggtgcgcttctcccgcgcggggctggtggatgggaacctggcgcgagtgacgttccccttcggcctgggtggggccttcgggggcgcggcgctggtgctgctggtgaagccggaagtcctcaagccgctggtgctggtgctgctcatcgcggtggcggtgttcctcgccttccgcaagtcgccgcgtccgggggacatgccggagcccgggccgcccgcgcgcgccagggccattggcgcgctcatcgcgctggccatcggcacctacgacggcttcttcggaccggggacggggacgttcctcatcgtggccttctcgtccctgctgggacacggcctggcgcgcgcgtccgcggacgcgaaggtggtgaacttcgcctccaacctcgcctccgtcgcgttgttcgccttcaagggcgtggtgctctggaaggtggcgctgcccatggccggcgcccaattcgcgggcgcctacctgggcgcgcacctggccgtgaagggcggcgacaaactggtgcgcaaggtggtgctgggcgtggtgctggccctggtgctcaagctggggcacgacgtggtgacggcctga

SEQ ID NO: 8871 - DNA, 978 bp, Myxococcus xanthus
gggctggtggtggcgttgggcttgttcgcgtccgtgttcattcacgaactggcgcacaccgtgtacgcgctgcgccgcggcgggagggtgcgctcgattacgttgatgatggtgggcggtgtgtcggagttgacggaggcgccgccgcgtccccgggatgaagcgctgatggccgcggtggggccgctgacgagcatcctgctggcggtgctgctcggcggcgcgacgtggctgctccaggaggtgcgctcgttcaacctccagttcgcgttcttctacatggccagcctgaacctgttcctgggtgtgttcaatctgctgcccgcgttccccatggatggggggcgcatcgtccgcgcgtcgctggcgggacggctggggatggtgcgcgcaacgcaggtggcgtcctggctgggacgtgggttcgcggtgttgttcggtgtgtgggcggtgctgtcgctcaatccgttcctggtcgtcatcgcgttcttcatcttcatgggcgcgcagggggaggcgcagcaggtgcggatgaagatgacgctggagcgtgtgccggtggccgacttgatgacgccgcgccgggtgggtgtggacgcgggggcgtcgctggagcaggcgctgtgggacttgcggcgtgcgaggctgttgctgctgccggtgacggaggacgaaaggccggtggggcaggtgtcgctggagacggtgcgggccgtgccggattcggagcggatgacgcgcaccgtgcgcgaggtgatggtgcccgccgtggtggtgcggctggatgaggatgggtggacggcgctgcggcgcatggccgaggaggagaggccccaactcgtcgtggtggaggcggatggggtgctggcggggacactcgacgtgaacgatgtgcagcgcggtatggcgctgtatcaggcgcgcgaggagcgcagcggtcagcaggatcggcggtggcggcaggagcggccggcgtaa

SEQ ID NO: 8872 - DNA, 1251 bp, Myxococcus xanthus
atggcggagggtgaggtccggcagtactgggtccgcaacgacaggggcaccatgtgggggcccctcaccctgccgaccattgaactgctcatcgaaagcggctccatccagggccggctccagatgtccgaggacgggctcaacttcgcctttccctggcgcttcccggaagcgcgcgaggtcgttccccgcgagctgtggggcccgggcgccccgcccgtctccgccgcggaacaggccgcaccgggcgctcccatgggcgtggcccccggagcgcccgtcatggcgaggccaggtgttcggcccgcggcaggccccggtgtcgcgccgagcgcgggccccggtgtccgccctggcgcggcgcccatcgcgggtcccggtgtccgacccatggcgggccctggcgcggcgcctatcgcgggtcccggcgtccggcccgtggcgggccctggcgcggcgcccatcgcgggtcccggcgtccggcccgtggcgggccctggcgcggcccccatggcgggtcccggtgcgcgggccactgtggaccccgcgcagcgtcccgtggcgcccgcccagcaggcccgtcctcccggagcagtgccacctccgcccgtggcgggagccgcgcgtccgccgagcgctccccccgcgagcccggccccggcgtccgcccctgtggcggtgcccgcggtggagggcgatgacgccgcaccggagattccggccctcggccaactcgagcagctctcccccatccgcctctatggccgcatcgcagcgagggagcagacagggctgctgtcgctgacgctggcggaccgcgtcgtccagattcacttccgcaagggcaacccggagttcgtcgactcgtcccatcccgaagaggcgctcgggccgtcactggtcgcggcgcggctgctcacgcccgagcagcttcagcgggccgagcccacgctggagcgctttggcggagacctgctcaccgcgctcttcggtctgggactgctccagccagccaccgccttcgccatcctggcgcagcgcgcgggcggcattctctccaggggcctgcgggctgagaccgggacgttcaccttcgagctgaaggacctgtcctcgcacaaggcgatgccgctgggccaccgctgggccgtgctgagcgacacggtgcgccggattccctccgcggacctcaagcgccggctaaccccggtgctccagcttcccatcatgaagtccggtggcgtcctttag

SEQ ID NO: 8873 - DNA, 366 bp, Myxococcus xanthus
atggagctgacgtgtggctatggctgcatcaacgcctcggagggagtgcgctgcgcccggacgcccgcgggcgtgtgcaagctggccagtggccgcatcacctgcttcgacccctcccccgccgccctgtgcgcctggaagcgcgaactgcccgcgccgcagtgcaagaacaccgaggcgggcccggtgtgtgggtacaactgcaccacagccttctcgaagtcggcctgtgcgtccaccccgaacgggctgtgcaaggtcttcgacagcgaggtgtactgcttcgacccgcccgctgaacagaaagcggacgcggcgtgtctggcagcgctcgggctggcagcactggatggcgcggcgccctga

SEQ ID NO: 8874 - DNA, 516 bp, Myxococcus xanthus
atggagatgctctgcaccctgcgcagcgccaccgaggcccagcgcgttgccctgctccaggcccccgaacagttggaggacttcgtcgacgatgacgaggacttcggtgacccgaagggctcggcgttcctggagttggacatcggcgaggcgtggcatggcctccagtacctgctgaccggaacgccgtgggaaggcagcccgccgctggacttcctggtgcgtggcggcgaggacgtgggcgacatcccttccgaggaaggcaccgcgcgcgtcttcacgccggcccaggtgcaggccctggccacggcgctgcagcaggtgacgcagaagacgctgcgcgcgcgctacgacgcgtccgtcatgcaggcccaggacatctaccccgggacatgggacgagcccgagtccgaggtggatttgctggaggagctgctctcctacttcgaggagctccagaagttcatggccgccgtggccaagcgccgggaggcgctgctggtgcacatcggctga

SEQ ID NO: 8875 - DNA, 510 bp, Myxococcus xanthus
atgcgttacttcacgaagcagcagggccagaaggaagcggtcccggtggacctggagcccctggggaacgaccagttcaaaatcaccgtgggcgccaccacgtaccaggtggacgcgctggcgctggagcacggcacgctgtccatgctggtagacggccagtcgtacaacgtcgagttcgaggagaacggcgacgagcttggcgtgctcctgcgcggccaggtgaaccgcatcgacgtggcggatgagcgccggctccggctgcgcgcggccaacgcggccttctccgtcgagggcaagcagttggtcaccgcgcccatgccgggcaaggtggtgaaggtgctggtgaaggtgggcgacgaggtgaaggagggccagggcctcgtggtggtggaagccatgaagatggagaacgagctcaagagccccaaggcgggcaaggtgaccgagctgttcgccaaggaaggcaccgccgtggagaacaacgccaagctggtgatggtggaatag

SEQ ID NO: 8876 - DNA, 1507 bp, Myxococcus xanthus
cgcaaagtgctcgtcgccaatcgcggcgagatcgccatccgggtgatgcgcacgtgcaaggaactcggcatcgccacggtggcggtgtactcggaggcggaccgctccgccctgcatgtgcgcacggccgaccaggccatcttcgtggggcccccgccttcgcgtgagagctacctggtgcagcagcgcatcctcgacgccgcgaagcaggctggcgcggatgccatccaccccggctacggcttcctctccgaaaacgccgccttcgtccgcgcctgtgaggccgaaggcctgacgttcatcgggccgcccgcctccgccatggactccatgggcgagaagacgcgtgcccgcgcgaacatgatcaaggcgggcgtgcccgtggtgcccggtaccaccgagcccatcccctccgtggaggaagcgcgcgcctacgtggagaagattggcttccccgtcatgctcaagggccgcgggcggcggcggtggcaagggcatgcgcaaggtggagcgcatggaggacttcgagtcctcgtggcgcgccgccaagagcgaggccctcaacgccttcggcaacgacgccgtctacatcgagaagtacctggagaagccacaccacgtggagatccaggtcttcgcggaccagtacggcaacaccatccacctgaacgagcgcgagtgctcggcgcagcgccggcaccagaaggtggtggaggagacgcccagccccatcctcacgccggagctgcgcgcgaagatgggcgaggtcgcggtgaaggcggccaaggccgtcaactacgtgggcgccgggacggtggagttcctggtggacgtgcaccgcaacttctacttcctggagatgaacacccgcctccaggtggagcacccggtgacggagtgggtgacgggcctggacctggtggccatgcagatcaaggccgccgagggcgagaagctcggcctcaccgaagcccccacgccgcgcggtcattcgattgaggtccgcgtgtacgcggaggacccgagccgcaacttcatgcccagcccgggcaagattacgtacctgcgcgtgccgggtggaccgaacgtgcgtgacgattcgggcgtgttccccgggtacacggtgcccaacgtctacgacccgatgatttccaagctgtccgtgtgggcccccacgcggcgcgaggccatcgcccgcacgcagcgcgcgctgtccgagtacgtggtgaagggcatcaccaccaacatccgctacctgaaggcgattctggcgcaccccgagttcatcgagggcgactacgacaccagcttcctcacccgccagcacgatgcgctgctgggcgcggaggacccgaagctgagcgagatggcgctgctggccagcgtggtgcacacgtaccagaaggaccagaagcgcgcgaagaccctgcctgctgccagtggcggccagggcggtggcaacggcggcgtctccccgtggaagctggcgctgcgcgcgcgccgctaa

SEQ ID NO: 8877 - DNA, 369 bp, Myxococcus xanthus
atgagtcaggccctggcgcaggatttccgggaccgggcgctgggcctcttcgtggaccgcgagcacagctacgcgcgctcctgcatcagcggcccgggccgcccgtccaaggccgtggaaggtgaggttctggacgtcatccggcaggcggcgcgctggctggacgtcgagacgggcatgctggcccgcctcttcggcggcggaaacgcggcacgcaacctgttggctgcggcggtcgacttcggcaacgaacctggacggtcgggtccgcccgctccgccggagccggacgaggacgaccgcttcgtggaggccaagctgacacaggctcgcgcttacatggagcagtacctgaacacccggaagtag

SEQ ID NO: 8878 - DNA, 1563 bp, Myxococcus xanthus
atggaccagactcccgagaaggaccccctccgcgcacgtctcgagaagatggagaagcaagccgagctgggtggcggtgccgaccgcatcgccaagcagcacgagtccggcaagctcaccgcccgcgagcgcatcgacctgctccttgaccccggctccttctgtgagctggacaagttcgtcacccaccgctcgagcgagttcggcatgggcgacaagaagattccaggcgacggcgtcgtcaccggctacggcaccgtggaaggccgcaaggtcttcgtcttcgcccaggacttcaccgtcttcggcggctcgctgtcgggcgcctacgcgcagaagatctgcaagatcatggacctggccacccgcgtgggtgcgcccgtcatcggcctgaatgactcgggcggcgcgcgcatccaggaaggcgtggagagcctggccggctacgcggacatcttcgtgcgcaacacgctggcctccggcgtggtgccccagatttcgctcatcatgggcccgtgcgcgggcggcgcggtgtactcgccggccatcaccgacttcatcatgatggtgaaggacacgtcgtacatgttcatcaccggcccggacgtcatcaagacggtgacgcacgaggaggtgtcgaaggaagcgctgggcggcgccgtcacgcacaaccagaagtccggcgtggcccacttcgcggcggagaacgagcaggccgccatcgtgatgacgcgcgagctgctctccttcctgccctccaacaaccaggaagaggcgcccgtccagccgtgcgaggacgacgcgttccgggccgaggagtcgctcaagacgattgtcccgagcaaccccaacaagccctacgacatcaaggaagtcatcaaggccatcgtcgacgacaagcacttcttcgaggtgcaggagcacttcgcgaagaacatcgtcatcggcttcgcgcgcatgaacgggcgcagcgtgggcgtcgtcgccaaccagcccgcggtgctcgccggcgtgctggacatcgacgccagcatcaaggccgcgcgcttcgtgcgcttctgcgactgcttcaacatcccgctcgtcacgctggtggacgtgcccggcttcctccccggcaccgaccaggagtggggcggcatcatcacccacggcgccaagctgctgtacgcctacgccgaggccaccgtccccaaggacaccgtcatcacccgcaaggcctacggcggcgcctatgacgtcatggcgtccaagcacatccgcgcggacatgaacttcgcctggcccaccgcggaaatcgccgtcatgggccccgagggcgcggtcaacatcatcttccgcaacgagctggccaaggccccggacgccgccgctgagcgggcccggctgacggcggactaccgcgacaagttcgccaccccgttcaaggcggccgagctgggctacatcgacgaaatcatccgtccggaggagacgcgcgcgaagctcatccgctccctggagctgctgaaggacaagcgccaggagaacctcccccgcaagcacggcaacatcccgctctag

SEQ ID NO: 8879 - DNA, 801 bp, Myxococcus xanthus
gtccacagcttcacctaccagctcacgaactatccccaggggaagctcgacaccatcgccgactcgaagttcgacctcgccatcgtcgagctgtcgcgcgacggctccgatggctggttcaccgctgccgaaatcaccgcgctcaaggccaagggcaagcaggtgctcgcgtacttcgagattggcgccatcgaggagtatcgccccgagtggccccaggtgcccgatgacttgaagctcggccctgtggccggctggcccgacgagcagtatgtgaagtactgggacgagcgctggtggcccatcgtccagggccgcatcgaccaggcgctcgccgcgggcttcaccgggtgctacctggacatggtggtgacgtatgaggagattcccgcgaactccgcgggcaccaaccgcgccgacctcgcgcggaagatggtggccctcatcgcgcgcatcagccagtacgccaaggcacgcaacccggccttcaaggtgatgccccagaactcccccgagctggtggatgaccccgcctacctgcccgccatcgacggactgggcatggaggacatgtactggtccgacgacaacgcctgcgacgagggctggtgcgaggagaaccggacgaacgcggcccgggtccgcgcggcaggcaagctggtgctctccactgactacgccattcaggccgcacacatcgcggatgcctatacccgctcacgcgcggcgggcttcgtcccctacgtctccgtgcgcgcgctggaccggatgacagtgaacgcggggtgggatccgcagtag

SEQ ID NO: 8880 - DNA, 687 bp, Myxococcus xanthus
atggcacgggccctccgcgacccggagaaactccaggacgtcctgggtctggcccccgtgctcgcgccccccgtggcgatgcggcggctggtggagcggctgatgagccacgcctccgcggcccaggccttcatcgagcgcccgcgcgtgggcctgctccacctggccgcgctgcgcgccctgcccgaacacaccctgggacgtgccttcgtcgaccacctggaggcgaaccaggtgaaccctgacgcactgccctacctggaggcgcggaccgacgaggagtacgtgcgagcgcacctgctcgaatcccatgacgtctggcacgtcctcaccggctttccgacgagcgtggcgggcgagctgggcatccaggccttcagcctggcccaggtgggcagccccttcgccctgggcatcctcgcgggcggcctgacgaacaccctcctctacgcgttctctcagcgcgaggagcgcatgcgcgccatcgtccggggctggctgctgggacaacgggcccgaccgctcttcggggcaccgtggtgtcaaatgtgggagtcgcccctggcggaggtccgccagcgctacggcctggacctggcggcggtggatgcagtgcttgacgaccccatgcgtccggccatggaagtcaggaatccaggcagcgcgtccccgccccaatcatgctag

SEQ ID NO: 8881 - DNA, 1011 bp, Myxococcus xanthus
atgccgttggccctgctgctgtccgtggcgggctgttcgcgctcgtccagtgatgcgtcacccgacgggacggtgacgttgctcaacgtctcctatgaccccacgcgggagctctacgaggacttcaacgcggccttcgcgaagcactgggcggccacgcgtggccagcaggtgtccatccagcagtcccacggcggctccggcaagcaggcccggtccgtcatcgaaggactgcgggcggacgtggtgacgctggcgctcgcgtacgacgtggacatgctgcacgagaaggcgcagctccttccggcggactggcaggaacggctgccccacaacagcgcgccgtatacgtccaccatcgtcttcgtggtgcgccagggcaatcccaagggcatccgtgactgggacgacctggtgcgcgaggacgtcaccgtcatcaccccgaacccgaagacgtcgggcggcgcgcggtggaactacctggccgcgtgggggcaggcgctgaggggcgagggcggtagcgaggcccgggcccaggcatacgtggagaagctgttccgcaacgtgccggtgctcgactcgggcgcgaggggcgccaccaccaccttcgccgagcggggcctgggggacgtgctcctcgcatgggagaacgaggcctccctcctcatccgcgaggtggggcaggcgcgcttcgaggtcgtcattccctcggtgagcatcctcgccgagccacccgtcgccgtggtggaccccaacgtggaccgcaagggcacccgggccgtggcggaggcgtacctggcgtacctctattcggacgagggccaggagatcgcggcgcggcaccacttccggccgcgctcggaggtcgtggccgcgaggcatgtgtccgacttccccggtttgaagcgcctcacgttggcggaagtcgcgggcgactggcggcgggcgcaggccacgcacttcgccgacggcggcctcttcgaccgcatctacgcgccccgcgcggactga

SEQ ID NO: 8882 - DNA, 1697 bp, Myxococcus xanthus
atgtcccgtcctactcgccaccaggtgctcccggggttccgtctgtcgctgggcttcagttggttctacctgggcctcatcgtcctcattccgctctccagcctcttcctgcggaccttttccctgagctgggaggagttctggggcaccgtgacgacgccgcgcgcgctcgccgcgtaccggctcagcttcggggcctcgctggccgccgcgctcgccaacgtcgtcttcggcctgctggtggcttgggtgctggttcgctaccgcttccccggccgcgacgtgctggagtccctggtggacctgcccttcgcgctgcccaccgccgtggccgggctcacgctcacgacgctgttctccgcgaaggggtggtacggccagcacctcgaagcactggggctcaaggtggcctacacgtccgtgggcgtggccatcgcgctgacgttcatcgggttgcccttcgtggtgcgcaccgtgcaacccgtgctggaggacatcgacgtggacgtggaggaggccgcggccacgctgggcgcctctccgtggcagaccttccgacgcgtcctctttcccgcgctcttccccgcgctgctcagcggcttcacgctggccttcgcccgcgcgctgggggagtacggctccgtcgtcttcatctccggcaacatgccgctgcgcacggagattgtcccgctgctcattatcacccggctggagcagttcgactacgcgggggcgacggccatcgccatcgtcatgctgggggcgtcgttctcactgctgctggccgtcaacctgctccatcgctggagccagcgccggctggaagcccggccgggagcgtgagcgccatgcatccgtccacccttgtcttgcgccgaagcgcgcgcagtctgagcggcccggcgttcgtccgttgggggctcatcggcgcggcggtgctgctgttgggcgtcttcctcatcgtccctctggtggccgtcttcaccttcgccttccagaagggctgggaggcctacgtcgccgccctgacgtacccgacggcgctggcggccatgcggctgacgctgctggccgcggccatcgccgtgcccttcaacctcgtcttcggcctggccgcgtcgtggctcatcgcgcggttccaattccggggacgctcgttgttgatgacgctcatcgacctgcccttcagcgtgtcacccgtcatcgcggggctcatcttcgtgctgctcttcggccggcagggctggctggggccgtggctcctggaccacgacgtccgcgtcatcttcgccgtgcccggcatcgtcctggccacggtgttcgtcaccttccccttcgtcgcacgggaggtgctgcccgtgatggaggcccagggcagcgatgaagaagaggcggcgctgacgctgggcgcgagcggctggcgcaccttcctgaccgtcacgctgccgaaggtgaagtggggcgtgctttacggcgtcatcctctgcaacgcgcgagcaatgggtgagttcggcgccgtgtccgtggtgtccggccacgtgcgcggagtgaccacgacgctgccgctgcacgcggagattctctacaacgagtacgacctggccggcgcgttcgccgtggcgtcgctgctgacgctgctcgcgctcgtgacgttggtggtgaagaagttcgtggagtggaggagtcagccgtcatga

SEQ ID NO: 8883 - DNA, 708 bp, Myxococcus xanthus
atggtgcaactggagcacctgggcggccgctatcccggccagctctccggcgggcagcggcagcgcgtggccttcgcacgcgccctggccatccgcccccgcgtgctgctgctggacgagcccttcggcgcgctggacacgcgggtgcgcgaggagcttcgggaatggctccatgccctgcacgagcgcacgcggttgacgacgttgctggtgacgcacgatcagcaggaggccttggagatatcccagcacgtggtggtgctgagcgagggccgcgtggcccaggcgggctctccctcggacatgtacgaccggcccgcgtgccccttcgtcgactcattcattggaggcgccagcgtgctgcgtggccacgtccaggcgggcagggcggccatgggggcgctgtccgtgacggctcccgccggcgtgcgcgagggcgagccggtgcatgcctttgtccgtccgcatgacatcaagctggcgaaggcagtcgcgggcgcggcgagcgcgtccaccgccaccggccgcgtggagcggctcaaacccgtgggaggctacgtgaaggtgttccttcgcctaccaagcggggacgaagtcacggtggaggtgccgcgctcggagttcgacgcgctgggcgtggcggagggggactccgtgcgcgccgacgtccggtccgccaccgtcttcgtgggggactactccatctag

SEQ ID NO: 8884 - DNA, 1413 bp, Myxococcus xanthus
atgggggagggcggctatgtcccaggggaacccctggagcaagacatgcacaaacgacacgcattgcgttcgatgttgtgggccgcgagcagtctggcgttggttggcggctgttccccggagccggaactgtccgacgcggaagcccttcccctggtgacgcaggagcaaggcgagcgggcctatgacccaggaccgggctggaacctggcgtggcaggacgacttcacgggcaacagcctcaactcggccaactggacggtgctgacgagcaacttcgaccctgtcaccaacaactgcaacttcggcacgggggagctggagttcccccgcgcgcagaacgtcaccgtcgctggcggcaagctcatcctcaccgcgcagcggacggcggacgcgccgtttgactcacgctgcgcgggttacgggccacgttcgtactactcgggccgcatccactcgaagggcaaggtggagcgccgctacggcaagctggtggcgagcatcaaggtaccgtccggctatggcatgtggcccgcgttctggacgctgggcgcgaacatctccaacgtcgggtggccccggagcggcgaaatcgacatcctcgagtggcactccaacgacgcgtcgtggatgaagtccgccgcgcactggttcgccaatggcgcgcagcagagctggggcacgggcgcgaaccgcgggtacagcatcgcggatggcttccacacgtacgaggtggagtggacggccaaccggatgatcttccgcctggacggcgagattcgcggcaacgagttcgcccacaacgaggcggccttccagcagaaccactacatcctcctgaacctcgccctgggcgggaactggtacggccacccgcacccggatgcgattggtctgccctggggccacacgaagacgatggaggtggagtgggtgcgctggtaccagccggggagcacgccgccgcccgcgtcactcaccaacgccagcttcgagaacggcatgacgggctgggccacctggagccccaacggcaccgaggccgcggacttcagcgagacgtacaacgggggccgcaccggcgcctatcacctgacgcactggacgaatggcacgcccttcgaggtctggacgtaccagccggtgccgggcctcgcatcgggcacatacaaggtccgcgcgtgggtgcgaaagagcggcgggtttgacctgtcgcgcctccaggccaagacgtgtggcgagtgcgcgcccgtgttcaccaacctggggaaccatggcgactggacgatggtggagacgccgcccatctccgtgacgggaggctacctggagctgggcttccacacccgcgccacgtcgggcaactccgccaacttcatccacatggatgacgtggagctcatccgcctctag

SEQ ID NO: 8885 - DNA, 1995 bp, Myxococcus xanthus
accctggacagcgtcggcgtggcctggcaccggctcgcgcaggaaggacagctcgacgcggcctacgagcaggatgcgctcgtcgccctgctccggacccggctcgcggccaaggacgccgaaccggtggtcctggtggggccttcgggcgtgggcaagacgtcggtgctccacgcgctcgcccagtcgctgcgcgcccccaccgccaccgaggccgagcgcgcccgcccgttctacttcctcgacggaagccggctcatcgcgggcgagggcttcttcggagactggcagcagcaggtgctgcgcgccttccgtgaggccaccgaggcccgggccctgctgtccctgggccatgccgtggagctcctcgacgcgggcaagagcgcccacagtgaccagaacgtggcccaactgctgctcccgctcctcgcggcgcgtgacgtggccgtcatggccgaggccacggaggagacctgggcccaggtggagcagcgcaacaccagcttcgcccggctcttctcggtggtgcgcgtcgcggagcccacgcccgatgcgctcggccgcatcgtcgccaaggtggcggaggacgacgccttggccgccgcgatgcaggtccagcccgacgcgctcgacgaggcgcgcttcctgtgccgccgcttcctgccctacggtgcccaggtgggcaacaccgtggccttcgtgcgccggctgctggcgtcctgtgcccaagcctcgcgcacctccgtcacccgactggaggccacccgccaattcgcctcggagtccggcatccccgagcacctgctccgggacgaccagccgctggcgtccgcacacgtgcgcgacttcctggcctcgcgagtgatggggcaggacgccgccgtggagcgcgcagcctcggtggtatccgtcctcaaggccggcatgtcggacgtgcggcgcccgctgggggtgctgctcttcgtgggccccaccggcgtgggcaagacggagctgtccaaggcgctggcggagctactcttcggtgcgaaggagcgcatggtccgcctggacatgggtgagtacgccggtccggacgccctgctgcggttgatgggagacggggagacgccgggctacctcacctcggcggtgcgccggcagcccttctgcgtggtgctgctggacgaggtggagaaggcccaccccgccgttcacgatgcgctgctgggcgtcttgggcgaaggccgcctcaccgatgcctccgggcgcttcacggacttccgcaacgccctcatcatcctcaccagcaacctgggcgcggacaccctgcgcgcccgcgtgggcttcgatgcgtcgggcggtgccccggacatggcctccctgcgcgcgcactacctctccgaggtgcagcgcttcttccggccggagatgttcaaccgcatggacgacgtggtcgtcttctcgccgctgtccgccccgctgctgcgccggttggtggtccgcgagcttgaagccgtatgccgccgtccaggcctctcgctccacgatgccctgctggaggtcacccccgccgcccaggactggctggccctgagaggcttcgacgcgcggtatggtgcccgccccttgaagcgcgcgctggagcgcgagctggtggtccccgtggcggactggctcgcggcgcatccccgcatggggccggcgaacctcacggtggacgcgggaaccacgggactcgaactgcgcgccgagtccctgggcggcgccgccgagggcgggggccgggaagccatcgagcggatcctcgaggaagcagccaccgtgcgcgcggaagtccagcgttggagccgctgcgcgcccatgcactccctgcgccgcgtcctggccgtcttcgacaaggtctcccggcacaccgcgtactgggaggagcgggcgctggccgaagaaaactcgcgcaagtcatcggaggcgcgagcgctggaacagtcgcttcgggagtgcgcccagcaggcg

SEQ ID NO: 8886 - DNA, 399 bp, Myxococcus xanthus
gggacacccgcgcccgccttcaccctccagacgctgacaggtgacaccgtgcggctggacgcgctccgcggcaagccggtggtgctggccttctgggccccctggtgcggcgtctgcggaatggagtcctccaacctctcgcagctgcgcaagctcgcgggggactccgcacatgtcgtgtctgtcgccgtggcctacgaagacgaggaggccgtccggcgcttcgcccaggagcacgcggtggactacccggtgctcctcggggatgacgccattcaatccgcctttcgtgtgaacagcttccccaccgtgttcttcatctcctcggagggacgcgtggaacgcgcggcggtgggctacaccaccctggccggactgttctggcgaatggtgctgtag

SEQ ID NO: 8887 - DNA, 366 bp, Myxococcus xanthus
atgcgagtcgaaatccgagcccggaacatccccctcacagagacccttcgaacctacgccgagcgtcgcgtgcgcttcgccctggaccggctgtccgacagggtgaaggaagtcgtcgtgcggctggaggatgccaacggccccaagggcggcgtggaccaggtgtgccgcgtggcactccgcctggaacacgggcgggagctggccatcgaatcctcggacaccaacctgctggcggccatcgaccggacgctggagcgcgccagcaacgccgtcacgcgggcggtgggccgcgcgcagcgccaggacggcacccggctgcgtgacgcagcctggcagcccgaggaggccgccgcgctgacatga

SEQ ID NO: 8888 - DNA, 414 bp, Myxococcus xanthus
gggctgcgccgcaagttcgagctgacgtccaccctcaccttcggggaggagggcatcagcgttcaggagcaggtgcaggtgagcgactccgccccggcccagccggacgtggccccccgcctctaccgtcgcgcgcaggacacgcggaacctggagctggcgaaaaacgcgttggtaggcaacaaggcgtcactgtggtcgcgcatggtggagcagcaggtgcgcattggtgcccgcgcggtgccggaggcccccatctgggccatgcccgcgaagaaggcccccacggacgccgcggccccggaggcggccagcaaggcgcaggcccccgcgacgacgggcgccgccagcccacccgccaaggcggctgccaagaagcccgcgggcagcaccgcgacgtccagcggcccgtga

SEQ ID NO: 8889 - DNA, 342 bp, Myxococcus xanthus
atgaagaagctactcctggggttcatgctggccgtggttcctgccgtgggctgtggtgtgggcgcggatgatgcgccgacggacaccgtggagacggtgacgaccgagtccggtgagagcatcaacctcgactacagccctctgacatcggaagaggagccgctggcgtcgatgggtgacgcggacggtgaggtctccgcaatggggccgaactgttgggtcacactcctgtactgcaaggaccctcgctacaacgactgggcgacctgtaagcagaacggcaagtgcacaaccaagcagttcgtcgacaactgcctcgcgctctacaagaagacctgctag

SEQ ID NO: 8890 - DNA, 753 bp, Myxococcus xanthus
gctctacagcgccatctatatgcaggaaggttcgtccggaaaggcgcacgacaacttccggcgagccctcaggtgaacccggacaatctggagtcgcgctacaacctggcactcaccctgatgaagatggggaagatggacgagtccaagaaggagctgcgcacgatcctggccgtcaatcctggcatctccgacgtgcaccacctcctgggtatcatctcctactcgaagggtgactacgacgaggccggcgagcacctcgcccgggccacgcaactggtccaggattcccccctgctgtggcacgacctgggcaccgcgctgatggagctgggccgctaccaggaagcgcgtgagtccttcgccaactgcgcccagttggaccccagcaacagcagctgcatcaacaacctgtccctggcccagcgcaagacggccctcaccgacgcggccttcaaggagatcaaggacacgcagcaggcggagaactccgcgcccgcgctcttcatgctcgcgcgtcagtaccgcgagaagggcctgctggcggaggaagaggccacctaccgcaagtgcgtcaagctggatgcgaagtacgccgcctgccacttcggcctctacgaactcttcttcgaagcccacaagcgcgagcacgcgcagatcgcctgcaagaacttcctgaagtacgggacgtctgaggaattccccacggagtaccagacgtgtgagagattcctgagcgacgcgacgttctga

SEQ ID NO: 8891 - DNA, 1071 bp, Myxococcus xanthus
atgagcgttcgtctcaccgtcacacagcgcagcgaggccggcgctgcccagagcaccgagttcgtcctcgacgacgcggtcatcaccctgggccgcgacaaggcctgccaggtcgtgctcgcccagcaggcggtgtcgcgcaaccatgcgcgcatctgccaggacgggccgctcttcttcgtggaggacctgggcagctcctacggcacgcagatcaacggcaagcccgtgcccaagggcgagaagcggctgctgcgcaacggcgacgtcatcgccatcgccacgttcgacgtccgcttcgagcgggtgatggacctgaaccccgaatctggcggggagaagacgtccttcatcgcccggggcatggtgaaggacgccatgcgcggcctggccggcggcggcgaggagcgctacctgcgcttcatgaacggcccccgcgaaggcgagcgcatcgagctgggggacgcgaaggaagtcatcctgggccgcgacgagaaggacgcggacatcatcctcaaggatgacctggtctcccggaagcacgcgaaggtgcgccgcgactggtccggcacgcacgtggaggacctgggcagccgcaacggcatcaaggtgaacaagaagcgggtcaaccgccggcagctcaaggacggggacgagctggaggtgggcgccacccgcttcctgtacgtggaccccaccgagccggccgaagagcccgttcagctcgccgccgaggtcaaggctccgcctccgccctcgccccgtcgtccgcgcccggagcccaagcccgtggagcccccgccggaggaggagcccgcgcctccgcccgaggagcccgcgcccgcgccggaagagccccccgccgaagagcccgcgcccccgcccgaggagcaggtctccgaagagccgcccccgccggtgtcggcggagtaccccatgccggatgagcccgctcagccgagcgcgatggcggcgctcaaggacaagggcaagctcgtgcctctcgtggtgatgagcgtggtgggcctggtcttcctggtgctgatgattgccgtgctcgcgggcgcctag

SEQ ID NO: 8892 - DNA, 750 bp, Myxococcus xanthus
atgttgctgggggcatccctggcctgttcggcctgctcggacggcggcaccagcggccctggcccctctggcgagagggagaagaacgtcgtcaagggcaaggccacggacaccgcgggcaagcccctggcgggggtggaggtggtggccgacaatcaggtcctctacgactccaatgtggtgggcgtgacgggcacggacggcacctaccggctggagctgggccaggcggccaccacctggaacgccagcgcgcggctcaagcgcgacttcaacggccgcagctacaccttcgaactgcaccccagcaacgccacccccttcgcgggcaacgagggcgccgtccgggacttcagctggaagctgaccggcgcgaagcccgagggcggcgcctacggcagcggcgtctacttcaacctgacggactacgtggatccggccgacccggatcaagccttgcagcgcgagcacgtggagttgacgctcaccccggtgggctcgctggtggacggcagcgccgggacgccggtgacggcccggggcaccaacacgccggacggcttcggcttcccggacctcccgctggggcgctacacggtgacgggccgctacgcgccgccgggacaggccgtccggccgctgctggtgcgcgtgcaggaccagggcacctacgccgaatccgtgacggctgacttccagcccgtcatggaggggttgtaccgcctggacgtggagctgaagttcccctga

SEQ ID NO: 8893 - DNA, 225 bp, Myxococcus xanthus
atgaccaccgccaccaccgccgccgccgccgccacgaaggccctcggagccagccagggtctctccgccctcgagcagaagtccctctccggcctgacgggtccggaccgtgagcgcgccgaggcgcagctcatgctccagaagcagcaggaggccaccgccttcgtggccaacctgatgaagaagctcaacgagatcgcgatgtccgtcatcggcaagatctaa

SEQ ID NO: 8894 - DNA, 225 bp, Myxococcus xanthus; identical to SEQ ID NO: 8893

SEQ ID NO: 8895 - DNA, 2124 bp, Myxococcus xanthus
atggctgccaccaattcgaacagcttcctctccaagtactccgacatcgtcctcgccgtggtggtcgtggccatcgtcgggatgatgatcgtcccgctgcccacgctgctgctggacgtgctgctgacgctgaacatcagcatctcggtggtgctgctcctcgtatccctctacgtgccagcggcgctgcacctgtcggtgttcccgacgctgctgctcatcaccacgatgttccggttggccctcaccatctccaccacgcgtctcatcctcctcaccggtgacccgggagaggtggtggtggcgttcggaaacttcgtggtgcagggcaacttcgtcgtcggcgccatcctcttcatcatcctggtcatcgtgaacttcatcgtgatttccaagggctcggagcgcgtcgccgaagtggccgcccgcttcaccctggacgcgatgcccggaaagcagatgtccatcgacgccgacctgcgggccggctccatcgaccaggaccagggcaagaagaagcgccgcgacctggagcgtgagagccagctcttcggcgccatggacggcgccatgaagttcgtgaagggcgacgccatcgcgagcatcatcatcaccgtcgtcaacatcgtcggtggcctcatcatcggcgtgacgcagaagggcatgtccgctggcgacgcggcgcagaagtacacgctgctcaccatcggtgacggtctggtcggcatgattcccgccatcctcgtctccacctgcgccggtatcatcgtgacgcgcgtggcgggtgaggaagagggcaatcacctgggcatggacatgggctcccagctgacggcctacccgaaggccatcgccattgccgccggcatgctcatcgtcctgggcctggtgcccggtctgcccaagattcccttcttcctgctgggcatcggcgcgggcctgggcgcctggacgatgctgaagaagcagcagcaggccgtggaggcggaggatgccggcccggccatggagacggacctgggcacgcccatggcatcggagcccgcgcccaaggaagccctcaatccggactccgagctattcatccccgtcgtcacgcccatcgtcctggaagtctccgacgcgctggtccccttcgtggactcgcgccaggacaacgggaagttcctcttcgaactcatcccgttcatgcgtgatggcctcttcgtggaactgggcgtgcgcttcccaggcgtgcgtgcgcgtggcaacggctcgctgccgccgggcgcgtaccagattcaaatcaacgaggtgcccgtcgtcaccggccaggccacgctgggccacgtcctggtgaacgacacggtggaccggctgcggctgatgaacatccagggcttcgaggccgtgaaccccgccacccggcagcccgccgcctgggtccccgagcagtaccgcgacacgctggaggccgccggcctcacgacgtgggacgtgcccggctacatcatcctgcacaccgccgccgtgctgcggcgcaacgcccgtgagttcgttggcgtgcaggagacgcagacgatgctggagcagttggagaaggccttccccgccatcgtgaaggaggtcgtccccaaggtcgtcaacgtgctgaagctgacggacatcctccagcgtctggtggaggaggagatctccatccgtgacttgcgcggcatcctccaggccctggccgagtacgggcaggtggaggcggacaacgtcatgctcaccgagcatgtccgcgcggcccagcgccgctacatctcccacaagtacgcgcgtggcaccggcaccctggtggtgtacctgttggacccgaacatcgaggacgccatccgcggctcggtgaagcggacctccgcgggcgcgcacctggcgctggagccggagctggcgcaggaaatcgtccaggccgtgcgttcggagtgtggccacctgccgcccagcgcgcagcggcccgtcatcctcacggccatggacatccgccgctacgtccgcaagctgctggagtacgagttcaacccgtcgttctccgtgctcagctaccaggagctgtcgcccgagctgaacatccagcccgtggcgcgcatctccacgcgatag

SEQ ID NO: 8896 - DNA, 465 bp, Myxococcus xanthus
atgacgactgaatccaaggcaacggtgaccaacgacgacgtgaagcccctgtccggcccggagatgctcgaacgggccacggaaggcttcaacctcttccaggacggccgcttccgtgagtcgctgaccttgttccagtccctggcggccatggaccccaccgaggcctacttccagacggcgctgggcgcctgccacctggcgctggaagacctggacctggccgagtcctacttcaaccgcgccatcgagctggacccctccgacctcacgcccttcgtcaaccgcggggaagtacacctgcggctcggcaaggtccacgaggccgcccgggacttcaatcatgcggtggggctggatcccgaaggacaggatccgctcagcgcccgggcccggatgctggccgccgcggcgctggagagcgccgagggggcgccgtcttccgaatccgacggcgcggcgtag

SEQ ID NO: 8897 - DNA, 252 bp, Myxococcus xanthus
atgacgctggagcgcttcgacgaggcgttcgacgccttccggctggcgctccagttcaacgacggccacgtggacgcgctggtcggccggggggaaatccagctgcgccggggcaatgtccccgaggcgctcgcggacctcagcaaggccatccagctggacccgggcctcaagcgccgtgccacgcagcgcgcccacgcgacgctgcgcaccctcaagcagcaggccgaccaggtgaagaagtcccggtag

SEQ ID NO: 8898 - DNA, 1167 bp, Myxococcus xanthus
atgtcgaacggcatcggcggagttggcggtaaccggcagctcaccacgacgcagggcgtgggtaacgtcaacacctcgacgatcgcgcgcaacgcgcagctcatcgagtcgacgctgaatctggttgagaaggccgttgaccttgcgggcaaggcggtgaacgtcgccggcaaggccgtggatcagatgtcccaggccgcggcccccacgaagcaggcgggtgcgacgggcaccaacgccgccttccccgccgagcgtcccaaccccctggacgcggtgcgcgaggccaactccctgaaggtggaagagggcaccgggaagatcaccaccccgggcggctacaccatcgagcagctgggccagttcgagtggcgcgtgacggggccggacggcaaaaacacccgcgtctggggtgatccgcacgttgacgagagcgacggcggcaagttcgacttcaagcgcgacacctccttcgtcctgggcgacggcacccgcatcaactgctcctgcaagccctggggcaacggcatgacggtgacgggccagctggacgtcgtctacggcgacagccacgtgcgcgtgacggacatcgacaagggcaagggcaaggtcggccaggtcaccaacaagggcatggacgaggtcgtccgcttccactcgaaccagtccgcggacgtcttccacatggggcagaacgcggccgactggacgttccatggcaaggagattgtcggccacgagaacggcggcgacgtgcacaaggtgggcgaggccgtcatcaccgagcggcgcaccatggccttcaactactcggcggcggcggactcccccgcggcgggtgaggtggcccagaattgggacatgaacaccaacctgccccaggtgaagccgctgccctgggacatgagcagtgccaagcccgagctgaacaagctgaacgagacgttcgactccatcagcaaggtgttcgaccagctcaagaacaccaacgcgaacggcttcaacccgttccgcaaggcggacgacctcttcggcgcctacgacaagaaccagcacaagtccgggctgacccagtccttcaaggcgctgggtgacatgttcgggacgctggagaagctgtccaagctgaatgatatggtccgcttccgcggtccccagtcgttctag

SEQ ID NO: 8899 - DNA, 180 bp, Myxococcus xanthus
atggagaccttcctcaagagcaacccgaacgcctccgccgacgacgtcaagtcgcacgccgagtcgacgacgaagaagcacgagacgaacgcgatgttccagaagatgcgggacgacaacttcttcgggaagctgatgagccgtcgcaaggagctcctcaaggacatgtggggcgagtag

SEQ ID NO: 8900 - DNA, 837 bp, Myxococcus xanthus
atggacgcggatgaagggctcgtggcccttgggttcacggaggtggaggcgcgggtgtactgcgagctgctcaagggggcgcccgccaccggataccggctcgcgcaggcgctggggaaggcgcctccgagcatctaccaggcgctcgcctcgctcgaacacaagggggcggtactcgtcgaggagggcgagccccgctccttccggcccgttcctccggacgaagtgctcacggcgctccagcgtggcttcgacacgcgcaggcgcgaggccgcggacgcgctgcgcaagctccacgccccggtgcaagacgaccgcatctaccacctcaagagccacgcacaggtgatggagcgcgcgcgggcgatgattgccggcgccaccgagcgactgctcttcgacctcttcccgccacccctcgcggccctcgccccggcgctcacggaggcgagcgccaggcgcgtgtccgtcgtggggcttgtctatgacgaaccccccaaggctcccttcgcctccgtgcgctcgtccagcgcggacttcgttcgggagcgctggccgggcgcgcaactgacgctcgtggtggatgcccgcgagttcctggtggcgctgctcacgccggatggcaccggcgtcaagcaggccatctggagtgacagcgtctatctctcgtgtctgcaacacagtgggctggccgcggagatccagctgagcgctcctccgtccgcgcgcgcgcggatggcgcggtccttctccctcatcaactcgagccctccggggttgcgccagctcgtcgggcgacagccccgttcctcttccaagcgcggagacaccccatga

SEQ ID NO: 8901 - DNA, 1032 bp, Myxococcus xanthus
atgtcgggcggttgtaccgagagcaaggtggcggaggaccaggacatcgtcctgagtggacgactcgttgacgaggcgggcgcgccgctctcggacgcgctgctgaagctctaccggagtgagaactccgcgtgcgcgttcgctgccttctcgtcgagctggaggtcggtgaagacccgcgtcgatggcaccttcgaggtcgacctgctgggggcggacacccgcaacgggagcatcgcgcgttgcttcgtggcccgctcgcccgagcagtcccagggaaggcgcgtttcggccttcttcctcatccagcagtcggaggtcgcgctgcccgtcatccaggagtggaccggcacgatgacggccaccgcgcaggcgcagggcgtgagcgtgggcttccggccgctgtccgccacccacggtgccgggaacaatgagcacgtgctgtccctccacccgtcgagcgccagggaggcctggcaggtgctcaaggccacctcgccggtcctcctgagcgactacgtcctcgaggacgcggaggggctcaaggcttccatcatcacgacgcgcgatgtgaatgcggggggcgtgacggtcggtctcacctataccagcgatgacgttgtcctgcctcgccgcgccctcgtcccggcaagccgtggcgcggcgtgcacctacctgaacgccgagacgccctgccgcgtcaccaacggcgacctcggcgggattgtgctcttccaggagggcgtccgtgaagtcgccgtgcagctctcgcggcccgtggtgcctcgcaaggccgtgctgcgcaacttcggggtgacgggcaccatgagcgagctggtgctggagggaagcgccgacggcgcccagtggatgcccctggccaacttgctcgatggcgccagtgtgcagtccttcatggaagtggacctcacgggcacgacaccggtgtcgcaggtccgtgttcgggccactccgcaagagtcggtgggcgcgttgcgctcgctggggcagctctcgctcttcgaggagtga

SEQ ID NO: 8902 - DNA, 384 bp, Myxococcus xanthus
atgcacttcgccgtgctgaactgcgcgggcaatgggccggtgaccttcaacttcagccgaggcacgggggccgacagtgtgcagctcaaccctggacagatggggaacgtcaagctcggggcgcacatcgctccggccctcgccgccacgcgcgtcaccatgggccggtggaccgaaggcctgcccgcgagcggctcctcgtacgtctccaacgccatgtcggtggccgacaattctggcacggcggacgccgtgcttgcctgcggagacatcatcacccgctacaccatgtcggacctgaccgtccccgcctgccacaactacgctgacctcgcgctctgcaacggcacgaactgcagcaacgcttgctattacacttggtaa

SEQ ID NO: 8903 - DNA, 1026 bp, Myxococcus xanthus
atgccctcacagcgaggggagggcgagtcctcgggcgggctgcgcctcatctccgagtcccccgtcgcactgggggatgccgtggacgtctatgtcacgaagaaccacgcctacgtcgtctccatcgacgacctcggcggcatcggcaacggcgggctcaccgtcttcgacgtgagtgacagggcgcaccccatcttcaaggcctccatcagtctgccgggggactcgagctggaatggcgtgtgggccaaggaggatgccctctacatcgccggaaaccgcgcgggcgtcgtcgtctatgacatctccaaccccgcgcagccagagtacgtgcgccacctgcccgcggggcagggggcgcacaccgtgctggtggatggaaaccggctctatgcgatgtcgcccggcgaggtgacctatgttcacgacgtcacctcgccgctggcgcccgtcctgctccagctcatcaccgtgccgtccgagttctcctcggggggcgcgcacgacgccttcgcgtacgagggccggctctacgtcagcaatggcttcggtggttactccatcatggatgtcaccgacctcgacaacgtgcggcacctgggccagtacgtgcacggcttcaacgcctacgcgcaccacagcgccgtggggaccttcgccgggcgcaccatcgccttcgagggcacggaattcaatggcagccacctgcgcgtgctggacgtcaccgacccggcgaacatcgtcaagatgggtgagttccgtctcagccccgtcacgtccatccacaacctgattctgaagggccacctgctctacatcgcctggtatcacgagggcgtgcgcgtgttggatgtgtccaaccccacgaagccgcgccaggtggcgcactacaacaccttccgtgagagcgaccccggccgcacggacaaccttttcgagggcaccttcggcatccgagtacccggcgacgggtacgtgtacgccgccgactccgtgcgcggtctgctcatcctcaacgaactctga

SEQ ID NO: 8904 - DNA, 789 bp, Myxococcus xanthus
ggccgctggatgtttggcgggtggctgctgttcgtcgtctggctcagcgtggagtacgtgcggctgcccgacgtccgcgcgcttcagacgcagaacccgcgcaccaccgcgctcatcacgcagcgggccgaggaggcgctggcggaggggaagaagccccgtgtacggcaggcctgggtgcctctggaggcggtggcgccgcatgcgttggatgccgtgctgagctccgaggacgcgcgcttctacaagcacgagggcgtggattggatcgaggtggagaacgccctcgaacagtccgtgcggaaggcgcgcctgggccgcggcgcgtccacgctcacccagcagttggccaagaacctctacctctccacggaccgcagcctcctgcgcaagggcaaggagttgctgctcgcccgccaactggagacccatctgtccaagcagcacatcctcacgttgtatgtgaatgtggtggagtggggagagggcgtgtacggcatcgaggctgcggcgcgtgagcacttcggtacctcggcgcgggcgctctccgtggcacagggggcgatgctcgcgggaatgctgcccgccccacgccgctggctgcccgcccagaagcccgagacgctgcgtatccgggctggcgccatcatcgggaggttgcagcgcgagggccgcatcaccgcgacgcaagcccgcgaggctcaggccgaactctcgcgcttcttcggcgaaacctccgtgcccggctccgtggtggaggccatctcccggctgtcctcggagagctga

SEQ ID NO: 8905 - DNA, 1554 bp, Myxococcus xanthus
atgggcctgggcgccgggcttgccgtgattgcttcacgggcaacgcggagcgccgaagtcgaagcgcgcatcgcggcacgccaggagcccgtcctgacacctgcccccggccccgcgccgcaagggcttcccgtcgtgacgcctgccgggcgcgaggagggtaaagtcccccaagggcatgtggacggggtggcactgcgctcgctcctgctccgacgccagttcgaggagctgacgctggcggtcgagcagctccagtggggcatggagtcgaacccccaggacgagcactggatgaccgacggcatcctggcgctcggcaacggctcctccgaatcgacggagctcctcgacgcctgggtggaagcgtcaccgcgctccttcgcgccctacctcgccagggggacccactgggtgtcggtgggatacctgcgccgcggggggaagaccgtgggggcaacggcgaaggaggaattcgccgggatgcatgaggccttcgaacgcgcggtgcccgatctcgtccgagcgtggtcgctccagccgaaggcggtcgcggcggcgcggccgctcatctacgtggcgaacgcgctgggcgacgatgaggctcgcgagcgcgcctacactcgcgccatggagcagtgccccacgtgtgcggacgtccgggccgtctatctccacggactcgccccccgctggggcggcacctacgagaagatggacgccttcgccgaggcgcagagccttgctcaccccaaggtgggcttcctgcgcggctttgccgattttgaccgcgcacacgacctagtggtccagggcaagaacgaccagggactggtcctgctcgcccaggcactgtcagccggcgactactgggagttcaggctggctcgggcgaagcaactgcgccgcaccaaggccctggacgccgcgctggaggaggcgaaccgggccgtggccctgcggcccgctcgtgcgtccgtctatttcgaacgggctcggattttctccaacagccggaagtgggaacccgcgggcaaggacctcctgcacgccttgcggttggacgcgacggactcggacggacgggccctgcgggaccacgtggtgaagggggtcatctacgacgcctgggaggcgcacaaggccggacgccgcgaggaagcgttgggcctgctggaactggctggggagctcgctccaggcaaccccgaggtggcacggcggcgcgcatgggtcgtcaaatctccacagcaggcggaggcgcgggccgaggagaagcaaggcgagggggcggaggacttccgcaccgtgcagcaacgggactacgccctggcgcgcgagcggcgcttcaaggaaatccttccgctctgggatgccttcatcgaacgcaatcccgaccacgggctggcctacatggagcgcagcgggacgcactaccacctgcgggacctcaagtccgcgctgtccgacctgaagaaggcgtgtgacctgggcgtcaacgaaggctgtgcccgggcgcgccaggtcgagcgcgccaaggccgcggcccgctga

SEQ ID NO: 8906 - DNA, 1083 bp, Myxococcus xanthus
atgctccactcgcgtcgtttcgtcctggccctctcgtccgtggtcgcggtcgccaccgcctgcagttcgccggatccagtcccggaccgccccaacatcctgcgcttcgaagcaaacccggcgaccatcgctccgggcgtgtccgccgagctgtcctgggaagtcaccggcgcgcaggacatctccatcgattacggcgtgggtgaggtgaccggaaggtcggtgcaggtccgcccgacagcgacgacgacgtacacactctcggcgaccaacgagagcggcagcaccaccgcgagcaccacggtcgcggtgagcacgtccgatgggacgaatctctccggaagtctcacgacgcgcacactgacgcgcgcgggctcgccgtatcgcgtgaccgatgacttgacggtgcccgcggggagccggctcaccatcgagcccggcgtccacctcattttcatgggacaccacaagctcgccgtgcatgggcgaatcaccgcgcagggcaccgcggccagccccattgtcttcaccgccaacaatcccacccgaggctgggctggactgcgcctggcggcgacgtcggacgccgggtcggacttcctggaacactgcatcttggagtacggcaacaagatcgacggcgagaacggcgcgggagcggagggctcctattccgagaacgccggtggtgcgctttggattggctcacgcgcgaacgtgaacctgaaccacaacgagttccgcttcaacaaggcgcccgcgttcggcggcgcgctgatgctgattgcgccgaccagttcgggtgtcgccaccgggaacatcttccacgacaacgaatgcaccggtccgcgaacccagttcggaggcgtgggcggcgcggtcaacaccgcgcacctcccggccagcaatcaatggacgttccgcggcggcgagttccgtaacaacagggcaccagagggcggggcactctacttcttcgacagcaacgtgctcctcgacggggtttcgctgtctggaaacagcccccagaactgggcgacgccggagccacaccggctgacgctcatcaacacgccgaggtag

SEQ ID NO: 8907 - DNA, 1831 bp, Myxococcus xanthus
ctgccgctggacgtcctcttcgcgccgcgcagcgtggccgtcgtcggggccaccgagcggccgggcagcgtggggcgcaccgtgttgtggaacctcatcagcaacccctttggcggcaccgtctaccccatcaacccgaagcggcccaacgtgctgggcatcaaggcatggccgtccctgggggccttgccggagcgggtggacctggccatcgtcgtcacgcccgcgcgagcggtgcccggcgtcatccaggagtgcgcggagctgggcatccgcggcgccatcatcctctccgcgggcttcaaggagattggggcggagggggagcgcctggagcaggagatcctccgcctcgcgcaggcggcccaggtgcgcatcatcggtcccaactgcctgggggtgatgcgcccgcccagcggcttcaacgcgacgttcgccggcgccatggcccggccgggcaacgtggccttcatcagtcagagcggcgcgctgctgacctccatcctggactggagcctgcgcgaggcggtgggcttcagcgccttcgtgtcggtgggctcgatgctggacgtgggctggggcgacctcatcgacttcctggccgacgacccgatgacgcgctccatcctgctgtacatggagtccattggcgacgcgcgggccttcctctccgcggcgcgcgaggtggcgctcaccaagcccatcatcgtcatcaaggctggccgcacggcgcaggccgcgcaggcggcggcgtctcacacgggctcgctgacgggcagtgacgaggtgctcagcgccgccttccgccgcaccggcgtgctgcgcgtggattccatcgccgacctcttctacatggcggagacgctggcccggcagccgcgccccgcgggccggcgcctcacggtgctcaccaacgcgggcggccctggggtgctggccacggacgcgctggtgtcggggggcggcgagctggccacgctcagcgcgtccacgttccaggccctggacgccttcctgccgacgcagtggagccacagcaacccggtggacatcctgggcgacgcggacccggagcgcttcgcgaaggcgctggaagtcaccggccaggacgaaggcagtgacgggctgctcgtcatcctcacgccgcaggacatgacggagcccacgcagacggcggaccgtctcaagccctacgcgaagctgcatggcaagccggtgctggccagttggatgggcggctcggaggtcgcggccggggagcgcatcctcaacgatgcgggcatccccaccttcggctatccggacacggcggcgcgcatcttcaattacatgtggcgctacacgtacaacctggcgggcctgtatgagacgcccgcgttggcgcaggcggtgagcagcgcccgggacgaggtgcgccagtgggtggagtcagcgcgcgcggaagggcggacgctgctgacggagtacgagtccaagaagctgctcgccgcgtatggcatccccaccgtggagacgcggctggcggtgacggaggacgccgcggtggcggaggccgcggccctgggcttcccggtggtggtgaagctccactcgctcacggtgacgcacaagaccgacgtgggcggcgtgcggctgaaccttccggatgcggagtccgtgcgcgccgccttccgggacatccggacgcggctggaggcgctggggcaggggcgcgcgttcgacggtgtcaccgtgcagcccatggtgcggctggatggctatgaactcatcctgggcagcagcgtggacgcgcagttcggtccggtgctgtcttcggcgcggggggctttag

SEQ ID NO: 8908 - DNA, 342 bp, Myxococcus xanthus
atgggctcgttgtcggcggacccggtgtacttcgagctcgactcggccacgctgcggcccgagtcgcgcgacatgctcgcgcagctcgccacgggcctgcgggagcgccccctgacgcgggtgacggtgtcgggccacacctgcgaactgggcaccacggagtacaacatcgcgctgggccaccgccgcgcggccgtggtgcgcgactacctgcgcaacctgggcgtggagtcctcgcagctctccatcgtctccttcggcgaggagcgcccgctgtcggacgcgcacacggaagatgcgctccgtaggaaccgccgcgcggagttcaccttctcctcgtag

SEQ ID NO: 8909 - DNA, 1356 bp, Myxococcus xanthus
gtcctcgtcgtcgacgaccacgtcgagatggggcagatgttgaaggaaccgctgacggacgacggctacaaggtcgacatcgccaccggcggcgcggatgccatcgcccaactgcgcgcgcgcgtctacgacgcggtgctgtgcgacctgcgcatgcaggacgtggacggcttcgacgtgctcgacgccgcgcgcaagctggacccggacctgcccgtggtgatgatgacggccttcggcggcgtggagagcgccgtggaggcgatgaagcgcggcgcgttccactacttcaccaagcccttccggctggacgaggtgcgcctgtcacttgagcgcgcgctggagcagcgccgcctgcgcaccgagcaccgcacgctcaagcagcaggccgcggaccgtgggggcctgggcgccctggtgggcagcagcaccgcgatgcgcgacctctacgcgttgattgagcgggtggcctggtccggcgccccggtgctggtgcgcggcgagagcggcagtggcaaggagctggtcgccagggctttgcacttcgagggcacccggcgcgcggggcccttcgtggccgtcaactgcaccgcgctgccacacgcgcttctggagagtgagctgttcggccacgtcaaaggcgccttcaccggcgccaccacggcccggcgtggcctcttcgtggaggcggacggcggcacgctgttcctggacgagattggcgacatggcccccgaactccaggcccggctgctccgcgtgctggaggacggcgaggtgcgggccgtgggcgcggacggctcgcgcacggtggatgtgcgggtggtggccgcgacgcaccaggacctggagacgcgcgtcaaggaaggccgcttccgcgcggacgtcttctaccggctcaacgtcgtcacgctgcggctgccgcccctgcgcgagcgccgcgaggacatccccgcgctcatcgagcacttcctccagcaagccaaggcgcgcaatccgcgctccgtcgtgcagcggttctccccggagacgctggcagcgctgggggccctgccctgggcgggcaacgtgcgcgagctggagaacctggtgcagcggctggtcgtgctcggctcgacggaggtggtggatctgccgcaactgcgcccccatttgccttcggacaccagccaggagaatcacccgctggccgctgcacagcgcaccatcgttcccctgcggcagttggagacggagtacatcgcctgggccgtggcccgctgcgggggaaacaagacgaaggcggccgagctgctcggcatcgacgtctccaccatccaccggcgcgagcgcgcggaaggcaatccgcaacgctga

SEQ ID NO: 8910 - DNA, 2115 bp, Myxococcus xanthus
atgcgcctgcctgtcctccccgtgctgctgctgtgtctgatgctctctggcgtcatcgcgggcgtcctgcacttcatgcagcgcgaccggcaagcgctggtggaccagatggcccgcgagcgacaggcgcagctcctggaggccgtgcgcggcgtctccgccgccctggagagcgcggaggaggacctgcgcttcgcgggcgagctgctggcccagccgggcaccgccgaggagcaccggcgcgagatgcgcgccctgctggaggcggtgggtcagtacaaggccatcctcgtcttcggcacggatggacaggaacggctccgactggtggaccggcgcagcgcggcggcgatgacgcaccagttcaccgcggaggacctggccctcaccgtggcgcaggcccgcagtcatccgccgggccacgtcatctcatccccgccccttccccgggcccaatcgggctggctgcgcgccttcgccaccgcgttgccggaggacgcgcaggacagcggcggcgtcgtcgtggtgctggtggacgccgagccgcgcttcgccccgctgaagctgctcgcgtcggactcggagacgcaacttctggtgctgggagtccatggaacgccgacggcgttgacccacccgaacctggcggacaggtaccggcggttggacaccgacggccaccagacgcccggcctcgcggcgctggcgcgggcgcttcgcgcgggtgagtcgggcacgcgcatcatcgagcgcaaggaggccgcccggctcggcctgggcgactcggaggtggtggccaccttcagcccggtgcggttcaagaatggcgcggcatggccggtggcgacgctcgcgtcgacgcgcgtgctccggatccatgagcgcggcctggtgctgcgcctgtcgctggcggcggtgctcgtctccgggttcctcatcgccttcggagtgtacgtggtgctcgcgcgcagccgggcggaagccctgcgggacagccagctccatgcgcagcggctggcgcacctgcacgacaagacgcagaagattctcgacaacatccccaccggggtcctggcgctctcctccacccggcacatctccgccgccaaccgcgcgctgagcgcccgcatgccggcggacgtcgtgggccagcccctgacggcggcctttccccaggcccaggcccccgtcatccagcgactggaggacctggtccacgcggccacgagcgacggccgggtgcgcagcctccacggtgaaccgctctgcctcttcgaagagcccggccagtacaacgtccacgcggtgccgctggagccgaacacgccggaggtccacacgctggtcgtcatcgaggacctgagcagcctgcgcgcgctggaaggacaactgctgcgcgcggagaagctggccacggtgggcgtgctggcggcgggcatcgcccatgagattggcacgccgctgggcatcgtccgcggccgggccgagtacgtgcaggagaagctgggacgcgagcacccgcaggcggccggcctgggcaccatcgtcgggcagatagacagggtgagccggacgctgcgccagttgctcgacttctcccggctccggccagcggacgcgcagacagtcccactggagcccctggtgcacagcgtgcgggagttgctgtggatggaggccgagcggcggcgcctgaagctggaggtgacggtcgcctcgcccgtgcccgcggtggcggccgaccccgaccagttccagcaggtgctcatcaacctggtgctcaacgcgtgtgacgcgtgcggggccggcggacgcgtccggctgagcgcgagcatggacaccggagacacaccgggcgcctggggcatggtgcgcgtggacgtcgaggacaacggctgcggtatcgccccccgccacgtccaccaggtcttcgaccctttcttcaccaccaagaagcgcggccagggcaccggactgggcctgacgatggtggcgcacatcgtgcgcaaccacggaggccgtatcgaactggacagcgcgccagagcgaggcacccgcgtcaccgtgcgctggcccgccgcggcacccgccggagaggagcgacatgtcgtctag

SEQ ID NO: 8911 - DNA, 705 bp, Myxococcus xanthus
atggcggagctgaacggacggctgggccgcaagcgcgacgcgagcctgtgctggacgcgcgcgctgtggtccgcgtccgacaccgaggccaccgagcttgcactgcgctggtccgattcagaaaacgaaggaggcgccacccccgccgaacggatggcgtcacccgcgcccacgggcgatgacgtgcgcagcgtcgccagcagcctggtgcgcgcggtgtgcgtcccaggtgcgcccgcgcctgtcgacgtggcggcactgcagcggtggctggaccggcatgacgcggagctcgacgtccgggcgctctggctcacgcggacggcgctcgacacgctggcgggtggcgatgcactcggacttgcgcgagcgggcgaccggctgctggagatgcttcagcgaggactttccctcgcgagagacgtgccgcgcttcctgcgaggtggcaccgattcggcccatgcgccccgggtgctggcgcagctcgaggccctgctggagcggttcgagcacacaccccgtcgccgctcgtccatcgaagcggcgcccgcactcacgctggcctatgtccgctatgtcttcgccgtgggactcgcgcggctcgggcaggcggaccgtgcccgcaccctggcgtccgcggcgggggaggcagtcgatgcgaaagagccatccacggcttcctttccgagcgtacggcgcgcgcgt

SEQ ID NO: 8912 - DNA, 1578 bp, Myxococcus xanthus
atgaccatcaccccggatggtggatggaagctgaacgccagcggacaggtcgaagatgcatcgcccaccgacgcgcgcgatgtccggcaccaggtggcgctcgacttcggggcggcgctgcgggggagcgccggcgcgacgctcgcgctgcagcccgacgcggagcgcgacggccgcgcctggaaggtggtgcgcgtcacctttggcgatgaagacctctacgacttgttcctcaatgaggccgacggagccctccacggtctgcgcatccgcgaggacaacgtcacccgcttcgtgcgactgggagactggcgtcaggtccagggcgtgcgaatccccttcctggaggaggtgctcaccgacaacccggactccgactcacgaacggtggtggaggcgctggagctgaacgtccccattccatccgcggtcttcgaacgcccccaggacgtccgcaaggcgatcttcgcgaaaggtcaccacagcaccggcttcatccccttcgagttcttcgacgagaaccgcgtctacatcccagcgcgggtgaatggccaggcgacgcaggtgcttctggacagcggcgccgagatgacggtggtcgacacggcctatgcgcgtgaactggggctgaagacgcaggggcagctcgcggcggtcggcagcggaggacatgcacaggcccagctcgcgggcggcgtggacatcaccttgggcaacctgcgactgacggggctgacggtcgccgtcatcaacctgtccgaggtcgcgcggttgataggccacccgctgcccgtcgtcctgggcaaggagtccttcaaccaactcgtcgtggacgtggacttccccaaccggcgcgtcgccttccatgatgcgtcccgcttcaaggctccgccgcgagcggttcggctcccgctggtcgaatccgcgggcgggcagcgcgccgtccagatctccattgagggccgtccccccattccggtgctcttcgacgtgggcaatggcggagcactttcgctcttccccgcctactggcagcaagccgggctgctcacggaaaggcgcagctccaggacgctgtccggagccgtgggcggactccgggagcgcgatgtagcgacgctgaaggacattcaactggcgggcatcaccctgaaggacgtgcccacggtgttcgacgacgcgggcaagagtatctccgcctcggaccggctcctcggcaacctggggctcgccgtcctcggacgcttccggatgataacggactatgcgacggacacgctgatgctggtccctgatgcccgcgcgctgcgtcagcccttccgcaaggaccggtccggcctgattgccctccccgcggaggggcggctcgtggtgaagttggtggcccctgggagccccgccgccggctcgggttggaaggagggggacgaaatcattgccattgatggcaagcccattggccccgattacgcgggcacggaactcgcgcgttggcgatatcgcgcagcaggtcagacggtgatgctcactttgaaagacggcagcaagcgtcggctcaccctgcgcgactactactga

SEQ ID NO: 8913 - DNA, 795 bp, Myxococcus xanthus
atgagcaaccctgaagtggtgacgaagacccagcgccggatgcactggggcgtgggcgtggcggcgctggtgatgctgttcgcgggcgtgggcacgtggctggtgctgcgccagtcggcgacggagctgccgcatccctccatggcggtcatccccaagccgtcccaccccggattggcgccgcgcgcggagccgccgctgccctcctccgcggagatggacgcgctgctgcgcacacggctcgcccgggcgtcgctcatgccggagttcgccacgtggctgaaggagcaggacctgctgcgccgcttcgtcaccgtcgtgggcaacgtggcccagggtgacagcccccgcgaggcggtgagcttcctcgctccggccggcaccttcgaggcacgccgcaaggccggcaagctcgtcatcgaaaagcagagctacgcgcgctacgacgtcatcggcaaggtggtgggctcgctcgacatgggtgtgctggtgtccacctaccgcgaggtgcgtcacctggccgagcgcctccacatggagacggctcgccccggaagcaccttggacgccacgctccacctcgccttcgagcaggtgctcgccgtccctgtcatcgacggtgacatcgaggtggtccccaagggcgcgatgttcgtctacgccgacccgaagctcgaagggctgacggccgcgcagaagcacctgctgcggatggggccgcagaacctccgccgcatccagggcacggtgcgcgaggcgtcccagcagctcacccagcaggcgtcccgccgctga

SEQ ID NO: 8914 - DNA, 285 bp, Myxococcus xanthus
atgggttttcgcgccggcaacaacttcagtgtggtcgaaatcgtcgagcggagccccacttcggtggagctgcggatgaatgacgtgctggcggacctgcccaccttctccgcgggcctgctggcgcgcgcggtggagctgtgcggtggggggcgggtggtcagcatccccgaggagttcgacggcaccgcagccaccttccacatccgctggtccgaggccccagccgaggccgccctcaccgccacggatgacgactcgggcgcgtcccggcctcgcgcgtag

SEQ ID NO: 8915 - DNA, 1400 bp, Myxococcus xanthus
atggctgagcccgaacccctcattggcatcgacctgggaacgacgaacagcatcgtcgccaccgtccaggacggccagcccgtcgtcatcaagaaccgcacgggccaggggctcacgccctccgtcgtggccatggcgaagaacggcaagcggctggtgggcagcattgccaagcggcaggccatcaccaatccgcaggagacggtgtacgcggccaagcggctcatcggccggaagttctcctcgcacgaggtgcaggactcgctgcgcgcgctctcctacgaggtggtggccgggcagcacgacgacttgcgcatccgcatgggcggcaaggacctgtccgtccccgaaatcagcgccatgattctccaggagctgaaggcggacgcggaggcgcacttcggccggcccgtctccaaggccgtcatcacggtgccggcctacttcaacgacgcccagcgcccaggccaccaaggacgcgggccgcatcgccgggctggacgtgctgcgaatcatcaacgagcccacggcggcggcgctggcctatggcttcggccgcacggtgaacgggcgcgtggcggtgctggacctggggggcggcaccttcgacgtgtccgtgctggatatctcccagggcgtcttcgacgtggtgggcaccggcggtgacacctatctgggcggcgaggactgggacaaccgcatcatcgaatggctcgttttcggcttcgcgaaggagcacggcatcgacctgcgcaaggaccgcatggcgttgcagcggctcaaggacgcggcggagaaggccaaggtggagctgtccagtgtgcgtgaggcggggctcaacctgcccttcatctgcacgccgcctggcggtggtgcggcgctgcacctgcaagccacgctgagccgcgacaagctggatgacctgacgtccgacctggcggagcgcgtggtggggcttaccaccgaagtgctcggcgaggcgggcgtgcgcgcctccgagctcaaggaagtcatcctcgtgggcggcatgtcgcgcatgccgaaaatcgtggaggccgtgcgcggctacttccgccgcgagccctgcaagggcgtccatccggacgaggtggtggcgctgggcgccgcgattcaggcccacgcgctggtgcagccggagcatgagctgctcttgctggacgtgacgccgcagagcctgggcgtggccatcgccgggggcaccgtgcgccggctcatccccaagaacaccacggtgcccacgtcggccacggaggtcttcgccacgtcgaaggacttccagcgcgtcgtgaagatcatggtgctccagggggagcacgacctggcgcaccagaacgagctgctgggcgagttcgtcctcaccggcctgcgggaggcgcctc

SEQ ID NO: 8916 - DNA, 1176 bp, Myxococcus xanthus
atgttgtggctggcgaacggactcgtcttctacgtgctgctcttcgcgaccggagagtggcgccgcatcgtcccgacgaactggcaggtgttccccgacgccgcgtctgctctgctccagtacctctccctgcgctggcctcagaacgatggctgggtcgcgtacaacggcctccagatcatcgcctacttcatcacggtcttcatcgcggcgccgctcgcgctcatgaccgggctcggcatgtcgccagcgctttcgacccggttccacggcatcagcaagcggctcagcatccagaccgcgcgctccctgcactttctcgtcctgtgctggttcatcctcttcaccttcatccatgtcaccatggtcttcgcgaccggcctgctgcgaaacttgaaccacgtgtacgcggggaccgacgccaacgattgggtcgggtttggcatcttcgctgtctccatggcggtcgtcgtgatcgcgtgggtggcggccacgccgttcacgctgcgacatccgcgggtcgtgcaacgcgtcgggtattcgctgatcggcccggcccagcggctcttcgagcacctcgacgccaagccagggacctacacggacaaggacatctcgccgtacttctggcacaacggcaagtaccccgagacgccggagtaccgcgcgctcttcgacaaccacttcgccgattaccggctacgaattcacgggctcgtcgagaatccggtcgagctgagcctcgacgagctgcgcgccatgccgcgccacgagcagatcacgcagcacttctgcatccagggctggtccggtgtcgccaagtggggcggcgtctcgatgcagaccctcctcgagctggtcaggccgaagcccgacgcgaaatgggtcgtgttctactcgctcggcgacggttccgacggcggccgctactacgacgcgcatcccatcgcgcagatgcactatcagctcacgatgctcgcctatgacatgaacggcgagccgctttcttacggccacggggcgccgcttcgcctgcgcaacgaggtccagctcggcttcaagcaagtgaagtggattgccggcatcgagttcgtcgctgacttcttcgaagtgggaggcggctacggcggctacgatgaagatcacgagttcttcgggtatcgtcagtcgatctga

SEQ ID NO: 8917 - DNA, 1641 bp, Myxococcus xanthus
cgaattccccggatgggcgccgcgggaacgaggttcggccgtaacgtcccgcttgagaacgcctggcccgagcccgagccggcgctgctggagccgagcccccgcgtcatcagcaaccggctgctcgcgcgccagtcgttcgttccggccacctcgctcaatctgctggccgcagcgtggattcaattcatgacccacgactggttcgaccatggctcgcccaagcgtggcggcgagttcaaggtccccctggacaaggagcgcggcgactcctggtccgaggaccccatgcgaatccgccgcacgcccgaggaccccacccgcatccccggtgccaaggacggcccgcccacgtacatcaaccagcactcacaatggtgggatgcctcacagatttatggaagcaacgaggaggagacgcgcgccctgcgctgcacggacgatgaggacggcggccagcgtcgaggcaagctcatcctcaccggcgaagggctggaggcgcagctcccggtagaccccaatacccacctgcagaagtccggggtgacgcacaactggtggattggcctgagcctgctgcatacgacgttcgccaaggagcacaacgccatcgtggaccggctgcggctggagtttcccgactggaatggcgaccggctcttccacacggcccgcctcatcaacacggcgttgatggcgaaaatccacaccattgagtggacgccggcgatcctcgcgcatcccacgactgagaccgccctcaacaccaactggtggggcctggtcggccaacgggtgacccggctgttcgggaggatgagccgcagcgagctcatcagcggcatccccgggagcgaggtgaaccaccacggcgtccccttcgcgctgaccgaggagttcgtggccgtctaccgcatgcactcgctgatacccgacacgatgcgactgcaccggatgcgggatggcgtccaggtgcgcgaggtggcgatggtggacctcgccggccccaacacgctgaaagccctcgaagacgggctcaccatggtggacctctgctactccttcggtatcagccaccccggcgcgctcgtgctgcacaactaccccgccttcctgcgcgacctccaccggcaggatccggacggcgccgagtcccgcgtggacctggcatccatcgacgtgatgcgcgaccgggagcgcggcgtgcctcgctacaacgccttccgcaagctgatgcacctccagccggcccgctccttcaaggacatcacccgtaacgagcagtgggcccgggagctgcgtgaggtctatggccacgtggaccgcgtggacctgatggtgggcatgctcgccgaagacccgcccaggggttttggcttcagcgacacggccttccgcgtcttcatcctcatggcctcgcgccggctggcgagcgaccgcttcttcaccaacgaccagaacgtcaacctctacactcagcccgggatggcgtggctcaacgagaacaccatggccagcgtgctgctgcgccactacccgggactcgcccccgcgctccgccagacacggaatgcattcgccccctgggagccggtgagcatggtggccacggagcccccggcgggaagcctccttcactga

SEQ ID NO: 8918 - DNA, 3960 bp, Myxococcus xanthus
gtgaaggacattttcaacttcttcgagaagccgaaggacccgctgtcgttcaacgccatccgcatcgccctggcgtcgcccgacaagattcgccagtggtcccatggcgaggtgaagaagccggagacgatcaactaccgcacgttcaagccggagcgggacgggctcttctgcgcccgcatcttcgggccggtgaaggactacgagtgcaactgcggcaagtacaagcgcatgaagcaccgcggcgtggtgtgcgagaagtgcggcgtggaggtcatccagtccaaggtgcgccgtgagcgcctgggccacatcaccctggccacgccggtggcccacatctggttcctcaagtcgctgccgagccgcatcggcaacctgctcgacatcacgctgaaggagctggagaaggtcctctactgcgagagctacatcgtcctcgatccgaaggcgacgccgctgcagaagggcgagctcatcagcgaggacaagatgcaccggctctaccaggagcacggtgaggactccttcaccacgggcatgggcggcgaggccgtccgcgagatgctcaagtcgctggacgtggagaagctgtccgaagagctgcgcaaggacatgcgcgagaccaccagcgaggcgaagcggaagaagtacgccaagcgcctgaaggtggccgaggcgttccgcgtctccggcaacaagccggagtggatgatgctggacgtgattccggtgattccgccggacctgcgcccgctcgttcccctggatggtggccgcttcgcgacctccgacctgaacgacctgtaccgccgcgtcatcaaccgcaacaaccgtctgaagcgcctccaggagctgaacgctccggacatcatcatccgcaacgagaagcggatgctgcaggaggccgtggacgcgctgttcgacaacggccgccgcgggaagaccatcacgggccccaacaagcgcccgctgaagtcgctgtccgacatgctcaagggcaagcagggccggttccgccagaacctgctcggcaagcgcgtggactactcgggccgctccgtcatcgtggtgggccccgagctgcgtctgcaccagtgcggcctgccgaagatcatggcgctcgagctcttcaagccgttcatctacaacaagctcgaagagaagggttacgtcaccaccatcaagtccgcgaagaagatggtggagaaggagcgtcccgaggtctgggacatcctcgaggacgtcatccgcgagcacccggtgctcctcaaccgcgctcccacgctgcaccgtctgggcatgcaggccttcgagcccgtgctgattgaaggcaaggccatccagcttcacccgctggtgtgcgccgccttcaacgccgacttcgacggcgaccagatggccgtgcacgtgccgctctccatcgaggctcagatggaggcccgcgtgctgatgatgtcgacgaacaacatcctcagccccgcgaacggcaagcccatcatcgtcccgacgcaggacatggtgctcggcatctactacatgacccgcgcccgcgagttcgccggcggcgagggccgcgtgttcgcctcgcccgacgaggtgcgtgccgcgtacgaccacggcgaggtgcacctccaggcgaaggtcgtctgccgcatcgacggcaagcgcaaggagaccaccgtcggccgcgtcctcctgtgggaggtcgtcccgcgcgcggtgggcttcgacgccatcaacaaggtgctcgacaagaagtcgctcggcggcctcatcgacctctgctaccgcctcacgggtgagaaggagacggtgctgctcgcggaccgcgtgcgcagcctcggctactacaacgccacccgcgccggtatctccatcgcgctcaaggacatgatcatccctgcgaagaagcaggagttcctggacttcgcgcgcaaggaagtgtcggagatcgagaaccagtaccttgagggcctcatcaccgacggcgagcgctacaacaaggtcatcgatatctgggcggagatcaccgagaaggtcgcccaggagatgatgcagcagatctcccaggaggagaccaccggggaccgcgacggcaagcgtgagacgcgcaagcagccgtccttcaaccccatctacatcatggccgactcgggcgcgcgtggtagcgcccagcagatccgtcagctggcgggtatgcgtggcctgatggcgaagccctccggcgaaatcatcgagacgcccatcacggccaacttccgtgaaggcctctccgtgctgcagtacttcatctccacgcacggtgcccgtaagggtctggcggacacggcgctcaagacggccaactccggttacctcacccgccgtctcgtggacgtggcgcaggacgccatcatcaacgagtacgactgcggcaccatggacggcctgttcatcggcgccctggtggagggcggcgagatcatcgagccgctcggcgagcgcatcctgggccgcgtggccctggatgacatcctcgaccccgtgacgggcgaggtgctggtgcgcgcgaacgaggagatcgacgaggaccgcgtccgccgcatcgagaacagcggcatggacaaggtgaagatccgctcggtgctcacctgccaggccaagcgcggcatctgcgtggagtgctacggccgtgacctggcccgcggccgcaaggtgtccgtgggtgaggcggtcggcgtcatcgcggcgcagtccatcggtgagccgggtacccagctcacgatgcgcaccttccacatcggtggtgcggcgacgcggcgcgcggagcagtccagcctggagaaccgctacgcgggtagcgtgaagttcgcgggcctcgtcaccgtgcagaagacggacggcacgctggtggccatgaaccgcaacggcgaaatcgtcgtcgtggacgactcgggccgcgagcgcgagcgttaccaggtcatctacggtgcccgcatcctcgtgaaggaaggccagcgcatcgagccgggcgtcctcatggcggagtgggacccgttcgcgattccgctgctgaccgaggtcggcggtgtcgtgcgctacgaggacatcatcgaaggcgtgacgatgtccgaggcgctggacgaggtgaccggtctgtcgcgtaagacggtcatcgagtccaaggacccggaggcgcgtccgcgcgtcaccatccgcgatgccaacggcaacatgatggacctgcccagctcccgcaacccggcgagctacttcctgccgcagggctccatcatcaccgtcaacgacggcgatgagatccacccgggcgaggtcatcgccaaggtgccgcgcgagacgacgaagaccaaggacatcacgggcggtctgcctcgcgtggccgagctcttcgaggcgcgcaagccgaaggacgcggcggcgatcgcggagatcgacggcgtggtgtcgttcggcaaggacaccaagggcaagcgcaagctcatcatcacccccgaggtgaacggcgagcagcgcacggacctggccaaggagtacctgatctccaagggcaagaacatcagcgtccactccggcgaccgcgtgaagtccggcgaggcgatgatggacggctcggccaacccgcacgacatcctcaaggtgctcggcgagaaggagctcgcgcgctacctggtggacgaagtgcaggaggtctaccgactgcagggcgtgaagatcaacgacaagcacatcgagaccatcgtgcggcagatgctccgccgcgtgcgcgtcaccgatgtgggcgacaccaacttcctggtcgacgagcaggtcgagaagtgggtgttcgaggaggagaacgagaaggtcatgtcggaaggcaagcgttccgccgttggcgaaccggtgctggtcggcatcaacaaggccttggttttccccgagtcctttattttcggggtggccgttccgggggccccc

SEQ ID NO: 8919 - DNA, 4227 bp, Myxococcus xanthus
atgccgacgcagatccagaacaatttccgcgtgcggaagaccttcgcgaagatcgcgaagatcatcgacattcccaatcttatcaacatccagaagcagtcctacgagaagttcctccaggcggacattgccgccgacaagcgcgaggacctcggtcttcagggcgtcttcaagtcggtgttccctatccgcgacttcaacgagacctcctcgctggagttcgtgagctaccacctggagcgcccgaagtacgacgtagatgagtgccaccagcgtggcatgacgtattcggcgcccatcaaggtggtggtgcgcctggtcgtgtgggacaaggacgaggagaccggcgcccagtccatccgcgacgtgaaggagcaggaggtctacttcggcgaaatcccgctgatgacccagaacggcaccttcatcatcaacggtaccgagcgcgtcgtcgtcagccagctgcaccgaagcccgggcgccttcttcgaccatgacaagggcaagagccactcgtctggcaagctgctctacaacgcccgcatcattccctaccgcggttcgtggatcgacttcgagttcgaccacaaggacctgctgtacgtgcgcatcgaccgccgccgcaagctgccggccacggtgctcatccgcgcgctcggcgccgtcccggacaccgcgaagaagaacccgctggagttcaagggctccaccgaggagatcctcaactactactacgcgacggagacgatctacctccacagcgcggaggagttcgagaagagcgtcgagctcgagctgctgcccggtcagcgcgcgacccgcgacatcaaggccaagacgggcgagctgatcgtcaagaagaaccgcaagttcacccgcgccgccatcaagaagctcgaagcggcgaagatgaagacgctcccgatcgatgcggacgagctcttcaccaaggtgtccgcctacgacgtggtcgaagagaccaacggcgtggtgctcctcgagtgcaacgaggaagtcacccaggagaaggtcgacgagctcctcaagcacggcatcaaggagttcaaggtcctcttcatcgacaacctcaacgtgggcccgtacctgcgtgagacgttgatgctggacaagctcgagacccccgagcagtccatcatggagatctaccgccgcctgcgccctggcgatccgccgacgccggagacggccatcaacctgttcaccaacctgttcttcaacccggagcgctacgacctctccaaggtcggccgcctcaagctgaacttcaagttcggcctcgaggagccgctcgacgggcagatcctcaccaagcgggacatcctcgaggtgatccgctacctgatcgatctgaagaacggcaaggggaccatcgacgacatcgaccacctgggcaaccgccgcgtccgcgcggtgggcgagctgctggagaaccagtaccgcatcggcctggtgcgcatggagcgggcgatcaaggagcgcatgagcctccaggagatcgagacgctcatgccgcacgatctcatcaacgccaagcccgtcacggcggtcatcaaggagttcttcgggtccagccagctgtcgcagttcatggaccagacgaaccccctgtccgaagtcacccacaagcggcgcctgtcggcgctcgggcccggtggcctcacccgcgagcgcgcgggcttcgaggtgcgcgacgtgcacccgacgcactacggccgcatctgccccatcgagacgccggaaggtccgaacatcggcctcatcgcgtcgctgtccacctacgcgcgcgtcaatgagttcggcttcgtcgagacgccgtaccgcaaggtcgaggcgggcgtggtgacgaacgacgtggctttctactccgctctcgaggaggagaagcacacgatcgcccaggcgaacgcggagacggacaagaagggcaagttcgccaacgcgctggtgtccagccgccggggtggtgagttcgtccaggctcgcgccgaggacgtggacctgatggacgtgtccccgaagcagctcgtgtcggtggccgcgtcgctcatcccgttcctggagaacgacgacgccaaccgcgcgctcatgggctccaacatgcagcgccaggccgttccgctgctgcgcaccgcggcgccgctggtgggcacgggcatcgagtccatcgtcgcccgcgactccggcgtcacctgcgtggcccggcgcgacggcatcgtggagagcgtggacgccggccgcatcgtggtgaaggcggacgtgccggcctcgctgagcgatgtcacgagcgaggtcgacatctacaacctgctcaagtaccagcgctccaaccagaacacctgcctcaaccagaagcccatcatcagcaagggcgaccgggtgatgaagggtgacgtcatcgccgacggtccggccaccgagacgggcgagctggcgctgggccagaacgtggtcgtcgcgttcatgccgtggcagggctacaacttcgaggactccatcctcatcagcgagcgcatcctcaaggacgacgtcttcacgtcgatccacatcgaggagttcgagtgcatcgcgcgcgacaccaagctgggcaaggaggagatcacccgcgacatcccgaacgtgggtgaggaggccctcaaggacctcgacgagagcggcatcatccgcatcggcgccgaggtgaagcccggcgacgtgctggtgggcaagatcaccccgaagggcgagacgcagctgtctcccgaagagaagctgctgcgcgccatcttcggcgagaaggccggcgacgtgcgtgacagctcgctgcgcgtccctccgggcgtggtgggcaccgtcatcaacgccaaggtgttcagccgcaagggcgtggagaaggacgagcgcgccaagcagatcgagtccatggaggaggcgaagctcctcaaggaccagaacgacgagatcaaggtcctccaggacagcgcgttcggccgcatccgcggcctggtgcgcaccaaggaggtccagggcaagctcgtggatgacaaggggaagatcctcctgaagaagggggacatcctcgacgacgagctgctgtccacggtgccctacaagtactggggtgagatctccgtcggcgacccgctggactcgcgcctgcgcgacatcctccgcaacctggaggagacgaaggaggccgtgaagctggccttcggcgagaagatcgcccgcatcaagaagggcgacgagctgccgccgggcgtcatcaagatggtgaaggtgtacgtcgccatcaagcgcaagctggccgtgggcgacaagatggccggccgccacggaaacaagggcgtcgtgtcccgcatcctccccgaggaggacatgccgtacctggaggacgggcgtccggtggacatcgtcctcaacccgctgggcgtgccctcgcgcatgaacatcgggcagatcctcgagacgcacctgggctgggccgccaagggcactggcgaagcgctgcagcgctacgtcgaggccaactggagctcggacgccatcaaggagcgcctcaaggtcatctacagcgacccggcgttcggcgagttcctcgacaagctcgacgacgaggagatcaagcagctgtgcctccgctccaagcggggcatccacgtcgccacgcccgtcttcgacggcgcacaggagacggagatccacgccctgctggacgaggggcagctgccccgctcgggccagatggtgctcttcgacgggcgcaccggtgagccgttcgaccagaacgtcaccgtgggcgtcatgtacatgctgaagctgcaccacctggtggacgagaagatccacgcccgctccatcgggccctactcgctcgtcacgcagcagccgctgggcggcaaggcgcagttcggcggtcagcgactgggcgagatggaagtctgggcgatggaggcctacggcgcggcgtacacgctgcaggagttcctcaccgtcaagtcggacgacgtggtgggccgcacgcgcatgtacgaggccatcgtcaagggcgacaacgtcctggagagcggcctgcccgagtcgttcaacgtgctcctcaaggaactccagtcgctcgcgctcgacgtggagctgctggagagcgccccgccggagcggcagcgcagcttcggaggcgacttcctcggcggtggtgacggcgaggagcgcaagacgggaactgaggcctga

SEQ ID NO: 8920 - DNA, 369 bp, Myxococcus xanthus
atggctgacctgaacgcgattgttgaccagctctcctccctgaccgtccttgaggcggccgagctcgtgaagcagctcgagagcaagtggggcgtctccgccgccgccgtggccgttgccgcgggcccggccgccgccgccgctcctgtcgaggagaagacggagttcacggtggtgctggccaacgccggcgccaacaagatcaacgtcatcaaggagattcgcgcgatcaccggcctgggcctgaaggaggccaaggacctggtcgagggcgctccgaagaacgtcaaggaaggcgtcaacaaggacgacgccaagaagatcaaggaccagctcaccgcggctggtgcgaccgtcgacatcaagtag

SEQ ID NO: 8921 - DNA, 396 bp, Myxococcus xanthus
ctctcagagggcaacgtcgagtacaaggtcatcaagaacacgctggcgcgccgtgccgcgcagggcacgtccgtgtttttcatcgctgatgacttcacgggccccgtggccctgtgcatcagctacggcgacgtggtggctcccgcgaagatcctggtcgagttcgcgaaggacatcgaggacaagatcaagatccgcaccgccgtcgtcgaaggccgcaaggtcgacgtcgccggcgtgaaggccctggcgaagctgccgggtctgcccgagcttcgcgcgcagttgctgggcgtcatcagcgagcccgcgagcaagctggttcggaccatcgcggctccgggttcgcagctcgcccgagtcgtccaggccaacgcggacaaggcgcagggctga

SEQ ID NO: 8922 - DNA, 858 bp, Myxococcus xanthus
atgctgctcgcgctggtggccatgctgctgggcggcagccaggcggagccactcacccaccagccgcgggccctgagcgcgggcctggactatttcgcgctggagctcctcgtgttggggctcctgttcatccccatggagcggctgtgggggctccacccgcagcgcatcttccgcgagggctggcagacagacctcaagcacttctttgtcagtcacgtgggcgtacagctcatctccttctcggtgatgattccggtgcaggtcttcttctcctgggcggtgcgcatggacttccaggcccatgtggccgcgcagcccgtgtggctgcaattcttcgaaatcctcctggtggtggacctggtgagttactgggtgcaccgcgccttccaccaggtgccctggatgtggaagttccacgccatccaccactccagtcagcagatggactggctggccagctcgcgctctcacctggtggacgtgctcgtcaaccggttcgcggggttcataccggtgttcctgctgggcttcagcccggccgccatctacggctacctcgttttcgtgtccttccacgccgtctacatccacgccaacgtgagccaccgctggccctatctccgttgggtgttcgcgacgcccgaattccaccactggcaccacacgtccgacgaggaaggcatcgacaagaacttcgctgtcttcctgtccttcattgatgtgattttcggcaccgcgcatctgcccgagcactggccgtcacggtatggaacgacgaagttccagcctccagagacctacctgggtcagctcgcctatccgttccaacggcacgaagaaacgccttacggatag

SEQ ID NO: 8923 - DNA, 1095 bp, Myxococcus xanthus
atgtcctggcacaagcggctcgaattatgggcgaagctgacactggcgctcgtggcgtccgccctgctgtggcgcccgggccgccggcggcgtcctggcaccccacttcctggtcctcgcaaggtgctgctcgtgcggcccgacaaccgcgtgggcgaggcgctcctcaccacgccgttgatgcgcaccctcaaggcgcacctccagtccgcgcccgaggtccacgtcctggtgcacgcgaaggtcgctcgagtcctgaacggccacccggacgcggacgtcatcattcccttcgaccggcgcagaatctggatgggcccccttgcccccggcatcgccgcgctgcgacgtgcccggtatgacgtcgtggtcgactgcgccaactgggagtcgccctccgtcacgagcgcgctcgtgtcccggctcgcgggtcccgaggccgtcgtcatcggtccagacctctggccggtgtcccgtctgcactccctgcccgtccccgctcgcacggacacgcggaacgaagccgttcaacgcacgcacctgctgaccccgctcacgaacggcgcagtggcgcgtgttttgtccttccgcgagccctccgtgggcccggccatccgcgcctatctggacgccctggccgggaagcccttcgcggtcatcaaccccggtggtcggttgggacctcggcggattccacccgcggccttcgccgccgcggctcgggcactggtggcgctggggcgtacccccatcgtcacctggggccccggcgaagaagcgttggcacgaggggtggtggaggcagcccctggctccgagctcgcgcctgctagcaacctggacgaactggctgccctgatgcgcgcagccggcttcaccctctgcaacaacacggggcccatgcacctgtccgtcgcggtgggtgctcccacgctggccttcttcctgcggatggacatggagcgctggggccatgcgtacgccccccaccgcatggtggacctcacccctctggttgatggtgcgggcggtcagggcttggaggagcgggccgccgaagaggtccggacgttcgcagcgagcctcccctcctga

SEQ ID NO: 8924 - DNA, 630 bp, Myxococcus xanthus
atgaacgcgaataccgtgctcccgcctggcttgttgctcgtgctctccgctccttccggggcggggaagaccaccctcgcgcaccggctcctcaaggagacgccggatgcggtgttctccatcagcgtcaccacccgaaggcctcgggggaaggagcgcgagggggtggattacaacttcgtcgacgtcgcgaccttccagtcgaagatcgagcgcggcgagttcgtggagtgggcagaggtctatggccacttctatggaagcccccagtcggtggtggatgaggcgcgcgcccgcaagagcgctgccatcttcgacatcgacgtgcagggcgggcaggccatcaagcgcaagcacccggatgcagtgaccatcttcgtgctgccaccgtccatggaagagttggagcgccgcctgagggatcgtcagacggactccgacgagaccatccggcgccggatgctggcggctcgctctgagatcgagcggggtatcgcttcctacgactacgtggtcgtgaatgacgacttcgagcgtgctttcagtgacctgcgctcggtggtggtggccgaacgttgccggcgcgaacgtgtggacgtgtcgaagctgggcctgggaatcggcggctga

SEQ ID NO: 8925 - DNA, 120 bp, Myxococcus xanthus
atgcaccgcgaggtgaacacgaccggctccaagagccagcacgccgagatttccgtgcgcgtggtggcgatgaaggccgaggtcgagcgcatccgcgaacaggtgcagaacgtcgaatga

SEQ ID NO: 8926 - DNA, 1442 bp, Myxococcus xanthus
tttgcccgccgcaaggtgttgctggtgggcgacctcgttgccgaccactacatctatggacagacggaccgggtgagccgggaggcgcccgtgctcatcgtccgctacgagtccgcggaggtgaagctcggaggtggcgccaacgtggcggccaacgtgcgagccctgtccggtcaggtctccgccgtcggcgcgctgggccaggacgagatgggcaaggagttgcgccgcctctgtgccgaatccggcatccaactggacgcggtgagcggtcgcgacatcgagacggagacgaagacgcgcatcctggccggtggggtgagcaccacgcggcagcagatgttgcggctggaccgaggccagcgaggcgcgctccccccgaagatgcgcaaggcgctggcgcggcaggtcgaagcctctgcccaggacgcggacgcggtggtggtgtccgactacggcgcgggtgtgctgggggacgaggtgcgcgatgtgctgcgtcgcctggccgcggacggcatgcccgtgtgtgtggacagccgctatgccctgtcatccttctcgggactcacggtctgcaagcccaacgagccggagctggaggcgctcgcggggcggcccgtgcggacccaggaggacatgctggaggcggggcacgccgcgttgaagcgactggagtgccgcgcgctcctggtgacgcgaggccgccatggcatggcgctcttcgatgcggacgggggcgtggacctcatccccgtccatggcgcgaaggcggcggtggatgtgacgggcgcgggagacacggtgattgcgacgtttgccctggcgctggccgcgaaggcctcgctcggcgatgcggcgcggctggcgaacgtggcgggctcgttggtggtgcagaagccgggcaccgcgacggtgtcccgcgatgaactgctcgaagagcttcggagcgcgagatgagcaccctcgagaaaatccaatcgctcgcgaaggtggcggaggagcgtgagcgctggcgggccgaagggcgcacggtggcgctggccaatggcgtcttcgacctgctgcacgtcgggcacgtccggtacctggaaggggcgcgggccctggcggatgtcctcgtggtggcggtgaactcggacgcttccacccgggcctacaagggccccggccggccctacatccccgagggcgagcgggcggagctcgtcgcggcgctggcctgcacggaccgggtcatcgtcttcgacgagtccaacgttcgcgtcatcatccgggcgttgaagccggacgtgcacgtgaagggcacagactacaccccggacagcatccccgaggccgacgaagttcgcgcctatggtgggcggacagccgtctcaggagacccgaaggaccacagcaccacggacctggcccggcgcctgggccgcgaggggtcggggtag

SEQ ID NO: 8927 - DNA, 1005 bp, Myxococcus xanthus
gtcatctccgtgggcaacgtcaacgtggggggtacgggcaagacgcccgcggtgctccatctggcggagcagttggtccaagcgggccggaaggtgggcatcctgacgcgcggttatggccgcgcctcgcgtgagccgctgaccttcatcgggacggagccgcttccttcctcggacctcgcgggtgatgagccgctcctgctggcgcgtcgctgtccccaggtccggctcttcgtcggctcggaccgagtcgcgagtgcctaccgtgcgcgggacgatttcagcctggacacggtgctgctggacgatgggttccagcatcgccgcctcgcgcgagacgaggacttcgtggtcgtggatgagtcggtggggctgggcaacggccacatgcttcccagggggccgctgcgtgagcccccggcgtcactccgccgcgcgacgcttttctggctcagggcacccgccacggcttcggatgctgctgtgctccccgtcatgaggcccgaggacacgcgcacgccccaatccaccacgcacctcctggtgccgacagaggcgcggtcggagcgtttctctgacacgctcggcgggtggttgccctcgagcccggggattcccagggtgaggactcgctatcggcccacggcctgggtggacccggagggcaaccttcatcccgtgacggcgctcacgggacagcccgtgttcgctctggcgggccttgcccggccggggggcttcctgaagaccctgcagtcgctcgggacggacgtgcgcgatgccgcgttgtttccggaccaccatcgcttcaccgcggacgaactgcgcgacgtccaggcgcgagcggtgcggctgggggcccgggtggtgacgacggaaaaggacgcggtgcgtctaccccagggcttcgaggcctgggtggtccgcctgggggtcgaggttctggaaggcgagtcccatctgcggcgggcgctcggactggaggatgctccgcgcggcttgtga

SEQ ID NO: 8928 - DNA, 804 bp, Myxococcus xanthus
atgtggcgcgacctgcgccgcttgaaggcgcggacggtggacgtggtccactcgcacttcagtcatgaccacctgctggcgaggtggggacggccttcaggcgccgtcctggttcgctcgctgcacgctccgcgctcattgcgctcctcgctcccggccgcggacgcctacacggtccccgcgagcgcactgcttccccgcctgttggagaagggcgcgacggcccaggtactgccagccctggtggacgcccggttccagcctgcgccggacgcgcggtcgctgcgcgcagagctcgggctcgaaggcacacccgtcatcggaatggtctccacgttccagccttcacgccggcacgcggtgggggtggatgcctttgccctgtatcggaagcagcggcccgaggcgcgcttggtgctcgtgggggacggcggcctgctggagcagacgcgcaaacaggtccaggacctgggactggcggatgccgtgacgttcgcgggctaccaacagggggacgccttcgcgcggtggctgcgagcgctggatgaggtctggctgctcggcctgggcaatgactggagcgcccgcgcggcggcccaggcccgtgcgtgcggcgtccgcgtggtggcggtggatgaaggcgccttgccggacctgacggatgtgcgggtggagagaccgacgccggacgccgtggtcgccgcggcgctgtccgaccagcgggcgcccgtgcggcacccgacgaacgagcagattgccgcggaggtcctcgcgctctacgcgcgagcgaggcgcaccccgtga

SEQ ID NO: 8929 - DNA, 1008 bp, Myxococcus xanthus
atgacactcatcgtccatccgcatttccaccaccgctacacgggcgtgacgcgccacgtggagacggtggtacccgcgctcgtccgggattcaggctcggagacgcgcgtcatcggctcgggcttgagtgaggggctgcccagaatcacctggccggagttgctccgtcggctgcgccgcgagcccgtggtgtggcatgcgcaccggaacaacgagctcctggtgggcatgctgctgaagctgctgggccgagaggtccgcctcgtcttcacccggcacacctcgatggcgcccagcggcttcacccgcttcatcgcgaggggcgcggatgcgctcgtctcgttgacgaagcaggtcgcggacgtcatcgcgctgccgtccacggtcgtctcgcatggcatcgacctgacgcgcttccacccgcccgaggaccgggacgcggcgtggcgcaagctcggcctgggtgggcgttacggcatcggcgtcatcggacgcatccggaaggagaaggggcagggggacttcgtgcaggccatccgcccgctcctgcccgcgcaccccgactggcaacccgtgctggtcgggctcgcgaaggggccggacctggattggctgaatcagcagatggcgggcatcgaggaccgcatcgcgttgcccggcgagcagtccgtcatcgagccctggtatcaggggctgagcatcctggtgcatccctcgtatgcggagggctattcgctggtgcacgtggaggccatggcctcgggctgctgcgtggtggcctcgaagctgccgtacctggacacgctcatcgagcacggccgcacgggcttcttcttcgaacccggagatgtccagggcctgcgcgagctgctggacatgctgatgcgagagcccgagcgcgccaggcagattggccagaacgcggctgaggaggcccggcgtcggtgtggcgtggagcacgaggcgcgagccctggccgacgtgtaccgggccaccgtggagcgctga

SEQ ID NO: 8930 - DNA, 1869 bp, Myxococcus xanthus
ccggtgcatggcgtgatgttgctcgtcgcgccggagtcggagcccacggcccgcttcctggagctgtcgagtgagcggccgcgcgtggcgttctgcgcacatgacgcacacggcctgccgccgtaccgggccgtattcgaatccctggccatgtacctgccaccggaacaggtgcccttcccgttgcccccggacgcgaaggaagcggcggagcaggtcagccgggccctgggcggtggtcagtccctgtgcgccttccgcgccctgggggagcctgggggcttcgcattggagggcctggacggtgtgcggcgtgaagcgcatgtgggcgacacgctgaccgtccggctcccggggcttcccgacgcggagtcggtgcaggtgcgggtgtggggaagcgcccgcctgggggcggacggccggtccgtcgagctgaccgagccgggggtggcgcaggtggaagtgtgggtgcgggcacccgggcgcttcttcgggacggaatggcggccctggctggtgcccagccccgtgcgcgtgctgcccccggggccgggcatctggatagacggcgcgaccagccgcccatgcgcgtcctctacgtcctcgtcacctacctgctcttggcagtcctgtgtcccggtgctcgcactgcaccggaagacgcgccatgggctgatggagcgcttgggcttctatggcccgcacagccacctgcctcccggggacgggcccgtcctctggctgcatggcgcgagcgccggggacctgctggccctctcgccgatgttcggcccgctgcgggctcgtttcccgggctgccgcctgttgctgtcgaccatgacggacagcggctacgcgatggcgaagggccggctggccaacgacatcgacggggtcgtctacgtgccctatgacctctggggcgcgacgcggcgagcggtccgggccatccgtccggacgtactggtgctggagtacaccgaaatctggcccaacctcatccgcgcggcgaagcggggtggggcgcgagtggtgatgacgaacgggcgcttttcgcccgcgaacgtcgggaagtaccagacgctgttccgcctcatcggcaacccgctgcgggatttggacctcctcctcatgcgcgaggaggacgaagccgtccgtgcgcggcagctcggtgccaggccggactgggtgaaggtgacggggaacacgaagttcgacgcgctcgccgcgggcccggtgcccgaggacgagaaccttcgcacggcgctgggcctgacgccgggcgagcgggtatggattgccggaagcacccatgagggcgaggaagcccagctcctgggggtgtacgcgcggctgcgcgagcggtggccggagctgcggttggtgattgcccccaggtacgtggaccgggcggcgcgaatcgtgacgcttgcgcgcgaggcgggactgagcgtggggctgcgctcgcagggcaatccggagcggggccaggtcgtggtgctggacaccatcggcgagctgtcgagggcctaccggctggcgacggtggtgttcgtcggcggctcgttcacgacgcgcggcgggcagaacatcctggagcccgcggggcaggggaagccggtgctctacgggccgcacatggacaacttccgggacagtgtcgcgttgctgacagggcagggtgggctccaggttcaggacgccgcggccttggagcaggcgctcgtgtcgctgctcgaatcaccggagcggctcgcgagcctgggtgcccaggcgctggagacggtgggccgtatttcgggcgccagtgaaaggaacgcggaggcgatgacgacgttgtttccgcacgggaggccggacccgcgatga

SEQ ID NO: 8931 - DNA, 1257 bp, Myxococcus xanthus
atgcgggcgacccagcgcgcgctgcggtggagccgggcgccggacgtggccacggcggcgctgctggcggagggcgcgctggcacatccggacaaccccgtgctggcccgcctgggcgagcggctggccgcgcaggtggcggcggcgcagctcccggacggcacctgccagggcggcaatggctggacgctccagcggttgttggtggccaccgcggactgcacgcgcgcggtgaacgcggcggcggtgacgccggagggcaagcgccgcgcggccttcttcaccgcgcgggcctcgggtgcgctggagcgcaaccgggcgcacgtcaaggatggctacaccgcggcggcgctgctggcgagcggcgcggtgacgggctcgttgcgggactcactgcgcgagcaggtgcgggacgccgtgcagcggcgcgacgagggtgccgcgttcctgcccgtggaggcgggcgtggtggacgccgcgggcggcacgccgacggaggccgaggccaccgcgctggccgtgctggccctggagggcgacgcgaaggcacccgtggcggacctgggcgccgcgttgctcgccagctatgagccggtgaacggctggggcaacgggcgcgccaaccgcctggccttgcaggccgtggtgtccctcttccgcgagccgctgcccgcccaggtgcgggtggtgctggagcgggacggccaggtcatcacggagggcaccttcgacgccaaggccctgcgtgaggtgctgtccctggaggcggcggcgccgggctccggcggagcgcacacctggacggtgcgcgcggagcccgcggtgcccgggttgggcttcgcgctggcgttgagcgccgcggtgccgtggacgcagcaggcacaggccgggttggagttgtccgtgcaggtgccctcggacgcgaaggtagggcagccgtcggaggtgatgctccaggcctccacgccgtcgggcctgccgctggtgattcgccatgggctgcccgcgggcgtgcaggtggacaccgccagcctggaggcgctcgtgcgcgaagggaaggtggcgtcctggcagagtgaggatggcgcggtgacgctgcggcttcctccccgagggccgggcgagcccttccaggcgcgcttccgcgtcatcccgacgctggcgggcacgctccagggaggcgcgtcgtcgctgatggccctgtcgcgccctgacctggtgtcctacgtaccccccgctacgtgggccgtacgctga

SEQ ID NO: 8932 - DNA, 639 bp, Myxococcus xanthus
atgttcgccgcttcctccgccttcgcccaggacgtcgagatgaacatccatgccgatgacattggcatgccgtcgaccagcatttccgtggagggcatgtccccggatggcaacgcagcgggcgtcaacatggagattcgtggtggcggcgctcgcatggaggtgaacgtgtcgggaaccggaactccgccgccgtcggggcgacatgagcgcagagagcgccgtgagtatcgcgaggaagtcgcgccgcgcgagacgcccgtccgacatgtgcggcaccactccgagcccgcgttccgtgactgtgggacgaaccaggacccgggctgcaccatgcagcgcaacggccatttcgcaatggacgcggagaccttccacggcttcatgcagtccctcaagagcactcgcaacgagctgacgcgggaggacatggtggagaaggtgatgacgcgggccttcctcaccgcgaagcagttcggcctcgtcctggacctgttccagaacgaaatcacccgcctggacgtggcgaagacggccgcgccccgcgtggtgaacccgcagcacgcgctggggttctcgtccaagtggaggaactccatctctgctgacgagtacgtggagatcatcaccgagcagtaa

SEQ ID NO: 8933 - DNA, 1038 bp, Myxococcus xanthus
atggagctcgacggcgcggagagggacgagctacagcgggcgctgacgagcgcgtttgcctcggtggagcaccttcgccgggtcgtggccgccacctgccgcagggatttggaagcgctgggcgtctccggtgggctgcgtgagcgcgtcttcgcgctcatccacatggcggaggcggagggctggctgcgcgagctgattcgcggcgtctaccaggccctgccccgacaccctcgcctccaacgcttcgtgcaggtgtacctcgcgtccatccagcgcagcatcccccgtgtcggactggagcgcatcttcggcagcggccgggcggacgccgagcgtgagcactggcgcaagcgcctgacttccatcgagcggcaggtgtgccgcgtggagccggaggtgggcgcggcgctgggcaccggcttcctggtgtctcccagcgtcgtgctcaccaatttccacgtcatcgagaacaggctgctggagtctctacgggtgcgcttcggccgcaaggtcctccaggacgggacactgctacatccggggacggtgtatcgcgtgacgcgctgtctggcgcgcagtccttacagccccgcggacctgatgcacccgcgtccgcgtgatgccacgtcgggcgagctggactacgccttcctcgaggtggcgggtgtccccggcgaggacctggtcgacggggagccccgaggctggctggagccgcccgattcgcgggagtccttcacgcccggcagcctggtgctcatcgtccagcacccggcgggccagccgatgagcgtcgcgctcgatgagttcctgggcgtcaatccgggccgcacacgcgtggcgtaccgcgcgtgcacggggccgggctcctcgggggcaccctgcttcacccaggacctgcggctggccgcgctgcatcacagcggtgggcctcgcgtcccgtccgcgtcggtgggacacaacgagggcatccccatcgacaccatccgcggcagcctgtccgggagcatgttgagccagttggggtgggggtag

SEQ ID NO: 8934 - DNA, 1242 bp, Myxococcus xanthus
atgctgggccaggtggacgggctcgcgttggagattcgccggccggtgcgaggcatccgcgtgcgcgacggggacctgaccgcgctggagcctcgtctaaggctgtacggcgcgtggtgtgacacgtcacgcaagctggatgcgctcccggccgagctgcgtccggagcaggcgagccagttgctggcggaagtggaaggcgcgctgcgcacggaggacaccgccaccgagcaactggaccgcctcgccgccaaggtgcgggagctggacgtggacggactggcgcgcgccgggctggaggcgcggttgcaggacatcgaccgtcaggcgcggacgctggtggagcagcacggtgaggactcgctgggcttccggctcaagtacgaactgctgtccctgctgtcgaccgtgcgggaggaactggcgcggggcgcgctggacgccgcccggcgccagttggagttcgctcgccgctcgtacttcgacatcctctgcgaggagctgtccgcggccctggcgtcccgcacgccgccgcgaggcttcacggaggaggagtgggaggccctcacccggcaggtgaacacactgctggagagagcccgcgagcgcgcgaacaccagcgtggatgatgccgtccgcatgtaccagggcgcgcatgccgcctatgtgcgccagctcatcgtggagctgcgcggcgcggtggacgaggcgcggcacgtcagtgagtccgaggcgcagacgcaggcgctcgatgaggtggaggcgctcctgcgcgaagccatgggtcttctggtggcggagtcgtcgcacgaggccgcggggaagtacggcgaggcgcgcgtccggtttgtctccgccagccagtcccagcggatggcgaagagcttccacctggagtcgctcgcgtcggacgacggggtcgacggggcgccctccgtgcctcctcccaccgcgcccagcggtggaagcatgcctcgcgctgccggaggcgcccgccggaggggcacccgcgctgggcgacttcgagggcatgccgctgccgtcgccgcgtcacatgtggctggtggagctgggcgtgctggcgctgctcaccacggtggcggtggcgttggggcttcagttgctcaatgtcttctcgcccacgtggggcggtttcggcgcgtgcatgacaggccttcctctggggcttcggcctgcaccaggtgggcaacgcctccttcgagggaatcaccgggttgctga

SEQ ID NO: 8935 - DNA, 681 bp, Myxococcus xanthus
atgccgtccatcgccgttttcgcccaggcccacccggagcaactggggtggctcagcagcaagctgctgggggtgacgctcacttccgcggagtgggtgctgtgggtgctggtgtgcctgtcggtgctctccatcgccatcatgctggagcgcacggtgtacttcgcccgtcaccggctgccggactcggaggcgctggcggtgcggctgtcgcgcggtgagctggacgcggtgaaggccgccatccaggggcgtcagggcatggaggccgccatcctgcgtgaagggctggcgtgcgccgaccagggcgcggacacggtggagcaggtgattgcctccaccctgtcgcgtgagcgcccacgctacgagcgcttcctgtcctacctgggcacgctgggcaacaacgcgccgttcatcggtctgttcggcacggtgctgggcatcatcaaggccttcaatgacctggggaagatgaacgcccagggcggcggcggggccatgcagcagaccgtcatggccggcatctccgaagcgctcgtcgccacggccgtgggtctggcggtggcgattccggcggtggtggccttcaacgtcttcagccgtcagctcaagacgctcaccagccgcgccaatgccctgggccacgcgctggtgggcagtcttcgctcggaggcccgttag

SEQ ID NO: 8936 - DNA, 435 bp, Myxococcus xanthus
atggcgggcagcgcgcaggacaacgacgacgaaatcaccggcatcaacgtcaccccgctggtggacgtggtgctggtgctgctcatcatcttcatggtgacggccaacttcatcgtccgtgagacggtggaggtggacctgccccgagccgccaacggcggtgagacggtgcagggcctggtcaacgtggtgctggacaaggagggcaagttcttcttcgacggcaccgagatgaccgagaaggagttggaggcgaaggtcgccgaggcggtggccaaggacaaggacacgcgcgccatcatcagcgccgaccagtcgctgccctacggccgcgtcatgcggctcatcgatgtggtgaagggtcagggcatcgcgaagttcgcgctcaacatcgagaaggacgtggcccccgcggctgcgcccgcagcgccctga

SEQ ID NO: 8937 - DNA, 1306 bp, Myxococcus xanthus
atgtcctccaccaccagcgccggaggtttcgcggcggccgtgggcaacacgctctacggaaggacgggccccacggcgaaggcgccccaggaggtgaaggcgtacagcgcgccgaagtacgcgcccatctaccaggtggactccgagcccacggtggcctccgaggtgaagattccctacccggaggaagcgcgccgcgcgggcgtggagggcaccgtcacgctctccatcaccatcgaccacgagggcaaggtggtggcggtgaagattctcaaggggcccggctacggcctcaacgaggcggcgagggatgccatccgccgcttccgcttcaagcccgccatcaagggcggcgagcctgtctccacggagatgaaatactcgtacaccttcctgctcgattgatgtcgccactcccgctgggagagcggcggagcccgggcgtgcccggcatgtcaggggtacccatccccacgggcattgccgggattccacctcgccatcgctccgtctctctttcagcgggagcggcaaccccctcacccgtatgcttggacacgccatgtcctccaccctgaaagcccgaggcgcgctcgtcgcggcctcgctcctgctggcggcgcccgtgctcgcgcaggcaccccaggccggcgcgcctcccacggacgcggccacgccacctgcggcgcaggcccagcccaccatcaccaagcctcccgaactggtgcagcaggtggaggcgcagtacccgcccgaggcgctcgcgcaggggctcaccgcgtccgtgcggctcatcatcaccatcgcggatgacggctccgtcgccgaggtgctgcccaccgagccggtgggcaacggcttcgacgaggcggccatcgcggcggtgcgccagttccgcttctcgcccgccgaggtcgacggcgtgcccgcgccggtgcaggtggagtatgtctaccacttcaccctcaccgcgccggagccggaggcgggcgccgaggccgtggaggccgagcagcccaaggccacgctcaccggtcagctcatctcccgcggcagccgttcgcgcgtgcccaacgccaccgtgcgctgcggcgacgacgcggacgcgcccgaggtgatgtccgacgaggacggccgcttcacgctcgaggtgcccgcgggcacctgcgaggtgcgcgtggtggccacgggcttccagctctaccagacgaaggaggagctgaaggcgaacgagacgacggaggtgaacttctacctcgcgccctcgggcggcggcctggagacggtggtgcgctccgaccggccg

SEQ ID NO: 8938 - DNA, 801 bp, Myxococcus xanthus
atgcgaggaaaaacggtggtcgtcacgggcgcctcggcgggcattggcgaggcgctggcggtggtgctggccggacgcggcgccaacctggtgctggcggcgcgaaatgaggaagcgctccagcgggtgaaggcccggtgcgagtcggccggcgggcgcgcggtggtagtgcccaccgatgtaggtgacgcggaggcctgccgccacctggtggagcgggcggtggaggcctttggcggcgtcgacgtgctggtcaacaacgcgggcgtgacgatggacgcgcgcgtggacgaggtgaaggacctgtccctcttcgaccggctgatgcgcatcaactacctgggcgcggtgtactgcacccaccacgccctgccccacctcaaggcgcggcgcggactggtggtggccgtgtcgtccctcacgggcaagacgggcgtgcccaaccgcagcggctacgcggccagcaagcacgccatgcacggcttcttcgactcgctgcgcatcgagctgcgcggcaccggtgtggacgtgacggtggtgtgccccggcttcgtcgccaccaacatccgcgacagcgcgctgggcgcggacggccagcccgtgcggcagagcaagcacgacgagagcgcgggcaacatggacgtggacacctgcgtggccatcatcctgcgcgccatggagcgccgcgagcgcgaggtggtgatgaccaccaaggcccgcgtcgcccagttcctcaagctggtggccccgggcgtggtggaccgcatcaccgcgaagaccatccaggaccggcggcgctga

SEQ ID NO: 8939 - DNA, 1701 bp, Myxococcus xanthus
gatgtgcgcttcgaatgcgcgctctgcttgcaggacgaggatggcctcctcgcagccgaggagtccacggtcctggcgcgggccgcggaggcgcgtcgggcgttggcgtcgcggggctccgtgcgactgctggagcggatggcgtcgcggggagatgcggacttcgcgctcgacgtgttgcggcggttgcccgcgcaggcgcctccgggggcgctgagtgcgttgctcgccgtgtcggaccgggtggcgggtggactggcggaggcgctgcatggctgggcccgtggccggcctttcgcggagttgccgccggaggaacgagcgttgtgggcggactgggcgctcgcgcggctggcgcggctctccgcggaggatgctcttcgtttcctcgagtgggccgccgccgcgcgggacgcggaccgggtggaggagacgcgcgccttcgtctcagcggtgtccgagtccctggcgcgagagccgccatcgcttcgcgccagccgcttccaggacgcggccttctcccggttcctctcgctcgctgacgaggaggatgcaccccggttgcacacgtggagtcgagaggcgccgtgcacggagccgttgctggaggcggtgctgtcactgtcctcacggctgcggtggggcgatgcgctcgctcccggccagggcgcgcgtttgttgatggcgctctggacgggggagggccgcgaacgcctgctggcgccgctggcgaaggtggtgcgcgcgtggagtggcggcagtcagcatgccgggttcatcgacgccgtgtggcggcgtttccagcagcacccggacgagcgcacagacttgttggccaccttcacgccgtggagggcggaaatctgggaacggcagcaggcggcggagcctgacgcggtggtgtgcttccagacgtggtggccggtggaggacccggagcagctaccggcgcgtgtggatgcgctggtccgtcagtcgccctcggaggacctgtcgcgccgcctcgaaccggtgtggaaggcggcggaggtccgggtggatgcgtggccgcgtgccacctcgctcgcggtgtcatacgcggcggcggtgttgtcggcgaccgtgaggcgggacgtcgacgcgctcgacccggacgcggagcgcttcctggcctggttccccagcttccgggagcgtgtcgtcgccgcgtcacctacgtcgagcgagcggagctactcccgcgacttcctgaaggacatcgaggtcgatgtccggttgattcgggagcacctcgagcgaaagcggcagcgggaggaccaggcgcacgaggcggagcttcggcgcatggtcgaggcgtcccgccagcgggacctggagcgccagcgggagttgatggcgcgtcaggtggaggcgtcaccgcccgcgcatgacgtggaggtcgcgccgctgcacacgccgctggtgctgctgaatccgcgcgggccggtgcagccgctcgacctggaggtgtgcttcccggaggcccggctgcgcacgctgctggactacacgcggctgttgaaggtcatgagcgtgaacaacgacgtgatggcggtgttcgaggcgcacggcctgtcggtggccacctggacgtcggaggccaccgcgtgggggacgctgctggtgcggcgtccggagctggccctgcgcttcggggtgttgttccaggggccatggggctga

SEQ ID NO: 8940 - DNA, 702 bp, Myxococcus xanthus
atggccccggcgggccgcgccgcggcggaggccaccaaggcggccctgctgagtccctacatgggcgggggaaccgccaccgcggcggcggcgacctcgcaggcggcgtccctggcggcgggaggcttcatctcgttcccctgcgccctcgcgtcctacatgctgacgggcatgtccctcttcacgatgctcatgctggcgcatggcgggttgctggtgctggtgtcggtgggcgtgcgcgcgtgcatgcgcgcgaagcggcccggtgcgtggctggtgtgtcgcttcagccgctgggcgctccatgcggagcagttcaaggcctcggcgcggtgtggctcgttgctgccgtggtcgcccatgctggcattcttgtgcagtcggctgttccaggtggcgcagtacggcgtgctgacctacgcggtgggcatcgacacctcactggtgcaggcgttcttcgcccagggcctctacctgtgcgcgctggcggtgggctcgctggtgccagggcaggtgggggtgagtgacggcgccttcgcgctggctgcgggcgtgctggacaccacggccgcgcgcgccatgtcggtggcgctgctggggcacctggtgcagttgctgttcgtgctggtgggggcgctcatcccgctggtgtggcggattcgggcgccgctgcccgtagcacccgcaccggcgtgccgctga

SEQ ID NO: 8941 - DNA, 291 bp, Myxococcus xanthus
atgcaccgtgtgtatccgttcgtcgtctccctggggctctcgctcgcgccgctcgccgcccatgccgcggcgccggctgcgcccgtggccgaggtgaaggcgccgaccatccagttcaagcagatgaacgcccgcgtggggtaccaggaggaattggacaacgccgtggacatgcggctggcgctcgacctgcgcgcttcgaacatggacaagccgatgtcggtggcgatgtcggtgacctcgtccagccgccacacggtgacggtgctggccgcgaaagggaaggtcatc

SEQ ID NO: 8942 - DNA, 624 bp, Myxococcus xanthus
ctcaccgcgcggggatatgcgctcatctccttcgactaccggctctttcctcctgccaccggactgaaggccccaggggacgtcaagtgtggcatccgctgggtcaaggatcacgcggccacctacggtatcgacccggaccggctcgtcctcttcggagagtccgcaggcgggcacctcgcgagcctggcggggtacaccgagggagatgctcgccttccgtcctcctgcgcccccggggacacgtcggtggcggccatcatcagcttctacgcgcccagcgacctggtggcctacgccgcgagcgcccctgctccgctcgtgggcttcacgggtgtgccgcaggaaggccaccgcgagctgtatgagctgctctcccccatcaaccacgtcgggccacgttcccctcccacactcctgctccatggcggggccgacagcgtcgttccgctcgacgcctcgcaagcgatggccgctcgactggcccaggctggcgttccccataccctgttcacgctgccgtacgcggagcacggcttcgacatctgggatggcggcttcggccgtcagctcgcccgggcgcaggtggggcggttcctccagcagcacgcgcccgtcaattga

SEQ ID NO: 8943 - DNA, 999 bp, Myxococcus xanthus
atggagcgtcccatgaaagcagtgcggttctcagccttcggacagccactgaaggtggtggaagtcgtggagcagccggacgtggcgctgaagccgggcgaggcccgggttgaagtgctggccacgcccatcaatccctccgacatcctcacgctcagcggccagtacgggcagctcccgaagctccccgctgtgcccggcaacgaaggcgtcggccgcgtcgtcgaggtccaggactccagcgccgtgaaggtgggtgacatcgtattcctcccgctgggcgcgggcacctggtgcacccacttggtcgctcccgcggactcgctcctgcgggtgccgccgggaaccgacctgcggcaggccgccatgctgttcatcaatcctccgaccgcggacctcctgctgcgggacttcatcgcgctgcagcccggcgagtgggtgatacagaacgccgccaactcggcggtgggccgctccatcatcaccctggcgaagcaggctggcttcaagacgctgaacgtggtgcggcgtgaagagctggcgccggagctcaccgcgctgggcgcggacgccgtgctgctggactcggatgaactgccggagcgcgtgcgcgaagtgacgggcggcgccaaggtccggctggccatcgacgccgtcggcggtgaatccacccaacgcctgggtgacgcgctcgcgcgcggcggcgtggtggtgaactatggcgcgatgagcggaaagggccctcggttgtcagccgccgccaccatcttcaaggacatcaccctgcgcggcttctggctggtgacgtggacgaagaagacaccgcgcgaggagcagggcgccctgttcgcccggctcgcgaagcaggtggcggaaggcgcactgcacgtcccggtagagggaaccttccccttggagtccatccaggaggccctgacgcgcgccatggaaggtgggcgcgccggcaaggtgctcctcacgcccaacggcccactctga

SEQ ID NO: 8944 - DNA, 195 bp, Myxococcus xanthus
atgccggaggatgggctgcccgagaaggtgggccggtattacgccgtcgacaacctgcgcatcgacgccaagaggacaggtgacaccaaggtattccgcacggagggctggcctctggccctcatcgtctccgaggacatcaaacaggcactggagcgtgtgaaggccaccggtgtgaagttcacgccggtgtag

SEQ ID NO: 8945 - DNA, 1347 bp, Myxococcus xanthus
atgagagcgcatgcggtcatctggctgtcgctggcgcttgccgtcacgggctgctcgacaacccggctcgtacgtctggacacaggggatgggccttccagggtccacacgccgttcacggacgatgacaccgggcccgtggagctggacgacgatgaattcgaggaggccatggtggaactcgcccgggacgtgcggcccttctccaatcccctgcgcgaggcccgccagcgcttcggagtccccgagcgaagcggcgtgtacctctaccagcctcgcggcccccggctcattctccaggaagagaaggacccggacggcccacgcctcctcgagtcctacgcggatgatgagctgacgcgcgcctatggccgctggtgcgaacgcaagtcgcagcccggcgactgcctgcgcctgctggccgaaggcccgctgctggccagcgacggcaagtactcgctggccatggccatcgccatggactcggtgtgggaagagacggccgaggcgctggaggacatggccgacccgcaggcgctgctggcgacggtgagtgcctcggtcagcatgtacctgctcctctggtcgctgcccgagccggtgagcaagggcctggcagccctgctgacggctacggccattgcctatctgggcgtggacaccgtgtggcgcattctggacggatggatggcgctggtgcgcacggtggaccgagccaccacctttgtacagctcagcgaagcgggcgaggcgtacggcgaagtgctcggggagaacgcggcgcgcgtcttcgtcatgctggccacggcggccatcggccatacggcgggactggcggcgaaggcttcgaggctgccgggctcagcgcaggctgcgctcgcggtggagacgcaagcgggctaccagtatgtggccattggaggcgtgcagtcggtggcgatgacggccgagggattcaccgtcgcactggcgcccaacgcggtcgccatggcggcccggggtatgagcggcggccacaccgaggaccaccacctggcgacgaacaagaacagcgtctccaccgcacgcggcgggccctggacgccgaagttcgagaagattttcaggaaagcaggaatggagttgaaggaccctgagaacatcgtgcccattccgggccacaaagggcctcatccgcaggagtatcacgacctgatccacgagcggctgtacgacgcaacccgccgttgccgtaacgtttctgagtgtagagaagcactgacgagagcactcagacggctggctgcggaaactcgcaccgcgggaacgcggttgaaccagcttgtcaccaagagcgcacagccctag

SEQ ID NO: 8946 - DNA, 2190 bp, Myxococcus xanthus
gtccacttccgcacctgcaacctctgcgaggccatgtgcggcctgcgcatcgagctggacgccggacgcatcacctccatccggggcgacgcggaggaccccttcagccggggccacgtctgtcccaaggccctggcgctggaggacctgcaccaggacccggaccggctgcgcggccccatgcgccgcaccgccagcggttgggagcccgtctcctgggacgacgcattggatgagaccgcgcgccgcctgcatgccatccaacgggagcacggccgtgacgcggtgggcgcatatctgggcaaccccaacgtccacaacctgggcaacatgctgttcggtccggagctgctgcgcacgctgcgctcgcgcaaccgcttctccgcgacgtccgtggaccagctgccgcaccagctcaccgcctacctcatgttcggccaccagctgatggtgccgattcccgacatcgaccacaccggctacatgctcgtgctgggcgccaatcccctggcgtccaatggcagcttgatgacggcgcccgacgtgcgcgcccgcctgcgtgccatccagcagcgcggcggccgcatcgtcgtcatggacccgcgccgcacggagacggcggccatcgccgacacgcacgtcttcatccggccgggcaccgatgcgctcgcgctgctcgccctgctgcacgtggcggtggtggagcacgcgccgcgcctggggccgctggatgccttcaccgacggcctggagaccgtgtgcgcgctggcccgggactttcctccggagaaggtctcaccgcacacgggcgtgcccgcgcacaccctgcgccgcatcgcccgggacttcctctccgcgcgagccgccgtgtgttacggccgcatgggcgtgtccacccaatccttcggcgcgctctgccaatggctcatcaccgtgctcaacgtggtgagcggcaacctggaccggcgcggcggcgccatgttcaccctgcccgcgttcgacgtcgtcggaggtccacgggccctggccgtgggccgcggcggcttcggccgctggaagagccgcgtgcgagggcttcccgagttcgcgggggagttgcccacggcggcgatggcggaggagatgctcacgccgggcccaggccgcatccgcgcgctgctcaccgtcgcgggcaaccccgcgctgtccacgcctgatggcgctcggatggaacaggcgctcgcgggcctggacttcatggtgagcatcgacccgtacctcaacgagacgacgcgccacgcgcacctcatcctcccgccggtgtcaccgctggagcgcagccactacgacatcgccttccacgcgctggcggtgcgcaacaccgcgaagtactcgcccgccctcttcgagcccgggccgggcagccgccaggactggcagattctgctcgccctccagcaccggctgctgacgctgcgcaagggccgcccctccgtgcgcgccacgctcaagtaccaggccctgtcccgtctgggtccggagcgagtgctggacctgggcctgcggctggggccctacggcgcgcgcttccacccggcgaagcagggcctcaccctggagaagctgcgccagtcgccccacggcatcgacctggggccgctccagtcctgcctgccccagcgcctccagacgaaggaccgccgcatccacctggcgccggagctgctggtggcggacgtgcgacgcctgcaagcagccttcccccaggacaccgtccccgagcagcacagtggcgagctgctgctcatcggccggcggcacctgcgcgacaacaactcctggatgcacaacgtaccgggcctgctgaagggcaagccgcgctgcacgttgatgatgcacccggaggacgcggcccggcgggcgctcgccgacggcatggaggccaccgtcacctcgcgcgtgggcacagtgacggtgcccatccacgtgacggacgaggtgatgcccggtgtggtgagcctgccccacggttacggacatggccgccagggcacccggctcgccgtggccaccgcccacgcgggcgccagccacaacgacctcacggacgcgcaggccgtggacgcgctctgcggcaacgccgccttcagcggcacgccggtgcgggtgctacgggcagcggcgcccgaatccgccacaccagcgggatga

SEQ ID NO: 8947 - DNA, 1713 bp, Myxococcus xanthus
atgggctgcttcacgcggctgcccgcgcgcctcgacgagatgcaggcctcgtctggaatctcaccgcggtacgcgcgctggttcagtgagagcgtcgcggcgctggtccggcacggcgtcctctccacgcgcgatggaaagacgtacacccggtccgggcctccttcgcgtcccgatgaggtctggcaggagtgggaagggtcgcgctcgcggtggacgcaggatccgaacacgcgcgcgctgaccacgttggcggagaccaccatcaaggcgctccccgacatcctcgtgggcaggcagctggccacggatgtgctcttctcgcgtggctcgatgagcctggtcgagggggtctacaagcacaacccggtggccgacttcttcaacgacgcgctcgcccggagtgtggtggcgtacgtccaactattgcgcgaacagtccccgggggcacgcgtccgcatcctggagatcggggcgggcacgggcggcgccaccgcgcacgtcctggccatgctgcgcacctgcgcgctggacgtcgaggagtactgcttcaccgacgtctccccggcgttcctccagcacgcggagaagacgtacagccccggcaacccgttcctgacgcgccggctgctggacatcgatgtccctctggaggcgcaggggattccccgtgcgcacttcgacattgtcctggccagcaacgtgttgcacgcgacgccggacatccgccggaccctgcgcaacgccaagtccgcgctggcccagaacgggctgctcatcctcaatgagatcagccacaacaccctcttcgcgcatctcacattcgggttgctcgacggatggtggagctacgaggacgaggacctgcggattcctggctgcccggcgctggctcctgagacgtggaaggcagtgctcgaatcggaaggattcagctcggtcttcttcccggcggccgatgctcacgagcgtggccagcaggtcatcatcgcggagagcgatggcgtcatccagcccatcagcccgcgcgcccagcggcagcgggccccggagcctcgccccgtcatcacggatgccacgtccatcgaggagcgggtccgggacgtcatcaaggcgtgcgtcgcgaaatccctcaaggttccggagtcgcagatccaggtcgactacagcttcgcggactacggcgtggattcgatcatcgccgtgaacctgagcaacgccatcaacgacgcctgtggcacgtcgctgccgacgacggtgctcttcgactacaacagcgtcgcggcgctgagtcagttcattgcccggaatcacggcgccgaggcatcgcggctgttggacgacaagccgcgagaggcgcctgtgcccccgcgcgaagtccttcgtgatgacagggaggcgccgctgcccgtcgccgtgagttccctccggaagacggtggcggtcgcgacggcggaggagcccatcgccatcgtgggaatgagcgcccgcttcgcccagtccgactcggtggaggcgctgtggcggcacctggaggcgggacgcgacctggtggaggacgttcgccgctgggacctggcgagccactacgcctccacgctgtcgggcgagggcgaccggtgcatgcggggcagcttcatcgaaggcaaaaaccgcttcgacccgtccttcttcaacatctccgcgctggaggcccgatgcgtggacccgcag

SEQ ID NO: 8948 - DNA, 7680 bp, Myxococcus xanthus
atggcgcgtgccgcgctccagctcgccgaaggggaggaggcggcggtcgtccggcccgttcgcgtgacgaacgtgacgtggccccagccgcaggtggtggaggggcccacgaccgagctgcgcgtgtcgctgttccccgaggacgatgggcgcgtgcgattcgacatccacagcggctccgacgacacgcacgtctgccacagccagggcctggtgactttcttcgagccgaagcccgcggcggcggtggatgtggccgccctgaagtcgcagtgccagcgcggtgagctgtccgccgagcagtgctaccaggcctttgcgtcactgggggccgcttatggaccggggcaccgggcgctccgcgccgtctatcagggcgttgaccaggtcctggcgaggctcgtccttccggagggcctcggttcgacggtggcgccctacgtcctgcacccctcgctgatggatgcggcattgcaggcgaccatcggcctgagcgcgcaggagtcgccggctcccatcgggttgccgttctcggtggatgcggtggaggttctggctccttgtccgccccagctgtgggtctggatccggaacgcagcgggaagcactgcgggaggggctgtgcggaagctggacctggacctgctcgcggacgacggacaggtgtgcatccggctcaagggcttcctgatgcggccggtgaaggagctgcgcgccgcgcccgcgcctcgaatcctggctccggcagaagaggtggatgcctcgccggccgatgccggacccttgggggacccaagctcggtgcgggaccagattcgcagcgtcctcatcacggaggtcgcgcgggccgtcaaggtcagcgcgggtgacatcgagatcaacacggagttcagtgagtatggcttcgactccatcagcctgacggagttcaccagccggctgaaccacgggtatggcctgtcgctcacgccgacgctgttcttcgagctgcccaccattgcagcgttgtccgagcacctcgctgagaagtaccggcagaacttcgaccggtacatggtcgtcgccaagcgaggcgccgattcggggaacacaccagcgccgacgaaggcggtggggccgaaggcggaggcacggcggctgcgacgcatgcctcggccgtctcggagcgcggaaccgctcacgtatggcaatgacgaaccactggccgtcatcggcatgagtggccgcttccccatggccgaggacctggaggcgtactggcggaacctgcgggacggtgtcgactgcatccaggagattcccgcgtcccgctgggactggcgggagatctacggcgacgcgaatcaggagcccgggaagacgctcatcaagtggggcgggttcatcgacggcatcgacgagttcgacccgctcttcttcggcgtctcgccttccgaggcggagctgatggacccccagcagcgcctgttgatgacctacgtctggctggcgatggaagacgcgggctactccgccagctcgctgtcgggtactcggaccgcgctgttcatcggcacgggacaggccgggtacggctcgctcatcgagcaggcgaacgccgaaatcaagagctacgcgtcgacggccgcggtgccctccgtgggcccgaaccggatgagctacttcctcaacatcaagggcccgagcgaacccattgagacggcctgctccagctcgctggtggcggtgcacaaggcgatgttggccatccaccggggcgagtgcgacacggccatcgtcggcggcgtcaacacgctcccgacgcccgcggggcacattggcttcgacaaggccggcatgttgagcccggatgggcgctgcaagacgttctcggaccaggcgaacgggtacgtgcgcggtgaaggcgtgggcatgttgatgctgaagcgcctctccctcgccgaggcggatggcgaccacatctatggcgtcatccggggaagcgccgccgggcatggcggacggacgaactcgcccaccgcgcccagccccaagtcccaggccgagctgctgcatgcgacctacacgcaagctggcatcgacccgcgaaccgtcacgttcatcgaggcgcacggcacgggaacctcgctgggagaccccatcgaaatcgacgggctcaagagcgccttcaccgcgctggacccgacgctcggcgcgggccccgtggaccgcgccttctgcggcctgggctccgtgaagacgaacatcggccacctggagctggcggccggcgtcgccggcgtcatcaaggtgctgctgcagatgaagtacaagacgttggccaagagcctgcacagcgagcagttgaaccggcacatccgtctggacggttcacctttcttcatcgtgcgcgagacgcagccatggcccgcgttggaggacggcgccggcaacgtggttccgcgccgggccggcgtcagctcgtttggcatcggcggtgtgaatgcccacgtggtcgtggaggagtacctgccatcgagtgcgcccgccgcggaggttccgcaagacgcgccgcacctcatcgtgctgtcggcgaagaacgaggcccgcctcatcgagcgcgcgcggcagttgctgcatgccgtggagcaaggcgaggtgtcgcaggcggacctgccgtcggtggcgtacaccctgcaagtcggccgcgatgcgatggaggaacggctggggctactcgcgcgctcgttggaggagctgaaggagaagctcctcgagttcaccgagggcagggggctggcggacagcgtgtaccggggccacgtgaagcggcataaggagttcctgtccgtcttcgcggatgacgcggagatgcaggaggcggtggccaagtggatggcccggggcaagctgtcgaaggtcctagaggtctggacgcgtggcatgcccgtcgactgggcgaagctgcatggcggcgcgcagctccggcgacggagccttcccacctatcccttcgcgaaggagaagtactgggtagcgaagccggcgcgcgcggagaaccgcgtccgggccggcagccgggcggccctgcatccgctggtgcatgagaactcgtccgacctgcgggggcagcgctacagcgcccacctcacgggagaggagttcttcctccgagaccatgtcgtgggccaggacaaggtgctgcccggcgtggccttcctggagatggcgcgcgccgcggtggtgaacgccagtggcctgacgcctcccggcaaggtgacactgcggaacgtcgtctggtcacggcccatcatcgtgaccgacgccccggtgcaggtgcacatcggtctggaggcggagcaggacggcagcgtcgtcttcgaaatctacggaggcaccgacgaggcgccgctgctcttctgtcaggggcgggcgcgcatcggcgctgggacggacgaggaggccactgcaccttgcgtggacctgtcggtcctccagtccggttgtcaggaccggcgacagagcggcgcggccgtctaccagacgttcgcgtcggccgggctgacctacggacccacgcttcgtgcgctccaagagctctcggtgggtcgtggccaggtgctggcgcgggccgtgctccccgagcaggtgttgagcagccaggggcagttcgtcctgcatccgagcttgctggatgccgcgttgcaggcggccctcggtctgcactcggacgagggaggacagctctcgcttccgttcgcgctcgatgcgctggaggtgtgggacgggcctgctccctcggacgtctggattcacctgcgcgatgagacggacggcgccgcgggtaagaaccggcagaagatttccatctccctctgtgaccgcgacggcaaggtctgggtccgcctgaagggattctccacgcggcccgtgcccgcggccggtgtgcgcgctggcgccgagaatcacgtcctcctgttcgcgcccatctgggaggagacggcgctcgcgagcgcgcctatcacagcggcgcggcgccgggtgctcgtcttctgtggcgccaccagcgccgtggccgaggccgccgcgaaccggattcagggggcgcagaaggtggtcatggggacgtcggccgccagcgcgccggagcgcttccgtgagctggttcagaagctgttcgaggccatcaagggaatggcgttgcaagcaggccgcgaggcgacgctgctccagtgtgtggtgtccacgcaggacacggagcgggactccctgaggggcttgctcggtctcttcaagacggcgcgactggagcacccgacgttgcagctccagatggtggaggtcgacgcgccaacggacgtcgagcgagtggtcgcgcggctccagtccagcagcacggcgccggagcttccgcacctcctgttccaggacgagaaggtgttggtgacccggtggcgggagctgacagcgccggccccggaggcgccactctggcggaaggggggtacctacctcatcaccggtggcgcgggcggcctgggcaagcggttcgcgcagaccatcgtcgaggccacggagcaagcctccatcgtgctcacgggccgttcgccggcgggggatgcgcagcgggcattcatggagtccctgcggcggcccggtgtgcgcgtggagtaccgcccctgtgacgtcacccgtgccgaggactgtcaggcgctcatcgcctgggtgcgggacaccttcggcggactcaatggcatcctccacgcggcgggcgtgattgaggacagcctgctcaagaacaaggactgggaggcctgggagcgggtgctggcacccaaggtccaggggctcacctgtctggacgaggccagccgtagcgaacggctcgacttcttcgtgatgttctcgtccttcgcgggggccatcggcaacccggggcagtcggactacgcggccgcgaacgcctacatggatgcgtatgcccgccagcgggaagcgcgagtggcccggggcgagcgcttcggaaagacgctgtcgatcaactggccgctgtggcgcgagggcggcatgcatgtcgacgccgcgaccgaacagatgatgacccatgccaccggcatggcggtcctggagacgaccgccggcgtgcaagccttccagcacgccctggagcacgcgcagagccaggtcatgatcctggcgggacaggccgagcggatccgcaagtggctgggccgcagcgggctgctggaaggaacgtcggtgagcccgagcccgtcggccagcgcgacctcaagcaccgcggagccgggggatgaagtacgtgcccgcgtctcggcgatgttgtgctcggagatcgcggtggtcctcaaggtggatgccgccgccgtggacgcggacagtgagctgagtgagtacggattcgactccatcaccctcaccgagttcgcgaacaggctgaaccgggcctacgagctcgacctgacgccgcccgtgctcttcgagtacccgagcgtggatacgctggcgggctacctgctgcgtgcacaccgcgagtcaatggtgcaccacttcggtgagcaggaacgcggcgccacgccggaagtcgtcagcctggccgaacggatgcccgcggccgagccagtgacatccgcgttgaggacgcgtgagcggaggggtggctcgcgcggacgttctgttgaaccggcgcggacggacgcgccgtcgacgtccacgccggcccgccggggacccacgcccctggccgtggtcgggatgagcggctgcttccccggggcccgtgacctggagcagttctggaccaacctggccggtggtgtcgactccatcaccgaggtccctgcgtcgcgctgggattggcgcgagctctacggagacccacgcaaggaggggaacaagacgaaggtgaagtggggcggcttcatcgaaggcgtcgaggagttcgatccactcttcttcggcatctcacccgtcgaggccgaggtcatggacccgcagcagcggctgctgatgatgcatgtctggcgggccatcgaagacgccggctacgccccacacagcctgtcggggacgcggacgggcatcttcgtgggcaccggcatcaccggctacaacagcctggtcgagcgggcgaacctcgccatccaggggtattcgtccacggcggtcgtcccgtcgattggtcccaaccggatgagctacctcctcaacctccatggaccgagcgagcccgtggagaccgcctgctccagttcgctggtggcgctgcaccgggcgatggaggccatcgacagcggaagctgcgacatggcgctcgcgggtggcgtgaacacgattgtcacgcccgggggacacatcgcgttcgacaaggccggcatgctcagcgaggacggccgctgcaagacattctcagccactgccaacggctacgcccggggtgaaggcgtcggcgtcgtcttcctcaagcggctggcggacgcggagcgggatggtgaccccatctacggcgtcatccgcagcagtgcggagaaccatggcggccgggccaactcgctgacggcgccgaaccccaacgcccagtcgcagctcctccaggacgcctaccggaaggcggacattgatccgcgcaccatcggctacgtggaggcgcacggcaccgggacggagctcggagacccggtggaggtgaatggcctgaagagcgccttcgcggcgcaaatcgaggcccggggtggcggtacgagcctcgagaagcactgtgggctcggctcggtgaagagcaacatcgggcacctggagctggccgctggcatggcgggcgtcatcaaggtgctgctccagatgaagcaccggatgctggtcaagacgctgcactgcgagcgcttgaacccgtacatcaagctggaggacagcccgttcttcatcgttcagcagacgcaggactggccggccctgatggacgagcgcgggcagccgctgccccggcgcgcgggcgtcagctcgttcggcttcggtggcgtcaatgcgcacgtcgtcatggaggagtacctggggaacgctcgggccaatgcggccaaggcggatgtgccccgtgggcccgtggccatcgtcctctccgcgaagaacgccgaacggcttcgggagcaggccgcgcagttgctggatgcggttcggagcgggcgctggtcggacgcggagcttccctcgctggcctacacgctccaggtcgggcgagaggccatggaggagcggttggccatggtggtcgactccctggcggcgctggagacccggctgcaggtgttcctcacgggaggcagggaggggctcttcgtggggggccgcgctggcagggcgcatccgtccgggaagggttccgccgaggcagaagccgccgtacgagacgcggtgacggcgtggaaggcgggagacgcctcgccgttgctcgggctgtgggcaacgggggggaccgttgactggacacagctctacgcggcgccgttgagccgcacccacgtccccgcgtacccgttcgcgcgggagcgttactggatttcccccgcgcccccgcgggaacaacagacgcttgaaaaaccggttgctcagacacgcccatcgctgatcggacagctgcggacgcgcatcggcgcggccgctatcgagggagaaaccgtcaatgattga

SEQ ID NO: 8949 - DNA, 2034 bp, Myxococcus xanthus
atgacgcacgtatggcgcgccatcgaggacgcgggtcacgctccgcagagcctggctggcagcaacaccgccatcttcgtgggaacgggcaacaccggctatgcgtcactgctggagcgttctggcgtcgccatcaagggaagcaccgccaccggctccgtgccttccgtgggaccgaaccggctgagctacctgctggacctccatggccccagcgagcccatcgagaccgcctgctccagctccctggtcgcggtgcaccgcgcgctcctcgccatcgagctggggctgtgtgacgcggccctggtcggcggggtgaacaccatcgtcaccccggacgcgcacatcggcttcggcaaggccgggatgctgagtgaggacgggcgctgcaaggccttcgctcgcggcgcggacggctacgtgcgaggcgagggcgtgggcgtgctgtacctcaagcgcctcagtctggccgagcgcgacggggaccacatctacggattgttgctgggcagcgccgagaaccacggcggccgggcgaactcactcacggcgcccaaccccaaggcccaggctgacctcatcgaggccgcctggctgcgcgcgggcgtggacccacgcacggcgggctacatcgaggctcacggcacggggacgtcgctgggagacccggtcgaaatcaacgggctcaagagcgccttccactccctctacgagaagacgggggcggctgaaggcaccgacgcgcacatcggcattggctcggtgaagagcaacatcgggcacctggagctggccgccggtgtggcggggctcgtcaaggtgctgttgcagatgcggcacggggtgctcgcgaagagcctccattgtgaggagctgaatccctacatcgcgctcaaggggtcgcccttctacgtggtgcaggaaggccgtccctggctcgcgctgaaggatgccagcggccgtccgttgccacggcgcgcgggcgtcagctcctttggctttggcggcgtcaacgctcacgtcgtcgtggaggagtacgtaccaagccacgaagcgactccgacgccgctgcgtgggccggccatctgcgtgctctccggtcggacggaggagcagctgcggcaacaggcccggcagctgcacgaggcggtggagcgggaagggtaccgggacgaacacctgcccgcgcttgcgtacacgcttcaggtgggccgtgacgccatggaggagcgcctggccttgttggtggactccatcgccgggctccaggagaagctccgtgccttcgtggacggcgcgggcgcgggcgacgcggtgttccgcggtcacgtgaagcggaacaaggacgcgctgtccgtgttcacgggcgacgacgacctccaggaggccattgcgtcgtggttgagcaagggcaagtaccacaagctgctcgacctctggaccaagggactgtcgttcgactggaaccggctgtacggggcccagcggccgcagcggctgagcctgcccacgtacccgttctcccggacgcgttactgggtcccggaaggggaacagcctgccggtgtgcccacgtggggagcgctgagggctggcggcgtggacgccctgcatccgctgctgcggcggaatgtctccgacctccgccagcagggctacgaggccgtgttcagcgcggaccagttcttcctcgctgaccacgtgattctaggcaagcgggtggtgccccggcgtcgtctacctggagatggcgcgtgccgcgctccagctcgccgaaggggaggaggcggcggtcgtccggcccgttcgcgtgacgaacgtgacgtggccccagccgcaggtggtggaggggcccacgaccgagctgcgcgtgtcgctgttccccgaggacgatgggcgcgtgcgattcgacatccacagcggctccgacgacacgcacgtctgccacagccagggcctggtgactttcttcgagccgaagcccgcggcggcggtggatgtggccgccctgaagtcgcagtgccagcgcggtga

SEQ ID NO: 8950 - DNA, 87 bp, Myxococcus xanthus
gcgaaggtgccgggacaccggtatccggtcgcggtggtcggcatcagtggcgagttccccggcgcccccgatctggcggccttctga

SEQ ID NO: 8951 - DNA, 477 bp, Myxococcus xanthus
atgttcctggacgaactagaccaccgcatcatcgacatgttgcagcgcgatggccgcgccacgcagctggagctgtcgcgtgcggtgaagctgtcccagccggcggtggcggagcggatccgcaaattggaggagcgcggcgtcatcacgggctactcggcccgcgtggacgcggcgaagctcggcaaggacatcacggccttcatcggcgtgagcatcgagcacccgaagtacttcgacgagttcttgcagaaggtgctgttgctgccggatgtcctggagtgccaccgcgtggcgggccaggactcataccttctcaaggtgaagacggcgaacacccgttcgctcgactccctcctggtgggaacgctgcgcaccatcgcgggagtcacccgcacgcagaccaccatcgtcctgacgtccatgaaggaggacacgcatgtccgcgtgcctccagacaccccaaaaggagcgtga

SEQ ID NO: 8952 - DNA, 486 bp, Myxococcus xanthus
atgagccttacgtcagtggagttggagtcggaccgcaccatcgtcatttctcgcaagttcaatgcgcccgcgcgcatcgtgttcgacgcgtggactcgggcggacctggtgaagcgctggtgggcgccgaaggccctcggcgtcaccatggcgagctgcgaggcggacgtgcgcgttggcggcggctaccgttacgtgctgcgcaatccggacggcggtgaggtggccttctccggccagtacgctgaaatcactccgccctcgcggctcgtgtacacgcaggtcttcgaaccgatggcggacgcgggttcggtcaccatcaccgtcaccttcgacgagcgcgacggaaagacacacatggtctcccgcgaactgtatccgtcaaaggaagtgcgggaggccgtcctcgcgtccggcatggagcacggcttgcgcgaaacgatggagcagctcgacgcgctcgtgtcgtcgccgggcctcgactga

SEQ ID NO: 8953 - DNA, 1209 bp, Myxococcus xanthus
gcgatgagcgccccccttcccccgccgcccgtatggcggttggcccagcggatgtcccgcatcaagacgtccgcggtgcgcgaaatcctgaaggtcgccgagcggcccgacatcctctccttcgcgggaggcctgccagccccggagctcttcccgctggaggccatcgccgaggcgcacgccgaggccctggcgaccgagggccgcgccgcgctccagtacagcaccaccgagggcttcggcccgctgcgtgagtggatttgcggccacctccagaagcgcggccgccagtccaacgcggaccaggtgctcatcaccaacggctcgcagcagggcatcgacctggtggccaaggtgatgctggaccccggtgacctcgtcatcgtggagaaccccagctacctggcggcgctgcagacgttcggcgcctatgaggcgcgcttcgccacggtgggcagcgacgaccagggcatgcgcaccgacgacctgtagcgcctgctggccacacacaagcccaagctggtgtacgtggtcgccaacttccagaaccccaagggcaccaccctgtcgctggagcggcggcgcgaactggtccgcctggcccagcagtaccgcttcctcatcctggaggacgacccgtacggcgagctgcgcttccgcggcgagcacgtgccgtccctgtccgccttctacgacgagggcgtcgtcgtgtcgctgggcaccttctccaagacgctggccccgggcatgcgcctgggctgggtggtgggcccgcgcgacttcgtgcgcagcctggccatcgccaagcagtccaccgacctgcacacggccacgctggctcagcgcgcggtggtgaagctgctggcgcgcttcgattacgcggcccacctggagtcgctgcgccccgtctacggcgagcgcgcccaggccatgctggacgccctccaggcgcacatgcccgcgggcacccagtggacgcaccccgaaggcggcatgttcctgtgggtggagctgcccggcgggctggacgcccaggcgctgctgcccaaggcggtggagcagaaggtggccttcgtgccgggcgcgcccttctacgccaacaacccgcgcccggagttcatgcgcctcaactactccaaccgcccgccggacctgattgccgagggcatgcgccgcctgggcgccgtgattgccgccgagctgggttga

SEQ ID NO: 8954 - DNA, 747 bp, Myxococcus xanthus
atgcagctcaaggacctgaagatcatcgtcacgggcggcgcccagggcatgggcgctcacttcgcgcagcgcctgcacgaggcgggcgcccaggtggccgtgggtgacgtggccgaggagcgcctcgccgcgctgcccgccggcatccaccgccgcaagctggacgtgtcctccgaggaggacatcgtctccttcgtgaactgggcgcagggcgccatgggcggcctcaacgggctcatcaacaacgcgggcatcctccgtgacgcgctgctggtgaagaaggaccggaccaccggcgaggtgaagaagctgtccaccgcggactggaacgccgtcatcggcgtcaacctcacgggcgccacgctgatggtgcgcgaggtggtggcgaaggtcgccgagtccggccagaagggcggcgtggtcgtcaacatgtcgtccattgcccgccacggcaaccgcggtcagtccaactacgtgtccgcgaaggcggcactggcggccaacaccgtcacctggtcgcgcgagttcagccccttcggcgtgcgcgtgggcgcggtggccccgggcatgattgagacgccgatgacgcagggcatgaaccagaaggcccgcgacgcgctggtctccaacatccccgtgggccgcatcggcgtgcccgaggacatctggctcgccgtgaagttcatcctggagtgcgactacttcaacggccgcaccatcgacgtggacggcggcctcaacttctga

SEQ ID NO: 8955 - DNA, 624 bp, Myxococcus xanthus
atgaagaagaagctgctgctgtccgcggtgatgacgtctgcgctgtccctggtgggctgtggtgagagcgacccggtggacaacacgcccaacctgagcacgccgcagggcatcctggcgttcgtggaaggcaagacgctgacgatgactggggccaacattcccagccatccgaacggcttcagtgaagacatcaactttggtgccagctcgcagtgttatcagagcgtcaccatgacggtgcagggcggcaacttccgggtcgacagcatcccgggcaccatcgagggcgcgccgaacgcgggcatgtccggcacctgcaaccccgagctcccgcagaacgcgctgtccttcacctcgaccgtcgtgagcatcgagaacgtgcagggcgacggcgagtgcttcgacgtcgcgttcacctacccgggcttccggcaggtgggccgcggcgcgttctccgcggaccggcggacgctggacctggagctcttcttcgagggcggcgccacgggcgccaactgcgcggcgggtggtgtgggctcggccacggtgaaccaggtcatcgggggcgagagccggccgttcgatggcaaggcggtgcagcgctacaccatcggcggttag

SEQ ID NO: 8956 - DNA, 1578 bp, Myxococcus xanthus
atgacggagggcgcgcacatgttcatcggtgactggatgggccgtggcgccctctactggcccgacagtgtcgcggtggtggacccgtcccggggtgacgcgggccgcttcacctaccgcgcgatgaacacgcgcgccaccgcgttgggcggctggctgcgtgacgtggccggcgtgcagaagggcgaccgggtgggcatcgtggcccacaacggcgtggagtacctggacgcgctgttcgcctgcgcgaagattggcgccgtcttcgtccccttcaactggcgcctgcacgccgccgagctggcggacctggtgcgctccatccgtcccggcgtgctcttcttcggcgacgacttccgcgacaccgtggcggatgtccgcgagcgcctgggcggtggcccccggctggtgtccctggagtcgcaaggcctgccgggcgcggacgcctacgcggcgacgctggcccacgtgccgggctcgccggtgacgcaggacgcggtgtccgaagaggacatcctctgcctcatcttcaccggcgggacgacggggcgctcgaagggcgcgcgcgtcagctaccgcatggtggcgtggaacaccctcaacacgttggtccacgaggtgcggcccggcgacgtcacggtgacgcacacgcccatgttccacacgggcgggttgctcgtgtacacgctgccgctgctcaccgtgggcggcaccgtcgtcctcatgcgccggtgggagccggaggcgctgctggacctcatcccccgggagaaggtgacgctcttcttcgcggtgcccacgcagtaccagcagctcctggagtcgccgcgcttcaagacgacggacttctcctccgtgcgcttcatgaccagcggcggcgcggcgctgccggtgccgctcatccaggcgtggcaggcggtgcacccggtgcccttcaagcagggcttcggtatgacggagttcggcccgggcctcttcagcatgggaccggagtacgcggtgtcgaaggcgggctccattggccggcccaactacttcatcgccgcgaagctggtggatgacgacggccgggaagtccccacgggcgaggtgggtgagctgctcctcaagggcccctccatgtgctccggctactttgaagacgaggccgccacgcgcgaggcgattgacgcggaagggtggctgcacaccggcgacctggcgcgcgtggatgcggacggcttcttcaccatcgccgggcgcaagaaggacatgttcatctccggcggagaaaacatctacccgctggagctggagtccgcgctgtatgagcaccccgcggtggcgcaatgcgccgtggtgggtgtgcccgacgcgaagtggggcgaggttggccgcgccttcgtggtgctgaagccggatgggaaggtttcggcggaggcgctgttggagcacctgcggggacgcgtggcgcgtttcaaggtgcccaagcgcgtggagctgatggagcgcctgcctatctccgcggccggaaagattctcaagcgtgagcttcgcgacgcggccgtggccgcggaccgggacagctcgcgtcattga

SEQ ID NO: 8957 - DNA, 996 bp, Myxococcus xanthus
atgcgatacgcccagattctctccactggccgctacgtccccgagaaggtcctcaccaacgctgacgtcgagaagattctcggtgagaaggtggatgagtggctccagcagaacgtgggcattcgcgaacgccacatgatggcggatgaccaggccacctccgacctctgcgtgggcgccgcccgccaggcgctggagcgcgcgggcacgaagccggaggaactggacctcatcatcatcgccaccgataccccggactatctcagccccgccacggcctccgtggtgcaggcgaagctgggcgcggtgaacgccggcacctacgacctcaactgcgcgtgcgcgggctgggtgacggcgctggacgtgggctcgaagacgattgccgcggatgacagctaccagcgcatcctcgtcgtgggcgcctacggcatgtcgcgctacatcaactggaaggacaagaagaccgccaccctgttcgcggacggcgcgggcgcggtcgtgctgggcgcgggtgacacgcccggcttcatgggcgcgaagctgctggccaacggcgagtaccacgacgcgctgggtgtctacaccggcggtacgaaccgcccggccaccgcggagtcgctggagctcacgggcggcaagcccgcggtgcagttcgtccgcaagttcccggcgacgttcaacaccgagcgctggcccatgctgctggaccagctcctcaagcggcagaacctgaagctggacgacgtgaagcagttcgtcttcacgcagctcaacctgcgcaccatcgaagccaccatgaagatcctgggccagccgatggagaaggcccactacaccatggacaagtggggctacaccggttcggcctgcatcccgatgacgctggatgacgcggtggtgcagggcaaggtgcagcgcggcgacctggtggccctgtgtgccagcggcggcgggctcgccatggcctccgccctctaccgctggacggcctga

SEQ ID NO: 8958 - DNA, 708 bp, Myxococcus xanthus
cccgtcacgccgcgaggccagaagacgcgtgcgaagctgttgaaggccgcggagtcggtcttcggtgagaagggctacgagcgcgcctccatcgcggacatcacgcgcaagggtggcgtggcgctcgggacgttctacgtctacttccccgacaagcagtccatcttcgtcgaagtggtggacgaactgggcacgcgcctgcgccggctcatcgccgagtccgtggccggctgcgaggaccgcgtcgacgtggagcgccagggcctgcgcaccttcttccagttcgtgcggcagcaccccaatctctatcgcgtggtgcgccaggcggagttcgtggatgaggcctgctaccgccgctactacgaccgcttcgctcgcggctacgtgagcgggctcacccgcgccatggaggcgggccaggtgcggcgcatggacccggaggcgctggcctactgcctcatgggcatcagtgatttcctcggcatgcgctgggtcctctgggaggaggacccggggctcgagcgcgtcctcgacaccgcgatgacgctcatctcccacggcctggacccgcgtgcgtccacgggccgcaacaccgtgaagtcctccgccgcttcgaagccgaagccgaagctgaagcccaaaccgaagcccctgaagaagaacaccctgcgtcccgcccgccgaccggcgcgcggcgcccggagctga

SEQ ID NO: 8959 - DNA, 120 bp, Myxococcus xanthus
atgagcgccgtgtatctgcccgtctacgtccaggatgcgctcgaggccagcctggagcgcatcacgcgcatccgtgctggcgcactccgtgccaccggcaatcactcaggccgaggatga

SEQ ID NO: 8960 - DNA, 465 bp, Myxococcus xanthus
cgcgtggaccccgacctgctccagggcttcatccgcgaggagagccgcttcaatgcccgcgcgcgttcggccacgggcgcgctgggcctggcgcagttgatgcccaccacggcgagacaggtggcggactcactggacatgccgatgccgggtgagtccgcgttgctccagcctcacacgaacatccgcctgggtgcggcgtacctgggacaactggtcaaacacttcggaggcaacgtggcctacgcggtggcggcctacaacgccgggccgcgcgcggtggagcgctggcggcatgcgctgcccgaagcggagctcgacgagtgggtggagcacatcggcttcgaggagacgcgcgagtacgtgaagaaggtgctcggcagctacagcgcctacaagctgctctacgcggacgagcccgcgctgctgagggacctgcgcctcagtgacgccagccggcggtga

SEQ ID NO: 8961 - DNA, 435 bp, Myxococcus xanthus
atggccttcatcgtggacatcgagcagcccctgtcaccgttcatctcggtgttcgcaggcgggcacgtgggcgtgaacctgaaggcgacgggcctccaggctggcggccgtgtttatctgaccgggaggcccttccagggccccttcctgtccgtccagggcgatggcaccttcttcgacgcggatgacgatgtgtcgaagctccgcgcctccgtcagcggactggtcgggtattcgcagcagttgggcaaccagtggcatatcgccttggcgggcggcgctgggttcagccacctccggcaggagaccgagctgccgcgctccgcgacctgcacgctgttctcctggtgtctgctttcgacgcccgagcgcaccgtcgagacaacgcagacgctgcatcccgtcgtgaggctcacggcggtacaccggttctag

SEQ ID NO: 8962 - DNA, 195 bp, Myxococcus xanthus
gtgctctacgtccggccgactcggcgcgagcatgagcgcgatgcggcgttcgccgagctcgccgccctggcgacgcccctggaccgcgatgccagaccggaggaggtcgcgcgccagattggcttcctgctgtcggatgactgcgcgctgatgacaggcacgaccttgctgagcgacggcggccgcacgctctga

SEQ ID NO: 8963 - DNA, 219 bp, Myxococcus xanthus
atggtgcctctgaccgaccgggcttcgctacctcaggaagcgcgctccgccctggaaaaggagctggcgtccctgacgctgctccaggacgtcgtgcgatggggcttcgcgagctcgccgccgcgcgatgtcacggaggtcatcgtccaggacgagttcacccacgacgtagtgatgccgtggatggaaggcagctacctcgtctttgacacgacctga

SEQ ID NO: 8964 - DNA, 111 bp, Myxococcus xanthus
atgaacgagggcacctgggccgccgcggtgaatgcggccaacaaggacaccacggcgcacaacgaaacggcgcgggcgcgccaacagttcctgcgcacgcccacttgctga

SEQ ID NO: 8965 - DNA, 2655 bp, Myxococcus xanthus
cctccccgggcggcatccgtgctggtgccgtgtggcgccgccttgcggagaatcgaccatggggtgagcgggaagctggtgctggtgacagccccgctcggctccggcaagacgacgctgctgacgcagtggtaccgcgaagcacgcgtgccgcacctgcttgcctggctgtcgctggacgagcaggacaacgctcccgagcggttcttcgcatacctggtcggggcgattcgccgggccgctccagacttcgacgcgtacagcacgagccagcccgagcacgcgacggccgtcatcctgcaaagcctgtggagcctgggccgcgagctcgtcgtggtgctggacgacttccatgtccttcgcgagcgcccactggtgcgggccttctcgtacctgctggaccactcaccaccgcacgtgcattgggtcgtctcgtcgcgcaacatccccgagctggacctggccaagctgaagctcaccgagcaactggtgacgctcgacggccgggacttgaacctggacggcgaggccatccgcgagctgggcctgcgcctgtgcggcgcggtgctcacgccggaggacatcgactccctccgcacgcggacagaaggctgggtcgctggcgtcaagctggcgctgctgtcggcgggtgagcacgcgagcgtgagcgatgcgctgaggaaggccattggctccaatcacgacgtggcccggtacctggcggacgcggtgctgcgcgagcaacccgaggaggtccgcgagttcctggtgctgagttccgtggtggagcaactccacggcgcgctctgcaacgcgctgcttggcatcacccgaggacacacactgctggggcagctcgagcggtcgcagttgttcatccaggcgctcgacaccgagcggcagtggtaccggtaccatccactgttcctcgatgtgctgcgcgcccagctcgcctgtgactacgcggaccgcattcctcggctgcaccgtgcggcgagcgcctggttcgcggagaaccagatgccggacgaggcgctgacgcatgcgttcgcctcggaagacagggactggtgtctcgcgctcaccgcgcgctgcatggaggcgtggatgcgcgagggcgagctcgcctccgtcctccactggaccgcgaagctgacggcgcaggaggtcatccggtcaccagccatctgcgtgggccacatcgcctgcctcatcctgtcccgtcgcttcgcgcatgcgaccgcggcgctgcgggatgcccagcaccacctcgacacggccgatgaggtatccgcccccgaacgcgagcggctgacgaagcggctcgcacatctcacgctgcttcacgccgtgttgtccgattcggcgccggacaccggcatggacctggacgcgtctccgggctccgaggagtcggacgtcttcatcgcgggcgccgtgctggcggcgaaggcctaccgggcgctccgaatgaaccgcttcgatgcgatgcgccgactcgcgctgagcgcccgggagacgttgcaggggcacaacaacccgttcctggtcggatacacggacgtccttgtcgcgctggcggaccgggcgcaggggaacatgaaggacgccgcggcgcgttgcgaggaagccttcgagcgcgcgagtcgtggacggcgcaaccccgtctgggcgaacgcggccacggcgctggccaacgctcgctatgagcagaaccggctcgacgaagccgaggcgctctgcgtcgaggtgctgccgctgctcccgcaggcctccgtgttcgagacgttcgcgctcgcctacctcatgctggcccgcatcaagacggttcgcgggaagtacgcggaggcgtaccggctcctggactacctccacggcgtgcttgagtgcggccaccagacgcgcttcctggcccatgtctgcggggagaagattcgcctctacctggtggagcaggcgcccgcacgaatgcgggtggtggcccaggagttcggcctgggcgagcgcatgcgccggggcgagtggagcgagaagcgcttctacgacgagacgtgggagcggctcggactcgcgcaggcgtgggtgctgatggcgcgcggccgtcacgacaaggcgcacgcgattctggaggtgctgcgggccagcgcgcacgaggtgggctatgtgtcacgcgagacggcgctgctggccaccatcgcggtgtgccactggcgcgcgggtgacgcgatggccgcattcgcagcattgaaccggggcttcgcactggcgcagcgcttcggcttcgggcgcagcgttttcgacgagacgccgggcctgcaggaggtcgtcatcgcggccgcccggcaacggaagctgagctacgcgtttcccgaccggtacgccacgcggtaccaggacctgctgtccgcgggaacgcgcgtgcctcgagagttcgcggctccaccctccgcgcccctggagccactcaccgagcgcgaactccagatgctcaagctgctcgcacaggggctgagcaatcaggagatcagcgagcgctccaacgtcgcgctttccacgaccaagtggcacctgcggaacgtgttcgccaagctggacgtgaccacgcgcaccgccgccatcgtcaaggcgcaggagcgcctgcagaggcacctgtga

SEQ ID NO: 8966 - DNA, 378 bp, Myxococcus xanthus
atcgagaccgagcgcctcgtcatgaagggtcacagcctcgaggactatgaggagtgcctcgcgctgtggagtgaccccgcggtggtccgctacatcagcggcaagccgtccacacgcgaagagatgtggtccaggctcctgcgttacgtgggccattgggacctgctgggctttggattctgggtggtgcgtgagaaggcgacgggccgcctcgtaggcgaggtgggcctgggcgacttccaccgcgacatgcagccgcccctgagcgccgggcccgaggcgggctgggtgctcgcccccggcttccacggcaagggttacgccacagaggcggtacgcgcgggcgctggcctgggcagatgcccagctcagccctga

SEQ ID NO: 8967 - DNA, 261 bp, Myxococcus xanthus
atgaccatggccccggtgaagcgacccacgctcaagcgcgccgtcaacccgatgcccgcgaatgtccgggcggcgttgctccaacgcgggctcatggacgcgtacaaggcgcgtccgccgtaccagcagaatgactatctcgggtggattgcccgggcaaagctggaggcgacccgacagaagcggctcgaccagatgctggacgaactggccggcggcacgaagtacatgaacatggcgtggtctggcgggcggaagtag

SEQ ID NO: 8968 - DNA, 1743 bp, Myxococcus xanthus
  unsure (1)..(1743): unsure at all n locations
atgcgcatcaccgtcatctccgggggcacggcctacccgcggcacctcaacaagcacatcgactactcgaagctggcggggaagcccggcttcgacccctcggtgaagaaccacagcctctccacgccgacggagatggtcgtctcccaggatggcacgaagctgtacgtggccgcgttcagctccagcaagattggcgtctacgacaccgcgtcgctggagagcaatgcgttcgacccgcgcaccgcgagcgccaaccacatccccgtgagtggcggcgggcccagcggtctggtgttggacgaggcacgcaaccgcctntacgtgatgacccgcttcgacaacgcggtgaatgtcatcgacctggccaccaaggcgcagctgtcctcggtgtcgctctacaatccggagcccgcctccgtcgtccagggccgcccgttcctctatgacgccaacttctcatcggccaacggtgagtcgtcgtgcgccagttgccacatcttcggtgacaaggacgagctcgcctgggacctgggcaacccggatgcgacggtgacggccaatcccatcaacatgcgcctcgcgagcgacctcgagattggcatcttccgttccttcaccggccacccgagctcacccatcaacgggacggggaagcagaacgagttccacccgatgaaggggcccatgacgacgcagaccctgcgcggcatgtcgaaccagggcgccatgcactggcggggtgaccgttcaaatggcttcttcggcgtcgatgccggcggggaggagatgtccttcaagaacttcatcgtcgccttcccggaactgctgggccgcgcgtcgatgcccaccgaggcggagatggacacgttcacggccttccagctccaggtgcaactgccgcccaaccccattcgaaggctggacaacgcactcacggcttcgcagaaagcggcgagcgacttctacttcggaagccgccgggtggacggcatcgcgattggcgatgacaacgggttcaattgcaatggctgccacacggttgacggtgcgcggggcttcttcggcacggacacccgttccagcttcgagggcatcagccagatcatgaagattccccacgtgcggaacatgtacacgaaggttggcatgttcggcttcccggacagcagcttcttcctgcacccggagacggggcagttgggtgaccaggttcgcggcttcggcttcacgcatgacggcgcggtggacaccatgttccgcttcttcagcgccatcgtgttctccaacaccagcatcggtgggcccctcgtgggcttccggaacgacaccgagcggcgccagatggaggacttcatgctggcggcggataccgacctggcgccgattgtcggccagcaggtgacgctcacggcatcgaatgccgccaacgtgggggcgcgcatcgacctgctgattgcgcgagcccgagcacagttcacgtcgaaggtgctcggtggcgcgacctacgaggccgacgtggtcgcgaaggtggccgtgggcagccgggtgaagggtttcctgtacgaacggggtcccgggacctggaagcccgatgacggcagcgcgaacatctccaccgcggcgctccgagcgctggcgaacaccgcggggcaggaggtgaccttcaccgcggtccctccgggctctggtacgcgcatcgcgctcgaccggaacctggacggcaggctcgacggccagtag

SEQ ID NO: 8969 - DNA, 531 bp, Myxococcus xanthus
tcgccaacggtgtatttcttcgactccttgggcagcaacgcccagaagctgggggtcgtccgccgcatcatcgagaacacgcaactgctgagcagtcccacgctcgtggacctctccgccgccgtccagaccgacgggcatacctgtggcacctggatgctcgaggccgccaggctcatcctccaactgcgcctgtccggagtggacctggccgacatcggcaccttccacgccgaactcctggcactccaggagcagattggggacctgcacgcgcagaacgtccagttccaggaggactacgcggcggaggactccatcgacgaggactctcatgacacgacgggaaaggcctccatgggcgcgtcgaagaactcggacgtcgagttgatgagcgaggaggtcgacccgttcgccgaaggggaggtcgacccgttcgccgaaggggaggtcgacccgttcgccgaaggggagatcgacccgttcgccgaagaggtggaagggatgagtgaggacgactcctccgcctga

SEQ ID NO: 8970 - DNA, 729 bp, Myxococcus xanthus
atgcgcatccgcgtcttcgattccgagcgggaggccgccgccacgtgcgcccagcgaatcgcccgagcggcggcggcacacccctccctggtgctggggctccccacggggcgtacgccgctcaacgtgtaccgggagctggtggaattgttcacacgcggcggtttggattgggcccaggtccgcaccttcaacctggatgagtttctgggtgtgtcggcggacgacgcgggcagcttccgcgcctacatggagcggcacctcttccagcacgtcaacctgtcgcccgcgcacatccaattcctcgatggcgcggtggaggacgcggaggcggagtgcgcgcgctacgaggcccggctggccgaagcgggcggactggacctggtgctgttggggctcggttcgaacgggcacctggccttcaacgagccggcggacggactgcgagcgcggtgtcaccggacgcggctgagtcgtcagacgcgcgaggccaacctcatgctcttcggggatgacccgtcgcgcgtgccgatggaggcgctcacgttgggcatggccagcatcctccaggcacggcaggcgctgctgctggctttcggcgaggccaaggcggaggcggtgcgcggcatggtggagggccccgtgtccccccgctgtcccgcctccttcctccagctccacccggacgtcgaggtgtggctggacccggcggcggcccgcgcgctgtaa

SEQ ID NO: 8971 - DNA, 414 bp, Myxococcus xanthus
atggtggatgaccagtacatgcgctcgctgtggagctggtcggcgcagaccaaggagctgatggggctggcggtgctggcgctggcccacgcgccgctgttgccggtggcgcccttcttcgtcgggacggtgtgggcctgcgcggcgaactactacttcgtccaccggcgggcgcacctggacccgaagtgggcgcgtgagcacctgccgtggcactacgaccaccacatgggcaaggaccagaacgcgaactggtgcgtgacgcacccgttcttcgacctggtcatgggcacgcggcgcgagttcctcaacgtgcaacctcccgcatccaagcagcccgcgcccgtcgaacagcccgtgcccgcgcccgtggaggcccggaagcgcacggcggcggcttccgggctccggtag

SEQ ID NO: 8972 - DNA, 1680 bp, Myxococcus xanthus
cggcacctcctcacgccgtcacaaggaagggtgccgatgctgccaggccgcatgatggatttcccgctcacgctgagccacttgatggagcgcgcacggacattctacccgcgctcggaaatcgtcagccgcaacccggacaagtcgctgcaccgctacacgtacgcggacttctacgcgcgcacgtgccggctggccaacgcgctgacgcggctgggcgtgaaggcgggggaccgggtggccacgctgagctggaatcactaccggcacctggaggtgtattacggcgtgccgtgcatgggcgcggtggtgcacacgctcaacctgcgcttgcaccccaatgacctgggctacatcgcgcggcacgcggaagactccgtggtggtggtggaccgctcgctgctgccgctgttcgagaagttcaaggacgcggtgcccagcatccgccacgtcatcgtggtgccggacgcgggccccgcgccggaggggacgctcgactacgaagcactgctggcggccgagtccccggacttcgactttccccagctcgatgagaactccgcgtcgatgctctgctacacgtcgggcaccacgggcaatccgaagggcgtgctctacagccaccgctccaccgtgctgcacgccctggcgtgttgcatgacggacgtgacgggcatgcgcgaggcggacgcggtgatgccggtggtgcccatgttccacgccgccgcgtggggcctggccttcgacgccgtcctcaccggcgcgaagctggtgcttcccgggccgcacctggacccgccctccctgctggacttgatggcggcggagaaggtcaccctggcgggcggcgtgcccaccatctggattggaatcctcgcgttgctggaccaggcaccgaacaagtgggacctgagcagcatgcggtccatgctgattggtggctcggcggcgcctccgtcgctgattgagggcttccagcagcggcatggattggaagtggttcacgcgtggggcatgacggagatgagccccgtcggaacgatggcgaaggtcaaggggccgctgcggcaggcggcgcatgaggcgaagtcctcggcgcgggcgtcacaggggttcgcgctgcctttcgtggagacgcgcgtcgccagcgacgacggcacgctgctgccctgggatggggagacgatgggcgaactggaggtccgggggccctgggtcgcgtcgtcctacttcagcgatgagggcgcggaccgctacacgaaggacggctggttcaagacgggcgacgtggtgaccatcgactcgcacggttacgtgcgcatctgcgaccgcagcaaggacgtcatcaagtcgggcggtgagtggatctcctccgtggcgctggagaacgcgctgatggcgcacccggccgtgctggaggcggccgtcttcgccgggaaacatccgaagtgggatgagcgcccgctggccgcggtggcactgaaggaggggcagcaggtcacgaaggaggagctgaccgcgcacctggcgggccagttcgcgaagatgtggctgccggatgactatgtcttcgtcccgcaggtgccgcggacgtccaccggcaagttcctcaagacgaagctgcgtgaggactacggcgaccacctgctgaagaatccgaaggcagacgcggcgacgtag

SEQ ID NO: 8973 - DNA, 147 bp, Myxococcus xanthus
atgggaatcatcctgttggtgttgtgggggctggggctgaccaccggctccaccgagggttactgggtccacctgctgctgctgttcgcgatggtggcgctcttgctggcggtggtgtctcagggccgccgggcggcctcggcatga

SEQ ID NO: 8974 - DNA, 1038 bp, Myxococcus xanthus
atgaaagtcgccgtgctcaccggcgggggtgactgccccggcctgaacgccgtcatccgcgccgtcgtccgccgcgccaacgcccacggcttcgagatgatgggcctccgagatggttggaaggggttgttggaggacaaccacttccgcctcacgcgtgaaaccacgtccggaatcctccaccggggcggaaccatcctcggcacctcgcgcgtcaacccgttcaaggtcgaaaacgggctggagcgcgtcaagcgcgccatcgaacgcaacggcatccacgccgtcatcgccattggtggcgaaggcacgctgtcggccgccacgcgcatgtcgcaggaaggactgcgcatcgtcggtgtgccgaagaccatcgacaacgacatcaacgccacggacttcaccttcggcttcgacacggccgtcgccatcgccaccgaggccattgaccggctgcactccaccgcggagtcgcacaagcgcgtcatcgtctgcgaggtgatgggccgtcacgtgggctggattgccacctacgcgggcatcgctggcggcgcggacgtcatcctggtgccggagattcccgccgacctcgcgaaggtggccgagcacatccagcgccgccacgcgggcgggcgcaccttctccattgtcgtggtggcggagggtacgcgcatcaagctgtcggcggaccagcaggagcagctcgtcaccagcggcgcactggacgaggcaggcaggccgcggctcggtggcgtgggcaccatcctggcgcacgaaatcgagcggcgcaccggcttcgagacgcgcgtgtccgtgctgggccacatccaacgcggcggcgcccccaccgcgcatgaccgcgtgctcgccacccgctacggcgtccacgcctgcgacatggtggcccgcggcgagttcgggaagatggccgcgctgcgaggcaacgacatcatcagcgtggacctggcggacgccacccgcgagctcaagcgcgtcccgcaggagttcttcgaagtcgcccaggtcttcttcggctga

SEQ ID NO: 8975 - DNA, 1425 bp, Myxococcus xanthus
ctcgacgcgacggcacaggcggagctcgtccggcgccgggagcccacgccgctcgagctcgtggatgcggccattgcccgcatcgagcgcctcaacccgacgctcaacgcggtcgtccagacgcaattcgaccaggcgcgcgagcgagcccggggaacgctgcctccgggccccttcaccggcgtccccttcctgctccaggacctgctcacggcccaggagggtcacccgctcactcacggctcgcgcttcgggaaggactacattccagaccaggacagcgagctggtgaagcgccaccggcgcagcggcctggtggtgctgggcaagtcgaacacgccggagatggggctgctccccaccacggagggcgagctgcacgggccctgccgcaacccctgggacacctcgcgctctccgggcgggtccagcggcggcgcggcggcggcggtggccagcggcatggtgcccttcgcccacgcgacggacagcggcggctccatccgcatccccgccgccgcatgtggcctcttcggcctcaagcccacccggggccgcaaccccatgggcggcgacatcgcggacgccgtccactggctcgtcaccgaacacgccctcacccgctccgtgcgagacagcgcggcgctgctcgacgtcacctgcggcgcggacgcggggacgccctaccaggcccccgccaaggcgcggccctacacccaggaggtcaacacgcccccgggccgcctgcgcatccgcgtggccgtacgaaaccccatgggcgccgcgatccacccggagtgcctggccgccatccactccgcggcccggctgctggaggacctgggccaccacgtggacgagggcagcctggaggtgcccggtgatgacgcggtgggccagcacttcatcaccgtgtggaccgcgggcgtcgtcttcagcatcgacgcgatggccgagcgcctgggacgcagtccggaggcttcgcacttcgagccattcacctgggccctctaccaatatggcctggaccagggcctgtccgcctacctgcgcgccagcgcggaattgcagcgtcacagccgcgccgcgctccgtcacttcgatgacgtggacgtctggctgatgcccaccctcaacgagctcgcgccgccgctgggcacgttctcctcgccaccgggcgagcccatggccccgctgctccgcgcgggcgccttcgcctcccactgcccgatggccaacatcacggggctgcccgccatgagcctgccgctccactggagcccggacggcctgcccgtgggcgttcagttcatggggcgctttggagatgaagccaccctgttccggctcgccgcccagttggaggctgcccgcccctgggcccagcgtcgtccggcggtgttcggatagagggttggaaggtcc

SEQ ID NO: 8976 - DNA, 510 bp, Myxococcus xanthus
cccctggagcccgtcatcgacgcggccgagcgccggcaccgccttcccccggggctgctgcgcgcgctggtgcaggtggagtcggagacgcgcgtgcaccgcatctccccggcgggagccatggggcccggacaactgatgcccggcaccgcggccatgctgggtgtgaaggacccgttcgacccggagccggcgattgacggcagcgcgcgctatctggcccagcagttgcggcgcttcggtgacgtgcggctcgcggtggccgcatacaacgcgggcccaggctccgtgaatggccgcgtgccgcgcaatggcgagacggagttctacgtgcccaaggtgctcgcggcgtgggagctgacgcgcccgcctccgccgcggaaggcgccgcccgcggtgaagcccgtggcgaagccgaagccggtggctccagcacgcacaaaggcaccggcgtccgcggcgaaggagccgaagaagcccgcagcgcccgcggagaatggccggagctga

SEQ ID NO: 8977 - DNA, 729 bp, Myxococcus xanthus
atggcgagccgggatggcacgcgggcgggtggcgcccaggagacgggcaagccgcccgcacggcccggaggccgccgcgaggcccaccgccgagagcgcgagcagacactggaggacgccgcgctgaagctgttcctggcgcggggcctggatggcgtcaccatcgacgacatcacccaggcggccggggtggccaaggggacgttctaccggtacttcgacgacaaggcggcgctggtggacggcctgctggagccggtgcgccgcgagctgctggccgggctggagacgtgcggccactccctggcggaggcgcgcaacgtggaggccatgttcgacgcgtaccgcgcggtggcggcggtgattgccagcgcgctgctccagtacccgggcgtggtgcggctgtacctccaggagtgccgggggccggcggtgggggcgcggacgaaggtggcggagctggcgcggcaggtggcgcgtcacgcggtggacatcacgcagaaggcgcacaccagcgggctgctgcgccccatccgtccggcggtgagcggactggcggtggtgggcgccgtggagcggctgctgctggcggtgctgagcgaggaggacatcggcaacccgctggagctgccggacgcgctcaccacgctggtgctggacgggctgcgccttcccccggaggtccgccctgggcgccggaagttggacggaggccccaagcgcccctaa

SEQ ID NO: 8978 - DNA, 501 bp, Myxococcus xanthus
atgctcgccaccggctgtgaatccctcttcttcatcgaggccgaggccgaggagatctgcaagacggagcgcgacctggccttccccgcggcgctgccactcaccgtcaacgtggagcggagcatcaccttcccgctgggtgacatctccgacccgctgcccgaggacacggacatcgaaaccgagcttcggctgcgcgtcttcgaggtgacggccgacacggacctcagcggcgtggagcgcgccaacgtctccgtgcgccagccgggctccaacgacacccacgtcatcggtgagtacacgcgcaccagcaccgcgcccacgcgcaccatccagctcaccagcaccggcccggtggacctgatggacctggcccggcagcccgagctcgagttcatcttcgacgcccggggcacgctgccttccgaggactggaccgcctcgctgcgcgcctgcgcgggcgtgaaggcgcacgcgaactacttcgacctggtgttctag

SEQ ID NO: 8979 - DNA, 402 bp, Myxococcus xanthus
atgctggacgcgggcgcgccgcacggcgtgggcctgtccgcggtgctgcggccgctgccgtggctgcgcttgcaagcgggtcccaccaccaacacgctcagcttcggcttgcgcggcggcctgagcatcctgccgatgcagaccttcctggcgccgtccttcaacgtggaggcggggcactacttcggttcggactacaacgacgtggtggactggctgggcgcgacgccgagccgggccagcgcggccattcgcgacgtgacgtacaactacgtcaccggcagcgtgggcctggaggtgggcgcggccagccgcttcaacttcttcactgcacctgggcctcagctacgtggacctgggcgtggacgacgcgagcgccctgctccaggacgccacggatga

SEQ ID NO: 8980 - DNA, 696 bp, Myxococcus xanthus
aacaccatggcgctgctgccgggctcggggcccaacaaggacgaggtcatcgtggtgatggcccacctggaccacgatggcgtggaccggcgcggcaacgtcctcaacggcgcggacgacaacgcctccggcagcgcggtgctgatggcggcggtgccggagctggcggaggcggccaagcgcggcgagctggaccgctccgtgctcttgctgtggacgggcgccgaggagaagggcctggtgggctcgcagtacttcgtggaccacccgattccggggctcggcatggaggagattgccggcgtcatcaacgtggacatggtgggccgctgggatgaccagcgcctgtcggtggtggacaccaactcgcgcgggcagcccaactacttccgggaagtgctggaccaggcgaacgcgaagctcgatgacccgttcgaccgcatcaaccgggacatcaacgtgttccgcgaccggcaggacggtgcgtccttcggacgcaagggcgaggacgtcctcttcatgttcgaaggcctgtccaaccccaacggcggcggagacctcatccccgagtaccaccgggccgacgacgacatcgacctcatcctccgcgacaacggcggagagaagccgcgccgcatcaaggatttgatggtcaacgtcatcgggctcgccgccaatcggacggcagaaccctga

SEQ ID NO: 8981 - DNA, 1056 bp, Myxococcus xanthus
gtcgaaaacgtgcgcaagcgtcccggcatgtattgcggtgacgttggcgagtacgggctgcaccacctcgtctatttcctcctggacgttgcctacgaagaagctcgccgtggggagtgcagggacgtggtgttggaggtgggaggggatggttccatcgcgctcttctgcaccagtcgcaccgttaccgccgagaacttggtcagagtggcgacgggagcgggcttcttggggcgtccgccgggcgatggctggggctgggacagcatgctcgtcgtgtccctggccttgtcttcccgctaccaggtggacatctgggcggacgggcggcagtggcgggtgatgggcgagcacggccatccccagggagagggggcggcggtgacgccgatggagccaatgcctgtctccgcggagcgaggggtacgcgtccacttcgttccggacgcgaccatcttcgaggtgctcgccttcgacagggctcgcctttcccgtcgctgtaacgagctggcggcgctcgctccggggctgcgcgtcagctttgccgacctccagcggggagagcgcacgctgtggcatctgcccggtggcgtggcgcagtgggctcacgtcctcacggaggctcggccccagctccaccccgagccggtcgtcttcgacttcacgtgggatggactgcgcgtccagtgtgcattgcagtggtgcgaagacgaggacagcacgctgctgtcatttgccaacgccgtgcggaccgtgcggcatggcgcacacgtgaagggcgtcactcaagcgctccggggcgcactggcgaagctctcaggtgagacgcggggggcattcccctgggctcgggtggcgcagggcctgacagctatcgtcgccgtgagtggaccccggagacagatggcgttcgcgggccccaccaaggagttgctggccatccctggcctggaggaggccatccgcaagcagctccagcccctgttcatcgagctccttcgcgagcacccggtgacgccggcactcctggcacggcgtacgagcggctcgcggtag

SEQ ID NO: 8982 - DNA, 117 bp, Myxococcus xanthus
atggacctggttctctttgttggcttgcagggctcgggcaagagcagcctctaccggcagcgtttcgcggccacgcacgtacacgtcagcaaggacctgtggcctcacgccgttcgc

SEQ ID NO: 8983 - DNA, 1056 bp, Myxococcus xanthus
atgggcgcgcgcctggagattctctcctgtgagggctgcacgccggccaccgtggagctgaagggcaactcggtggcctcggccttcgtgttcgacccggcgcccgtccccttcgacttgattcccgtgcatgagcgcacgcagtcgtacacacgcgcgcgcaacatcacctggcgccccgtcaccatcgagcggctggtgaccagcgaccatgccttcgtgccgctctcccggccggagggctcctccgtcgccccgggcgaagtcgtcgagatgcagatggagttcgcggcgcgctactccggtcccaacgtgggcgacctcacggtgcactacacgtccgacaaggcgcgcaattcgcaggtgattctggacgcgcgcggcggccggcccacgctggcggtgacgccggtgtcgctggacttcggcgaggtgccggtgggcggcaaggtggagcgcgtcatccgcatctccaacgcgggcaccaacggccccctccagttcctcggcgtggcggcgggcggcgacagtccgcagttcagcgtggacgtgcccacgcgcggcaccgaggcctatccgtggagcggcggcgtctggcccgtgctggaggcgacgcccgggctgcccattgcccctggcaccgacgcgctggagctgaaggtctacttcgagcccacctcagtgggcacgtggacggccgcgctgcgcgtgcgctcggatgacctgttcaacccggagcgcgaaatcatcctcactggccgctcgcgcgccaccgcgccgtgcgtgtacgagttgacgccgcagccggtgatggacttcggcaacgtgacgccaggccggggcgcggtgcagggcttctacttccgcaacccgggcagcgccgagtgcgccgtgaagaacatccacatcagcaacaacggcggcggcgtcttcttcatgccgggcggccggctcacgggcggcgtggtaccgtacgactcgggcttcagcgccatggtggccttccggccgcaggcggagggtgacttcaccggcgagttgcagttgacggtgagc

SEQ ID NO: 8984 - DNA, 567 bp, Myxococcus xanthus
atgaggcgcggggcgcccgaggtgacgggggtggagctgccccgggactccgtgggcttcacgcgccgcgagtgcccggagtgtcagcggcccttcaagacgcgtccggggcccatggactcgcgcgcggtgctgcacaagctcctgggcttctaccccttcgagaatgcccacgagtgcgtggagggcattcccgtctggggctgcccgtactgcggctaccgcgcggaagcggacgcctttctcacgcccgcccagcaggggcacctggaggccgtggcgcgcggctgggccaaccacgtgcggtacgagcagctggcgcacgtggcgcgcacgctgtccgtcaaccccaggccgacgttcgttgcggtggagccggaggccctgccgggccccatggagccagagccggacgagctgctgcgcgtcatgcccatgctctgttgtggcgaagaggtgaaggtcatctgggagtgggaccaggcactccactgcttctcctgcggcgcgcggcatgatccgatgagcggccgccagcaggtggagctgcgcttcgtctcggagtag

SEQ ID NO: 8985 - DNA, 783 bp, Myxococcus xanthus
cccgacgcgcccgctgtgcttttcctgcatggctggctggaccattcccacagcttcgatgccctcatcccgcacctgccccaaacgtggcggctggtgctgctcgactttcggggcatgggccgcagcgcccacgtgggtcccggcgccacctaccagttcagcgactacgcgctcgacgtagaggccacgctggacgggctgggcctggacgcggtgcacctggtggggcactcgctgggcggcatcgtctcacaggcctacgccgccgcccgtccagggcgcgtgaagagcgtgacgctcatcgaaagcctgggccccgctggcgggcccgcggaaggggccctgggccggctgcgcagcgcactggatgacgcgcgccgcccgcccaaccgcaagcgctaccccaccgtggaagccgccgcggcacggctgctggagaacagccccacgctgacgcaggacgcggcgctgtacctcgcccggcacgggacggagccctacgagggcggcttcgccttcaccttcgacccgcgccaccgccgccgcttcggcatgggttatgacgaggcccagtggatggcgctccaggccggcgtcacctgcccgctgcagctcatcctcgccaccggcgggctgcgccacgatgaagccctcatgcgcaaccgtacgcaggcgctccaaaccctcgcccatccaccgctgcacctccccggcggacaccacgtccacatggagcagcccaaaatggtcgcggaggcgctcattcgcctcatccgctga

SEQ ID NO: 8986 - DNA, 1822 bp, Myxococcus xanthus
acgctgaatgagcgcgaggagcacgggctgtccgtcctggacctggagtccatcgaggaggaggtcggcctgggaggccgcttcctcgtcaccctgggccgcgcggaccgccgccccttgcccacccgcctgcacaacggcgacctggtggccgtgctgccccgccgcgcggaggtgaaggagcccgcccgcgcgctcatctcccgcgccaccgccacgcggatccagctcgccttcgaccgctccccgccgccctacgtccacgagggcctcctgcgcctggacgtcgtccccaacgacgtcacctatgaccggctgcgtgccggcctccagcgcatcaaggccctggacaagggcgccgagcggcacaagcgcgaggtcgtcctgggcaacgagccgccccgctttgacaagccccgcgagttcgagcccacccgccccctcaaccccgaacaggaggacgccaccgcccgcgcgctcgccggcgaggacttcttcctggtccacggggcctccgggcaccggcaagtccaccgtgctggccgaggtcgccgcccaggccgtggcggacggcaagcgcctgctctgcaccgccgccagcaacgccgccgtggaccacctgttggacctgtgcctggacaagggcctgcgcgccatccgcgtgggccaccccgcccgcgtggccgcccggctccaggaacacaccctggacatcgtcgtggagtcccacccggaccgcgccgtctcccgcgacctcttcgacgaggccttctccctgctgggctacgcgcgccgccagcgcaaccaaggccgcagccgcgagcgcttcgccaacgcccgcgcgtccaccacggaagccaagggcatgctcgacgaggcccgcgccctggagcgcaaggccgtgaagtccgtgctcgccaacgcggatgtcatctgcgtgacgctctccagcctcgactccggcgtgctctctggacagcagttcgacctggcgctgcttgatgaagccacccaggcaaccgagcccctggcgctgctgggcttcctgcgcgccccccgcgtcatcctcgctggcgacccgcagcagctaccgcccaccgtcctctcccaggaggccgcgaaggccggcctgggcgtgagcctcttcgagcgcttgctcaaggaccatggagagggcgtcaaacgcatgctgcgcgagcagtaccggatgaacgcgcgcatcatggatttcccctcaagggagatgtacggcggcgagcttcgcgcccacccctccatcgcggaccgcacgctggacgccgtcctcacgcctggcgcggacgtggatgcgccccccgtgctctacctggacaccgcgggcaagggcttcgacgaagaagtcgagcccaccacgcgaagcctcttcaaccccggcgaggctggactggtggaagcccgcgtgcgcgccctgctcgccgccggactggccccccgcgagctggcggtgattacgccctacagcgcccaggcccatcagctccgcgagcgcatcgaggcgctcagccccgaggtggaggtcgacaccgtcgacgcgttccagggccgggagaaggacgccatcatcgtctccctcacccgctccaacagtgaggggcagctcggcttcctcaccgacctgcgccgcatgaacgtggccctcacccgcgcacgccgtcacctcttcgtcgtgggcgactccgccacgctcagcgggcaccccttctatgcccgcttcgtcgaggggacccagacccacggcggctaccgctccgcctgggaatggcctgacgcccaggacacctga

SEQ ID NO: 8987 - DNA, 1170 bp, Myxococcus xanthus
tacagcatcaacttcgcccggggcgtggacgggaacgcgcgcggcctggtcccctccggacaaggcatcttctaccgctacaacgagtcctcccagttcggcggcgccaagtctcgctacgacatcaaccgggagctcatcgacccggccgggccgtaccgcgccgtgttccagacgtccagcgtgggcagcgcgcaggtgacgagctacaccaccatctccgcggaggtggatgactacctgttccagtaccccatcctcagcacgcagtcacagagcaacaccggcaaccagaactcgcggccacaggcgtgggcgaagaacatcgtgtccgtgggtggcatgtaccactacgacaacaccaaccgcggggatgaccggtggaatggcggcgccagcgtgggtccggcggcggacggccggctcaagccggacctgtcgtactactacgacctcatccgctccgcgtcgaacaccagcaacacgtcctacaccaacttcggcggcaccagcgcggccacgccgcagacggcggggcacttcggcctgctgttccagatgtggcacgagggcgtctgggcgggcttcggtggtggcgcggatgtcttcgccagccgtccgaagatggccacggcgaaggcgctgatgatcaacatggcccatcgctacaactggctcgcgggcggctccaacggtgacctgacgcgcgcgcggcagggctggggtaccgcggacgtgaagcgcctgtatgaccgcgccgccgtgacgagcatcatcaacgagacggacaccctgctcccgctcggcacgaatacgtacaacgtcaccgtggctcccggggagacggagctcaacgtcaccatggtctacaccgaccccgccggcacggtgggcgcggcgcacgcccgcatcaacgacctgtcgctgcgcgtgacgtcccccaccggcgtcgtctactggggcaacaacggcctgacggcgagcaacgtctccacggcgggcggcgtgtcgaacaaggtggatacggtggagaacgtgttcctcgccaaccccgccgccggcacgtggaccgtggaggtgattggtgacgaaatcatcgaggacacgaatctggcgacgcgcgtgctggacgcgacctacgcgctggttgtgagcggcggcaagatctag

SEQ ID NO: 8988 - DNA, 799 bp, Myxococcus xanthus
cacggggcggacccgcgcatggacgacaccgggtacacgcagccggcgctcttcgtgctggagtacgccttggcggagctgtggcgctcctggggcgtcgagccctgggcggtgttggggcacagcgtgggtgagtacgtggccgcgtgtgtggcaggggtgctggaactcgaggacgcgctccggctcatcaccaggcgcgcgcggctcatgcaagagctgcctcgcaatggggagatggtgtccatcacggcgagcgaggcggtcgtcgcgcaagcgctgactccgtacgcggaccgggtgtcgattgccgcggtcaacgggcccgcggacaccgtcatcgcgggtgaacgtgaggcagtggaggccctctcctccgcgttccagacgcaaggcctcaaggtccggcggctcaccgtgtcccacgcgttccactcgccgctgatggagccgatgctggatgcgttcgagatggcggcgggacacctgaccttgcgggcgccgcgcatgcacctggtgtccaacgtcacggggcaggtgctcgaggagggcacggtgctcgacgccgggtgcttccgccgccacgtcctagaggccgtgcgtttccacgacggactcaaggcgatccgggcattggggggtcccgtcttcgtctaggtcggcccgcatccggcgctcatgggcatggcgctcaagggcctcggggacctcgcgggcacctggctcccgtcgctgcgcaagggacagcccgaccaggcgcagattctctccagcctggccgcgctcttcacgcagggcg

SEQ ID NO: 8989 - DNA, 501 bp, Myxococcus xanthus
accctctcccgcgtgaagtcgggcgcgcccaacgcagtgggggtcgacatcccccaggagctctggattgccatgggcatctccaccacgtcccttctgggcacaccgctggtgctgggcggcaagcgtgcgcgcagcccggacgagaagctggtgcagaacacctccgtccaactcgcggaggcccccgcggacatcgacgctcaccgccagggcgtgctctacgccaacgcgaacatgacggacgcgcgcatggcggacatgttccagggagacgaggtgggcaacaccgcgcacatcgacctggccaaggtgcagatgttctatttcacgctcatcgcagcggtgggctacttcatggacgtggccatgtcggtggcgcgcgggacgacccacgcgatgcccgccctgtcgcaaggcatgctcgccctgctggccatcagccatggtggatacctgctaggaaagacaggcgaccactcgaactccaagcagacctga

SEQ ID NO: 8990 - DNA, 1086 bp, Myxococcus xanthus
atgctgtcgttcatggccgcgctcgcggtcctgctgtcagccactccgtcgagcgcattcaagattcccatcagcgaggagtcctacctcaacgtcgccatcctcctgcagccgcagctccagattgtcgacgaaggcgcgccgtccggcggccccagctccgacatgttcctgcggcgcacgcgcctgctcgtcttcggccacatcacccagaagctgtcgttcttcgccgagacggaccagcccaacttcggcaagaacggcgactggaacgtcgccttcttcatccaggacgcgttcatctcctacgaggtggcggagaaagtctggattgacgtgggcatgctgctgccaccgctgacgcgccatgtcctccagggcgccgtcgcgttgcaggccgtggactaccactccagcctggtccgctgggcacctggcgtgggcaaggtgtggcgggacatcggcgtgcaggtccgcggcttcgccggccccttgggattccgggccgccatcttcaatggcgtcaacggcaagacgaccccggatggcaccgtgctcaacccggacgatttgcctcgcatcacggcgatggcgcgctggaacttcttcacgcgcgaggaggacctcttcttccaaggcatctacttcgcctccgagccgcgcttgtcggtgggcatcggcgccgactaccagcccaaggcggtgtccacggaatccggtctccatgattcgttgggcacggccgcggacgtgttcctcgacgtgcccctggcgaacgaccaggagttcgtcttcaacgccaccctcttccactaccgccagggcttggacaacccgcagagcggcacagggctctacgcggagacgggctggcgcttcggcaagttccagccgctcatctccggcgagtacttcaaggcgcgcgtggacggccaggacctgctcgcgctcaagcccggcttcaacatctggttccagaagcacacgctcaacctccggacagaggtcgccgtcgcgtggacgggcgacatctcccaggcacgtgccgccgtgacgggcacgagccagctccagctcttctactaa

SEQ ID NO: 8991 - DNA, 1965 bp, Myxococcus xanthus
atggcccagacgcaggaagcgctcattcccacgaaggacgccttcagccgcaaagcccacgtgaagagcctggaggactaccagcgcctctaccagcgcagcatccagcagcccgaggccttctggagtgagatggctgaacagctcacctggttccacaagccagacgccatcatggacctggacgccgaacaggtggacttctcctggttcggcggcggcaagctcaacgcggcctacaactgcatcgaccggcacgccacggagcgccccggcaaggtcgccatcatctgggcgaagaacgagccgggcgagtacgaatccatcacctaccgcgacctccagcaccacgtgggccgcgtggccaacgtgctgaaggcgcacggcgtgcgcaagggcgaccgcgtctgtatctacctgcccatggtgccggagctggcctacaccatgctcgcgtgcgcgcgcatcggcgcggtgcactccgtggtgttcgccggcttctcatcggaggccctgcgcgagcggattctcgactccggcgccaaggtgctcatcaccgccaacgaagggccgcgcggcccgaagttcgtgcccaccaaggccatcgcggacgaggccgtggagggcctgtccctggtggagtccatcctcgtggtgcgccgcacgggcaaggaagtgcccatgctcgccggccgcgactactggctggacgcggagatggcgaagcaccgcggcgtctgtcccgcggagtggatggactccgaggatccgctcttcatcctctacacctccggctccacggggaagcccaagggcgtgctgcacaccaccggcggctatctcgtctacgcggccaccacgttccgctacgtcttcgacatccagccggaggacgtctacttctgtgcggcggacctgggctgggtcaccggacacagctacatcctctacgggccgctgatgaacggcaccaccacggtgatgttcgagtccacgcccaccttcccggacgcagggcggctgtggcgcgtggtggacgacctcaaggccaccatcctctacaccgcgcccaccgcgctgcgctcgctcatcaaggagggtgacgcgtgggtgaagaagtcctcgcgccagtcgctgcgcctcctgggcagcgtgggcgagcccatcaacccggaggtgtggcgctggtaccacgacgtcgtgggcgaaggccgctgcccggtggtggacacgtggtggcagacggagacgggcggcatcctgattgccccgctgccgggggccacgcccaccaagccgggctccgccaccctgcccttcttcggcgtggagccggtgctggtggacgacgagggccgcgtcatcgaaggcaacggcgtcagcggcaacctgtgtctggcgcgctcgtggccgggacaggctcgcacgctgtatggccaccaccagcgcttcaaggagacgtactacgcgcgcttccccaacctgtacttcaccggtgacgggtgccgccgcgacgaggatgggtactactggattaccggccgcgtggacgacgtgctcaacgtctccgggcaccgcctgggcaccgccgaggtggagagcgcgctggtggcccatgaggccgtcgccgaggccgcggtggtgggcttcccgcacgacctcaagggcacgggcgtatgcgcgttcgtcacggtgaagccggactggcaggagtccgcctccgagcagatggtgggcgcgctcaaggagcaggttcggcatgtcattggccccatcgccacgccggaccgggtggtgctggtcaacggcctgccgaagacgcgctccgggaagattctgcgccgcatgctccgcaagattgcctcgggcgaggtggagaacctgggtgacgccagcaccctggcggacccgtcggtgctcgacgaactcctcgcgaaggccacacccccacaggcgaagcgctga

SEQ ID NO: 8992 - DNA, 285 bp, Myxococcus xanthus
atgtccacgaatccgaatgaggaagcgctggaagcactcgcggcggcgcgctggcgcgtggccggcgtgctcaccgtgacgacgctggtggcgtacctgggcttcatcctgctggtggcgttcgacaagccgctcatggggcagcagctcgtccccggcctgtccattggcatcctgctgggcgcgctggtcatcgtcgcggcctgggcgctgacgggcatctacatgctgtgggcgaacgggaagtacgaccgcgccctgcaccaactccgcggtgggaagtga

SEQ ID NO: 8993 - DNA, 1635 bp, Myxococcus xanthus
atgaaccccgcagaaacgacgacgcagctcggccagccgaacgcgacggccatcctgttcttcctcctcttcgtcggcgtcaccctggcgattacgtactgggcggcgcgcaagacgaagacgacctcggagttcttcgccgcgggcggcggcgtgagcgcggcgcagaacggcttcgcgctcgcgggcgactacatgagcgccgccagcttcctgggcatcgcgggcctggtggccacgtccggcttcgacgggctcatctactccgttggctggctggtgggttggccggtcgtgacgttcctcatcgccgagcccctgcgcaacctgggcaagtacaccttcgcggacgtggtggcctaccggctgaagcagacgccggtgcgcctgtccgcggcggtgggcacgctcaccgtggtcagcttctacctgattgcgcagatggtgggcgccggcaacctcatccacctgctgttcggcctgtcctatgaggcggcggtcgtcatcgtgggcgcggtgatgattctctacgtcctcttcggcgggatgattgccaccacgtgggtgcagatcgtcaaggcggtgctgctgctggcgggcgccacggggctcgcgggcatggtgctgtccaagttcggcttcagcccactgcggctcttcaacgaggccgccacccaatacggcgcggaggtgctggcacccgggaagctggtgaacaacccgctggaggccatctccctgggcgtggcgctgatgttcggcaccgcgggcctgccgcacatcctgatgcgcttctacacggtgccggacgcgaaggcggcgcgcagcagcgtcttctacgccacggggctcatcggctacttctacctggtgacgttcatcctgggcttcggcgcgtccgtgctggtgggccgtcaggcgattaccggcgtggacaagggcggcaacatggcggcgcccatgctcgccgaagtcgtgggtggcacgggcttcctgggcttcatctccgccgtcgccttcgccacgattctggcggtggtggccggcctgacgctgtccggcgcggcggcgctgtcccatgacttgtggtccagcgtggtgcgcaaggggcaggcccccgaggcggagcagctcaaggtggcccggctggccagcctcttcctgggcgtcctggccatcatcctgggcgtggccttcaaggggcagaacgtggccttcatggtgggtctggccttcgccatcgcggcgagcgccaacttcccggcgctgctcctgtccatggcctggaagaagttcaccacgaatggcgcggtggccagcatgctgacgggcgccatcagctcggtgctcttcatcttcctgtcccccacggtgcaggtggacctcctgggcaacacgtccgcgctgttccccctgcgcaacccgggcgtcatcaccattcccctggccttcatcgtgggcgcggcggtgtcgctgctcttccccgagcacgagtccgccgcccgcttcgccgaagtgaagcaccggatgcacgtgggggtgccccagccggcccccgcggtggccaccgtggcatcgaagcccgcggatgagccgtcccgccccgccgccacgggcagcgaggccaaggcctga

SEQ ID NO: 8994 - DNA, 1047 bp, Myxococcus xanthus
atgctcgcgtgcctgctcttggccgcgggcgccgccgccgcgcacgacgccgacatcctctatattgaagcgcaccgcgcccgggccgaggcacccgaggtccgtcagattctgacgatgacgccggagacgctggccttgctcctggccgacgcggatgggggctcgctcctcacgcggcatggactggacgcgcggcgtgacgccatcgccaccgacatctgggatgcgatgccgctggcttccggagggttgccgtgcgtgcggaccgcgcacgccacggcgccgaggcagtccttcgtggaactgtccgccaccttcacgtgcccgccgggtggaatgcgccagcgcttccgggtgctgacgcggctgccgccggagtaccgggtgattctgggcagtgtgagggaaggggaggttcctggtgccgtgttcgcggatgccacgcggccggaagtggacgtcccggaaggcggacgcggcacgccgctgctgagccgcttcgcgggctgggtgggcctgggcgtgcgccacatcttcgagggtgtggaccacctggccttcctgctggccgtgctgctggtggggggcggctggaggcgggtgttgctgctggtgacgtccttcacggtggcgcactcgctcacgctgggggccgccgcgctgggctgggtggtgttggacggagtccaggcccggtgggtggaggccgccatcgccgcgtccatcatctatgtggcggtggagaacctggtgctgcgcgagcaccggcaccgggtgctcgtcaccttcctcttcgggctgatccacggcttcggcttcgcgggcgtgctggccggctacggcctgggcgagtccgtggtgacggcgctgctgggcttcaacgtcggtgtggaattgggccaggcggtggtggtggcggtgctgctgcccgtcctccgcatggtccagcgccgtccggctttgcacacgagggccgtgaggggactgtccatcggaatcctcgcggctggtgggtactggatggttgaacgcgccctcggttga

SEQ ID NO: 8995 - DNA, 789 bp, Myxococcus xanthus
cgcggtcggttgcacgaaatcatcttcgaggcggagacgcccgcgggcagggcattcgacgtcggcctcctgtgggccatcctcttcagcatcatcgcggtgatgctggagagcgtcgcctcggtgcgggcccagtacgggagcctgctgctcggcgtcgaatggttcttcacgggcctgttcaccctggagtacctgctccggctcttctccgtcagcaagccgctgcgttacgcccgcagcttcttcgggctggtggatttgctggcgatcctgcccaccttcctgagcgttctgattcccggggcacagtccctgctggcgattcgagtgctgcggctgctgcgcgtcttccgcgtgctcaagctgtcgcacctgctcggccaggcggaggtgctgctcaccgcgctgcgcgccagccgcccgaaaatcaccgtcttcctgggcaccgtgctgaccatcgtcgtcatcatgggcgcgctgatgtacgtggtggagggccaggagaacggcttcgacagcatcccgcgcgccatgtactgggccatcgtcaccgtgacgacggtcggctttggcgacatcacccccaagacggcacctgggcagttcatcgcctccattctgatggtgatgggctacggcatcatcgccgtgcccacgggcatcgtctccgtggagctggccgccgccacgcggcacgcggtggacaaccgggcgtgccccgcctgtggccagcaggggcatgacctggacgcgcatttctgcaagcactgcggtcacgggctctag

SEQ ID NO: 8996 - DNA, 714 bp, Myxococcus xanthus
atgctcttccgccagctcttcgacacgacgtcctcgacgtacacctatctgcttggggacgaggaacaaggaacggcactcctcatcgaccccgtcgcggagaagctcgaccgggacctcacgctgctgcgggagctaggcctctccctcacccatgcgctcgacacacacgtgcacgcggaccatgtcactgcgtccggcctgctccgggctcgcacgggcgccaaggtggtgagtggcatcaccggggcaccgtgcgctgacatccacgtgaaacatggcgacacgctgcgcgccgggaccttcacgctccaggtgctcgcgacgccgggccacacggatgacagcgtgagctacctgttgggagaccgtgtcttcaccggggatgccctgctcatccgtggcaatggcaggacagacttccagaatgggaacgccggcaccttgtatgactccatcacccaggtgctgttcgcgctccccgatgagacgctcgtgtacccggcccatgactacagagggctgacggtgacgaccatcggcgaggagaagcgacacaacccgcgcgtggccggccggagccgagacggcttcatccagctcatgaacaacctgggcctgccgaagcccaagctcatcgacgtggcggttcccgccaaccgcgcttgtggactgacggcaccggtccgcgcgcgaggcagcttcacacattga

SEQ ID NO: 8997 - DNA, 900 bp, Myxococcus xanthus
atgcctcgcaccgcgcataggccgctggaagtggatgaggagaagctcgtccttcaattccccagcctggaccgtaaggccgtgggtgctttcttcacgcctgcaccgctggcggaacgcaccctcgcgctcgcgctccagcacgtgggcggaggccccctcacggtcgtggacccctcgtgcggcgcgggcgccttcctcaccgccgcttcgcggctgcggcccggcgtccggctctgtggcctcgagttggaccccgaggtcgcccgcctctgccaggcccgcgtgcccgaggccaccgtgcgcgcgggagacgcgctgcgagacggactggagcccctgctcgccaccactccgccggaccaccaggagctgtgggtgggcaacccgccctacaacggcacctcctccgtgctgaaggacccgggcacctatgcgcggctgcgcgccctgctcccactggcactgatgcctggcaccagcctgcgagacgacttcgccttcttcctcctggtggccgcgcaccggctggccacccgtcccggtgcgctcgccttcatcatccccgcgagcttcctcgacgccttcatgtacgcgccgcttcgccagtcgctgctggagacactctccctgcgcgaggtggtggacctgggccccggcgccttcgcgggcacccaggtgcggacctgcatcaccgtgtggagctccctcccgggcccccaccccgccccgcgcttcgagcggggcggcatcggacaacacttcacccccgagccccccgagtggcggctcgcccccactgcgcccgaggcctccgccctggacgcccgctggcgagagcgtggagagcccctgacgcgggtcgtccccgtaagcctccccggcgtgaagacacgctag

SEQ ID NO: 8998 - DNA, 555 bp, Myxococcus xanthus
atgaagattcgagccctgctcaccgccgccgcactgaccgccgccctccccgcactggctcaggagggcgcgggcacgccgccgccagcggacaagaagacgcagcccaagggccagacggccaaggcccaggtgaaggactccgagggcaaggacgtgggcgaaatcaccctcgagcagaccaagcaaggcgtcctcatcaagggcaagctgagcaacctgccgccgggccagcacgccttccacatccacgaggtgggcaagtgcgaggggcccgccttcaccacggcgggcggccacttcaaccccaccaagaaggcccacggcctgctggcgcccaagggcaagcaccaaggcgacctgcccaacctctacgtggcgcaggacggcacggtgcagttcgacatcttttcgcagaacggtctcaccctgaagtcgctgttcgacaaggacggctccgcggtggtggtgcacgccaaggaggacgactaccacaccgatccggcgggcgacgcgggcggccgcatcgcctgcggcgtggtggagaagacctag

SEQ ID NO: 8999 - DNA, 708 bp, Myxococcus xanthus
ttggtggccgtgtgggactacggccggggccgctcgctggtgatggccacggacgcttcctggtactgggccttcgcggcgcacaagcacggctcgcccagccgcgcgtatgaccgcttctggggcaatgcgctgcggtggctggtgagggacccggacctgacgacgctgaaggtgacggcggacccgccgtccgtggagccgggccggcccgtgggcgtcgtggtgcaggcgcggatggcggactaccagccggcgcaggacgcgcaggtgcgggtggagctcttctccgtcgccacgcagaagccggtggcggtgcagacgggcaccacggggacggacggcgtggtgcggctggagttcgagccccccgcgcccgggccctacaagctgctggcctccgcgaagaagggcgagacggacctgggcaagggcgaggacgcggtggccgtgcgcgccgtggggcccgagctgtcggacgcgtccgtgcggccggagttgatggcgcagattgcgaaggagacgggcggcaagtcatacacgctgccgcaggacggccttccggatgtgccgctgctggacccgccggtggtggaggtgggccgcgccagggaccagccgctgtgggaccgctggtactacctggtggcgctcatcgcgctgctgggcgcggagtggttcgcccgccggcgcttcggctacgtgtga

SEQ ID NO: 9000 - DNA, 2280 bp, Myxococcus xanthus
atggtgggggagaaggcgctgcgaatcgtgggagtcgccctggccgcgttgctgacggccggcgccgcggagaatccacggagtgccattctgggcacggtcatcgatgcccagtcacggcagcccgtcgcggaggtcgtcgtaacggcgagcctgtccgcgcagggcggtgagcgcatcgccgtgacccagcccgacggaaggtatcggattcccgacctgcccccgggcgactacgcgctccgcttcgagcgcgagctgttcgagccctactccctccccctctccgtcagtgaagggcgcaccttacgcgtcaacgtcgagctccagccgacggagccaggagaggccgttggattgttctgcggaggcccgactgtcgacacgagcagttcgacacttcggttcatccagtggcgagaagacgtctcgcgcgttccggtcagccgcccaacgaagtgggctggcgccatgcgcacctcggacagcctcgcggagtgggtacccggcacggtggacagcgtggacggaaggtccttcagcggtgccactccctttgaaaacgaatacctgctggatgggctttcgactcgcgatccgaccacgggccgcaacctgctcccgctgagccaggaactggtcagcgacatcagcgtgctcaccggcggatacatgccggagtacggacgtaccacggggggtatcatcgacctggagccagtggtcatctccaatgagctgcatggtgaggtcttcgcgaactgggcaccgggcgcgctggaaggggcatggaggcctgcgacaggcccccgccccgccctctcctcggacggcgcgctccgccacctgggggatttcggcgggacactgggcggaccgctgctcaaggaccggctctggttcttcgcgggcatcgtccccgcgctcagccgcgtcgaacaggacgccggcttcatggaccagcgcagcctccaggcactggccaggctgacgtatgccctcaaacacagacattggacatcgctgacggttgtcaccactcccgcgttgatgcgggggatggaaggcgcgcaggctccgcgggcggtggacagcgacacggtcatgaccgtgctcgcctacaacgccatggtcctcgacggacgcgtcacgctcgatgccaaggcgagttggctgggccacgatgtcacccggctgtcgcctgttgcccctgcgagcgtcgacacggaccgattccaggcgaagacgcaggcctcctattggctgaaggccctgggacaccatgcgctggaaacaggcctggagctcgaacatgtcgtccaacgcccatcgcaggtcgccgacatcaccagcagcaacttgagcgggttcgtgcaggaccgatggaccttgaacgaccggctcacgctgaatggaggtcttcgctacgacgcgcagttcctcgatgcggacgtgcgtggaaacatgacgcatcaccagctctcaccacgagtcggactcgtcttcgaccccggcgggaacggccggatgaagctgttcgcgcacgccgcgaagtatcaggggatggttcccctggggttgctcacgccggacgcgcgcatcgcttcgcggctcggcccgacgtcgtcttccgagttcatcgcgggcgcggagcatgagctctcgctgttcgcgaaggcgggtgtgacctacacgcgccgccgcctggatgatgcgctcgcgaccattgcggacgacggtgcgggcgggtttctcatcgtcaatcccggcgcgggccctgctgccagcttgccgaaggcaacgcgcacctatgatgccgtcacggtggagcttggccgcagcttttgggacggctggcaggcccagctccgttacacatggtcttggctccatgggaactacgcaggccccttcggcactgatggcggacggccgctgtcacagtcgcgattgctcgcagcggaccggccccatgtcttcaaggcctttgcatccaaggagttcacgctcacgcggaagctcacgctcaacgcgggcctcgcctacctgggcgcggctggggcaccgcgcgaagcggccagcacgcggacgccgtgggtacacaccatcgatgcccagctgagcgcgcgctacgacactgacgaccagcacatcgtgacgctgaggatcgacgcgttcaatgtgctcaatgcacaaacaactctccgtgaggagacgttgctgcccttgcagtaccagacgccacgacagctccgcctaggggttcgctactccttctga

SEQ ID NO: 9001 - DNA, 3450 bp, Myxococcus xanthus
ctgcaacccctgctcgccgcgcttcgttcggtgcacggcggagacttctccgtgcggctcccgggcggcggcgccgacccggtgatggaggagatcgccagtgccttcaacgccgtggtgtcgctcaacgccaccctgacgcaggaagtggtccgcgtggagcgcgtggtcggccgcgagggccgcatgggcgagcgcgtgtcgctgggcgacgtgcgcggcgattgggcccacagcatcaactccatcaattcgctcatcggcgacctggtgcagcccaccacggaggtggcgcgcgtgctggtggccgtggcgcagggcgacctcacccagaagatggcgttggagattgatggccagcccgtcaagggcgagttcctccgcatcggcactaccgtcaacgcgatgctggaccagctcaactcgttcgccgccgaggtgacgcgcgtggcgcgcgaggtgggcagcgacggcaagctgggcggtcaggccgaagtgcgcggcgtgtccggcgtgtggaaggacctcacggacaacgtgaacctgatggccaacaacctcacggcccaggtgcgcaacatcgccgaggtgtccacggcggtggccaacggcgacctgtccaagaaaatcaccgtggacgcgcgcggcgaggtcttcgagctcaagagcaccatcaacacgatggtggaccagctcaacggcttcgcctccgaagtgacgcgcgtggcgcgcgaagtcggcaccgaaggcaagctgggcggtcaggccgcggtgcctggcgtgtccggcacgtggaaggacctcacggacaacgtgaacttcatggcctccaacctcaccacgcaggtgcggggcatcgtgaaggtggtgacggccgtcgccaacggcgacctcacccagaagttgatggtgccgtcgcagggtgagattgccgcgctgggcgccacgctcaacgcgatgacggacaccctcaacgtcttcgcgcagcaggtgaccagcgtcgcgcgcacggtgggcgtggaaggcaagctgggcgcccaggcccaggtgcccggcgccgccgggacgtggaaggacctcacggacaacgtgaacctgatggccaacaacctcacggcccaggtgcgcaacatcggcgaggtgacgacggccgtcgccaagggcgacctgtccaagaaaatcaccgtcgacgtgcgcggcgaggtgctggagctcaaggacaccatcaacacgatggtggaccagctccgcgccttcgcctccgaggtgacgcgcgtggcccgcgaggtgggcaccgacggaaagctgggcggccaggccgacgtgaagggcgtggggggcgtgtggaaggacctcacggacaacgtgaactacatggcctccaacctcaccacgcaggtgcgcaacatcgcgctggtgacgacgtcggtggccaatggcgacctgtccaagaagattacggtcgacgcgcgcggcgaaatcctggagctgaagaacaccatcaacacgatggtggaccagctcaacagcttcgcctcggaagtgacgcgcgtggcgcgcgaggtcggcacccacggcaagctgggtggccaggccgaggtgcgcggcgtgtccggcacctggaaggacctcacggacaacgtgaacgtcatggccgtgaacctcaccacccaggtgcgcggcatcgccaaggtggtgacggcggtggccaacggtgacctcacccagcgcctgaagatggaggccaagggcgaggtggccgagctggccgacaccatcaacgcgatgacgcagacgctgtccatcttcgcgcagcaggtgacggacgtggcgcgcacggtgggcgtggaaggcaagctgggcgcccaggcggtggtgccgggcgtggcgggcacgtggaaggacctcaccaacaacgtgaacctgcttgccaacaacctcaccgaccaggtccgcaacatcgccgaagtcaccacggctgtcgccaagggtgacctgtcccgcaagattaccgtcgacgccaagggcgaggtgctggagctgaagagcaccatcaacacgatggtggaccagctcaacagcttcgccgcggaggtgacgcgcgtcgcgaaggaagtcggcaccgaagggaagctgggcggccaggccgaagtgcgcggcgtgtccggcgtgtggaaggacctcacggacaacgtgaacttcatggccgtcaacctcaccacgcaggtgcggggcatcgtgcgcgtggtgacggcggtggccaacggcgacctgaaccagaagctgacgatggatgccaagggcgagattgccgcgctcgccgacaccatcaacgcgatgacgcagacgctgtccatcttcgcgcagcaggtgacggacgtggcacgcacggtgggcgtggaaggcaagctgggcgcccaggcggaagtgccgggcgtggcgggcacctggaaggacctcaccaacaacgtgaacctgctcgccaacaacctcacggcgcaggtgcgaaacatcgccgaggtcaccacggccgtggccaatggtgacctgtccaagaaaatcacggtcgacgccaagggagaggtgctggagctcaagagcaccatcaacacgatggtggaccagctccgcgccttcgccgccgaggtgacgcgcgtcgcgaaggaagtcggcaccgagggcaagctgggcggtcaggccgacgtgaaggacctgtccggcgtgtggaaggacctcacggacaacgtgaacgtgctggccggaaacctcacggaccaggtgcgaaacatcgccaaggtgaccacggccgtcgccaacggcgacctgtcgcagaaaatcaccgtctccgtgaagggcgaggtgctggagctgaagaacaccatcaacaccatggtggaccagctccgtgccttcgcctccgaggtgacgcgcgtcgcgaaggaagtcggcaccgaaggcaagctgggcggtcaggccgcggtgcccggcgtcgccggcacctggaaggacctcacggacaacgtgaacgtgctggccggaaacctcacggaccaggtgcgcaacatcgccaaggtgacgacggccgtcgccaacggcgacttgtcacagaaaatctccgtggaggcccggggcgaaatcctggaactgaagagcaccatcaacacgatggtggaccagctccgcgccttcgccgccgaggtgacgcgcgtcgcgaaggaagtggggacggacggaaagctgggcggccaggccgcggtgcccggggtcgccggtacatggaaagacctcacggacaacgtgaacagcatggcctccaacctcaccgcgcaggtgcgaaacatcgcgctggtgaccacggcggtggccaatggcgatttgtccaagaagattactgtcgacgccaagggcgaaatcctggagctgaaggacaccatcaacatcatctttaga

SEQ ID NO: 9002 - DNA, 1662 bp, Myxococcus xanthus
atcgccggtctggtgctgttcctcggaggggccagggcgcaggggcgcggtgtgcttggtgcgagcatcctcttgctggtccacgcgttggcgcaccgagaggacatcttcgagttgtggcccggcccggtgctggcgctggcggggctggcggtggtgacgctggggccgtggttcgtccggcgcaggggcttgtccgagagcgctgctcgcatgcgcatccaccaggccatggccatctatctgttggcagcgctcgtgtacgcgttggcgacgaatggaacgccgtcgtcgacgctcgcagcgctcaacctcctgggggagatgctgctgagcatgggcgggagctggatggtctctcccgcgttgcctgtgacactggcgctcgtcgccgcgtcggtgctcgtggcggctttccagtggaagggcacgctcgcctcgctcgtcgcgacgctgggggcctgggtggtgggcggcacgtttgtcgcctcactcatggccttcctttcgatgcgcgcgagtctggtcggcccgtggctgcgttatggcgcgctcttcatcctccatggcgcggccctgtccctggccgcctccgtgggcgtgctggccctccatgccgcccaggagtgggtgcggaggcgccggtcggacgtcgccggcggcctgtcgtggggacgcgacacagggttcgtggtgagtggactgatgctcgcggccctggcggtggggggctccgcttccgacggcgctcttccgctggagatcgcctccattggcatcctggtgttggtggcgctgcactgcgcttggagccagcacaccggcaggcacgtctacttcgtgcagacagcggtggtcggcgtctacgccctggtgcgcaatctgtatgcaccgggcctgcgcgccgagcacgacgcattcttcgcgctggccctgggcttcatcctggtgggagtgacggtgctggcccggcgggcgggcgtgcagcccgtggaggcggccacccggcgcttcgcggcactgctgcccgtgggcatggcgctggtgctgccaggcgaggcgacgcaggaggcggcactgctcgcggggggctccggactcctgtacgcgacgctgggcgcggtggagcgcagccggctgttcggtgcattcgccgcggccgcgtgcaacttcgcgctgctcatctccgcgctggcctttggcctggagggtttggaaatctacctggcgcccatgggtttgctgttgttgatgctgggccagctcttcgcggagagcctgccgcacgccgcgcgcaacacggtgcgaatcctcgggggcttgttgctatatgtgcccgcgtcggcgcgcatcgcggtccaggtgggccagtctcccgacggcacgtatgcgctcgtcttcagcggggtgtgtctgctcggcgtggtggcgggcatggtgttccagattcgcgcctacctggcgttggggaccctgttcctcacgctggacgtcgcggccacgctgctcgacgctgggctgagggaccaccgcatcggcttcctggtgatgacgctcaccgggctcacactcattggcgggcgcgtcctgacgacgttgaagcgtcaggagtgggaaatgctcgtgcggcgggtccgcgtccagcttcgcggttgggattga

SEQ ID NO: 9003 - DNA, 804 bp, Myxococcus xanthus
gttcgggtgctcctgccgacggggtattacaacaacccgggcgtgcgttaccccgcggtctacctgttgcacgggggtggaggcgcgaactcggctcagtgggtggagttcggtgcggcgtatgcgattaccgagaacatgcccgtcatcaccatcatgccggatggcggcaaggtcggttggtacacgaactgggtcttccctcgcggggtgaatcaggcgtgggaggagttccacctcaaccagctcattccgtgggtggaccagaaccttcgcacgctggcgtacaagcggggccgtgctatcgcggggctgtccatgggcggcttcggggccatcagctatgccgcgcggcgccccgacctgtttgcctatgcggccagtttctcgggggccctggacctgggtgacgccgccatccgcgccaccgtcacggaggaggggacacggtggcttcagaatccggatggggcgtttggctctcccttctggcccttcgaccaggcctggaacatgaacaaccccattccgcgtgcggcgtctctgcggggcgttgccgtcgccttgtatgcggggtcgggcatctgggatggggatgtgctcgaacgcgtcccgggggcgtccacggaccggttccaccatgcgctgaatgccgcgggcgtgccgcaccactacgagatgtatggccgcccagcgccgggccagaagcccttcggttgtgacggcggacacaacttcagttgctggaactacgcgttcttcgacgtgctgccgcgcatgttggccgtgcttgacgggccgtaa

SEQ ID NO: 9004 - DNA, 702 bp, Myxococcus xanthus
atgagcgacatcatggatgccatggatcgccgtgatggcggcaacaactcggccacgcctcgtatcaagccggatgttccgctgtcgcgccgtgagaacttcgcgttcgacgccatccaaccgggatacggaacgtcgaagtccgccatcgacaagcacggcaagctccagcccgcgggcgacagcgtcaccaccagtgcctccgaccacgtcgatggcgaaaagtccatcaaggcgaagactccgtatacgtccttcagcggcccgccggtgggcgtggacggcacggccacggggcccctggtcgacaacccgctctacggcaaggaccgcatcgtcaccaacccggccaaggaccccaagagcggtgtggtgctcgaccagttcgacatccagcgcgacctccgaacgagcaccaggcccggcttcgacgagaccgcggtgctgcgctccgagccacgtccacagccgctctggcagcccacacccgaagagcgcgccgtcatgccccaagtcggagtggaccccgagaagccctcgttcacgtttcgcgaacgcgcgatggtgaactcggcgcgggacaaggagtacctggtcaagggcaccatccacgagttcgacttcttccagggccagccggacggctcgctcaagcccctctccaagcaagaggtgattgacgaagccaggaagaagtcctga

SEQ ID NO: 9005 - DNA, 393 bp, Myxococcus xanthus
atgacggcgctggcggagcgaatcgtggatgcgagggtccgggcacggctgatggtgttggccgcgttctgccgggctcacgcgtcgcgattgctcgcacggctggccgcgctgggccgaggtccactgccggttcctcccgaggacatcgagctggattcggatacgttgctggaactgcgccgcgagggggccttcgcccgtgcgtcggccgcccgctatgagacgaccgcggagctggcccgtcagcaggcggacctctcctccgcgtgggtctgcgagctgaaccgcaccgaggagcaggaccgctcccgggagctgctgtccctgggcgaagggggccctggggcccgtggtccacgccgacgcgccggccagcgccgccccgggtga

SEQ ID NO: 9006 - DNA, 1008 bp, Myxococcus xanthus
atgttgcttcacggagacttcgccaacttcgtcacgaacttcgtgccgacactcggcaatcccgcgtcatcggcgccggggctcgcaccgtacctggcggcccgggacatcgacgtctggggcgttgaccgtcgctggacgctgccctccgcctacggagacatctccgacctgggcgagatgggggttgcccaggagctcggagacatcaccgtcgcgctcaccttcgcacgggcagcacggctcagcggcgaccgtgacaagggccgaatcgtgctcggcggattctcgcatggcggcgagctggcctacgcgtatgccgccgccaacggccgccacgtgtcggcggtcgccgtgctcgacgcctactacgacatcgcgcccgagcacgcggaactgcgcgagcttgcgtgcgccaatgccgccgcgggacgtgaggcgcttgctcaaggcgtgaccgactccgacaacagcttcttcatcacgttgggcgagctggcccggagcgccccccaggcgcagtctccagtgttttcgagctacaccaaccgcggtgcactgctcgcgatgaatggcctcacctaccttctcgcgccatacacgccgctgtaccacctgagcgcgcccatcctcgacgccaacggcgacgttgcggcattgcgcgagtcgtccgaggacagcgtgagcgcgtggttcgccagcgcgccgccgcaccagtcgctgcgtgagaccgtggaactcgacgaaatctggtgcggggcgacaccaaggcccgagctctcgaacatccgcgtcccgttgttctacctcggcgccgctggcgcgttcggtgactacgggctgtattcgacgacccgggtgtcatcgacggatgtcacggcgctcgtcgtccgccgcttcggcccggagcgagtgtccgaggacttcggccatggcgacctcttgtacgcggcggatgcaccgacgctcgcgtggcaaccgctcgcgacgtggttgctgagccactga

SEQ ID NO: 9007 - DNA, 468 bp, Myxococcus xanthus
atggccctgggggtgggggtgtccaagcacttcttcagcagtccggtcctggacgtgctggaggtggtggagatgaacgacttcagccgctacgacgtggaggtgcccctgtacctcagcgcggactggggggacgtcttcaagctctacgcggcgcccaagtacatctacagtcgcacccggctggacgcgcggctggtggactactcccagcaggggaagccggtgtcaggcttcgacgcgaggcttcccgcgacggtgggcagccacttcgtgggctccacgctgggaatcgccgtgggctaccggtacgtccacctcttcgccgaggtgacggggggctacttccggagcaggccgcagctcttcgggatggagcggaacctggggggcgttaccgtgatgccttcagtgggcctggccatccgggcgggcggttcggacaggaagccgacggccggtcgctga

SEQ ID NO: 9008 - DNA, 1551 bp, Myxococcus xanthus
tccctgggccggcatccgtccaacacgttgcggctggtggaccgggaggtttccaaggaacacgcggtcatcgagcgcgtgggcaaggacttcatcctcaaggacctgggctcgtccaacggcaccttcgtgaatggccgccgggtgaaggagctcaagctgcgcgacggggacgaaatctccctgggcgcctcgcggctcatcttccacagcggcgagccggtggcgccggccaacgcgcccaccgcgccgggcgtgacggtggtggcgcagtccatctccatgccggccttcctggcgcagatggaccaggtgccgcagaacttccggcccgccgaacaggtgtcggacgtggaggcgctgcgccgcgactacgagaagctgcgcatcgcccatgagttccaccgccaggtgagcctgcagggcagccagacggggctcttcgagcagatcctcaaagtggccttccaactgctggccgcggaccacggcgtcatcctgaaggtggccgcggacggcgagttcatcccgtcggcggtgcaccaccgctccgacaaggccgtcaacgtcatgctgtccgacaccgtgctcaagcgcgtggtggagacgggcaaggcggtgctgacggcggacgccatcatcgacgagcgcttctccgcggcggagagcatcgtcgcacagggcatccggtccgccatggcggtgccgctgaaggtgaacgggaagattcaggcggtgctcttcctggacagccggcagcagatcaacgccttctcggagaaggacctgaccatcctctccggcatcgcctcgcaggcgagcatcgcgctggagaacgcggcgctggccgagcagattcgcgccgaggccgtgacgcgcgcggagctcagccgcttcctgtccaaggccgtcgccgacgcggtgatcgccggtgagacggaagacctggcgcagagccggctggcggaggtgagctgcctcttcgcggacatccgcgggttcaccaccatctcggagaacgattctccgcaagaggtggtagacatgctcaacgcattcttcaccgccatggccggggtggtgttccgccacgaggggaacctggacaagttcattggggactgtgtcatggccgtctgggggccgccgctgtcgcacccggacgatgccgcccgcgcgcttcgggctgccttggagatgcaggacgccgtgcatgagctgaaccgccgccgcgtggccgcgggcaagcagcccatcgaggtcggcatcggggtgaacaccgggcaggccgttgtcggctacatgggcagcgccgagcgccacgagttcaccgccattggcgacacggtgaacacggcctcgcgcctgtgtggcatggcgaagagcggtgaggtcctggcctccgagtctacggtgcgcagggcgggcgccggcttcgacgtggaggggctgccggccctccaggtgaagggcaaggagaaggccgtgccgacctaccgcgtccacgggctggagtacaccaccgccgcttcctcctcacgccgcgcatga

SEQ ID NO: 9009 - DNA, 2244 bp, Myxococcus xanthus
atgagtccgacgacgcaggcctgccccaactgcggccatctacacgacatccgcgtctacgtgagcggccagcgtgtccagtgccgctgcggcatccggttcgaggcccgccggggtgacgtggccgccgaggtggcgcgcaacacgatggtgcccacgggcagcggcatccaggagcagcgccctccggccaatgggacctccggcgtggtgacggtggttcctcacgcggagccggagccaggcatcgacatctccctttctcgcgctccggagcccgtgcgctccgcgcctcccggtggcgtgaacgggctgccaggcgtggcggcgccggggaccagcggtgtggccatgccttccagcaacggcgcttcggacgcgtcagtggaccagacgttggtgcgctcgtccgcgaagacgggctcggacaccgcgcactcggagctgaacgcgcaagagaacagcaccttcgtgggcgctggcaaggtggacctgccgggcttggagctgctggagctgctcgggcgcggcggcatgggcgaggtgtggctcgcgcggcagcagtcgctggggcgcacggtggcggtgaagctgctgccgccgcggctggcgaaggacccggagttcgtcacgcgcttcgagaaggaagccacggcgctggcggcgctcaaccacccgcacatcatccagatcatcgaccggggcgttgcgggcgagcactactacttcgtcatggagtacgtggaaggccgctcgctgcgcgaggcgatgtcggccgggctcccgccggagaagggcatcaagctcctcctggcggtggcgcgcgccatcgagtgcgcgcacgacaagggcatcatccaccgcgacctgaagccggagaacatcctgctggacgggcgggggcacgtgaaggtggcggacttcggcctcgcgggcatccgcgcgccggactcgcgcctgcagctcaccgcgacgtcggtggccatgggcacgctgaactacatggctcccgagcagcgccgcgacgcgaagaacgtggacgggcgcgcggacctcttctcgctgggcatcatcctctacgaggtgctcaccggggagcttccgctgggccgcttcaagctgccctcctcgaaggtgccggggctggacccgcgcgtggacccggtggtggaccgcctgttggagcaggacccggccgcgcgctacgagaaggccagcgagctgtgcgccgcgctggaggcgatgatttccaccagctccgcgccgggcatcccgcagagcgacctggacggccgcatggtgcccgcggccgcgcggtcggtacggccggggcggcagaccgcgctgtcgcgtcagctccgttcgggctggcggcgcgtgcgcggtggcctgtcggtggtgggcgggctggcgctgctgggcttcgcggtccggtggttcgtggggccggtgagcctccacctgggcgacgaccagcgcgtcatcatcggcacgaagggtatccaggtgaagcccggcaaccgggtgctgccgccgaacacctacggcgaggtcttctcatcgctttccttcgcggcgcccgccaaggccgggggcacttcgcgcctggagctgggcttcaacgagggcaacgaggaggtcaacgtccatagtggccaatggcggctggtggatggggagctccaggccttgcaggcgggcaaggagaccaatgggcggcggttgattccgcgcgcgtacatcgcgcagcgctacttctcgtccaacgatttcacggccgaagtgctgatggacgtggcgcggctgggaccggagtacgcgcaggaagcggatgcgcagcactacggcgagctggcgttccgcatcaaggacttgcaggtctccgcgttcgccattccggacgtgggcatgcggctgtcgtggcgctacttcatgccggacgggcgcgaggtggtggggaacagcgcgcaggacacggaggcgctcgtcgaggacgagatgccgctgccggcccacggcccctaccaggtgcggctgcagatgcgccggaacagctcgggcgtgctggtggaggcgttcctcaacaacgagcgctacgcccgcaagctgctggtgggcctggaggaccgcgtgggcaaggtggccctgggctgccgcaacctgtcctgctcgttcgatgacttgaaggtccgggggcacctgatgccccggcccgtccgccgcgtcgccgccagccccgagtag

SEQ ID NO: 9010 - DNA, 879 bp, Myxococcus xanthus
atggcactgacgccggtctacgcggcgtgcctgttgggactgttggtggtggccttcgcctacgggcgcaaggacgtgacgtcccgtccctaccgcgtgcctctgttgtggttcggacttctggcgggggtgtcgctcgtcgtgctgcggcacgtccaggggaccggagcggtgttggcctcggagacggccgtgaaggccatgggctctgtcctgctgatgctggccgcggggttggcgctgcggggcgcctgggcccggacccgggccaacgtgctgcggggttcggcgccggtgccgctggatgaagcggtggaggccctgcgtgccggtgcatccccgggctggggcgtctaccacggcgtcctggacgcggagtcgacgttgacgtcgcccggtggcgtgccgtgtgtcttcttcgacgcggaggtgcgcgaggtggcggcggacggccggcgcgggccgctgttgtcgcgtgagcgcgcgtatgcgccggtactggcgctgcgtggccagcgcctccatgcttcggtgtccttttcgcccgcgtcgctgatggctccggtggaggtgcgccggtgcaaggccctgccaggcacggtgcccgcgtcctggtatcagacggcgcacccggaggccctgtcctgggagcgcgtgggcgcggtgggcgaatcctgcctcgtggtgggtgaactccggaggggccctgtcgagggcagctacgccctggtcggtcgggagggcggccccgcgatgttggtgctgggaccccaggctccggccacctgtgggacgctggcgcgccgggcctggcggcacttcgcggcggccggggtgctgtccatggccgcggccgtcgtcctgtcaggggcgctgtga

SEQ ID NO: 9011 - DNA, 282 bp, Myxococcus xanthus
atggagcaggacctgtaccggctggcggatccccttcccccgcccaccctggtggccagcgtcatggcgcgcgtgtccgccgaacccgtgccccggcgccgcgaggtctggtccgggctggccatcctgctgacgtcgatgctgggcgggctgggctacctggtgatgagcgaccaggcgctcggccggctgggaaccgggctggcctccgtcctggtgcaggggcgcccctttgttgaaggcgtcctcagtggcgcccacgcgctgtggtccaccgcaggc

SEQ ID NO: 9012 - DNA, 570 bp, Myxococcus xanthus
atggctgaggaagctcctccgcttccctggaaagcggacgtgcaggccgcccgccggggtgacccgtccgctttcgaggccttggttcgcagcgtgcagcgccctgtctacggcctggcgctgcggctgctccagagcgaggccgaggccgcggaggtggcgcaggaagcgctgcttcgcgcctaccagaacctccaccgctacgacgacgcgcgcccgttcgacctgtgggtgctcgccatcacccgcaacctctgcctggacctgctccgccgccgcaccaaggtgcgcaccgaggagctggagcccatgaaggaggtgctccccagcggcgaggcgtcgcaggaggaaggcgccatcgcccgcgaggagcggcagtcgctggaggaggccatggccaccctgtccgtcgaggaccgggaggtgctcgccctctattacgtccagaagcgcacgacgaaggagatcgcccagatcatgggctgtgcgcctggcaccatcatggcccggctcttccgggcccgtgagaagctgcgcaagaagatgacggccgaggaggctccacgatga

SEQ ID NO: 9013 - DNA, 1644 bp, Myxococcus xanthus
gggggcgccgtgcgaatcaaacaaaagcccgaggacttctccgtcaaggagtcataccgtttcgacgaagtcgactcgggacgtcaccgcgtctacctgatggacaagcaaaagctgtccacgttcgacgccgtgacccggctgcgggatgcgttcgggctcaagcccggcgccatcagctactgcggcctcaaggacaagcagggccggaccgagcagatcatcgcggtggacggcgccgacgtggacatgcaggagcctgacctgcggctgaagtacctgggccgcacggacaagccgctgtccgccgccaacatcacctccaaccgcttctccgtcacggtgcgcgcgctccagccggagtcgctggggcccctcaacgtggccgccgccgaggtcaaccgcctgggcgtcatcaactacttcgacagccagcgcttcggctcgctgaagcacggccagggcttcatcgccaaggacctcatccggggcgacttcgaggccgcgctgcacaactacatggccaagccgtccgagctggaccggacggaggacgccaagatcaaggccttctggaaggagaactggggccgctgggacgcccgcgtcccctacgagggcacgcgcaagtaccaccgcgtcctcaagtccctgcgcgatcagccgggtgactacctgcgcgccttcatgcagatcgacgcggactaccgcgcgatgctgatcttcacgtaccagagcttcctctggaacgagggtgtgcggcgctacctccagctgatgctgccgcgcgagcacctcttccccatgcgctaccaggccggcacgctgctgttccaccgcgacgccagcccggaggtgctccgcacgctgcgcgacgcctccttccccctgctcgcgccgaactcgacgttcagcgacccgaaggtggaggaggccgtgcgctgggtgctgggccgcgagaagctccaactgtcggacctgcaagtccccggcgccgagcgcaggctctacttcaagcacgaggagcggcccctgctgtcgttcccgcacaagctcgtcgtgggccgcacgcaggcggacgagctcaaccgcgacgacatcaaggtcaacatcgccttcaccctgccgcctggcgcctacgccaccctggtcatcaagcggctgttccacttcgattacgccgaggacagcgcggagaccatccgcgcctcgcagcggccgaagctggcggaggccgaagccgccgccgcgcacgagccctccagccgccggggcccgccccgccgtgacgcggacggcgcgcgcgcctcgagccgtagcgctccgggcacggagacccgccgccgttcgtccggagaccgcgacacgcgcgcgcccgccggcaaccgcgatgcccggggcgcaggcgctccgggccgccgccgcaccggtccgcgcgaggtggagctcctggagcccgcctcgggccgcgcccgcaccctggccgccaaggcccccgcgcccgccaaggccgcggagcccgccgcgccgctgggcttccgtgagcggcagcgccagcgcaaggacgcccgctcggccgcgcgcgcggagaccgaggccaaacgtgcagccaaggccaagcccgcgaaatcacggaagaaatag

SEQ ID NO: 9014 - DNA, 2358 bp, Myxococcus xanthus
atgaaagtggtcaacaagctgctggagaagcttcccgacgtcgtggcgggcaaggtgcccgacgtgaagctgcaggaccaggacatcaaggtgccgctggcccaggggaccttcacggaagagaaaatccttccgcccaagctcgccatgcacggcttcaccctctccttcgaagccaccggcgaagcgtccatccggaacttcaactcgctgggcgacgtggacgaaaacggcatcatcggcgagccgagcccggagagcgccgagccagggccccggccccaactgctgctgggcagtgacatcgggtggatgcgctaccaggtgtccgcgcgcgtgaaggccgccgtgagcgccagcctgtccttcctcgcctccgagaaccagacggagctgtccgtcacgctcagcgactaccgcgcgcatccgctgggccagaacatgcgtgaggccgtgcgctccgacctgtccgagctgcggctgatgcaggccaccgacctggccaagctgaccacgggggacgcggtggcgtggcaggtccgcggggcgctccacacacggctggagctcaactgggcggacatcttccccaccaacctcaaccgcctgggcttcctgcgcggcaacgagctgctcgcgttgaagaccagcgccaaggcgggcctgtccgcccgggtgtccctcaccgacgactaccagctcagcttctcccgtccccgtgccggccgcatccaggtcgccgtgcgcaaggtgaagtcccatgagcaggcgctctccgccggcctgggcatcaccgtggagctgctggacccggcgacggtgaaggcccaactgggccagttgctggaagcgctgctggggcccgtccttcgcgacctcgtcaagaagggcaccaccgcggtggaaatcatggacggcctggtggacaaggccagcaaggcgaagctggacgacaatcagaagaaggtgctgggcctggtgctggagcgccttggcatcgacccgcagcttgcggacccggccaaccttccgcaggcctgggccgacttcaaggcccgcgtcgcagagtcgctggagaacgccgtccgcacgcaggtcgccgagggcttcgagtacgaatacctgcgcctgtcggagacctccacgctgctggaggtcgtcgtggaggacgtcaccgcgatgcgcttccacgagtccctgctcaagggcaacctggtggagctgctgaagtggatgaagagcctccccgcccagcaaagcgagttcgagctgcgcaactacctgcacgccaccacgctcacgcgccagcaggccatcggcttctcactggggctgggctcgttcgagctgctcaaggcgaagaacgtcagcaagcagtcctgggtgacgcaggagaacttccagggcgcccggcgcatggcgttcctcggacgccggggctacgaggacaagctgctgggcacccgcggccagtgggtggtggacctgaaggcggacatgacgcgcttctctcccacccccgtggcctccgacttcggctacggcctgcacctgatgctgtggggacggcagaagaagctgtcgcgcaaggacctgcagcaggcggtggatgacgccgtcgtctggggcgtgctggacgcgaaggacgcggccaccgtcatcagcaccatgcaggaggacatgggcaagcaccccatcgaaacgcggctcgagctgaagatggcggatgactcgttccgcgccctggtgccccgcatccagacgctcgagctgtcccgcttctcacgcgccctggcccgcgcgctgccctggagcgagcagcttccccgcgcctccgccgagttccggcgcgcggtctacgcccccatctgggaggcctacctccgcgaggtgcaggagcaaggcagcctcatgctgaatgacttgtcacccagccgcgccgcgcagatcgccaagtggtacttccagaaggaccccacggtgcgcgaccttggcaaggacctgcagctcatcgaaagcgagtggcgcccgggtggcggcaacttcagcttcgcggaggtcatctccaagaaccccaacacgctcatgcggtgcaggaacttcgtgagcggcatggtgcgcctgcgccgcgccatcgacgaacgcaaggccccggacgagctgcgcaccgtgttcggcgagctggagggcatgtggaccaccggcttccacctgcgcgctgcgggctccctgctctcggacctggcgcagtccacgccgctgggcctcgccggcgtggagcggaccctcaccgtgcgggtggcggacagcgaggaacagctcgtgttctccaccgcgcgaagcaccggagccgcctga

SEQ ID NO: 9015 - DNA, 972 bp, Myxococcus xanthus
atcatcggcgagtccccgcagctccaggccatctaccgactggtgcgcaaggccgcgcccaccgatgcgacggtgctgctgcgcggcgagagtggcagcggcaaggagctgttcgcccgtgccgtccacgtgaatggtccccgcagggaccagcccttcatcaaggtggactgcgcggcgctgcccgccacgctcatcgagaacgagctcttcggccacgaacgcggcgccttcaccggcgcggaccaccgcgtgcccggcaagttcgaggcggccagcggcggcacggtgttcatcgacgagattggcgagctgcccctgccggtgcagggcaagttgctgcgggtcatccaggatcgcgagttcgagcgcgtgggaggcacccaggccgtgaaggtggacgtgcgcatcgtcgcggccacccatcgggacctggcccgcatggtggccgagggccgcttccgcgaggacctctactaccgcatcaaggtggtcgaggtggtgctgccgccgctgcgggagcgcggcgcggaggacatcgagcggctcgcccgccacttcgtcgccgccgtcgcccggaggcaccggctgacgccgccccgcctcagcgccgccgcggtggagcgcctcaagcgctaccgctggcccggaaacgtgcgggagctggagaactgtatcgagagcgccgtggtgctctgtgaaggggagattctcgaagagcacctgcccctgcccgatgtggaccgggccgccctgccgcctcccgcagccgctcagggtgtcaacgcgccgactgcgcctgcgcccctggatgcgggcctgctgccactggcggaggtcgaacgccgccacatcctgcgcgtgctggacgccgtgaagggcaaccgcaccgccgcggcccgcgtgctggcgattggccgcaacacgctcgcgcggaaactcaaggagtacggattgggcgacgagccctga

SEQ ID NO: 9016 - DNA, 846 bp, Myxococcus xanthus
atgttcgagcagcggttccagcgcaatctgggcgtggtggatgcggagacgctggacaaactgtcacgcacgcatgtgttggttgcgggcgtgggcggcgcgggtggccagtgcgcggtggacctggcgcggttgggggtcggcggcgtgacgctggcggacttcgacgtctacgagcgccacaacatgaaccggcaggtgggctgcttcgaaagcacgttgggccgctccaaggtggaggtggtggggcggatgtgtcgggacatccacccggcgctgcggctgcgggaagtgccggagggcatcaccgaggccaacgtggaggacgtgcttggcgggggcggcgtgcagggcccggtggattacgtggtggaggtcatcgacatcgcgggggcgcatgagaagcaggtgctccaccgcgcctgccgccagcgtggcgtgccggtgatgacggggctgatgttgggattcggcgcggcgctgcacgtcttccagccggatgcgccgctgtacgaagcgctctacatcctgccggatggacgcatcgacctgccggccatcatcccccacctgggaagctacatgctccgcgagtacatggacgcgtgcttccagggccggggccacgcacccacctgcgtggtgggcgcgacgagcgcggcggggatgatggtgacggagttgacgcgcgcggtgatgcggggcccccggtccatggtgtcgtggccggagtacctctatgtggacttcttcgaccacagcttcgtccggggcaccgccgcgtcggccctggcgcggcgggtggacccggcgtcgcgggccggaggtgccccggccgcgagctga

SEQ ID NO: 9017 - DNA, 771 bp, Myxococcus xanthus
atggcgaaggagagctacaacgacctcatcttccagctgggcgacctggctcgggacaggttgccgggcaagcccacctgtccccgttccatggaccgcgtctaccgcgccgaagaggcggtggtggcgcgccgggatgaactggcggcgctcgagcaggagatgaatgacgaggacgcggcgtattcggactttctcgccgagcagggggaggagcgggcgaagcacgccgtcatcgtcaagaagtggaagaaggcggtggacgccatcgacggcaaggtgaaggagctgcgcaagacgctcgcgtctcgcaaggccgaacagcgctacgccgaggatggcctggtcaagctcgagaagaagatcagcgacatggagctgaccggcgagccgcccgacaagatcgaactggcccgcggcaacctcaagaagaaccggctccagcagatgcggctcggtcggcaactggaggatctggagtccaacctggccaccgccctcacgcccttgcccggtcagcccggcgcggcaggcatcctggcgcacaagcgcatgctggagatggaggacgaggcggaggagcgcaagctcgaccacgagcaccgcatggcggagctcgaccaggcaatcgccgccaaggaggaacaggtccaggcctcggaggattatctggatcaagcactgttcctcctgggcgaagacgtgtatgcacagcgcatcaacgatgcgcagctcgcaccgttctacccgcggttggatcgcgcgcagtga

SEQ ID NO: 9018 - DNA, 189 bp, Myxococcus xanthus
atgacgggctaccgcaccaccagcctgctccccttgccactgggcgacggggacggctccctctacggcgtgatacaggtactcaaccgccgcggagaggaccgcttcaccaacgaggacacgcaacgggtgaccgtcatcgcctcccaggtgagcaccgagctacagagtaccagcctttatcaatag

SEQ ID NO: 9019 - DNA, 1758 bp, Myxococcus xanthus
ccgcatggcggtggtggtcctggccgacgaggacgacaactccggcttcggtccggagagctacatccagttcctccagacgctgaagggcacgggcatgtcccaccgcagccggctctacggactggtgcccaccgacgccggctgcgcgaccgcgggcagtggctcggcccgcttcaccgccgtggcccacggcacggggggacaggtggccaacatctgcggacagaactacgacgggctgctggaccaggtcatccagggtgccggggagccgcaggcggacttcccgctcaccgcggcgcccacgggcctgggggagatggccgtgcgcgtccagggccagccggtgcccgcgacgcagtgggtctacgacgcggagcagaacgccatcgtcttccagcccggggccgtccccttggccggccagtcggtggaggtccgctaccgcagcctctgcgcggtcccgtaggcccggcagggaggtccgggtcaccccggccaagacagggaagtcgcggtgttacaggaaatgatgcaccgtggacttccgtgttcccacccggcgcggctatcgtggcggacgtcgtggaaacattcggccgctacgagctgcttcggaaactcgccatcggcggcatgggcgccgtctacctcgcccggcagaaggggccggtggggttccagaagctgctggtggtgaagcggctcctgccccacctgtccgaggacgacgagttcatcgacatgttcctggacgaggggcgcatcgccgcgcacctcaaccaccccaacatcgcgcaaatctacgacttgggagacgtggacgggcagtacttcatcgccatggagtacgtgcatggcgaggccgtggggcccctgggcgcccgggcccagcagcacggcatcaccatcccgctggggctcaagtgccgcatcatcgcggacgccgccgcgggcctggacgcggcccacaacgcgcgcagcccttcgggccggaagctggcgttgatccaccgggatgtgtccccgcagaacgtgctggtgggcttcaacggcggcgtgaagctcatcgacttcggcgtggccaaggcgtccgggaagctgtcccagacgattgtcggcaccatcaagggcaagcacgcgtacatgtccccggagcaggcccggggtgagccgctggactcgcgctcggacgtgttcggcctggggacggttttctacgagttgctgacacagcagcgcctcttcaagcgtgagacggagctggccacgctcaaggcggtggtgggaacgaagattgtccctccgtcggaggtggtgccggagattcccaaggcgctggacgccatcgtcttcaaggcgctggcgcgcaagcgggacgagcgcttctccacggccggtgagctgcagctcgcgttggaggagttcctcctcacggagaagctgcacgcgacgacggcgcacctggcggccttcatgcgggacatgtacgcggaggagctggaagaggaccgcttcgccaccgagcccaccgtcatcaacttcgacctgcgtcaggcggcgagggcccagtcccccaggcctccggcgcgcgccagcggtggctcctcccccgcgacgtcgcccgtgaacgccggtcaggcgcggcccgccgccccggcccgtccaccggccgccgcgccgggtgcgaaacccgccccagcgaagcggcctccaccgaagggccccggcggacagggcgacggcggcaagtag

SEQ ID NO: 9020 - DNA, 1101 bp, Myxococcus xanthus
ctggaagccgcgcgcgaaatcgccgtggacctggaggcggattcgatgcacgccttccgcgcccggctgtgcttcctccagctcgccaccgacgaccaggtcttcctgttggacacgctccaaccgggcgtggtgccgggcatgctcgccccgctgatggccgacccggcgcgcaccaagttcttccacgccgcccagggcgacctccagttcctcgccgaggtgggagtccgagtgcagggcctcttcgacacccaccgggcggccaccctgctggggtggcccaaggtgggcctggccgacctcgcccgggaacggctgggcgtggagctgccgaaggagcaccaacagtcggacttctccatccgccccctgcccccgggcatgcgggagtacatcgccaatgacgtgcgctacctgtgcgagctgggccgccaggtccgcgacgcctgccgcgaggccgacatcctggaggaggtcctcctggactgcgtccgcctgtgcgacgaggccgcggcgcgccccgacgtgggcgcggacttcaagcccaagctgccccgcgccgggctgaatcccacgcagatgacgctggcccacgccattgcccacgccctgcaccgcaagcggctggagtgggcggagaaggacaacgtccctatggggcggatgctctccaacatggcgttgggtgacatcgcggtgaagctgcccaccaaccccaaggagttggcgcgcatggccggcgtgcggggctccttcatccgctcgcacggggaggagctcctggccgtggtgcgcgaactgttggagaagtcgcgccggggcgaactggcgccggagcgcgaacccaagggccccaaggacaccaacaagcgcaagcgcgaggaggccctcaagaccttccgcgtggagaaggccaccgagcgcaaggtgacgcccagcgtggtgctgaccaatccgctgatggacgcgctggcctcgcagcccccgaaggacgtggaggcgctgacgcaggtgccctacttgggggagaagcgggtgcggctgtacggccccgcgctcgtggagctgctggccgcctaccccgtcctcaacgcctga

SEQ ID NO: 9021 - DNA, 2739 bp, Myxococcus xanthus
atggagatgctcccggtgcggtgccgacacttcatctatccgctgctcgtcctctgcctcggcgcctgtgcgggctcgcggccccagcccgctcccactcggtctgcccccgctcgccccgtcacgcaggccgtgacgcccgagaaggaggcccccgtcctcaccccgccgggactgcggctgtctccggccgtgcggcccgtgcggcagacggtgacgctggagctggacccgcggcggaagatgttcagcgggacgacggacatcgaaatcgagctgccccaggccacgcacgaggtgtggctgcacggggaggagctctccgtgaaggacgcggccttcatcgtggcgggcgcgcgggtcaagacgtccacgctgcccatcggcgacatgctcgtcttcctcccgcgtgaggcggtgggccccggcaccgtcatcctgcgcgtggcgtacacgggccgggcgcgtgcccgggagagctcaggcgtctaccgcgaacaggacgcggggcgctggtacacgatgacccagttccagccgctggccgctcggcgcgccttcccctgcttcgacgagcccgccttcaagattccctggcggctcaccctgcgcgtgcgcgaggaggacggcgccttcgccaattcaccggtggaggccgagacgcacggcccggatggatggaagacggtgcgcttccagacaacgcccccgctgccctcgtacctggtcgccttcgcggtgggcccctttcaagccgtggacgcgggcgtcgcgggccaacaccgcgtgccggtgcggatgctggtgccgcagggccgcgccgcggaagcggcctgggccgcgcaggccacgcccccgctgctggagcacttggagacgtggttcggcacgtcctacccctacgcgaagctggacgtgctggccctgcccggcacgcaagggggcgccatggagcaccccggcctcatcaccttcagcgccccgctcatgctgggccccgtggagggggactccctgtggcgccagcgctacttcgcgctgacgcaggcgcacgagctcgcgcatcagtggttcggcaacctcgtgacgcccgcgtggtgggacgacctctggctcaacgagtccttcgcggactggctcgcctacaaagtcgtgacgcagtggaagcccgaatggcgcggtgacgtgcgccgcgtggaagcgcgaggtgatgccctggtggaggaccggctcgtcagcgcgcgcagtgtccggcagcccatcgaagcgccgggagacgtccactccgccttcgacggcatcacctacaacaagggcgccgcggtgctggccatgttcgagtcctgggtgggccccgacgccttccagcaaggcgtgcggcactacctggacacccacgcgaggggcaccgccaccaccgcggacttcttcgaagccctcacccaagccaccggcaaggacgtggcgcccgccttctcctccttcctggaccagccaggcgcgccgcgcgtcgccatgacgctggagtgccccaaggagggaccgccccggctgaccctggagcagcggcgctatctccctctgggctcgccgggcggacgcggggaagaacaggcgtggcaggtgccggtgtgcgtgcgctacgccgccgggggcacggagggccgcgcctgcacggtgctctcggagtccacgggcacgctgtccctggatggcgcgaagtcctgcccggactgggtccaccccaacgcggaaggccgcggctactaccacgcgctgctgcgcggtgatgcgatggagcggctgacgcggcaggggggccgggggctcagcatcgccgagcgccgcgtcctgctggatgacgccgaggccctggtggccagtggcgagctggacgtggcccaggccctgacactggccacgcgcctgctgcgagcggacgacccggacctcgtcatgggcgcggcggccctggtcgccagcgtgcgggatgacttcgtcccgcgagccgcgtggccaaaccgcgcgcgcttcgtccgtggcctctttggcggtcaggctcgccagttgggcttcgttccgcgcccgggcgaaagcgacgacgtgcgcatgctgcggccccggctggtgtggatggtggcccagtcaggcgaggacgtcctcctgcgaacggaggccgggaagctcgcgctgcgctggctggacgaccggcgctccctgtccatggacgcggcgcagggcgtgctgggcgccgcttcggcctcgggggatgccgttctccaccagggcatgctcgaagccctgcgcaccaccacggagagccgtgagcgcgacgtgctcttcaccgccatgggaggctttcaggattccgcgctcgccagcgccagccgggccctgctgctggcgccggacgtggacacgcgtgaggccctgcccatcctcttccggcagttggaggagcagcccacccgcgcgggtgcgttcgacttcctgcgcgagcacttcgagacgctccgggagcggctgccgcgggacatcgcgccctggctgctgggcaccggcggattcttctgcgacgccgaacaccgcgcgcggttcgcggacttcttcgcgccctacgcgcccaccttcgaagggggtgagcgcgccctggcgcaggcgctggaacgcgtggacctgtgcatcgcccagcgcgaagccctgcgccccggcttggaacgcttcctgcgccgctactga

SEQ ID NO: 9022 - DNA, 381 bp, Myxococcus xanthus
ttggggcaggatgcgcgcatgtccgaatccaagcgctacgagggtggttgccactgtggtctggtccgttacgacgtgagcctggacctgagccagccgctggtgtcctgtaactgttccatctgtctcaagacgggcatgttgttgggcttcgcccccgcggagcagttcaacctccagaagggggccgagcacatcaccgactaccagttcggcaagaagtccattcaccacctgttctgtgacacctgcggggtccgctccttcggcaaaggcacgatgccggacggcaaggagatgcgcgccatcaacgtccgctgcctggacggcatcgaactggacggcctgccggtgatgaaggtggacggaaagaatctctag

SEQ ID NO: 9023 - DNA, 771 bp, Myxococcus xanthus
ccctccctgggcagcgagtcggcgcgagagcgcgcggaccgcctggcgtcgttcctccagcgcgcgctgggcaagctggtggaggtgagcgtcgcgtccagctacgagacgctcgccaaggatttgctctctggccgcgcggacgcggcctgggccccgcccttcgtctgcgcgcgcatggaagccatgggcgtgcgcgtggtggtgcgcggcgtgcgccggggcatgtcgtcctaccggtccgccctggtgtgccgggcgggcgcggggctgacggtggagcggctgaagggcaccaccgccacatgggtggaccgggattcggtggcgggctacctgctgcccaccgcctacctcaagacgcagggcctggagccgacgcgggccttcttcgcgcagcacttcgcgggctcgtaccagggcgcgctggagtcggtgctggacggcaaggcggacgtcaccagcgtcttttgcccgccggcgtccacggggctgacgttcgccaccggcgtggaggacgtgctgggcgcgggcgccggccggcgcttcgagctgattgcgtacaccgacgaggcccccaacgacggtgtcccggtggccatggggctgcagccgcagttggtgagctcgctggagtccacgctgctgagcctccagacgtcgccggatgggcaggcgctgctgaaggacatcttcaacgcggagcgcttcgaatccgcgccgcgcatgggctaccgcgcgctgtaccgcgtggcgctggccagcctgtag

SEQ ID NO: 9024 - DNA, 825 bp, Myxococcus xanthus
atggctcgagagcaggcagtgaaggcgcggaacgaccgcaacggcgcactggtggaggcgatgctgctggccgcgatggccgacgggcgcgtctcgcagcgggagatgcagacgctcctcagccgcgtgctggagcgcccggagttcgagggcacccgcccggatgagctcaacgccctggtggagaccagcgccgcgcggttgtcggaggcgaagaatctggatgacgtgctcgcgtcgctgcggcgccggctgccggaccataagaaccggatgctggccttcgggctggcggcggcggtggccctggcggaccagcgtgccacgcgggacgagctgggcctgctcaagacgttccaggccgcgctgggcatctccgaggacgaggtggcgcaaatcatcgacgtcatcgagaacggcggcagcctgagggaggcgctgggcgagccgctggagcggctgttcgcggaggtcatggtgctggtgagcgccgcggacgggaagctccaggaggccgaggcccgggcgctggtggagagcttcgcggcggaccccctcttcgagaacgtcagccccgagcgcgcccagagcttcgtcagcgagtccgtgacggccctggccgccgagggcctgccccagcgactccatgtgctggcccacggcctgacgacgcacgcccagcgggtgaaggccttccggctggccatcaagattgcccacgcggggggcgccccgagccatcccgagcagcgaatcctggatatgctccaggccaccttcggcctggctgacgatgaagtggcgcgactgagcagggaggggtag

SEQ ID NO: 9025 - DNA, 675 bp, Myxococcus xanthus
gtgaagggtctgattggcaagaagatcggcatgacccaggtgttcaacgatgagggcaacctcgtcccggtcacggtgatcgacgtgggcacctgccaggtcgttggcaagcgcaccccggagaaggacaactactccgcggtgaccatcggttttggtgagatccgcgagaagattctcaacctggccgagcgcggtttcttcaagaaggccaacgcgccttaccgccgccacctgaaggaattccgcgtcacgccggaggaggctgcctccttcaacgtgggcgacgccgtcaaggcggacatgttcgccaagggcgagctggtcgacgtgaccggcatcaccaagggccgcggtttctccggcgtcatgcgccgctggaacttcaagggctcgcagacgaagacgcacggtacgcacgagtaccagcgtcacccgggcgccatcggtcagcgtaagacgccgggccgcgtgtacccgaacaagaagatgcccggtcactacggcgtggatcaggtcaccacccagaacctgaccgtggtggacgtggacgtggagaagggcctggtgctcgtgaagggtgccgtcgccggccacaacaacggcgtcgtctacatccgccccagcatcaaggcggccatgcgcgcgcagcacaaggccgcgcgcggcgcgtag

SEQ ID NO: 9026 - DNA, 837 bp, Myxococcus xanthus
gacgtccagcgcctggaaaagagtctgcttggccacatgggccgagccatcgcggaccaccgcctcattgaggacggggaccgcatcatggtgggcgtgtccggaggcaaggactcctacacgatgctgcacctcctgcgggagctccagcgtcgcgcacccgtgaagttcgagctgctggcggtgaacctggaccagggccaccccggcttcccagcggacaagctggaggcgtacttccagcgtgagggctacccgtacaagctgttgaaggaggacacctacagcatcgtcctggagaagacgcctccggggaagacgcagtgctcggtgtgctcgcgcatgcggcgcggcatcctctatacggcggcggtggagctggggtgcaccaagattgccctgggccaccaccgcgacgacctcatccacacgctgctgctcaacctcttcttcgccggctccatcaaggcgatgccgcccctcttgcgcagcgacgatgggcgcaacgtggtcatccgcccgctgtgctacgcgccggagaaggacatcgcgaagttcgcggagttgatggccttccccatcatcccgtgtgacttgtgcggcacgcaggagaacctccagcgcaagcggatgcagcggctgatggaggagctgggcaaggagattcccaacgtccgccagagcgtcctcaacgccatggcgaacgtgcggccgagtcacctgctggacaagacgctcaaccccgacccgctgcacgccagcgaggaaggggccacgacgaccgaaccgaaggacacgcaagggagcgccagcccatggctcgagagcaggcagtga

SEQ ID NO: 9027 - DNA, 642 bp, Myxococcus xanthus
atgcccaagttcaccctcgttcctcccgaaatcgaggcgtacgcggacgctcacaccacggcacccgcgcccctgttcgatgaactccgtgatgtcacgtatgcgcggatgtcctcccccaacatgcaggtcgggtccgttgaaggcaccttcctgcgcatgctggtcgcgttgaccggtgcgcggcgggtgttggaaatcgggaccttcaccgggtactcagcgctgatgatggcggaagcgctcccggatgatggggcgctcattacctgcgacatcgaccccgaggccaccgacgtggcgcgcgctttcttcctgcgcagtccgcatggacggaaaatcgacctgcgcatggggccggcgctggacaccctgaaaacgctccaggggccattcgacctggcgttcatcgacgcggacaagccgagctacgccgcctactgggacgcggtgttgccgctgctgcggccgggcgggctcatcatcgcggacaacgtgctgtggtcgggccgggtgctccagccggagggccccagtgaccatgcgattgtcgacttcaacgcgaaggtggcggcggaccctcgcgtggagcacgtgctgctcacggtgcgtgacgggatgatgctcgcgcgcaagcgctga

SEQ ID NO: 9028 - DNA, 1368 bp, Myxococcus xanthus
atgcgaggtatcgcgacccagtacaatccggagacggggcagtacgagacgcccacgcacgaggtcgtctatcaggtgcccgccgaggacgcgatgatgacggcccggttcatcctggagaagagccgctatgacgtgatggagaaggaggggggactggagatgttctcctccttcattccggacgtcattccccccgagcgctactacatccaggggacgcggctcgggccccggcaggcactcgttcgagtctttcgcatcaggtacacgcaggaagggggaggctacactgcggaggcctccggtcggtccggcgggcatctctccgtggcggatgccttcaccaatatccctgggctggagggctaccggccggcgcacggctaccgcgacctgggtatcgagcagaagctgctggagcggctggagatggctcccgcgctggagctggtgggcggcaattcccctgttcccattcgctcggtggtgatggagaactggggcgagaagggtgggaccaccgccacctccgccgctcccgcgtgtggtgctcccttggcgggggcctcgtccctgttctctgcgggaggcgtcctgctcgtggcggaccccctgggcacgcaggaggtgccgtccgcggcgctgcggatgttgtgcgaggcctcggcccaggagctgccggtgacgctggcgctgtcgattcccgtctccgagcagtcgctcctcgatagctacctggccagcgacggcgattcagcggccgttcaggagctcctctcggggagtgctttctggcgccggacataccaagacgggcgcagcagccgcgccatgctgtggctcgtcgagcaggtccgccgcatgcgcgtctctggaaaggacgtggacgtggccgccatcgactccgacaaggcccacggcaatgcgcgcgaggcgcagatggcccagcatctgctgaacgctcagtcgaagcgcccccaggcctggacgctggtgctcacgggcagcgtccacgcgcgcaccacggaggtgagctgggatggcgacttcgagcccatgggctctcgcgtggtgcgcgcccttccctcggtgcgtgccctggatgtgggcttccagcgaggcacccagttcgtctgccgctacagcgtctgggatgaggaggtggagtgcaacgtcttcggcatcagcccgacgctcgaggcacggcagtcctccaagcaggccgttggcctgcagctcttcacctcccagcagcctcacggcttccacggccggctctacctgggcgcgctgagcgcatcgcctcccgcgctccaagcgccgcgccaggacaccaccgtcgaccccgtgtcctcctcgaagtga

SEQ ID NO: 9029 - DNA, 969 bp, Myxococcus xanthus
catctccagaaagccgtctacttggagctgtggaccatccccctctatctgacggccgcctattccttgcaggttcctggcacgaacgctcagctcccgccccagcaggtgaccgttcgcggaaagaagaaccccaatcgaagccgggagcagctcgccttcaacaacatctactcggtcgtcgtacaggagatgctacacctcgaactggccagcaacctcttcaatgcgctgttcgcccccaagggatactcgccgaagttcacaggcgaatgggcgccgcggtacgacaagttcccgtcctggatcgcggtcaacaagcccgtgaagctcgggccggtgaaccctgagcaaatgtccctcctggccgccatcgagacccccgagccaaagaccgatggcgcgccgaacgggccgcaagatgtctacgattccatcggtcagttctacaaggccatcgagcagggcatcaatcagcgctggaacgaactctaccagcccgacgcggaccaccggcagaagagcgaattcgccaacccgcaatacaagggagacgactacgccaggttcagcagcaccatcggcggtgacagccgcaccgcgctgaaacaggcgaatgaggtgctccaggccatcgtcgggcagggcgagggcaacttgggacccgtcatcgacccagagctccgccccgaggatgccaacgacctggaggatcagttcagccatttcgcgcgattccggatggtgcaggcaatgctgaagttcggcggcccgctggagacctaccccaccacagggggcagtgggctcgcggccgcgcagcagcagctcaccgccggattcacgagcctcttgaccgcgttggagaagggctatgccggggacgacgaactcgacctcggtagcatgtgggctcttcccaagcagatcgtgtccgtgtggtccgcgggcggagtgccgcagttctaa

SEQ ID NO: 9030 - DNA, 975 bp, Myxococcus xanthus
gagaagctccgcctcggaggcattgaccaatgggtctcgatccgcagccgcgacctacgcaatccggtgctgctcgtgctccatggcggccccggctgggtggcgatgccgacgagttggtatttcgcgcacggctgggacgaattcttcaccgtcatccaatgggaccagcgcggcgcgggcaagacgtatgtcgcgaacgatccggccacggtcgccccgacgctcaccgtcgagcaggtgcacgccgatgccgaggagctcgtcaaatgggcgcgccagaccttcggcaaggagaagatcttcgtcctcggccatagttgggggagcctcctcgggctcaccctcgcggagaggcaccccgaatggctccacgcctatatcggcgccgcccagggcatcgatgcgcgggagagcgagcggcgcggctgggcctgggcgatggaacaggcgcgcgcggagaagaacgcagaggcgatccgcgacctcgactcaatcgcgccctatgccgttggcaagacgccggtgccgttgaaggacatccagctccagcgccgctggctcaatttcttcgggggtgccgcctatcggcgtcccgatgcgagcttcgagggcgcagcggtgaatctgtcgcccgaatacaccgacgaggaggtacgccaggtctggaaggcgcaggatttctcggtcgagaggctccttgccgcgatactgacggcggacctatcgcatgtgaagcggctgaagacgccgctgctcctgttcctcggacgccacgaccgcaacgtctcggcgatggttgccgccgaatggttcgcgggcgtcaaggcgccgtcgaagcgactcgtctggttcgagcagtcggcgcacgagctgatggccgaggagccgggcaaggtgctgctctcactcgtccgctatgcccgtccgatcgccgagcgcgccggcgatgtcgcgcccgccagcacccaatag

SEQ ID NO: 9031 - DNA, 1311 bp, Myxococcus xanthus
ctcgaactggacgacatccatagcggagtgctgcggccccgcccttctccgtacgtcgcgacctatatcctcctccgcatcgatgaccggagcgcggggcgggagttgatggggcggctctgctcggttgtggccacggccgcccatccgagcagcccgaccgccgattgctggctcagcgtcgcgctcacgtatcacgggctcgaggcgctgggcgtaccacgaaactcactggacagcttcgcgtgggagttccgccaggggatggccgcccgggcgaaggcactgggggacgacggcgagagcagccccgaacactgggagccaccgctgggaacgagcgacgtccatgtcgtgctgacggcgctttcgccgactcaggctcaactcgaaacggcgctggagcgcgcgagcaaggcggtgcgggaacttggcggcatcgaggcaatctggcgtcaggactgccatgcactgagcaccggcaaggagccgttcggcttcaaggacggcatcagccatccggccgtcgagggcagcggcattccaggaagcaatccccacgaggaaccgctcaaggcaggcgaattcgtactcggctaccccgacgaaacgggcggcgtgtccccgatgccctggcctgacgtcctggggcgcaatgggacgtacgtcgccttccgcaagcttcatcagcgggtggccgcgttcaggcagtacctgaaggccaccgcgagcagccgggaggacgaggagtttctggcggcgaagatgatggggaggtggcggagcggcgcgccgctggcgctgtgcccacaccacgacgctcccgaccttggcgccgattcgtcacggaacaacgccttcctctattcagatgacccgaccggatacaagacgcctcccgcgtcacacgtccggcgagcgaatccccgcgacgcgtccgtcgccggcgtggtcagactccatcggatgatccggcgcggaaccgcctatgggcccgaactgcccgagggcatcctcgaggacgacggcgccgagcgagggttgatgtttgccttcatcggcgcgcacctcggacggcagttcgagttcgtgcaatcggagtgggtcaacggcggtgactttctcgggctgggcgatgcgaaggaccccctcgtcggcgcgaacgatgggacgggcgtgttctcagttccaaagcgtcccatccccaggcgcatgcaaggcctccctcggttcgtggtcacccgtggaggcgagtactgcttcatgcccgggctccgggcgctgcggtggctggcggacctccggacatga

SEQ ID NO: 9032 - DNA, 123 bp, Myxococcus xanthus
atgccgccgggcgacggcagggccggcgacgtgctggtcgccgactccaccatcttcagcaccttgttcggggcggatgacagcctcttgcgtttctggaagaacctcgccacggcccactga

SEQ ID NO: 9033 - DNA, 522 bp, Myxococcus xanthus
ccccaggccatggccattcccaggtcgactgatcacctcgagcgggggaagtacggtccgatttttccgaagactcctgcttgttatggcttcacgattgttgccaacgtcaagcccgggcgcgccgatgccatgcgtggctacggccagagggtcgccgaagcactcaaggccaaccccgaccttctcgcgccgctcaagctccactacctccgctgggtgctcttcgatgacgacacccggttcatgtatcagggcatcttcgacaccgatttcgacaaatacaccgaggacgcagtcgtactcttcacacagtccggaatcaacaccgccttcgagaacctcgaggggtttcccatggactggaagaccaacacgcctgcgttcatccagttcatccgagaccaccagtgcaacagctttctcgagtacggcgagtacccgttcttcacaggcgatgaaatcaagaaggcgctgaagatcaaggccgcgctcgccgagatgctcgagcagatgcagtag

SEQ ID NO: 9034 - DNA, 1716 bp, Myxococcus xanthus
ccggacggcaccgcgtgtgagccggacaatgcctgcatcaccggcgccacctgccaggcgtggctctgccgggtcgaggagcgcgcctgtgacaacggcaacgcctgcaccacgtacgtgtgccacgtgctggacgggtgccagtccgtgccggcgccgccctgtccagcgtccgggccgtgtcaggtggggacgtgcgacccgcggatgggatgcgccacggcccccgcgccggacggcaccctatgcggcgcggcccaaggcacctgcgaggacgcggacgtgtgcctggatggggcctgtgtgaagcgcgacctgccggagggcttcctgtgtgaagcggccagcccgtgccaggtgtcggggcactaccgcggcggcgtgtgtgcgcggcccgcggcgcaacccctgaaggtggattgggagcacgacgcccgggcgggagaagagcagcttcaggacctgctggtggggccggaaggggacgtgacgctgtcgggcttctacggcacgcccgtgctggacgcggcgggcaaggggcctctggtgcgggcctccaaaccggcgcgccgctgcatgctgtggaacgaccggatcctgtgcatggacatgccgatggacgggacggtgtcgctgctggagcgcgacacggggacaccgcggtggaccttcaccctggccgacgcgcggccggacttccgggacaggacgcagacgctcttcctggcgcggctggcggtgatggcgccggaccggctggcggccctcttcgaggcctaccccacggaccagcggcgcgacacggcgtgccgcatgtacttcctggtggtgctggatgccttcggccacatggtgtccgcgcgcgagttgacggacccgatgctcgccgagtgcaaccacccgcacccgtatggcctcgcctcggacgcggtgggggacctctacgttgccttcgcgcccacgctgaacacgggcgcgccgctggcgtcggggacgccctcgttgctgatggccttctcctcggacggggtgccgcgctggcggaggacggagcccctgcgcgcgggcgagctcgcggtggtgaacgggctgctgctgcccgaatggggcttccaggcgttgagcacccgggacggaacaccggtgggggagcacctcgcccagcaactgggccgcgcggtggccacccgggacgtggtggtgcccagcgcgtcgggcaccacggtgaacgcggatgtggacagcctgagtttcacgccggccgccacgcagctgaagggcttccggctcccggacctggagccggcgtggctgtactcgctgaaggaaggccagcacctgacgagcaaggagctccggctggccacctggcccaggggcgcggggcttccgcccgagacgctggtgttgacgcacgcggtggcggccgacaaccagcggttgctggtgggcgtgcgcgcgcgggatggggcggaggccttccagtgcccgctcgactacgcgccgcgcacggtgccgcagttgatggagctggggcccggtgccctctacctgatggatggggccctcagttgtggcgagtgcgatccgcccttcgccaacagccagccgcgcttcatgcgcttccccatgccggggttgctgcccgcgaacgcgccctggcccgggactttcggaggaccggggcatgggcaccatgagaacgcggctcactga

SEQ ID NO: 9035 - DNA, 663 bp, Myxococcus xanthus
atggatacttctgtttcgccccgcaccgtcaccggccgtctcgacgtccaccctcgaggcttcggcttcctcaccgttcagacgcccggctcgcccgaggtgctgtcggccttcgtccctccgcccgacctcaatccgtacttcgccggggacgtcgtcacggccacggtgacggcgggcgcggatgggcgctggtcggccagccagttgtcgttggtggagcggcctcgcacgcaggtctacggcgaggtggtgctgcgcaagggcgtgaccctgctccacgtggaccgcgaggtggccaacgcggactgggtgctcgacgccgcggggacgcaggtgcaggccggtgacgcggtggtggcgcgcatcgacgaaggcaaggtggtgctgctctaccgggtggaggaaggggaggaccgctccctggagcgcgtcatcgcccggcacgggctgcgaaaggacttctccgcggaagtcgtcgaggaagcgcggggggcgcgcgcggtgccgcatgcggtgggcgcgcggaagggacttgcgggacgtgcccacggtgacggtggatgcgccgtccacgcgggacatcgacgacgcgatttcggtgctgccggcggggccggacggggcgctgcggcttctggtgtccatcgcggacgtgggtga

SEQ ID NO: 9036 - DNA, 822 bp, Myxococcus xanthus
atgatcgcacgcacgctctgcgtctttgcttcgttggccgtctctctggcggcgccggttgccgcggcacaggacgacgagaacgtcctggacaaggtcgtcgtccgcaaccggctgtacgaaccgggcggcaagttggagatgtccttcggggtcggtctgccgctgcagacacacctgacggcgcactacgtcttcaacgccggggtggcctacaacctcttcaacagcttcgcggtggaggctcgggccggctacgcggccagccgtcatacgggcctggcgcgttccatctccgagagcttcctcaaccgcgaggacaagcgcgtcaccgacgagctggaagacctctggcagatgaacctgcacggggtggcaggtgtccgctgggcgcccatctacgggaagctcagcctgctgtcggacctgccggtccacttccaggcctacgtctgggcgggcgggggcctcgcctcgttcaagcgcaactccgtgatccagtgcacgcaggtggtgaaccgcgagctgggcatctgcgacaaccgcacgtcggtggatgaccgcgggtcggccacccagaacttctgggtgaatgagtcgcgggtcgccccggtggtgtcggcggcggtgggcttccgcttcttcatcctggacaagcacggcgtgcgcctggagctgcgcgactgggccttccgggacaactaccgcgtcaacctggagcgcgatgcgtgggaggcggggcaggcgacgggggagcccgcgcgcagccctggcctcacgcacctggtgcagttcgaccttggctacaccttctccttctag

SEQ ID NO: 9037 - DNA, 732 bp, Myxococcus xanthus
atgcgcttcctgggctgggatttgacggacccgtacgcacgcattccccggccagtggacgtggcggaggtggatgcccgggggcaggtgcgcttctccgagctccggtggcctgtcccctcgaaggcgctcggcttcaccccggagctgctgcgcgcgtcatttcctttgaacccggaggatgtgctcgtcatcgatggcccccaggcgctggcccggccgggagcctccgtgcgcgaagcggagcgatgcctgcgcgcgccgggacgcacgcccgacgtgctgcccgagcctggacgtcccttcgccggcttcgtccggggcggggtgctgctgttcgcggcgctgcatgcgcggggtgggcatcccctgttggacgtggacacggactcgctggaggaggcccgcctcttcgaggccttccccggcgcgacatggcgcgcgctgtctgtggagaagttggggaagaagacgtctcacgcgggacggacgcgaagacaggcggtgctggaggcgcggggcctgcgcttcccgccgggcctgcttcccacccatgaccagttggacgcggcgctgtgcgcgtggctcgggtggctcacgcgcaaggcccctacgcacgtcaccgccgtgggcgcaccgctcaccgtggataaccagggctggctgcgcgaggggcgcatcctctcaagcgcccacaagttctccacagtgaagggcctcgccgctcagtga

SEQ ID NO: 9038 - DNA, 810 bp, Myxococcus xanthus
atgctggccctgggcagcccgcgactggacgcggacaaggcgctcttcctgctgcggcaggtgcctcggctggaggacccgtccctcttcgtggcggtgatggacgtgctccggggcgaggccttgccgcagtcctcccacgacgaagcgcgcacggtgttccgccagaagctggaggcgctggcggccgctaacccacgcgccatgcagattcagttgctgctgctcctgggagacacggagccgggctcggagatgagcgcggcggagattgaccgcctggagcaggtggccgccctccccgtgtggcgcgagggcgtcttcacccgcacgtacgaggaagcccggaagctgctggagggctcgggggtgccggatgtcagcgccacggcgatggcggtggcggcccacagcgtgacggaccggggctcatgggtgctgcgcacgcgcaacgtgggcacgcgcggctcgctgtcccccgagggccggaagcggctgggccgcatcacccgcgacatcggcacgcgcatggccgaacaacccaccatggtggagcgcgtggtgggcctgcagctcgtccgcggcggcgcccaggagatgggcgacgaggccgggcgtgaacaggcgctggcgcgaatcgaggcgctggagggcgcggtgaccctcttccgcaaggcgtccatggaccgctggcccctgcatgcgctgacggaagcgttgatacaggcgagcacgcgagacgagcccgcctacctgctgtccttcacgcgcgtggaagcgaatcaggcggcggagacacaacaaccctag

SEQ ID NO: 9039 - DNA, 501 bp, Myxococcus xanthus
atggatgtgcatgacgggacgctgcgcacccgcgtggacaagaagctcttcagcggattcaaaggcggcagcgtccgcctgtacgtctccagcccgcgcgtcgaaggcatccacgccagcggcggcagccacgtggacgcggacgccacgcgcacggacgagttcgacgtcgaggccagcggcggcgccatcgtcaacgtccgcggcgtggatgcacgccaggtggaggccgaggccagtggtggctcgaaggtgacgctggcgggacgggcaacggacttcgacgtcgaggccagcgggggctccatcgtgcgtgccctggacgtgaagggcgtcaagacgctggacgcggaagcgagcggcggctcgcgcgtggaggtggatgcatccgaccgcgtcagcggcgaggcctccgggggcagcgtcctccagctcgtgtcccgcccgagccagagcgacgtgcgcgccagcggcggctccaaggtcgtctacaaggactga

SEQ ID NO: 9040 - DNA, 2808 bp, Myxococcus xanthus
atgagtgggaacacgctgccgctcgcgccggaagcgcgctcgctgggcaagtacgaggtgctctgccgcctgtcgacgggcgggatggcggagattttcctcgcgtcccagcgtggcctggcgggtttccacaagctggtggtgctgaagcaaatcctccccgacatccgcggcgaggaggaattcgtccggatgttcctggacgaggccaaggtgacggccgcgttcaaccacccgcacatcgcccaggtgtacgacctggacatcgcggacggagagctcttcctctccatggagttcgtcccgggcgccacgctggtggaggtggcccgcgcgtgccggcaggccaacacccccatccccatgggctacagcctgatggcggtgcgcgataccgccgtggcgctgcactacgcacacaccttcacggatccgctgggccgcccctctcccgtcatccaccgggacgtagcggagaagaacatcatggtgacgtacgagggcgtcaccaacctgctcgacttcggcatcgccaagagcctggcccgcgccagccgcaccgcggtgggcatggtgaagggcaccagcggatacatgtcgcccgagcagatcatgggcgagccggtggatgcgcgcagcgacctgttcagcctcggcgtggtgctgcacgagtgcctcaccggcatgcggctgttctacgccaagcaggccgaggcgatgatgaacgcggtgctgcgctgcgaggtgacgccgccctcgcgcaccaacaagcacgtgccgccggagctggacgccatcgtcatgcgcgcgctgtccaagcgccgcgaggaccggtacgcctccacgctggagttcgcccgcgccatcgagcgcgccgtggggccgctcatctggcatcccgagcagagcagcgagctgatgctgcgcctcttctccgaccggcgcgagcagacgcggcaactcctgatgagcgggcagaacgacacgggggacaccaccggcgtggtgaacctggccaaggtgatggccatgggggtcgagccgtccgagctgcccaccggcggcgtcaccttgccgccggcgcctcgggcttcgggaacgcctcggaacgccgcgccgtcccccgcgccccggcgtcccaccacgggcgctcccgccgcgtcccctgaagccggcaccgttcgcaaggccgtgcttcaggcgcctccgggcaagcggctggcctcgcgcgcgtctcccgctgacgcacacgctccgccgcctcctcccgccgaggcgacgacgctccctccgtccggggggcagcacgtgcgcacccagccggggatgccggcccactctccggagcacacggtccgcacgcagttgccgggcaccggccgggacgcgggcgcctctgcgtccacgccgggtgaggcctcctcacgccagggctcgcgggcctcggcggccgatgcccaggccgctgatcgggaacagacccaggtccgcggggtgcgttccccggagtcacccgctccgccagcacccggggactctcgcgcccgaccgattcgcacgccggatacgctccctgccgcggatgatgcgcatcgggcacgctcgtctcgcgcgactgagccgacgcctgctggcgatgacgcgcctcggacccgttcatcccgcgcacatgagccggctcccacctcggatgacgctccgcgggcccgttcatctcgcacgcccgagccttccccgtccgtgaatgagcccccgcgtgccgaggcacggtcccgcgcgtcccggacgcaggacggcctgcgcgcctccgtgcccacgccgccccccgccgagcgcgacctgcagacggcgatgattcgcatgccggtgctgccccccgagcgtggtggggacacggctccggtgacgccctcgccgcgccgccccattcctcctcgccgcaggcagggtggctcttcgaccgagcccaccacccagcccgtccgcgtccaagacatgcccatggaggaggacgaagaagaatccacggtgcaaggccgggggagcgacacaacaggccccaggcgcgcacgggccccccagttccagccacaacccgctcggcgaagccgggcctggatggctgtcacggcggtggtgggcgtgctggcgctgggcgtcgcggtggtgatgctggggctggacggtggcgtcgtgtcctcccggctgaaacccctgctcggccagggtgctgccccatcgccctcccagcaaaccgccgggacacgccctccggtgaacgcggacaaggacctggcggcggcgacagcgacgcccgtggccccaccggtgaacgatgggccgaaggacacgggtgattcggccctggtcatcgcggatgtggaccccgccaccctgacggatcaggtccccgtgccggatgagagcgccccggactcggactccgccaccgaggacgacgccccgctcaaggagccccggaccttcaagcgcgtccgcaacgggacgcagcggagcaaggcggtcgccacggcaccccgcaaggcaccggccacgccgcccgcctcggagagcgtaccggcgggcgagcccggcttcctcaccctggtcaccgagcccaaggcccaggtgttcctcggcggccaggacctgggcaagacgccgctcttcaaggtgaagctgcccgcgggccagcacaacctgaagctggtggatgccaccaccaaggcgcaccaggtccccgtggacatcaagcccggggagacgacctccgtccgcggcccgttgagcctgctttcggacccctga

SEQ ID NO: 9041 - DNA, 825 bp, Myxococcus xanthus
atgcagcgcatcctcgtggcggtactgggagtcaccctggcattgggcctgtcgacgggctgcaccaagcagcgcatctccgccgagaaggccgtggcccgcaccctcatctccgacgagcaggaggagcagctcggcaagcaggtcaaggcggagctggagacgaaggagaagatcaaatacgtgcagaacgcggccgtcgtcgactatgtgcgcggcatctccaccagcatcctgaaccaggcctccaaggaccggcccggggtgaagtggaagatcaacgtcatcgacgacccgaagacggtcaacgcgttcgccacgcccggcggctacctgtacgtctacacgggcctcatcctggccgcggacacggaggcggagctggccggcgtcatggcgcacgaggcgggccacgtcgtgggccgtcactccgcgcgcgccatggtcaaccagatgggcctgcaggccatcacccaggcggcgctggggcaaaacccgggcacggtggcgcagatcgccgcgtcgctggtgagcggcggcacgctgctggcgcacggccgcggcgaggagattgaagccgacgagtacggcgcccgctacgcctccggggcgggctatgacccgcggggcctcatcaccttcttcgagaagctccagaaggagcagggcgacacgcccgcgctgatgaagtggctgagcacgcaccccaccaacagggatcgcatcgtgaacatccagaagatcatctcgcagaagaacctgcggggcagcaacaacggcccgggtgggcttcccgccatcaagcaggccctgggcggcaagtag

SEQ ID NO: 9042 - DNA, 228 bp, Myxococcus xanthus
atggcggcgccagagcccgcgcccgcgccggccgcgcccgagccggtgaagcccgctccccctgcggtctccgcgagcccggcgaagaaggacccgctgctcgacgaagacgtgtccgacgctccgcctccggtggtgaagaagccggagcccagcaagtccagcaagccggcgctgccgccagagcccaagtacgacatctccgagtgggacccgaacggggactga

SEQ ID NO: 9043 - DNA, 1371 bp, Myxococcus xanthus
atgcgcgtgcgcctggcgcccaccttcaacatctccgagcaggtggcgttgaagatggaggtcctcggcctggacaacttcatcatgggcgccatgccggacacgctgctgcccggcaacacgcgcaacatcttcggcatcttctccgagagccaggacccgctggcggacgcgctccaggactccatcaagctgcgccgcgcctacggtgaggtgaagacgccggtgggcatcctgcgcttcggccgcatgggcagccagtggggcctgggcatgctgcgcaacgacggcacctgcttcgactgcgacttcggcgacaccgtggaccgcgtccagttcgtcaccaaccccttcgagggctggtacgtgacgccgatgctggacttcaactcggagggcgtcaccgacacgcgtggcaccgtgggcgagcccatcgacctgacccagtccgatgacgcgcacagttgggtgattgccatcgcgcgccgggacaccgaccaggtcatccgctccaagctggacaacaaccagggcgtgctccagtacggcctgcacttcacctaccgcacccagaagtgggagtacgacggctccaccacgaatggccagaacaccggcttcatcccgcgggacgcgacgctgttcgtgccggacctgtggctgaagtacgaggagaagaactggcggctggagttcgaggccgccgcccagttggggcgcatcggcaaccgcgcgctggacgtgggcgccatcaacgaccccacgctcaaccagagcctcaccgtggcccagttcggcggcgtggcgcagggtgagttgcggctgctggaccagaagctgtcgctgaacatggagctgggcttcgcctccggcgacaaggcgtatggcttcggcaaccagccgggccgcccgggttcgggcgccaacggccagacggcgccgggtgacttcgagggcccgcagtacgactgcggcacgggcggctgcagggacaacgccatccgcaacttccgcttcaaccgcgactaccgcatcgacctcatcctgtggcgcgagctgctggtcggggtgacggacgcgttctatgtccgcccctcggcgaagtacaccatcaccgagggcttcgacatctacggccgcgtcatctactcgcaggccatgtacgcgcagtccacgccgtccaccacgcgcaaggcgctgggcctggaggtcaacgtgggcgcggactacaagacggaggacgggttcatcgccggcatcgcgtacggcatcctgttcccgatgagcggcttgcaggagttcgacgcgacgctgcgcaacgacctggacacgccgcagaccatccgcgcgtggctggggatgcagttctag

SEQ ID NO: 9044 - DNA, 873 bp, Myxococcus xanthus
atgccagagctacccgaagtcgaaatcgcgcggcgcaacctggtgcgctggttcagcgaccggcgcatcgtgcgcgccgagtcggagaacacccgcatcttccgaggcgccgagcgccagcagttcgacgcactcacgggccggttggagtcgctggtccgccggggcaagtacctgctcttcgctttcgagggcggtaaggggctgatggggcacctggggatgacgggcaagttcgtccgccgcaccgaggggcaggtggcgccctacagccgcgcccggttccatctggacgacggccatgtcatccacttctccgatccacgaatgttcggccgcctggagccggcgcccgccgcgcgcctgcgggagctggacgcggtgcgaatcctggggagggatccgctggcggatggcctcaccgcggggcagctccagcaggccgtgggctcctcccggaaggagctgaaggtggcgctgatggaccaggagcgcatctctggcctgggcaacatccacgccgccgaggcgctcttccgcgcgggccttcacccctcgcgccagcccggctccctgacgccggacgagtggaaacgcctggtccaggccatccgcgccaccatcgacttcggcctcaaggagcaggagggggaggagccggtgtacctggaggaggggcgctcggagaatccattccaggtgtacggccgcgcggggagcccatgctcccagtgtggcacccgggtcgagtccttcacccagggaggccgtaccacccacttctgtccccggtgccagccggaggacggacgccgaagtgaggcgggggcgccggccgttgacggcgcgaaggcccgccctggtaagcgttga

SEQ ID NO: 9045 - DNA, 1047 bp, Myxococcus xanthus
atgcggttgcccagactcaagcacctgtcctggcgcgagttcagccggcgcttcgtgagggagttccaggaggacagcgtcaccgacatcgcggcgcaactgccggactacctgctgttctcgctgttccccttcctcttcttcctcgtcacgctggtggcgtacctgccgttcgccccgggcgcggtggacgcgatgttggaccgcatccgtccactggtgccgggggacgcgatgggcctcatcaccggccacctgcagtccctggtcaaccagccccagcccaagctgctgacggccggtctggtcatcacgctgtggtccgcgtcgcgcggcgtgaatgcgctgcgcaccgcgctcaacctggcctacgacgtctctgaatcccggcccctctggaagacgcagggcctggcgatgctggtgacgctgctgggctcgctgctcatcccgctgtccttcgccgcgttcctgctcggtgggcggctggggctgtggctggcgggcaagctgcaactcgtggacgccttccacctcgtgtggtcctggttgcgctggcccttcaccgcgtcactggtgatgctggtgctggcgctctgctactacctgctgcccgacgtgaagcagcgcttcaagtacatcacccccggctccgtcctgggcacgggcctgtggctgacgagcacctggggcttcacgcagtacgtggagcacttcggcaagtacaacgtcacctacggctccatcggtggcgtgatggtgctgctgctgtggctctacctctccgggctcatcttcatcgtcggaggtgaagtcaacgccatcctcgagcacgcctcggtggaggggaagtcgaagggcgcccgcggcttcggggagcccgcgccgctggagccgcccctgaagacgcctggcgcggccaagagcgccagcagtgccatgcggtcgaagctggcgcgcttccgatggcggcgccgtgtggcccgggggcaggagcccgagccgaccgtggaggagcaggaccctcgctcctccacgctgcactga

SEQ ID NO: 9046 - DNA, 903 bp, Myxococcus xanthus
atgctggcgtccgacctgggctccgatgcgccgcgcaccacggatgcgcagcagcagcggctggtgaacggagcgccgctctacaaccccaacgtgtcggtgcacatcgtccagaagaagcgcttcgcggacgagggccgtcacgagctgacggtgtacccggccacggtgcaggtgaacgggaagtacaccgaccacgcgggcacggcggcgcactacacctatcacctgcaggagaacttcgccctccaggtgatgggccagtacaactggtactcgaacgagagcgccttcaacctggagctcatcgacaaggtccgtgagcaggcgcaggcggcctcgtcgctgctcctggtgtggggcgcccacgcgggcgtggaggtgacgccgctctacggcaagttcgccttcctcaacaactcgctcgcgcagttcagcgtggtgctcagtggcggcgcgggcgtcggctccacgcgccacctcatccgccccgcggtgacgaacgatgtggagggcgagtcgttccgggtgcccgcgcgcttcggtgacacgggcaccaagttcatgggctcggtggggggcggcttccggctccagttcggcgagtcgtacgcgctgcgcgtggaggtgcgggacctcatctacaccgcgcgcgtggaccgggtggacggctgcaacctggcggacttcgaggcgctcgaagcggcgcgttccaccaaccaggacttcgcctcgctgaacctgagcggcagctgccgctacgagaagttcgacggcatcgacccgaagacgaagaagaactaccgcgaggacatcatcctgggccgagacctggtggtcgagccgtcctcggacgtcctcaacaacgtgagcttctacgccggcttctctgtcctcttctga

SEQ ID NO: 9047 - DNA, 888 bp, Myxococcus xanthus
atggctgtcagggtgggcatcatcgggagccccgggttggcccaggcactgggcatccccggcaagggcgagtcccacatcttggagacgcccttcggtcctcacgcgggccccatcgtcaccaccgagctcgacggcgtctccgtcgcctacgtcgcccgccacggcaccggccacgtctacaacgccacccgcgcgccctaccgcgccaacatgtacgcgctgaaggtcctgggcgtcacccacgtcctcgccaccggcaccgtgggcagcctgcgtgagcacatccatccgctccacctcgccctgccggaccaggtcatcgaccgcacctaccgccgtccctgcaccttctacgacgacgtcgccgtccacgtggacctgggcaaccccttctgcggcaccctgcgtcaggtgctggagcacgccagggacccgctggggccgaccgtgcacgccgaggccacctacgtctgcatcgaaggcccgtccctcagcacccgcgcggagagcatgctctaccgcacctggggcggggacctggtgggaatgacgggcatgcccgaggcccggctcgcccgggaggcggagctccactacgcgatggtggccctgcccaccgactacgattcgtggcagccgcgcgcgccggggcaggagcatgacgacctgctggcgcaggtctcccacaaccggaaggccgtcaccgccagcggcgccgcgctcatccgccgcgcgctgcctcgcatcggtgaagcccgcgccatctgccgctgcgacaccgcgctggccctggccatcggcaccgagcgcagccgcatccccgacgaggtgcgcggccgcctccgtccactgctgggcagatacctcccgcccaacgtcgcctga

SEQ ID NO: 9048 - DNA, 849 bp, Myxococcus xanthus
atgcttcgtccgggtgaggacctgcttcaggtggaagagcggctgtggcttttgtccgcgccgaccgggcaaggcacctacgacttcgccttcgaccgcttcttcgcatgccgccgtccgtacgtgctgccggagtccatggaggtggtggccagggtcggcgtctggaacgactacgccgagcgctaccgcgagttggcggaagcgggtatccgcctggtgcacacacccgagcagcacctacaggccacggagctgccgcactggtacccgaagctcacggacctgactccgcgcagcgtctggttcgatgagcggccagacgcggagaccgtggagcgtctgctggggtggcccgtgttcgtgaagggtgagcggcagaccagccggcaccgcaagtcgctctccatcatcgaagggcccgagcagttccgccaagcgatggctgcctacgcaaaggaccccatcctccactggcagcgagtggtgtgccgggagttgaggcccttgcgccgggtcgaggagggcgcgccggaccgcatccccagctccttcgagttccgcaccttctggtggaagggccaactggtggggtgggggccctactggtggcagggcacgccgtacaccctgacgccggaagcgcagcgcgaggcgctcgggctcgggcgtgaggtggcacgtcggctggacgtgcccttcctcgtggtggacgtggcccaggaggtatcgggccggtggattgtcattgagtgcaacgacggccaggagagcggctacgcggggatttgtccgttcgcgctctggcgggccatcctggatgtcgagcgcggaaccggagcggcctag

SEQ ID NO: 9049 - DNA, 645 bp, Myxococcus xanthus
gacttgttcgacggcctgggtggcacaggccctcgcgaggaatcgctgggccccggtgccgtggtgcttcggggcttcgcgctgtcccacgacgcggagttgctgagcgcggtccaggacgtcgcgctcgcttcgcccttccgccacatggagacgccgggcggcttccgcatgtcggtggcgatgacgagctgcggttcgtggggctgggtgacggaccggacggggtatcgctatgccgcggtggaccccgtgcagggacggccctggccggagatgccggcgatcttcctgcggctggcgcagttcgccgccgcgaaggccggcttcgaagggttcatccctgatgcgtgcctggtgaatcgctacgagcccggggcgaagatgtcgctgcaccaggacaaggacgagcgtgatttcaccgcccccatcgtctccgtctcactggggctcccggcggtcttcctcttcggtggcgctgagcgagcggacaggccggcgcgagtacggttgagccatggcgacgtggtcgtctggggcgggccagcccgcctgcgctaccacggcgtcacgccgctcgagccgggccaccatccgcaggtgggtgggcatcgcatcaacctgacgttccggaaggcgcgatga

SEQ ID NO: 9050 - DNA, 570 bp, Myxococcus xanthus
gccgtgttccgcagccgcgtggtgatggcgcggcacggcttcggaagaggtgagtacaagtacttcgagtacccgctgccggacgtggtcgccgggctgcgcggggcgctgtacccccggctcgcgccgattgcgaaccgctggaacacggccatgggcatcgaggtgcggtacccggagtcgcatgcggcgtacctcgaacgctgccacgcggcggggcaggtgcggccgacgccgctgctgttgcggtacgaggcggacgactacaactgtctgcaccaggacctctatggggagcacgtcttcccgctccaggtggcgattctgctgtcggagcccgggcgggacttcacgggaggcgagttcatcctcaccgagcagcgtccgcgcatgcagtcacgggcggaggtcgtcccgctgcgccagggagacgcggtggtgttcgccgtccaccaccgcccggtgcagggcacgcgaggcgtgtaccgcgtcaacctccggcacggcgtcagccgcatccgttcaggacagcgccacacagtaggcgtcatcttccatgatgcggcttga

SEQ ID NO: 9051 - DNA, 909 bp, Myxococcus xanthus
ctcatgctccaggtcctcatcagcgcgggaacgtacctggcgggcaaacgcgcgatgtcggagctggcgccgctcacggtggtgctgtggcgtttcgtgttgagtggctcggtgttcatgttgttactgtgtttcctgcccgggccccggcttccgccgcgcaacgagtgggggcgggtgctgatgctgggcctgctggcggggccggtgaaccaggtgttcttcttctatggcctgtcccagtcgacggcggcgcacgcggcgctgctctacgcgctgacgccgctgggcgtgtacctgctcagcctggggcgggggcatgagcgggcctcgttccgggcgatgggcggcatcgtcacggcgttcgcgggcgtggtggtgttgctgttggggcgcgggctggcggacgcgagcggctcgttgatgggagacctgctcatcctgggcgcggtgatgtcgtgggtggtgtacacgacggagggcaagccgttcgtcgccatccacggaccgattcgcgcgacgtcgtggagcatggtggcctccacgttgatgatgatgctgatggcgccgttcttcgcgaagccggaggcggtgctcgcggccagctccgcggctcggtactccatcgtctacctgggtctgctcacgtcggtggtggcgtacctgctctggtacttcgcgttgtcgagggtgccggcgtcgaaggtggccgtgttctccaacctccagcccgcggcgaccgcgctggccgcctgggtcatcctggatgaggcgctgcactgggagattgcggtgggcggcgtgctcgtgctcctcggcgtgcgactgacgcaggcggcgcacgtccggccgcccgccgtggcgccggccgcgccagagcggcctcccgtctcatcgagcgtcggatag

SEQ ID NO: 9052 - DNA, 882 bp, Myxococcus xanthus
gactgcatgggcgagcgggccgccgagcggctggacgtctcgctcctgctgccgggcgcgaagacggtcatctccttcgcgaacaactactggcgcgacgacgcggagacggtggactcccccatcgcgcgctatgcccggggacgcgactaccactccacgctgcgcgaccggatgaaggcgttccgcaaggcgctcaacgtgatgtacccggggctgggcagctacggcggcgtggacagtggcccgctgatggagaaggtgtgggcggcgcgcgcggggctcggctacgtggggaagaacggctgcttcatcaccgagccctatggttcgtgggtgctgctggccacgctcgtggtggatgccgaggtcgacgactacggcaacggcccggcggcggaccggtgcggcgcgtgccgccgctgcctcatgtcctgtcccacgggggcgctggtgggcaacggccgcgtggatgcgcgcgcatgcctgtcctaccagaccatcgagaaccgtgagcagcaggtgccggaggcgttccggttcaagttcgacaacctgattttcggctgcgacatctgccagcaggtgtgtccgctgaaccgccggccggtgttcgcggagcacccacgcttcgcgccccgagcggtggcggaattgggtgtgcgcgagctcgcgggactcacagtggaacagtatgagcacctaatacctggcaccgcgctggcgcgcgcacggtacgacgggctgcgccgcaacgccgtgtatgcgttgggtgtggcgaagcaggcggatgcgaaatcgttgctcgaaaagctctgcggcgattcgagtgaattggtacgtaccgccgcgcaatgggcgctccttcagctcgacccctga

SEQ ID NO: 9053 - DNA, 342 bp, Myxococcus xanthus
atgtacgaggccttgggtggcatccttccgtggaacgccagctcgctggaccgcgcccggcaggacgcccgcgtgcgagaccggctggtgcaggcgctggagcgccgtgagctggtggccctgcgcgtgcagcgccgcgccgccgcctgggcgtggccggaaccggccctgccgcccccccggcccgagcccgaggtcatccccctggcgcgcccccccgtggaggtcttcaccctcttccccgacccggcacggcaggccgaagccctgcgccaggccgcggcggcgggtgtgccgttctgcgaggagtgtgaaaagcagaagcaacgggccgcggcgtga

SEQ ID NO: 9054 - DNA, 528 bp, Myxococcus xanthus
atgcgtcaggccacggaggaagcgcccacctcggcgctctacgccatcctggacggggcgcgggcccccaacatccaccggctggtgctcacctgcggcctgacgcagagctgcctctatgcggggaagctgccaccggagctggtggaggtggcgccctacctggtgcaactgcggcccggagcgcccgccacggagcaactgctcgccgcgggctggggcaagagctggggcatcttcgtgcagagcccggcccacccggacgcgctgcggcggcacctgcggcgcttcctcaaggtcaaggacgccaacggcaagccgctggtgttccgctactacgacccgcgcgtgctgcgcgtctacctgcccacatgcacggacgatgagttggacttcctcttcggccccatcgagcagttcttcgccgagtccgaggacggcggcagcatgctcgcctacgcgcgccgtcccgaggaggcgcccctggacgcgccgccgctgaccgtcctcccgacgccgctcatgtag

SEQ ID NO: 9055 - DNA, 1393 bp, Myxococcus xanthus
cccctgctcacctcgctgggccgaaacctgagccaggccgcccacgagggccgcctggacccggtggtgggccgcgcgcgcgaggtcgaggaggtcatcgacatcctgggcaagcggcgcaccaacaacccctgcctgctgggcgagcctggcgtgggcaagacggcggtggtggagggcgtggcgcagcgcctgctcgagctgcgtgggtcgctgtcggagaaggtgctggtggagctggacatggccacgctggtggccggcacgcagctgcgcggctcgttctccgagaagctcaacacgctgacggaagaggtccgccgctccaacggccgcgtggtggtcttgatcgacaaagtccacacgctgctgggcgcggtctccacgggtgacagcccgaactactccgccaaccagatgaacacggccatggcccgcggtgagttcccctgcctatgcgccaccacacacgacgagtaccggaagttgatgaccaccgacccggccctggagcgctgattcacccccgcggtggtgaacgaaccctgcgtaccggagacggcggagatcctccgcggcatcatcggccgctacgaggagcaccacgggctgcgctacacgcccgaggcgctggaggccgcgacgtccctggccagccgctacgtgacggaccgcttcatgccggacaaggccatctccgtggtggacctggcgggcagccgctgccaccgcgagggccgcgacgtggtggagcccgccgacgtggcgcgcgtggtggccaagctcgcgggcgtccccgaggagcgcctgctgatgaacgactcgtcgcgtctgctccggctggagcaggacctggcggagcgcgtcatcgggcactcggaggcagtcacgcgcatcgcccgggtcatccgccgcaactacgcgggcttcgcgtcgcgccgccccatgggcagcttcctcttcctgggccccacgggcgtgggcaagacggagatggcccgcgcgctggcggacgtgctgttcggcagccgcgactcgctggtgcgcctggacatgagcgagatgtccgaacagcacggcgtctcgcgcctcatcggctcgcccgccggctacgtgggcttcggtgagggcggacagctcacggagcccgtgcgccgccggccctcgtcggtggtggtgctggacgaaatcgagaaggcgcaccgcgaggtgcagatgctcctcctccaggtcctggaggaaggccgcctgacggacggcaaggggcgccacatcgacttctccaacaccgtcatcgtcatgacgacgaacctgggtgcggaggccttctcccgcaccggccgcccggtgggcttcggcgcggactctgcgggccccggggtcgccatggaca

SEQ ID NO: 9056 - DNA, 1539 bp, Myxococcus xanthus
atgaaacgactgctcagcctcttcgtcgccctggcgccgctcgcggtgtccgcccagcctgattcgggtggctacaaccgcgcgctggccgccttcaacgccggtgacatggacaccgccgcacccctcttcttcgaactcgcggagagcgcctccgacgcggaggtgaagggcaaggcggagtacttcctcggacagtccttggcccagaagggcctgcccgtggccgccttcatcacctatgcggccatcgtcaatgccggaccctcgcacccctcgtatctcaaggcggtggagggactggtggacatgcagcagcaactggatgagcacaacctcatccccagcatcctcaaccaggcctacaccgacgaggtgcgcgaccgctgggtgacgctgcccaaggaggtgctcgcgcgcatcaactacctggtgggcacggtgagccagcgcaagagccgcttcgaggaagcgcgctcgctgctggaggcggtcccccaggacagtcgcgtgtacgcgaagtcccgctacctgctcggcgtggtgctggcggacccgcgcttcccgggccgtcccagcgaggcctccgtgttggacaaggacgcgctggccgccttcaacgcggtactggccgcgaaggaggggcagttggacttgcgcgccacgcagcacctggcgctcatcgccctgggccggctccactaccgccgcggtgagtacaccgacgccagcgccgcttatgagcgagtgccgcgctactcgcgctactgggaccaggccctcttcgagaacggcttcgcgcgctttcagaacgaggacttcggcggggcgctcggcagcctccaggcgctgcatgcgccgcagttcgccggggccttccagcccgagtcgtggattctcaaggcgaccgtctattactactcgtgcctctacgacgaggtgaagacgacgctggcggccttcgacgaaatctacgctcccatggagcggcaactggagcccttcaccggggaggacgtgccgctggtgcagtccttcaacctggtcgcggcggagaaccgccggttgccgcgcccggtatacctgtggcttcgcaacaacgagcgcatccgcgaggtgatgcggatgctggagcgcgtggacgatgagaagcgtgcgctgacgaacggacgctggcgcggtacgccgctggcggcgcagtccaccgcgtcgctcgaggaggttcgcgggacgctgctgcaggtgggcggaacgctggcgcagagccgcattcgtgaggcagcggacaacctgcggaccttctccgaccaggcggaaatcatccgcgtgcagacggccttggatgagaaggacttgttgcaggccggcgttgaccagaaggcgctgctgacgcggcagtcgctgtatcgcccgaagatgccgagcgcggcctggaactactggaagttccagggcgagttctggatcgacgagattggttattaccaatacacgctgaaacgtggctgcccggcgaagaccgctgaacagcagccgtag

SEQ ID NO: 9057 - DNA, 1776 bp, Myxococcus xanthus
atgaagcagtcctccaagaagtttccaggcgtgttgcgcacctggtctggcgtcgtcgccgcatccctgctcgcagggtgtggtggctccgaatccctctcatcggaggagccggcggccgcggcgcaggagcaggcgcagacgggcgccgcgcccatcctcgattcgatggatgccatcgcgctcgacggcgagctgacgtcgaagacgcgcagcctcatccgcgcgaagctcgcgcaggggcaggtgcatcagcaggttccggtggtgtcggactcggggcaggcgctcgtgctgaacgaccagggcctcgatggtgacgagcaggccggtgacggcgtgttctccgccattggcgacgtggacttcgtcacccaccgcgccacgcaggaccgcattcgcgagttccaggaacgcaatccccagacgccgctgacggtcgcgaccttcgacaaccgcgtccgtgtctccgagcgcgtcctcacgccggtgtcgcccgacgtcttccggccgggtgtccccatccccatcttccccgcgggcatctcccacgcggtgaagccggagaactcgctcatcatcacccaccccaacgtggtcaatgacccgacgcgcacgtatgacccgtgcacgaacgccggcaacccgaatggtgtgtggacgttcaaccacctgatgcgggagatggcgagctcgtacgtgtcgccagcaaacctgacggagcactggctgcgtcagtggaccgtgaaccagaacatcaacggctggacggtgccggcgcgcccggcgatgaccgcgcgaatcctcacgccgtggccgcgctcgagcggcgcgctggagctggcgcggtcgccgttcaagctggtggccatcgtcaaccgcctggacctgggcgccagcgcggggccgtccgcctacgcttctggtaacgcgggcgagctgcgcttcgtcttcgccgcggtggatcgttcgagcgggacctgtggcgtgcggcccttcctggtcatcttcgagtacggtgtcccgcacgccagctgtgacgcggtccgcacctgggcgcaggggtggctgaacctgtcggcgccgtccatgattctgggcagctccgcgtacaatgcggcgctgacgagcctcacgcagcaggtggtggtgcgcaacgccgcgccccgcaagccgaacggcagcgccatcaaccagatccgcaccaacgaggagtggctgcgctacccgtgggagctgcgtgagtttcacctgatgggctcgggtccctcggtgaaccgcctgcagggccagccgacggtgctgacgccgggtgattcgcacaacaacacgacggtgctgcgtgacttcatcaacgcgaacacgcccgccatcctggccaacagctacaccgtgccgccgacgtaccccacgtcgagcacgccgttcctcggcgcgttcccgtggatttcgtcgccgacggactcgtactggcgtgcgtcgggcatctccgtcaacgacgcccgtcacgtcttctcgcgcaacacctgcaacggctgccacggccgcgaagcgcgcactgagttcacgcacatcgacgagtacggcgcgctttcgccgttcctcgccacgggcatggccagtccttccacggccttctgggtgcaggaccccgtcgtgacgtcgctgagccgtccgttctacgaaatccagatgcgcaacacgaacctggacagcgtggcgaaccaggcctgcctggcgcgcgcgttcgaccggcctaagctctccgcgcactga

SEQ ID NO: 9058 - DNA, 993 bp, Myxococcus xanthus
atggcgcctcgcattggaacgctctgggactccgtcggaaacaccccgctgctgcgcatcggctcgctgagccggcagacggggtgtgaaatcctcgcgaaggccgagttcatgaaccccggcggcagcatcaaggaccgcgccgcgaaggggatgattcagtgcgccgaggcgcagggcctgctgaagccgggcggcgccatcttcgagggcaccgcgggcaacaccggcatcggcctggggctcttgggccgcgagcgcgggtaccgcgtggtcgtcaccatgccggacaaccaggcccgcgagaagtacgagctactggaggccatgggcgtggaggtccgaaaggtccccgcggtgcccttcgccaatccgaaccacttcttccaccaggcccgcgtgctggcggaagcgcagggcggcttctgggcgaaccagttcgagaacccggccaacggcgactaccactacgagacgacgggccctgaaatctgggagcagtgcgagggccgcgtggacgtgctggtggcgtccgtgggcagcggtgggacgatgggcggcgtcagccgttacctgaaggagaagaaccccgccgtgcgcgtggtggtggtggacccgccgtgctcgggcctcttcacctacgtgcgctaagggcgcatggaagggcccggatcttccatcaccgagggcattggcatcatgcgcctcacggagaacttccgccgggcccaggtggacgaggccatgcgcctgggggaccaggacatggtggagatgctctaccacctggcgcgcgaggacgcgctggtggtgggcacatcggcggccctcaacgtgcgcgccgcgtgggagctggcgcggcgtcatcggggcgaggggctgcgcatcgtcaccttcctgtgcgaccacggcagccgctacgcgtcgaaggtgttcaacccggagttcctcgcgtccaagcagttggaggtgaggccgcttcccgtggattga

SEQ ID NO: 9059 - DNA, 1233 bp, Myxococcus xanthus
atgcgagcgttcctggacaatttgcggttggcgttgggcaccttcctgggcaacccgctgcgctcgctgttgacgctgctgggcatcgtcattggcgtggcgacggtcatcaccatgatggggctcatcgagggcctgcgggtcaaggtgaacaacgacctgggacggatgggggcccacaccttccaggtgacgaagtggcccgcgggcggcttcgggcgcatcaactgggccaagttcgccaagcgcaaggacttcgagatgcccgactcgcgggccatcgaggagtcctgcccgtcggtggggacggtcgtgcccaccgacgacgagggtggccagaagctggccacggcgagctcggagacgcggccgtcggtccgcgtgttcggcacgcccgccaactacccgctggtgagcggggtgtcggtgcaggccgggcgctacttcaacgaagtggaggcgctggacggccgctatgtggcgctgctggggacggacgtgtcggacgcgctgtttccgggcatgaatccggtgggccacgaggtgcgcatcaagggccggcccttccgcgtcatcggcctgctccagaagcgggggagcatgctgggcatgttcagcctggacaaccaggtgatgattccgctgagcgtcttccaccagctctacgggaagaagcgctcgctggacatcagcgtgcaggcgaagtccccggagctgttcagcaaggcgcaggacgaggtggcctcgctgatgcgccggcgccgcgacgttccggcgaacatgcccaacgactttgaattacacacgaacgagtcggtgacggcgtcgttcaatcagctctcccaggtcatcaccatcgcgggcgtgggcgtgtgcctgctgtccctggtggtgggcggcatcggcatcctcaacatcatgctggtgtcggtgatggagcggacgcgggagattggcgtgcgcaaggcgctgggcgcgcgcaagcgccgcatcctgggacagttcgccacggaggcggtgctgctgtcgctgatgggcggcgccctgggcctgggcctgggcttcgggctggtgttcctgggcaactggatgatgggctttcccatgcaggtgcccccgtgggcggtgggcctggccctgttcatgagctgcggcgtggggctcctgttcggcatctacccggcggcccgcgcggcgaagttggatccggtggaggccatgcgggcggattga

SEQ ID NO: 9060 - DNA, 1239 bp, Myxococcus xanthus
atgagccagcggtccgccttccgcgtggatgtgctggagggcgcacgcatcgcggtcttctccctgaaggccaaccgcctgcgcacggtgctgaccaccctgggcattggcatcggcgtggccacgctgctggccatcgtcggcatcatccaggggctcaacacgtccttccacaagcagttggccaccttcggggcgaacacgatgtacgtgtccaagtggccctggatgatcaagggcgactggtggaagtaccgcaaccggaagaacttcaccctggagcagatgcagcggctgcgcacgctggcgcccttcgtgacggccatgtccccggcggtgtctcgcctgtcggacgtggcgcatggcggcgagcagatgtccaccgtgcgcatccagggcgtgacgcacgagtacctcaacatctctggctacgaaatcaccggcgggcgcttcctcaccgaggcggacgacgcgacgacgcggccggtggcggtggtgggcgcggacgtggtggacgggctcttcccgggcgtcagtccggtggggcagtcgattcgcatcgacaaccgcaccttccaggtggtgggcacgctcagccgcaaggggaagatggtgggggagagcatggacctgctcgtcttcatccccttcaagacgttctattcgagcttcggcaagggccgcagtttcgagattgccatggcggtggaggatgcctcgcagatgcggtccgcggaggaccagctcaccggcatcatgcggcgcgtgcgctccacgcctccgggggcggaggacgacttctccatcaaccggccagaggccatggcgcagacatacgagcagctcacgggcgcgttgtacggcgtggccgtgggcgtggggctcatcacgttgctggtgggcggtatcggcatcatgaacatcatgctggtgtcggtgcgcgagcggacgcgggagattggcgtgcggcgtgcgctgggcgcccggaaacggaccatcgtcttccagttcctgatggaagcctcgagcgtgtccgcggtgggaggcctgctggggacgaccgtgggattgggcacggccaaggtggtgtcgctcatcacgccgctcgcggcggacgtgcagccgatgaccgtggtggcgggggtgggcttcgccgcgctggtgggcctgctgttcggcatctggccggcggcgcgcgcggcgaacctggaccccgtggaagcccttcgttacgagtag

SEQ ID NO: 9061 - DNA, 540 bp, Myxococcus xanthus
atgctgaacggcaaggacgtgtcgcgcatgagcgacgacgaactcgccgtcatccgcaacgtggagattggcttcatcttccagaccttccaactgctgcccaaggagacggccctggccaacgtggagctgccgctggtgtaccggggcattggcgcgcgggagcggcgcgagcgggccaaggcggcgctggacaaggtgcagctcacccaccgcatgcaccaccggcccaacgagctgtccggtggacagcgccagcgtgtggccattgcccgcgcgctggtgtccgagccctccatgctgctggccgacgagcccacgggcaacctggactcggcgacgggtgaggagatcgtccgcctgttcgagcagctccacaaggggggccacacgctggtgctcgtcacgcacgagcccaagctggcggcgcgctgcccccgggccatccgcctgagcgacggagagattgtcgcggacggtgacggccgcacggtggccatgggaacggcgacggacgtactgaacgcggggggcgcatga

SEQ ID NO: 9062 - DNA, 1143 bp, Myxococcus xanthus
cctccgccgtcgctcgaagtccagctgtcgaaggcccggaagggctccatcacccgcactatcaccggcgcgggcaaggtgcaggcggccacgacggtgaagatctcgtccagcctctccggtgacctggtggagctggcggtgaaggacggcgaggcggtgacgaagggccaggtgctgggccgcatcgatccgcgcctctaccaggccgcgcacaagcaggccttggcgtcgctgaacgcctcgcgcgccgacgtgcaggtggcggaggtggaggtgggccgcgcgcagttggagctcgcgcgtgcggaggacctggcgaagaagggcctttcgtccgccgccgaggtggacacggcgcgggccacgaagaacacgggggatgcgcggctggcatcggccaagcagatgctggcccgcaacatggccatcgtggaccaggcgcagacggacctcacgcgcacgacgctggtgtcgcccatcgacggcaacgtcatcgagctgtcgcgtgaagtgggtgagcgtgttcgtggctcggacctgtccgaggacgtggtgatgaccatcgccgcgctcagcgccatggaggtgaagttcgaggtgggcgagcacgaggtggtgcacctcaagccgggccagcccgcggagatcacgctcgacgcactggagggccagacgtactcgggctccgtggtggagattgcccagaaggcgctcatcaagaacgagggcaccgaggccgaggtgacgagcttccccatcaccgtcgcgctggacacccgtccgcccaacgtgctgcccggcatgagctccgaggtgcgcatctccgcggagacgcacaatgacgtggtgctggtgcccatccaggcggtgacggtgcgctcggagcgctcgctgccggactacaaggcgcccatcgaagggggcgggctgacggcgaagcggacggagtcgctggccaaggtcgtgttcgtggtggacagcagcaacaaggcgcaggtgcgccgcgtgcagacgggcatcggctctgacacggagctggagatcgtcttcggactcaatgatggcgaccgggtgattgaaggtccgcaccggacgctgttgaaggagctgaacgacggcgacctcgtgcgtgagccgtag

SEQ ID NO: 9063 - DNA, 1347 bp, Myxococcus xanthus
atgaacgccttcgtgatcgcggtcgccctggccgccgctccctcggactccggtacacccatcaccctggaccaggcccgcgcggagggccggcagaacgtcgcggccatccaggccatgctggatgtggccatcgcggacgaggacgtgaacctgtcccgctcggtgctgctgccgcagctctcgctcgatgcgtcggccggaaagatctggttcggccgcaggcaggagttcaccacggttccggacccggccaacccgggaagcttcatccgcaacgcggtggagacgccctccaccagcacccagaactacgacctgggcttgtcgctcacgcaggtcatctacgaccgcgcccgctggaagcagttggagcagagcggcgtggtgcgtgacgcgcagaagggacaggcgcgggaagaggcggacacctccgagctggaggccatccgccgcttcttcaccctctaccgcacccaggccacgctccaggtgctgaaggccaccgtcgagcggagcgagcagcaggtggagcgagcccaggcgctcttccacgcgggccgcacgggcaagaatgaagagatcaccgccacggtgaacctggggaccgaccgcatcaactacaccgcgatgctcgggcagctggtcaacgaccagtcccagctcgccgtgtggttggcccggccgggcaccgaggtactgacggcccaggacccgggcgtgctcacgaccgagccgccgcccgcgccgtcggtcaacgaggcgctcgcgtcggcccgcgcgtaccggccgctgctcaggacgctggagctgcgcatccgcgccgcggagctgaagcagtccattgcccgctcggagtacctgccgcgcctgatggcccagggcctctacaaccgcggcggtccggacgcctcgctggtgttcaccgagccgcgcctgcagaaccgctttaccgcggccgtcgggttgagctgggacctgttcaccggtctgtccacgggggcgagctcccgtcgcgccgaggcggacatccgcaaggcgcagctgacgctggagcagacggcgcgggaaatcgaaggtgaggttcgcgccgcgcaccgcacgctggaggcccagttggaggccgctcgcctggctgcgcagaacgtcgaggtcgctacccagggcctggagatgcaggaggcgcgcttccgcgctggcgcgggctccaccctggaggtccgcgacgcgcagctgagcctgacgcgcgctgagctcgccttgttggaaaacaggatcgatgtcgaaatcgcccgctattcattgcagcgggccatgggcgccctgagcccgggagagtcgaaatga

SEQ ID NO: 9064 - DNA, 510 bp, Myxococcus xanthus
  unsure (1)..(510): unsure at all n locations
atggggctgtcggaggcggacctcacggacaagatccaaacggagtcgcgaaaggcgctggtcggtggcatcgccaagggcgtcatcctgatgccgctgatggcgctgctcctggcctgcatcctgtgggtggtcagctggctcttcgaccggcccgcgtccttcgagcagttgctgtccgcggccgtgctggcgctactgcccatcgcgctctaccacctcatcctgaccctntgcgtcgcggcgcagcactccattaccatggcgcgggtgatgaacctcgtaccgtcgaacctgggagccgtgttgcaaggcttgagtccgaagatgcagcgcgtggcgtccaccgtggacttcttcaacctctggagcacgggcctgctggggctgggcttttccgccgccaccgggatgagtcgtgggcgtgcggtgctgctggcggtggcgctgtacgccatgtacgcgggcatcttcctcatcggccttcccgcccaggcaggtgcgcaatga

SEQ ID NO: 9065 - DNA, 678 bp, Myxococcus xanthus
tctaaagccgcgcacgagctgcgcacgcccctcaccaatcttaggctgcagctccagttgctgtaccgccagcttcgccgcgaggaggccctggacgtggagaagctcgcgcagcgggtgctgtcctgcgagcgacagacctcgcgcctggcgaccctggtggacagcctgctcgacgtgtcccggctggcgcgcggccgcatggagctgaacctggagcccgtggacctggacgagttggtgcgcgaggccgtccgccgcttcgagacggaagccaggacagcgggggtccaggtgacggtggactcgccggcccccgtgacgggccagtgggaccggatgcggctggagcaggtgctcaccaacctgctgtccaacgcgctcaaatacggccacggagcccccgtggacgtgcgcgtgcgctcggacgaaacacaggcgatggtggaggtggaggaccgcggcatcggccttccgccggaggacgcgcagcgcatcttcggccgcttcgaacgcgccgtctccagccgccactatggcgggctgggcctgggcctcttcatcacccgccagctcgtggaggcactgggaggccacatcagcgtggccagcaccccgggccagggcgccacgttcaccgtcgcgctgcccttgagcggcccacgtgccgaggcttga

SEQ ID NO: 9066 - DNA, 183 bp, Myxococcus xanthus
atgaggaagggcacgcggctgaggctggtgctgcgagacctgggctccgggtccgccttcgcctccatggcggtgtcgggccagctccccatctggtcgctggtcctctacggcgtggcccaggtggccgcgctggcggggtggcgccccttcgccaaccgggtgaagctcacccttagagca

SEQ ID NO: 9067 - DNA, 138 bp, Myxococcus xanthus
atggtgaacggcaacgacgcgcttcgctgcacgctggaccggaccattggctattcggaggcggtggggaagagcgcgacgttcacgcgctcgaccaacacgtcgccgaatgacagacagtgggccgactacaagtga

SEQ ID NO: 9068 - DNA, 480 bp, Myxococcus xanthus
atgacccccgcacccacggaggtgctgctgttcaccctgaacggccagcgctacggactgcccgcacccgacgtgcgcgagttggtacgcgctgcgcgcctgacgccgctccctcgcgcgcccgccgtggtggagggcctgctggaccttcggggggagctgctgccggtgctggacctgcgcctgcgcttccgccacccgccccgcccgctgtcccccatggatcacttcatcgtggcctccgcgggcgaccgctgcgtcgtgctgcgcgtggaccgggccgagggcctgcgcgtcctcacaccggatgagtgggacgccacgccgcgccagcttccgggcgtgggctatgtggcgggcgccgtgaagctgaaggacgggctcgtcctggtccatgacctgcgcaccttcctgtccgaggccgaggccctggagctggatgccgccctggccgcgccgcaggagccggagcccgcgtga

SEQ ID NO: 9069 - DNA, 1680 bp, Myxococcus xanthus
tatgcggcggtgctcgcgctcgtggaagagcgcgccgggctggtgccgcccagttgccccgcgtccgccgaggaaggcatcgcccgcgccatggagcgggccgggctgaaggacttcgacgcctaccgcgtgcggctcgcggaagagccctccgcgctggatgacctgctcatcgagctcaccgtcggggagacgtatttcttccgcacgcccgagcacttcgaacacctgcggagcgtcgtgctcccggagctgcgcgagcgccatggcccggaccacaccgcgcggatgtggagcgccgcgtgttcgtccggcgaggagccctactccatcgccgcgctgctgctgggcgaaggctgggacgagcacatggccgtgcacgccacggacgtgtcgcgcggcgcgctcgcccgggcccggaaggcccactacggcgactggtccctgcgcggcggctgggcggaccggatgcgcgcccacctgcgcgccgagggacgccggtacgtgctgtcacccgaggtgcggaagcgcgtgcgcttcagctacctcaacctcgcgctcgacacctggccgtcggcggacagcggcatctggaagctggacgtcatcttctgccgcaacgtcctcatctatttcaaccggcccaccatcgaagccgtcgcgcgccggctccatgacgcgctggatgagggcggctacctcttcaccggcccgtcggacccgccgctcggtgggctggcgccgctggagtccatcctcaccgaatggggcgtgctgtaccgccggcccctgcccggagccaccctctccctgcccgttccggccgcgtggagcccgtcctccaccggcgtacccggtaccgcgacgggcaccacgtccctgggcaccaccgcgccgggcctgccctccggctccgaatcctccacgcggaccgcgctcccgggcgcatccgctccgagccatccaggcggctccgcagccagaacgacgacacccgcctggagtccccccggcgcgggcgggacctccgcccaggcggaaggaacgcgcgcggcgggccagccccaggccagcgcggggtccgtcctcgggaacacagcgggcaccggtgcccccgcctcgcgaagcggcgccctccccagggccgagacaccgacacacgcccccagcgcggcggccatgcacgcggcccggcaggccctggcgcggggccactggcgcgaggcggcccagcacttgggagcattggactcagacgcggacaccgccgccctcgcggtgcgcgcgctggcgaacctggacgccgccgccgccgtctatgcctgcaccgaagcggccacccggcaccccttggtggcggggctgcgctacctggagtccctgctgctgctgggccaggggcgcgcggcggacgcggagcgcgctgtccggcaggcgctgtacctggagcccacactcgtcgtggcgtggctcatcctcgggcgcgtgctacggaggcacggcgacacgtccggtgccctgaaggcctggcgcgaggcggagcaactgtgcaacgccctgcctccggacgcgcccgtgccccacgcggacggcgagaacgccagcagactggcggaggtggcgcgcggagagcggtcacgcatggaggcagccctggctgccggtgaggagctgagctga

SEQ ID NO: 9070 - DNA, 603 bp, Myxococcus xanthus
atgccggacgtcgactgggaagccacgcgcgcgaggctggcgcggctggccgacctggtgaaggaacagggcaccttgtcgcccgaggaggccacggcgctgctggaggcccgcgcccgggcactctcgcgcgagccccgtccccaggtcgaccccggcaccttgcgcgaggtggtccgcttcaaggccgccggccagcgctatgccctggagtcccgcttcgtgctggaggtggttcgcgcgccggagttggtgacgctgccgggcgcgccccccgcgctgcgcggcctcaccctgatgcatggcgaagtgcttcccgtggtggagctggcgccgctcttcggacgcgcgccttcggacgccgcgggcccggtgctcgtggtgggcgtgggacgggcggagctgggcgtgcgcaccgaggaagtggaggaagtcaccgtgctggcgggcagtgagctgctggcgccgcccacctccctgaacgacgacgccggacacctcgtgtccgcggccgacagggaaggcaccctggtactggagggagaggcgctgctgggtgacagtcgcctcatgttcgatatgtccggcgaaggagcagcatga

SEQ ID NO: 9071 - DNA, 1644 bp, Myxococcus xanthus
atgagcatcgggaaccgcatcgcactcggattcggactgtcgctactgatgttgctcatcgtggcgggtgtgtccttccagggcgccaatcagctcacgacgagcacggcgggcctgctgacagcccatgagaacttccgcatcatccgcgaggtccgcgcgctgctgatggacgccgagtccggccagcgtggcttcatcctcacgggggatgagtcctacctggtgccctaccgggaagcggcggtggcgctccagaatgacctgtcccgcctgcgcgacgccatggcggaccaccccaaccagcgggcgcgcctgaaccggctggagcccatcgtcacccagcgggtgaaccggctggaggaaggcatccgcctgcgccgccaggagggcctggaagctggagcgaagttcatccaggccggccagggccgggaggtcatgctccaggtcaagcagatcatcgacgagatgctggtggcggagcaggagcgctgggacgagcacgccaccgccgcccgggacatggcccagcgcatcctctgggtgctgggcatcggcacgctgctgggcgtggtcatcgtcggcggaggcagctacatcatcacccgcggcatcaccacgccgctgcgcgcgctcatggtgggcgccgaacaactggggcgcgggaagctggagcaccgcatcgacgtgaagggccaggacgagacggcccaactggcgcgcgcgttcaacgacatggcggagaagcgccagcagaacgaggtccagttggagaaggaatccgagcagcgcgagcacacgctccgcaccgtggcggagttcgtcaaccagctcgcaggcgccagcgcggaaatcctctccagcaccaccgagcaggtggccggcgcccaggagcagggcagcgcggtgacggagacggtgagcaccatcgaggaaatcaccaagacgtccgaggaggccgcgggccgcgcccgcgcggtgagcgactccgcccgccacgccgaggacgtgggccgcagcggccgccgcgccgtggaggaggccgtgggcgccatgggcgcggtgcgtgagcaggtggagtccatcgcctcgcgcatcctcgccctggccgagcaggcccaggccattggcgacatcatcaccaccgtcaacgacatctccgagcagacgcacatgctggcgctcaatgcctccatcgaagccagccgcgccggcgagcacggccgcggcttcgcggtggtggcctccgaggtgaaggccctggcggaccagtccaagaaggccaccggccaggtgcgccagattctggggcaaatccagaaggccacccacggcgcggtgatgaccaccgaggaaggcaccaagagcgtggccaccgccacccgcgtggtgtccgaggcgggcgccaacatccagacgctgtcggacctgctggcccaggcctcgctgacggcggcgcagattgccgcctccgccaaccagcaggccaccggcatcggccagattcgtcaggccatgcatgacgtgaatcaggccacgcagcaggccctcatctcatcgcggcagaccgaacgcgccatgcaggacctcaacggcatgggccagaagctcaaggggctgctcggagagtacgggcgctga

SEQ ID NO: 9072 - DNA, 327 bp, Myxococcus xanthus
atggtgggaaaggcggcgcgtgaggcgcgtgcgcgcctggggttgacccaggtggaggtggcggccttggtggacatgcaccccatggtctacagccgagtggagcgcggaaagatggtccccagcgcgggcatgctgcgccgcctcagcatggtcctccgcatctccacggatgaattgctggggctggcccggcccggcaaggacgaacggcgtgagctggagaaggaaccgccgctgctgcgccggctggtgacgctggcgcgtcagctggacgatgtgaacctggaggcgctcgtcacgatggctcgcgcgctgacccgatag

SEQ ID NO: 9073 - DNA, 270 bp, Myxococcus xanthus
ctggccctgcacgccctgggcaagagccacgaggcccgtgccatgctggagcgcgccttggcgcttcgcaccgcccatccgggcccggccgaggacctcgcgagcacccgcttcgccctggcccaaacgctggtgaagcaggacgggccccgcgcccgggggctggccaaccaggccctgcacttctacgcagccgaagagcccacctacgccatggaggccagctccgtgcgcaactggctccaggacctccggcgccggaggcgctga

SEQ ID NO: 9074 - DNA, 1640 bp, Myxococcus xanthus
atgcttcacgtcattcccctgggcggcctgggcgaaatcggcctcaactccatggtcatcgcctgccgtggggagatgctgctcatcgacgccgggctgatgttcccctccgcggggatgcccggcgtggacatcatcattccggacttcagccacctgaagcagaacgccgcgcagctcaagggcgtgctgctcacccatggccacgaagaccacctgggcgccctgccctacctgctcaacgaggtgcccgtccccgtctacggcacgcgcttcacactggccatggcgcgccaccggctggaggagctgggcatcgaggcggacctgcgcgaaatcgagccgcgcgagcccttccccgtgggcacggcgttccgcgtggaggccagccgcgtcacccacaccgtgccggacgcggtgggctacatcctgcgcacgcccgaaggcaccctcatccacaccggcgacttcaagctggacccggaccccatcgacgggctgcgcacggacctggagcgctggggcgaggccggcgaggaaggcgtgctgtgcctcctctccgactccaccaactccgaggtgacggaggagacaggcagcgagcgcgtggtggagcagaccttcgagcgcctcttccagggcgccaccggccgcatcatcgtcgccctcttctcctccaacctccaccgggtgcggcacctgctggcgctggcggagcggctgggacgcaaggtggccctgcagggccgcagcatgctgcgcaacgtggagatggcgcgggagatgggctacctggacgtgcccgactcgctcttcgtccacctggactcggtgccggcgctgcccgcgcagcgggtgctggtgctgaccaccggcgcccagggcgagccccgggccgggctgtcccagctcgcgtcgggggacggccccgtgcggctgaatcccggcgacctggtggtgctcagctcgcgggccatccccggcaacgagcgctccgtgggcgcgctcatcgacgcgctccagtggcgcggggcgaaagtcgcctacgcccaggtggagccgggcatccacgtctccggccacgccagccagccccagcagcggcgcgtgctggacctggtgcgcccggcccacttcatccccgtccacggcgagggccgccatctgcacaagcacctgctcaccgcgcgcgaggccgggctggagcccgcccagtgcctgctggcacaggacggcgacgtcgtcaccttcgagaaggccgggggcgcttcaccggcagcgtcccgtccggacgcatcctcaaggaccggttcggccccggcctggtgacgccggacacgctccaggagcgcgtccggctgtcggagacgggcatggtggccgcggtggtggtcctccagcggggctcccagcaactggtggcggggccacagctgtccggccaggggctgtccgtggacgaacaggtcctgctcccccgggtggcccaggacgcgcgagtgctcttcgaggaactgtcccccatcctgcggggcgatgacgccctggtgagagaggaactcacccgggccgtgcgccgggcattcaaggcgcacacgtccaagcgtgccctggtggtgcccttggtcgtccgggtgtag

SEQ ID NO: 9075 - DNA, 498 bp, Myxococcus xanthus
atgccatccttcgacgtcgtctcgaaaatcgacctcgctgagctcgacaacgcggtcaaccagaccaagaaggagctcagcacgcggtacgacttccagggcacccatgccgacgtggtgttggccccggacaataccgccatcaccgtgaaggccaacagcgaagaccgcgtccaggccgccaaggaagtcctcctgacgaagctggccaagcggaacatcagcctgttcgccttggagtacggcgacatcgagaagacgggccttcacaacgtgaagcaggtcatcaagctccagcagggcatcccggtggagaagtccaaggagctggtgaagctgctgaaggactcgaagatgaaggtccagggctccatccaggccgaccagcttcgcgtcacgggcaagaaccgggacgacctccaggcggccatcgccctgttccgcaaggagcaggaccggctgaagctggacatgcagttcatcaacttccgcgattga

SEQ ID NO: 9076 - DNA, 291 bp, Myxococcus xanthus
atgaagagcgcctccgccgggaagctgctgcgcgtggagcgcgagcacgaggagcggcgcaccttcgtgctttcggtggcggacggactcgacgcggaggcgctcgagcgccgctgcgaggaagtggccgccctggcccaccggctcatcgaggaaggtcacgaggtgggcctggacacgccggaggaccgcatccggcccgccgcgggcgcggcccaggagcggcgcctgctgcgggcgctggcgtggctgggacacgagcgccctcgcggtggcgaggaggcggcatga

SEQ ID NO: 9077 - DNA, 1104 bp, Myxococcus xanthus
atgcgcgctgccgccctgtccttctgcctcctgttctgcgccccgggcgttgcgtctgcccaggcggaccgtccttccaagccggttccctccctcgccaagcccccgcgcatccagggtgggctcaaggccttcgcgtcgccgatggtgctcaagcccgtcgccgtggagggcgccaccgcctcgttcaccgccaaggtgggcgcgcgcaaggacacgctctacgtcggcgtggaagccaccgacgaccagctccaggccggcgatctgctcaccctgtccctctacttcccgggcaccggtcccaccgccgccggctacacgtggcgcttcgccttcgatggcaagcgtgcgtccggggcggagagcggcacgccgcagttcgcgcaggacctggtgacggccgccgtgcagcgccagggcaacacgctgctgctgatggcgtcggtgccggtgcgcgccttcccccgctttcccgccgtggacccgctggtgatggacctgtgcctcacctacgaggaccgggacagtgcggacggcaaggccacgtccatctccaactgccagagcggcaccatggtgggtgacgcgctgcgcctgccggacgagcctcgaaagggcctcaagctgaagctgccggagaacgtcacctcgctcgagcccaaggaggacgggctgctgggctgggactacatgagctacccggcctgggcccaggcggatgacgagctggcccctgcctcgctgcgccgcctggtggcgccggacgccgtcgttccctcgtccgtggacctgaacgtgccggatacgctcaccctggaggacggcggtcgcgtcgtcacggtggtgaccgggaagaatccgtatgccgtcgccggtcaatgtgacgccgatgacgagctgcggttgggcctctacctggtgaccgggaagacagcgcaacgggtgctcgagtggccggccgctacctgcgcgctggggcgcacgtcgtcggtggaactggaagaagagggcgtgctgtccatccgttactcgaacggcacgtccatgaacttcgcctggagtgggacccacttctcgcgaaccgaactcggaaagcggtag

SEQ ID NO: 9078 - DNA, 1401 bp, Myxococcus xanthus
atgatgaccctcggctgcccgaagaaccgggtggactccgaggtgatgctgggcacgctgcgccaccgcggctacacgctggtgcaggaggcgtccgacgcccaggtcatcgtcgtcaacacgtgcgccttcatcggtcccgccaagcaggagtcggtggactccatcctggagatggccgagctgaagaagtccggcgcctgcaagacgctggtggtgacgggctgcttgtcccagcgctacggcgaggagctgtcgaaagagatgccggaggtcgaccacttcctgggcaccagcgcctacgcccagattggtgacctgctggccgccgaggcctcgccgcgtcaggtgattccggacccggactacatccacgacgccaatacgccgcgcatcaactcgatgccgaagtacacggcgtacctcaagatttccgagggctgcgacaacgcctgtgccttctgcatcatccccaccctgcgcggcgggcagcgctcgcggcccatcgacgacatcgtcgccgaggcgaagcagttggcggacagcggcgtgcaggagctgaacctcgtcgcgcaggatttgacggcctacgggcatgacctgccgggccggccgaagctgcatgatttgctcaaggcgctggtgcaggtggacgtgaagtggattcgcctccactacgcctacccgcgcatcttcccggacgagctcatcgaggtgatggcctcggagccgaagattgcccgctacctggacatgcccgtgcagcacgtcagcgacaagctgctgctgtccatgaagcgcggccgcaactcggagttcctcaagggcctgctgaccaagctgcgggagcgcgtgcccggcctggtgatgcgcacctcgctcatcgtcggcctgccgggtgagacggaagaggacttcgagatgctgaaggagttcgtgaagacgcagcgcttcgagcgcctgggcgtcttccagtactccgacgaagagggcaccgccgcctacgacctgccggacaaggtgccgcagaagctcatcgagcgccgctggcgcgaggtcatggccatccagaagcgcatcaaccgcgagcagaacaagaagctcgtgggcaagcgcctggaggtgctcgtggaaggccccgcgccggagacggagcacctgctggtgggccgccaccagggccaggcgccggacatcgacggcatggtctacatcaacgacggcctagcgtacccgggggagattgtcaccgtggaggtgacggaagcccacgactacgacctggtcgcccgcgtggtggagcgcccggacccgaagcagcgcgagcacaccgcgcgcgacgcgcacccggcgccgctgccggtggcggcgatgcagcgtccggcccctcgcgcggagtag

SEQ ID NO: 9079 - DNA, 966 bp, Myxococcus xanthus
atgcgcccgtctcccaccgagttcgaccgtcagtacaccgaacagcgccgctccatcgagttggcccgccgctacctggaaaaggagggcgtctcgcggatgtacgacgccctctccaaggaagtggagcgcggccggttgtccgtgcaggacgcaagtggcgccatccgcttcggattgctggccgtcatcgaacgcgtcgcggagcgcgtgggccacacgcactacgtcgacatgttgaaggacgaggagatgctgaatgcgcttcgctccacgctggacgacatctgccggcgcaagggcgtggacaccttcgagttccgccagcagtgggctcacaccaacctccaggccgtgctgcgtgactggcacctggtggtgcacgaggaacgaggccggcagcgctacgaggtggcggcggacctggcccggcgcctggtgaaggagacgccggggacggtgctggcgcagacgctgaagctgcccgcggacgcgttcgtgctgctggtgtcgcccgaggcggggctcgtgggcctcggcccggacggcacgcccgcgcccatcaccgaaatctacgcggtggagtcgcccgcgcctgagggcaaggcgtggttcctgtggctcaacatgcgggacgcggggaaccgcgcggcccgggcgctcatcaacgtctacctgcaggacgggaagacgctggatgacgctatcgccttcactcgggagcagggcggccctcagcaggacgcgggctgggaggactgctgccggttgctcgcgggggttgcgcggcacatggccgaaagtgggcccgtgcgcgaggtctggtacgacgccacggcgcgcgagctccacgagaaactggcggcgacgccgaagtcggcgaaggcggaccgggagaagctgcgcgagcgcctgcgcgccgtcagcccgggacgcaccctggtgctggaggagccctcgcgctga

SEQ ID NO: 9080 - DNA, 846 bp, Myxococcus xanthus
atgacgcagggcggagcggagctcacggggcccttcgtccttggctcgcgcgagcccttctcgcgggtgtccgtgcggctcgccgaggcacaggggcttcagccgctcgaaacggcggccaacctgccgccgcgaaccttcgtgctggacgcagtggaggtggccgagggactgggtgtccacccgctggtggtggaggccgctgggcgttgggattcgccgagcagcctgggccgcctggggccggatgtctggggccgcttcactgcgacgctggacgcaaagggcggggtcctggtgctgcggcgcccccgcgtccggccgtcagaaggctccgccaccagccattgcgccgcgcccgatggctccttccgtgaggaggcttgctacggcctgcatgtgcggcgcgagccggatggcagcgtctcgatcagcggcgccgtgtaccgggacctgccagaaggagggcggcttcacctggagccgctggggccggacgggcagaagctggtgagcggctgtggcgtggggctgagcttcccctccaccagcaggggcctgacgacgcagcaccgcgtgccctggcgctccctggcgcaggcgctgcctgcctgccatgcggcgctgtccaccgcgcgagacttcacgctgagcctgttcgaggaaggccgccagcccgagtgccccacggcctgtgccttcgtcacggagaccgcctctcgccgcaccgtgtgtgagtgccagcccacgccgctgggtgagggcgtggccatgccggcgcgaggcgcttcctcgcgtgagcccccgccaggggagcgggagttggagccggaagacccccgttag

SEQ ID NO: 9081 - DNA, 534 bp, Myxococcus xanthus
cgcgcgggcttccgccaggactacaagtacaagaccttccggcgcacgcagacgtccgaaggcaccgtcacgtacaagaagcccggcctgatgcgttgggagtacctgaagccctcgccgcgcaccttcgtgctggcgggcaacaaggtgtacgcgtacgacccggcggcccagagcctcaccgtggccaacgtggacaccagccagctctccgcgtcggtgacgttcctcttcggccagggaaagctcgcggacgagttcaacatcaccaagggcgcctgcaaggactgcaagggcacgctgctggtgttggatccgctgaagaacgagccgcgcttccgccaggtgcgcctggaggtggatccatccacggcccaggtgctcaagagcacggtggtggacccggacggcagcgagaacaccatctccttcctcaacctgaagacgaacgtgggcctcgacgcggacagcttcaagctggatgtgccggacgacactcgcgtggatgacttcacgaaggcgaagaagcagtaa

SEQ ID NO: 9082 - DNA, 1098 bp, Myxococcus xanthus
atgtccggtcgactcggtgaactgctggttcgcgagaacctcatctccgtgcagcagctgcgcaaggcccaggaagagcagcagaagaacggcacgcgcatcggcaccgcgctcgtcaagacgggcgccatcgaggagtcgaagctgaccgacttcctctccaagcaatatggcgtgccggccatcaacctgaaggacttcgacgtcgagccggacatcatcaaactggtgccgaaggaagtggcggagaagcacctggtggtgcccgtcaaccgcgcgggcccgtcgctcatcgtggccatgtgcgacccgtccaacatcttcgcggtggacgacctgaagttcctcaccggctacaacatcgagacggtggtcgcctccgaggtctccatccgcgaggccatcgagcgctattacgcggagaagggcccgtcgctggaggacatcgtcggcgacgtcggtgacgacatcgaggtcaccaaggaagagacggagaacatcgatgagatggccaaggccgcggacgacgcgcccgtggtcaagctggtgaacctcatcctcatggacgccatcaagaagcgcgcgtccgatatccacgtcgagccctacgagaaggacttccgcgtccgcttccgcatcgacggtgtgatgtacgaggtgatgcgcccgccgatgaagctgcgcaacgcgatcacctcgcgtttgaagatcatggcctcgctggacatctccgagcggcgcctgccgcaggacggccgcatcaagatcaagatgggcggcggcaaggagatggacttccgcgtgagcgtgtgccccacgctcttcggcgagaaggtcgtgatgcgtctgctcgacaagagcaacctccagctcgacatgacgaagctgggcttcgacgcgcagccgctggcctggttcaaggaggccatcgaccggccctacggcatggtgctggtgacgggccccacgggctcgggcaagacgacgacgctgtactcggcgctctccagcctcaaacggcctggacaccaacatctgcaccgcggaggacccggtcgagttcaacttcgccggcatcaatcaggtgcagatgcatga

SEQ ID NO: 9083 - DNA, 540 bp, Myxococcus xanthus
atgattggtgagatccgcgacttcgagacggcggaaatcggcgtgaaggcggcgctcacgggccacctggtgctctccacgctgcacaccaacgacgccccgggcacggtgagccgtctgctcaacatgggcatcgagccgttcctcgtgacggcttcgctgaacctcatcctcgcccagcgtctggcgcgtcgtctgtgcccggcctgcaagaagccggcggagaacgtggacgagcaggcgctcatcgacgccggtgttccgccggacaagattggcaccttcacgatgtacgagaaggtcggctgccgcgactgcaacgaccgtggctaccgcggccgcgtggccatctacgaggtcatgcccttctgggacggcctcaaggagctggtcatcaacggcgcctccgccgcggagctgaagcaggaggccatccgcctgggcatgagcagcctgcgcatgagcggtcttcgcaagatgatggacggcgccaccacgttggaagaggtggtgggaaacaccgccccggaccgcttctag

SEQ ID NO: 9084 - DNA, 690 bp, Myxococcus xanthus
atgatcgacaagatcaacaccgagcgtcatgagcacatcatgaccatcgaggaccccatcgagtacctgcacccgcacaagaactgcctcgtgaatcagcgcgaggtgggggcggacacgcggaacttcaagacggccctcaagtacatcctccgccaggacccggacgtggtgctcgtcggtgagctccgtgacctggagacgattgaagcggcgctcaccatcgcggagacgggccacatctgctacgcgacgctacacaccaatagcgcggtgcagaccatcaaccgcgtgttggacgtgttcccgccgtaccagcagccgcaggtccgcgcgcagatgtccttcgtgctggaaggcgtgatgagccaggcgctggtggcgaaggcgggcggccccggacgcatcctggcgctggaggtgatggtgcccaaccccgcaatccggaacctgatccgcgaggacaaggtccaccatatctactcgtccatgcaggtcggccaggcgaagttcggcatgcagaccttcaaccaggccctggcggcgctgctgctgcggcggctcatcacccaggacgaggccttcggacgctctaacgacgcggaggagttgcgcaacatcctggccacgggcggcggcggggccttgcccggaatgcagcggccaggcgggggagcgggtggtcgatag

SEQ ID NO: 9085 - DNA, 1209 bp, Myxococcus xanthus
  unsure (1)..(1209): unsure at all n locations
accgcccagttcctctgggaggcgaagaccaagagcggggagtcgaaaaagggtgagatggaggcgatggacgtcgaggccgtcaacgcgcgcctcaagtccctcgggctgaaccccgtcaaggtgcgcaagaagagcatgctggacggggacatcacgatccccggcttcagcggtgtcgaaggcaaggacatnctcgtcttcacccgtcagttcgccacgatgatcgacgccggactgccgctggtgcagtgcctagatatcctcgcgagccagatggacaacccttccttcaagaaggtgctgttcgccatcaagagcaaggtggagcagggcagcaccttcgcggacgcgctgaaggagcaccccaaggtcttcgacgagctctacgtccagctctgcgccgcgggtgaggtgggcggtatcctcgacgccatcctcaaccggctcgcggcgtaccgggagaagaacgagaagctcaagtcgaaggtcaagagcgcgatgacctacccgatcatcgagatcctggtggccatcggcgtgacggcggtgctgctgctgaaggtgacacccgtcttcgagaagatgttcgcggacttcggctcggagctgccggggccgacgcagatgatcgtgaacttctcgcacatggcgcaggagtacttcttccatgtggctggctcgattgtcgccgtggtgatgtccttcacgtggagctaccgccagccgcgtggccggaagttctgggacaaggtgttcctcttcatgcccgtcttcggccccgtgctccgcaaggtggccgtggcccggttcacccgcacgctggggaccatgatttcctcgggcgtgcccatcctggacgcgctggacgttaccgcgaagacggccggtaaccgcacggtggaagacgccatcatctacgtccgcgggaagatcgccgagggcaagaacatcgcggggcctctggccgagacgaaagtattcccgtcgatggtggtccagatgatcggcgtcggtgaggcgacaggcgccatggacaccatgctcaacaagatcgccgacttctacgacgacgaggtggacgcggccatcaacagcctcacggcgatgattgagccggtcctcatggtgttcctcggcggcgtggtcggtggcttcctcatcggcatgtatctgccgatcttctcgcttgccggcgccatccagtag

SEQ ID NO: 9086 - DNA, 1578 bp, Myxococcus xanthus
gtgcgcccgtcggagaggggcgcctttcgttcgcggctcgtgtggttggtgttgttccgcacggtcgccgcgagcctctcgctcgtcatcaccctggcgcggcttctccttcatccttcccaggagctgaatcacgcggacaccctgtcgctcgcggtcatcatcatcgcgtacgtgtcaacggtggtggtggggctgcggctgcgcaaggggcagggggggctcggggacgcctgggtgcaggtcgtgggcgacgtcgtcatcgccaccggcctcgtgtacctcagcggtggctccgactcgcccctgacgtttctctacagcctggccgtcatcggcgcgtcggtcgtcctggaccgccgaggcgcgctctgggctgctgctgcgtctgccctgtgtttcggggccttggtcatgggctcacaactcctggacggcgcgtctggtgggttgatgccgcccacgcgggtgctcttcgtcctgggcagcaactccctggccctgggcctcatcgctgtgctgtcgggctatctctcacgtcagctctccgcgacaggtggcgccctgtctgctcgcgaggcggacctccagcgattggggcggcttcaacagcagattctctcctccatgccgtcggggctggcgacgtgtgatgcgcagcgccgcgtgacgtacgtcaatcccgccggttgcggaatcctccaggtcgaccccacgcaggtcgctggcgtcgaagtcgaagcgcttcttcctggcgtttcagtcctggcgcctcgatctcctcgcagtgaattggtggtgggaaagggcgcgaagcggcgcatcctggggctgtcggtaacgccactggagggtgagcccggggctttgctcatggtcttccaggacctcacccagctccgccggatggaggatgacctgaagagggccgatcggctcgccagcctgggtgcactctctgcgcaactggcgcacgaactgcgcaacccgctggcgtccatgcgcggctcggcgcagttgttggcgcaggatgcacgggatgacgtggcccagaagctcaccaacatcttgatgcgcgagtcggatcgtctggcacggctcgtcgaggagttcctgcgctttgctcgtcccccggtgcccagcttgcggagggttccacttgcctcgctcgtgacggagaccatggacatgctccgggtggatccactggcacgtgacgtacgggtcgaagtcaccgcgcccgagcctctcccggtctcggttgacccggatcagctgcggcaggtgctcatcaacctcgtgcgcaacgggtttctggccgcaggcccgcgcggtgaggtgaaggtcgcgctgactcggagcgagaatgaggcgagaatccgcatctgggactcgggggggagcatcacggaggagatgatggggcacttgttcgagccgttcttcaccacacgcgatggcggcacggggctggggttgtccaccgcgcactccatcatccgggcccacggaggctccatccgggtgcgctcgaaccgtgatgaggggaccgagttcgtggtggggttgccgctgtga

SEQ ID NO: 9087 - DNA, 927 bp, Myxococcus xanthus
tcggcgatggaacgcatcgccacccagctgggccgcgcggtgcagggaaaatcctcccaactccagctcgtggtgacgtccctggtcgccggcggccacgtgctgctggaggacgtcccgggcgtgggcaagacgacgctcgccgaggccctggccaaggcctgtggcctgagcttcgcccgcgtccagttcaccgcggacctgatgcccgccgacgtgctgggcgcccaggtcttccacgcgcagacggccaccttccagttccgtcccggtcccctcttccggcagctggtgctggcggatgagctgaaccgcgccccgccgcgcacccagtccgcgctgctggaggccatggcccagggccaggtctccctggacggcgccacgcacgcgctgcccgcgcccttcacggtggtggccacgcagaacccggtggacttctccggcacctacccgctgccggactcgcagctggaccgattcatggtgcgcatgtccctgggccacccgacgccggaagtggaggccgggctgctcgtcacccgcgacggcacaccgccgctggacgcggtggagaccgtctccgagcccgaggagctggcgtccctgcgctcgttcgccgcggcgctgcggttggacgcgtcggtcgcggactacgtggtgcggctggccacggccacgcgctcgcacggcgacctggagcgaggcgcctccacccgcgcggtgctcgcgctgggcgcgaccgcacgggcccacgcgctgtgggacgcccgggacttcgccacgcccggtgacgtccgcgcggcgctggtgccctgctgggcccaccgcatcatgctgcgcagcgccgtgcagggcgtgtccgcgcgcgacgaggcggcgcaccttctggaggagattgcccgaaaggtcccggcgccccggtga

SEQ ID NO: 9088 - DNA, 1413 bp, Myxococcus xanthus
ctggggtcgcgcggccacatcctcgtggtcgatgacgagctgtccatgcgtgagtacctcgagctgttgcttcagcgggaggggtactcggtgacgagcgtggccagtgtgaaggccgcatgtgatgtgctggccctggacggagtggacctggtcatctccgacttgaagctgggcacgggcagtggcctcgacgtcctgcgggcggcccgggcccggtcggcttctcccgaggtggtgctcatcactgcctatggcacgcccgcggcagcggtcgaagcgatgcgggaaggcgcttacgactacatctgcaagcccttcgacaacgaggagttgcggctcctggtgcagaaggcgctggagaagcgaacgctccgtcaggagaacagtggtctcagggcgcggctatttcctggcctggatggcgcggtgggtcagagcgagcgcatgcaggcggtctgggccttggtggagaaagtcgcttccggccgcagcacggtgctggtgacgggggagagcgggacgggcaaggaactggtggcgcgggccatccatatgcgcggcactcgagccgcgcgtcccttcctgcccttcaactgcgcggcgttgaacgaggggacgctggagagcgagctctttgggcatgtgaagggggcattcactggcgcgaccaccgaccgctctggcctcctggtggccgcaggcgatggcaccgtcatgttggacgaggtcggggagatgccgctcgcgacgcaggtgaagctgcttcgtgtgctccaggagcggaaggtgaagccggtcggcagcgccgcggagattcccttccaggcgcgtgtcatcgcggcaacgaaccggcggctcgaagccgaagtaaaggccggacgctttcgtgaggacctcttctaccggctcaacgtcatcacgttggagctgcctccactgcgcgagcgttccggcgacgtgtcgttgctggcgaactacttcctgtccagactgtcggaggagttggggcgacccggtctgcgtttctcccccgagacactggggctattggagcgctatcccttcccaggcaacgtgcggcagctgcagaacatggtggagcgggccgcgaccctgtcggattcagacctcctggggccctccacgcttccacccgcagtgcggggcgatacagaccccgccgtgcgtcccgtggagggcagtgagccagggctggtggcgggcttcaacctggagcggcatctcgacgacagcgagcggcgctatctcgtcgcggcgatgaagcaggccgggggcgtgaagacccgtgctgcggagttgctgggcctttcgttccgttcattccgctaccggttggccaagcatgggctgacggatgacttggagcccgggagcgcttcggatgcgtag

SEQ ID NO: 9089 - DNA, 663 bp, Myxococcus xanthus
atgcgcgtctcgcgattcaacccccgcaaccgtggcttcacgctcatcgagctcatgatcgtggtcgccatcatcggcatcctggccgccatcgccatcccgaacttcatcaagttccaggcccgctcgaagcagtccgaggcgaagacgaacctcaaggcgctgtacaccgcgcagaagtcgttcttctccgagaaggaccgttactccgacttcgccaacgaaatcggcttcgcgccggagcgcggcaaccgttacggctaccgtgtgtccgctgcggcgggcgattgcgaggtgcgcaatgcggctgaccttccggtgcctgctgccggcgttccgtgcatctccaacgactcgttccgcttcggtgccaacagcgccatcgacgatccgaccccggttgtcgcccgcttcgtgccccagggcgctgccgggtggaacacgaccctcggtgtgcagccgaccatcgcagactgccccaactgcaacttcttcgctggtgcgcgtggcaacgcggacaacgaggcgaccttcgatgactgggtgatcgccggtttcgagggctctggccaggtgggtccgtgctccgaggcgggtaacgttgcctccggtaccccctacaacacgcgcaacgacgtcgcctgcgacggcgcggcccagtaa

SEQ ID NO: 9090 - DNA, 867 bp, Myxococcus xanthus
atggcagagaagccggccaagccattgcggacgaaggatgggcccatcctcccccggcgagagttcctcgaaatcgtgggggcggcgcagaagccgctgttggccgacttctactggctccagtccatccagcaggtcggccgtgcgaacacggacacggaataccgggacgtgttcttctacgcggatctggcgacggacctcgatcccaagttcaggtacgtctacgagtggggtgccatcaccacccccgtcaacctggggagggacgaatgggcgaacacggacctgtcatcccggctgctaagcaaggggctggttgagttcccggacgaccgccggttcctgttccaactggcctacaacaagatgacgtatgacagggactacaagacagctgccgaccagctcatgaagttgtcgaagtaccctgagacgcccccctatctgctgcaactcgccacgcgcctctatgcgcaggctggcagcatcgatatggggcttcaactggcgcagatgctgcgtgacggtgcggaagacgacgagtcacgagccttctacgaacaccgcatcaaggaactacttcgagagcgcttgctgacgcagatcgacgaggctgttgcggcctaccagcgtgaccggggagaacgccccaaggcggtccctgtcttggtgcgcgcgggctacttgagggccatgcccatagatccgctggagggacagttcttcatcgacaggcaggggcgcgcgcgttccacctcgggaatctacaggttggagatgttcgaccagaagaagaaggatgagctgcgggaagacatcgcggcgggtggcattcagttcgaccttccggaggagatgccatga

SEQ ID NO: 9091 - DNA, 871 bp, Myxococcus xanthus
atgacagtcgcgggcgcgtcggatccgaacctgccagtttccatccgggggttgtccaagacgtacaaggtgggcttcttcctcaacaagcaggtcaaggcgctccagggactggaccttgagattgccccaggccaggtctacggactgctggggccgaacggggcgggcaagtccacgaccatcaagattctcatggggctggtgcgggcctcggaggggcaggccttgctcttcggagagccaccagatcggccgcatgttcggcggcaagtgggcttcctgccggagaacccttcgctttatgagtatctcaccgggcgtgagttcgtgacgttggctgggcgcatcttcggcctgagcggtcatgagttggaccagcgcgtagagcgggtgctcggcgatgtcgggatggggcgagcgtccgatttgcagatccgccgttactccaaaggcatggtgcaacgtacggcgctggcccaggcgctcatcagtggacctcgcttgctcgtgctggatgagcccacctccggtttggatccgctggggcgccgacagatgcgggacttgatcctggccgagcgcgcgaaggggacgaccatcctcttctgtacgcacatcatctcggatgtcgaatcgctttgtgaccgagtggtggtgctggtgggggggaggagggtccaggagggcagcgttcaggacttggtgtccgcgaaggccccatcggtggagatggtggtgcacgggctgccgctggaggtgctccagtctctgggattcagctatgagcacgcgcagcaattggacagtcgcgtgctgttgcggatcccgagcgctgattcgcatgggggtttgcgcactgtcatcaacg

SEQ ID NO: 9092 - DNA, 1746 bp, Myxococcus xanthus
cacgacaccacgctcatcgccaccatcgcagttggactcggactggccttcgtcggtgggttcgtcgcacggtggctgaagctgccacctttggtgggctatctcctggcgggcgtggccgtggggccattcacgccgggcttcgtcgcggatgggggccttgccggtcagttggcggagattggcgtcatcctgctgatgttcggcgtggggattcatttctccatcaaggacctgctcgccgtgcgcaatatcgcggtgccgggcgccgtcgtgcagatcgcggcggccaccgtgatggggaccgcggtctcgcactggtggggttggagcctgggtgcgggcctggtgttcggcctcgcgctgtccaccgccagcaccgtggtgctgctgcgcgccttggaggagcggggcatcctcgattcggtgaatggccgcatcgcggtgggttggctgattgtcgaggacctggcgatggtgctcgccctggtcctcctccccgcgctgggcaacgtccttggctccgccgacacgcagacgcccgcgacggcggccgctggagacagcctcatctggaccctggccttcacgctggggaaggtgtgcctcttcgtggcgctgatggtggtcgccggcacgcggctggtgccctggctgctgacccaggtggccaagacgggctcccgcgagctgttcacgttgtcggtgctggcggtgtcgctggggattgcgttcggggccgccgcgctcttcggcgtctccttcgcgctgggcgccttcttcgcgggcgtggtggtcagtgagtcggagctcagccaccgggtggcggaggattcgctgccgctccaggacgcgttctcggtgctgttcttcgtgtcggtgggaatgctcttcgacccgatggtgatggtgaagcagccgctcgaggtcctcgccgtgctgggcatcatcgtcctgggcaagtcgctggccgccttcttcatcgtgttggcgttccgctacccggtgaacaccgccctcacggtgtccgcgagcctggcgcagattggggagttctcattcatcctggtgggattgggcgtcacgctcgggctgctgccgaaagaagggcagagcctggtgttgtcgggagccctgctgtccatcaccctcaatccgctcgtcttcaagaccattgatccgctgctggcgtggctacgccggcacccaaggttcgccgcgcgcatggaccccgaggaagatgagctgtccgacctgcccattggcatgggggacgtgcaactgcgcgagcacgcggtgttgattggctacgggcgcgtgggcggcgtgattggccagagcctgacggagcagaagattcccttcgtggtcgtggagcagaaccgcgagtacgtggagcgccttcgtgaggagggcgtgcccgccatctacggggacgccgcggtgcccggcatcctggagcacgcgcacctggatacggcgtccatcctcatcgtcgccacgccggacgcgctgcaggcccgcgccatcgtggagcaggccaaaggcgtgaatccgtcccttcccgcggtggtgcgcacgcatggggacgaggagcgggattacttggtgtcattgggcgtggaccgggtggtgatgggcgagcacgcgctggcacggagcatgttggactacgtgctggagcgactgtccgcactgaaggccgggcctctgttgccggcacccgcggacgccgtggtgccttga

SEQ ID NO: 9093 - DNA, 843 bp, Myxococcus xanthus
cacgaacgccaggtcaccacggcctccccccaggcccaggccttcttcaaccagggcctgcggctggcgtatggcttcaaccacgacgaggccgcacgctcgttcgcccgagccgcgcagttggaccccacctgcgccatgtgtttctggggcgtcgcgctggtgctgggtcccaactacaacatgcccatgctggcggagagtgcgcccgccgcctgggacgccctccagcgcgcgcggcagctcgcaccccgtacgacgccggtggagcaggcgctcatcaccgcgctcgtccagcgctaccccggcccgaatgccctgccaccggagaagatggcccccttcaacgaggcctatgccagcgccatggcggacgtggccgcgcgctacccggaggacctggacgtgcagacgctccatgccgaggccctcatggaccggaatccctggaagctgtggtcgctggacggggcgccggctccgggcacggagcagattgtcgccacgctggagtccgtgctcacccgggccccctaccacctgggcgcgaaccactattacatccacgcggtggaggcctcgccgaacccggagaaggcggagccttccgcggaccggctgggcgctctggcgccgaaggcggggcacatcgtccacatgccggcccacatctaccagcgcgtgggccgctacgcggatgcatcggaaagcaatcggaaggcggcggcggcggacctggcctaccagaagcaggcgaagccgcgcggccacgtctaccccatgtacacgtcccacaacttcggcttcctggcgtactccgcgtccatggaggggcggaagcag

SEQ ID NO: 9094 - DNA, 3345 bp, Myxococcus xanthus
atgcagtcctcgggcgcggaaatcatccacctggggcacaaccgctcggtggctgagattgtcgactgcgccatccaggaggacgtgcagggcatcgccatcacgtcctaccagggcggtcacgtcgagttcttcaagtacatgattgacctgctgcgcgagcggaaggccaacatcaaggtcttcggcggcggtggcggcaccatcctcccgtcggagattgaagagctccaccgctacggcgtcacgcgcatctactcgccggacgatgggcgggccatgggccttcaggggatgattgacgacctcatctcccagtgcgacttcgagaagcggccggcggacttcgcgcccctgctcgatgcgccctcgatgcgcgagccgtcccggattgccccgctcatcaccatcgcggagaacttcgcgtcccagggcgcggccctgcgcgaggccatgtcgcatatccaggccaggggcccgcgcgtgcccatcctgggcatcaccggcaccggcggagcgggcaagtccagcctcgtggatgagctggtgcgccgcttcctcgccgacttcccggacaagacgctcgccgtgctgtccgtggacccgtccaagcgcaagtccggcggcgcgctcctgggcgaccgcatccggatgaacgccatcgacaatccgcgcgtgtacatgcgctcgatggccacccgccagagcaacctcgccctgtccaagcacgtgggcgactccatcgaaatctgcaaggccgccggcttcgacctcatcgtggtggagacctccggcatcggccagtccgacaccgaaatcaccgagcactccgacgtggcgctttacgtgatgacggcggagtacggcgcggcgacgcagctcgagaagatcgacatgctcgacttcgcggacgtcatcgccatcaacaagttcgacaagcgcggttcgctggacgcgctgcgcgacgtgcgcaagcagtggaagcgcaaccacaacgccttcaccaccgccgatgacgcggtgcccgtgttcggcaccatcgcctcgcagttcaacgacccggggatgaaccagctctaccgggcgctcatggacaccatctccacgaagacgggcgcgccgctcaagtccggcttcgagctcacgccggggatgagcgagaagaagtggatcatcccgcccgagcgcacgcgctacctggcggaaatcgtcgaggcctgtgagtcctatgacggcttcgtgaaggcccaggccgccatcgcccggcgtatgtaccagctccacggcaccatcgaggcgctgcgcaccaacgtgggcaggaagcgcctggaaatcgtcgagcccaaggacccctcggacacggtgcaggtcaccgagcgcgtcgagggcgagcccgcctacctgagcgagctggtggagctgtacaaggatttggagtcgcggctccacgccgactgccgccggctgctggccgagtggcccgcgacgaagcgccgctacgccgcgtccaagtaccagttccaggtccgcgacaaggtcatcgagctggacctgtacgcggagacgctctcccacctgcgcatccccaagattgccctcccccgttacgaagactggggtgacatcctcacctggctgctgcgggagaatgcgccgggcgccttccccttcaccgcgggcgtcttcccgctcaagcgcgagggcgaggaccccgcgcgcatgttcgccggcgagggcggcccggagcgcaccaacaagcgcttccactacgtgtcgcggggcctgcccgccaagcgcctgtccacggccttcgactcggtgacgctgtacggcgaggacccggaccaccggccggacatctacggcaaggtgggcaactcgggcgtgtccatcgccaacgtggacgacgcgaagaagctctactccggcttcgacctggcggacccgtccacgtccgtgtccatgaccatcaacggccccgcgccgatgctgctcgggttcttcctcaacgccgcggtggatcagcagtgcgaaaagtggattcgcgagaacggcaaggtcgacgaggtcgagaagaagattgatgccctctaccgcgagcgcggcctgccgcggccccgctaccagggcgacttgccgcagggcaacgacgggttgggcctgctgctgctcggcgtgtccggcgacgaggtgctcccgcgcgacgtctacgagcgcatccgcgcgaagacgctccagtcggtgcgcggtaccgtgcaggcggacatcctgaaggaggaccaggcgcagaacacctgcatcttctccacggagttcgccctgcgggtgatgggcgacatccagcagtacttcatcgaccagaaggtgcggaacttctactcggtgtcgatttccggctaccacatcgcggaagccggggcgaaccccatctcccagctcgccttcacgctggccaacggcttcaccttcgtcgagtactacctgtcgcggggcatggacatcgacgacttcgcgcccaacctctcgttcttcttctcgaacggaatggacccggagtacgccgtgctgggccgcgtggcgcgccgcatctgggccaaggccatccgggacaagtacggcggcaatgaccgctcgcagaagctgaagtaccacatccagacgtctggccggagcctgcacgcgcaggagattgccttcaacgacatccggaccacgctgcaagcgttgctcgcgctcaacgacaactgcaactcgttgcacaccaacgcctacgacgaggccatcaccacgcccaccgaggagagcgtgcgccgcgcgctcgccatccagttggtcatcaacaaggagttcggcctctccaagaacgaaaaccccagccagggtgcgttcatcatcgaggagctgaccgacctggtggaggcggcggtgctggcggagttccgcgccatctccgagcgcggcggcgtgctgggggccatggagcgcatgtaccagcgctccaagattcaggaggagtccctctactacgagacgctgaagcacgacgggacgctgcccatcatcggggtgaatacgttcctggaccccaagggctctccgacggtgacgccgcccgaggtcatccgcgcaacgacggaggagaagaactactccatcacctcgcgcgacgccttctggaagcggaacgaggcgacggcgcccaaggccctggaggccgtgcgccgcgcggcgctggacaacggcaacatcttcgccgcgctgatggacgcctgtaaggtctgcacgctcggccagctctcccgcgcgctgtacgaggtgggcgggcagtaccggcgcaacatgtaa

SEQ ID NO: 9095 - DNA, 927 bp, Myxococcus xanthus
atgctcgcgcgcaccatcaccctggtggagagcgagctgccgcgccatgccgcgctcgcccaggaggtcctcacgcggctgctccccgccacgggtggcagccggcgcgtgggcatcagcggcgtgccgggcgcgggcaagagcaccttcatcgacgcgctgggcatgcacttggtgaaggccggcaagcgcgtggcagtgctggccatcgacccgtccagcaccgtgtccggcggcagcatcctgggtgacaagacgcgcatggcgcggctgtcgcgcgaggaagccgcgtacatccgccccagcccctccagcggtactttgggcggcgtggcacgcaagacgcgcgagacgctgctcttgtgtgaggcggcgggcttcgacgtggtcctggtggagacggtgggcgtgggccagtcggagacggtggtggccgacctggtggacttctacctggtgctcatgctggcgggcgccggggacgaactgcagggcatcaagcgcggcatcctcgaggtggcggacatgctcgccatcaacaaggcggacggcgacaacaagccgcgcgccgaaagggcccgctccgagctacgcgccgcgttgcacctgatgcggccaggcgccgagccggaaatcaccacctgcagtgccctggagggcaccggcatcgagaagctgtggacatccgtcgagacgcagctcgggcggagcgcggtctcgggcgcgatggagcgccgccgcaaggcgcagcaggtgcagtggatgtggtccatggtgcaggacggcctccgagcggccctgcgtgcgcaccccgaggtgtccgcactggtgcccacgctggaggcggacgtgcgcgaagggcgtgcgacaccgacgtcggccgcactgcgggtgctgggcgcgttcctccctgaaacgagggcctga

SEQ ID NO: 9096 - DNA, 2193 bp, Myxococcus xanthus
atgcgcccccacgtaccggacttctcgggcatcgacttcgacgcccccgaaacgcactccgccgcgcccatgcgcgaccagcaactgcgtcaggccggcgaggccacgcgcaacgccgagcgctgggacacgcccgagggcatccccgtcaagccggtgtacacgcgagaggacatggagggcgtggagcacctgggctcgctgccgggcctgccgcccttcgtgcgcggcccctactccaccatgtacgtgcagcagccgtggacggtgcggcagtacgccggcttctccacggccgaggcctccaacgccttctaccgccgaaacctcgcggcgggacagaagggcctgtccatcgccttcgacctcgcgacgcaccggggctacgacagcgaccatccccgcgtggcgggtgacgtgggcatggcgggcgtggccatcgactccatcaaggacatgcgcatcctgttcgaccggattccgctcgaccagatgagcgtgtccatgacgatgaacggggccgtgctcccggtgctggcgctctacgtggtcgccgccgaggagcaaggcgtgcgccccgagcagctcagcgggaccatccagaacgacatcctcaaggagttcatggtccgcaacacgtacatctacccgcccgctccgtcgatgcgcatcatcggcgacatcttccgcttcacggcggagaagatgccgcgcttcaacagcatcagcatcagcggctaccacatgcaggaagccggggcgacgcaggacctggagctgggctacacgctggcggatggcgtggagtacgtgcgcgccgggctcgcggcgggactgagcgtggacgccttcgcgccgcgcctgtccttcttctgggccattggcatgaacttcttcatggaagtggccaagatgcgcgccgcccgcctgctctgggcgaagctcatcaagggcttctccccgaagacggacaagagcctggcgctgcgcacccacagccagacgtcgggatggagcctcaccgcgcaggacgtcttcaacaatgtcgtgcgcacctgcgtggaggccatggccgccacccagggccacacgcagagcctgcacaccaactcgctggacgaggccatcgcgctgcccaccgacttcagcgcgcgcatcgcccgcaacacccagctctatctccagttggagagcggcaccacgcgcgtcatcgacccgtggggtggcagctactacgtggagcgcctcacgcacgaactggcgcacaaggcgtgggcccacatccaggaggtcgaggcgctgggcggcatgacgaaggccatcgaggccggcctgcccaagctgcgcatcgaggaggcggcggcgcgcacccaggcgcgcatcgactccggccgccaggccatcatcggcgtgaacaagtacccgcccgagcgcgaggactccatcgagattctcaaagtggacaactcggcggtgcgcgaggcgcagattgcccggctgcgcgagctgcgcgccgagcgcaacgcggaggacgtccgccgcaagctggacgcgctcaccgaggcgggacggcgcggcgagggcaacctgctggcactggccatcgacgcggcccgcgccaaggcgacggtgggcgaaatcagcgacgcgctcgagaaggtgttcgggcgctacgaggccacggtgcgcagcgtgacgggtgtgtattccagcgaagcgggcaaggacgctcagggaatcatcgacgcgcgcgagaaggcggacgcgttcctcgcgcgcttcggccgccggccgcgcatcctcatcgcgaagatggggcaggacggacatgaccgcggccagaaggtcatcgccaccgcgttcgcggacctgggcttcgacgtggacatcggtcccctgttccagacgcccgaggagtccgcgcggcaggcggtggagaacgacgtgcacgtcgtgggcgccagctcgctcgccgccggccacctgacgctggtgccgcaactcaagcaggccctcaaggcgctgggccgtgaggacatcatggtcgtcgtgggcggcgtcatccccgcgcaggactacgacgcgcttcgcgccgcgggcgccgcggccatcttcggccctggcacggtcatctccaaggcggccatcgaactgctcgacaagctggccgcgtcgctggaggaagaggcgtga

SEQ ID NO: 9097 - DNA, 1017 bp, Myxococcus xanthus
tctaacgcctgtggcggctcgccggaggcccaggccatggtgctgcacgcgcgcaccgcgagcaccacgaagacgcagcgggacccgtgggtgaacatcctccgcgccaccgcggagtccttcgccgccgtcgtcggtggcgcggacagcgtcagcacctcgccgttcgacgaagccctgggcacgcccgacgcgtccgcccgccggctggcgcgcaatacgcagctcatcctgcgcgacgagtcgagcctcaaccgcgtcgccgaccccgcgggcggcagctactacctggagcagctcacacaggacatcgcccgcgcggcgtggaccgagctgcggcgcatcgaggcgctgggccgcatggagcaagcgctcacgagcggcgacgtggcccgcgtgctcgcggagacgcgcgcggcgcgcgacaaggccgtgcgcacccgccgcctgcccattgtcggcgtgagtgagttcccccacctgggcgaaacacccgttcagcggaagtcccgcgccgaggcgtccacggcgccagcgacatcgggccccctgccgctgcgcccggcgcgagtggccgagcccttcgaggcgctgcgcgacgcgagcgaccgccacctcgccgcgcacggtgcacgccccaaggccttcctggcaagcctgggcacggtggccgagcacaccacccgctccacgtggacggccaacgtcctggccgcgggcggtatcgagccggcggaccagcatggcttcgcggacatcgcggacgcggtggcccgcttccaggcatccggcgcgccgctcgccgtcatctccgggccggacgcgctgtatccagaatgggtgcccgcgttgacggcggcgctgaagtcgaagggcgcgcgcgcggtggccgtggcgggccggcccggtgaccatgaggccgccttccgcgcggccggcgtggacgtcttcttctacgcgggagcggacctgttcgcgctcctgtcctcactgcaccagcagctcggagtggcctga

SEQ ID NO: 9098 - DNA, 324 bp, Myxococcus xanthus
atgtcggggctacagatccaccgtgaggagtccgcaggttccgtgacgctgcgactggaaggcacgctggacggcaagacggcggaagaggtccggacctctctgagcgccctgagtgggtgtgaggtcgtactggacttcgcccacctgcgggagttcaaggacagcgccgtgggagtcctgacgcgaggcctggtggagcgccccgtccaactgcgcggcctggccactcaccacgagcggatgttccggtacttcggtgtgggcacagggacgtcgccgcgccctgcctactacacgcccgaggacgtcttcctggcgtag

SEQ ID NO: 9099 - DNA, 1143 bp, Myxococcus xanthus
tggtcgggcgtgctcgacgggttggggcaggggagcgcgcgaggcttcttccggcgtgatggcctggaggtgacggggcacattcccggcgcgggcggcgcgcagcggcactcggtgggcggcgtggagctggagggccgcaggccgctgggagagtaccaagcgctgactgtcacggtggcgacctcgggtgagacggtgacgcaggaggagggcgcacaggcctcctcgtggtggcgcgccagcgtcatggccatggatgaggtgcggctcttcggaggcacgctggacgtggtgccttcgatgcggctggagcgggtggggccgtactggttgctgtcgccgaagctgggtgcatccgtcgagctggggcgcggcttcgggctgcgcgccaacgccgggcagtcccaccgcgcgccgtccttcctggagctgtacatccggcaggggacgctgctgcccaaccccgggctgaagcccgagcgcgccttgtacgcggacgcggcggtgacgtggcgctccggtccggaagactccgaggaagcggcgccacgctggggcctcacgctgggcggcttcgcggcgctgtatgagaatctcatcgcctatgagctgtacccgccgctgatggcgcgtccgtacaacttcgacaccgcgcgcgtgtggggcttggaactggagggcgaggcgaggcctttctcctggctcctggccagcacgggctacacgtacctgcgcacggagaaccgctatggggacccgcgcttcttcggcaaggacctgccgtaccgtcccagacacaagtgggtggggcgggtgcgcgcggggccagattggctcaacgcccgcgcggaagtgctctaccagtccgcgcagctcatcaaccgcaccggctcgctcgatttgccatcacgcacgttggtgagcgcgggcgcgtccagcacctttcttcatggtccggacctcaccctgtccgtcgagctgaagaacctcctcgacgtccggaccttcgacttcacgggcttcccgctgccgggtcgcgccgtctacgtgacgctcgcggtagcgctcgagccaggcgcgtcaccgtcatcctcatccactcgggagccccatgactcgcccgcgtcccctgtcccctga

SEQ ID NO: 9100 - DNA, 696 bp, Myxococcus xanthus
atgttccagttcggcaatgccgtcgcgcgcgtggacatctccaaccccgaacagccgcgcaaggtggacacgatttcgctcaccgggctggacctgaagcccttcgacggcggcacggtgttgccgctgccttactccgtcgcggcgacggaggcgggggtgtacgtcagcctcaccaacctgaatccctacaacggctacaagcccaatggcccgggcatgctcgcgaagatcgaccccgcgagcggccgtgtgagcgccatcgacctgggcgcggcggattgcctcaacgcgggctacgtggaggccgtgggtgaccagctcgtggtggcctgcctgggcgaggccgagtacgacgaggccaacgggcacagcgccagcgccgtgcgcgcctccgggctggtgctggtgaagaacgacgcgcccgtggcggcgtacgcgctcaaggcggggtgtgagcccggaacgctgggctgcaacctctccgtggccagccgcttcgcggtggcggagggcgcggtgtacctggcggacacgaacgcgggccgcgtcttcgtggtggcggtggaggacgggcggttggtggagcgccgcggcttctcttcgccccaggccctggggcccgcgctggaggcgtgtcccacggacccgcgccggcccgtgtccaatgccattgacgtcaccgccctgcactga

SEQ ID NO: 9101 - DNA, 858 bp, Myxococcus xanthus
atgtccgtcctgctcgccacggtgctgtgcctgctcaccggtacggtgagcgcggcggagacgtcgagcctgaggacgctggggccgccagcgccttccaaggtgcggcgcgtggtgacgctggcgccctcgctgtcggagatggtgctgtccctgggcgcggggagcacgctggtgggggtgtcccgcttcgacgaggcgaaggaggtggcgaagctgccgcgcgtgggcggcttcacggacccttccgtggaggcggtgattgcgctcaagccagacctgctcctggtgcagcccgggccgggcaaccagcgtccggtggagaagatggccgagctgggcgtgcccgtgctgctgctgccgctgcactccgtggcggacgtgctcgcggccatgcgcgcggtggggaaggcgctcggacgggagaaggaggcggaggcggtggtggtgggcatcgaggccacgcgcacgcgcatccgggaggcggcgaagaagctgcccgcgccgcgggtgctgttcgtctatggcttcgagccgctcgtggtggcggggcctggctctttcgcggacgagctgctccgggacgcgggcggcatcaacgtggcggcggacgcgagctccgcgtacccggtgtactcggtggagcgcgtggtgcgtgcccgggccaccgtggtggtggatgccgcggacgtggacgtgggcaaggacaagttgcgggcactgcccggcctgtccaacgcgcgctgggtggacctgccctccatgtcgctgctgcagccgggaccttcgctggggcggggactggaggaactcttccgtttgctgcatccgaagggaacgggtaaggccgcgccgtga

SEQ ID NO: 9102 - DNA, 1017 bp, Myxococcus xanthus
atgttgttcgggggcttcctcgtgttggcggtgggctgcctggccgtggcggtgcgcttcggtgagcagtccatctccctcaccgccgcgctgacggagcccacgtccacggacgccgtcatcttctggtcgctgcggctgccgcgcgcgctgctgggggccatcgtgggcgcggggctggcggcctcgggcgccacgctccaggggctcttgcgcaatccgttggcggacccgttcgtgctcggcgtgtctggcggggcggcgatgggggcgacgctggcgctcgcggtggggctcgccaccgtgggcgaagtggcaccgggcctgggcggcgccatggcgcgtctgtccgcgccggcgctcttctccttcctgggcgcgggggccgccatcctcttcgtcctctccgccagccggggctccgcgtcgcgcgcgccctacgccgcgctgctcaccggcgtggtgttcaacgcgttcgcctccgcggccatcaccctggtgaagacgctgtccgcccctgaccggctgggggaaatcctctactggctcgccggagcgctggggtacgagcgcggcggcacgctgctgctctccgcgctgcttcaggccggcgcgattggcgtcatgtgggtgctctccgcacggttgaacctgttgtcgctgggggacgatgacgcggcgtccctgggggttccggtggcggcgacgcgccgctggttgctgctggccgccagcgcgagcgtcgcgggcgcggtggcgctcacggggttgattggcttcgtgggcctcatcgtgccgcacctgctgcggctggccttcgggccggaccagcggctgctggtgccactgtcggcgctgggaggcgcggccttcctcgtcctgtcggatttgctggcgcggctggccttccccttgttcggggccgaacctcccgtgggcgtcgtcaccgcgctgctgggaggcccgctgttcctcgcgctgctgcggcggcgggtgcgtctggggaccagtcattga

SEQ ID NO: 9103 - DNA, 1290 bp, Myxococcus xanthus
atgttcgccacggccagcttggtgctggcggttgccaccacgggctgtggctccgaatgcgtggatgtctacgactgccgcaacgagaacggccctgctcccgcgggccaggagtggacgtgcgcctcggagaagtgtgagacgcggcccatccagcaactccccggggaagacgcgggcaccgacccggagaccgatgctggcacccatccggagccggacgcgggcacggagccggacgcgggcacggagccggatgcaggtacggagccggacgcaggcacggagtacacgtgtgagacggcgccgtacgacccggtgctcggcacgcttcagctccaggcgggcttcgagaccgcgaactccgcgcccatgccggacgacgtgctggcggtggccgtcacgccgggccccacgtatgcggtctatgcagtgcaaggggggacgagcgcggacgtctattcgctgggaatctggccggacctgacgccttcctcgtcgccgctgttcaacgtcctggcgcccgaggaccgaggggccacgtcgggcatctaccccaaccgcttcctcgtgcatggcgccgagcggctgctggccggctacacgaagtcgggtggcgcgggcacggtctcgctctatgacatcgtcacccctgacaactcgagctacgtcaactcgccgggcaacatgagcgccgccgcgttcacgtcgggcacgacgtccgccttcctcatcaacagcatggggctgtccgccatcgacggcttcggaatctatgcgctggtgacctccgcggagcccgtggcctccgtgaaggtggccgacttcccgcagaccgccggcggaaatggcttcagcgccgtggcgaccaacggcgtctccgtgctcggtttcgtcgttccgccggactacgccaacgtggcctacgcggtggcgccctccgtcgtgagcgcggcgctctcctccaacacgccgttcgcattggatgcgcagccccagattgacgtgggcagcgacttcaacgcggcctccgctttcggtgacggcgtcgtcgtcaagcggggtgcctatgatgacacctggcagttcatcaccaccgacgtgtcccgctacagcctgtccgcggacgcgaccccgggtgaggtcgtcattggcgagcgcacgccggtgctgacgctcgtggaccagtgcacctccgtgacgcagctgacccacctgggctcggacctgctggtgggcatcgaggacgtgaacggcgagcggctggtccgcatccgggtcgtccagtga

SEQ ID NO: 9104 - DNA, 504 bp, Myxococcus xanthus
atgacgggggaggtggaccgccgcgccgcgctcggcacgctgctcaagggcacctgtgccctggcggcggtcggggcggggtgtggtgacgggtggcgggaagccgtggtgctcgaccctcccgatgcgggagggccgggcccgtcttgtgcgccgccggtgccgtcgggcccacccggcgagggctgggtggaggtccccctggtggagcatcccgcgctggaggtccccggcggcgccgcggaggtccgcattccccaggcgctgctggacgtggtggtggtccacacctcacctggctgttacgcggcgctctggcgcatctgcacgcacggtgattgcgccgtggactgggtgccggccgacggcgtcatggaatgcccctgtcatggctcccgcttcacccaggaggggcaggtgctgaatggcccggcgactcgaccgctcgcggccttccccgtggtgagacagggcgcgtccctgttcatccacaggccccgctga

SEQ ID NO: 9105 - DNA, 1686 bp, Myxococcus xanthus
atgtggcagatcatcatcaacgggcccggctacttcgacacgtcgtacgatctgcctgagggcgtgacgagcctcggccgcgcggacgagaacgatatcgtcctgggcggcgatctcgtctcacgccggcatgcgcggctgttcgtcgacggtgacgtgctgcgaatcgaagatttgggcagtcgcaacggcagccgcatcaacggcgcgcccttgcagggttctcggcaactcgtcgccggagactcggtggcgctgggcgagaacgtcctctccgtgcgccagcccaacaccgtggagaacgcggccacggagatggtggacctgggcgcgggcggcgtcgtgcgcttcggccacggccaggacgtgggcccctccgtcctgatggcgaagaacgtgcgcgacgcggacgtgctgcggctcctggacaatgtgggtccggtctccttcgacgacagcttctccgcgtccgcgccgctgcccgccgcgagcccgcgcgtggggcaggagacgctggtgctgttgttccgcaccgcggaggcgctctcgtcggccgccacgctgtcttcgttcctggacaccaccatggaccggctgctggaggtcactgacgcgaccacggcggtggtgctgctcaagcacgccacgggcgccatggtgcccgccgccgtgcgccaccgcggccggctggccaagggcgaggtgcccgtctcggatgccatcgtggaggaggccctgcgtcagggccgcgcgctcgccgtgggcgacgtgcgcgatgaccgccgcttcgcgggccgggagagcgtcatcctctacggcgtggaccgggtgctgtgcatccccatcggcaccgagccgccctacgcgggggtgctctacgtcaacctgtcggccaagggtgacgccagcgtggagtcgatgctggatacctgcaccgcggtggcgcatctggtggccaccggcgtgcagaagttctccccgcgcgagggcagtcccgcggcggacaggctgcggcgcgacctggagcgcttccacccgccggacgtggccgagcgccgcgccgccgaggcccagaagcagggcggcaagctgcccggcctggaggagcgcagcctcaccatcctgcacgcggagctcgtgggcttctccgtgttgtgcatgcgcatcggcgccgctcgggccacgcagatgctcaacgactttcacgcgcggatgagcggcatcgtcttcagcttcgaggccaccgtggagggcttccggggcgaatccctgcgcgccctcttcggcgttccctacgcgaagggcgaggactcgattcgggccgtccgggccgccctggcgctgcgctccgagtgggagcggtccatggcgcgccggcccctggacgagcgctgcgagctgcgaatcgccctgcacagcacccgggccctggtggggatgatcggcaccgaggtgcgcccggactacaccgtggtgggggatggcgtcgggattgcggggtggctcgccggtaccgccagcccgggccaggtgctcattaccggcaaggtcctggccaccgtgggggcacgcttcgacgtccagccgctgggcgagcgcctcatccgccccccgaaggacaaggtagcggccttcgaggtgctggaagaggatgtaggccagttgaccaatcccggcttccgttga

SEQ ID NO: 9106 - DNA, 623 bp, Myxococcus xanthus
cagccctttggccggtacacgctcctgtcccaactggcgacggggggcatgggagagatctacctcgcgcggttggagggggcgcaggggttcgagaagctctgcgtcatcaagaaaatcctcccgcagcttgccgcggacacggacttcgtcgagcgcttcgtgggcgaggcccgcaccctggtccgcctgagccacggctccattgcccaggtgctggacatgggcctccacgaggacgaggcctacatggcgctcgagcacgtggacggcaaggacctgcgcaaggtggccgcgcgcgtgcgggacaggcagatgccgctgccggtcacgttcatcctctacaccatgggccgggtgctggacgcgctggcctatgcgcaccgcaagaaggacgacgacggggaggacctgaagctcgtccaccgggacatctcgccgcagaacatcctcatctcctacgaaggggaggtgaaggtcatcgacttcgggctcgccaagagccggctgtcggccgcgaagacgaaccccagcatcatcctgggcaagttcctctacatgtcgccggagcaggcgcggcaccagccggtggaccgccgcagcgacctgtacgcggtggggct

SEQ ID NO: 9107 - DNA, 807 bp, Myxococcus xanthus
atgtcgggcggcgtgatgtacctggcgcaccgtgggacgagccaggccgaggcgttggcggagcagtcccgccagtccgccttggacgccgccacgcgggcgcgtgacgcggaggccgcgcggctgcagttggagcagaagctggcggcgctggaagccgagcgcgcccagctcgccacggagaaggagcagctcagctcggagaaggaacagctcagccagacggtgcaggaacaggaggcggagctggcgaagctgaaggccacctacgacgacctgcaggacaagatgaaggcggagatcgccgagggcgccatccgcctgtcccatgccgagggccgcatccaggtggacctggtggacaaggtgctgttcgattccggcgacgcgagcatcagcgcgcgcggccaggaggtgctgacgcggctgggcagcgtgctggccaaggtggaggacaagtccatccaggtgtcgggccacacggatgactcgcccccgtcgcagaagcttcagagcaccttcccatccaactgggagctgtccgtggcgcgcgcggtgaacgtggtgcgcttcctccaggacaccggcggcgtgcccgcgcgccgactggtggctgcgggctacgggcagatgcggccagtgtccaccaacgcgaccccgctgggccgcgcgcgcaaccggcgcatcgaggtgctcctcatgccggacctgccctccaagcgcacgccgaccgcggccgtccagcgcgcggtcgcgggtggcaccgcgaccaaggcccaggcgaagcccgcgcgcggggcgaagtag

SEQ ID NO: 9108 - DNA, 2985 bp, Myxococcus xanthus
atgagaaaggtgttgttcctcggggcctttgccctgggcgcctcggcctgtactcccgatatcgcccaggacccgccgcggagccccgaagactccgtcgtcgcggagttcgatccaaccgggtctccacccgtcgtcccgtcgcccaacgacctggccattgtcaacggtctggtcaacgcgcccatcaacccgcaggcgccggcggcggagcaggagttcacgcgcgactacgtgaacacgctcaacggcttcccgaccacggtcaccgcgaccacccgcatccggggcctggaggcgggaacggtcaacacgaacacggtgaagatcatcgacgtgtacgcgggtacgccgctggcgaagccggcgacgcccagctacatcgggtacaacgaggaaaccaacctcgtcaccatcatccccccgctccccggaggctggcccaagggtggccgctacgcggtggccatcatcggcggtgagaacggcgtgaagacgacggccggcaagccggtcatcccgtccgccacgtgggccttcgccagctccgccgagtcgctggtcacctgcgacgacctggcggcgcccaactgccagacgaccaccgagctcatcccctccacggtgacggagcccgccgcccgcctggcggaccagacggccagcgccctgcggctggagcagctgcgccgcggctacgcgcccatcctgaagctggtgtccgagcagttcagcgtgaagcgcgaggacatcgtcctcctgtggaccttctccatcatggaccacccggaggccaccttcgatccgggcaacggcgtcgtccccttccccaatgacctgctgcgcaaccccgaaaccgggctgctggccctgccggagcccaccgaggccggccccgcgcagatgctcatcaagggcctcaacaccctggacggctggtccaccaccgcgcccatcgtgtcggagaacggcgcgaaacgcggccccatcgacacgggttccctgctggacgcgaacaccgtgcgcatgaagatcggcttcacgccggacaccgaggaggagcagaagaccacgctgcgcttcgtcaagctgaccaaccccacctcgggcaccaacccccaggtgaagctgtgcttcaactgcgagcccgtcgtggagggcctgacgccggcgccgaactcgccgcagcagctccagattgtcccggaggtgccgctggacgaggccacccagtatggcgtggtgatgctgcgcggcatgaaggacacgctgggccgcaccgtggcgcccaccgccgcgcaggcgctgatgcgcatggtcaacccgctggtggacgccaacggcaagagccaggtggcggccgttcctgacacgctcgcccgggacctggagcgggcgcgtgtgggcatgaagccgctgttcgacggcctggaggccgcgggcatcgcgcgcaaggacatcaacctggcgtgggccttcaccacccagagcacccgttccatcctcgagcggctgaacgcggcccccacgcaggtgccggtgccggccgaccccgtctacctgctggaccagacggccaccatcaagggcacgatggccggcctgacgctggacaacgacgcggtgggccgcgtcttcatcggcgcgtaccactcgcccttcttcctggatgacgcgcagggcacgctcaaccgcgccacgccgcgcatcgaccgcgtcccgttcatgctcttcacgcccgcgggggcggcgcccgcggacggctacccggtggtcatctacggccatgggctgacgggcaaccgcaccaacatcttgacggtggccaacaacttcaacgcggcgggctacgccgtggcggccatcgacaccgtgttccacggtgagcgcgccagctgcgccggcatcagcgaggacgccccggttgtcgtcgacgagaaccgcgatggcgtccccgagctcaccatcaccacgccggacgcggcctgcgacgacggcgacacctgcgacgtgacggcgggcagccccaccttcggccgctgcgtgtcgaacatccagccggcctgcgacgtggggccgaccgcgtcgccgcacggtgacctgttctgctccagccagggccggggccgctgcgtcgtgaccgagcccgacagcaccaccggcacctgcgagggcggcgacttcgcccgtccgggtcccaatcagccgccgtacgtctccggcgcgggcttcctgaacctggtcaacctgttcgccacccgcgacaacttccgccaccacgtggtggacttcgcccagctggcgcgcgcgctggacaccgacaccctcaacggccgcctggctgccgcgggcgccggtacgctgaacaccagccagttcagctacgtgggccacagcctgggcggcatgcagggcgtcctgtccgcctccgtgtcccccgtcgtgggccgcacagcactcaacgcggtgggcggtgacctggtggacatcctcctgacggccacggactcgacgttcgtgcggtaccgctcgggcttcttcgaaaccctggaaaacagcggccgcgccccgggcacgccggagttctacgagttcatcaccctggcgcgcaccatcctggacccggcctcgccccgcaactacggcaggtacctggagaacgcgccgtccgcgcccgccaaccgcaatgcgttcatccagtacatcgagggtgacatggtcatccccaacgcggtgaccgagggcctcatcagcgcggccaaccgcccgctggtcggcgtctccgagccccgcacggtgcagacgtacctggcggaggacgggatgggcctgccgacgaacgtgcgtcacgcgttcttcggcatcgtggacccgtcgctggaccccagctcggcggccagccagttcctccggtccgtgcgcaacaccgcgcagaaccaggtcatccagttcctgaacacgggcgtcgcgtcgcccaccccgtaa

SEQ ID NO: 9109 - DNA, 699 bp, Myxococcus xanthus
atggtggggacgggggcggtcgcgtttccggtgcaggtgccggatggcgcccagggcgaggggccggaggtgacggagctgcgcgcgaaactggccgagcgcgacgccgagttgaaggcgaccctggcgaagctgcacctctacgaggatgaggcccactacgccgaggccgaggccctgggcatcacggagatggtgaaggcctctgggctccccgcccggcagcagcgccggctggcggtggccatcgtccgcgaggcggctcgcaacgacatcgacccgctcctggtggtggcagtgatccgctgcgagagttccttcaacaactacgcggtctcccacgtcggggccatgggcctgatgcaggtgatgccggacaccggcacctggctggcggacaaggccggcctgcaactgggccgcaccagcaacctcttcgactcggagaccaacgtggagctggggaccgcgtacctggcggacctcatccagcgcttcggcaccgtggagaaggccctggtcgcctacaacgccggccccgggctggcccgccgcatcctggccaagaaggaagcgcgcacgaagttcctggccggctaccccgccaaggtcgtgaaggaattccgcaagctgaaggccgctcaggagaagcagctcactctgcgagaggcccagaagacgaatggccagaagagctga

SEQ ID NO: 9110 - DNA, 1194 bp, Myxococcus xanthus
atgaagaagacactctccctcatcacgttgctcgccgccgggacgacccaggccgcgggcttccaggtcaacacccagagcgcacgctcctcgggcatggccaacgcggcggcggcgtggctggatgactcgtccgccatctactccaacgcggccaacatcctgggcgtggagaagctggacgtcaccgcgggcgtcaccggcatcctccccagcctgcagttcacccccacgggtggctccgtgcaggggcagaagacgacgctgtctccgccgccgcacgtgttcgccgtgtacaaaatcacggactcgctggcggccggcgtgggcttctacacgccgttcggcgcgagcagccggtggaaagacgacttcgtgggccgcttccgcgcccaggagtccgggctgtccatctacaacatcaaccccacggtggcgtaccaggtgcacgaccgcttccgcgtgggcgcgggcctgaacatcacccgcggcacgctggagattaagcgcgcgctgggattcgtcaccagcgaaggccaggtgcacctgggcggcgcgggctggggcctcggcttcaacgccggtgtccaggccgtggtggtccccaagctcgtgacgttgggcgtgcagtaccgcagccccatcagcatgacgttcaagggcgacgcggacttccgggacgtgccgccggccttccagggccgtctgccggacacccgcgtggagggtgacgtcaagctgccgcagtcggtggtggcgggcatcgccgtcacgccgctggaccgcctgacgcttgcgttcgacgccaactgggtgggctggtccagcttcccggagctcgccatcgagttcccggacaacccggccatcaacaacccgctgccgaagaactggcgctcgacgtggaacttccacctgggcggtgagtacggcatcaccgacgcgctgcaggtgcgcgccggcgtgctgtgggacccggcgcccagcccggatgagacgctgacgccggacctgccggacgcgaaccgcttcggcgtgtcggcgggcgtgggctacagcttcggcgcggtgcgcgtcgacgccgcctaccagttcgtcaacctgttcgacaaggacagcacggcgccgggcatgacgggcgtctacaacggcacggcccaggtgttcggcctgacgctcggctactccatgtag

SEQ ID NO: 9111 - DNA, 228 bp, Myxococcus xanthus
gcaggtggcacacacctctatctctcctacgcgtgcccgtgggccagccggctggccgtcatccgcaagctgaagaagcgggagtgcgccatcggcctgacggtggtggacccgcgcatgggcgatgacgggtggaccttccagggcgaacccggctccgacccggagcccttctgtggcttcgagttcctgcgggagccccacgacaggacattgggtttcggatga

SEQ ID NO: 9112 - DNA, 528 bp, Myxococcus xanthus
atgaaccgactattgggtgtgctggtggtggccgttgccgtggtggcgcatgcggaggatgcggggggcctgaagtggacggcgcccgcggactgggcggtgcagggagcccggccgatgcgcgcggcgacgtacaagattcccgcggcgaagggcgacacggagggcgcggagctggccgtcttctacttcggtcagggccagggcggcgcggtggacgccaacgtgaagcgctgggtgggccagttccagacggcggacggcaagcccattccccaggagaagtcgaagacgaaggcggagaaggtcaacggcatgacgttgacgacggtggacgtgaagggcacgtacacgggcggcgggccgatgatgggcccctcgacgcccaagcccggcttccggctgctgggcgccatcatcgagggcgcccagggcgccgtcttcttcaagctgacgggcccggagaagacggtggccgcttcggagaagtccttccgcaagctgctggagtcggtggagaagcagtag

SEQ ID NO: 9113 - DNA, 1218 bp, Myxococcus xanthus
atggcgcacgtgcacggcgcggacaggcagcgggccgtccagctcgccagcgagggcaggttggaggaggccctggcggaataccagggcgtggtgaaggacgggccggacgacgcggaggtgcgtcagaaggtggcggagctgctggagtggctcggccgttccgcggatgctgtcgccgcgtaccaggaggccgcgctggcttggacgaaggcgggtcagcccttgcgcgcggtggccgcgtgcgtggccttgccccggctgggcgcgccccaggccgcgctcgtgcgcaccgcgcgcgtgctggcggagcgcttcgccctgccgccgggcgctgcggtgcccgtggaggccacccgggcgcatgtcgcggaggatggcgccaccgggctgcccatcctctcgcaggtgagccgggagaccttcgtcgcgctgctcgaggtgctccaggtgcgcgccttctttccggggcagacggtggtggaggaggggacgccgggcgcctccatgttcgccctggtggagggccgcgcggacgtggtgcgcgcgctggaggacggccaacggcggagcgtgggcaccgtgacgcccggggacttcttcggggagctggcgctcatctccgaggggcccaggctcgccaccgtggtggccaccgagcgcgcggtgctgttggagctcacgcgccagcacatggaggcggtggcggcgcggcacccggacgtgacggcggtggtggacgccttctaccggcggcggatggtggagaacctgctgcgcagcaacccgctcttcaatcagctgtcgcccgcgcagaaggccgcggtgtcgcgcgacttcgagctgcgctcctttgccgcgggcgaggcgctgatgacgcagggccagccgggagacgccttctacgtgctgctgcgtgggcgctgcacgccgtggctggagcagcctcatggacggcgcgtggcgctgtccgcgctgcgagagggcgacgtcttcggtgaaatctccctgctgctggacaagccggtgtccgcgacggtgcgcgcggacgtggcgggcgtggtgctgcggctggagcgcgacgccttccagaagcacctgctcagccagccaggcctcaagggccagttgatgcgcatgggcacggagcggctccagcgcaccgcgcaggcgctggcctccgggcgggtgctgcacgacggagacctgcgcgtctga

SEQ ID NO: 9114 - DNA, 939 bp, Myxococcus xanthus
gcggatggcgccgcggccgacgtcgcacagctccacgagcaggcgggcgcgctgctcctggccgcggaggcgtggctgcgcgcgggtgaaccggcccgggcggcggcggccttcgagcgcggcggtgcgctggagcgggcgctgtcgctgtacgagtcgctgcaggcgcgcgaggccatggcccgctgtctcacccggctgcgccgtcccatggaggccgccgcggtgtaccgcgagctgggcaacccgcacgcagagctggagtccctgcgtgctgtgtctccggacatcgcggtggcgcggcgtgaggcggtgctgcggatgagcgcgctgctcgacgcgcagggggagtcgtggcgggcgttggtgctgctggcggatgcgctccaggcgccggagcttcggggtgacatcgcgctccaggcggaacactcgcggctgctgcgccacctgaacctgaatggcggtccgtcggtggagcccgcccgcgcgccgccactgccgccgccgccgccggacggctacgaatacctcaaggccattcctctcttcggcgagttgtccctggtggacatgaaggacctctaccaactggcgcggccgttgcagttcgcgcagggggccacggtgctggagaagggcgcgcccggctcggggctgctggtgctgttggaggggacggtggacgtgctcgccggtccggagcccggtgcccggttgctcaacacgctggggcctggagccttcatcggcgaagtctccctcatcctggacggagacacgtccgcgcaggtgtgtgcgcgcacggacgtgcgggccttgcgggtgacgcgcgtggacttccagcactacctggacacgcacgaggcggccgcgctgcgcatcctccgcctcttcacggaaaagctcgcggagcgcgtgcgcgcgctcagcgcgtag

SEQ ID NO: 9115 - DNA, 1575 bp, Myxococcus xanthus
gtctgggcctacgtcgtgttcactgacaaccagccgcccgcggtgcgctccgcggtgatggccacggtggtgctgctggggctcgcgctgtggcggcgcgcggacgggctcaacggactggccgccgcggccgtggtgctggtggcctgggcgccctccagcgtggccgacctgtcgctgcggctgtcgttcctcgccgtactgggactggtgctgctgtcaccgccgctgcggcaggcgctgcccctggccgagcccgacccgtccgaaccccaccgcgtccggcgctggtggggacaggcgcaggagacggtggctcagacgctgtgcgcgagcgcggccgcgacgctgtcgggactccccatcgtcgcggcgaccttcggacgggtgagtatcgcggggctcatctcgaacgtggtcgccctgcccttgtgcgggctgctcacgggcctggccgcgggtggcgccgcgctcttcgtcgtcgcccccgtgctggcgacaccggtgctgtgggccggcgcttgggcgtccgagctgctgctggtcatcacccggctcttcgcggcggcgccgctggcctcggtcgaggtgccgtcactgggcttcctgtcggcgctctacgcggcgggactgctgacgtgggcgctcggcacggggcgctggcggctgggtggtttgttggctcccgcggccgtcgtcgccgccatcctggcaccggtgctcacgccgcagcccgggctccgcgtcacctttctctacgtgggtcagggcgacggcgtggtcgtcagctccggtggtgagcacatgctcgtggatggcggcggcgttccaggcggcatggacaccgcggaacgcttcatcctcccgtacctgaagcacgcgggcatctcccagttggacctcgccgtgctgtcacatccgcatccggaccatgcgctcgggctggcatccgcgttgaaacagattcccacccagcgactgtggatgcccgcgggcgacggagacggcccgctctcgcggcaggtggtggctgcggcggggacggcgctcgtggaggaagtcgaggtgggccatccacccctgcgcctgggcgaggcgaccatcgaagtgctcgggccaccagcgttggagacacgcgacctgctggaaggcgcgaacgaccgaagcgtggtgctccttgtgcgccacggcgacgtcaccgtgctgctcacgggcgacgtggaggcggatggcgaggagtccctggcggaactgttgggtccggtgacggtgatgaaggcccctcaccacggctcacggacgtcctccacggaagccctgctggcacgcacacgcccacggcacgtcgtcttctgcgtgggccggcgcaaccggtacgggttcccccacgacgacgtggaggcgcgataccgggcgctgggaagcgagtgctggagaactgaccagcatggcgccatcaccgtggaaagcgacggccaggacgtccgcctgctcaccttcctgccccacgagccctctccccgggccacaccggttgcgcgggctggggacccatcaccagattggggccgatga

SEQ ID NO: 9116 - DNA, 255 bp, Myxococcus xanthus
atgattccagaggatatcgacctccagcagctcaccgccgacctgaagaacgcgctcggcccgggagaacccatcgggtacctccgtggcaagtccgtgatgcgcaacctgctcgtggacatgcgcggcttctcgcagttggaggcggaggagctcatcgacacgatggagactcgcggcttcctccgcttcctgggggaccccaccgagcggtccgtcgcggaagcgcactgggacatcagcccccacgcgtga

SEQ ID NO: 9117 - DNA, 534 bp, Myxococcus xanthus
atgcgcggactgacgttcctggtgggcggcggtgtcgagggctacacgagcgcactgggctccgacatcaacccgggccttggctacggcgtgacggtggccatcaagcccacgaaggtgctgggcatcgagctgggctactcgggtgccctcaacgagttcgaccagcgcgtggtgacgggcgcccgaagcggcccggacctggtacgaaacggcgcgcacgtggtggccacgctgggcctgggtgccgcgcccgtgcagccctacgtcctgggcggcgtgggcatcagccggtacaacgtgcgggcacccacggtcgccttcgcggatgacacggcgggcaacatcccgttgggcggcggcctgcgcgtccacatgggcaacttcaccgccgatgcccggctccagtacagcttcctcctggaccagcagttcgcggcgaacgccccgcccggcgacgtcacgattggcgaccggaacttcagcagcggcggcagctacgcgggcaccgtcaacatcggcgcgacctggtag

SEQ ID NO: 9118 - DNA, 759 bp, Myxococcus xanthus
ctcacggcggagtggcggtatctcgtcatgctcaactacgaggtggacccggaggtactgcgccccctcgtccctcgtgacacggagctggacacctggcagggccggaccttcgccagcatggtgggcttccgattcctcgacacgcgcgtgcggggactgcccgtgccgttccaccgcaacttcgatgaggtgaacctgcgcttctacgtgcgccacctcggccctgaaggctggcggcgaggcgtggtgttcgtgaaggaaatcgtcccgcgacaagccatcgccaccgtggcgcgcgtgctctacaacgagccgtatgtcgcgctgcccatgcggcacgtcgtggagatggaaggcgcgcacaccggcgcccctggccgcgtcgaatatgcgtggaaggcggggggaaagtggcagcacctggcggcgacgacgctcggtccgccgcaggccagcgagcctggctcggcggcggagttcatcaccgagcactactggggctacaccgcgcaacgggacggcggctgcgcggagtaccgcgtggagcatccccgctggtccgtgtggcaggtggacaccaccgcgctcgagattgacgtggaaggcatgtacggcgcgaggttcgtccccttcctgcgcggcaagcccagctccgccttcgtcgcggacggctcggccgtggccgtgtatcccggcacgcgaacgggctccggtgccagccagtcgccagcctccgagaagccgcgcgccgcctga

SEQ ID NO: 9119 - DNA, 711 bp, Myxococcus xanthus
atggtcgaggccgcgcgcaccttctccgtcaatggcgtgctggtccctccgggtgtcccgaggctggtgattcccggagaggcgctcggcctgcccgacgacatgggactgcgcgtgcttcaagaggccgtcagtgagcgcgggctgggcaccgtggcgctcctcaagggattgctgacgggaacggatgaaccggccccatcgcgcgcggccaccctcacctgcctcacgggactggatgtcgggcgcgtccatgcgctcgccgaggaacagacggacatcggccgaggcagcgacgtggcgatgcggctgagagaccgggccgtgtccaggacgcatgcgcgcgtcctccacggcgagggaggattctccctggaggacctgggcagccccaacggcgtcttcctcaacggccagcgcgtcgactcccgggttccgttggcggatggcgacgtcattgaaatgggccgttcactgctccgcttccaggccgccgtggaagagcccccgccccccgcctcgcctgctggcgagcaggaaccgccctctggcgcggtcagccccgcttccaccgaggtcacgctggagcccacgcccgaggcacctcccagcgtgcccaagcctcgcggcgaatggtggctgattggactgggcgcggtggcggcctccgtgggcgtggccgtcacgtggctgctcgcgacgggaagctga

SEQ ID NO: 9120 - DNA, 1035 bp, Myxococcus xanthus
atggcgctggaactggagcgcagcttgctgcgcgagcgcgccctgtcgcagaagctgccgccggcccccggcgggcgcggcggggatgaggtgggcttccgcagcgccgccatgcagcgggtgatggagctggtgcgcctggtggcgccccaccgcgtggccgtgctgctccaaggcgagacgggcacgggcaaggaggtgctggcgcgcatcctccaccggctcagtggccggggggacgtgccgctcgtggtgcaggactgcggcgcgctgtcggagacgctgctggagagcgagctcttcggccacgtgaagggctccttcacgggcgcggtggcggaccaccccgggctcttcgtgctcgccaacggcggcaccatcttcctggacgaaatcgagaacaccaccgccaacctccaggccaagctcctccgcgtgctggagacgggggacgtgcgtccggtgggcggcacccaggtgcgccacgtggacgtgcgcgtggtggccgccagcaacaaggacatgggcgaggaagtgcgcgccggccgcttccgcgcggacctcttctaccggctcaacagcttcaccgtggacatccccccgctgcgggacaggccggaggacgttccggagctggcgctctacttcctggaggtgttcaaccgcaccttgcgccgctcagccagcggcatcgcgccggacgcggtggacgcgttgcgggcctacgcctggccgggcaacgtgcgcgagctgcgcaacgtcatggagcgctcggtgctgctctcccgcccgggcgaggtggtgtcgcggcggctgctgccgccggtgctgggctccaccctggccctgcgcaacgagccgggtggggatggctcgctgcgcgcgcggttggatcgggtggagcgggagttcatccgcgaggccctggagcgccacggcggggtgctgcggcgcgcggccgtggcgctggggatggacccggtgacgctgggccggcgggtccggcgccacggcttgtggaaaggagacagctag

SEQ ID NO: 9121 - DNA, 462 bp, Myxococcus xanthus
tcctgctacgtggaggcgctcgacttcacgcgcgaccgcatcgacatgcgcgcggtgcaggggcagtggaacacctttggcatggagcgcgagcgcgaaatcctcatcgcgcgccgcaatggcgtggccgtgggcgccgccgtcctggagctgggccagcagggcaccaatctctacagcctgctcgacatggcacggctgttccccctgagcgacgcggggccgtccacctacgtcgccctggtggatgcggcacgccgttggtacgccgcccgccaccgccgttcgttccactatctctgtgaggacgacggtgggcagtacgtacaggacgccgggattcacgcaggtccggacccgtacatgtggatcatctccgcgaagctgatccccgactatctcgaacacatcagtgaagtctccatcgggcgccgaagcgctcccaacactcgccaggggtaa

SEQ ID NO: 9122 - DNA, 1203 bp, Myxococcus xanthus
atgcgtctcccgtcctccgtcctcgctccgctgctggccgtcacctgtcttgccaccgcctgtcgtgatgagcatgccgggccgcgtcagcagacgccccgcattcccgcgcccacgcagctccgcaccctggacgcggcgcccgcggacctcacgttccgcagcggcgcgacgttcgccggtggcgcggtggtgtacctgggctccaaggtgtcaccggagaaggccgcgcccggaacgcaggtgaggttggcccattacttccgagcggttcgtccgccgccgcagggcttcgccttcttcgtccacgtcgtggacccggccagtggcggcatgctcacgaacgcggaccatgaggtacaggggggcgccgcgccgctggcgtcatggccggtgggcaaggtcatcgaggacgtccactcggtgcccatgccgggcacgcccgcgcgcgtgatgctcggcttctggcggggaggctcccggctgcccgtggacgacgccaatgcgcatgacggctcgcagcggatgttggggcctcagttgggcggggccgcgcaggagctgcccgagtactccgtcccacgcgtgagccagccgcccaccatcgacggcgtgctcgatgacgcggcgtggaagcagtccaaaccggtggtgctgcgccggagcttcgacgggagcgccgcgcgccagcgcaccgaggcgcggctcgtccatgacggcaagttcctctacgtggccttcgacctggatgacccggacgtgtggggcacgctgcgcaagcgcgatgaccccatctacgaggaggaggtggtggaaatcttcctcgacgcgaacgcggatggccgcacatacaacgaactccaggtgtctccgcacaacgtcatcttcgacgcgtacttccccgcccgtcggcagggcatggaccgctcctgggattcagggatgacgtccgccgtgaaggtgcggggcacgttggatgatgactcggaccgtgacgagggctggtcggtggagatgcagattcccttcgaccggctggccgaagtcccgcacattccgccccagccgggtgaccgctggcgcttcaacctctaccggttggagcaccatgaccgccgcacggtggaggggcagtccttctcgcccctcttcgtcggcgatttccatgcgctgccgcgcttcggttggctcgtgttcgaatag

SEQ ID NO: 9123 - DNA, 243 bp, Myxococcus xanthus
atgtactacgggcgcacgcacatcgtcgtggatgcccggggcttgacctaccgaggcatggtgcggacgcggcgcttcaccttcgcggacatccgcaagctcgatgtcctgcccggaccggtgactgtctacgccatccggggcaaggcgggcctcgtccacttcaccagcttcttcatgcaccatcagcagctcgcgcggctcctcgtggagcgcgcggggctggggcccattccaggctga

SEQ ID NO: 9124 - DNA, 1317 bp, Myxococcus xanthus
atggtcgtcttgcgcagcttcgtcatcgcgctgtccgcggcaatgctgctgggggctgcggagccatccgccgcggcccgggccgccttcgtgcgcggggagtcggcgctggcacgtggccgctgggatgacgcggccaccgcctaccgcgaggccctggccgacacgcccggctatccctccgccctcaatggcctgggcagcgtgctcttccgcaaggggcaggtgcaggaggcgctcacgctctttcgtgacgccgcgaaggccgaccccggcttcaagatggcctggttcaacctgggctatgccgcgcggaagacgggggatgcggccaccgcggcacaggcctacgagcgctacaccgagctcgagcccggcgacgcggacgggttctacgggttgggggagagttaccggcagctcggccagaaggacaaggcgattcccgcgtaccaggcgtacatcgcccgtgagcagcgcaagggggagcaggtctgggtccgcaaggcgaccgagcacctgaaggccatgggtgccgagccgctcgcggtggccaccgcgccggcctctgcgacgccctcggcggcgcccgccgcggaatccgtgacgtccaatccggcgctggcggcgtcgcgcatccgtgacggcgacgccttgatgaaggagcgccgctaccgcgaggcggccttcgccttcctggatgcgtcccacgcggatgggggccatgtggaggccttgttcaagctgggcaacgccttggcggtgctgggctattacggacaggcggtggcgcagtgggagcgggccaccgcgctcacgaaggacgcggccatccagcagagcgcgaaggagaacatcgaccgcgcgcgggcgaagatggtgcaggcgggcgtttctccccaggccgcgggacaggcaccgggctccggccccgtgtccgacacgacgcgcgcgttggcgcgccgggcgtatgatcagggcgtacagcgcatcggcagcaaggacttcagtggcgctctgaccagcctcacccagtccatccaactcgagcccatgctgaccgtggccttcgtcgctcgaggcagcgccaacatcagcgtgtgtcgctactcggaagccgcggcggactatcagtacgccttggagctggagcccggctcggcgtctccgctttacggactggccgaatctttccgcgccatgggccgcacgctggaggcacgcgacctctacgagcgctatgctgcctcctcctccgcggacgtccgcccccagctccaggaggaatcccgacagaaggcggcgcgcctgcgttga

SEQ ID NO: 9125 - DNA, 1311 bp, Myxococcus xanthus
atgccgaacgtcgtcgtcatcggagcgcagtggggagatgaggggaagggcaaggtcgttgacctgctcaccgagcacgcccaggtcgtcgtccgcttccagggcggcaacaacgcgggccacacgctggtggtgggtgggcagaagacagtcctccacctgattccctcgggtatcctccaccctgggaagacgtgtgtgattggcaacggagtggtggtggatcctgccgtcctcgtcggggagattgacgcgctgaaggtgcgcggcttcctcaaggacgacgcgcagctcctcatctccgacaatgcccacgtcatcttcccgtggcacaagctgctggacagcttccgcgagaaggcgcgcggcggcagcgccattggcaccacgggccggggcattggccccgcgtacgaggacaaggtggcccgtcgcggcatccgcgtgcgggacctgctcaacgcggaccggctgcgcacgcgcatcgaggcccggctgccggcggcgctggacgagctgaaggacctgtgcgcgcaggcgggcgacccggtgccgcagctcgaggtgccgcagatactggcggagttcaccggcctgggcgagcggctcaagcccttcgtccacgacgcctcgctctatctgtccggtcaggtgcgccgcggcgcccgcatcctcttcgagggcgcgcagggcacgctgctggacgtggaccacggcacctatcccttcgtgacgtcctccaactgcgtggcgggcaacgcggcggtgggctcgggcctggggcccacggccatcgacaaggtgatgggcatcagcaaggcctacaccacgcgcgtgggcggcggtccgttccccacggagctgcacgacgccatcggcgaccagttgcgcaagatgggcgacgagttcggcacgaccacgggtcggccccgtcgctgcgggtggctggacggcgtggtgctgcgctacgcctcgcgcgtcaatggcctgtggggcatggccctcaccaagctggacgtgctcagcggcctcaagacgctgcagatctgcaccgcgtacgagctggacggccagaaggtgatggagctgcccggcgactacgaggacctggcgcgcgtcaagcccatctacgagacgctccagggctgggacgagcagatcgccggcgtgcggaccttcgacgagctgccggagaacgccaagcgctacgtgcgccgggtggaggaggtcagcggcgtccccgtggtgtgcgtctccgtgggcgctgaccgcggtgagacggtgctgctccagaacccgttccggagctga

SEQ ID NO: 9126 - DNA, 1278 bp, Myxococcus xanthus
gtggtggtggtgccctcgatgggcggccggaggcgtggcacctcgggccgtgcccacttcgagcgcacgcatggcatctccctgcgaccgtgggttccggattcgctggacgactacacctccagccgcttcgacgcggtgcgcgcggagctgaaggcgcgcgaggacgccgagtaccgccgcctgctctacgtcgcgctcacgcgtgccaaggacatgttggtgctggcgggcggcgcggagccacgcggtggcaaggactcctggtggcacctcatcgacgggcgcctggaggtggacgcggacctgcgtgacctggtcgatgagctggacgtcgacacgctccctccaccggcggacccggagccgcccggtcctgaggccctgttgctcgccgaggcgcgcgtcgaagccgcgctgctgcgggtgcgaggtcagcgtgtcgcgcaagcggaatcactgggcgccgcggtggcttccgcggaggcgttgcaggacttcatcgcctgtccgcgccgcttccactacgtgcaccggctggggcttcgcggtgcgccgtggccctgggaagtgctgccccgtggcgcgccgcccctggtggagcctgacggctggcttcccgccgagcgtcccgaggacctggtgcagcggctgcttcgcggcgtcgacctccgattggcggcgccggatgtagacgcttcggagcggcgggcccacctggagacgctgctgcgtgacgcgggcgcgcttccggacgaagagggcatggatgcggtgctgaacaccttggagcgcttcctgacgtcggcgttcgcacgtgaactggcgcgggcgccgtcacagacaattcaccgaagccttccgttcatgcttgccctggagggcgaggtgggggtcgagggggcggtggacctgctgtgggagtcaccccaaggggaggccgtggtggtggccttcaaacacggcgggcgtcatccgctgggagcggccgcgtacacctacgagctggcggccctggggctggtggcccggcggatggtgcgagaaggggtgccggtgcgggtgggagtcgtcttcctgaaagagtcccagccagagcctgagtggctgtccgggcccaggggcctggaggaggccgccgggcggctcgcgggggcagcacgggcagtggcacgcggcgaagcgaggggtgaatgggatgggagggagaaggcagcctgccaagccctgcattgtggcttcgcggaacactgtcacccggccccccgcgcgtgctaa

SEQ ID NO: 9127 - DNA, 732 bp, Myxococcus xanthus
atgtggacggcggccctggtgttcgcgctcggcgcgacgggcgcccaggcgcaggactcgaagtcggcgaagaagcccgcggccaaggccgcaccggcgactccggccgccgcgccggcggcgcccgctgcgctgtccgaggaggaccagcagaccctctacacgctcggtctctccattggccgtgatttgtccctcttcgcgctgtcgcccgaggagttgaaggtgctgcaacagggcctgtccgacggactcggtggaaagacgtccgacatcgacccgaaggagcaggctcagcggattcaggccttcgccaagagccggcaggcccttgcgggcaaggccgcgctggagcgcgccgccaaggagcccggcgcggaggtgcttccctccggcgtcatctacaagcaggtccaggcgggaaccggccgcagcccgcgcgccgtcgacaccgtcaaggtccactacgagggccggctggtggacggcaccatcttcgacacctccgcccgccgtggaatccccgtcgagttcccgctcaacggcgtcatcccctgctggacgcagggcgtggcgaagatgaaggtgggcggcaaggcgaagctcacctgccctggcaacaccgcctacggtgagcggccgccctctggctcgcgcatcccgcccaacgccgtcctcaccttcgacgtcgagctcatcgacatccccggcgacacgtcccggcagccgtag

SEQ ID NO: 9128 - DNA, 354 bp, Myxococcus xanthus
atgcgcgtgaagaagggtgtcaaggcccgtcgtcgtcgtaataggattttgaagctggccaagggttaccgcggccgtcggaagaactgctacaagcgcgccaacgaggcggttgagcgggcgctggactacgccagccgcgaccgcatgcagcgcaagcgggacttccgtcgcctgtggatcgtccgcatcaacgcggccgcccgcacggtgggcctctcctattcgaagctgatcgcgggcctcgcgaaggcgaagatcggcctggaccgcaaggttctgtccgacatggccatcgcggatccgtcgggttttgcggccgtcgccaacatcgcgaagcaggccttacccaca

SEQ ID NO: 9129 - DNA, 1929 bp, Myxococcus xanthus
atgtccgacatcatcacggtgacgctccccgacggctcgcagaagcagacggcccgggggaccacgatcgcggacttcgtgcgggagagcatcggccccggcctggcgaaggccgccctcttcgcgcgcgtgaatggccaggacatggacctggcccgcaagctggacgaggacgtgaagctgcagatcttcacgcccaagagccccgagtccctggagttgatccgccacgacgccgcccacgtggtggccagcgcggtgcagaagctcttcccgggcacgcaggtgaccatcggtcccgcgacggaggagggcttctattacgatttcttccgcgagaagcccttcacgcccgaggacctggagaagatcgaggcagaggcgaacgccgagctgaagcgggacatggccttcgtccgcaccgaaatctccatggacgaggccgtgcgcctgttcgaggagaagggcgagaagttcaaggtcgagatcgtcaaggacatcgcggccaagggcgccaagacgctgacgctctacacgcacggtgactgggtggacttctgcctggggccccacgcgcccagcacggggaagatcggcatcatcaagatcctctcctccagcggagcgtactggaggggggaccaccgcaacccgatgctccagcgcgtctacggcactgccttcttcgacaagaagcaactggcggagtacctgacgcgcatcgaggagtcgaagaagcgcgaccaccgcaagctgggcaaggagctggacctcttccacttccacccgtactcgccgggctccgccttctggaccccgaagggcaccacgctctacaccacgctgtcgaactggatgcgtcagctgacgcagaacgacggctacgtggagatcaagacgcccctgatgttcaacaaggggctgtgggagaccagcggccactggggcaagtacaaggagaacatgttcctcgtgctcgacagcgagtcgggggagcatgacttctcgctcaagccgatgaactgcccgtcgcaccacctgttctacggcttcaagaagcacagctaccgcgacctgccgctgcgctaccacacgcaggacgtgctgcaccgcaacgaggcggcgggctccctgggcggcctcacgcgcgtgcgccagttcgcgcaggacgacgcgcacatctactgcacggaggcgcagatcaccgacgaggtgcggcgcttcgtgaagctcctggaccacgtctacaaggcggtgggcctcacctacgcggtgaagctatccacgcggcccgagcagcgcctgggcgatgactccctgtgggatcgcgccgagggcggcctcaaggccgcgctggagtcgctgggcctcgagtacgagctggccccgggtgacggcgcgttctacggcccgaagatcgacttcgcggtgtcggacagcatcggccgccggtggcagctgggcaccatgcagctggactacctggcgcccgagcgcttcgacctgacctacgtgggcgaggacaacgccgagcaccgccccgtggtgctccaccgcgccatcttcggctcgttcgagcgcttcacggccatcctcatcgagcacttcgccggcgccttcccggcctggctggcccccatccaggcggtgctggtgacggtggcggaccggcagaacgactacgctcggaaggttcgggactccttgagggcgaagggctaccgggtggagttcgacgagcgcggcctgtcgatgaacgcgaagatccgcgaagcccagctccagaaggtgccgttcaccctggtggtgggcgacaacgaggtgtcgggcgagggcgtgtcgccgcggcggtatggcggcgaggacctcaagacgatgaaggtgacggacttcgaggccctgctggcgaaggaagcggccctgccgtga

SEQ ID NO: 9130 - DNA, 699 bp, Myxococcus xanthus
ctggagtcgctacacaaggagatcaccgactgccgggcctgtccccggctggtggagtggcgggaggaggtggcgcgagtaaagcgccgcgcctaccgcgactggaattactggggattgcccgttcccggctttggagaccccaaggcccggctcatcatcgtcgggctggcgccggcggcccatggggcgaaccggacggggcggatgttcaccggagaccgctcgggcgacttcctctatgccgggttgcaccgcgcgggcttcgcgaatcaggccctcagcgagcaccgggatgacgggctccggctgaaggacgccttcatcgtgtcggcggcgcgctgtgctccgcccgacaacaagcccctcccagaggagctggcccgctgcgcaccgttcctggatcgcgagctggcgctgctgccgggccgggtgatgctcgcgctgggggccatcggctggaacgccgcgctcgtggccctggcgcggcaggggatggaggtaccgtcgcctcggcccgcgttcgggcatggggcggagctgcgcctgccgggcggccggacgctgctgggctgctaccacgtcagccagcagaacacgcagacggggcggctgaccccggcgatgttcgacgccgtcatgtcccgggtccacacgctgctggaaacggcggatccgaaggcgcgcgggaagagttga

SEQ ID NO: 9131 - DNA, 747 bp, Myxococcus xanthus
atgagcaagcaactcgtggaggagctgtacacgccgaacctgactgccacccgtgagcgcatcaagacggacccccggctgaaggtgctgctggatgacaaggcggaccccgcgctcttcgaggcattcctcatcacctggaactcgctgggcgtctacatgacggagccggtggacgggtggattcgccgcgccggtgaggccaccgtaaaggcgggcctggacgacgtgggccagaagctcatcgcccacgccaagcacgaggccggccaccacctgatgatggtcgaggacaccaagcacctggtggcccggtggaacgagcgccgcagccccaagctgaacgccgaggagctcatcgcccagccgcccacggaggcgatgaaggagtaccgggagattcacgagaacaccatcaccggtgagatgcccgccgcgcaggtggccatcgagtacgaaatcgagggcctgtcgacggtgctcggccccgtgattctcgagcaggccaagcgcgtctgtggcgaggaaatcctccagggcatgtccttcctcaaggagcacacggagattgacgtgggtcacaccgcgctcaacgaggtgatgctcaacaagctcctgtcgcaggtgccggacaaggcgcccatcatcgccaagacgggtgccagcgcgctcgacatctacctgcgcttcatgggcgactgcgtggagcgcgccgggaagctggtccagtccgccgccgcggcctga

SEQ ID NO: 9132 - DNA, 1059 bp, Myxococcus xanthus
ctgtggtggtcgggggtgatggtgggctcgctggggctggtgttcgcgctgctctccgtctttggcggagtggcggtgccagtgctgctcgcactgtcgggcgcgtacatcttcaatcccatcgtcaccgagttggagaagcggcggctggaccgcacgtgggggacgacgctcgtcttcgcggtggggacgctgatgctggtcggcgcggtgctgtacctcatcccggtgttccgggaggaggcgtcgaagctgccggacttcttccaccgcgcgagcacccaggtggtgccgaaggtggaagggttggtggggcattcgttgccggacctggtacgccagcgcaccaccgagctgggaaagcaggcgtcagagctggtccagagcgcggggccggcggcggcgcgcatcctggcgagcttcgcgggcaacacggcgcggctggtggtgacgttgctgggcctgtcggtggtgccggtgctggccttcttcttcctgcaggactacccccggctgatgggcatggtgaaggacctgctgccccggcgcgcagtgggactggtgagccggcgcttcgcggaggtggatgaggtgctctccgccttcgtgcgcggccaactcatcgtcggcggcgtgctgtcggtcatctatgcggcgggcctgtccgcggcgcgcatcgacatggccattgtcattggggtgattgccggcttcggcaacatggtgccgtacctgggcacgggcgtgggcatcgtgctgtcgctggtggggctcatgctgtcgtggcaggggccgtggcaactggcggcggtggcggccaccttcgtcatcgggcagatgctggagggcttcgtcatcaccccgcgaatcgtgggggagaaggtcgggctggcgccggtggcgatcatcctggccatcctcgccttcggtgagctgttcggcttcgtgggcatcctgctggcggtgccggtggcggccatcctcaaggtggtcctgagcgtggtggtggagcgctaccgccggacgcggctctacacgggggagcccaagtcgccgtga

SEQ ID NO: 9133 - DNA, 363 bp, Myxococcus xanthus
atgcggaaggttctgctgttggtgatggtgtccacgttcgctgggtgtgcgaagcgtcaggagcccgagtccctgctcaaggcccgcgagctgatggcggaagcccagaatcccagcggcaacctggcactgctctgcgagcccgtggacgcggaggtgtatctagatggcgtctggcaggggctctgcagcgacttctcgggttcccccaaggcgctgcgagtgggcagcggcctgcacgagattgaagtgaagaagcaggggtactggccctatacgacgtacttcgagcccagccgggcccgcgcgcggctgaccatccagctccgcgcctctgggccgaaggccggtggttcggagtga

SEQ ID NO: 9134 - DNA, 567 bp, Myxococcus xanthus
atggaccaggccgggcgcctccacatcagcgcggggcgcaccgtggcggacgagctggcccgcgacgacgtccgcaagcgagtggaggccgcgatgggcggctacaaggtcgtcgcccggcggttcttctccgacagtggcgtggagattgacgtggaggtgccgctgtcggccctcaccgcgtcgctgttcgcgccgcccgccgcggacaccgtcatcgccatcaacggcgcgggcgcgaagaagtacacaggcctggtggtagatgcgcgagggctcggtgtgcagcccgtgctggcgccccgcctcttggatgacagcggcaaggcgctctacggcgcggcggcgctggccagcgagcgccgtgccgcgacggccgtggccgcctggttccagagcctggatgcggcgaagaaggcctcgctggtgggggacaagcccctggtggtgaaggccaagggttccaaaggttccgacctggtgctcgcctcggaggatgcgaaggcgctcgtcgaggccaacacgcgcttcctggccgagggccgggtcgtgatcgtcacgcagtga

SEQ ID NO: 9135 - DNA, 336 bp, Myxococcus xanthus
atgagcgacaagcggaagaacaagcgggcgcccctcgacatctacctgaacaagtacatgggtggcgtgccgtacatgtcgcgggccgcggacatcagccaggaagggctgagcctcgcccggctgctcgagcctcagcacgaggccaagcgcatcggcctccagttccagctcccgggctcggaggagatcatctacgccgagggtgaagtggtccgtgagtgggccgagctgggggccaagcgcgagcgctcgggtgtgcgcttcacgttgctcaccgatcgtcaccgcaagatgatcgacgcctacgtcgaccgtcacggcaacgagaactga

SEQ ID NO: 9136 - DNA, 1983 bp, Myxococcus xanthus
atgacgtccacgttcgacgcggcggccctgaaggcggagctcgtgacgcggcacggcgaggcgcagcgggcccgcattgagcggggcgtggagcaggtggcggcgatgtggcggccggaggacggagacctcgcggcgttcgcacgtgaacagttcctgtccgatccgaacgcgctcgacgcgaccttccagcggctggagcggttgttcgagcagctcgacgggcacctgtacgaaatcgggcgcgagcttcagtggtacacggatttggacctggggccattgctgccggtggagcccctggtggcggcgtatgatccggccgcccacgtcaccacggacctgttccgcgcacgcgtggggttcgtggtgttgctcaacttcccgctcaccacgttggcggagcgcgtggagcaggggccgtcatggacgcggcggcagtgggccgagacgcggctggccgggcgcttcaaccagcgcgtccccgcggagattgaacaggcgtcctcgcgcgccatcgccgcggccaacctgtacatcgccgaatacaacatctggatgcatcacctggtggatgcgcagggacggcgccccttcccaaaggggctgcggctcatcagccactggaacctgcgtgacgagctgaagggtgactactccgacgcggcgacgggcgcgctgaagcagcggatgatcgtccaggtgatggagcgcatcatcacgcagacgattcccgcggccgtcatcgacaacccgcggttggattgggaccccttcaccaacaccgtcacggtggcgccgccgcagacggtggaggcggatgctcccgcgcgcacgacgaagccggatgcgtcgccggagccggacacgcgctacacgcacctgctggccaccttccatgcggcgcgtcaggcggacccctacgtgccggtggcacccacgcgaatcgcccggagcttcgagctgggccgcgagctgcctgaggcgcgcgtccgggccttgctgacacaggtgctggagtcaccgctggtgccgcgcgtggcgaaggagattgaagcgcgcctgggccggaagctggagccgcaggacctctggtactcgggcttcaatccgggcggcaagcggaaggagtccgaactggatgcgctgacgcgcaagcgctaccccacggcggaggcgttcgcgaaggacctgccgcgcatcctccagggcatgggcttcacgaaggcgaaggccgcgtggctggcggagcgaattcgcgtggacgcgtcgcgcggagcggggcacgcacagccggcgcttcggcgaggcgacttcccccggctgcgcacgcgcgtggagaaggggggcatggactacaagggctacaacatcgcggtgcacgagctggggcacaacgtggagcaggtgttcagcctctacggcgtggaccacacgctgctcgcgggggtgcccaacaacgccttcacggaggcgctggccttcgtgttccagtctcgcgacctggagttgctcggactgggcaagccggacgcggcgagcgagcgggagcgggtgctcggcgagctgtggcagacgtgggagcgcgcgggcatcgcgctggtggacatgtcggtgtggcactggatgtacgcgcacccggatgccacgcccgtgcagcttcgcgaggcggtggtgggcattgcccgcgaggtgtggaaccagtacttcgcgccggtgctgggcggggaggggagcacgctgctggccgtctacagccacatgatcagctatccgctctacctgcccgattatccgctgggccacctcatcgcgttccagattgaagagcacctgaagcgcaagggaccgctgggcgccgagttcgaacgcatggccacctacggctcggtgacgccggaccagtggatgattcatgcgaccggggccccggtgagcgcggagccgctgatccgcgccgccgaggccgccctgagtcgctga

SEQ ID NO: 9137 - DNA, 204 bp, Myxococcus xanthus
atggctactggtaccgtgaagtggttcaacgatgcgaagggtttcggtttcctcacgcaggacggtggtggtgaggacgtgttctgccaccacacggccatcaacatggatggcttccgcaccctgcaggagggtcagaaggtggagttcgaagtgacccgtggccccaagggcctgcaggcgcagaacgtccgcgcggcctga

SEQ ID NO: 9138 - DNA, 2070 bp, Myxococcus xanthus
ggccctttgttggcccccgcggggcgctcgcgcaagggcacctacctggacatcttcgcggcggcggcgcgcgcgggaatctcgcgggccatcgtcgacgggaagctcgcgtccacggatgacccgccgcgcctggcgaagacacgtgagcacgacatcgacctcgtcatgtacgagggcaagctgtcgaagctggagcgcgacgtcttcgagaaggcgctgggctggggccagggcgcggtgaaggtggacgccggcaagggcgagacgctgctgtccaccgagcgcacctgtcccaagtgcggcaccgccgtgccggagctggacccgcgctggttctccttcaacacgaagcagggccgctgcgagtcgtgcgagggcaccggcatccagggcggcgccgaggcgatggccgagggcgaagtcgcgccgtgtcgcacgtgcggtggcagccggctggcccccgtcccccggggcgtgcggctggagggcgcgcgctaccatgaggtggtgcagcagtccgtggcgtccacgctgacgcgggtgcgcggttggaagttcaagggggaccgggcgctcctgggcgagccgtcccgccaggagctgctgcgccgcatggaattcctggagcgcgtgggcctgggctacctgtccctggaccgcaacgcggccacgctgtcgggcggggagatgcagcggctgcgcctgtccgcgcaactgggcgcgggcctcaccggcgccatgtacgtgctggacgagcccaccatcggcctgcacccgcgcgacacgcaccggctgctggacaacctgcgcgccctggtggccacgggctccacggtgctggtggtggagcatgactcggacaccatccgcgcggcggaccatctgctggatttggggcccacgggcggccggggtggcgggcacatcctggcggaggggccgccggacgtggtgctggagagtgattcgcccaccgcgcgggccttgaaggagtcgcaggtgcggcctccctcgggtcggggcgaggcgaagcagtggattgagctcaagggcgcgcgggccaacaacctgaagcgcgtggacctgcggctgccggtggggcggctcaacgtggtgtccggcgtgtcgggctccgggaagagcacgctgattcgccaggtgctgtacccggcgctgcgcgagaagctggaccgcgtcacggcgaagcccggccccttcacctcgctgcacggggcggaggcggtgaagcgcgtgctgtcggtggaccagtcacccatcggccgcacgccgcgttcggtgccggcgacgttcctgggcatctgggacgagctgcgccgcgtgttcgcggccacgcccgaggcgaaaatcaagggcttcacgcccacgcgcttctccttcaactcggacagtggcggccggtgcaccgcgtgcgacgggcagggcgccatctcccatgagatgtccttcctcccggacgtggtgacgccgtgcgaggcctgcaacggcgcgcgcttcgacgcggccacgctggaggtgcgctaccacgggctcaccattggcgacgtgctgcgcctgtccgccgacgaggccaaggatgtcttcaaggcgctgccccgcgtggccgcgccgctggagtgtctggccgacctgggcgtgggctacctccaactcggccagggttccaacaccctgtccgggggtgaggcccagcgcttgaaactggcggccgagctgacggcctctgcccggcacgaacccacgctgtacgtgctggacgagcccaccaccggcctgcacctgggcgacgtggagaagctcatcaccttcatgggccggctggtggaccgcggcgacacgttggtggtcatcgagcaccacccgtccgtgattggcgcagcggaccacgtggtggagctggggcccgatggtggcgaggcgggaggccacatcgtcgcggagggcacgccccgcgaggtggcgaagcagaagacgcctaccggccgggtgctcaagtcgctcttttcggatgaggacacacgctcgcgtgccgcggcgcggcgggcgtga

SEQ ID NO: 9139 - DNA, 474 bp, Myxococcus xanthus
atgtccttccatcacctctccgccaaccggctcgacggcaagccggagacgctgtccggctaccagggcaaggtcgtcctggtggtgaacaccgcgtcggaatgtggctacacgccgcagtacgcgggcttggagaagctccaccaggaatacaaggacaagggcctggtggtggtgggcttcccgtccaacgactttggcggccaggagccgggctcgtcggaggagatcaagaagttctgtgagctccgctacaaggtcaccttccccatgttcgagaaggtgaagacgaagggggacggccagtcgcccgtctacgcgttcctgtcgcagcaccaccccgcgcccaagtggaatttccacaagtacgtggtgggcaaggacggccaggtgaaggccggcttccccagtgcggtgacgccggacagcgcggagctgaaggcggccatcgacagcgcgctcgcgcagccatag

SEQ ID NO: 9140 - DNA, 975 bp, Myxococcus xanthus
atggacacccgggacacggcgtggccgccgctgccgctggaggcgtggcaggacacctacgccacgttgcaccggtacacgcaggtcgtcggcaaggtgaagctggcgctgacgccgccgcagaaccactggtggaacgtcgcgttccgcgtgacggcgcggggcatgacgacggggctcattcccttcggaaatggcgccttcgaggtggacttcgacttcctctcgcacgagctgcacgtgcacgccacccgtggaccgtcccgggtgatggcgctggagccccggcccgtcgcggagttctaccgggacttcatggcgacgctgcgctccatgggcatcgacgtgcgcatctgggagcagcccgtcgagattcccgacgacaccacgcccttcggtaaggactggcaccacgccagctatgacggtgaagccgtggagcgctggtggcgggcgctgcttcaggccacgctcgtcttcgaggacttccgcgcgcgcttcaccggcaagtgcagcccggtgcacttcttctgggggagcttcgacctggcggtgacgcgcttctccggccggcccgcgcctgcgcgcatcggggcggaccccatcacccaggaggcttactgcgaggaggtcagcagcgcgggcttctggcccggcatgcaggccaccggcggcgcggccttctacagctatgcggccccggagccggagggcttcgcgcgcgccagcgtgcgcccggcccaggcccggtacgacgccaacatcaaggaatacctgttggcgtacgacgacgtgcggcgcgcggaggacccgaaggcgtacctgctcgacttcctccagagcacctacgaggcctgcgcggacctgggcggctgggagcgggagcgcctggagcggccgctcatcgtccccgagtccctgcgcgcggcccgcgccgtggaggagggaacggtcgccgagcagcccgcgccgtga

SEQ ID NO: 9141 - DNA, 519 bp, Myxococcus xanthus
atgctgcgccagcacggtgggcaggccggggtggacgcggtgctgcggcggctgccggcggaggaccaggcgctgctgaggcagatgctgcttcccgtcggctggtatcccctggagctgaaccttcggttggacgcggccatcgcgggggtgatgtcgcccgaggacaaggaccgggccttcctggagatggggcgcgcttccgcccatgaggcgctgcatggtccgcagcatgtcttcgtcaaggcaggcgagccgcacttcctgctgagccaggcgccgaaaatctaccgcttctattacgcggtgggctcacgcacctatgaacagacaggcccgtgcgccgcggtgctgcggaccttcggcgcggagaacgtcaccgagccggactgtctcaccatcatcggctggcacgagcgcgccatcgagctgtgtggcggccgcgccgtgcacgtcacccaccccatgtgccgcgcccggggcgcaccgcactgcgagtaccactgcacgtgggagtga

SEQ ID NO: 9142 - DNA, 762 bp, Myxococcus xanthus
atggctggcccctgcgcggtggaaggcgcggagcaggtgcagcacgccgcctcggtggtggccgccgcgggtgcccatgtcctgcgcggtggcgtattcaagcctcgcaccagtccctacgcattccagggcatgggtgagccgggcctgcacgtcctggcggaggccgggcgccgccacggcatgcccatcatcagtgaggtgatggagtcggcgcagattcccctcatggaggagtccacggacatcctccaggtgggtgcgcgcaacatgcagaactactcgctgcttcgggcgctggggaaggtgcgcaagcccgtgctgctcaaacgaggcctgtcggccacgttgcaggagtggctgctggccgccgagtacatcctcgacggcggcaacgaacaggtgatgctgtgcgagcgcggcatccgcaccttcgagacggagctgcgcaacacgctggacctggcggcggtggcctgggcgaagcagcgctcccacctgcccgtcatcgtcgacccgtcccatgcgacgggcgacccggcgctcatcctccccatgtcgctggcggccgcggccgcgggggcggacggattgttgattgaagtccacccgaagcccgagcaggccatgtgcgatgggcaccaggccctgacgcctgaacgcttcgagacgttgatgcggcggctgccagccgtgctagacgcggtggaccgacacctttggcggccggaaagcccggcccaggtcgtgagggcgcgatga

SEQ ID NO: 9143 - DNA, 174 bp, Myxococcus xanthus
atgccggacctgggggcgaagggcgccgcggcggggcaggtgcgccaggtgctggcgaagctccagcgagcgggcttcacgcgggcggcggcggtggcgatgtcgtcaccggtcgagggccttcacgtgcagaaggtggtggtgccgggcatgcgcatctcggagctcctatga

SEQ ID NO: 9144 - DNA, 1164 bp, Myxococcus xanthus
atgaagcggcgcgcggacaagctcgtggtgttcctggggccctcgcttccagaggctgaagcgaagcgactggcgccgtgcacggtgctgccccccgcgcgccagggggacgtgtggcgcgcgcagcggctgcggccccgggccatcgccctggtggatggcgtcttcgaggcacagccctcggtgtggcaccacgagctgctggcggcgctggaggcgggcgtggccgtcttcggaggcggcagcatgggcgccctgcgcgcggcggagctggcgccgcacggcgtggtgggcgtggggcgcatcttcgagtggtaccgcgacggcgacgtggtggacgactcggaggtggcgctgctgcacgcggatggtgagcacggctggcgtccgctcacggtgcccctggtcaacgtccggcacgcggcggcatgcgcggcccaggcccgggtgctgacgcgcgatgcggcccgggcgctcgtcgacgctggccagtccgtcttctaccaggagcggacgtgggcgcgggtgctggagaccgtggcacctcgctggtccgcgtccacccgggccgcgtgggacgcgtggtttccgcacggcgcggaggacctgaagcgacaggacgcgctcgcgtgcctccggacggcggcggagtgggtggcttcgggtgcgcccgcgccgcacggcgctccgcgcgagccgtcatccctggtccggcgtcgtcggctggtggatgacgtgacggcgacgcaggccggggccgtgtcctcgggtcaggtgctggacgtccttcgtgcgtccccgaacgcgccggcgctggccgaggcggggttgcggcgggcgctgctcgcgggctgggcgcgcaccctgggactgggcgtctccgatgccgaggtggcggaggaagaggcccgttggtggcaggcccagcgcgtgcccgtctcgcgccgtgaggcccacctcgcgcgcctgggattggacgcggtggggctgcggcggctgtgtggggagctcgcgctggagcggctcgtcctggcgcattcggcgcgcctgctgccggacggcccgtcctgggacgaagcgctggccgccgaggcccggctgagcggggcctgggcggacgccgccgaggctgtggacccaacggagcgcgttgggtcctcctga

SEQ ID NO: 9145 - DNA, 462 bp, Myxococcus xanthus
ccgggcagcgaggtcggcccctggcgcgtggtggcttcgctgggctcggggggcttcggccgggtcttccaggtggagcgggcgggccgccactactcgctgaagatggcgcttcgcccggcgggactccacgcggcggaggaagaggacatcaacggtcggctggcgcacgaggtcgcggcgctgctggcctgcgctccccatccgaacctcccggcactgcacgccgtggaccgctggcccgagcctcctgacggctacctgtacttcgtcaccgactacatcgatggcgagacgttccatgagtggcgctggcgggtgaagcccacggcggcgcacctgctgaccgtcttcacggagctggtgcgcgtggtggcggacctgcaccgccggggcgtgcaccaccgggacatgaagggcgacaacgtcctcatccgccgcgaggacgagcgccccacttag

SEQ ID NO: 9146 - DNA, 576 bp, Myxococcus xanthus
ctgctgacccgaatcgccccaccgctgctggcgctcgctgtcgccgcgtgctccagcatcgacgtgaacaccaactatgaccccaccgccacgcagaagctggaggggtaccgcacctatgcctggctcccacagcccacgggcaaggacgaccgcgtctacaaccccatcgtcggcgcgcgcgtcgagcagtcagtggaccgctacctgcagtcgcgcggctaccagaaggtggagtccactgccaacccggacttcctcatcggctggcacggcgccatccacaatgcgctgaaggcggagacggtggacgcctactacggctatccctggggcggtcccttcacggaccccttcttcgcgggcggcgccgtcaccatgccggagacggagctgcgtgagtacgaggagggttcgctcatcctcgacatcgtcgacccgcagtccaggcagctcgtctggcgcggcacggcccaggcggagctggacgagaatgccagcgcggagaagcagcagcggcggctggacgagtccgtgaaggaggtgctggagcgcttcccgcccaaggcgaagtga

SEQ ID NO: 9147 - DNA, 450 bp, Myxococcus xanthus
atgctggccctgctgccctgggtggcggtggccgcgcccaccgggcgcgaggcccgcgtcgaggagcggatggagcgcgcggagcagcggcatcggctgcggcaggtgctggagctgtcggacgtcctggacctggacaacgcgcaggcgctgaagctggaggagacgctacagcgcttcgacgagcgccgccgcccactgcgcaagcaggtgcgtgaagcggcgcgcatcctccaccgggcggcgcgaggtgacagtgaggccctggcgcaggtggacgcggcggcgctgggtgccttcgaggcacgcgagcgcatcgcggcgctcgacaaggagctgtacctggcgctggcgaagtcactcccccaggagaagcgcgcccggctcgcgctcgccctggcgcgcagcgagggccgccagaagatgaagcgggaacccgggaaggattag

SEQ ID NO: 9148 - DNA, 522 bp, Myxococcus xanthus
atggctgcgtgccctgaccaggaagagcggctggacctgcatgccgcgggggcgttggaggatgacgaggcgcttggactcatccagcacctggagggctgcgaggggtgccggcaggcgctcgcggcctccaaggagctgctctcgctggtggcgctgcccgcgctgtcaccccaggagaagacggagctccaggagctgccccggcgcacgctgtcggagtggcgccgcggcgcacggcgccagggtctgggcttgaagacgctgggcgcgctggtggccaccgtcgcggcggtgacgttggtactgctcgtgcccggcgcgtggcgggtgccaggcctgggactgaaggcgccggtgacggcgacggcggcgcccgccaccgacgtcgaggaactggacgcggagacgatggccgccatcgaggcctgggcgggactggagccgctggacgcggtgctgttcgaggactcccagggctgggacgaagagttcgacatcgatgtgggagagacgctgtga

SEQ ID NO: 9149 - DNA, 594 bp, Myxococcus xanthus
atggcccgggcgggcctggagcgtgcgccggacgaggcgctctgccgcgcattcctggagggcgatccggcggccttcgaggtgctggtgacgcggcaccgctcgctcgttttctcgctggtgcgccgctacgtgacgcgcccggaggacgcggcggacctggtgcagagcgccttcctgcgcgcgttggaggcctcgcgccgcgtcttcgcgcgcttcacgccgtcgggaccggcgcccttccgggcctggttggtgcgcatcgccctcaacctggcgaagaaccacgcccgtcaggtgcagcggtggcgcccggtgctggtggcctccgggccggatgacgtggtggaggacccgtcggagtccgctcaggaccggctggagcgagccgagcgcgagcggcaggttcgcgccgaggtgctcgccctgccccgccgccagcgcgaggtgctgacgctgcgcgtggacggcgggctggcattcaaggacatcgccgagacgctcggcatcacggagaacaatgcgaaggtgcagttccaccatgcgatgaagcgcctcaaggcgcgggtgggcgcgcccgaggagaagcactga

SEQ ID NO: 9150 - DNA, 5463 bp, Myxococcus xanthus
atgacgcgtctcgaaatcttgcaggcgctccagtcgggacggatggccttggcggacgccaagaaggcgttggccgccatcgaggcgcaggtgcagccggaggacttcggactggtggtcgcgggcgtgggcggcgtggaggccgcgcgcctgtcagcctgggccgtggcaccgccgtcgcctggggacatcaccatccaggtgcgcgcgtctgccctcaactaccccgacgtgatgtgtgtccgggggctgtaccccaccatgcccgaatacccgttcgtgccgggcttcgaggtggcgggtgtggtctccgccgtggggcccggcgtcgcccgcttcgcggtgggcgacgaggtcatcgccgtcacgggaccgctcctgggcggacacgcctccaaggtcaacgtgccggcggacaacgccgtgcggaagcccgcgacgttgacgttcgaggaggcttgcagcctgccggtggtcttttcgaccgtctattacgcttttgagatgggcaagctcgccgagggcgagcacgtgctggtgcagaccgcgaccggtggctgtgggctcatggccttgcagttggcccacctgaagcggtgcatctgtcacggcagctccagccgtgatgacaagcgcaaggtgctcgagcgcatcggcgttccacacgtcatcgactacaccggtgacttcgcgccggagattcggaatcagaccggtgggcggggcgtggacgtggtgctcaacatggtgtccggcgaggcgatccagaaggggatcgactccctggctcctttcgggcgctacctcgaaatcgcggtgcacgccctgaagaccagcccgaagctggacctgtcccggctggtgcagaaccagaccctccacagcatcgacctgcgcagggtcgggttcgccgggcgcctgggggcgcaccgcctgctggatgagatggccgccatggcgagcgcgggggagatcgttcccattgtctcgcgcgtctacccggtccggaagcttcaggacgccctccagtacgtgagcgagggcaagcacattggcaaggtggtcctcagtcacacggcggaggaggtcgtcgaccgcacggaggcgtgcatcgaggcgatggttcgccaccgcaagcgcttcgagtcctccgcgccttcgaagcccaccgtgccggtgtccccacctgaggttcggacggagcgcccggtgacccaggacatggagccggtggcggtgattgggatggcgggcaagttcccgcgcgcgagtgatcttgcgcagttctggcagaacatcgcccggggcgtggactgcatctcggaggtgcccgccgggcgctggtcggtggcggagcactacgacgccgacgggaacacgccggggaagagctacagcaagtggctgggcgtgctggaggatgcggagagcttcgacccgctcttcttcggcatctccccggcggaagccgagcggatggacccgcagcagcggctgtttctcgctgcgtgctggcactgtatcgaggacgcggccatccggccctcctcgttgtcggatacgcgctgcggcgtcttcgtgggctgcgggcccacggactacgggcgtgacctgcgtggcggtgacctcaacgcccaggcgctgatgggaggcgcgacgtccatcctcgccgcccgcatctcctacctgctgaacctcaagggcccctgcctggccattgaaacggcctgctcgtcttccctggtggccatctcgcaggcgtgtgacagcctcgtcctgcggaactgcgacctggccttggcgggtggtgtgaacgtcgccttcggaccggcgatgcacatcatgagcagcgacgccggcatgctgtcgaaggatggccgctgctttaccttcgatgcgcgcgcgaacggcttcgtccctggcgagggtgtgggcgtactcctgctcaagcggctgtcggatgccgtgcgcgacgacgacccgattgccggcgtcatccgggggtggggcgtcaatcaagacgggaagacgaatggcatcaccgcgcccagtgcgaagtcgcaggccgcgctcgagcgcgaggtgtatcgccgctttggcatcgacgcggacaccatttctctggtggaggcgcacggtaccggcactcggctgggcgaccccatcgaggtcgaggccctggtcgagtccttccgagagcactcggcgcggaagcactactgcgcgctgggctcggtgaagagcaacatcggccacctcatgacggctgccggcgtgtccggtgtgctcaaggtgctgatggccatgcggcatcagtccctgccgccgaccctccacttcgaggccgtcaatccgcacctcgcgctcgaaggctcgccgttctacgtcaacacggagctgaagccctggactggcgtccccgtcagacgggcctgtgtgagctcgttcggtttcagcggcaccaacgcgcacgtcgtgctggaggaggcaccgtcccagtcgcggaccgtcgcgggggatgccgtgtcaccggcggcgcccgtggtgttcacgctatcggcccggacggaggtgcagctcaaggagctggctcaatcgatggcggcgttcatctcggccacgccggacgtggaccttcgagacctgacgtacaccctgcaagtcggccgcgagatgctggagcaccggttggccatcctggcgggctcgcgggaagccttgcaggaggcgctggccgcgtatctctctggccggccgtcggcggccgtgctgtcggggcaggcgaagcgcacggcagcgagcatctccgccctggccgctgacgaggacggacgggtcctcttcgaaagctggctgcacaaggggaagctccggagggtcgcggacctctggacgcagggcgtggatgtcgactggcggcggctgtacgcgacgcacacgcctcgtcggctgcgcctcccggggtacccgttctcgaagaagcgttactccccgcccgtggtggaggcgcaggccgtctccacggtgagaggcggcgcggtgcttcaccccctcgtccaccgcaacagctccgtcctggctgagcagcgctacagcagcacgctccggggcgacgccttctacctggcggaccatcaggtcaacgggcgcaaagtcctgcccgccgcggcctatctggagatggctcgcttcgcggccagtgacgcatgggcggacgaagcggtgggccggatacctgtcctcaggaacatggtctggacctcgcccttggtggtggatgacgcggcggaggtcggagtcgcgcttcatgcgcaggatgcggggcggctgacgttcgagattcattccgcgcccgacgcagcgggggagcgcaccgtccattgccgcggtctggcggagttgcaggagcgcgtggcgccgcgccatgacctccggcggctggaggcggattgcaccctgcgcgtcctgagccgggagcagtgttacgagaccttcgcccggcttggtttgaactatgggcccggtcaccgtgcgcttgtccgggtgcgggtggggcacggccaagcgctgggcgaggtcgagctgcccgagcacctggtgggcgacggccgatcgttcgtgctgcaccccgcgctggtcgactccgcgctgcaagcggtggtcggtgtgttgggcgacgaaggcggcaccgcgcccgcgctgccgttcgcagtggaagaggtcgtggtccatggcccgtgcatcccaagaatgtgggcggtcgtgcggagcgggaccggggaggggatggcacggaagctcgacgtcgacttgtgcgacgaacagggcgctgtccgtgtctccatccacgcactctccctgcggcctcttcccgagcagccgtcggcctccgtggcaacgggactgttccagatggagtgggtgcctcgcgagctgcccgctggcgatgcggggacgttcgaacaccgtgttgtcatcctgtgcggcatgcagggcgtggacgtggcgcagctgtcatcgcggctcgacggtgcggagtgcgtggcggtggacgcgtcgcatgcctccgttgcggaccgcttcctccatgcgagcgcgcagttgctgggtgtgctccagcgagtcacgacatcaaggctctcgggcaaggcgctggtccaaatggtggccgcttcaggggccgacctgctgctgtatggcctgagtgggatgctcaagaccgcggcgctcgaggacgacaagatcgtgggccagacggtgctgctcgcacatcccgcttcttcgatcgaccagatggtcgaggtgttgcggaacgaggcgcgggggcttggttcaaactccgtgcgctacgacgagggccgccggttgctcgcgacctggaaggcccggtccaccgacgcggtcgccacggcttcctggccagacagtggcgtctacgtcatcagcggcggggcggggcgcctcggcttgcgggtcgcggaggagattgctcagcgcgcgcgtggagcgagcatcgtgctggtggggcgctcggcaccaacgtccgaagtggcggcgcgaatcgagcgcatcgccggcacagggacgcaggtggtgtaccgccaggcggacgtcggagacctgaccgcggtcgatgccctggtgcgagaggtccggagcgccttcggccccatcaaggccgtggtgcatgcggcgggcctcctgcgtgaccgctacctccgggacaagacctccgaggaactgcaggcagtggcgtggcccaaggtccggggcatcgtgaacctggacctggcgacgcgcggagagccgctggaactgttcctggtgttctcgtcgattgccggcgccatcggcaacatcggccaggcggactacgcggcggccaacgccttcatggatggctatgccgcgcaccgggacgcactggttcggactggcgaacgtgccgggcgcacgctgtcggtcaactggcccttctgggaggagggcggcatgcaggtcgatgccgccacggcgaagcgcaaggtccgtgagtgggggctggcggcactgtcgagcacccaggccttcgacgcgctctatcgcggcctgcgcacggatgcggcccagttgatggtgctctcggggcacctggaggccatccagcgccgactgaccttgtcggaggagggcggggcacatcgcgcggcgactggcgcggcgcgcgccgtgacgattgatgacgacaccctgaggacgcaggtccgccaggtcctcatgtcggtcgtgtcgaaggtcctcaagattccgttcgaggagctcgacgccgacgccgagctcaaggagatgggcttcgactccatctcgctgaccgacctcgcgcaccagcttgctggggagtaccggctggacctggctcccaccgtgttcttcgagcacccgaccatcaacgccctggtgggacggctggtgagcgagctccaa

SEQ ID NO: 9151 - DNA, 1239 bp, Myxococcus xanthus
atgggcttcttcggcacgggcggctgctcggtggaggagatcggccgggcgattgatgagattcaatcccagctgacgaagggtgagcccttcggcatgaacctgctggccagtcatggcgaatcgtccctggagctggagaccgtcaagctctacctggcccgaggtgtccgcaacgtcgaggccgccgcgttcacccaggcgacgccgtccctggtgttctaccgcgtcaagggactgcggcaggacgcccagggccgcgtcgtctgtgacaaccgcatcatggccaagctctcccgtccggaagtggccgaggtcttcatgtctccgccgcctcggcggttggtggagcagttgctccgcgacgcgatgattacgccggagcaggccgcgatggcggagcgcgttccgctcagccacgacatctgtgtggaggccgactccggtggccacacagacggcgcgattcccaccatcatcctgccgacgctgctgcggcttcgcgaccgactggtgagccggtacggctacgaagagcccatctgcatgggccaggcgggtggcatcggcacgccggaggccgccgccgcggcgttcatcatgggcgcggacttcatcctcaccggctccatcaatcagtgcacggtggagtccgggatgagctcggatgcgaagctgctcctccaggagatgggtgtgcaggacacggactatgcgcccgcgggcgatatgttcgagatgggcgccaaggtgcaggtgctcaagaaaggcgtcttcttcccggcgcgcgcgaacaagctctatgcgctctacacgcactacgacagcgtggatgacattccggagaaggtgcgcaagcagcttgagagcagcttcttcaagaagagcctttcgcaggtctgggaagacaccaaggtgtacctgcgccgcaagggccagcaggccacgattgacaaggcagaggcccatcccaagcagaagctggccctgatcttcaggtggtacttcgcttactcgacccggctcgccttcgctggcaccggcgaggaccgcgtgaactaccaggtgcacaccgggcccgcgctcggggccttcaaccagtgggtgaagggcaccgaattggagtccttcagcaaccgccacgcggacgtgattgccatgaagctgatgacggaagccgccgaatacctcaaccgccagtaccccaggttggccggccaggaaggggggcagtcatga

SEQ ID NO: 9152 - DNA, 2733 bp, Myxococcus xanthus
ctgtcaaagacgttgctgttcgagcatcggacgctcggggagctgaccgcacacctggcagaggctttcgctgaccgcctggcgggcatcttcggccttgccccatcggtcgaacagcgagaggaggccacgcgtccggccaagcgtgaaccggcgccccgagtgagtgacggaggcagccccacggacgtggccatcatcggtcttgcgggccgctacccgggcgcgagggacctcaacgccttctggcggaatctgcgtgaaggcgtggacagcatcggagaggttccgcaggaccgctgggatcacagcgccatcttcgacccggacaagtctcggccgggaaagacgtacagcaagtggggcggcttcatcgaaggcgcggcggagttcgacccccgcttcttcaacatccctcccaaggaggcccacttcatcgacccgcaggagcgcctcttcctggagtgcgcctatgcctgctgtgaggacgcgggctacacgcgggagtccctggcaaagctcggcggggaccgtgccggcggaagcgtgggcgtcttcgtgggcgtgatgtaccaggagtatcagttgtacggggcgcaggagacgattcagggacggcccctgtcgctgccgggaaacgcgtcgtccatcgccaaccgggtctcctactggttcgacttccacgggccgagcatggcggtggacacgatgtgttcctcgtcgctcacggcgcttcacctggcgatgcagagcctcgcgaacggagattgcgaggcggccctggtgggcggggtgaacctgtcggtgcatccgaacaagtacctgggtctcagccaggggcgcttcgtctccagcaaggggcgctgtgagagcttcggcgctggtggtgatggctacgttcccgcggagggtgtgggcgctgtcctgctcaagccgctggagcgggcgaaggcggatggtgaccgcatctatggtgtcatcaaggccacggcggtcaatcacggaggccggacggcgggcttcagcgtgccgaacccgaacgcgcaggcccaggtgattggacgcgcccttcgccgcgcgggtgtggatgctcgcacggtgggttacgtggaggcgcacggtacgggcacgtccctgggcgacccggtggagatcgcgggcctccagaaggcgttctccgagttcacctccgacaaggcgttctgcgccattggctcggtgaagtcgaacattggccactgtgagagcgctgcgggcattgctgggctgaccaaggtgctgctccagatgaagcaccgccagctggtgccgtcgctccactcccaggtgctcaacccgcacatcgacttcgatggaacggctttcgtcgtgcaacagcggctgacggagtggaagagcccggtgcaggagcacgagggccgccgcgtcacgcagcctcggcgcgccgcgctgtcgtcgttcggcgccgggggcgcgaacgcacacgtggtgttcgaggagtacgtggaggaggcgaatccgagggccactgatcgcgaaagccaggcaccggtggtcattctcctgtccgccacgctggaggctgggctccaggctcgggcccgccagctgctggactggatgcgcgaccccgagctgcgtcagggctcgctggatgacgtggcccatacattgctgaacggccgcgagcacatggtcgagcggctggccttcgtcgtcagcaccttcgcggaactggaggcggccttggaggacttcctggcggcggatggctcgcagccgaagtccaagggcaagcgcgtgtggcgcggacgggtcgagcgggtgtcgaatggactgacggacgccctcgttgacgaggacatgcagcagactgtcgacgcctgggtcgccaagcggaagttcgacaagctgctggacctctggaccgccggggtatccatcgactggagccgcctccatggcggctcgaagcctaggaaggtgtctctgccgacgtacccgttcgcccgggagcgctactgggtgccacggttcgacgagcgttcgactccggaacccaagcagcacgtggagctccccccggtgccgagcctcccccgcgagattcccgcgccggtcacgccacgcgctcggatcaagttggagcccgtgggccaggtctccgtggggaacggcgtcgaggcgcgtcgcctcccgccgatgcccaaggtcctgactccgacgcgctcgcccgaggacgcgcctccggtggtagcggaagtccgcgagcctgcgcgcgcgcccgtgcagcctgtctcggagccaccggtgcccgcaccgaagcgcccggcacctgttgcgcctcgcacgcccgcacccgccggcgtcacgctcgaacagttgcaagcggagttgaccgtcagcctggctcgcgcgcttttcctgcaaccctccgaggtggacctggacgtcgggttccgccacatcgggctggactccatcatcagcgtggagtggatccagtccgtcaacaagagctacggcatcaacgtcgcggcgacgcgggtgtatgactatccgaacatccgcgagttctcgaagtacctgggcaacgagattcaaaagacggtcagcgcgggcgctccggctcagggtgagccgccttcgttggatgagctgcttcgccaggtggaagccggcgagctggatccctccgtcgctcagcagttcctgacgaacagccaatcctga

SEQ ID NO: 9153 - DNA, 669 bp, Myxococcus xanthus
atgttctcttccatcgccacgaagtacgacgtgacgaatgaggtcctctcgttcggcatccaccggctgtggcgccggaaggccgtccggctcagcaccgcgaaggaaggagaccgcgtcctcgactgcgcttcgggcactggcgacctggccctggccttcaagcgcaaggtgggcgtgtccggccgtgtcgtgggcacggacttctgcccggagatgctggagagcgcccccgccaaggcggagaaggcgggcctccaggtggacttccaggtggccgacgcgatggacctgcccttcgcggccgacagcttcgacgtggcctccatctcgttcggcatccgcaacgtggatgacccggtgaagtgcctgaaggagatggcgcgggtggtccggcccggtggccacgtcgtggtgctggagttcggccagccgacgggggccttcggggccttgttccgcttctacagcaagacggtgatgcccacgattggagggctgctgacgggcaaccgcgccgcgtaccagtacctgcccaagacgtccgcctccttcccggccggtgacaagttcctggagttgatggaccagtccggggcctacgcggcaaagtccgcgcatgcgctcacgttcggcaccgcctacgtctatgtcggcaccgtccgctga

SEQ ID NO: 9154 - DNA, 786 bp, Myxococcus xanthus
caggcgcgggtagctattctccaagggctccggcagctcgccaccagcgaacggctgccgctctatttctacggcgtggaacgggatgacacgacgctgagagaggcgctcacctcggcgacgttccaggaaatcttcatctacgacgacaacgtcatggatgtcccgggggacaacttcgacgcctacctgggacagttcaagagcgacgtccggcgggtgctcaagaaggagatggctcacgctcgggatacgggcgttcgcttcgagcgcgtctcccggatgggagagatggcggagcaactggagcggttctacgaggtgacctactccaagtacggcaacgagcacctccgccatccatccacgttctgggcagcgctcgaccaacacgtctcgcccgaggccgaggctgtggtcgcctaccagaatggcgaccccatcggcttctccctgctactccacaagaacgatgagatgtggttctaccgggtcggccgcgccgaggccggggcatccgagacgccgctgtacttcaacctcgcattctacgagcccctgcgccgggcctatgagctcggcgtcaagaagctctggctgggcgccagcgggtacgagacgaagcggcgccgtggcgcgcgcaggcacgggctgtacagctacctgtggattccggggcgctggtcacgcacggtgcttcagccttacgtgtctgcctactcccgcgtggccatggccatggctgctagcggcacacagaatggccgcatccgcaagacgccctga

SEQ ID NO: 9155 - DNA, 3674 bp, Myxococcus xanthus
atggccgcccgcgtgcccggtgctgaagacgtggaggccttctggcgcctgctgcgtgagggcagggaggccatcaccttcttcaccagcgaagcgatgaaggcgttgggcgtggagcccggctggctggccaatccaaacttcgttcgcgcagcccctgtcctggagcggccggggcgcttcgacgcggctttgttcggatacgccccacgtgaggcggagttgctggacccgcagcaccgcatcttcctggagtgtgcctggtcggcgctggagcacgcgggctacgccccgggccggttgacggtctctaccggcgtcttcgcgggctccagcttgagcacttatctgctgttcaatctgctctcccgggcggagttccagcaggccgaggacacgttcccggccatggtcggtaacgacaaagacttcctggccacgcgcgtggcctatcacttcaatctcaaggggcccgcgctcaccgtgcagacgggatgctcgacgtcgttggtggccacgcacctcgcctgtcagtcgctgctgggctaccagtgcgacgtggcgctggcgggcggcgtgtccgtgcacatgccccagcgcacgggctaccactctcaggacggcggcatcacctctccggacgggcactgccgcgcgtttgacgccaaggggcagggcacgctcttcggcagcggcgcgggcgtggtggtgctcaagcgcctggaagatgcgctgaatgatggtgacaccatccacgccgtcatccgtggctcggccatcaacaacgacggcgccatgaaggtgggctacaccgcccccggggtcgagggacagtcggaggtcattgcccgcgcacaggccgtagcggaggtgtccccggactccatctcctatgtggaggcgcatggcaccgccacgccactgggagatcccgtggaggtgcaggccctcacggaggccttccgagcggggacggacaagcgtggcttctgcgggctgggctcggtgaagaccaatgtgggccacctggacgcggcggcgggagtcaccggcctgctgaagacggtgctcgcgttggagcatggcgagctgcctcccagccttcactacgagaagcccaacccacgcatcgacttcgagagcagccccttctacgtcaacgccgcgctcaagccgtggccggagggggacacgcctcggcgcgcgggggtgagctcgttcgggattggtggcaccaacgcgcacgtcatcctggaggaggcgcctgtctccctcccgggcgatgcggcgcgcccattgcagctcctggtgctgtccgcgaagacaccctcggcgctggagtcccagacggccgcgttgctggcgcacttgcaggcccacccggagcagcagctcgcggatgtggcctggacgcttcaggtcgggcgcaagcccatggagatccgccgcatagtggtgtgtgaggaccgggcgagtgccgtggcggcgttggagtccaaggacccgcagcgcatgtttaccttggccccgggcaacagcacgccgtcggccgtcttcatgttccccggcggaggcgcgcagtacccggacatgggccgtggcctctacgcctccgagaaggtgttccgcgaggccgtggactgctgctgtgagctcctgaggcctcggctgggctttgacttgcggcccgtcatgtacccggacgcggcgaatgccgcggatgccgtgcagcgcctcaagcgcacctcgctggcgctgccggctctcttcaccgtggaatacgcgctggcgcagctgtggcaatcctggggcgtgaagcccgaggcgctcatcggccacagcctgggcgagtacgccgcggcctgcctcgcgggcgtcttctccttggaggacgcactggcgctggtggtgctgcgcggcaagctcttcgaagaactgcccggtggcggcatgctcagcgtcccgttgcccgaggcggagcttcgcccgttgctgggggattcgctgtccattgccgcgatgaacggacccgcgcagtgcgcggtcgccgggacggtggacgccgtcgaggcgctggccgccgagctgacccggcgcgaggtggagttccgtcacatccccatcgacgtggcggcgcactcgcacctggtggagcccatcctcgcgcgcttcgagtcctttgtggggaccctgacgcgcaatgcgcccacgttgcccattgtctccaacgtcaccggcacgtggatgacgcccgaggaagcggtggacccggcttactggacgcggcatctgcggcagacggtgcgctttggtgacggcatccgcacgctggccgcgcagcctgggcgtgtctacctggaggtcggtccaggccgcacgctggggacactggcgcgcctgcagctcaatgggcccaaggccccctcggttctctcctcgctgcgtcacccccaggacccggtgccggatgacgcgtttctctccaccaccgtcggccggctctgggcggcgggcatggaggtggactggagcgcggtacatggcggtgctcggcgtctgcgggtgccgctcccgacctatcccttcgagggccaggattactggctggcgccggaggtgtcctcctcgcgtcgaaggggtatcgcgcgcaagagcgcggacgtggccggctggttctatcttcccgcgtggcagcgtgcgccgttgatgcccaaggcagggcccgtgacgccgcgcggatgggtcgtctaccaggatgtggggggcctgggggcggccctggcggagcggttggagcgcctgggccacggtgtcattcgcgtgacgcccggccccggtttccgtcaggtgacggagcacgagttcaccgtggatgggcgagagcgtgaggaccacgcccagttcctacgtgcgttgaaggctcggagcttcaacgtggagcgcgtggtgtacctctggagcctcgatgtgtccggggcggactttgacgaggctcaggcgcgcggtttctttagcgtgctgcggctggcgcaggccctgtccggtgcggagctgcccgggcccgtggagttgacggtggtggggcgcgaagcgctggaggtggagagcgccgatgcggtggctcccgagcgcgccacgctgccggcgctgtgcaaggtgattccgcaagagttggacaccgtggcgtgccgctacgtggacgtcagcacgccatcagtggacgcattggtgcgggaggtgacgtcggatgccccggatccggtggtggcctggcgcggcccacaccggcaggtgcaggcgtacgagccgctgcgcatcgaagcggacacgccggtgtcctggcccctcaagcagcgcggcgtgtacctcatcacgggcggcctgggcggcgtgggcttgcggatggcggattatctggcgcgcaccaggcaggcgcggctggtcttggtggggcgctccggcgcggagcaggacgcggatggccgccgtcaacgtgcggtgcgagcgctggaggccgcgggagcggaggtgctggtggctcgcgcggatgtggcggatgaggcgcagttgcgcacggtcctggcggaggtggattctcgctttggcgcgctggatggagtcatccacgccgcggggctcccggccgacggcccggtgtcgttgcttggcgccat

SEQ ID NO: 9156 - DNA, 6373 bp, Myxococcus xanthus
cggcgccagccagtaatcctggccctcgaagggataggtcgggagcggcacccgcagacgccgagcaccgccatgtaccgcgctccagtccacctccatgcccgccgcccagagccggccgacggtggtggagagaaacgcgtcatccggcaccgggtcctgggggtgacgcagcgaggagagaaccgagggggccttgggcccattgagctgcaggcgcgccagtgtccccagcgtgcggcctggaccgacctccaggtagacacgcccaggctgcgcggccagcgtgcggatgccgtcaccaaagcgcaccgtctgccgcagatgccgcgtccagtaagccgggtccaccgcttcctcgggcgtcatccacgtgccggtgacgttggagacaatgggcaacgtgggcgcattgcgcgtcagggtccccacaaaggactcgaagcgcgcgaggatgggctccaccaggtgcgagtgcgccgccacgtcgatggggatgtgacggaactccacctcgcgccgggtcagctcggcggccagcgcctcgacggcgtccaccgtcccggcgaccgcgcactgcgcgggtccgttcatcgcggcaatggacagcgaatcccccagcaacgggcgaagctccgcctcgggcaacgggacgctgagcatgccgccaccgggcagttcttcgaagagcttgccgcgcagcaccaccagcgccagtgcgtcctccaaggagaagacgcccgcgaggcaggccgcggcgtactcgcccaggctgtggccgatgagcgcctcgggcttcacgccccaggattgccacagctgcgccagcgcgtattccacggtgaagagagccggcagcgccagcgaggtgcgcttgaggcgctgcacggcatccgcggcattcgccgcgtccgggtacatgacgggccgcaagtcaaagcccagccgaggcctcaggagctcacagcagcagtccacggcctcgcggaacaccttctcggaggcgtagaggccacggcccatgtccgggtactgcgcgcctccgccggggaacatgaagacggccgacggcgtgctgttgcccggggccaaggtaaacatgcgctgcgggtccttggactccaacgccgccacggcactcgcccggtcctcacacaccactatgcggcggatctccatgggcttgcgcccgacctgaagcgtccaggccacatccgcgagctgctgctccgggtgggcctgcaagtgcgccagcaacgcggccgtctgggactccagcgccgagggtgtcttcgcggacagcaccaggagctgcaatgggcgcgccgcatcgcccgggagggagacaggcgcctcctccaggatgacgtgcgcgttggtgccaccaatcccgaacgagctcacccccgcgcgccgaggcgtgtccccctccggccacggcttgagcgcggcgttgacgtagaaggggctgctctcgaagtcgatgcgtgggttgggcttctcgtagtgaaggctgggaggcagctcgccatgctccaacgcgagcaccgtcttcagcaggccggtgactcccgccgccgcgtccaggtggcccacattggtcttcaccgagcccagcccgcagaagccacgcttgtccgtccccgctcggaaggcctccgtgagggcctgcacctccacgggatctcccagtggcgtggcggtgccatgcgcctccacataggagatggagtccggggacacctccgctacggcctgtgcgcgggcaatgacctccgactgtccctcgaccccgggggcggtgtagcccaccttcatggcgccgtcgttgttgatggccgagccacggatgacggcgtggatggtgtcaccatcattcagcgcatcttccaggcgcttgagcaccaccacgcccgcgccgctgccgaagagcgtgccctgccccttggcgtcaaacgcgcggcagtgcccgtccggagaggtgatgccgccgtcctgagagtggtagcccgtgcgctggggcatgtgcacggacacgccgcccgccagcgccacgtcgcactggtagcccagcagcgactgacaggcgaggtgcgtggccaccaacgacgtcgagcatcccgtctgcacggtgagcgcgggccccttgagattgaagtgataggccacgcgcgtggccaggaagtctttgtcgttaccgaccatggccgggaacgtgtcctcggcctgctggaactccgcccgggagagcagattgaacagcagataagtgctcaagctggagcccgcgaagacgccggtagagaccgtcaaccggcccggggcgtagcccgcgtgctccagcgccgaccaggcacactccaggaagatgcggtgctgcgggtccagcaactccgcctcacgtggggcgtatccgaacaaagccgcgtcgaagcgccccggccgctccaggacaggggctgcgcgaacgaagtttggattggccagccagccgggctccacgcccaacgccttcatcgcttcgctggtgaagaaggtgatggcctccctgccctcacgcagcaggcgccagaaggcctccacgtcttcagcaccgggcacgcgggcggccatgccgacaatggctaccgcgagactcgcgtccccctcataccgggtgtgacgacccatgtttgtctacccctgcttccttgcgcgcggctgatggagctcgaaccgctcgagctgctgctccgagcgcccctgggacgagactcggcggcgcttcgatgcactgaaggactggacggactcacgtcagggggacgccagcatcccattcaccggatgcccgacatgcacctgcctgccgcgtgctcgcccgctctctccgagaacggcaactacactccaggtagctcatcctggtaccagtatgacattgcctgctgtggtaaccccagccgtaatccagcgataactgcctagtcaatttacctagaaaaagtaacttgacgcaccatataagtttttcgtgctctagcgactttcacattgaaagctgctttacttgaggcgctggggggcctgcttcgttgcttgctgtttcgcgcgccagggccccggcgtgctccggaatggaaccgctgcgcgcgagcgtgcgggtcctccggctcccgaaaacatcttggggactcaagaaatcatggctggcgacacccactggaacgggctggagattgcaatcatcgggatggcgtgccgctttcccggggcctgtaacgccgaggcgtactggcggaaccttcgggatggcgtcgagtccatcaccttcctccaggagtcggagctggagccttccgtcatggaggacccggcgctgcgcaagtcgccgcagtacgtgcgcgccgcggcccccatcgagggcgcggacctgttcgacgcggccttcttcggcatcacccccaaggaagccgaggtgatggatccgcagcagcgtgtcttcctggagtgtgcctgggcggccctggaagacgcgggctacgaccccgagcgctatcgggagcacatcggcgtctacgcgggagcccgaaccaacacgtacgtcttcaatctcttctccaacccggccgcactggggatgctcggcgcgttcgaggtgggcctcggcaacgacctggccttcctcagcacgcgggtggcgcaccggctcaacctgaagggtccggcctattcgctgcacaccgcctgctccacctcactggttgcggtgcacctggctgcccaggcgctcctcgcgggcgaatgccgcatggccctcgctggcggtgtggccctccagtcgcctcagcgcaccggctacctgtatcaatttggtggtgttgcatcgccagacggacgctgccgcacctttgatgcgcaggcgcagggcaccctcttcggtaacggcgcgggcctggtggtgctcaagcgcctggaggacgccctggaggatggagacaccatccacgccgtcatccgtggctcggccatcaacaacgacggcgcccagaaagccagcttcaacgcccccagcgtccaaggccagtcacgcgtcatccgcaatgccttgctgaccgcggaggtggacgcgcggagcatcacctatgtggaggcccatggcaccgccacccaactgggcgaccccattgaggtgcaggcgctcaccaaggccttccgtgccaccacccagcgacggcgtttctgcgcgctgggctcggtgaagggcaacatgggccacctggacgcggcggcgggcatcacgggcctgatgaagacggtgatggcgctgaagcacggcgagctgccgcccagtcttcactacgagcgtcccaacccagccatcgacttcgacagcagcccgttctacgtcaacgccacgctcaagccctggcccgcgggggactcgccgcggcgcgcgggcgtgagttccttcggcgtgggcggcaccaacgcgcacgtggtgctggaggaggctccccggttgcccgcgagcgcaccctcgcgacgtgcatggcacctgttgcctctgtcggcccggacgccctcggcgttggagtcggtcacgacgcggctggtggagtcattgaagaaacaagggggtgtgaatctggcggacgtggcctggacgctccaggccggacgccaacgtttcctgcaccgtcgcttcgtgttggctcgcagcgcggaggatgcggtcgacgcgctgtcacagccacaatgccctcgtgtattcaccgaggcgcaggacgcggtggagcggtccgtggcgttcctcttcccgggccagggctcgcagcacgtggacatggggcgagcgctttacgaggcagagcccgtcttccgcgtcgaggtggaccgctgcgcggagttgctgaagccccacctggacggactggacctgagaacggtgctgtaccctcagtccgaggccgccgaggtcagcggggcgaagctggcgcagacggcgctcacgcagcccgcgctcttcacgctggagtacgctaccgcgcgcctttggatgtcctggggcgtgatgccgcagtcgatgctgggacacagcatcggcgaatacgtggcggcgtgcctcgcgggtgtcttctcgctggagcatgcgctgagactggtggccgcgcgtggccggctcatgcagggacttccttccggtgcgatgctggcggtgcccctgtccgaggacgaggttcagccgtacctgcgcgcaggcggaatcgagctcagtctggcggccctcaatggccccatgcagtgcgtgctgtcggggacgcacgcagccgtcgaagcggtgcgaaagcagctccaggaggcggggattcagtgccagccgctggtgacgtcgcatgccttccactcgtcgatgatggactccatcctcgacgcgttcgccgcgcaggtggccacggtgccgctggcggcgcccatgcttccatttgtctccaacgtcaccggtacctgggtgaccgccgagcaggcgacgagccctcgttactgggccgagcacctgcgcgggacggtgcgcttcgcggacggcttgcacgcgctcctcaccgacgccaggcgcgtgttgctggaggtaggcccgggccaggtgctggggaagctggcgaagcgtcaccccgccttcactgcctcacacgcggtgctggcttccacgcctccgcccaaggacgccggggccaccgccggcatggcgccgctggcctacgagacgctcggccggctgtggcaagcgggcgttcgcgtggactggaaggggttccatggcgcggaggttcgctaccgggtgccgctccccacctatcccttcgagcgccagcgcttctggatcgagcccgccgccgtcgagaccgcgcctcggggcacgattgcatcccagcctgtgacggcggtgcccgacgccacgcctcaggcatcgcaggcggaaccggggggcgaagcagtccgtgctcgctcgtatcagccgcgcccgcagcttcgcagtgcgtatgtcatgccgggcacgccactccagcggtcgctggtggagctgtggcaggagatgctgggcgtggcgcccatcggcatccaggacaacttcttcgaactgggcggtgattcgctcatcgccgtgcagctcagtggccgcatcaagaagcagttgggcttggacctgcctgcgtcgagcctctacgaaggcgtcaccgtggaggccctggcggcgttgctgaagccagcggaagcggaggggcaggagcgccgtgaagaggcgccagcggcggatgcttcgctccagcgtcgcaagcagaccctggcgcggcagcgcaaccttcgtcgcttcgacgacgatgatgatgcgtga

SEQ ID NO: 9157 - DNA, 1128 bp, Myxococcus xanthus
tgcgcaccattcgcagcgcccagactgtgggagcctggccgagcccacagtccccaggcggacgagcagcagcgcctgctcgccaacgtgctgcaccagacgagcaccacgccgctgccgcgcctctggtacttccccagcgccaagaaggccgtcgtggtgatgacgggcgacggacacccgggtggcgccaccacccagcgctggaaccagtacctcgcggacagccccaccggatgcagcgtggacgactgggagtgcatccgaggcaccatctacgactacgtgggcggcctgagcgccacccaggccaacacctacgtggcccagggcttcgagtacgccctgcacatcaacaccggctgcgcggactacacggccaacacgctggacccgaacttcttcaccccacagctcgccagcttcgcgtccgccttccccgctgtccccgcgcccgtcaccaaccgcacgcactgcatcgcgttcagcgactggtccacccagcccaaggtgtcgcgcctgcacggcatccgcctggacaccaactactattactggcccgactactgggtgcaggaccgcccgggtatgttcactggctccggcctggccatgcgcttcgcggacctggacggcactccgctggacgtctaccagctcgccacgcagatgacggacgagtccggccagtcctacccgctgcacatcgacacgctgctggacaacgcgctggggcccacgggctactacggcgccttcaacgccaacatgcacgtcgactcgcagccatcggccggcgcctccggctcggccgccatcatcgcgtccgccaagcgtgacggcgtgccggtcatcaccgcgaagcagttgctggagtggctcgatgcccgcgaggccacccaggtgtccaccgtggccttcaccggcacggtgctcaccttcaacctcacgagccccgcgcgcaacctgtccctcatggtgcccacccgcaccacgacgggccgcacgctgctgtccgtcacccgcgcgggctccgctgtgacgacggtgacgcgcaccatcaagggcgtggacttcgccttcatcgacggcgcgctggccggcacctacaccgccacctacaactga

SEQ ID NO: 9158 - DNA, 1149 bp, Myxococcus xanthus
atgctgctcgccggctgggtgccgctggtgctgctcggcgtgctggcacaggccgcgctggagcgggtgctgtcggtgtccatcgccccggtggagggcgtgctggaagaggtcgcctcggagctggcgcggcgggagctgccgcaagactcgctcaacgaggcgcggctcaacctcgcgcaggcggagctggcgcgacgagccctggtgcgccgcgtgcccgccttcatcaccgcgctgatactcatatcaggcgcggcgctgacggtggccgcggtgctgctcgggcgggccctcacgcgtccggtgcgcaccctcacggaaggcatgtgggcctatgcgcgcggcgacctctccgtgcggctcgccacccccgagcctccacgcgacgagctgcagttcctcctgggccagttcaaccgcatgggccaggagctgctgtcgcagcgcgagcggctcaagtccgcggaacagattgccgcctggcaggacgtggcccgcgcgctcgcgcacgagctgaagaaccccctcaccgcaatgaagttgtcgctcgcgcgtctgaaccggacggatgcgtccacgccccacgacaccacccgcatcaccgaggccgtggccctcctccaggaggaagtagacctgttgatgcggatgacccagagcttctccaccttcgcgcgcctgcccgcgccgcgcttccaggacgtgcccctgcgcccgctgctggccgaggtgtgcaccctgtacgcgggcacgtcccccgtgcccgtggagcttcggcctggcgcggaggctacgctgcgcgcggacccggatggcctgcgtcgcctcttcggcaacctggtgaagaacgccaccgaggcctcttccgccagcgccgcgccagtccacgtcacactggagtcgccgcagccgggcaccgtgtgcgtcaccgtggcggatggaggcagtggcgtccccaccgtcctcgaaggcccggccctcacgcgtggcctcttcagcaccaagcccggcggcagtggcctgggcctgcccatctcccagaaaatcgtccacgagcacggcggcagcctgcgcctggagcccgcgcccggaggcggtacgctcgcgcgtgtggaactgcccctcaccccgcctccgtccccatga

SEQ ID NO: 9159 - DNA, 1353 bp, Myxococcus xanthus
atgaagcccggtcctcgcatcctcatcgtcgatgacgactctggcgtcctcagggccctgcgcggactgctgagtgatgagggcttcacgcccgtggaggcccgctccgcggcggaggcctcccagttgctcgacgcgcccgaaggtcccccggcgatgatgctgctcgacctgcgcatgccgggcgagacgggcctggagctgctcgcgcgcctgccccggcccttccccgcgcccgtggtggtgctgtccggagaggcgtcgcccgccgaggccgtgcaggcgctgcggctgggcgcgacggacttcgtggagaagccgccctcccccgagcggctgctcaccgccgtgcgaaacgcactggcactgggctcgctccaggaagagcgcgagcggctgctggacgcactggcccgccccgggcacctggtgggtgacagcgctggcatggcgtcactgcgccaactcatcgcgcgcgtgggccccagcgacaccgccatcctcatcaccggcgagacgggcacgggcaaggaacgcgtggcgcgagcgctgcacctcgcttcgggacgcaagggccggctcgtcgccgtcaactgcgcggccattccctccaccctgctggagagcgagctgttcggccacgagaagggcgcgttctccggtgcgctgtcgcggcgcgcgggccgcatcgaacaggcgcacggcggcacgctgttcctcgacgaactgggcgacatgcccctggagctccaggccaagctgctgcgcgtcctggagacgaaggaagtggagcggctgggcggcagcctgcccgtgccggtggatgcgcgcgtcgtcacggccacgcaccaggacctcgcccgcgcggtgaaggagggccgcttccggcaggacctctacttccgcctcaacgtgatgcctctccaggtgccgcccctgcgcgagcggccggaggacctgctccccctggcccgcgccttcgcggcggagttcgcggggccgcaggtgccactggtgctcgcgcccggcgcggagacctcgctgcgcgcctatgcgtggccgggcaacgtgcgcgaactgcgcaacctcatcgagcgcctcaacctgctccggggtgagggcccgctcaccctgggcccggagctcgtctccgcgccccaggccaccgccgcggccagccgcccctccctgggacaaaagagctaccgagagcacgtggaggacttcgagcgcgagctcatccgcgcggcgctccaggaaggcgaaagcatcgccggggccgcgcggctgctgcaggtcgaccggggcaacctctaccggcgcatcaaggcgctcggactccctgtcacctga

SEQ ID NO: 9160 - DNA, 2448 bp, Myxococcus xanthus
atgaaccgcttcgcgctcctcatttgtctcctccccgcgctcgcagtcgcgcagccagcccctgcacctgagccacgctccgacgcgccctcatccgcggaagccgctccgtcgcaaggtgaaacgggaaacaacccgcagtcagagcgtgcggaaggcgcaaccactgccacggacaaccaggaggctggcggcaagccacgctcccccacgaccgacgcccgaggcgacaccccagcggacacgcagaagtcctgccccgacgacttcgaggacgacgactcgggagacaccagcgttctggccccgcttcagctcgccgtggatgggcgctcgctcacgcccggccgcatcgaactgcacgggcttcactggctgacggatgcgcaggtgcgtgccttcatcggtgcgccccgtgcggactcgggggccctgctgagcggaagcgaagtccacctgttcctccggcggctcgctcgctcggggctgttcgcccgcgtggagccgcgcgtgcgcgtggccgaggcgccgcagccggcggtcctcgaagtccacctggaggagaaccccgtcgtctccgccgtggaggtgaacgggctccaggacctgcaggccaccgagattctcgaagagctgctccggctcccgtaccggttccccaccgaggacgaagacgaagagtccttcaccgccacgctgcgcgtggactcccggcgcggcacgctctccgtcgtccgtccctgcccgcctcgctatccgccccgtgactgggtggcccggctggagcgcggcacgctgcaccccggcatcttcctgggcggcgtcgcccacggcctggagcgcacgctgaagcgcctgcgtgacgacggctacatgctcgccagcctgtccgcggtgttgtcgccggacggcaagctgatggtgacggtggatgaaggccggctcgagtccatcgaggtgcgcggcgtggacgccgacatcgccgcgcgtgtccaggatgcgctggacctgaagcctggcaccgtgttcctccgcagtgacgcgaagcgcgccgtgcggcggctgacctcgcgactccccttcctggagcccgcggacgcggacgactccgacagcccgcgcgcccagcgcgccaacatcatcgagacgcgcgagccggacggcacccgcgcctatcacacgcaggaagcaccgcgcgcgaagccgcgccaccgggagcaggtggagttcgagctgaactggaagcagttcgccgactggtgggacgacgtggactcggccgacagcatcaccctcgagggcaagaagctggtggtgcacctgcgcacgcggcggcccgacttcgacgtggacctgcttccgatgcacacgcaggtgacgggcttctcgccaggtcttgcggggcggctgcgcctctgggatgcgaaggaccgcgcgcacgtcaccgtggatgccgcgctcaccatcccgctgcggtggggcggccagtatctgccggatgacccggaaggcacgcagcgccagcggcgcatcaacatgctcggtggggcgaagctccaggtgccgcgggtggggctcgcggagctgggtgcgcaggtctacgacttcaccgacacgctggaccggtggcggatgggcgacatcgactcgtcgctctactcggccctcatcaaccggccggaccgcgactacttccgccgcaagggcctcacggccttcgccacctggcgctgggcggacgactggctcgcgggcgtcgagtaccgcaacgaccgctacgagtcgatgcgcagcttcacgccacccttctccctgttccggaacgactcggcgcccttccccaatgcgcccgtcaccgagggccgcttcgactccgtggtggtgcgcatggagtacgccagcaacgtgcccgccgccgcgtccgtgggctcgctgttccgcacgccggagacgtcgctcttcgatcgggatggcgactgggagagccgcgcctcgctccggggtctgctcacgctggaggtgggcaacggtccggggagcgcgggcggtgacgcgcgcttctggaagctggtgagcgacatcgcgatggaggtgcccaccggctgggacaccggtctgtcgctgcgcgtgcgcaccgcggggggccaccgtctgcccgaacagaagcgcgaggcactgggtggatggacggcgctgcgcggcttcggcttcaaggagtaccgcggcgacgtgtccgtgctcaccagcgcggagtaccgctggagcgccctgggcgtcttcgtggacctgggcacggtgcgggcggatgacgcatggacggatgcacggctcggcctgggcgccagcctccactttggagacaacgtgcggatggacgtcgcgtggcgcacggatgagcgggccaccgccacgcccgaggcccggctgctcttccagcggaccttctga

SEQ ID NO: 9161 - DNA, 474 bp, Myxococcus xanthus
atggtccgttccgaagccttcgacttcgtctcacccgagctggaccggttggtgcgactgggcatggcggggaagctggaggtggagctgacgctctggcaacgcaacaccgtctggttcgacgcgcgaatggacaccgcccggctgacgcaggtgctcgccttctccaagggcgcctacgtgctggatggacgccccctgccagaaggcccgtcctcactgacgctggagcgcgtggcgtggaccttggaaaaaaggcccgagcccggcgcgcgctatgaagtgcgcatcagcgtccgcctgcacgtcgtgaccgccgcgagcctgggccgggtggccgcgtggctcacgcaggggaagcaagcgcctggcgaggaaggcaccaccctcacgggcaccgtgctgcttcgctcggtggccgaggacctcgcccgcggcgccagtgcgcgctgtgacgtcacccggccgccctga

SEQ ID NO: 9162 - DNA, 318 bp, Myxococcus xanthus
atgcgacgttggctgtccttgctgttcgccctggccgctgggtgtgctccggcgccggcgccacccgagtctcctgaccgcggcgtccaggtcttcgcgcctccgggcatcgaggcccggggaagccgcgtccccgtcctctacgtggaggaggaaagtgcactgtacttcccccagggcgtcggaggcggaggctcacggcacccggtggtgcccagccctgccgagttgctggccctggggcgacgcaccgacatcatcatcgtcaccgtcgccccaggccactccaccacctccgcggctattgccgcgccatga

SEQ ID NO: 9163 - DNA, 1629 bp, Myxococcus xanthus
atgttgcgccagcggttgcccggcgcgcgcatcggctacttccaccacatcccgtttccgtcgtcggaaatcttcagcacgctgccgcgtcggcgtgagctgctgaaggggctgctgggcgcggacctcatcggcttccacacggtgagctacgtgcggcacttctccggagcgctgctgcggcacctcgggctggacacggacatcgaccgcatcatctgggaggggcgcgacgtgcgcgtgggcgccttccccatgggcatcgacgcgcaggccttcgaatcgattgcgagcgagcccggcatgcaggaggaggtggcgaacttgcgccggtcctccgaaggacagcgcatcctgttgggcatcgaccggctggactacaccaagggcattccgcggcgcctcctggcggtgcagcgcgtgctggagcgcacgcccgcgtggcgtggccgcctgcgtttcatccaggtgacggtacccagccggacccaggtggaggcgtacgccaactaccgcgagctggtgaacgagctggtggggcgcatcaatgggctctacgggacggtgcacaacgtgcccgtgcactacctctaccgctcattcaacgaaggcaagctcgtggggttgtcccggggcgcgaatgtgatgctcgtcaccccggtgcgggacggtatgaacctggtggcgaaggagttctgcacggcgcgtccggacgacgacggcgtgctggtgctcagcgagttcgcgggcgccgcagcggagctggggggcgcgctcatcgtcaacccctacgacgtggacgccatggcggacgccatcgagaaagcgctggggatggcggaggaggagcgccgcacgcgcatgcacacgctgcgcaagcaggtgaagtcgcgggacgtgcattggtggacgtcctccttcctcgaccggctccagtcgctgcccgcggtggacgtgcgcgccgaggcgagcgcgcccgaggcgctggcgcagatgaagcaggtggagcggctgcaactgctcctggactacgacgggacgctggtgggctacgcgccccggccggagctggccgcgccggatgcggcgctgaaggagttgctggcgaagctggtggcccggcccggcatctcggtgagcatcgtcagcggccggcccaaggagacgctggaggaatggttgggcgacctggccatgggcctgtatgccgagcacggcctgtggtcccgcccggcgccgggggaggcgtggaggatgctggagggcgtgacgttcgactggaaggagcgcgtgcgccccgaactggagaccttctccgcgcgcgtgccgggctccttcgtggaggagaagacagcgtcgctggcgtggcactaccgcctggtggacgcggagttcggcgccatccagtcccgcgagctgcggctgtacctggcggagaagttcgcagggcagtccatggacatcctccccggggacaaggtggtggagattcgtccgcggggcgtgcacaagggccgcgtggtgggcgaggccacgaaggacgcggcgcccggcgccctcgtggtggccatcggcgatgaccgcacggacgaggacctcttcgcatccattccgcccggcgggctcacc

SEQ ID NO: 9164 - DNA, 417 bp, Myxococcus xanthus
atggtggcccgcatgctagcgcgccccgggctggacctggacgcacacctggaacgcctgcacgggcgcccgctgcgcagatgggtggcggaagcgccgcaggagttccgggccgctgaacgccgcgccctgcaaggactgccggccggagggctggtggccgtgggaggcggtttcctgtcgcaccaccccgacgcgctgaccgggctcttcaccctggtcgtccccatctgtttcgacacctaccgtgagcggctgctcacggaccggacgcgcccgcggctgcgcgccgacatgtcgctcgaagaagaattgtccgcggtgttccatgagcgcgaggtgctgcacgcccgcgtccccaccgtggccctggaggacttcctccgaggctgccttgcccccgaggtgcccctgtga

SEQ ID NO: 9165 - DNA, 216 bp, Myxococcus xanthus
atgacgctgccgccggacgtgttgtcgctcgtggtgccgctgctcgcgctgccgcaggccacgcactatgtgctggatgccttcgtgtggaagccgggccggcagcccgcgctgctgtcacggctgggctggacaccgatggccacccgacacgagggaccaacatctggcatgaagcccgtttcgacgatggccattcctgcacggagtgactaa

SEQ ID NO: 9166 - DNA, 654 bp, Myxococcus xanthus
  unsure (1)..(654): unsure at all n locations
gctctcaggccatcctcagtggtgtcgctgataacgcccggccgcgaactcttcaccgtggagcggccgcagatttctcgagagcgggagcgttacgtctaccggccgaacacctcacccgcgccggagaacgtggcggtgcacgtcctcaatcgagcccacgccatcaccgcgcgggtggaggtggaggacggcgtcnagggcgtgttgctctgccacggtggattgacgggcgggtactcgctcttcgtcaaggacggcaagctgcactacgtctacaacttcgtgggagagagggagttccacgtggagtcctccgtagacgtgccgaagggacacgcggagctgcgcttcgagttccagcccacgggcgcgcccgaccttcccgcgggccggggcgcgccggggcggggacgcctcttcatcaacggcgacctggtggcgcagagcgacatctcggagaccatgccgctgctcatcagcctgggcgagggactcacgtgcggccgagacgagaactcgccggtgagtcagcggtaccagccgcccttcgcgttcaagggtgggacgctgacggaggtggtggtggacgtgtcgggcgagcacgtccacgacgccgcgacggaggcgaacacggtcatggcgcggcaatag

SEQ ID NO: 9167 - DNA, 1779 bp, Myxococcus xanthus
atgcccgggcccctctacgacgaggccctgggtgtctccgccgcgctcggctggttccgcttggagacgctgctgtgggtcaccgtgctcgcggggctcacctgcgccctgctggacctgggcaccgggcgccttcgccgcgccggcctgcgccgcgccaccctggccgccctggtactgcccctggccgccatcgccttcatggaggcgcgcggccccgccctgggcctgcggatgacggatgcgtggctcacgcgggagctcggcggcctgcgggagacggaacacttcgtcttccactactggcaaggcaagccgcgcgaggacgtggaccgcttcgcgcgggacttggagttccgctgggcccagacgcggcacttcctgggcgtggcccctaccgagcccatccacgtctggctctaccgcgacgagcacgaaaagcagcgcctggtgggcgccggccgcacccagttcgccaagccctggcgccacgagttgcacatccaggaccggcccttcccccactccgtgctccaccatgagctggcgcacgtcatggcggcccccgcgggcagcggccccttccgcgtcaccacccggctgggcgtctggccgctcatgggcgtcatcgagggattcgccgtcgccgcggacggcccggtgcagggcgacctcacgctgcaccagtgggcggcgggcatgcgcaggcagaagctggcgccggacatgcgcaagctgatggggccgcagggtttctaccagtcggcccccgcacgcgcgtacacggtggcgggctcgttcctgcgctacctggcggacacctatggcgcggaccggctgcgagccgtgtatgcccatgcggacttcaacgccgcatacggccgtcccctgggagagctcgtcaccgagtgggagcagtacgtggacgcgctccccctggacgaagcctccgtggcgcgggccttcgcgcgcttccgcaccggcagcctcttcacccgcgcctgcgctcgcgaggtggcgcgactgtcggattccgcccggcaggcgctggcgagtgaccccgaggacgcgctgaagcgctaccgccgcgccggcgagctccagcccgaagagcctggcttccgcatcggtgaggccgtcgccctgtcccaactggagcgctacgcggacgcggacgccgtgctcgccgaggtgggcgaacgcatgaagggccaggccgtgctggaggcggaggtggccatggcgcgggcggacgtcgcgctgcgccgcgaccagcccggcgaggcccgccgcttcctcgacaccgtgctgtcgaaggacgccgggccggagctgacgcgcaccgcccaggtgaagctcgccgccatggaggacgccgtgcgccaggcccccatcgaagcgtacttccgggccggccaggacgaggtgcgtctgctgatcctcgcgcgcgccctggccgcggtgcccacggacccgttcctcaactacctcatggggcgccggttgcagcaggtgggctcgcccgtgctggccacgggctacctgcaacaagccctggcggcggaaggcctgccggaagcgctccgccgcgaagccctgcgcatgcgggtggagtcagcctacctggcaggagactgcggcgcggtgcggcacgaggtcggtgcactaccggactttggcgccgccttccgggcctccgccgacgagtggcgggagcgctgcgacttcgaggagaagaccttccgtggactgctggtgccacgacaggctttccgctag

SEQ ID NO: 9168 - DNA, 528 bp, Myxococcus xanthus
atgcgtttcgagtcgcggcatcggattcaggggacggtggatgaggtggagcgcgcgctcctcgacgagcggtacttcgagttcctcctcaagcaccatggcgtgctgctggagctgcagcccctggaagtgaagccggacggagacgtcgtgcgccgccgcgtgcgctaccgccccaagcccgtcatcgagaagattggccccaagacggtgcccccggagtggttcgcgttcatcgagacgtccacctatgacaagcgccgcaaggagttgacgttcgagaacatccccacctcgaacaagatctccaagatgctggtgaacaccggcaccatgcgcttccgcgacgtgggcggtggccagacggagcgggtgatggacggtgaaatcgccctcaagctgcccttcctcctcaagccgttggggctcatcgcggagaaggtcatccagtcggagggcctgaagatcctcgacaacgaggtgccggtgctcaaccggttcatcgccgaggtcatccgccccggttag

SEQ ID NO: 9169 - DNA, 468 bp, Myxococcus xanthus
atgctcaaacgcttcctcgccttcagcgtcctgtccctgctggccgcctgcgccccgaagcgcatccccggcacggacatcgtcgacaactccgacacgcgcgccattctcgccgtcatggaggagtaccgcaccgcgctggaggcccgggacgcccaggccatccagaagctcgtctcgccttcgttccaggacgacggcggcacgccgaacgaccccagcgacgacctgacggcgcagaacctggtgccctacctggagcgggtgttcccccgcatccagggccctcgcatcgagctgaacatccgccgcatccaggtcggtgacggcgtggccgccgccatctactactggaacgcctcctggcggatgccgtcgcttcactcgcgcccgatgaaggagtccgagctggagcagatggtgctgcgcaaggaagacggcacctggaagatcctcaccggcatctga

SEQ ID NO: 9170 - DNA, 1581 bp, Myxococcus xanthus
atgggcaccgaagggcgcaaggactggcagcggcgcgaaagcctcaccagcgcgctggttcaggtgggcgtggtggcggtgctgctcgcgggcgcggtggttttcttcgtccaccgaggcaccgtccgcaagcagacggaggaacacctgcgcgcggcccgcacggccgccatgcgtggcaaccccgctgacctcgcccgcgcgatgacggagctggacgccctgttccagctcgacgccgaggcccgtgacgcccaggccctggctgccgacatccagacggtgctgtggctggagcaccggcagcccggcgcggacgccaaggcccgcgagcacctctcccgcgccgcgcagttggagtcgcagtccggcgagcgctacggcgcccacgcactgcatctgctggccgcgggcaagtccgccgaggcggagcagtacctggccgggctcgaggcccgcggcgccaacaacgcccggctgacgctggcccgggccctggcgctccaggcgcgcggcgaccttcccggagcgaggcaggccttcgctcgcgcggcggaagcgtcctggcgcgatccacgcttcaccaccgcgtacggcgaagccctgatggacgaaggccagtacccgcaggcggtggaggccttcgccaaggccaccagtgtcaacccggaccacctgctggcccgcgtgtccaccgcgctggcccacacctaccaggggcgcaagatggaggaagcgcagcaggtgctctccggcgtggaggcccggggcgcggagctgacgcccggactgaaggcccgcgcgggcgcgctgaaggcagagctggcgctggctcgcggcgcgcccgacgaggccctctccgccgcggacgaagcgctgaaggccgttcccgatgagcactacgccctcttcgcccgggcccgggccctggcggtgaagcatgacgtccaggcccgcgcggccttcgaggcggccgtggcccggcgccgcaatgcccccctgctctacctggacggcgcgcgggcgctgcagaccgctggtgacaccgacggcgcggtggccctgctggacgcgtacgaggccaccttcggtccggtgcagaccaccaccccggacggcaagaaggctggcctcttggagaaggacagccgctactggctggcgcgcggcggcgtgctggaggccgcctcccgtcaggacgatgccctggtcgcctacgacaaggccctggcggcgcgcggcgtggagctggcccaggcgcagtacgccaagggcgcgctgctgctggcgcgcaaggactacgagggagcccgcccgctgctggccgccgtggcacccgacagcggcgcgggcacgatggcggaggcctacaccgccatgggggacctgctcttcgcgcagggcgagcacgccgccggctgccagcactacttcttcggcctcgcgcgagagcgggcgcagggcacgccccgcgaggcgctggcggagcgcgtggaggacatccggaagcggctggagtccgccggccaggccagcatggccaaggcctggaaggcggagtcgagctcgctcctagagtag

SEQ ID NO: 9171 - DNA, 558 bp, Myxococcus xanthus
atgaagcacggccttcggtggatggtggtggcggtgccgttgctggcatcggcctgccagcaggaggcgcagggcagcgcgcctcgtgccacgccgaaggcggcagagcctcgtccgcgcatcaccgacgtcaccgccgaggactacgtcatgcagccgcttccgcgtggacatgtgcggctggaggatgccttcggcggagcgcgccgggtggaggtggagatcgccgcgacggcgggcacgcgtgcacggggcatgatgtggcgcaaggagctggcggaggggaaggggatgctctttctcttcccgcacgaagaggtccaggggttctggatgcgcaacacgctcatcccgctggacatgattttcatcacgtccgacctgcgcgttgcgggcatcgtgtcgcgcgcggtgcctcgctcactggaatcccgctccgtgggcgtacccagccagtacgtgctggaggtgcccggcggctggacggagaagctgggcatccgcaagggcagtactgtccgcttcgagggcgtggcgggcttggacatcgagccctga

SEQ ID NO: 9172 - DNA, 399 bp, Myxococcus xanthus
atgtccgaacagaagacaggtccagagcaccgccagaacgggcgcgcgcccatcgagctgaaggtcgactacaagaagctcaactcgttcttcgcggactacacgaagaacatcagcaagggtggcacgttcatcaagacgaagaagccgctgcccatcggcacgcgcttcctcttcaagctgacggtgccacaccgggaggcccccttcgaactgctgggcgaggtcgtctggtccaaggcggacgcggacgagcccggcatgggcatccgtttcatctacagcagtgaagcgcagcgggtggagttcgagacggtggtggaaggactgatgtccgacagcctcggcggcgagctgacggagaagctgctcaacaagccgctgcactcgcactcatga

SEQ ID NO: 9173 - DNA, 972 bp, Myxococcus xanthus
atggcggtacacacggcgctaccccgcgaggcattcgagcgggtcgcggaggcattcgggctcggggctgtgcgtgaggtgacgcccattccccagggctccatcaacaccaaccaccgcgtggagacgcagagcgggcgctacttcgtgcgccacaccacggtgcgctccgcggacgatttgcgcttcgaatccgcgctgctcgcgcacctggccgcgtaccacttccccgggcccgtgcaggtgacgacgcgtgacggcgcgaccttcctggagctggagggtggccgcgtcagcgtcttccgctggctgccgggcgaggagctgcgccacccggccctcaccgccgaccacctggagcggctgggcgcggagctgggcaagctgcaccgcgacacgcagtccttctccggctcgagggagaatccctacggaccggagacggtgagcggctggctggaggcgctggtggcgcacccggatgcggagctggcggccgtggcgcgtgagctgcaacgcgacatggagacgtcgcgcgcggcgcggcaggggctggagcctcgcggcgtcatccacgcggacctcttcatggacaacgtgaagtggctgggggaccgcgtgggcgccttcttcgacttcgagatggcgtgccgggaggactacggcctggacgtggccatcacgctcaatgcctggtgcttcgacggcgggcagtacctgccggagctgtgccgggccttcattcgcggctacgtggacgtccggccgctatccgccgtggagcgcacgaacctcttcggccatgcgctctacggggcggtgcgcttcacggcgagccgcatccgcgactaccacctgtccccgctgcctgcggacaagctggtgcgcaaggactaccgcacctacctcaaccgggcccgggcattgaatgccatggggcccgagggcttcgccgcgctgttgggcctgtga

SEQ ID NO: 9174 - DNA, 501 bp, Myxococcus xanthus
atggtgaacgtgacgcgctctcaggtggtgggcggtgtgctggcgctgctggcggccggcgcggtgctgtacttctggccgcggcagcagctcaccgtggaggaggccatccgccgccaggtggtggtgatgacgcgcgccgcggaggcgaaggacgtgggcggggtgatggagcacgtctccgagcgcttccgctccaacgggcagggcggctggtcgaagaaggacgtgcgcggcatcctcaccgcgcaggtgctgcgtggccagtgggtgcgcgtcttcgtgacgaacctggaggtgcgcgaggtgtcgccctcggaaggggagttccaggcgcgcttcatcttcggccgctcccaggcggagaaggtggagcacctggccgccgacagcgtgctgaacgcctacctcatcgaaggcgccttcgagaaggaagaggacggcgagtggcgcgtggtgcgcgcccggccggagtccatcagccccaccgacctactctag

SEQ ID NO: 9175 - DNA, 1029 bp, Myxococcus xanthus
atggacgcgtcggggcagcaggcatcgctggcggcacctcccggaaagctgctcgcgtcgcaccacgcgagccggcagctctccacggaggaagcgctccagttatgggagcgtgagctgcccgccgacgccctggtgaagcatgtggagccgatgacggacccggcccacctcgtcacactgatggagacgcagcggcggatggtggagcgcttcggtgccacgcgagtcacggtgctgggcatgggcgcggtggcgttgcccacgcgggcgctgctcgcccagaacaacgtgttggactacgtcgcggcgggaggcgcctgggtcgcggcgcccggccagcggctgctggacgacgccgtgcgagcgctgcgcggcgcggaccggtacacggtgcctccgccactgcgtctgggcatattggggacgtcaatcgtccacttgcgctcgccccgcatccaccgtcagcccttcgaccgcatcgacctgccggaggacgggccggtggagcccgtggtggacgcgctcctgcctcactacggaggcttcgccgtcaccagccccttcaagctgcggctggcgaagcacacggggtcctcgctggacgccatcaacacgctggtccgccggggcggccggtgggaagccttcaataccgacacgttcggcgcccgcacggtgctcgagcggctcggggctcgcgaagtcttcgtcctgggggacggtggcgccacctcggcgctccggtccgtggcggcggagctgagctgcgacttgcgcgtcttgcgacgcgccgacatccaggcgcctctcacaggggcgggcgtctggacctggcccgatagggtgcccgctcctgacgacctgcgcttcgacggggcccgtgtggcggtcatcgcctacggagccccgggccggcgcatcgccgcggagattgtccaacgcggcggtactccagtcctgctgggtgcggcgtggttcatcgcgcaagcccggcgtcagcgccaactctgggagtccgcgacatga

SEQ ID NO: 9176 - DNA, 1332 bp, Myxococcus xanthus
atgaacgagtcgtcgctgcgtgagctcgggatggacctcatcgaggagcgccagttcgagcgagccctggccgtgttcgccgaggcggttcgccgcgtccccgcggaccaccgctcgcggatgctggccgcgcgctgcctggcggaactgggcgagcgtgagcgcgccgtcaccgcctaccacgcctgcgcggagggcttgctgcgccgggactacctgttgtccgccatggccgcgtgcaagctggcgctggacctggcgcccaacgagcggcgcttgaaggagacgctgtttcgagtgcactcgcgcgcggtgcgcaacgcgccgggccgcgcggtggtgcctccgccgctgccgcccgaaaccctctacgacggcaaggtggagacggacctgatggggctgcagggcgaggaattgtccagccgcgccatcgaagtgctggccgcgacggacccgggcggcgccgcggaccccaacagccgtccgccgttgccgctgttcgcggagctggaccgggatgccttcgtggacctggtgcggctgatggcgtggcgccgcgtgaagccggaggaggcggtgagccgcgagggcgagcccgccgactccctctacgtcctggtcgccggcaaggcggaggtgacgcgacagatggagggcgaggcgcgcacgctgggcttcctcggcggtggctccatcttcggtgaaatcgcgctgctgacgggcgctccgcccacggcgacggtgtccgcggtgtcggacacggaagtcttcgagattcgccgcgagcacctcaacgcggtcgccaagagccaccccgcggtgccgcaggtgctggcggacttcgcgcagcagcgcatggcgcgcaacctgatggccacctcgcccatgttccagacgatgccggagtcggagcggggcgcgctgctgcggcgcttcaccttccgggcgctccaggctcgggagaaggtgctggtggagggcgagcactcgccggggctgttcctggtgctggccggtgagctggtggtgcagaaggaggacccggcgggcggcgtggtgacgctgggcatgctgcgcgagggcgaggtcgcgggcgaaatctccctgctgacgggcctgcgcgcgacggccacggtggcggcggcgcgcaagacggctgcggccttcctggagcgcgcggccttccacgaactggtgacggccgttccggacatccgcacgtacctggagcagctgtcggaccgccggctgaagcagattggcgaggcgctgcggcccgcggaaatcatcgacgcggacgaactggtgctcgagcccgaggccgcgtga

SEQ ID NO: 9177 - DNA, 1788 bp, Myxococcus xanthus
atgcatgtgctggacggcccggacaagggccgcaagaagcgcttccagagcgtgcggatggtggtgggccgcaacaaggactgcgacttcgtgctggaggaccagtccgtgtcccgccgacacctggagttggtgtacggccaggccggcgtggtgatgcgggatctgggcagcgtcagtggcacccaggtcaatgaccagcgcgtggacgagtgtctgctgaagcatggagacgaaatctccatgggcaagacgcgcctgcgcttcgtggacgaatcggagcagatcaaggagctgcgcgcccaggcggaggtccgcgaggctgcggagaagcgcgagcgcgaggcggccgcccgcgaggcggaggagaagcggaagaaccaggccgccgcgcgtggcagcgaggtggatccgaacgacccgcgcttcaacgaggccaccaacgccaactacaagctgcctgactcgctcaaggagaactccggcagcaagggcgcggtggccgtaccccggccccgtccgcccatccgcagcacgccgacgcgttcgaacagcggtggactgacgggcaagcagaaggcgctcatcggcggcggtggcgcgttggtggtggtgctggtcatcgggctgatgctgattccgtccggacctccgcctccgccttcgccggacccgaaggtggagaaggcgaaggtgttgatgcagcaggcgcgcgagtccgtgcgcgcggatgacttcgccaacgccgtccgcctcgtcggcgaggcggagaagctggtgccgggcatcgacgcggacaacctggcccggggcgcgcgcacgcagttggaggtgatgaccgcgctggatgccgtccgcaccctcatcgaggagaagcagttcgacgaggcgcgcgcgaagctggaggcgacgccgcagggcacggcgaagacggatgacatccgccgcaagctggcgacggagctggaggagaaggacatcgcctggcggctccagcaggtggaggagtccttcgcctcgcgcgacccggagacgattcgcccgctcatcgcgcagttgccgccgttgaaccggccggcctacgaggtgaagctgacggacctggaggccgagctggcgaaggaggcccaggatgcgtcgcgccgcacccgcaacgccaacgcccgcgcggcggaggtggccaaggagaagcgcaaggagttcatcgccgaggccttcaccgacgtggagcgccgcttcaacgggggggactaccagcgcgccgtcctggagtgcgaccgggtgatggacaagtaccgggcggacaaggacgtgaaggaccgggccctggccctcaagcgtctgattccccagttccggcgcgcgctggaggacgggcagaaaaagctggattcgaactcgctggaggcgggggcgaagcccctgcggcgcgcggcggagctgtaccgccagattggcttccggggctcgttggggaacaccatcgacgaacagctcgcgtcgtcatcgctggcggcggggcagagcgcgctgaagaagggcgacctgggcgcggccggctcgcacttccgtgaggcgctgcggctcaacccgggtgacgggcgggcgcgtgaaggactggagaacctgcagaagaaggcggaggagctcttcctccgggcctacatccagcgggacagggatccgaaggccgcggcggagatgttcaaggtcgtcatcgagacggcctcggaaggctccgacgtcaagcgcaaggcggagatgtatctgagcgagctccagccgtga

SEQ ID NO: 9178 - DNA, 858 bp, Myxococcus xanthus
atgcgcaacctcatccggggcgtgtcccgcatcggccgtggtgactacaacgcccagctcggcgtgcgcggcgacgacgaggtggccgtcctggcccgggagttcgaccagatggcccgctcgctccaggcgcgtgaggcccagctcaaggcccaggccgaggccctcatgcgcgcggagcaactggccgccgtgggccgcatctccgcgcaaatcgtccacgaggtgcgcaaccccctgtcctccattggcctcaacgtggagttgctccaggacgggttcgaaaccgcccgcttcgcgacccccgaggacgcggccgaggtgaaggacctcatctccgccgtcacccaggaggtggaccgcctggcggatgtcaccgagcagtacctgcgcatggcccgcccgccccggcccgacctggacccgcgcgacgtcaccgccgtgctggacaccgtgctcgacttcacccgagaggagttggagcgcgccggcgtggaagtggtgcgcgacttcgccctggataccccgcatgtgctcgccgacgagggccagttgcggcaggtcttcctcaacctgctgcgcaacagccgcgaggccatgccgtccggcggccgcctcaccatcgtcacccgtccggcggaggacgccgtggaagtcacggtgcgcgataccggacagggcatgacggaggatatccgacagcgcctcttcgagcccttcttcaccaccaaggaggggggcacgggcctgggcctggccgtcagccagcaaatcctccaggtgcacggtggctcgctctcctgccagagtattcccggccaggggacggccttcgtgttaaggcttcctcgcgcatga

SEQ ID NO: 9179 - DNA, 1332 bp, Myxococcus xanthus
atgagcttcactacgtaccgggacgtgctgccctccgggctgcgcgtcgtcactatcgagacgccccacctccacaccgccctgctcgccgtctacgtgcggacgggcagccgccacgagacgctcgtcagcaatggcgtcagccactacctggagcacctcttcttccgcggcagcgagggctggccggacaccgtgaagatgaacgcggcggtggaggaggtcggcggcaacctcaacggcgtcaccacccgggaccacgggtactactacacgcccatccaccccgcgcacctgcgcgtgggcctggacatcatcggcgacatgctcacccgtccccgcctcaccgacatggaggtggagcggcagatcatcctcgaggagatgctcgacgaggtggacgagaagggccgggacatcgacctggacaacctgtccaagcacctgctcttccccggacacccgctggccctgaagatcgccggcacgcgcgagtccgtcacgaacatgacccacacgcagattctggagcacttcgcccagcactacgtcgcggggaacatcgtcgtcaccgccgccggccgggtgaagcactcggaagtcctggagatgaccgagcgagccttcgcccggctcccgcgcggcccgtccagcgtcgaggcgccgccgcccctcactccgcccggcccgcgcctgcacttcgtcagccatgacgagtcgcagacggagttccgcctcaacttccgcggcgtccccgagcagcacgaggactaccccgcgctgcagatcatccgccgcgtgttggatgacggcctgtcctcacgactgccgttcgaaatcgtggagaagcgcggcctggcgtactccgtgagcgcgtcgctggacgcgtaccacgacgcggggctcctcgagatcgaggccgccagcgctccggagaaggccgcgacggtcatcaccgaggccttccgcgtgctgtccacgctctgtgagaacgaggtgggcgaagaggagctggcgcgcgccaagcgccggcaccgcatgctgctggagttctcccaggactcgccgggcgagctgtccggctggttcggcggcacggagctgttccgcacgccggagtcgtttggccaccgcgccgacctggtggactcgcagtccgccgcgcgcgtgcgcgaggtggcccggcgctacttcaaccgggagaacctcacggtggtggcggtgggccagcgcaagggcctcaaggccctggagcgcgtggtggcggatgcccccggccttcccgggccggaggccgcgccgcgggcggtggtcagcggcggccgcggatga

SEQ ID NO: 9180 - DNA, 114 bp, Myxococcus xanthus
atggagcgcctctccggccgccgcgtctccatgctccagtccgacgaattcgagctgctcaccgcgctgcccggcgtgcgtgacgcgctggaagtgttcgacgaagcggcatag

SEQ ID NO: 9181 - DNA, 801 bp, Myxococcus xanthus
gcgctgcgctgtgtggcgcgccatggcttcgacgtcgccagacagggctatgtcaacctcctgccgggccaccgggccccgggcaatgccgacacccagtcgatggtcgccgcgcgagagacattcctcgcgcgaggccactacgaaccgttggccgcgctattggcggagcatgccgcgcggctcaccggcgccgatgccacagagggctgcgtgctcgatgtgggagcgggtaccgggcactacctggcccgtgtcctcgaccggtgcccggcgctgacggggctcgccatcgacatctcccgcttcgctgcccgccgggccgctagggcccacgcccgcgcgggagccctcatcgcggacggcgagcggacgttgcccatccgaaatcacagcgttgcactggcgctcagcgtcttcgctcctcgcaacgtcacagagctccaccgcatcctgaatcgccgaggcgcactgctcatcgtgacacccacggaccagcacctgacacagctcatccaacccatggggctgctgagcgtcgacgcgcgaaaggaggagcggctccacacacggctgcgggccacgttcaagccaggcgtccgggaagcgctggagctgaccttgcggctgacgcgcgacgacgcgttccacatcgcggccatggggcccagcgcgttccatgcatccacggaggagctgcggcggcgcgcggacgtgttgcccgagctcctcaccgtcagcgcgtccttcaccgtggccagctaccaccgcgtggagaggaacggctccgcgcccgcctga

SEQ ID NO: 9182 - DNA, 1104 bp, Myxococcus xanthus
atggcacaggcccaccgcatggcgggcaacgagggcgccgccatcctggccttgaagcaggccgcctccatgttgccgggctcggaccccaccatccagcgccaactggccgacatctatctccagcagggcctcaccaaggacgcgctcgcggcgctcatcaccatgcgggacgcgggaaacctgccggacgcggacgtgctgcggctggcccgtatccaggcgcgtgagggcatgattgatgccgccttcaagacgctggagaacatcctgcgggagaacccggacgacgccgaggccaagtccgtcgaggccgaggtgctctggctcaagggcgacgagctcctggccgccaacctcatggaccggctcctcaaccaggacccggcgctggcctccgcgcggctgctgcgcgcgcgctacttcctggtcagcggcttcccggacctggccgagtccgacctgaacgccgtgaagggcgctgacgcggagcggccggaggtggtgacgctgcgcgcacgggtgctgctggccttgggccgggccgcggacgcggaggaggccctgcgcgggctggtggaggcgcagccgcagaacgccgacgcgctggcgtggctggcggagacggtgcgggtgcagggccgccgcgcggatgcgcagtccctggtggaccaggcgctccagctcaacccccggctggcccgggcgcagtacgtgcgcgggcgctcgctggaggagcaaggggaccgccgcggcgcggaggaggcctaccgcttcgcgctgtccgcggagccccgcttcgcgcccgttcacgcccggatgtggcgcatccacttgaatgcggaccgcatcacggacgcggagacgtcactggagctgctgctcagcatgagcgaggccaccatcgaggagaaggcccagctcgccgccctctatgcgcggatgcagacgaaggtgacgcagggcctcaagctcatcgacgaggccctgaagcgggagccggagaacccggactacctccgcacccagaaggcgctgaacgcgctgctgccgaagcccaagaagaagtcctcgggcccgatcatcatccgcggccgccgctga

SEQ ID NO: 9183 - DNA, 387 bp, Myxococcus xanthus
gcggtggcccgggtggacgtgacgcccgaggccgccgccgtcatccgccagctccgcgccacgcacgggcccttgatgttccatcagtcgggaggctgctgcgacggcagcgcgcccatgtgctaccccgtgggggacttccgcgtgggccagcgagacgtcttcctgggcgaggtggagggctgccccgtctacattggcggcgcgcagttcgagtactggcagcacacgcacctcaccctggacgtggtgaaggggcggggcgccggcttcagcctggagtccccgctgggcgttcgcttcctcacccgcagccgcgtcttcacggacgaggaatacgaacgggtgaagaacgcgcctccgccccggcgtggacctccggagtag

SEQ ID NO: 9184 - DNA, 1515 bp, Myxococcus xanthus
tacgccgcccccaatcagcccggctccaaggtgcagttcaagccccgctaccagaacttcattggcgggcgctgggtcgaacccacgcgtggtcagtacttcgagaacatcagccccgtgacgggcaagcccttctgtgaagtggcccgctccacggccgaggacatcgagaaggcgctggatgcggcccacgcggcccggctctcctggggccgcacctcgccgaccgcccgagcgaacatcctcaacaagatcgccgaccggatggagcagaaccgggagatgctcgcggtcgccgagacgtgggacaacggcaagcccgtgcgtgagacgctggccgcggacatcccgctggccatcgaccacttccgttatttcgccgggtgtatccgcgcgcaggaaggcggggtgagcgagctggaccacgacaccgtcgcctaccacttccatgagccgctgggcgtcgtggggcagatcatcccctggaacttcccgctcctgatggcggcctggaagctggccccggcgctggcggcgggcaactgcgtggtcctcaagcccgcggagcagacgccctccagcatcctgctgtggaccgagctcatccaggacctgctgcccgaaggtgtgctcaacgtcgtcaacggcttcggcgtcgaggcgggcaagccgctggccagcagcccgcgcatcgcgaaggtggccttcaccggcgagacgagcacgggccggctcatcatgcagtacgccagtgagaacctcatccccgtcacgctggaactgggcggcaagagccccaacatcttcttcgaggatgtgatggcgcaggacgacgacttcttcgacaagtcgttggaaggcttcgccatgttcgcgctcaaccagggcgaggtctgcacctgcccgtcgcgctccctcatcagcgagcgcatctacagccagttcatggagaaggcgctcgaccgcgtccgcaaggtgaagccgggcaacccgctggacaccgacaccatggtcggcgcccaggcgtccaacgaccagttggagaagatcctcagctacatcgacatcggcaagaaggagggcgccaaggtcctcatcggcggcgagcgcgtggcgctgtccggggacctgaaggacggctactacgtggcgcccaccgtgttccagggccacaaccgcatgcgcgtcttccaggaggagattttcggccccgtggtgagcgtggcgaccttcaaggacttcgacgacgccatccgccaggccaacgacacactgtacggcctgggcgccggcgtgtggacgcgtgacgggaacaccgcctaccgcgcggggcgcgccatcgaggctggccgcgtgtggaccaactgctaccacatctaccccgcgcacgcggcgttcggcggctacaagcagtccggcatcgggcgggagaaccaccggaagatgctggaccactaccagcagacgaagaacctgctggtcagctacagccccaaggccatgggcttcttctga

SEQ ID NO: 9185 - DNA, 2019 bp, Myxococcus xanthus
gagttgcgctccatcctcccccgctggcagcgctcacggtcgctgggcgccccgagcaccggacagccggacgaagggccccgtgtgggcagcttggcgctggtcgagcgccgggcccggctggagccggtgtggcacgagctgggcggcatgttggagatgttgtcggcggcgcccctgccttcggggcgggtggcgctgctcgcggaccgcgagggcgtcatcctggcgacccgcagctcgggcggggacttcacccaccacgcggattatgtgcgcctggtggagggggcctgctgggatgagacctctcgcgggacgaatgccattggcactgccttggcggagtcctccgccgtcgcggtggtggggccggcgcactacgcgcagcggcaccatgggctcgtctgctacgcggcgccggtccatgacccctttggagagctggtggccgtgctggacgtcacggggccggctggcgcggcggatccgctggtgctggtggcggtggccagtgtggcccatgccgccgaggcgcggctgcgcgaggtcgcctgggcccgagtggccgctgcggcgcgggggggattggagtcgcgcctgtcgcgtgaggatggcccggtgctcgtcgtcgagccgatggggcgggtgagtcgcttcaatgccgccgcgcgcgcgttgctcggtggacaggggccgatggcggtggaggcggcgctcggtgtttcgtggcgggtgctgacggacgccgcgtttcgaggcgcggcgttggagacgcgtcttgcttcacaggggccggcctggcgcatccatgcggaggcggtggggacgggggatgcgagctcggcgctcgcggtgctggtgcggctggaatcttctggtgtccggtccctgggcatgacccctgggagcgcggattcacgtccgacggtggcggagccttccactgagggccgtgggcctcgcgcgctgtcccgggacctgtggggggcggatacggtggtgccacctggaccgtgggcggcgctcaaggggaacgacccgcagcaccgcgccacgttgcgagaagcggagcggttcgcgcccacgagcttgccggtgctcctgctgtcggagacgggcacgggcaaggagctcctcgctcgcgcactgcactcggccagtacggtcgccacggggcccttcgtggcggtgaactgcggcgcgctgtcgcccgcgttgctggagagtgaactgttcggccatgcgcctggtgccttcaccggcgcgcgcgtcggcggcgcggagggaaagctggcggcggcggacggcggaacgctcttcctcgacgagctggcggagatgccgcccgcgctccaggtgttgttgcttcgggtgctggaggacggtgcctattcgcgcgtgggagagtcccgcgtgcgacgctcgcgcttccgcctggtgggcgccacctgcagggatttggacgcggccgtgcgcaacggcacgttccgctccgacctctatttccgcctccagggcgcggtgctgcggctgccaccgctgcgcgagcgcaacgacctgccggaactggcccatgcactcctccggaggttgtcggaagaagaaagcctggccacgtcgagcatctccgccgctgcgctcacccggctcgcagcccacccctggcccggcaacgtgcgcgaactgaagacagtgctgcggttggcgctggtgcgcgcgggaggcgcccccgtgttggacgtggatgccctgccgtcaggcctgggaagcccgctctcgcccggggcccaaggagaaccacggcccgccgtgccgcctgtttccagtccgccgagtcaaccgagcgcgggtgccgccggcggtccgttgcgcgagctggaggcccgcgccatccaggaggccctggcgctcagtggcggcaacgtggcgcaggccgcccggcgtctgggcatcgcacggagcacgctctaccggatggcggagcgcttcggcatcacgctgccctcgcgcgcctga

SEQ ID NO: 9186 - DNA, 1020 bp, Myxococcus xanthus
atgaataccttcggcgaactgtttcgcctgacgacgtttggagagagccacgggcccgctctcggcgccatcctggatggctgccccgccggcgtgcccctgacgcgcgagcagattcaagtcgcgctggaccgtcggcgccccggccagtccaccatcaccaccgcgcgcagcgaaccggaccaggtggagctcctgtccggcgtcttcgaggacaagacgctggggacgcccatcgccgccatcgtgcgcaacaccaaccagcgctcgggggactacgagaagctgaaggccgaggaccggcccggccacgcggacgccgtgtggcgcgagcgcttcaagcaccgtgaccaccgcggcggcgggcgcaccagcgggcgcgagacgctctgccgcgtcatcggcggcgccatcgccgaggcgtacctcgcccgtgacgtgccttccatccgcaccgtcgcctacgtgtcccaggtgggcaacctggtggccgccgtgcccgcgccgggactcacccgcgagcaggtggacgcccacgccacgcgctgcccggacgtcgccatccgcgacgagatgtcccggcgcatcctcaccgcgaaggaggcgggcgacagcctgggcggcgccattgacgtgcgcgtggagggcctgcccgtgggtctgggcgagcccatcttcggcaagctcaaggcgcgcatcgcgcaggccctgggcagcatcggcgccgtcacgggcgtcgtctggggtccgccggacctgctcgagcgcattggccagcccggcatccagttccacgccgtgaaggacgcatacggcggcatccagggcgggctcgccaacggtgagccgatgcagattcgcaccttcttcaagccgcccgcgacgctgcaggagcatgcgaagggcggccgtcacgacccgtgcatcatgccccgggcagtcccggtgctggaggccatggtgtcgctcgtcatcgccgacctcgtcctccacttcaacgcgaggccccacgcgccatga

SEQ ID NO: 9187 - DNA, 591 bp, Myxococcus xanthus
atgacgatgaaccccgcgttcgtaagcatcctcatgctgctcgcactggtgggttgcacgaaccaccgccagacgctgctggagcgcacgagcagctatgtggtgtacgacatgcccgcacgacaggtcatgaaggccgccgagacgatcctgagtgagcgcggctatgccttgctacccagcacggacccgatgttcctcatcacgccgtggaaggtctccggcaactacgacgtcttcacccactggtcccgcgtctacgtcgaggggcacaagcgtcccgacggtcggttcaccgtgcgcgcataccatatggccgccaacatgcccgcccggacgcagtcgctgccgacgccggagacgacgaccatgacggcccccgaggagaagcagaacatcatgcccacggtcctgctctccaccgagcccgtactggtgcgctccgccaggcccaacctccgcagggacctcaatctcgaatgggccatcatggagcagctcgacccagacttcgccggacgcgtcaagacgcaggtcgacgtgtatctcgcccattcgtcctcgaagcggccgggtgacgtacttgaatga

SEQ ID NO: 9188 - DNA, 927 bp, Myxococcus xanthus
atgaaggacgctccgcctcccgcggaagccgctcccgcggctgccgcggagccacccgtggacccctcaaaggtggtcctccggtggaagattgcccagggcgcgccctcgtcgtaccggctcgacatcgagcgcaccggcggcgcgcccgccagcaccgaggaagccgcgccccccaagagcgccaagggcaagggcaaggagaagcccgcccccgtcgccgcggcccccgcggtcctgcccgggcccgtcacctacttcatggagcggaccgactcgggtgactaccgcctccgcgtcgtccctgtgggcagcaacgtcgacgcggacacggccacgctgagcgagcgcggcttcgtgctcgacggcttgcaaggcgccacccgcaacaccgccaccctggtcctggagctgccgagagatccggtgggcaccggtgacgtgtggtcgctcggcaccgagctgatcctcatggaggcgctggggccccagttccaggccggccagcccgagcggagcaaccgcgtgaagctcgccagcctgacgcccgccgacgggggcgagcaggtggccacgctggagtacgccatctccgagaagctggccggcaaggtccgcgcgaaggatgagccccccacctcgcccgcgcgcgccgaggaggaagacgcggaggcggacgactcgggacgcccccggccccgggccgcgcccgaaaccagcgccagcgccgaggtgagcatcaccggccgtggcgagttcctggtgaaggccgggcggtggcgctcgtgggaaggcaccgtcacgtcggtgacgaagggcggcttccccaccgccgcgctccaggtgcccaccggcgccctgaagctgcgcctcaccgcggtggaatcggctcccgcgccgacgccaacggcccagccacagcagtag

SEQ ID NO: 9189 - DNA, 2214 bp, Myxococcus xanthus
atgtccgagccgccagagaagcccgtgactcccttgttcgatacgacccgtgacgcgctggcgtggctgcgggcgcaggggctcgagcacttgtcgcggctgagcctggcggtgctgatgccgctggtggaagcggcctggctgccgcaggcgcgtcccgtgctcgcccgccgaaggctcgtggagttgctgagcacggactcgctggcgcgttggatgacggaggcgatgccgtctccccggatgaaggagctgctgcccacgctcgcttggcgcttcgtggaggcggagcggctgggcgcggaggcgtcacgggcttcgctcgacgagcggctcgctccgcccgccgagtctcgcacgcaccgcgtccatggcctgttgctggcgctgcgtgcgcgcgttccggcgtccgtcgccccccggccgatgcacgcgctggtgccggacctgatgcagtacgacgctccgctgccgggcttccgtctccgcgagacgcgcatctccgagctgcctgtgggggcgcatgcgggcttcatccttcccgaggcccggctgattttcgctcccaccgaggtgacgggggactgctcctgtggcgcgacgttctgcgtccacctgctggcggccatcgacacggcattgcagtggttgcgccagccctggtccgagtcctttggagaggagctggaggaactggtccgtcccggttgggagcgcgcgctgcgggcgctggagcgggccgttgacgacagtcccggtgggcctggaggtggcgaggtctcctggcggctggacgtcatcaacgggtatggcgtggagctcgcggcctacgtgcacaagcgcaacaagaagggccagcgcagcacgggcgcgaaggtgagccggcgcaagctgctgcaggaccatggctcgcaattgtcggcggcggacgcgcgcttggcggcgctgctgccggagtcggaagcccccgcgtcgcgcgcgctgctcttcgaactggtggggcatccccgcatccacctggatgagaatccggacctgctggtgcgtatcgagcgcgtgaaggtcgggctcgtcgccgaggaccgggacggcgtggtcatcgtgagcgcgggggtggatggcgcgatgctgcccacggcgatgctggagcgggtgcgcaaggctcagccggaggaggggctctacatctgggatgacagccagcgggtgctcacggtgctggacgcgggccccgaggtccgcgcgctgctcacggcgctgaaccgccacggcaattcgtttccgccggagagccacgtcgcgctgctggaccagctgtcgaagctgtccctgcgcgtgccggtggcgctgcctcggagcgtcttgggggagtcggtgccgctgcgctacgcccccgtggtgcgcatggaagcgcatgcgagcggggcggtccgggtggagctgcgcacgcgcccgttgccggacagtcccacgttcattccgggggagggggcgcgcgacgtccacgtccggcgggggacgggggccgtgcacgcggtgcgtgacttcgttcaggagcgcgacgcggcggagttgcttcaggcccggttgccgctcgacacggcggagcccgaggagctgcccttcaccttccgcttcaccagcgcgcagggcggcctcgcggtgctcgcggcctgtgtggagctggagccgaagccggagctggaatgggtgggggcgccggtgcggctgttccatgccgctgcgcctccggcgctgaaggtcatcctggagcggaagcgggactggtttggcgtgctgggtgggctctccgtggaaggcgagcgagtggagctggcgcggctgctcgatgcggcgcggcggaaggaacgtttcgtccaggtggactcgacgtcctacgtggagattgaaggcgcgctgcgggagcacctggagcggctggcggaccatgcgcatgccacgcgccatggcctggaggtggggccttccgcggtggagacgctcacggcgctccaggacgcaggcgccgaggtggaggcggacaacacgtggcagtcgctggtggagcgcatcttcgcggcgaaggagctgaagccgcgggttcctacgggactgaagacggcgcggcgggattaccagttggagggcttcccctgtcttacccgactgtcttcgtggggctcgggtggggtgctcacgctccaccgtagagcg

SEQ ID NO: 9190 - DNA, 1095 bp, Myxococcus xanthus
atgccaacgcccacttcgaagcgagggctgctgctcgtcaacctggggacgccggatgctccgcagacggggcccgtgcgccgctacctgcgcgagttcctcaatgacccgcgcgtcatcgacatccacccgctggggcgctgggcgctgctcaacttcatcatccttccgatgcgtccggcgaagagcgcggaggcgtaccgcaaaatctggatgaaggagggctcgccgctgctcgtgtacagccaggccctggcggcccaggtggccgagcggctggcgggggagtacgaggtggtgctggccatgcggtatggctcgccctccatccccgacggcatcgcggcgctcaaggcgcgcggcgtgtcggagttcaccgtgctgccgctgtacccgcaggaggccgcgtcctccaccgcgtcctcgctggcgcgcacctatgaggtgctggcccagtcgtgggacgtgcccttcgtgcgcgcggtgccggccttcttcgagcacccaggcttcctggatgccttcacggccgtggcgcggccggtgattgacgacgcgcgcgccgactacgtcctcttcagcttccatggcctgccggagcggcacatgcgcaagagcgaccccacggggacgcactgcctgtccaccgcctcgtgctgcgacgccatgacggacgccaaccgccactgctaccgcgcgcagagctacgcgacggcgcgggggctggcccagcggctgggcctgccggcggaggggtggagcgtgtccttccagtcgcggctgggccgcacgccgtgggtgaagccgtacacggacgtggtgttgccggagctggcgaagaagggcgtgaagcgcctggcggtgatgtgcccggccttcgtggcggactgcctggagacgctggaggagattggcctccgcgcgcgggagcagttcctggaggcgggaggggagtcgctgacgttggtcccctccctcaacgcccacccggcctgggtggacgccgtggtgcgcatggtgcgcgagtcggacgggccgcctactgctgtggctgggccgttggcgtcggcgcgggagccgattccaccgcggtga

SEQ ID NO: 9191 - DNA, 360 bp, Myxococcus xanthus
atccgcatcaccgtgaagcccgcctactggccggagcgcagcgctccggagtccgggcagttcgccttcatgtacacggtggagattgccaacgagggcgacgcgccggcgcagctcaaggcgcgccattgggtcatcaccgatgccacgggcaaggtggaagaggtgaggggcgagggcgtggtgggccgccagccccacctggggcccggagagcggttcgagtacacgagttgggccatgctgcgcacgcccttcggcaccatgcgcggcacctatgacatggtgcggccggacggcacgcacttcgaagcgcgcatcgccgagttcgcgctcacccttcccaactccctgcactga

SEQ ID NO: 9192 - DNA, 933 bp, Myxococcus xanthus
ctctgggtgggtttcaacgtcttcgtcctcgcgatgctcgcgctggacctcgggctgttccatcgcaaggaccatgcggtgacgccgaaggaggcgggcctctggacgctggtgtggattaccctcagcctgattttctgcgcgggcatctggcactaccaggggcccaccgtggggctccagtggttgacggcgtacgtggtggagtacgcgctctccgtcgacaacctcttcgtcttcctgatggtgttcagctacttccgggtggcgcccgagcaccagcaccgggtgctcttctggggcatcctgggcgcgttcgtcatgcgcgctggcctcatcatcgccggcacggcgctggtgaagcagttccactggctcatctacctgttcggcgcgttcctcgtcttcaccgcggtgaagatgctggtgtccaaggacgaggagatggacccggagcagcagggcatcgtgaagttcgcgcgccgggtgctgccggtggcccggctgggtgaaggcagccgcttcatggtgcaggaggacggccgcagcaagttcacgccgctgttcatcgtgctgctggtggtggaggccacggacctgctcttcgcgctggactccatccccgcggtgctgggcatcagccaggacgccttcatcatctacacgtccaacgtgtgcgccattctgggcctgcgctcgctgttcttcgtcgtggccagcctgatggagaagttccacttcctgaaggtgggcctgagcgccatcctgggcttcgtgggcgtgaagatgctcatcaccttcttcgacatccacgtccccatcggcatctccctgggcgtgattgccggcgtgctggtggcggccatcgtcgcctcgctggtgtggccgaagcagccggagcccggacaggaccgggaaagcgcgaagacgtag

SEQ ID NO: 9193 - DNA, 2142 bp, Myxococcus xanthus
atgaggagggccgaggtgcttccagggaagccgtatcccctgggcgccacgttcgatgggcagggtgtcaacttcgccgttttcagcgagcacgcgaagaaggtcgaggtctgtctcttcgatccggaggaccccgcgaaggagacgcgccgctttcccttgctggagacgacgcaccaggtgtggcacggctacgtgcctggcctggccgcgggcgccctctacggactgcgcgtgcacgggccctacgagccgaagaaggggctgcgcttcaacccccacaagctgttggtggacccgtatgcccgggccatccacggccaggtggactaccaggcccccatctacgcctatacgccgggcaccaaggaggacgacctcgcgttcgacacgcgcgatgacgcggccgccgtgcccaagggcgtggtgatgggcgcggacaccttcgactgggagggagataccccgcctggcgtgccgtggcacgacacgctcatctatgaagtccacgtgaagggcttcacccagctgcacccgcgcgtcccggaggcgctgcggggcacctacgcggggctggcgcacccggccagcatcgagcacctgaagaaggtgggcgtcaccgcggtggagctgctgcccatccagcacatcgtcgacgagcctttcctcatccagcgcgagaaggtcaattactggggctacaacacgctggggttcttcgcgccggacgcgcgctacagcggctcgggttcgctgggcgggcaggtggacgagttcaagcgcatggtgaagcagctgcaccgcgctggcatcgaggtgctgctcgacgtcgtctacaaccacacctgcgaaggcaaccagctgggccccacgctgtccttcaagggcgtggacaacgcggcgtactaccggctcacggagaaggacccgcgctactacctggacgtcaccgggtgcgggaactcgtggaacgccacgcacccgtacgcgctgaagctcgtcgccgactccctgcgctattgggtggaggagatgcatgtggacgggttccgcttcgacctggccaccacgctgggaagagacaggcacggctacgacacccgcgccgccttcttccaaatcatccaccaggacccggtgctcagccgggtgaagctcatctccgaaccctgggacgtgggcgactttggctaccaggtgggcaacttcccggtgctgtggagcgagtggaacggcaagtaccgcgacaccatccgccgctactggaagggcgatgaccggcaggcggcggagattggctaccgcctcaccggcagctcggacctgttctcactgtccggccgcaagcccgcagcgagcgtgaacttcgtcaccgcgcacgacggcttcacgctgcacgacctcgtcacgtacaacgacaagcacaacgaggcgaacggtgaggagaaccgcgacggcgccaacgacaaccactcctggaactgcggggtggagggcgagacgaccgacgccgaaatcaacgccctgcgcgaacagcagaagcgcaacttcctggcgacgctcttcctgtcccagggcgtgcccatgctggtggccggcgacgagatgggccgcacgcagaagggcaacaacaacgcctactgccaggacaacgagctgtcgtgggtggactgggagctgaacgacacgcagcgcgcgctgctggacttcacctgcgccctgaccaagctgcggcgtgagcagccggtgctgcacaagcggcgcttcttccgcggcgcccatatgtgggacagcgagctgaaggacctggcgtggttccggcccgatggccaggagatgcgcaaggacgactgggagaagccctacgtgcgctccctgggattcctgctgggcggtgacgccatcaccgcgccggacgatgaagggaaccggattgtgggggacaccatcctggtgctgatgaacgcccaccacgagcccatcaccttcaggctgcctgctgtcgaatggggcgcggactgggagctggtggtggacacggcgttggcgggggagtcgcttcgcacgcatacgccggcggggggcaccgtgcaggtggtgggccgctccctggcggtgctgcgccgcccggcgacggagtag

SEQ ID NO: 9194 - DNA, 261 bp, Myxococcus xanthus
gcccgcgagcacggcgacacggtgttggtggcctgcgcgccgcgttacaccctgtccgccctgcagtcccctgaagggctggcgggcgcttatggcagcacgttcctggaccttccggaggcatatgcgggcatgatgttccgcgatgtgttcaccggctgtcaggtgcggcccgagcgtggaccgggtggtgcggtgttgcctctggggccgctcctggcggagtttccggtgattctgctggagaggagcgccggatga

SEQ ID NO: 9195 - DNA, 840 bp, Myxococcus xanthus
atgctctacctgggcgcggcggcgctgtccgtggtgctcgcggcgcgggacacggcctggacagactggctcgctcgcgccccgctgtacctcatcgccgcggcgtcgttacatggcatcagcctgttcacccatgaggccgtccacggtggcctcgcgcggcggccctggttgaaccggctgggtggcatcgcctgcgcgctcccggtgttgcagaactacgcggcctacaaagtgctgcacctgaaacaccatgccgacctgggcggagggaaggacccggaccactacgccaactacacgggtcggcggtggctggagttgttgatgcatgtgggccggctgctgctcggttatcccgcttacatcacgatgattcccatcttgggttggcgacagggaacgaccgccgagcgccgatgggtgctgttcgaagtggcgctggccgtcgcgggcctgacggccgcggtcatcttcatccccggacaggtgctgctccatgcctgggcgattccgatgctcctcctcaacaccctggtcaacgtccggggcatgagccagcacaccttcctgccagagagcacgcacccggtccgaggctcccggaccatcctgtcgaacccggtgacgcgcttcttcatgtgcaacgagaactaccacctggagcaccacctgtacccccgcgtgccctggtacaatctgcccgagttgcaccggacgctgcgcgcggacctcgtcgcgcagggggcccccttcatcccgtcctacttctcgttcgtgcgcggcgtcctctccggttcgctcatccgaggggcgaaacccgccacgcccgatgcctga

SEQ ID NO: 9196 - DNA, 891 bp, Myxococcus xanthus
atgcctgagcggctgtacccgcacgaagtcctgctggcggcgttcggcatcgtcctctccacagcgctggtgttcgtcgcgggaatctccgcgaccgtcaccgcgcaagccgttggtggcacggtgctgttcatgggcagcgtggcgctgctggcgcgactggacgcagtcgcccatgtcttccgggcacggctgctgctcgcctacctcgcgacgttcttcttctatgcctccgtgaagcaggccgtccccgcgctggggctcgtgacgcgtgatgcgtggctcctgtccgctgacgtgttcctgttcggcatcacaccggccgcatggctccagcggtggagcacgccctgggtcaacgagctcttcagtgccagctatctagcgttccacggatacctgcacctcgccatggcctgggcgctggtggggccgcgtgcgcgagcggagcgcttcttcatcgacgtcttctccgcctatctcccgggcatcgccggctactacctgatgcccgccatcggtcccgtggccgcctggccggagctgttcaccgtccccatcgagggtggctggttcacgcaactgaatgccgccgtcgtggcgagtggttcgtccacctacgacctcttccccagcctgcacacgtacatcacgctggtgctgctcgaacacgaccggcgccagcacccgtggcggttccggctgatggtgcccgtcgccgtggccatcctcatgtccacgctggtgctgcgttatcactatgccgtggacctgctggcgggcgccgtgtggttcatggtgtttcgcgcctgcttcccccggcttcaggcgcgctgggaggcgcggacggcgctatcgaagcacgaagcgccgacggtgggcgtcgggtga

SEQ ID NO: 9197 - DNA, 996 bp, Myxococcus xanthus
ctgcccgagggcagcgtggcggtggtggaccgcaccgtcgcgaagctccacccctccctcatccccaccctggaggcgcgcagcccccgcgccatcatccagctcaccggcggcgagagcgccaagacgttcaccgccctggagaaggtcctcgccaacggactggcccttccgcgctccggcacgctcgtggccgtgggcggcggcaccatcggtgacgtctccaccgtggccgcgcatgtcctcaagcgcggcgtgcgcctggtgcaggtccccaccacgctgctggcggcggtggacagcagcgttggcggcaagggcgctgtcgacatgacggtgcgcgggcgcgtggtgaagaacccggccggcgtcttccactacgcggacgaaggctgggtgtgccccgagttcttcgacacgctctccgatgcgcagcgccgcgagggcgcgctggaggcctggaagatggtggtcagcctcgacgcgccgctcttccgccgctatgtgcgcaagccgcccgcgctcgagaagctcgtgaaggacgcccgcgccctcaaggagcgcatctgcgcgcaggacccgtacgagcacacggggctgcgccgggtgctcaacttcggccacaccttcggccacgtgctggagagcgtgtcccgcttcaagctgtcccacggtgacggcgtgggtctgggcatgctgctggccctggacgtgggccgtcacctgggcgtgacaccggagcccgtggccgccgaggtcgaagccgccctggccaatggccccggcgtgcagggccgcgagcgcgccgccgccctgctccgccgcgcgccgatgaaggacgtgcgggcgctgctcaccgccgacaagaaggccggcgccaagggcgagctgcgcatggtgctgctgacggccattggcgccaccgaggtgcgtgacgtggacgaatcaagctggcgtgccttgtggcccgcgtggacgaagggggagcgaccatga

SEQ ID NO: 9198 - DNA, 417 bp, Myxococcus xanthus
acggccctggaagaccaggtgctcgtgctcgtcaacgagcgccgcgccgcgggagccgtctgtggcggcgtggccaagccgcccgcgcccgcgctcagcaacaacccccagttgcggtgtgcggcgcgcaagcactccaaggacatgggcaccaacaacttcatgagccacacgggctcggacggctccacgccctggcagcggatgaactgggccggctacacgtaccgcaacgccgcggagaacgtcgcggccggctactccacggccctggccgtggtgaatggctggatgaccagcaccgggcactgcaacaacatcatgaacccggcgctgctggagattggcgtcggctacttcaacgcgccgaacagcacgtaccggcactactggacgcaggccttcggccggcagtaa

SEQ ID NO: 9199 - DNA, 591 bp, Myxococcus xanthus
atgcgtggccgggcgctcatccagggcgcccggcccgcctcgttcgtcatggacttcctcctgctattcgtcggtctcatcaaggtggtgttcggcggcctggtcgccgcgctgggcatctggctcgcgctgcgtggactgagccgcatcctcggcgccaaccccgtggaggagctgcgccagggcaacgtcgccgcctgcctcgtccacgccgccagcctggtgtcgctgggcctgctggtgcagcacgcggtgcaggccacgtcggacgcactggacctcaccgtgcagaatccgccgctgcatctgctggtcgtgggccggctggtcgcggtggccgtcctgcacgtggggctgtcactgggcgtgggcgtcacggtgctcggcacgggcgtgctgctgttcgaccggatgacgccgggcatcgacgagctggcggaagtgcgcaagggcaacgtcgcggcggcgctcatcctctccgccatcctgctggtgctggcgctgctgaccgccccgggcctccaggcggcgctcaacgggctcatccccttcccccagctccttaaagggacgctgcgcgcgcccgcgtga

SEQ ID NO: 9200 - DNA, 486 bp, Myxococcus xanthus
atgcgctgcatctacgaggaattgatgcgcaccaacgccgagcccgtgcggaggctgggtgacaccttcgtcgcctccatccgcgagcggaggctggatgccgcgcaggccacgcagctcatcctcggcttcgttcagagcatcgactacgaactgccggagcacgaggccttcggcatcgtcccaccggcgctggtccccgccgagaatcgcggcgattgcgactccaaggcggtgctcgcggtgatgctgctgcggcaggcgggagtcgacgcggtggtgctgtactccgacccgctgtcccacgcggcggtgggcgtggggctgcccggcaagggcacggcgctgcgctacgccgggcgcagctaccagtacgcggaggtcaccgcccagggctggccactgggcatgattccgccccaatacgacaagccccggctgtggaaggtgctgcccctcaacgggggcccggacaccgcgggctga

SEQ ID NO: 9201 - DNA, 363 bp, Myxococcus xanthus
atgggtgcaccttccctcatccgaaatttgaagctgcgtcagcacatcgccgggctcaaggcggagtggaacgcattggatgcgccctacctgcgcgcgctgagagacggcaccttcgcgcgggaggacttcgtcgaaacgcagctccagttctcctccgcggtggcgcacttctccaggcccatggcgatgctcgccagccggctgcctcggccccaccagcggctgccgctggtggagaacatcttcgacgagcacggacgcggcacgttggctcacggccacgagcgcacgttccacctgctcctctcgcgcctgggcgttgagacagctcgcgtggagcgacatgtgacctggccctag

SEQ ID NO: 9202 - DNA, 921 bp, Myxococcus xanthus
atgagtgacgtgcgcttcatcgttgcccggcccgactcgctcgggccctatgtcgagcggctgcgcctgctggagcgtgaaatcctctatccactcgcggatggggccgaccacttcttcatcgaccatgggcccgggtaccacccgttcttctcctccatgggagaggcgtacttcctgctggcgctccgtggcgacgacttgctcggttccgtgacgggggtcttgcgtccggtgtggcacgggacgcggaaggtggacgcgctctacatctgcgacctcaagctggcgaagcacgcgcggggctccggcctctccacgaagctcctgcttcaaggcctcaagcacctcttcctcattcctccgctgcgccggattcgtttcctctacggcgcggccatgcgcggcgcccggggcgatgtgatgcgcatcgcccgtgggtggaatccgctgcgcatggggcgccccgcgagccagctcgcgctctacttcgtgccgcccgctcggcttcaggcggtggatacgcggagtgcacccccgcgccccacgggagcagggctccgtctggggcccgcgcccgccaggacgctggaaggggcggggtggtgcaccacggcgggggccaaggaccttcagcgtttgtccacggggcgcccgtggccgctggtccatctggcggcgccgcccgaagcctggacgcagggttggggcgagtaccttcgtacctgcggtgtggagctggcggcgctcggggaggaggcgctcgcctgtttcagcatcgacgagcggctggaggaccacgtccactggctgcgagaggtgggcatcgctcctgattcggtgtgcaccgtctattctctcgacctctcctttcctgccagagcgccagcatgggtgcaccttccctcatccgaaatttga

SEQ ID NO: 9203 - DNA, 990 bp, Myxococcus xanthus
atggaacctggcctggtttcgacgccgccccttcgcttgaagttcgccgttgtccgggaggatgccgcgctggagttggcgctcgtcgagcgcacgcgggcgcgggccgtgctcacggtggcctcgggaggttgcacactcctcaccctggcgcggcgccatccagcgctcgagctggtgggcttcgatttcaacccgcgtcagctcgcgcatgtccgggagaaggcggaggggctcggtcgccttccgctggcgcgctacagcgtggatgcggaggacgcggcggccctgaatcagcgcggcgaattcgaggggctcttccgcacgctccgccgcttcatcgaggagttcgtcgcgcccgcgcatgaactcgccgcgttcttcgcgccggccaccacggcctcacaacgccgggaggcctgtgcccgctggttcgcttcgccctactggcccgtggccttcgagctggccctggcggcgccgctgctgaacaccatgtttggtcccgcggcgacccagcatgccgagcccggctcgtatcctggctatttccaggcggtcttcgaacgcgggctccagcgcgaggatgcgcctcgaaatcccttcctccagcacgtgctgctcggcaggtacctgcgtgaggatgcccccgagtatctccgggctgaaggcccgctggcgctgacgctcgtccagggctcgttgccggatgtgccgcgcctggaccgcttcgacgtcatctcgctctccaacatcttcgactggtcggaagacgcgctggtggcggagtgggcgggggtgctcgcacgtgaggcccggcccggttgcgccgtcctcatccgccagctcaacaaccgccgggaccttcgcggcttcttccagcccgccttcgagttcgatgacgcgctcggcgcggagctgcttgccagggacaggagcctgttctacgagcgcatcgaggtcggcttccgcgtgccagacagcccatga

SEQ ID NO: 9204 - DNA, 1254 bp, Myxococcus xanthus
gcgagtgattcaaacacccgtgagcgcgggacaggggccctgccgttgctgcgtcaccactcggcgttccgggccttgtggggcgcgcgagtcctctccttcacgggtgatgcgctcagcctggtggcgctcatgctgtacgtcgcggagcagacggggcaggcgctggctgtctccctgtagctgctcgtgggggacttcgcacccgccttgctggggccgctcaccggggccatcagtgaccggttcgacctcaagcgagtgatgattgcctgcgagttgctccagggcgcgctcctggtgctcatcgcgctcacgatgccgccactgccggtactgctgactctggtcgccgcgcgagcggttgccggacaggtgttccagccagcctcccgggcggtggtgcccgcgttggtgcggagcgaggacctggaggccgccaacgccagcgtgggcttcgggacgcaggccgccgaagcgttggggccgttgctcgcggcggcgatgtttccgctcgtggggctccagggcgtgctgctggtggacgcggcgtccttcttcctgtccgcgggcttgttggtggcgctgccgtccgtgccgcctgcgcatgacggcgccgcgccgcccgtgtcgttgttccggcaggcacgggacgggctcgtctacctctggcgggcgcgggtggcccgcgtcgtcgcgttgggcttctgcgccgtggtggccttcaacggcgtggatgacgtggcgctggtgttgctcgcgaaggacaccttccaggcaggggactcggcggtggggttgctgctgggcgcggtggggctgggcctggtcgcgggctacgtgctgatggcgcggctgggcgcgggggcggcgatgccggtgatgctggtgctgggcttcgcggtgagcagcatgggcaacctgctgaccggcttggcctgggccgtctccgcggcgttcgcgatgcaggccgtgcgcggtgtgggcatcgccgccatggatgtggccagccacacgctcatccagcgctgggttccggctgggatgcgggggcgggtattcggcaacttctacggcgccattggtgtggcggcggggctgtcctacgtcgcgggaggattgttgctggacgcgacgtccgcgcccgtgacgctgctggtggcgggggcgggtggaatgcttgcgaccgtcgtggtggcgtggcggcttccgggcgcgctgcggacaagcgccgcaacgcgcgaaccggattga

SEQ ID NO: 9205 - DNA, 708 bp, Myxococcus xanthus
atgctgccgggtgcctgggtggtgctgcgcgtggatgggcggggcttctcgcgcttcaccgaggcccgctacgagaagcccttcgacccggtgttccaccagttcatggtgcgcaccgccagcgtgatgctggaggaactccaaggcgtctacgcatacacgcagagcgacgaaatctccgtgctcttccggccggactgggcgctcttcgaccgctccgtcgagaaggtggtatcgctggcggcgggcctggccagcgccaccttcacgcacgccgcgggtgtcccggcggtgttcgacggccgtgcatggctgggcgcatcggagcgcgcggtgctggactacttcatctggcgacaggcggacggcagccggtgttcgctgcatggctggtgctactggacgctgcgcaaggagggccggagcgcggcgcaggccacccgtgagctggacggcaagcccgtgagctacaagaacgagctgctcttccagcgaggcatcaacttcaacgacgtgcccctgtggcaacggcgtggaagcggggtgtggtgggaggcgtaccagaaggagggcgtggacccacgggatggccggcggacccagacactccggcggcggctcaaggtcgactccgagctgccaatgaaggaggcctacgagcacctggtgcggggcctgctcgcggcgccaggcgccgaggcggactga

SEQ ID NO: 9206 - DNA, 1968 bp, Myxococcus xanthus
atgacgccctccctcctgctcatcgaagaccccggtgcctcccgggaactccaggtgctttccctggaaagtcagggctggcgggtctgggcttccgcagacgttccgggcgcactgacgctgctgcagacgcagtcggtgcaggtggtggtggcggcggccggcctgctgatatcggatgggacgcacctggagtcactgcggcacgcactgtcgctggcgggcgccctgttgcaaatcagcgccttccccgcagagcgggaggcgctgcgcccgctcggcttgtcggtggagcgctacctgagccggcccctgtcgctgggggcgctggtggaaggggtgcggcaggccttcccggtggaggcggccggggggccggaggcacggcggccccgcgtgctggtggcggatgacgacccggtctcccgcaagctggcgcaactgcacctggcgcctttccgtttcgaagtggtgctggcggcggatggcgccacggcgctggacctggcgcggcgccgcggtccggacgtggtgctggcggacgtgctgatgccgggcatggacggcttcacgctgtgcctgggcttccggcaggaccccaggttggcccgggtgcccgtcatcctcacgcacaccatcgcgcccgacgagctggacttgcgcatggcccacaacgtgggggccaacggcttcgtgcgcaggacgcaggagggcgacgagctggtgggcgcgctgctgcgtgagctgcgcgccggcgggccttcccacacgtcgccacccgcggacctgagcaccgaggaccacctgtaccggatggtgcgccagttggagcggcgggtggggctgctggagcaggccgagcgcaccgcccgggagagcgaggcgcgctaccgcctggtggtgagcggctcctacgacggcatctgggactgggatttgcgcggccaggccttctactggagtccgccgctgctggacatgctgggcctggggccgggggacttcggcgggacgttctccgccttcctggagctgattcacccggaggaccggccggaagtcatggccgcgctgtccgcgcacctggagcggggcacgccctatgacgtgactctgcggctgcggcacgtcaccggcacctggcgctcgtgcgtgagccgtggccgggcgctgcgggacgcgcagggccgcccggtgcggatggccggcatcattggcgacgtgacggagcagttgcgtctctaccgcgagacgcaggaggcggtgcgcgcgcgcgacgacttcctcagcgtggcggcccacgagctgcgcaccccgctggcggcgttgcggctgcgcgtgcagggcgcccagggcgtgctgcgcgcgggcctgagcagcgggacggagcggctggagcgcgcgctggattcggcggaccggcaggtgcagcgcctgtcggacctggtggagtcgctgctggacgtgtcgcagctccagggcggcgcgccccggctgcacctggaggacgtggacctggcgctggtggtgcgcgaggcggtgtcccgttcggaggacgcggcggcgcgcgcgggctgtctgctggtgctcagtccgctggagcccacgccgggacggtgggacgcggcgcgcctgtcccaggtgatgacgcacctgttgtccaatgcgatgaagttcgggccgggcaagccggtggaggtggcgctggagtccgggcgggacgtggcgacgctgatggtgaaggaccatggcatcggcatcgcgcccgggcggctggagagtctctttcgccgcttcgagcgcgccgtgccggtgcggcactacggcgggttgggcctgggcctgtaccgcctgcgccgcatcgtggaggcgcatgggggcggcgtgtccgtggacagcacccccggagcgggcgccacgttccgcgtccgtctgccgcgcgagggcccgcccgcggtgaggggctga

SEQ ID NO: 9207 - DNA, 452 bp, Myxococcus xanthus
atgagcacggcgaaggcttcccgtatcgtggtggacccatccgcgctgcacgccgcgcccctcaccccgccagtgtccaagtcggacgcgcagcgggcgctggtgctggggcacctcacgggctcgtggccgctgccctcggtgcaggccgaggcggacgaggacctccccgccgacgtgcgcgtgctgcgccagggcgtcgaggccctgcgtctgcctccggacgccgtgcgcgacatcgactgcgcggacggtggcgcgcccttccgcatcctggccacccaggcggcggtgacgcccggcgctcaggcgcgcttcaccggcacaccccgcctgggcgagcggccccacggcccgctcttcacgtccctgcgcgaggccctgggtcccatgggcctcacgctcaccgagggcacgccctggcccgtggagctgcgcgcgccccgtgatac

SEQ ID NO: 9208 - DNA, 342 bp, Myxococcus xanthus
atgcgcgacatggtggtcgcgtgcctgcggccctatccgggcctcaccttctcgcatgcttccagtggcttggaggccatcgagcggctgtcgctccagccgtgtgacttgctggtgctggacctcaacatgccggacatcggcggcatcgaggtggtggagttcgtgcgtgggcaggaccggctgcgcgagctgcccatcatcatcgtcaccacgcggggagacgaggcatcgcggacgcgggcgttggcggcgggggccagccgtttcatgacgaagcccttcacgccggacgccatcctgtcggaggtgcgtgggttgctggaggggaggcgcgcttga

SEQ ID NO: 9209 - DNA, 1995 bp, Myxococcus xanthus
atggggcaccgccagttgctggctctggaggccagcatccggcgggggctgccgcacccgcgcgccgtgcgcgagctcttccgcgccgtgcacaccatcaagggcctgtcggccatggtggatgtggagcccatcgtcgacatcgcccattggatggagacgtgcctgcgccacgccgaccgggcggggggccgcctgcccgaggccagcgtggagccgctgatggaggggctgcgcgaaatcgagcagcgtgtccgccaactcgccgtgggcaagcaggccgcgccggtgcccccgggcctgttgtctcggctggaggcgctggatgccgaaggcgctccgggtgggagcgtcgcgagggcggcgcccgccgcgctggcgctggaggaggccgtggcctcccggctctccgcggtggagcgggagcagctcaccacgggcgccaccgatggccgccgcgcggtgcggctggacttcatccccggcgcggaccgcgccgccaacggcatcaccatcaacagcgtgcgcgagcgcgtggcctcgctgggcgagacggtgaaggtgctgcccctgtcggggcccgccgtgggcggaggggcgctcaccttcgtgctgctgctgctcaccgaggcctccgacgccgcgctgctggaggccgcggggggcccgcccgcgtcggtgcgcccgctggccgccgtcgccccgaggacacccgccctggcgcccttgcccgagtcggcgctggcggacgaggagcccgaggaggcgcggcgtggcggcggctccctgcgggtggacgtgtcgcgcctggacgaggcgctggagcggctggcggcgctcgtggtcaaccgttcgcgcctgacccgcgcggtggcggcgctgacggcggccggcgcgcccacgcgcgagctgcaggccatcctccaggagaacgcacgccagcttcgcgacatgcgcacggccatcctccgcttgcgcatggtgcgggtgggggatgtgctggagcggctgccgctgctggtgcgcggcctgcgccgcagcacgggcaagtcggtgcggctggagctggatgtgggggacgcggagctggacaaggccgtggcggaccggctgttgcccgcgctggtgcacctggtgcgcaacgcggtggaccatgcgctggagtcgccggaagcgcgccgcgccgcgggcaagccggaggaaggcgtggtgcgcgtggccagccatggccgggcgggggggctgttggacctcaccgtggcggatgacgggcgcggcgtggatgcgcgggcggtggccgcgcgcgcgggcatgcccgtgcctccgacgccggacgcgctgctggaggtgctctgccggcccggcttctccacccgggatgccgccaacgcgaccagcgggcggggcatgggcatggacatcgtccagcgcatcatcgtggaccaactgggcggcgagctggggatggagacgcggcccggcgccggcaccaccttccggctccgcgtgccgctcacgattacgctgctggacgcgctcgtcttcgagtgcgccgggcttcgctacgccgtggcggtgggctccgtggaggagctcgtcgaggtggacgccgcgcggctggtgtggcccgcgggcgcggggggcgtggccctgctggagcgcagggggaactcggtgccgctgatggggctggcccggctgctggggcgcggggaagcggacggccacgaaggctcggtggccaaggcgctcctcgtgcgccagcgcggtgagctcgtcgcgttcggcgtggagcggttggtggggcagcaggaaatcgtcctgcgtccgctggaggaccccttggtgcgcgtgcccggcgtggcgggcgccacggacctgggggatgggcggcccacgctggtgttggacctggccgcgctcgggctggcgcgaggtggcggcgcgccgcaccgacgcagggcttccgtctgggaagaggggcgcctcgcatga

SEQ ID NO: 9210 - DNA, 447 bp, Myxococcus xanthus
atgagcgtgctgcatgtcgtgttcaaggtagacggagccgagtacgtgctgcccgcggcggacgtgctccagatggagtccttcacgggggccacgcccgtaccgggcgccgcgccgcacgtcgccgggttggtgcaggtgcgcgggcgcgtcatcccggtggtggatgcccgcctgcgcttcggcctgccgccggtggagcgcacgctcgactcccgggtggtggtggcgcagctcggcagccgggtcgtggggctcgtggtggacagcgcccgcgaggtgctgaagctggacccccagcagctcaagccgccccctccgctggtcgtggagggagcgcgcggtttcgtgaaggccgtggcccaggtgggcccgcgcctggtgatgctcatcgatttccctcgggtcatcggggaggagacgttggatggcgacggacagcggtaa

SEQ ID NO: 9211 - DNA, 677 bp, Myxococcus xanthus
atggcgacggacagcggtaacgcaggggtggcgctggaagaagcccgtaccctggccgaagacgcggcgcgcagtgtccaggagagcgtggggttggtgcaggcggtggaggggctcgcgacgcggctggcggccggcggcaacgagcaggccgcggcctccgagcaggtgcgcgccgctatcgaatcggtggccgcgcacgtggaggagacgggccagtctgtccatgagttggtgcgctcgcagcgcacggtgagcgactcagcgcgggcccaggtccaggaggccgaggccaacgcgggcaccctccatgaggtgaacgcctcggtggccggcgtgcgcaaggacgccgcgcacctggcggcctcggcggacaccacggcgggggcgctggaggaggtgtcgcgctcggtgaagggcgtgagcgccaacgcggaggagctggccgcctccagcgaggagctgctggcctccatgacggagatgaacgccaccgtggcggacctggtggcgcgcaaccagtccagcgccgccgccactgatcaggtgtccgccgccgccgaggagatggccaagggcattgtccggctgtcctcgtattctcagggtgtgggtgagcgcaaacggcaggatccccaggctgggccgagcactggtcgagctcccctggtcaaggg

SEQ ID NO: 9212 - DNA, 1425 bp, Myxococcus xanthus
atgggcaacgatatcgacaacattccaccggtgacgcgaccagagcccgacgccggcacgcaatcagacgcggggacggagccggacgcaggctcggagccacaggctgacgcgggcagcggtcctgttgaaggaccgtggccgacggacgcggtgacgaactactcgtctcgctacaacatctcccgggcgcaggcggtgggcgtggatgccgcgcacaacatctggctgctggatggcgaccggattggcgtgctgcgcgcggactcgcggcaggtcgtctggacgcgcgcgcccattggccaggcccagggcggcttcggtccggaccgagcggccaccggctccaccgtcatctgtggtggcagcgcgggccgcgcctacgtgggctacgccacgaccgacctgcgcgcggacccggacttcccgggactgcagcccaactacatcgtcagccccaacgagtgctaccagcccgacccggcgcagccgtgcttcccgtacagccatcgccggctccagtactacaggcagggtgacgtggatgtggtgcgcctggacggcagcaggcagattgtcctcgaggagcacctgcaccaatcggtgcgcaactcgacggacgcgaacggcaacccccgcgtgcagacaggcccgcgccggctggatgacgtgcacaacctgggcatccgcaacagcaacgaccaccacttcgacgaggaccgcagcatcctgagctgcgtgacggtgatgcacggccgtgacgagggcgacgtctacgtgggctccaaccacggcgtcactcgcatccgcggcctggagtacaactcccaccggcacccggtgtggctcaacgagaagggcagccagatggcgggctacacctacgggctcggcatcgcgcaggacggggacgtcctcatcgccaacgagtggatgttcggcatcgtcacgccgacgccccaccacggcgactgggacaacatggacaagcgcgtcaaccggatgaaggtggagtcctcctacctgccccagctcaacagcatcagtgagctcgacagttggcgcggcttccagcagacgaccgacggccgctactacctgggcagcaaggaccacggcctgtgggagatgacgattatgtgggcctccaatcaggcccagacgggcacccggctgaccggcgccaacgcggagcagaacgccgcgctccagaacatcaacgcgctggcggccaccggtgacggctcgctctacattggcacggaccgcacgggtctgtggcgcctcacgccgctgaagacgctggagaaggtggcggacgtgagcggctcccgggtgcggcagctcatctacgacccgcgggtggcgccggcggcgctgtacgtcctcaccgacaaaggcctgacggtcctccgcggcaactga

SEQ ID NO: 9213 - DNA, 531 bp, Myxococcus xanthus
atgaagaagctcatcgccgcagtcgcattgtgcgtgggaagcgccgcgttcgcacagcagcagccgtcgcaaacgcaggtgccccgccccggtacggagaagagcaccggcgtggacgccaccgaagtggggcccgccatcggcaaggccgccaaggacgtgacaggcatccagacggaggatgaaggcaccttcaagatggacaaggccatgagcctgcaaggcaccctcaaggaggccaccgcggacggcgtgagcctgtcccgcccgggcctgcctgacgcggacctggacgtgcgcgacaagacggtgctgatgctagacggcaagaaggtcgccaagacggatgagattccggaaggcgcctcggtgcgcgcgaagttccagttggagggcgatgaggtcgtcgcgctggagctgcgcgccaccagccccaagggtgccaagaagaagcagccaggcaccggcggcgctggcacgcagccgcatgagtccgtcgacaaggagctcgacggcacgccgacgcggtaa

SEQ ID NO: 9214 - DNA, 234 bp, Myxococcus xanthus
atgccggacctcatcctgctcgacctgatgatgccgcgcatggacggcttcgccttccatgaggcgctgcgtcacgacacgagcttcgaccgcatccccgtgctggtggccagcgcgggcctggacgtgaagggcgcggcggaaggcctgggcgtcgccggctggctgcgcaagccgctggacctgcgcgagctgctcaacgcggtgaagcggctcagtcagttgcccaactga

SEQ ID NO: 9215 - DNA, 321 bp, Myxococcus xanthus
atgagccacgccgacctggtggacgcgctgggtgacgagggctacgaccgggtgaccatctaccgaaacctgacggacctcaccgaggccgggctcgtggtgcgggcggacctgggcgaccacgtctggcgcttcgaactgaagcgcgcgggcggggggcacagcggcagccacccgcacttcacgtgcaccgactgcggcaccgtggcctgcctcccggaggagtcagtccgcatcgcgtcctcgaagggcgtgccccgcgcggtgtcccagcgctcggtggaagtgcagcttcgcggtctctgcgacggctgcaactga

SEQ ID NO: 9216 - DNA, 411 bp, Myxococcus xanthus
ctaaagaagcgccgcttcaccacgtatgagcgggtggaggagctctacccgctcatcgtgaagaaggacgggcggcgcgaggcgttcgaccgggagaagatcgtcaacgggctgaagaaggcgtgtgagaagcggcccgtgtccgcggatcagctcgaggagacggtggtcgccatcgagcggcagctgcagggcatgggcgagaaggaagtgccctcgtccgtcatcggcgaggagatcatgcgccggctgcggcagctggacgaggtggcctatgtccgcttcgcgtccgtgtaccgcagcttccgcgacatcgcggagttcatggacgagctgaaggccctgcgcgaggcggaggcgcgcgagcagcgccaggcgcctccctcggcaccggtggacaagggcggttag

SEQ ID NO: 9217 - DNA, 1092 bp, Myxococcus xanthus
cgggcggtggctgagttcttcatgcgcatcgcgctggaggaagccgccaagggcctgggccgcaccagccccaaccccgtcgtgggcgccgtgctggtgaagggcgggcgcatcatcgcccgcggctaccacaagaaggcgggcagcgcgcactcggaggtcgtcgcgctggaggccgccggtgcgcgcgccaagggcgcggacctctacaccacgctggagccgtgcgaccactacgggcgtaccccgccgtgcagcatggccatcatcgaggcgggcgtccggcgcgtcatctgcgcgtcggcggaccccaacccgaaggtgagcggcaagggcgtgtcgcggatgcggcgcgccggcctcaaggtcctcacgggcgtgctcgcggaggatgcggaccgcctcaaccggcccttcttcaagatgatccgcacgggcctgccctgggtgacgctcaaggcggcggtgacgctggacgggaagctggccaccgcgactggtgactcgcgctgggtgacgggggcgccggcgcgcgcctgggtccaccggctgcgggactcggtggacgtcatcctggtgggcgccaacactgtccggaaggacgacccgaagctgaccacgcggctgcccggaggcggcgggaaggacccgctgcgcgtggtggtggacagccacctgcgcctttccccgggctacaccatcttcacgcagcgcagcgccgcgcgcaccgtggtggccacgctggaggatccggagggccgcaaggcgcggcgcttcctggcccagggtgtggacgtctggcagctccgcgagaaggcgggacaggtggacctcaaggccctgctgcggcggctggcgaagggcggccacaaccacgtcatggtggagggcggcgcggagatgtacggctccttcctgcgtgggcgcctggcggattcgctggcgctgttcctggcgcccaagctgattggcagcccgggcctgtcgtgggccggcgacctgggggtgaaggagatggcccaggccctggcggtgaaggacctcgccttcgaacgccatggcgacgacatcctgctccaggcgctgttgtag

SEQ ID NO: 9218 - DNA, 1628 bp, Myxococcus xanthus
  unsure (1)..(1628): unsure at all n locations
atggctccggagtccgttgatgtcatcatcgtgggcagtggtccggtgggagcgatggcggcgaatctcctgggacagcaggggattcggacgctggtggtggagcgtgaagtcacgcctcatggccagtcccgcgccatcagcgtggatgacgagggccagcgcatcttccagtccgcggggctggtgggcgacctgggcgcgggcttctatccgtgcaagcggctgcagtacctgaatgactcgctgcgctcgctggcggaggtggacttcacccggttggaccggccgttcggctacgtgcccgcggccttcttccagcagccgcgcatggaggcggtgcttcgtcagggactgaagcgcttcccgcacgtggacctgtggctgggccacgaggtggagtcctttctaccaatatgtggaaagcnntcaccgcccgcgtgaaggaggtcgcgggggagcgtgccgtcaacgtgcgcgcgcgcttcctgctcgcgtgcgacggctcgcacagctccatccgccggcggctgggtctgaagctcgtggggacgacggcgctggagcactcgctggccatcaccgtgaagacgcgctcacccgagcccgaattcaccagctacctgtgcggccccgtgcgccgggggttcatcgcgcgcaccgcgccgaacgagattcgcttcgacatcatcctggagccagatgcggacctgaaggcggcgcgctcgctcgagaacgtgcggcggctgatcggctactacctggacccggattcggtggagctcgactccgtcaagatcttctcgtaccacagccgcatgtccgagcagtggcgggtgggccgcgtgttcctcctgggcgacgcggcgcacctgatgccgcccttcctggggcaggggctctgcgcgggcctccgggacgcggcgaacctgacctggaagctcgggctggtgctcgcgggcgcggcggatgcgtcgctgctcgacacctacgaggaagagcggcgtggccacgtgtcggaggtgattcgcggctcggacgccatgggccgggtgatgatgtcgggcgggcgggtgatggctcgcgtccgcaacgcgctcatccaggtgatgtaccggctgccggtgacgggcgacttcatccgcgactacaaggtgaagccgcagatgccgctgcgccggggcttcatgctcggcgcccaacgcgagaagggggacgtgccggaaggctcctacttcccgcagccgcgcgtggagcggcccgacggggagacggcgctgctggatgactgcctgggcgagggcttcgtggtgctgacgcgtccaggtgcttcccaggaggcccagcgcgaggcacgggccctggcggacgaactcggagcacgctggtggcaggtggccgcggcggaccgcgcgggaagtggcgggccggacacgctggtggacctggacggccggctgggcgcctggttcgtgcagtacgcggccgacctcgtggtgctccggccggaccgctacgtgttcggcatcgcagggggtggcaagcggggccacctcctgggctcgctcaagggccgcgtccgccctcactcgcgtccgagtggcgcggaggtccggcgggcgggctga

SEQ ID NO: 9219 - DNA, 663 bp, Myxococcus xanthus
atgtttaccggcctcattcaggaccttggcagggtggagcgcgtcattcccggcgggatgaccgacctgtggattcacacctcgctgggcgcggcggccttcgagctgggcgagtcgattgccgtcaacggcgcctgcctcacggtggtggagcgcaccggtgacagcttccgcgtgcaggccgcgccggagacgctgcgccggacgacgctgggctccgtgaagcccggagaccaggtgaacctggagcgggccctggcgctgggtgaccggctgggcgggcacctggtctctggccacgtggacgccgtcagtgaggtgctggagacgtacccggagggtggctcctgggtgatggggttccggctgccggaggaactggcgccgtacttcatcgagaagggctcggtggccatcgacggcatcagcctcaccgtcaacaccgtggaggcggaccggttccgggtgcagctcatcccggagacgcaggagcgcaccaccttgaaggcgcggggcgtggggtcgaaggtgaacctggaggcggaccagatagggaagtacgtggcgcggctgttcgcgctccagcggggccagggggcccccgggggacgtggcgggctgacggcggcggccatcgcggctgcggggtttggcacgccgtag

SEQ ID NO: 9220 - DNA, 504 bp, Myxococcus xanthus
atgcctcgctacttcgacggtgactttctaccccccaagggccgtttcgccatctgcgtggcccgcttcaacggtttcatcaccgaggagctggccaagggcgccgtggacacgctggtgcgccacggcgtggccgacgcggacatcgacgtgtaccgctgccccggaacctatgagctgcccggtctggttcggcgcgtgaccgagacgcggcagtacgtgggcgtcatcaccctgggcgccgtcatccggggcggcacgccgcacttcgactatgtggccggcgagtgcgccaagggcattggcgcggtggccttcgaggccgcggccgccacccccgccaagacggtgacttttggcgtgctgacgacggacacggtggaacaggccatcgaccgggcgggcgtgaaggctgggaacaagggagcggaggccacactggcctgcatcgagatggtcaatctgtacgcgaagatgtcagcgacggacggaaggaaggcgtag

SEQ ID NO: 9221 - DNA, 423 bp, Myxococcus xanthus
atgggcgcgcgaagaacgggacgtgagcgtgcgctgcaggcgctctaccagttggagatggccaccgcgacgacggcggaggcgctggagtcagcctggtcggccgccgaggagagcaacaagcgggacccggacgcggtgaagttcgcccgggaactggtggaaggtgtgcagtcccaccgggacgaaatcgaccagctcattgagcggcacagccacaactggcgcctggaccgcatgtcgcgcatcgaccggaacgtgctgcgactgggcattttcgagctgaagtaccgcccggacatcccccgcaaggtgtccatcaacgaggcggtggagctgggcaagaacttcggcaatgaagaatcgagcgcgttcgtcaacgggctcctggaccgcgtcgcggtcgccttgaacaagccgtga

SEQ ID NO: 9222 - DNA, 198 bp, Myxococcus xanthus
atggctgaagcgggaagggtgctgtccaaggcccgggtggagtccgtggcgctggaagtgcccgccggtggccaggtggaggacgccgcgcgggccgcggctttccagaagggctttctgcccgcgttcaagggcgaacgggtggccgtcctggcggacaagggactcgtcaagtcgctgcctgcacgcaagggctga

SEQ ID NO: 9223 - DNA, 375 bp, Myxococcus xanthus
atgcgtgtcaaggtgttgattgtcgaggactcgaaagcatcgcgcgagtacatcgccgcgatggtcgaggccgtggagggggtcgaggtggtggtgacctcgagcggcttcgaggccctgaagctgctgccgcgtcaccgcttcgagctcatcatcaccgacatcaacatgcctgacatcaacgggctggagctcatcaacttcgtcaagaagaaccccaactaccgcgaagtgccgctcttcatcatcaccacggaggggcgcgatcaggaccgcgagcgcgggctcgcgctgggcgccgcggagtatctggtcaagcccttcctccccgggagcctggaagcgctcctgcggcgctacctgaagctgccgtga

SEQ ID NO: 9224 - DNA, 2202 bp, Myxococcus xanthus
atgggcgctccggcggaggttgccgcggacgacccgctggaccggttggagctggaggcgcaggtccgctccgtcttcacggagtatgaggaacaccggctgcgggagaacgtgcggcggggtgtgtcgctgtggcgcgtgcgggccgcctttgatttgtccgacttcgacaagggactggcggagctcaacgcgaggctcaagccgctgggcgaggtcatcagcacgttgccgtccgcgcagccgggtggcgcgcatggcatcgcgttcgacctgattttcggtgcgcaggtcgaccgtgtgtccctggagacgggactggagggaacgcccgcggagctgtccgcgttgacggtgcgcccggccgcggcggctgcgacgagcgcgctgcttcaggccgcgcaacccgccgcgacgattcgcgcgtccgggggcgcgaagtccgagacgcggactggagacgcggcgacgcacgatggggacgcaagcactgctcaggacgcagtggcagggggcctcgcggcacctgatgcacccgtccgcgtgacggatacggccccagaggcgtcgcggaagggagcaacgccctcgcgcggctcccgaggcgccgcaagccgaggcacgtccgcggacgccaaggatgcgcccgcggcagggcattcgacgtcgcccaagggcggcggaaagaagaagggtgtgcgcgcgacgcccgccgcgatgtctcccgaggcgcagcagccgctcctttcgcacgtaccggaagacacggagcccgggcccctggaatggcccacgtcggacgccgacgtgcctgccaatgccagcggctcgccttcactgactcccgtgcccggaccctccagcgtgcccgtcgtcgcctacctccagggcgccgccaaggcatcacccaagggcctctcggtagccccagcggcaccggccggcgcccccgtgagcacccctgcggcgctgacggcggacacgtcgctgcgctccctgacgcagaccgtgcgggtggacatcggtcgcctggatggcctcatcaacatggtgggcgagctgctgctcatcaaggccaatctccagcggctcgcggagtccgcgaggcaggacggcgcggtggcgctctccaagctattcggccaggagctggcgcgcgaaacgcgaggcctggagcgcaagctggaagcccttcaggaaggcctcctggaagcgcggatggtccccgtcggccaggtgttcgacaagctggcacggctggtgcgacgcatcacccgcgaggcgggcaaggaaatcgagctcgccatcagcggcggtgaggtggagctggacaagctcatcgtcgaggaactcagcgacccgctgatgcacctcatccgcaacgccatcgaccacggcgtcgaatcccccgacgcccgtctggccgcaggcaagccccggcgcgcggtggtgggcctgcgcgccgagcagaagggcaaccacgtcgtcatcgaggtgagtgacgacggctccggcatcgacgaggtgcgcgttcgcgaggtggccatcacgcgcggcctcatcaccttcgcgcaggcccaggagatgagccggagggagctgctcaacctcatcttccagcccggcttctccaccgcccgcagcgtgtccgagctctcaggccggggcgtcggcctggatgtggtgaagaacaacctgggcaacctgtcgggcatcatcgacgtgtggagcgagcgcggaaagggcaccgcctttcacctcacgctccccgtcacgctggccatcattcgcgcgctgctggtgggcgtcagtggccgcacctacgcggtgccgctcaacagcgtgctggaaatcatctccgtccagcccaaggaaatccgcaccgtggagcggcgcgaggtcctggacctgcgcggacagacgttgcccttcgtgcggctgtctcgcatgttcgccttgccggagcgtccggtgagccgccacttcgtggtggtggtgggcctggcccaggagcgcttgggcatcgccgtggacgaattgcacggtcagcaggacatcgtcaccaagcccctggggggccggctccagtccgtccggggcatctccggcgccaccgaactgggcaaccggcgcaccgtcctggtgctggacgtggcggcgctcctggaagagggcatggccgtggagcggcgtcgcgcctga

SEQ ID NO: 9225 - DNA, 318 bp, Myxococcus xanthus
  unsure (1)..(318): unsure at all n locations
atgaacctgcgcggtgagctgctgcccgtgtacgacgtcaaggtgcggctgcggctggcggagcgggcgcccctggtcgccgggcccgacgcgccggcgccgccccggagtgctcgcatcctcgtgctgcgcacggagacggggcccgcgggggtgtgggtggatggcgtggtgggcgtggtgaanctcaagccgtccatgctggaggcaccgccaccggggttgcgcgtgggtgacagggattgcgtggtgggcatgggccggcgtggccccatgctctacatcctcttggacgcggaacaggcgctcgccccatga

SEQ ID NO: 9226 - DNA, 525 bp, Myxococcus xanthus
atgaaggactccgtcaacctgctgtcgcggcgtccccacgtggtcccggatgaagtgtcctcggccgcggacacggtggtgcaactctgtgccttcttcatcggcgcggaggagtacgtgctggacatcatgcgggtggaggaaatcctcccgctccagcgcatcacccccatcccccacgctccggcgttcgtggagggtgtgctccatctgcgcggcctcatcctgccggtggtggacctgcggtgccggctcctgggctcgccggggccggagacaccgaagacgcggctgctggtctgcaagctgggcacgcggcgcgtggcggtgaaggtggaccgggtggcggaggtgctgcgcgtgcggcgcggcgacatcaagcccgcgcccgcgctgagggtggcgggacacacgccctttgtcgtcggtgtctgtggaccaccggaccggctccggctgctgctggacctcaaggcattgctgcgcgtggagttggagcgcgagtcttcaaggaacacgacgtag

SEQ ID NO: 9227 - DNA, 378 bp, Myxococcus xanthus
atgggccatcaaggactggagcagcaccgtcgaatcctcggcatcctcttcatcgtcatcaacgggctgtcggtgctcatcgccgtgggagtgatgctgttcttcggggcgatgggcgggatgttgccgagcgcgaagcccgaggaacgggcgctgattgttgccgtgggcatgggcgtgggcgggtgcctggcgctgctggggttgccgggtgtcatcaccggcttcgggttgctctaccgcaaagcgtggtcgaggacgctgacactggtgctgggcatcctcgccattcccaatgttcccctgggcacggccctgggggcctacgccctctggttctacctccagccagggtctgaccaggtcttcgacacatga

SEQ ID NO: 9228 - DNA, 1980 bp, Myxococcus xanthus
atgaacccccactccgagcccccggtcgaggaagaggcgcgctacctcgcactccagtcgctggacccgtgcaccgcgggcgttctggagattctcatcgtcggcttgcatgacgagagctggcgcgtgcgccacgtcgcggcggaggccctcaagcggatgcccgcctcgagcgagctcgcggcccggcttatctccgtgctgggggagcgaggggagacgggggctcggaacgcggcggcggaggcgctcgcggggttgggcagtgttgcgttgggcccgttggtggacctgctggcccatccggacccggaccaacgcaagttcgccgcggacatccttgggcagttggggcagcgcgagtcggagggccccctggtgcgttcgctctcggacgcggacctcaacgtgcgtgtgtccgcggcggaggcgctgggacgcattggcggcgcgcaggccgtcaccgcgctggagacgctgctggccgagccggagccgctgcttcgcctgtccgccctggaagggttgacgctgcttcagcatgcggcgcccctgccggtggtgaaggccttgctggaggaccctcggcttcagcggagcgcctaccggatgctgggcctccttccggaggcggacgcgacggtgcgcatctgccaggggctcacgtcggagttgcgctcggtgcgagaggcggcgctgtccgcgctggggacccaggccgcgcgttccgcaggcgcgcggcgcggggagctcgaagcggtggtgcggaaggccctcttgcccctgcccggtatgacgccgcgattgactgcggcgctggcgtccgaggacgtcatggtgtgcgcgggcacgctggtggcggtggcctcgctgggcgatgcttcgctggccgtgcccgtggcggagtgtgcgcgcgaggcgcggctgctgcgcgaggtcctgcgcacgctgggcaggttggggccggacggcgggtacatcttgcttcatcgcctgccggacttgtccctgccggcgcgggccgccgcggccgaagcgctggtggacctggtcgacgcctcggcggtggcgccgctgtgcgcgttgctggagtgggtggaggacgagcttcgcgcggtggtggtgcgtgccttggggcggacaggcgcggcctcggcggtgtcgccgctcgtcgccctgctggaagagccatccctcgcgggcgcggcgatgcgctccctggccgggctggcggagtcgtgtcggccggcggtgctggaggcgctggaggacgcggtggcgcgcagggccacgcccgcggcggtcgccgccctggcccgcgtgggcggagtgccggccctgcccacgttgaagcggctggcgcgggacgaggaccctcggtggcgggcggcggcggtggtggcggcgtgtgagctggatggcgacgtcggtcgggagttggtgcgcgcggcgctcgcggatgagtccgtgccggtgcgcatcgcgggcacgcgggccctggcgcgactgggtgggcctgacgcgggcgcgctgctgtctccggtcctgagggacgaggacccctccgtgcgggtggccgcggtggaggcggcgggggactgcggcgcgttggaccgggtgccggacctggtggccctgacgcgggatgcggatggcgcgctggcggtggccgcggtgcgggccctggcgcggatgggagcggcgggcccaggggtgttgcgggaggccgcggggcatccggacgtggaggtggtgaaggcggcgctggtggcgggggcggagtcgtcggccggggtgacgatggcgctgtccctgctgcgtcatgcgcgctgggatgtccgcgcggcggcggcgcgagtgctgggcgattcggcggggccggagtgtctgtccgccgcccgggaggcgctggaggcggagtcggacgccctggcgctgcgagccctctccgatgccgtggagcgcctgctccggcgctga

SEQ ID NO: 9229 - DNA, 2463 bp, Myxococcus xanthus
atgacgctggccatgagccttggaatcgggtcgaaggcgttggcgcagcctcctcggcagctccatgcgggtgaaatcgcggcgggtctgaagcggctcggtgtgacgggcagtgtcctctatgtcgcggcccacccggacgacgagaacacgcgcttgctcgcgtggctggtgggagagcgcggcctgcgcgcgggttacctgtccgtgacgcgcggcgatggtgggcagaacctcatcggcaccgagcaggacgccctgttagggctcatccgcacgcacgagttgctcgccgcgcggagcgtggacggcgcggagcagttcttcacgcgggcgcgggacttcggctactcgaagagcgcggaagaggcgctgcgcatctggggacatgaagaggtgctggcggacgtggtgctcgccatccgccgcttccagccagacgtcatcatcacccgcttcaccacggagccgccaaaccacggccaccacacggcctccgcgcagctcgcggcggaggccttcatcgccgccgccgacccgaagcgcttccccgagcaactctccgaggtgaagccatggaaggcggaccgcctgctgcagaacgcctcccaatggtggttcaaacccgatgaggacctgtcccgctacgtgaagctggaggtgggcggctacgacgcgctgctcgggcgttcatggggcgaggtgtccgcggagagccgcagccagcacaagagccagggcttcggccaggccgtggaccgaggccccagcacggagtacttcacgccgctggcggggacgctgccgaagcgcgacgtgttcgaggggctcgacttctcctggagtcgttggaagggctccgaggccgtgtcccgcgcggtggccgccgcgacgaaggcgttcgatgcgcgcgccccccaccgctcccttcccgcgctcgtccgcgtccacgaggcgctgaccgcgctgccggacacccatccgtggaaggcgcccaagctgcgggagacggaggcgctcatcgccgcctgcgcgggtctgttcctggaggtgcgtgccgccgcgcccacgggcatcccggggttgcccgtggcgttggacgtggtggcgctgaaccgctcgcccgccgctgtcgagtgggtggggctgacgctgccaggcgagaaacccgaggccgtggggaaggcgctgggggcgaacgtgccgttgaagctgtcgcgcacggtgacgctgccgacgacggcgcccatctccacgccctactggctccgcgagcccgtcacgggagggctctacacgctggagggcgaggaccgcgcgctcaccggccagccagagggcgttcccgcgctgtcggtggcgttcgaatacaaggtcgcgggccggcgcttccgcgcggtgcgtccggtggtctacgtctggacggacccggtgcgcggcgagctctaccgtgacttcgaggtcgtcccgcccgtcaccgccacgctggcgcaggacgtgctcatgttccccaacagcgagtcccgtgccgtgccggtggtgctggccgcggggatggaccaggtgctgggcattgtgcgaatggtggcgccgcccggctggcgcgtggagccctcggcggtcgcgttcaagttcgaggcgcgcggagacgagcacaccatcaccttccaggtgacgccgcctcagggctcgacgcggaagggtgacctctccgtgaatgtcgacatgggggaccgcgcctggtcctggcgtgcccgttccgtgtcctatccccacatcccgccgctgacggtgcgccagccctccacggctacggtggtgccgttctccctggccacgaagggcaagcgcatcggctacatccccgggccgggcgaccgcgtcgcggagagcctgagcgcggtgggctacgaggtgacgctgctcccggaggagcggctggcccaggagaagctggagcgcttcgacgccatcctcgtgggcgtgcgcgccttcaacgccaacacgcacctcgccgtccaccgggagcggctgctccagtacgtggaaggcggcggccggttggtggtgcagtacaacaccaacagccgcgtggggccgctcacgtccttcgtaggcccctatccgctggagattggccgcgaccgggtgacggatgagacggcggtgatgacaccgctccgcgctgatgagccgctgctgcgcgcgcccaatgcgctgaccgccgcggacttcgagggctgggtgcaggagcgcggcctctacttcgcgtcgtcatgggacgctcgctaccagcccgtgttcgccatgcacgatgctggcgaggcaccgcttcagggcgcgttgctggtcgctcgccatggcaagggcacgttcatctacacgggcctcgctttcttccgtcagcttcccgccggcgttcccggcgcctaccgcctgttggccaacatcctctctcaatga

SEQ ID NO: 9230 - DNA, 873 bp, Myxococcus xanthus
atggcgcgcttcgacgacggacgtccggagatgtcagcggaggagttccgtctcctccgggaccacgtgtattcgcactgcggcatcctggtgcacgaggacatgaagttcgtgatggagcgccggctgtggccccggctggagttgctggggctgccagactacggcgcgtaccaccgctacctacgctacgacgccaaccggcacgccgagttggaggcggccgtcgaatccctcaccactcacgagacgtacttcttccgcgagcccacgcagctcaaggccttcacggacgaactgctcccggtggtggggcagcgcaacgcgcggttgcggcgcctgcgggtgtggtccgcggggtgctcgtccggggaggaggcctacacgctggcgatgctcctcaaggacagccgccgcttcgacgactgggacgtggaagtcctgggcacggacatctcccggcgcgtgttggccatggcgcggcgagcggagtacgggccttccgcgctgcgtgccacctcgccggaattgctggaacgccacttcgtttcgctgggcaacagccgcgtgcgcgtccgggacgaagtgcgcgcctgggtgtcgtttggccaccacaacctgctggacgaggtgggtagccaactggtgccacgcatggacgtggtgttctgccgcaacgtgctcatctacttcgacctggcggcacgccggaagttcctgcgcatcgttcgggaccggctggtgccaggggggtacctgctgctgggacactcagagaacctgctgaacctgggctcggacttcgagttcgttcacctgcgcggggacctggtgtaccggaggccggagctggacgaaggagcgcgtcgatga

SEQ ID NO: 9231 - DNA, 1038 bp, Myxococcus xanthus
atgagcagcaagggcgtcatctccgtactggtcatcgacgactctgcccacaaccggcggaccctctccacgatgttggagtcggagccggacgtgcgagtggtggaccgcgcggcggatggcgaagaggggctgaagaaggtcgtggacctgaagcccgacgtggtgacgctggacctggagatgccgaagctcggcgggtacacattcctccgcctgctcatgcgcacggcgcccacgcccgtcatcgtcatctccagctattcgcaccgctcggatgtcttcaaggcgctggagttgggggcattcgacttcatcgccaagccgcagcacccgacgttcgaggccatggaggcgcttcgggtggagctgctggagaaggtccgggcggcgcggcacgtgcgccccggttaccggcacgcggcgccaggggctcgcgccatggcggtggcgggcgagccgccactggtggtgtccgtgggcgcctccacggggggcccccccgcggtgcagcgggtgctggagggactcgccgtggagcccacgccgtgcgtgttggtctgccagcacatgccgccgcagttcacccgcgccttcgcggaccggttggaccgcatcggccccttctcggtgacggaggctcgtgacggagacctggtacagcccgggcacgtgtacatcgctccaggcgggcggcacatggtggtggccgagcggggctcccggctggagctgcaaacgccgccgcccacgcccgtggacaagtacgcgccctgtgtggaccgcctcttcgtcagcatggcgcaggtgctcggcgccaaggccctgggggtggtgctcacgggcatgggcgccgacggtgcggagggcgcgcgcgcggtgcaccgcgctggcggcgaggtctgggcgcagtcggaggagacctcggtggtgttcggcatgccgggggaggccatcgccaccggggcggtgaagcgggtgattccactgggtgacatcggcccggcgctcgcggccctggcgcggcggcggcgctga

SEQ ID NO: 9232 - DNA, 321 bp, Myxococcus xanthus
atgtacgcgttgcagcgcctgtccggcgtggtgtgtaccgaggcccaggacggcgccgagggcttgaagaagctgacgcagggccgcttcgacctggtgctcacggacatcaacatgccgctgatggacgggctgaagctcatcagccacatccggcaggcgaccgagtaccggaacgtccccatcatcgtcgtcaccacggagggtgcggcggcggaccgggagcgcgcgatgaagctgggcgcgagcgcgtacctggtgaaacccgtgcaggcgaaggtcgtgctggataccgttcgggacctgctgaagctggactga

SEQ ID NO: 9233 - DNA, 568 bp, Myxococcus xanthus
atggattccgtcctgcgggtggagggcctggagaaggcgtacggcgaggtgaaggccgtgcaggggctcaccttcgaggtggcgcccggcgaggtgctcgggttggtggggcccaacggcgcggggaagacgtccacgttgcggtgcctggcgggcatcctgccgcccagctcgggccgcatcctggtcgcgggatatgacttgtcgcggacgccggtggacgcgaagcgcgcgctggccttcctgccggacgagccgcgcttctttgaatacctcacggtgtgggagcacctgaacttcacggcgcggctctacggcgtggaggactgggaggagcggggccgcgcgctgctggaggagatggagctgacgggcaaggagaagtccctgccgggcgagctgtcgcgaggcatgaagcagaagctgtccatcgcctgtggcttcctgcattcgccaaagctcatcctcctggacgagccactcgccggcctggaccccatcggcattcggcggatgaaggcgtcgttgcggcgccgggcggaggagggcacggccctggtgttgtcct

SEQ ID NO: 9234 - DNA, 1272 bp, Myxococcus xanthus
atgtcgtgcctggaggaccgggacgcgtcggtgcgcgccctggcggcggacacgttgtcccgcattgggagcccggccgcggtgccggccctgttcgagcggttggtggacgaggacctgcgcgtggtgcaggccgcggtgggggccatccagtccctgggcagcgacaccacggagaagctggcgttgcaggcggcccgttcccccgacgcgcgcctgcgccgcgcggcgctgcgcatcatctcctacttcggctattccaagggattggaagtgctgctccaggccatgcgggacccggatgagcgcctgcgcgacgcggccatctacggcctgcccttcatcgaggacccgcgcgcggtggacgcgctgctgacggccgccaatcacgagtcggagcgcacgcgcgcggcggccatgcgcgcgctggggcagacggagaaggaggcgcgcatcacctccacgctgctgcgtggcctcagcgaccgcgacccctgggtgcgctactacgcgtgccaggcgctggggaagctgaacgaggaagccgccgcggacgccatcgtcgcgctggcggacgacgccgctggccaggtgcgcgtggcggtggtggacgcgctggcgcacatgcacacggagagcgcgatgtcggcgctccagcgcgcggcggtcagcgcggacgcggatgtgcggcgcgccgccctgctggggctgggcgtgggccggcggccggacgcgctgcccgtgctgctggaggcggcgaagtcggaggacgcggccacgcggctcgtcgcgctgtccgcggtggccgaatacgaggcgccggagacgctgcccgcactgctgcatgccgcgggagacggcgacgacagcgtgcgcagcgccgcggtgggcttcatcgccacgcgccccggtgtcccggccacgcaggccttggtgtccctgctgggggacatgacgctgcgcgagcgggtggtgagcgccttggcgctgccgctggagggacggctgccggggctgctggccgcgctggaggcggcggacgaagtcacggcgccgctgctggtggcggcgctggcccggatgcgacgggcggacgcgcgcgccgcgctgatgcagctcctggtgtccgccagtccggcgggccgtcgtgccgcggtgcccgcggtggcggcattggggacgttggaggcacgcgaggcgctggagcgcgcctcccatcgggacgaggaccccgaggtccggcgggcctgccggctggtgctgagccgctga

SEQ ID NO: 9235 - DNA, 822 bp, Myxococcus xanthus
atgttctccctgcccatgtctccccaggtgttcgccatcctggccgcgctcatcgagcagcgctccggggtgcactacgcccccgaggaccgggagctgctcgccgacaaggtggtgccccgcgcgctggacgcgggcttcgactcgctgctcgactactactacttcctccgctacgacccggcgggctccgaggcgctggacgcgctggtggactcgctgctggtccacgagacgtacttcttccgggaggccctgccgctgcgggtgctggccgaggacctgctggtgcccgccgtgcgcgccggacggcggccccgggtgtggagcgcggcctgctccaccggagaggagcccctcacgctggcgatgattctcgcggagttgggcgcgctcgacgaggtggagctgctggccagcgacctgagcgcccgcgcgctggagcgggcccgcaccggggagcacaacctgcgctccctgcgcgcgctgcctccgggcgtggagggccggtggttggagacgtgcgaggggcgcccacgcgtccggccggagttggtgcgcgcggtggactggcggcgcgtcaacctggtggatgccagcgcggtggcgcagttgggcaccttcgacgccatcctctgccgcaacgtcctcatctacttccaggacgacaccgcgcgccgcgtggtgtcgtccctgacgcgcgcgctcgctccggagggacacctgctggtggggacctctgagtccctgatgcgcttcggcaccgcgctcgcctgcgaggagcggcgcggcgccttcttctataccaaggcaaggccatga

SEQ ID NO: 9236 - DNA, 1047 bp, Myxococcus xanthus
atgacggtggtgtctcccattcgcgtgctggtggtggatgactccgccttcgcccgcaaggtgctgcggcaggtgctctccagcgcggagggtttggaggtggtgggcgtcgcgcgcgacggcctggacgcgctggagaaggtggccgagctctctccggacgtgctcacgctggacctggtgatgccgggcctggatgggctgggcgtgctgcgcgcgctcgcctccagtgccgccgcgccccgcgtggtggtggtgagcagcgcgggcgaggagagcgagctggcggtggccgcgctccaggccggcgcggtggagctggtgaacaagcccaccgcgctcgccaccgagcggctgtatgagctgggcggcgagctggtggcgaaggtccgcacggccgcgggcgcggtggctcgcgcgccgccggagccggcaccgtcgccggaagccacctccgcgccggtggctcgcgcggccgcgaagagcctggtggtggtgggcacctccaccggcgggccgcaggcgctcacccgcctgctgtccgagctgcccgtggacttccccgcgccgctggcgctcgcgctccacatccccacgggctacacggaggcggtggcccggcgcctgaacgcgcactgcgcgctggaggtgttcgaagcggtggacgggctggagctgcggcccggccgcgtggtgttggcgcgctccgggcagcacctcaagctggagcgccatgggccggtgacgctcgctcggctggaccggcagccgctgcgcacggcgcaccaccccagcgtggacgtcctcttcgaaagcgccgcgcgaagctggggctcggacgtggtgggcctggtgctcactggcatgggtgacgacggcgtcgcgggcgcccgggccatccgcgaggccggaggcaccgtcctcacggagagcgagtcctcctgcgtggtgtacggcatgccgcgcgccgtgaaggaagcagggctggccaccgacagcgctccgctggagggcatgctggcgctgctgcggcgtcatgtgcgctga

SEQ ID NO: 9237 - DNA, 936 bp, Myxococcus xanthus
atgctgtggtgtctggccatgcccgtggtggccctgtcgatgtacgtggcccccgggtggattccctatctctgccccctggcgtgctacctggcgctgtcggcaggcgtcatcgcgcacaaccacaaccactgccccaccttccgcaaccggaagctgaacgaggccatgggcatgtggctgtcgctcttctacgggtaccccaccttcgtgtggattccgacgcacaacctcaaccaccacaagttcgtgaacaaggcgggcgacgccaccatcacctggcgctactcgaagaagcacaacttcctggtggccttcctcttccccttcgtctccacgtactggcagcaggagccgacgaaggcgttcatcgacaaggcgcgtgagcgcaaccggccgctgtaccgccagattctcacccagtatgccgtctggggcggcacgcacgcggcgctgctggggctggccatggcgatgcacggcgtggccggtggcgcgcgcatctgggcgttcgccttcctggtacccgcgctcttctcgctgtggaccatcatgttcttcaactacatccagcacgtccacacggacccctggagcgagcacgaccacagccgcagcttcaccggccgcctcatcaacttcttcctcttcaataacggcctccacgccgtgcaccatgagacgccgggcctgcactggagcctgctgccccaggcgcacgcgaaaatcgaggccgccatggacccggccctcaagccggtgagcttcttcgcctggtgcttccgctcgtacgtggtggcccccttcctgccccgcttcggaacggcgcaggtgggacgcgcgccctatgagccgcccgcgggtgtcgcgctggacgtgcgcttcggggacgacctgcaggccgtcgactcgggcgtcaatgtcgcccgcgtctga

SEQ ID NO: 9238 - DNA, 888 bp, Myxococcus xanthus
atgggcctgcgcgcgctgaggctgcgcctggggggggatggtccgccggtggtgctggtggcggagccggagacgcccgccgaggtgctcgaggtgggcgacgcggagggggtcgaggactgcctgctgtcgcccctgcgcacgcacgagctgcgcgcgcggttggcgatgctggcgggtggcggcgtcccggccgcgtcggtgcgtgcataccgtgtgcgttcgcgcctgctgctgctggccggcgccagtggccccctggcgtggagcgggctgggcgctctgctggaggcgtgtggtcatcgcatcctctacagcgccaccgtgggcggtggcgccgcgcgcgtggccgaacagggggagcggcccgacctggtgttgtctcgggaaggcgcgccaggtgtgcccaggggcctgccctcgccacggttgcagccgctgctggcgggggtgccgtcgcttactctggacgcggacgcgccggtgcgtccggcctcgttgctgccccgcatccacgcgctgctgggacgggaggacgcctcgctgcgtgtcgaggctcgggtgcgattctgctgtccggtgtccttcggcgagtcggggccgcgcggcgcggagtggcgctccggcgtgtccagcgcgctgagccctgggggcctcctggtgcgcacgctggtgccggcgaaggcggggacggcggtggagctgcacatcctgctgcccaccctgggcgagcgcctggagacacacggcgtggtggcctgggcccacgcctacgcgcctcgcaacggcgtgtcccacccctacggcatgggcgtgcgcttcctgggcatgggcccaccgcgcctcatgcaattgcgccagttgtgccaggcggaggtgcgcccgtga

SEQ ID NO: 9239 - DNA, 309 bp, Myxococcus xanthus
atgctgctggcggagctgggccacgacgccatcgtcgcgcgggatgggctggaggcgctggcgcgcgcggagcaggagcggccggacctcgtcttcctcgacgtgctgatgccgcacctggacgggctggagacgtgccggctgctgcgcgaccgggagccgacgcggcgcacgcccatcatcctctgcagtgcgcgcgccgaggcgcgcagcgtgcgcgcgtgcttcaacagcggctgcaacgacttcgtggccaagcccttcgacggcgccgcgctggtggccctgctgcggcgctacctggattag

SEQ ID NO: 9240 - DNA, 1404 bp, Myxococcus xanthus
ccccaggcagaggccctgacgttcgcgggccgctcctggtcctatgaagcgctggatgcggaagtctcccgatgggttgccgcactcgaggcggagggcgtcggcgcttcggacagggtggcgtcgctcgcgacgaaccacgtcgcctccgtgtgcctcttctgggcgctgggccggctgggcgcggtgttggcgccgctcaatgcccgcctcacgtccgtggagctggcgcccatggtggaggacatccagccccgtttgaggctggcgctgggggccctggcggagcggctccctggagcccggccactcgagtccttcgcggaggccgtctccacgggggcttccacgtgccagcccctggaggcatcgtcgccccgggttgtgctcttcaccagcgggaccacgggccggcccaagggcgcggtcctcaccgaaggcaacttccgggcgtcttcacgagcgtcggcgggcaacctgggggcgcatccagccccgcgttggctgggcacattgccgcttttccacgtggggggcatcgccatgctcactcgcactgcctacgagggaggctgcctcgtcctgcacgaacgcttcgacgccgatgcggccaaccgggccatcgacggggagggcgtgtcccacgcgagcctcgtggctacgacgctggagcgagtgctggaggcccgaggtgaccggcgcatgccggactcctttgcatgggcgctgataggcggaggtccggtgcccgtgcccctcctcgcacgagcgagggccgcgggcctgcgagcccttcagacgtacggcctgacggaggcctgctcacaagtcacgactgagcgcccggacactgcggacggccgcaccgctggtgtcccgttgctgggtgtcgaggtgcgcatcgtcggcgcagggggcgaagtcctcggtgctggggcggagggcgacatcgaggtgcgcgcgcccacggtgatggccgggtactggcagcgtccggaggccacccaggaggcggttcgcgacggctggctgcgcacgaaggacgtcggtgtgctggatggtggggggcggctcaccgtgctgtcacgccgcacggacctcatcgtccgaggtggggagaacatctacccggcggaggtggaagcggtgctcgtcaaccaccccgcggtgcaggaagcctccgtggtgggcttcccggacgaccgctggggcgaacggcccgtggccttcgtcgcgccgcgccaggggcaaccgcaccccggggatgaggaactggcggcgtggtgccgtcagtccctggcgggcttcaagacgcccgcgcgtttcgtgtgggtggacgcgctgcctcgcaacgccatggggaaggtcgagcgcaccgtcctgagacggcacgccctccgctga

SEQ ID NO: 9241 - DNA, 414 bp, Myxococcus xanthus
atgtggttcgacatctcgagccagggctgccaggcctgggactccaaccacgggagcaactaccacttcgccatcggcgcgccgaccctctccttcaacgcgaactgggacgaggtgattgcgggcacgctgcgcgccggccagcagctcatcgtcaactacgacgaggcccgcctgcccgagtgtcgcgcgacctacaacggcccggcctggtcgattgtcgcgcagtaccgcttcgacaacggccccatccaggagacggtcgtcaccggctccggcaggtccgagccgacggccatcaccgctccggccggcgcccgccacctggagatgtggttccgcaacacggaccgcagctcctgcgtgagctacgacagcaactacggctccaactatcacttcgccgtggagtga

SEQ ID NO: 9242 - DNA, 798 bp, Myxococcus xanthus
atggaggtgggggtggtctgcgccgcggccgtggaggccaccagcaccagcgggaggagggagggaagaaatcgccggaccaagatgcgctcctttcgagcggcagagggagcggacggcggtagtccgctcccgcgcatcaggtcaatggcttccccgcttatccatataggttggaaagccatgttgaggggagaatcggagctgaggcgggccgctgacggagggctgatcgagcagcgagcccggctgctgctggacttcacgcgcacgcggctgatgggcggcgtggccattgagccccggccggtggacctgaaggatttggtggccaaggtggcccacgagttcggcgtggccttcccccagcgcaccgtcgaggtggaccccaagggcaacacccagggcgtgtgggacccggaccggctggcgcaggtgacgtccaacctggtggagaacgcgctcaagtacagcccgccggagacgccggtgcggctgacggcgcgcgggctgcgcacccgggtggtgctggaggtccacaacgccggccgccccattccggacaacctgctgccccacctcttcgagcccttccgcggcgggccccagagctcgcgcacgctgaagatgagctacgggctggggctcttcatcgtccgggaaatcgtccaggcgcacggcggcaccatcgaggtccgctccgatgaggcggaaggcaccaccttcaccgtgacgctgccgcgccgctccatgccggcccgaccgccccagcctcccaccggaagcccgcgcgactaa

SEQ ID NO: 9243 - DNA, 438 bp, Myxococcus xanthus
ttcctttgggtattgggggaccatgcctcgccgcgtccacccccatcggtggagcccggtcccgaggcccggcggcgccgctttctggtggtggacgactcgcccctcacccgggagctcatcgccaacctgctggaggcggtggggtacgacactgtcatcgcctcggacggcgcggaggccctggaggtcctggagtctcatcccgtggacctggtcgtcacggacctggagatgccgggggtgaacggcctggagctggcccggcgcctgaaggggcaccccgtccattcgaggctcccggtggtcatcctcactacccgtgggggggaggaggaccggcggcgggggttggcggccggggtggacggctacatcaccaagggcgacctggtgcgccaggacctggtggatgtggtgcggcgactgctgggctga

SEQ ID NO: 9244 - DNA, 318 bp, Myxococcus xanthus
atgggccagaaggccgcgcatgacttcctggagtccgtcgcgggccgcaccctgctgatgctcgcctatgacgagccccggctgctgctcgggcagctccccaccgggttcctcgcggcggtgagctacggcgagcggcgcatggtgtggacggggcctcgcagcggccgcttcgtcatgaagcgggacttcatgcccaccgcgtaccacgagggtgtcctgcacgccgccctggaagccgtgggcgcgcgggacatcggggtgcaagggcgcgagctgggcctgctcgacacggagtacgcgctgtcctggcgctga

SEQ ID NO: 9245 - DNA, 369 bp, Myxococcus xanthus
atgtccacgcccaacctcgtcctcctcgtggaagaccacgctgacagccgggagctgctggaggagttcctcaccctggagggcttcaccgtggagacggcgggcaacggactgtccgcctgggagcgcctgagccgtccgcccctgccggccgccgtcctcctggacctgatgatgccggtgatgagcggctgggagctgatgcgccacgtgcgcgaggacgcgcggctgagcaccctgccagtggtggtggtctccggggcgggaagctcccaacccctgccggagggcatccgggccacggtgcccaagcccgtggatttattcgagttgcgcgccaccctggagcgggtggtgagccccgcctga

SEQ ID NO: 9246 - DNA, 396 bp, Myxococcus xanthus
atgagcgggcgcgcacggtttgcctgggcgctggtggtggggctgttgggccatgcgctcaaccgatttcccgtggaggtcatcccaggcatcgacatcctgctgggcttcttcctcatcatccccgcggccccgctgctggggccctggtgcgcggggctcgcggccggcatcgccacgtccgccaccgtccaactgtggggccacccctggagcatgctgggttcgatgatggaaggggtcgtcctgggcgcgctgacccggcgctactggccccttcaggcggacgggctcttctggctgggaggcatcccctacctcatcatcgtcagccatcgcctgggcgtggacgtcacggcggcgagcacgctcgccattgcggtcaagcaggcgatc

SEQ ID NO: 9247 - DNA, 297 bp, Myxococcus xanthus
atgggcgcgtggacggagctggtgtggcagccccatgagaagtgggccgtggtgcccggcctgcgcgtggacaactaccacctgtcgccggggattgatcgtcgcgcgctggagccgcggctcaccgtgcgtcacaaggtgtcggaagcgctcacgctcaagggcggggcgggcctcttccatcagccgcccaccaccctcatcagcctgcccgtggtggacgtgggaagcctgctgctggggctccagcaaggtgtgcagctctcggtcggcgcggaaggaaggcgggctgagagc

SEQ ID NO: 9248 - DNA, 924 bp, Myxococcus xanthus
atgctgctgcccggcgtgggcagcatgctgtccggcgtggcctacccggtggtgcgcggcagccagcccgcggccacgggctacttcctggatggcatccgcgtccccatcctcttccacctgttcctggggccggccgtcatccacccggacttcatcgacgccatcgacttctatccgggctcgccgccgccccggtatgggcggttgatggggggcgccatcgacgggcgtctcagccgcccgcgggatgacggcgtccacggcagcgcctacgcggacctcatcaacgcgggcttcttcatcgagacgccgttcaaggacaccggcaccaacgtcagcctggccggccgctattcctatacgccctggctcatcgccctggcggcgaaccagctccagtcgccgccccctcccgggcgggagaaccccaaggtggtgctcgacttctgggattatcagggccgggtggagcagcggctgggcgagggcacgctgcgcctgtttgcctttggctcctcggacaccttcggttcgaaggcccaggacgcatggggcgacaccgcgatgcaatccattgtcttccaccgggtggacctgcggcaccggcaccccgtggggcccggtgagctggaggtgggcgggacgtgggggctggaccgcttcgccatcgtcagccgcagtcccccgggtgaggccaccgaagtccatatcgaccaggggcactggtccgcgcgcctgggctacagcgcgacgctgtcacccagcgccacgctgcgcggccggggcggacgtggagcacaagcgcgccatcgtcgaactgctccagcaggacggcggctccgacgcgggcgtagaggtagcgcccgtggcgctggggaccttcatgggcgcgtggacggagctggtgtggcagccccatga

SEQ ID NO: 9249 - DNA, 186 bp, Myxococcus xanthus
atgaggtacgtggtgcgcaccaagggcaaccgccggccgctggtgggggccatgctggtgtcggacgcgcatccggacgcgccggtgcaggcggacgtggacggacgcttcgaggcgctactggcccgcgggcgtgcatgcggtgtgtatctccgcccccggccacaagcccggcgtcttcagtga

SEQ ID NO: 9250 - DNA, 237 bp, Myxococcus xanthus
atgatgcccagcgtgccgaccctgttccggctgtgtctggcactgcggttgtcggcggacgtcgggctggggctcgccacggcggccagcgtcggcgccgcgctctgggaagaggactccaggcacagggaccagttgccggagatgcggaaggtgctccgaacgctgcggcgcatgtcgcgcagccagctcaacctgatgaaccaggtcgcggccgccatcctgcctgagcggtga

SEQ ID NO: 9251 - DNA, 1161 bp, Myxococcus xanthus
atgcggattgcccaggtttcgctcattcccctccggttggagctgcgccagcccctgaagacgtcacaaggggggcacgcggtgcgagaaggcttcctcgtccgcgtcgtcgacgaggaggggcgcgaaggtctgggcgaggcgatgccgctgcccgcgttcggcaccgagtcgctcgaagactgtggcgtgacgctgaacgcctggctgtccgagctgaagggccagttcctgggcgactcggtccgggccatcgaggacacgttgtcgccgttcccccctgccgtggcgcgaggcgacggcgtgcgcatccgtgcacgtcaggtgacgccagcgggcgccatgccggccgcggaacacgcgctggagctggcgctgctggacctgctcgcgcaacgccagggtgttccgctgtgctggctgctggcggaggaggcgcggacggaagtggcggtgaacgcgctgctgggcgccgacacccccgaggccctggcgggagaggcccggcaggccgtggccgagggcttcggcacgttgaagctgaaagtcgccggccggccgctggacgccgacgaggcgcgagtgaaggccgtgcgcgatgcggtggggccggacgtgaagcttcggctggatgcgaacggcggctggtccgagcccgacgcgaagcgcgccctggaccggctgggttggtacggcctggagttggtggagcagcccacgccgccggaggacctcgcggcgctctggcgcgttcagcgccgcgccccctgcacggtggcggcggacgagtccctggcttctcccgatgcgctccgggcgctgctgacggtggacccgttgctgggcggtggcccggcggtgggcgcggtggtgctgaagcccatggtgctgggcggactgttgccgtgcctcgtggtcgcgatgcgcgcggcgcggctcggaatgcaggcctatgtcaccagctccattgatggcgtggtggcgcgggctggcgcggcacacctcgcggcggcactgccatccggagcgctggcctccgggctcgctattgggcgcttgctggcgaaggagccggaagatcatccgtaccatccgcagcaaggcgtcattcgcctgtcgagcaccccggggctcggactgagctcccagtccctggtgtga

SEQ ID NO: 9252 - DNA, 1059 bp, Myxococcus xanthus
atggaggtccagcgtcaggaggcgaaggagacggggctggacctgagcgtggtggacctgtccgcctcgtgcgcggcgacggcgctgacgctctccgcggccatcaagaacgagcggcccacgggcatcgggaactccaccgcggcggtgtacgcggggacgccgggcgccggcggcgtgcggctgggcaccatcagcgtcccctggctggtggggggggagaccttccccttctcgctgtcgtacacggtgccggagggcaccacgaaggtggtggtcgtcgcggacgaggacggcacctatccggaggacgacgaggacaacaacttcgcctccattgatttcgagattccttgtgccaccaaccagcagccggtggccaactgccagaacgtcaccgtccccgcggacgcggcctgtcagggcagcgccagcatcgacaacggctcgttcgacccagacggcttcccggggccgttctccgtggagcagtcgcccgcgggcccctatgggctgggcaccacgagcgcgcagctcctggtctccgacggcgcggccacccgcacgtgctcggcgaacgtgaccgtcgtggacgtcagcgcccccacgccgggcgccaaccgcggcctggtcatccagccggtcctgggctccgactacgtgctggtttccctggatgactgcgcgatgccggccgtcgacaactgcggcggcgagctcgacctgggcgcgtcggccagcatcatccgcgtcacctccgacgagtccaacgacgccctgtccctgctccggctgctggcgtgtgacgacatcaagctgagcccggaccgcaagtccgcgatggttcgcgccgaggcggccctgctgggcaacggccgggtctacaacttcacgtactccgtgaaggacgcgtccggcaacagcgccatcggcacctgcaacgtgaaggttcccgcgctgctggccaaccccgccatcgattcgggcgtcgtgtactgccagggcgacaactgcccctccggttcgcgctcccccgggctgctctgctcgctgctgtag

SEQ ID NO: 9253 - DNA, 2400 bp, Myxococcus xanthus
atgtccgcgtgggaggtggaggtgcgccgcatccccgcggcccaggcgctgccaaggctcgcgctgcgcgacgggttgccccggctgctggaggtcgtcgcctcgctgatgcgccgcggctcgcccggcggcgtgggggatggcctgggggatattccggaccggcatgccatcgagcggctgggggaaggcttcgacctgcggcaggtggtgacggagtaccggctgctgcgcgcgtgcgtgctgcgcttgtggacgtcccgggagaacgccacccaccgcccggaggcggagctcgtcttccacgaggccatggatgaggcggtggcggcctccgtcagccgctactcgctggcgcgcgagcgcacgttgcaggcgctggaccgcatcagcaccgcggccctgggcagcgccgacgccgcggagctgttgccggccctcctccaggtcctgcgggagaccgtggccgtggtggacgtggcggccgtcctgctgctggaagaggacgtcctgcgggtgcagagcgtggtgggctcggggatggccgtgggggacgtggtgcgcatgggggagggcttcacgggcaccatcgcggccacgcggcagccgctgctggtgcgcgcggcgcgcacggacagccgggtgagcgagccgtccttgcgcgatgcggacctgtcggcgttgttcggtgtgccgttgctcttgggagcgcagttgatgggcgtggtgctgatgggcagccgcgccacccatgaactgtcggaagaggaccagttcctcttccgggccatggcggcgcgtaccaccgcgctgctgttgcaggcccaggcgcatgcccgcgagcgcgaggcgcgcgccgtggcggaggcgtccctggagcgcctccgggagagtgaagcgggcctgcggcggtgggcgcaggtcttcaagcggctgggcgtgggcgtggcggtggtggacgcgaccgaggagcggctgcgcgaggtgaaccccgccttcgctcgcatgcatggctactcgccggaggagttgacgggacggcggctggaggacacctatgcgccggaagcgcgcggcgtgttgcctcgacacgtcgcggcggcgaactccaagccgtcgcacgaatatgaatcactgcacatgcgaaaggatggcacccgcttccccgccttcacgcacgtcacggccttcaaggatgagtccggccgtgtggagcagcgggtggccaccgtggtggacatcacccagcgccgcgccatggagatggaccggcagcggctgctgggcgccatcgaggccgagcgcgcgcggctggcgtcggtgctggaccagatgcccgcgggcgtgttcatcgcggacgcaccgtccggccggttggtgatggccagccggcaggtggaggtcatcaccggcaggcccttccatccctccacgtcgatgcaggactacatgtcggacaatggcgtctcgctgcacccggatgggcggccctacgccatggaggaactgccgctgacgcgcagcctgcaccacggcgaggtggtacagggcgaggagatgctcatcccccgcgaggatggtcagaacatcgccgtgctgctctccagcgcgcccatcctggaccgggagggcaccatcgtcgcggcggtggccaccatggtggatgtctccgaacggcggcgcgcccaggaggcctcgttgcaggcggcccgcttcggcgagcggctcatcgccattgtcagtcatgacctgcgcaacccgctcaatgccatccagttgtccgcgacgcagttgttgcacagcgaggcgcttccggagcgcgagcgccggttggtgacgcgcatcgcccgctccggcgaccggatgaagcgcatgatttcagagctgctcgactttacgcgcgggcggctgggcggcggcattcccatccaacgcacggccggtgattttcgggccgtggtccggctgggcgtggatgaattggaggcggcctggcccgagcgcaagctggcgtttcgagtggagccgggccgctacgaaggggagtgggacggggaccggctgctccaggtggtcagcaacctggggggcaacgcgctccaatacagccccgcggacgcgcctgtgtccttcaagttgtatgacgatggcgacttcgtggtgctggaagtccaaaaccccggcgagcccatctccccggagatgctcccccggctcttcgaccctttccggcgcggcgccatggcgggggtcggcggagcgagcagcagtgggctggggctggggctctacatcgtcgagcaggtggtgaagggccacggcggacgtatcgaggtgacctccaccgcccaggcgggcaccaccgtccgggtgacgctgccccgcctgccgatggcctga

SEQ ID NO: 9254 - DNA, 3252 bp, Myxococcus xanthus
atgcccaagcgtaccgatatccgcaaggttctggtgattggctcgggtccgattgtcatcgggcaagccgtcgagttcgactactccggtacacaagccatcaaggcactccgggatgaaggcgtggaggtggtgctgctcaacagcaaccccgccaccgtgatgacggaccctgagttcgcgcatcgcacctacatcgaaccgattacggtggaggcggcggagcgcatcctcgcctcggagcgaccggactcactccttcccaccatgggtggccagactgcgctcaacctcgccaaggcgctggcggagcagggcatcctggagaagtacggcgtgcgcctcatcggcgcgtccctggacgccatcaacaaggccgaggaccgccagctcttcaaggcggccatgcagaagattggcgtggccctgcccaagagcggctacgcgacgacgctggaccaggcgatgagcctggtggaggacatcggcttcccggccatcatccgcccgtccttcacgctgggtggcaccggcggtggcatcgcgtacaaccgcgaggagttcgagaccatctgccgctcgggcctgaaggccagccccaccaccaccatcctggtggaggagagcgtgctgggctggaaggagtacgaactcgaggtggtccgcgacacggcggacaacgtcatcatcgtctgctccattgaaaacctggaccccatgggcgtgcacaccggtgactccatcaccgtggcgcccgcgcagacgctgacggaccgcgagtaccagcggatgcggcaggcgtcgctggccatcatccgggagattggcgtcgaaacgggtggctccaacatccagttcggcatcaacccgaaggacggccgcatggtcgtcatcgagatgaacccgcgcgtgtcgcgctccagcgcgctggcgtcgaaggcgacgggctaccccatcgcgaagatcgccgcgaagctggcgctgggctacacgctggatgagctgcgcaacgacatcacccgcgacacgccggcctccttcgagccgacgctggactacgtggtggtgaaggtgccgcgcttcaacttcgagaagttcccgcacgcggaccggacgctgaccacgagcatgcgctcggtgggcgaggtgatggccattggccgcaccttcccggaggcgtacatgaaggcgctgcgctccatggagctgggccgcgtgggcctggagtccccggagctgccggcggagaaggaggagcgggagaaggtgctgcgcgaggcgctgcgcatccctcgcccggagcgtccctggttcgtggcccaggccttccgcgaaggcatgacggtggaggacgtgcacgcgctctccgccatcgacccctggttccttcgctacatccagatgctggtgaacgaggcgcagtcgctccaggagtacgggcggctggaccagcttccggacgaggtgctccggcaggccaaggcgcacggcttctccgacaagtatctgggccggctgctcggctacccggcggaagaggtgcgggcgcaccggcacgcgcgcaacatccggcccgtctacaagcgggtggacacctgcgccgcggagttcgaggcgtacacgccctacctgtactccacctacgaggaggaggacgaggcgccgcccacggaccggcagaaggtgctcatcctgggcagcggccccatccgcatcggccagggcatcgagttcgactacgcgtgcgtccacgccgccttcgcgctgcgcgaggccgggtacgagacggtgatggtcaactgcaacccggagacggtgtccaccgactatgacacgtcggaccgcctctacttcgagccgttgaccatcgaggatgtgctcgaggtgtcccagcgcgagaagccggtgggcgccatcgtccagtttggcggccagacgccgctgcgcatctccgtgccgctggagaaggcgggcctgcccatcctgggcacgtcgccggacgccatcgaccgcgcggaggaccgggagcgcttcgccgcgctcatcgagaagctgggcctgaagcagccggagaacggcgtcgcgcgcagccacgcggaggccttcaaggtggccgagcgcattggctaccccgtcatggtgcggccctcctacgtgctgggcggccgggccatggagaccgtctacgacgtggccagcctggagcggtacatgcgcgaggcggtgagcgcatcgcccgagcacccggtgctcatcgaccgcttcctgaaggaagccatcgaggtggacctggacctggtggcggaccgcaccggcgcggtgatgattggcggcgtgctggagcacatccaggaggcgggcgtgcactccggtgacgccgcggccacgctgccgccgcactcgctgtcgccggacctggtggagcggatgaaggaccaggccatcgccctggcgcgcgagttgggcgtggtgggcctgatgaacgtgcagttcgccatccaggggaagaccatctacatcctggaagtgaatccgcgcgcgagccgcacggtgcccttcatctccaaggccaccggcgtggcgatggcgaagatcgccgcgctctgcatggtgggcaagacgctcaaggagctgggcgtcacgcaggagccggagttcaagcacgtggcggtgaaggagagcgtgttccccttcgcgcgcttcgcgggcgtggacgtcatcctcgggccggagatgaagtccaccggcgaagtgatgggcctggcgaacgactacgcgtccgccttcgccaagagccagctcgccgcgggcgtgaagctgcccaagagcggcaaggtgttcatctccgtcaaggatgacgacaagccggcggtggtggacctggcgcggcgcctgcggagcatgggcttctccctcgtggtcacctccggtacgcacacctacctggcgacgaagggcatcgaggcgcaggtggtgcagaaggtgacggagggccgcccgaacatcgtcgacaagattgtcgacggcgaaatcgtgctggtcatcaacaccaccttcggcaagcaggagatcgccgacagcttctccatccgccgcgagtcgctgatgcactcggtgccgtactacacgacggtgcagccggcgcggatggcggtgggcgcgctggagtcgctcaagtgcacggaactggaagtgaagccgctccaggagtacctgggcatcaacgcggcgcccccgggcacgcggcgctga

SEQ ID NO: 9255 - DNA, 1122 bp, Myxococcus xanthus
atttcttccgtggacgtggaggggtttcaccgtgagttgaaggcgcttcgtgagcaactggacgcatcgctgggcgaggcggatgcggcgcacctccggaagattgagcgctggggtcgggcggcgaccgcgctgggtgcggcgacctgctggctggcgccgaacccgctcagcgcggcggcgctcagtgtcgggcggtccacgcgttggctgctgatgcaccatgtggggcatcggggctacgaccgagtgccggggcttccggcgtctcgcacgggtaagggcttcgcgaaggggagccgccgctatctggactggctcgactggatgctgccggaggcctgggtgttcgagcacaacgtgctccaccactcgcacactggagaggatgcggaccccgacctcctggagcgcaacgcggaggggacgctgcgcaacccggagcgttcgctggcgctgcggtacgtgcagctctcgctgctcgcgctgacgtggcgggccagctactacgcgccggagacgctcagttcgctgcgccgcaagggccggcgcaagggtggggagctgacgcgcgaggagctgaaggagctgctgctgagctgctatctgccgtattcggccgtgcagttcgggctcttcccggcgctctacctggtgttggggccgtgggcgtcgttcagcgcgttctgcaactccgtgatggcggacatcctcaccagcctgcacacgttcctggtggtggggccgaaccacacgggcgaggacttgtaccggttcgactcgaagccggagagccgtggcgagcgctacgtgcagcaggtgattggcagcgcgaactaccgcacgggcggggacctgaacgacttcgcccacctgtggctgaactaccagattgagcaccacatctggccggacctgccgatgctgaagtaccgcgaggtgcagccgcaggtgaaggcgctttgcgagaagtacggcatcccctacgtgcaggagagcgtctggacccgcgcgaagaagatggtggacgtcgtggtgggcaagacgtccatgcggaagctcgcgccgaagcgcccggcccaggatgccggagtggccgctgtgcctgctcccgcggcgtga

SEQ ID NO: 9256 - DNA, 219 bp, Myxococcus xanthus
atgctggaggagagcgtgtcgcccaggctcttcgcgaagggcctgtccgatgcggagggttccatgctcctggcgcacggcgtgttgccgcatgagcggaagctcgaggtgttcgtccaggccctgcacgacgtcgtctttcccgggctggaacggtgcggagtggacaccactcccggacggcagtgggtggagcattgtcgccggtcaggagcgtag

SEQ ID NO: 9257 - DNA, 1086 bp, Myxococcus xanthus
atgaccgacctgttcgcgcccctcgagctccgaaagagtgtcatcgcgcccaaccgcatctggctggcgcccctgacgaacacccagagccatcccgatggcacgctctccgacgcggagcttcgcttcctcgcgatgcgcgccgatggcgggttcggcatggtggagacgtgcgccgcctacgtttcccaggacggcaagacgtggccgggcgagctgggcgttcacgacgacgcgatgctgcccggactgaagcgaatggccgcgcgcatccatgaagggggcgccctgctctccgcgcagctcttccacggaggacttcgcgccaacgccgaggtcagccagcgcgaggtgtggagcgccagcgcgtatgacgcggacggcctccactgccgcgaagccaccgaggccgacatcgagggcgtcatcgcggccttcgcgaacgcggcgcgccgctgcgccgaggcggggttcgacgccgtggaactccatggggcgcacggctacctattctcgcagttcctgagcaccgtcttcaaccgccggcaggaccgatggggcggctcgctggagaaccgctggcgcctccttcaggagacagtccgcgcggtgcggcgcgcggcgccctccctggtcctcgccgtgcgcctgtcgccggaggacgcgaggcaggccaggggcctggacctggacgagtcgctggaggtcgcgcgcatgctcacgcgcgagggcgtggacatcctccacctgtccctgtggaaggcggcccacaacaccctgaagcggccggaccagcacgcgacgccgctcttccggcaggccgtgggcaccggtgtccgcatcgtggtcgcgggcgaggtgcgcacgcgcgaggaggcagaggcccagctcgcgcgcggggcggatgccgtggccgtgggccgagcggccatcgcgaaccatgactggccgcgccgcgtgcagcgaggcgacgcgctccaggtgccgccgctgtcccccaccacgctcaacgccgagggcctgtccgacgtcttcgtgaactacatgcgcaactggcgcggcttcgtgacggaccaaccggcctga

SEQ ID NO: 9258 - DNA, 354 bp, Myxococcus xanthus
atgaagggccacatccacgcgttcgagccacgcgcgggcgggacgtaccggatgacactctcctacgacaatgcggaccacaccgcgcccgggaagacctccgcgcacgaggacgtcgtcgagggcctcttcgtggagctcgtccccaacgaacgcatcgtgcagcgattcgagttcgaatcggatgaccccgcctacgcgggcacgatgaccatgacctggacgctgacgcccgtcgccgggggaacccgcgtcaccgtcacctgtgaagacgtgcccgaaggcattcgccaggaagaccacatcgagggactgacctcgaccctggcgaacctcgcagcctacaccgagtag

SEQ ID NO: 9259 - DNA, 375 bp, Myxococcus xanthus
atgttcgccctcttctcccgcctgcgcagccgcgaaccgctcctgggcaccatcgcgtcacggtacgccgacggcgcgttcgaccagctcatccacctgcccgagcaggaacaagccgtggtggaccacttctacggccgcctggatgagctgcgctggtacttcacgtacaccgaggacatgcccggcaccgcccaactgatcttctccaagctgcacaagcggctggaggagtcctaccgagtgctcgtggtgacgctgggcccaccggttccgccagatggctcgcgcgtggtggatgtcgaggccgtccggcacgacgccgccgaagctccaccacggaagacgctgacacgaaccacgcggcgcgcgtag

SEQ ID NO: 9260 - DNA, 453 bp, Myxococcus xanthus
atggagcgcccgcgcctcttggcccaagcgggtcaggagctccaacatctggccaccggtggcggctcgaagctcgtcgtgacgctggagctgacgcaggaggtggatggcaccctgcgcgatgcgaagctcatctcgctgagtggcaacccggcctacgacgcctacgtcctgaacgccattccggcgtcacttgcgaagctcgctgcgccacccgctggcgcgcgaggtgtccgagccgacggcatccataccttgtgggccgtggaaggccgcgtcgtgtacctgcgcaagctcaaggaactgaagggacaggacgcctggtacatcgccgcgacgagcgctgctggcatcctggccggacgcttcgaggagacgacgggcgaaatcgaggtcatcgacttccgcaacccacggttcgtgtgccggtcccacttgttgcgcgtctactga

SEQ ID NO: 9261 - DNA, 297 bp, Myxococcus xanthus
atgagcatcgaggacaagattcaagccatcttgatgtccatctccagcgacacggacgaggagattctcgacgtgatggagcagatggcgaacgtgcgcgaccagcgcgcctcgttgggcaccggtgaggcggaccggaaggcgggcgcgaagctggagagcagcatgcaggagctggagctgcgccttcagcggctggtggagaagcgcaaggcgatgttcgacctgatgagcaacatgtcctcgaagttccacgagatggcgaagacggccatctccaacctgcggagcgcctga

SEQ ID NO: 9262 - DNA, 861 bp, Myxococcus xanthus
tgggtgatggcggcgcgccccaagacgctgacggcggcgctggtgccggtgttggtgggcacggggctcgcgttcggctcgggcgtggggcgcctgctgcccgcgttggcagcgctgctgggcgcggtgctcatccagattggcaccaacttcatcaacgactactacgacttcaagaagggcgccgacacgcacgaacggctgggccctcagcgcgtgacgcagagtggcctcatcgcgccgggcactgtgctggcgggcgcgggcgtgtgctttgcgctggccacggccgtgggcatgtacctggtggcggtgggcggctggcccatcatcgccatcggcctgacgtcgctgctgtgcggctacgcatacacgggcggcccctttcccctgggctacaatggcctgggagacgtgttcgtcttcatctttttcggcttggtggcggtgacggggacctactacgtgcaggcggggacggtggaccccgcggcgtggtgggcggcggttcccgtgggcgccagcggcaccatgctcatcgtcgtcaacaacctgcgcgacgtgacgacggacgtgaaggctggcaagcgcaccctggcggtccgcttcggcacgggcgtggggaaggcggagtacctcctcctcctggtgctgtcgtacgccacgcccttcgcgatgtacgcgctgaagctggccagcccctgggtgttcctgtccctgctgagcctgcccctggcggttcccccgttgcggcaggtgttgaagcaggagggggccgcgctgaatccggcgctggggtccacggccagactccagctcgtgtttggagtgctgttcgcgttgggcctctacctgcgatga

SEQ ID NO: 9263 - DNA, 1113 bp, Myxococcus xanthus
tggacgaacgtgcacggcatcgaccagacaccggacacggtggagacggtgtccggcttcccgcacaaggtgtaccgggacggcgcaggcaacgcgctggtggagacgtgggaactcaccggcatgggccacgcggtggccatggatgcgcagttcccgtttccaggcggcacgggcagcgcggcctgtggctcggtgggggcgtacctgagcgatgtgaatctctgctccgtctaccaccaggtgaagttcttcgggatgacgggaggcggaggtgagcccacgggggataccacgccgcccaccgtcaacgtgacggcgccggcgagcggggccacggtgagtggcacggtgaatgtcaccgcggatgcggcggacgcggtgggcgtcacccgggtggagttcctggtgaatggcgaggtggtgtccacggacacgcaggcgccgtatgccttcgcttggaacagcacggccgtgtccaacgggcagtacacgctgggggcccgtgcgtttgacgccgcgggcaatcaggcgacggacaacgacacggtggtgacggtgagcaactcaggctccccggcgccggtgacggtgcagttcgccagcatcgcggcggatgatggctacctgaaggcggacgcggatggcagcggggcggcgctgggattcatgacgaacctggcgctcggccgggggacggatgggaagtacaaccggtcgttcctctccttcgacacgtcgagccttccggacggggccaccgtcacgcgggcgttcctgacggtgagctactcgtcgggctcgggagacccgtggtcgacgcccgcggggaacacgctggtcatcgacgcgaagacggggacgttcaacgcggcgaacacggaggtgacggactgggcggcggcggccacggcgagcagcgtcgcgggcatcgaccggttcagcgcgggaacgaagagctccggggacttcagcgcggatggactctccgccatcagcaagacggggaagacgcagctccggctgcgcttcacccaggcgcagacggccacgcagtacctgttcatccgggatggggcgaacgcggtgctgacagtcgcctatacgccgtag

SEQ ID NO: 9264 - DNA, 738 bp, Myxococcus xanthus
ctcgactccattggcacggcgggggtgcgggtgctccagcggcggacgggttaccgcttcacgttggacgcggtgctgctggcccacttcgcggccaccgaacgtgtcgacgagtccgggcggatgttggagctgggcgcgggcagcggcgtggtgtccttcctgctggtgaagcagttcggccgggggcccgtggatgccctggagttccagcccgccgttcatgcccggctgatgcgcgccgtggcgctcaacgcgtgcgaggcccacgtcaccccgctgctcggggacctgcgacggatccgcgaacacgtctccggcggccagtacgcccacgtcgtgtccaacccgcccttccgcctggccgacgcgggggttcgcagcccggatgacgaacgggccgtgtccaagtcagaggtggcgtgtgacgcaccatccgtcgtcgccgcggcacggtatgcgttgatgcccggcggcggcgtgagcctcgtgtacccggccgcgcgtgtggccgaggtattgggcctgctgacccaggcgaagctccaccccaccgtgctgcgcttcgtccacgcgcgggtgggagccccggccacgcgcttcctggtgcatgccctgcgagacagggaccggggcctcgccgtgcgcccacccctcatcgttcatggcgaagggcccgggggctactccgcggaggtggcggcgttgatggatccgcccctcgcggagagtcgctga

SEQ ID NO: 9265 - DNA, 507 bp, Myxococcus xanthus
atgaacgtggcgaccctgaccgagcaaccgagcatcctgaaggcagcggccctgctgcccccgcgcctgtcgctcgggtcgacgatggtggtgcatggcgtgtccaagctccgcgccgagggcaccgcgcaacacgcggacctcttcgagcaactgggcttcaagccaggcaagccctgggtcatcgccacgggggtggtggagctgctctcaggcgtgagctccatcctgggcatcgccacgcgccccgccgcgctggctatcctcgtcacgcaagccatcgccgtggccaaggtccatggctccaagggcttcgacatcacgaagggcggcttcgagttcaacctggcgctgggagccatcgcgctcggcctgctgctgcgaggcccgggaccgctctccgtccacagcgccatcgagcgccgggtgaagcgcaaggagctgcggcggctgcggttcctgccgcgccagcgccgtcgttcggtgctgctcgacgtgctggggtga

SEQ ID NO: 9266 - DNA, 1272 bp, Myxococcus xanthus
atggaggccctccaggcgaaggacgcacccacggccatcacccaactgtccgcctgcgtggaggccgcgccctcgcgcgtggattgccgctgggagctgggctgggcgcactcgctggagaaccagtgggcggaggcctacacgcagtggtccgaggtacagaagctccagccggaccacccggacctcgagggcgcgctggcccaggcccgtgggcaggccatgctccaggcgaagctgtcgcaggggcctcagctcatcaaccgccctcccccgccggccaacgcgaaggtgcgcatccgcgcggtgggtgacgtcatgctgggcaccaccgtgcccgaaggccacctgcctcccgatggcgccggcagcgtgattgccggcgtacgcccgttgctggaggacgcggacctcaccttcatcaacctggaagggccgctgtgcgacacgggcgagacgaagaagtgccgctcgtcgaaaaactgctacgcgttccgctcgcccaccgaatacggccagtacctgaaggagtccggggtggacctggcgtccacggccaacaaccactcgggtgacttcggcgaggagtgccgccgcgcgacggagtccacgctcgacgcgctgggcatcgcgtggagcggcgcgccgggcacggtggccacggtggagcgcaacggcctgctcatcggcatggtggcgttccacacgtcgccgtcctgcaaccacctcaacaacctgaccacggcgacggggctggtgcgcgtggccgcggccgagcacgacatcgtcatcgtgtcgttccacggcggcgcggagggcagcaaggcgctgcacgtgcccaagggccgggagaagttccacggcgaggaccggggtgatttgcgggccttctcgcgcgcggtggtggacgcgggcgcgcacctggtcatcggccatggcccgcacgtggtgcgcggcatggagttctacaagggccggctcatcgcctactcgctgggcaacttcgccacctatggccggttcaacctgcgcggtccgcagggcctgggcatggtgctggaggtcgagctgaaccgcgacggcgacttcacggcgggccgcatcctccccacgaagcaggtggacaggggcatcgccgtgccggacccgaagggcgccgtcatcaaggcggtccgcgacctcaccgcggatgacttcccggagacgggcgcgcgcatctccgacgacggcaccgtgaaggtccgcggcaagggccctgtctccatgcgctga

SEQ ID NO: 9267 - DNA, 1179 bp, Myxococcus xanthus
tacttcgcggtctgggtgggagccctgatctccaccatcggcacctggatggagacggtggccatgggtgtgtacgtcaccgaggccacgggccgcgccgagtggacgggtggcatcgtcgccctcaccttcctccccgcggtggtgctgtcgccggtgggcggcgcgctcgcggaccggttcgaccgtcgcgcctacgtcgcgctgggcacggtggtgcagttggtgctcgcgggcgtgttgacgctgctggccttcacgcaccggctcagcgtccccgtggtggccgtcatctccttcgtccacggctgcgccagcacgctcatcaatcccgccttcgcggcgatgctcgcggagctcgtgccaccccgggacttgcacagcgccatgagcctcaactcggcgcagttcaacctggggcgcatcatcggtccggcgctggccgcgctggtgctgagcatgggcgggacgtcctgggcgctgctcatcaacacactgtccttcgtcgcggtgttggtggcgctgtcgcaggtgaagacgctgacgcgcaaggtgacggagggcggtcagggcctgtggaagcagattgcccatggcttcaccgtggcgcggggggacccggaaatctcgctgatgctgtggggcacgttcctcgtcgcgggcctggtggcgcccttcatcggcctggtgccggtgttcgccatccgcgtcttcggccagggcgcggcagccacgtccttgctcgtcacctgccagggcgcgggcgcggtgacggcggcgctgctggtgggcacgctggtggaccggtggggccagcggaagctgctgggcatcgtggcgacgtccatcggcgtcgtgtccacgctctattggctgtcgcccacgctgcagatggcggccgttgtcatcttcgtgctcggcgccaactacatgatgctgatgagcgggatgcacgcgtactgccagtcgcgcgtgccccgtgagctgcaagcgcggatgagcagcctgtacagcatggtactgggcggcgcgtacgcgtccggcgtctggggcctgggcgcgctggcggaccggctgggcatccgcttcgtcaccgtgagcgccagtgtgttgttcatcgcgttggtgctgacgctgcgcctgttgcgtccgcagcgcttcgacggcgctgtcgcgtag

SEQ ID NO: 9268 - DNA, 309 bp, Myxococcus xanthus
atgccgaacaggaagtacgacccgtacacgggaggcaaggaggcggccaccaagcccccctatgcgccggaccgcgtggagcggggactggaagccgacgacaccctgccgctgtactccgcggactccatccgcgacacccgcgaggagaagttcgccctggacagtgactccgaggtgggcggctacgtccccgacatccgcagccccatcgacgaggcggacgagctggagcgcgagcgccggggccgcgagcgagccgaggagcggcaggtctccgacgaggaagacgaggcgcgcaaccgctga

SEQ ID NO: 9269 - DNA, 1251 bp, Myxococcus xanthus
gagctggctacccagctccgggtgtcacgcccgacagtgtcgcggttgctggcctccgcaggcccgagcgtctgccgaatggggcaggggcccgccacacgctatgcgcggacccgctcgattgcccccttgggcgaacaggtacggatgtaccgcgtcgacgagaccggccgtccccacgaggcaggcgtcctgcacccgctgtggaacgggggctgctggattgcgcgagaggacggggtaggtgaacggttcgccgggctgccgcctttcgccgccgacatgagccctcagggctacctgggccgaggcttcacgagccgtcacctcgagttgggactcccccctcgcatcacggactggacggaggaccaccagctcatcgcactggcgttgcgaggcgatgactgcgtcggaaaccacatcatcggcgcggcctccctggaccggtttctcgcaagcccgcttcggcccgtcaccgaggcccagtacccggagctcgcccgctcatcgatgtcgagcgaggcaggctccttcgccggtggcgatcaacccaagttcactgcctatgccgagcgacgccacgtcctggtgaagttcgcggccaacgatgacggcgccgccgcccaacgttggagagagctgctcgtctgcgaaggcctcgcgctcgaagtggtccgcaacgccgggattccggccgcggcttcgcgctccatccgcgtcgagggctaccagttcctcgaggtcgagcgcttcgaccgggtgggtgaaagaggccgcaaggcgctgctctcactcaaggccatcgacaacgagtacctcggccacgaagggaaggggagcacctggaccagcgcggcccgctacctcctccagagccagtacatcagcgaagaggacgtcaggcgcattcgctggctcgacaccttcgggcagctcaccggcaacaccgaccggcacttcggcaacctctctttcttcgaggacggacccaagcggttccggctcgcccctgcctacgacatgctcccgaagatgttcgcccccgtgggcacgagcatcatcgatcgcaccttcgagccccggccgcccacctcggagacgctcgatgtctgggccgatgccgcacaacacgcactggcctactggagccggctggagcagacccccgaactcagcgacacgttccgcggccactgcgcacgatgcagggactcacttgccgcgctgatgcagcggacgccggtctga

SEQ ID NO: 9270 - DNA, 219 bp, Myxococcus xanthus
atgatggacgggcagcgccggggcacgagcaacgcgacgaacctgagcctccgcgacgtgccgcccggggaacatgcgctggaggtggacttcacggtgggcgggaagctgcggcgctcgacgctggcggtgcccgcgagccatgagctgttcgtcaccgcgtccgaagagcacggtgtccaggtgacgaacaccaagccgctcacgggcacgccgtag

SEQ ID NO: 9271 - DNA, 180 bp, Myxococcus xanthus
  unsure (1)..(180): unsure at all n locations
cgcgacgccagcgccgcgnacgtgcagcgcatggccgagcagtacctggacccggcctcgatgcagattgtcctcgtgggtgacccggcgaccatccaggagcaggtgacgccgctcggcctgggcaagctggtgcccatcgagccggatgaagcaccggtgccgcgcgcggcgaagtag

SEQ ID NO: 9272 - DNA, 627 bp, Myxococcus xanthus
atgagcatggagcggatccgcaccgatttcccggaggtgacgctggccatcctcgcgggagggcagggccggcgcctgtctggcgtgcccaaggggctgttggaagtggaggggcgcacggtgctggagcggctcctggcgctggccccgtgcttcgaggacgtcttgctggtggcgaacgtgcccgggccctatgcgcgcttcgggttgcgcacggtggcggacgtggtgccgggcaagggagcgcctggcggtgtccatgcggcgctggtggccgcgcgcacgccctgggtggtggcggtagcgtgcgacatgccgttcatcacgacggaggtcctgcgggtgttgctgggcgcgcgggacgacggcgtggacgcggtgtgcttcgaggcgcggggcaggttggagccgttgctcgcagcgtaccggtcggcgttggcaccggcgtgggagacgacgctggcgacggatccgtcgatgcgggagctgttgtccggagtgcgaacgcggctgttgtccgaggccgtgctgcacgcggtggatccgtcactccggtccctggcgaacgtgaacacccccgaggacctggcgcgctacggtgtggcgctgccgtcgtggcgggggtga

SEQ ID NO: 9273 - DNA, 858 bp, Myxococcus xanthus
atgggcgtgaagctggcttacgagacgtggggtgagggctcccgtccgctcgtgttgctgcacggcttcaccggcagccgcagggccttcgacgggctgcgtccgctcctgggccgcgacgtgcgcgcggtggcggtggacctccccggtcatggggccacgccgctgccggaccagcgggggcgtgaggccttcgtggagacggtggacgcgctcgtcgcgctggtggactcgctggggcaggggcccgtggacctgctgggctattcgcagggggcacgcgtggcgctggcggcggccgtgcgcgcgccggaccgcttcggccggctcatcatggagagcggttcgccagggctgcatcggcgccaggagcgcgcggcccggcgtgaggcggacggacagctggcggccttcatccgttcgcggggcgtggacgccttcgtggaccgctgggagcaattgccgctgttcgacggcctgcgccagcttccgcaggagcgtagggacgcgctgcgctcacagcgccgcgcctgcacggcggaggggctcgcgggcgcgctggagtgtctggggctgggtgtccagccggatttctggccggagctgcatgcccagcggctgcccacgctgctcctgacgggcgcttcggattcgaagttcacccagattgcccgccgcatggccacggagctgccggtggtctggcgccacgccttcgaagactgtggccacgcgccgcacctggaagcgccggaagcctacgtccgtgaagtcctcgggttcctccagactccctggtacgaggccccgcagttcgacagccccatgcccgtgcgcgagggaagggtggcgtcgtga

SEQ ID NO: 9274 - DNA, 87 bp, Myxococcus xanthus
atgattgtcggcacggagcgcttcatggaggcagtgcgccggctggacctggatggcatcaccttccaagcgctgcccgcgcactga

SEQ ID NO: 9275 - DNA, 318 bp, Myxococcus xanthus
atgctgaagacccctcttggacgtttccgtgcagtggccctcgcggagggcctgtccgtcatcgcgctcttcttcatcgccatgcccttgaagtacgccgcgggcatgccgcaggccgtgaagttcaccggctgggttcacggcctgctcttcgtgctctacctcttcgcgctcatggaggcggccatcacctaccgctggtccttcgtgcgcgtggtgggcggcgtcttcgcgtcgctgcttcccttcggcaccttcgtcttcgaagcgcgcctgcgtcgcgaagcggccgagccggccgtcgagcccgtgccctga

SEQ ID NO: 9276 - DNA, 615 bp, Myxococcus xanthus
atggagcgcggcaagtgggacacgccagaggatgtggagcgcgagctgagctcgcggctcgcgctcgtggaagcgtccgagggcattcgcggcatgcacttcgcggccgtcctcgacaccgtgcgcttcctcggcggtgaacaggcggtggctcccatccagcagggcggtgactaccccgccgacctggacaccaccgagttctaccccgtcccgcccttcatgcgcgtgttcttctccgcggcccggctgctggcaccgcagctcggcggcgtcgaggaggcgatgcggcagctcggcgtccagggcacgctggccttcatcaactccatgttcggcgcagaggtccggcagcaggtgggcggcgagcccaagcgcctcgtggagatgctccccgaggcctaccgcatggccatcaacttcggagagctgcaggtggcgtggacgggcccgcgctcgggccgcatccacatgcgccgcatcttcacccccgtggcctacaacgagggcatgctcgaaggcgcgctgctggccgtgggtgcccaggacatccaggtgcgcggcggacagacgtccctgctggacagcgagtacacgctgtcctgggactcgtga

SEQ ID NO: 9277 - DNA, 558 bp, Myxococcus xanthus
atgaaggcaaacaactggaagaacctggccgcagtggcgggcgtcatggtgtcggtgagcgccggcgctcaggagtcgtcggggagctttggttcggaggggcagttcgtcatcagcacggatgcctccgcgagcctgggttactccacgcagggcagcggcatcggctacatcttcctggagcccggcgcggactacttcctcaagaagaacctgtccgtcggcagcggcctccaggtccgcgcgctcttcggcagcggtgacacgattgccgccttcggcctgaacgcgcgcgtcggttacaacatcccgctctccgaccgcgtctccgtgtggcccaagggccaggtgtcgctgtacatcggcgacgacatcctgcccttcgccaactcggcgctccccgccaacgtcactgtcatcctggaaggctacgcgcccttcctcttccacgtgacgccgcacttcttcgtgggcggtggcccgcgcctggccttcggcctgggcgatgacgtggaggtgaacttcagcgtcgcctccaccatcggcggctacttctag

SEQ ID NO: 9278 - DNA, 122 bp, Myxococcus xanthus
atggcaggggtggagggccgcgagtcttgtcgtgagcagacggaagaccatctcacgatgcgtgagctgatggctgagctggaagagctgccctcgggccatcccgagtggcaggcgcgtct

SEQ ID NO: 9279 - DNA, 894 bp, Myxococcus xanthus
atgagccgcgtgcccgcgctcagcgtggtgggctggtccggcgccggcaagacgacgctgctcacccggctcgttcccgagctcgccgcgcgaggcctgcgcgtggccgtggtgaagcactcctccgacgcccatccgctgcaccggcccggcagcgacaccgctcgctaccaggacgcgggcgccgtgctcaccggcttcaccacgcccgcgggcgtccagctcacgacggccaccgccctctcggacgcgcttccctcgctgctcgagcgctccgcgggcgccgtggagctggtgctcgtcgaaggctggaaggacggccccctccccaagctggaggtatggcgggagggtctgggcccgccgctggcgccctcgcgcccggaggtcctcgcggtgctctcctccgagcccgcactccccacggacttcccacccggcctgcgcgtgctgcaccccgacgacgtgcgcgccgtggcggacctcatcctggcccacctgcgcccgagccgccccgcgcccctgccccccgtggatgcccgcggcgtcacgcgccgcttcgtccagcggtggaacggcgccacgctactcccggcccaggaggacgacatcgcggtggaggagcctctggagattcgcgtcagcggagactcggtggccaccaccatgcgcacgccaggacatgaccgcgagttggccaccggcttcctcttcgccgagggcatcctccagagcgtggacgacctgggcgggctggcacactgcggacggccaggcgaggagggcttcggcaacgtcatcgaagtcacccccgcccccggcgccttcctcgacgtggagcgcgtgagcaccgcccgccggggcaccctcaccaccacagcctacggccgttag

SEQ ID NO: 9280 - DNA, 1188 bp, Myxococcus xanthus
cctgagcgcgtgccgctcctcgatgcccagggccggttcctcgccgctcccgtcacggcttcccgctcgctgcccggctgtgacaactccgccatggacggctgggccgtgcacgccgaggagacgcagggcgcctcccgcgatcggcccgcgcgcctgcgcgtcaccagcaccatcttcgccggcgccctcccctccacgcccctccggcccggagaagccgcgcgcgtcttcaccggcgcgcccctgccccccggcgccgacgccgtcgtccgacaggaggccactcgcgccgccgaggacggcacccgcgtggacgtcttcatcaccgtgccgcccggcaacgacatccgccgcaccggagaggaagtcctcaccggcacacccctcttcgacgcgggccagcgcgtgggcgccgcggtgctcggcgtgctcgcgtccatgggcgccacggacgtctgggtgcgccccgcgccgcgcgtcgccgtgctcgccaccggcgatgagctcgtccctcctggcactccggccctgccccaccaggtgtacgagagcaacctcgtcctcgtggccgcgctcgcccgcgaggccggcgcggatgtccgccagctcgcccgcgcccgcgatgacgagagcgccctgcgcgatgcgctctcgcgactggccccgcaggtggatatcctcatcaccaccggaggcgcctccgtgggtgacaaggacctggtgaaacgcgtgctcgccgcgctcggcgcccgcttcttcgtggacggcgtcgcgctcaagcccggcaagcccgtggccgtggcccggctgggtgacacctccgtcgtcgtgctgcccggcaatcccggcgcggccaccgtggcgttcgaccagttcgcgcgcccgctccttctaaaacaccaaggtgtgttggagacgcgccgccgcgtccgcgcccacctctccgaagcacgccgcaagcaggcgggcctcacctacctcatcaccaccaccctggaagcccgggacggcctcgcgccgcgcgccgtgctccgtccccagggcgccgggcagatcctccagaacgtccacggcgagggctgggccctcctcccaccgggccgcgcggacttcgccgaagacgacctcgtcgacgtcgagctcttcgaccggcccaccttcacccccgtgggcgcattggcatga

SEQ ID NO: 9281 - DNA, 1794 bp, Myxococcus xanthus
atggcgctgcccatcgaagcccatgccctcattggagacacgcacagcgccgcgctggtggcgaatgacggcaccatcgactggctgtgctggccgcgcttcgactcggacgcgtgcttcgcggcgctgctgggtgagccgcggcatggcttctggcgcatcgcccccaccgtgcccgtgcggcgcgtccaccgccgctacgtgcgcgacacgctggtactggagacggagttccacaccgacgccggcaccgtgcgcctgtgcgatttcatgccgctgcgcgaggacacgccgcatttgattcgcatcgtggaggcccgcaccggacaggtgccgctccacctggagttcgccccctgcttcggctatggcgaccgcacgccctgggcccgcctgattccgggaggcgtcagcaccaaggccggcccggacgcgctctacctgtccacggagctgccgctgcgtttggagcacagccatgtgctcgcggacttcgccgtgccggaaggccagcgcctggccttcgtcctgtcctggcatccttcgcacctgcctccgccccggcagccgccggaccccttcctcacgcgcgcggacacggagcgggggtggcgcgcctgggcgctccgctgcatccatgagagcccctggcgcgcgcaggtgctgcgctcgctcatcaccctcaaggcgctcacctactcccctaccggcggcgtggtcgccgcgcccaccacgtccctgcccgagcggatgggcggcgtgcgcaactgggactaccgctactgctggctgcgggatgccacgctgacgctgctgaccctgctggacgccggctacacccaggaagcccaagcctggcgggactggctgctgcgcgcggtggccggagagcccgacgagctccaaatcctctacggcgtagccggagagcgccgcgtcaccgagctggagctgccgtggctgccgggcttcgcgggctcgcgtccggtgcgcatcggcaacgccgccgtgggtcagctccagttggacgtcttcggcgagattgccgactgcctctaccacgcgctccgtcatggcgtctgttcggacgccgaggcctgggacgtgagcgtgcacctgctgcgcttcgtggagcgcaactgggaccagcccgacgagggcatctgggaggtgcgcggcgggcgacagcagttcacccactccaaggtcatggcctgggtggccatggaccggatggtgaagaccgcgaacctgcgcggcatgcgcggcgcgcaggtggagcactggaaggcgctgcgggcgcagatgcacgcggacatctgcgcgcggggctacgacgcgcgccgcaacaccttcacccaggcctttggcagccagtccctggacgccagcctgctgttgattcccatggtgggcttcctcccacccgacgacgtccgcgtgcgcggcaccgtggaggccgtccgccgcgagctgtgccaggacgggctggtgcgccgctaccacacgcacgagacgcgggacggcctccctccgggcgaaggcgtcttcctggcgtgcagcttctggctggcggacgcgctggcgctgatgggccgcgagggcgaggcgcgcgagctgttcgagcgcctgctgggcctgtgcaacgacgtgggcctgctgtccgaggaatacgacccggtggcccacaagatggtgggcaatttcccgcaggccttcagccacctcgcgctggtgggtaccgcgctgaacctgtcgcgagagggcggccccgttcaacagcggagccactga

SEQ ID NO: 9282 - DNA, 939 bp, Myxococcus xanthus
atgagcaccgacgccacccacctgccccgttccgccctgctgttcctggcccgccgccctggactggaggacgccgccatgcgcctgcgccccttccggcggctggcctcacgcttcatcgccggagagacgctggaggaggccgtggacgccgtgaaggcgctgtccgcgcgcgggctcatggcgtcgttcgaccacctgaacgaggccgtccagacgcccgaggagacgcgggaggaggtgcgccagtaccagcggctgctggcccgcatcgacgcggtgggcgtgcgggccaacgtgtcgctgaagctcacccagtgcgggctgttgttcgatgaagccctggccctggagaacgcgcgcacggtggtggccgaggccgcggcccgcgactccttcgtgcgcatcgacatggaggacagctcgatgacgcaggtgacgctggacatcgtgcgacggctgcgcgcggagttcggcgagccccatgtcggcgccgtgttgcaaagcgccttgcggcgcacggagcaggacgcgaaggaactgtgcgcacagcgcatccgcatccgcctctgcaagggtgcctatctggagaagcccgacgtggccttcccagacaagcaggacgtggatgccagcttcgttcgcaccatgcgggtgctgctggacagcggcgtgtatcacggcatcgccacgcacgatgaacggatgattgaagcgacactggaccacgcggcgaagcgcggactgccgcgcggcgccttcgagttccagatgctgtacggcatccgcagggacttgcaggagcgactcgtgagggagggtcacccggtgcgcatctacgtgccgtacggacggcactggtacccgtacttcatgcgccggctggccgagcgccccgccaatctggccttccttctgcgcaacctggtacgtgggtag

SEQ ID NO: 9283 - DNA, 63 bp, Myxococcus xanthus
atgcgccaccccgatgccttcaacacgctggccggggacttcctccggcagcccccggactga

SEQ ID NO: 9284 - DNA, 1047 bp, Myxococcus xanthus
atggatggattcgcggcggccatcagcgcgctgtcgcaggccacgggctatcccgtgctggccgagtccacctcgcaggcccgctatggcggcggcccgctcacgctgtcctattacgacgcgatgttgcggcatgcgccgttcgcgaaggcgcaccgtccggagctcgtgttgcgcttcgggggcgggctcacgccgaaggtgcctcagcagtggctggacggctcgggcgcggacaccgtcctcttcagtgacggcggcgggttgttcgacccggcgcaccgtgcgtccacggtggtggagggctcggcggtggcggcctgtgaggccctgacgcgaggactcgcgcgcggcgtgggggcgtgggcacgaggcttcctggccgcggagcaacgggtgcgcacggcgctggaggccgcgttcgcggagcagcccgatgtgctctccgagccgcgtatcgctcgcgaggtggtggcggcgcttcccgcgggcgcgccgctcttcgtatccagcagcatgcccatccgcgacctggatgccttcgctccggcgggcacggtgccgctgcgggtgctggccaatcggggggccaacggaatcgacggcattgtctccagcgcgctcggcatggcggccgctgcgggccgctccgcggtgctgctcacgggggacctggcgttgctgcatgacgtgggagccttcgtcaccgcgtcgcgcacgcgagtgccgctcacggtggtggcggtgaacaacgatgggggcggcatcttctcgttcctccccatcgcccaggtcgcgccgcgggacacgttcgagacgctcttcggtacgccgcacggtgtggacctgtcccacgcggcggcgctgggcggcgcccggctccaccggccggagacgcccgtcgcgctcaggtcggccgtgcgcgagggcctggagggcgggctccacctggtggaagtgcgcgtggaccgcaacgcgaatgtggatgagcaccggcggctgttcgctcgaatggcggcctcactgggagaaggaccatgggcgtga

SEQ ID NO: 9285 - DNA, 2004 bp, Myxococcus xanthus
ctgccctgccgacgcggtatcgtcttccacaacatcagccccgcgcggttctacgaagggctgccgctggcggacgcgctggtggcgggacgggcccagctcgccgcgatggcccccttcgcggatgtggccatcggcgtgtcggacttcaacgccgccgagctgcgcgtcgcgggttaccgcaacgtccacacggtgcccctcttcatcgaaccggagcgattctcccgcgccagcgcggacgcgaagatgctccagcggctcgaaggtccaggccccgtgctgctcggcgtgagccgggtcatgccgcacaagcgcttcgaggacctgctcgcgctccaccgcgaagtcctgcggttgcgcccccaggcccgcctgttgatggtgggcggctacgagccgggcagccggtacttccgcatgctccagcgcgaggcgcgcggcctgcgcggcgtgagcttcctggggcgcctgagccacgcgcagctcgtggccgcgtaccgctccgcttccgtcttcgtctccatgagcgagcatgagggcttcggtgtccccctcatcgaggccatggccgccgaggtgcccgtgctggcctacgcggccgccgcggtgccggagaccctgggcggcgcgggcgtggccttcgaccagaagcgcttcgccttcctcgcggagctggcggtggacctgagcgaggacgtctccctgcgcgggcccgtcatcgctggacaggcgcggcggttggagcacttctccgcgccttccgtgcagaccgccttcacgaaggcactggaaacggtgctcccccgccccacgcccacgaagtcccggaaggttccggagcgtccccgggtggcgatggtggtgcagcgctacggcgaggtgacgggcggcgcggagaagctcgccgcgcaaatggccgagcacctggcgccgcactgggacctcaccttgctgacgacctgcgcgaagaaccacctcgtgtgggacaacgcgtttccgcccggccccgacgtcgtggacggcatcaaggtgttgcgcttcccgtccacgcgggtgcgtaacatccgaggcttcaacggcctgtcgcggcaggtgttcgacaagagcaacgagcggctgcgtgaagagcagtgggtggccgagcagggccccatgtgccccggcctgctgcaccacctggccaccgagcgcgacgcctacgacggctatctcttcttcacctacctctacgcgcccacggtgtggggactgccgctggtggcggaccggtccctgctggtgcccaccacacatgatgaggcccccgtccgcttcggtgtgtatcgggacgtcttcgaacgcccgcgcgccctgctctgcctcacgccggaggagcacacgctcatcgagaagtacttcccgaatcacgcacccacgcgcgtggtgggcgtgggcgtggaccggcctcgggcggatggcgcgcgcttcaaggagaagcacggcatccaccggcactacctgctctacatcggccgtcaggagccgggcaaaggcgtgcctgagctgctcgagtaccaccaggccctgaagaaccggttcgaggacgcgccggacctggtgctcgcgggcgacaccaacatggagctgtccggcgagggcgtgcgctatctgggccgtatcgacgagcaggacaaacacgacgcgctggcgggggcgttggcggtggtggtgccgtcccgctacgagagcctgtcgctgctgacgctggagtccttcgcccagggcacgcccgtgctcgtgaacgggcgctcggacgtgctggtggggcaggtggagcgcagcggcgcgggccgcgcgtacacggacctggagtcgttcatccagggcctgcgcgaggtgggctcggagcgtgagcccatgggcaagcggggcctggcgtacgtgaagaagcagggctggccgcaggtggtggcggcctaccgggaagaaatgcaacgcatcctcgaggagaagcgccgatga

SEQ ID NO: 9286 - DNA, 813 bp, Myxococcus xanthus
cccttcgtcagcgtcgtcatccccgcctacaacgagggacagcggctgcctcgcttcgtcgcggagctcacgcgcgtgttcctcgagcggagcgccccgccggtggagttcgtcgtcgtcgacgatggcagcgcgcccgagcacgccgaactccagcgcgcgagcgtagaggcggcccaggctcgcctcgccaccgagggggcgcggcaccagttcacctacgtggcggcgcctcgcaaccagggtaagggctcggccatccggctcggttggcgtcacgcgtcagcgggcgtcacgtggctggccttcctggacgcggatggagccatcaacgccgaggagttccaccggctggtggcgctgagcgcctcggagatggcgcggaacgtagacctcctggccggctcacgcatcctcatggccggacgccgcgtcgtgcgcaacctccaccgccacctgcagggccgcatcttcgccacgctcacggatgcgaacttcaaactccacttctacgacacacagtgcggggtgaagttcgttcgcgcggacatcctgcggccgctcctggacgtcctccaggagcagcgctggctgctggacgtggagttgctggtgctgctgaagcgccagggcgcgcgcttcctggaggtccccatcgactgggaggacttcggaggttccaaggtcatcccagggctcgacgcggcgcgcatgttctgggggctgctgcagcttcgtcggcgactggagcatgtgtccctgcctacccaccgtgacgcgttgcccgaaggcgagccacacgcccagcggtag

SEQ ID NO: 9287 - DNA, 3780 bp, Myxococcus xanthus
atgcgcgccttgactgacctgccctccgaccccacctctcctctgaccctgggcctgccgggctttgtcttcgaggacctgtatcgtcccgctggtctgcgccggttggcggagcgcttcgacgcacagctcaccgaggatgagcccgagctcttccaggccttcgacgcgtaccgcaagtctggcggcacgagcgtcagcggcgccgcggagtcggacctgctcgtccgcgtgtcgcgccacgtgtcgcgcttcgtcacgcgcctcttccgagtggagcaggagctggagcgcctgtccggccgcctcaagggcgagctgccgctcttcgacttcaagcgcgagttcatcacccgccgcgtcttcaagaagggcgccgcggaccgcccggcgctggcggagttcccctcgctggacgcgcgcatgcggctgatgctccagctgggcttcccggaggcgctggccaccggggacctggagcggggtctggcggaatccgtcctctcgctgatggacctggagcgcctgttctccaacgcgctgcccgccgagcgtcagggcgaggcggaggccctgcgcgcccgctggtccgcgctgcgcgaggtgctgctgtccacgcccgagggcaaggacgccttcggctccagcctcgtcacgcagggcgatgacgccgcggagatccagtccgtgcgcgcgctgctgtcgctggcggaccgttggacgtacgcgcgggcgctgcatccggagacgaaggacctcttccacgcctggcccacccaccggattcccaagccgctggtgttcgaccagctcgtccagctccagcgtccggacaacgagctgcccgaggccaccgagggcctggagcaccacctccgccaccgcgacggcttcaagctcaccgaccgccggggcacctcgcgcgacgtgatgaacgaggtggactactgcgtgctctgtcacgagcggcagaaggactcgtgcaccaaggggttccccgccaaggacccggtggccgaggggcaccactacaagaagaacccgctgggcatccccctcaacgggtgtccgctcgacgagcgcatctccgaggcgcacctgctcaagcgtgaaggcaactccgtggccgcgctggccatggtgacgctcgacaacccgatgtgcccgggcaccggccaccgcatctgcaatgactgcatgaaggcctgcatcttccagaagcaggagccggtgaacatccccctggcggagacagccacgctcacggacgtgctgaacctgccgtggggcttcgaaatctacggcctgctcacgcggtggaacccgctcaacgtccgccgcccgtacgcgctgccctacgtgggccgcaacgtgctggtggtggggctgggtcccgccggctacacgctgtcgcactacctcctcaacgagggcttcggcgtcaccggcgtggacggcctcaagattgagcccttccccgacgcgctcgtgggccgcaatggccactcactccagcccatccgcgactggtccgcgctcaccagcgagttggacgagcgcatcctggagggctttggcggcgtgtccgagtacggaatcaccgtgcgctgggacaagaacttcctcacgctcatccacctcacgctggcgcgccgggagagcttccgcatccacggcggcgtgcgcttcggtggcaccctcacggtggaggacgcgtgggcgctgggcttcgaccacatcgccatcgccgctggcgcgggccgcccgaccatcatcgggatgaagaacaacctcatccggggcatccgcaaggccagtgacttcctgatggcgctccagctcaccggcgcgttcaagaaggactcgctggcgaacctccaggtgcaactgcccgccatcgtcatcggcggtggcctcaccggcatcgacaccgccaccgagctgatggcgtactacccggtgcaggtggagaaggcgctcgcccgccacgagaagctggtgtcccaggtgggcgaagaggccgtgctggcccgcctcgacgcggaggagcgcgccacctaccagacgttcctggagcatggccgcgccgtgcgcgaggagcgccagaaggcgaaggccctgggccgcgacccggacttcatcaagctggtgcgcgcgtggggcggcgtcagcctcgtctaccgccgcagcctcaccgagtcccccgcctaccgcctcaaccacgaggaagtgacgaaggcgctggaggaaggcatccgcttcatcgagcgcatgagcccggtggaggccctgccggacgcctccggcgcggtgcgcgcgctgcgcttcgagcgcatggtgacggtggacggcaagctcaagggcagcggccagttcttcgagctgcccgcgcgcacggtgtgcgtcgccgccggcacgtcccccaacgtcacgtacgagaaggaatacccgggcaccttccagctcgacgcgcgcggcgagtacttccagagccacgagctggtggacgccgaagacggcttctcgctggcgcccgtgaaggcgaaggaggacccggccgcgaagacggggttcttcacctcgtaccagaaggacggccgtttcatctccttctacggcgacaaccacccgacctacgcgggcaacgtggtgaaggccatggccagcgcgaaggacggccacccgcaggtggcgcggctgtacgccaaggaagtggccgcgctcgacttcaccgacgaggtggcccaggcggcgcgtgacgcgcgccgcgccgcgcacttcgccaggctggacgaggcgttcaccgccaccgtggtggccgtcaaccggctgacgccgaccatcgtcgaggtggtggtgcgcgcgcccttcgcggccagccacttctctcccggccagttctaccggctgcagaacttcgagcggaacgcgcccgtggtggacggcgtgcgcctcaccatggagggcctggccctcaccggtgcctgggtggacaaggagaaggggctgatgggcaccatcgtgctggagatgggctcgtcctcgcgcctgtgcgccgcgctcaagccgggtgagcccgtggtgctcatgggccccaccggcgcgcccacggagattggccacaacgagacggtggtgctcgtgggcggcggtctaggcaacgcggtgctcttctccatcgcccgctcgctcaaggcggccggctgccgcgtcgtgtacttcgccggctaccggcagaagtcggactccttcaagcacgacgaaatcgaggccggcacggaccagattgtgtggtccgtggacactggggacacgattgaggcgcgccggccgcaggacgcggcgttccggggcaacgtggtgcaggcgatggtggcctacgcggagggcaagctgggccccgcccccgtcatctccctggcggacgtggaccgcatcatcgccatcggctcggacggaatgatgcgcgcggtggccgaggcgcggcacggcgtgctccagccgcacctcaagccggggcacgaggccatcggctccatcaactcgccgatgcagtgcatgatgaaggagatctgcgcccagtgcctccagcggcacgtggacccggtgacgggcaaggagacgtgggtgttctcctgctacaaccaggaccagcggctggaccaggtggacttcgtcaacctccggcagcgcctgcgcggcaacaccgtcatggagaaggtcgccgacgtctacctggcgcagctcttcaagcaggccccgcacctcaagcgcgtctga

SEQ ID NO: 9288 - DNA, 498 bp, Myxococcus xanthus
ttgaggcttttcctggttaggcacgcggatgcggacgcggagatccccgagggtctcggtgacgaggcacgcgccctcaccgcgaagtcccgcaccagcactgcccagcatttcgcttcgctgaccgagcgcatcggtcctgtggggcgcatcctgaccagcccgctggttcgcacggtgcagacggcgcagattctctccatctccgccaggttcgagggcccgctgaaggtgcatcgctgcttgctgcccgacatgcccgtgggcgcggtggaaccggtgctcaacgagtacgcggacgagaacctcgtcctcgtgggtcaccagccgtccatgggcgccctggcggcccatctgctcggcatgcagtccttccccaagcccgtcaacccgggcaccgtcatcggcctggagcgcgcggagggggagtcttcaccggcgttcaagttcctgttctacgccgcccctggtcagcaggtgctcgacatcatccagtga

SEQ ID NO: 9289 - DNA, 330 bp, Myxococcus xanthus
atggacgaagctcgctacaaccagttggtctccgccgcgttcaagcgcatcctcgccgcggcggacaccatcgaccctgacatcctggaagccgacagcaccggcgacatggtgacgctcaccgccgcttcgcgggagaagtgcatcgtcaacacccagcgcgccgtgcggcagatctgggtggcgggccagggtcagggcatccacttcgactacgacgcggccaccggcacctggaaggacgacaagggccggggcctggagttgatgtcgttcgtcgcggacgtcgtccgcggcatcaccggggcggacttcgtctatcccggctga

SEQ ID NO: 9290 - DNA, 672 bp, Myxococcus xanthus
atgcgcgtgcgcaaggtgctgtggggactgtgggtgctcgtggccttctcggcctgtaagaaacccgaggacgcttccgggccgcccgccggggtggtgggcgagcaggcccccggcgctcccgacggtgtggtggaggcaggcccctacacggtgacgaaggagaagctggacgcgtacgtgggctatcagcggcggatgttggaggtgtacggctcgctcatgaagggcctgcagaacctgggggcgttggtggacgccggcaccccggaggccatggccgccgcgcgcgagggcctgaaggtggtggaggccaaggccaaggcggaggccgaggcgcgccgcgaggcacagctctccgaggcggacgtcaacggcatcgcggaggtcgtcaccgccgtcgtcagtcagcggcagttggggcgcacgctccaatacgaagaggagctgaagaaactggaggcgctccaggcgaagctgccgcccgagcagcaacagggcatggcgccccaggtggcgtcaatgcgcgcccaggtggaggccttccagacgctggccgatgcccgccgcgactacggcgatgcgaacatcgacgtcgtcctgacgcgcgaggaagacctcatccagaactaccaggagatgattcgcgtcttcaccggcacacgccggtga

SEQ ID NO: 9291 - DNA, 483 bp, Myxococcus xanthus
aagcggctgatgttgatggaggtgaagcgcagccggcgctaccgctaccccatcgccgtgttgctggtggacatcgacaagttcgcggagaaagccgcgcccctggcccctgccgcgcggaagctcgcgctcgccgaggccctgggactgctggtgtccggagtgcgcgacatcgacgtcgccgtgcccttcgcggacagtcgcttcgtcgtcttccttccgcacacgccgcgctccggcgcgctggtggtggggcagcgcctgcgcgagctcatcaagtccctgacggcctacgagggcgccagcgcctccgtgggtgtcgccgtctccgagcccccgtcgggccgtggacccgtggcgggcgccctgtctcaggtcagcttcggcagcctcctcaaagaggctggagaagccctgcgtcgcgctcaggccgcgggtggggactgggtggaggccgcgagcggcaggactcagccgggatag

SEQ ID NO: 9292 - DNA, 549 bp, Myxococcus xanthus
tcgttcatcaccatcgccgacctcatcgaataccgccgccggaaggaccggctggtgcgccgcgagcccggccagcagaccgtcaacacccgctacggtgagttcaccgccctcacctattcgtggctgcccgacggcgtgaagtccctggtcctggtgaagggcgacccggcgtcgcggcccagcaccctggtgcgcctgcacgcggcctgtgccctgagtgacgtgttcggctccccgtcgtgcaactgcaacgtgctgctggatcaggcgctggcgcgcatcgcccgcgaaagctccggcgtgctggtgtacctgccaggcatgcacggggacgacttgggcatccaccacaagcgcaacaacgacggcagcagcggccccacgcgtggcccgcaggagtcgcgtgacctgggcatgggctgccagattctcacggacctgggcatccacacgctccaggtgatgaccaactcggacgtcacctaccgcgggctcgcgggcttcgggctcaccatcgagaagcgcgtcccgctccagccggactga

SEQ ID NO: 9293 - DNA, 811 bp, Myxococcus xanthus
atggcggcgccctcggaaatcgaacagggcatgctggccttgctgttcgagttcgaacacctgcgcgtggccaccctgccgccgctcaacgccaccgaccggctgcgcattggccgccgcatggactgcgacctggtcgtcgacgacgcgtccgtgtccaagatgcacgcggagctgcggtggaacgaagccgaccagcgctgcaccgtgcaggacctgggctccaccaacggcaccttcctcaacgcccgctccctgggtggccgcgaggccgtgctgcgcgacggcgacatcctcagcgtgggcaacgtgcagttctggtacctgctcacccgtaccctgcatgagcgcctgcgcgcgggcgaagccactggactgggctcgcgcagcggctgaaccttcccgcatgtccacaccgccacgcgacgagcgcgactacttcgagcgcatctacaccgtcaccacgcaagtgccacctgggcaggtggccacatatggggacatcgccgtcatcgtcggtgatggctgcgatgcccgcgtcgtgggacatgcactgggcgcgttgggcgcccgcgcggacagcgtgccctggcaacgcgtcatcaaccgcacgggtggcatcagcacctccggctacggacagcgcgaggccctggaggcggagggcgtcaccttcgacgagcgcgaccacgtccggatggcgtcacaccattggacgggccccagcgagacgtgggcccgcgcacatggattccagccgttgcctccgcgcgaagtgaagactccggacgcgcaattgaaactgttctga

SEQ ID NO: 9294 - DNA, 1311 bp, Myxococcus xanthus
atgaagacgcacactcccgttgagagccagcgctgggtggccggaatgacgccccttgcggtggtggatccgctcgcgggtgcggacgtattgggcgttccgaccgtctactgggagcgtccgctggcgcaggacgcggcggcggggtggggtgaggcggcggtggtggaggcgcaggacgcctccgacattcctgacgtgctggcctcgctgggccgcgtgcaggtgcgctggctgggctaagccccggagtcgatgccgggcccctggtttggcggcatccgtttcggtcactcgggcacggtggacacggcgtgggcgtagcacggtgtgacgcgctggacgctgcccgaggtgctggtgttccgcacggcgcgcggcgcgtgcgtcgtggcgttcgcgcaggaaggccgcgggggtgaggacctggtgcgctcgatgatggagcgcgtccgtgcctgcttcccggagtcgtaccggcatgcgcgcggcgagcccgtggcgttggagttgcgcgcgtcgcggctggacttcgaggtgcgggtgcagcgcgcgctggacgcgattgcgtccgggcacctccagaaggtggtgctggcgcgcccgctggatgcggaagggcccgcgccctttgatgtggtggacgtgctggcgcggctgcgtgagcagaatccccgctgcgccaccttcctgttccgcgctccggacgacacgtgcttcctgggcgcgacgccggagacgctgtgccgggtggacggtcaggtgctggagacggaggccctggcgggcacggccgcgcccggccaggcggacgggctgcggggccatgacaagaacgtgcgcgagcacgcgtccgtggtgcgctacctcgtcaccgcgttgacgccgctggcggagcaggtgtcgtcggacgcggagcccgcgctgctggccttgaagaacgtcgttcacctgcggacggggtttcgcgccgagctgcggccgggggtgacgccggcgcaggtggtggaggcgctgcatcccacgccggccgtgggcggtacgcctcgtgagcgggcactgtcgttcctggtggagcacgaaggcctggaccgtgggtggtacgcgggaccggtgggctgggtggggcctgggcgggcgcacttgatggtggcgctgcgctcggcgcgcgtgaagggcgcgaaggcccggctgttcgtcggcgtggggctggtggctggctccaacgcggactcggagtggcgggagacggagatgaagagcctggccatgttgcgggccttgggaggcggggatgtcgtccgacgctaa

SEQ ID NO: 9295 - DNA, 549 bp, Myxococcus xanthus
atgtcgctcgcgctgctccgctggggagtcttcatcctcctgtgtcttttcgcgccccaagccgtcgccggcgacgcaaagccccggcgaagtgaggcgaagggcagtcggctcgttcgtctcaagaacggccagttgcttcataccgacgccgcggacgcgtaccggcggatgaaggccgaagcgcgttcgaagaacatctacctctgggtccacagcggctaccgctcccccgcgaagcagcgccggctctatgagcgctaccgcaagggcaaggggccccaggcggcacggcccgggcgctccaaccatcagcgaggcctcgcggtggacctggtcatcggcggtgtcaagacaccgacctatgactggctcgtgtcgaatgcatgccgcttcggattcaagcgcacggtgcgctccgagccctggcattgggagtaccgcccacacagcacccgcgagccgaagccggggcgtgactgcgtgggccgccccttgaagcgtcaacggccccaatctccgcccgtggcgagcaccgagaagagctga

SEQ ID NO: 9296 - DNA, 3779 bp, Myxococcus xanthus
gcagccatgctcgtcgtcacatcgaacctcgaagccgtcaccgtccacgcggagggggcgctttgtacgcgggtcgccacgattcccacggcgggagggatgttgcccacgcaggtgcgaatcaatggactgcccctgtcgttgcaacccggctcgctccgggcgtccgtggtgcacggcccgtcgggactcgccgtgcgcgaccttcgtcccacctatgacgtccagcttccgccagaagtcgacgtgcccgcggagcaccgcgccttggaggaagccgagcaccgcctctccgacctcacccaacagctcgcgcgcgtgggtcaggaactggatgcgctgtcgaagctgtcccccgggtttccgccccggccgaaggaagcgcaggagccccgggacgcccccgtgtccgcgatgctgtcgctcatgtccttcgtggacaccgagctcgccgcgctccattcgcggaagctggacctggagcggcagcagcgtgacgccgaagccgagctgcgcttgcggcgcaaccgcgtcgccgaagcctcttcgtccgtgcgaggccagcgcgcccgcgtgtaccgcgcggtcgtgctgacgctgtcgggcccccttcccgcggatccgggggcgcggctcgcgctcgaatacgccgtccagggggcgcgctgggtgcccacctacgacttgcgcctgccgcgaacgctggaagagggaacgctgcgcatgcgcgcctccgtgctccagcgcaccggcgaggactggacgggggtgaagctcgccgtctccaccgcggacctcgcccggcatgcggaagtccccgagctgaaggcgctgcgcattggccgccatcaaccggctcccgcgcgttcgggctggagggaggcgccaccggggctcgatgagctgttcgcgggctacgacgccacgcggtcgcccacgccggttcagcctgagctcctagccgaacccgagcccatgcccgccggcctcgagcagccccagaagaacaagcgcagtgccgtgcccatcgcgcccaagcccgacttcgccatgccggaagcggccgcgccaccgcctccgccggcggcggcccctcgaagtgctccgatgcgtcccagtgccgctgcccccgaggacgaggagacgacatcgcgagcgcgagcgcgaggcggtggcttgatgtcgcgcgcgcgccgaccgccacctccggccgaactcgaggaggcgcccgagagttcattcgacgatgacgcagacgggctcagcatggataccgcctcgctgggcggtggtggtggtggcggcgagcgaacacctccgaggcaggagccctccgacgcattgttggactacgaccgcctgaccatgccgcccgcggatgaccagggcgcgcgtggcaggctgcaaccgcgccccgggcacgtcacccaggagctggtggccctggcggaggtccacgcgcagatcgacatcaccgtgcgagtcgccctgagtctgcaggagacctcttccatatgggcggcccccgcgccggcgtggtcccagccgccacgcacgtcctcgcctcacttcgatgcgcgcttcgatgtagagacgcgcgcggacgtgccttcggatggagcgtggcacaccgtgccggtgttgtccgtgccagtggggctgtccgcggaatacgtctgcgtcccctccgtggagtcgcgtgcgttccgcacggtgcgcgtggagaaccggacgccgtatccgctgctggcgggtcccgtggacgtcacgctggagaacgagttcctgatgacgtcccccctgcccaccatggccccgggctcgacgcagcggctggggctcggtgtggaggaatccatcaaggtcgcgcgcaacacgcggttcgacgaggccatgggcggcatgttcggcggctcgacgatgctgacgcaccacgtgtcggtggagctggccaaccggctcagcaatcgcgtcctggtcgaggtgtgcgagcgcgtgcccaccgttcccgtcaatacggagaaggacatcaaggtggaggaattggaagtggccccgctctggcagaagcgcctgcccttgcccggtgaagcgaaggtggagggcgagcgggcgtggcgcgtggtgctccagccaggtgaagcgcagacgctgaaggcgacatggacggtcaagattccgggcaacaagatgctcggcggcggcaaccggaggacatgatgggcacccctttcatcctgcccgtggtcaaggtcaccgtcctcgaggaccgggcgctcgtcgagcggcggggggagattcccctgtccgtgggaacgcagcgactggtcatccagggactgtccccgctcgccgtggaccgctcgctccaggcgaaggtcgcgggtggcaccatctcccaggcacgcatccgccgggcgacgaagccgcaaccacccgaggccgagcgcgaacaccgcacggcgctcggaaagcgcgtcgcggagctggagcaggagctccggcgcgtggtcgcggacgaaacccggctggcggcgcggctgcggctgttggacaccgcgcgcgccgatgtccaccgcgccatctccgagcaggcaggcgccggacagtcgcggccggagacgtggcgggagcagttggagacggtgcgccgcgaaagcaactgtcggcgggactcggcgctccgagaggctgagcgccggacgctccgactgcgggaacagttcgacgaagcacgggcctcgcagacggctgtcgagctcctggagccaacggtcgacacccaggccgagctggaggtgggccaccccacgggcgggcccgccacgctgtccgtcacgtacctggtgccctgcacggcctggcggccgtcctaccgcgcaacgctgtcccgcgaagcctccggtgagtccgtcacactggagtgcgaggccgtcgtctggcagcgcaccggtgaggagtggaaggacgtggagctggcgttctccaccgcgcgccccacgctgggcgccacgccgccgcggctccaggaggaccggctgtggctgcgggacaagacggagcgcgagaagcaggtggtggaggtggccatccgtgaggaggtcatccagaccgcgggcgaggccggcgctgcccgacgggacgatgcgctaccgggcatggacgacggaggtgaaccgctgacggtgacggccccgcatcgggccagcgtgccaccggacggcgagccctaccgcgtgcccctgttccagttcaccgcgcccgctgcctccgagctggtggccatgccggagcagtcccccctggtgcaccgggtggcccggttcgacaacacgggccccacggtgttgctcgcgggccccgtgaagctggtgcgcactcacggctatgtggggcgtgcgcagctgcgtttcaccggcaagggcgagcgcgtgaagctgggcttcggcagcgaggacgcgctgcgcgtggcacgaacggaggacgtgggacgggagaccagccggctcaccggccgcaaggtgacgacgcacaaggtgcgactgttcctctccaacatgggcgcgaagtcggtgccggtggccatcgaggagcggattcccgtctccgaggtggagtcggtggaaatccagttgcagagggagagcacgaagcccgcgcccgcgcgcgtcagcgaggatggcatcgtccgcttcgagctgacggcgtcgccccgctcgcagcaggagctggcgatggactacgtggtgacgagcgcggcgaaggtggccgggctctga

SEQ ID NO: 9297 - DNA, 1341 bp, Myxococcus xanthus
atgagcgaggagtcggcttcggatttccgcgcggagtacgcgtgcagtgagggctgtgactttcgcgcctcgctgatggacgtggtgtaccggtgcccgcgctgcggcggcctgctggaggtcgcgcacgacgtgaaggccctgcgcacggtctccgcggcggaatggaagcgccgtttcgagacgcgcttcggctccgcgcgcctgccggatggctcgggcgtctggggcaagcgggagtgggcgtatccgcagctcccggcggaggacatcgtctcgctcggcgagggccgcgtgccgctcaagccgttgccgcgcatggcggcggagctggggctggccgcgctggacttgaaggagtgcggcgtctcgcccacgggcagcttcaaggactgggggatgacggtcctggtctccgcggtgaagcacatgcgtgcccggggcgttccgctgcgcgcggtggcgtgtgcctccacgggcgacacgtccgcggcgctctcggcctactgcgcggcggcggggattccggcggtggtgttcctgccgcgcgacaaggtgtcgctcgcgcagctcgtgcagcccattgccaatggggcgcgggtgctgtcgctggacacggacttcgacggctgcatgaagctggtgcaggcggtgacggcggacacggggctgtacctggccaactcgatgaactcgctgcgcatcgaaggccagaagatggtcgccgtggagctctgccaggacctgggctgggagccgccggactgggtggtgattcccggcggcaacctgggcaacgccagcgccttgggcaagggcttcgagctgatgctgtcgctggggctcatcacccgccggccgcgcatcgccgtggctcaggcccagaaggccaacccgctggtgcgctcgttccggggcggcttccaggagctggtgcccctgcaggccgagcctaccctggcgtcggccatccagattggcaacccggtgtcattcaagcgcgcggtgaaggtgctcaaggcgttcgacggcgtggtggaggacgccagcgagtccgagctggccaacgccgccgcgcgggcggaccgcgagggaaccttcacctgtccgcacacgggcgtggcgctggcggcgctggagaagctggtggcgcagggcgtgattgcccggggctcgcgcgtggcggtggtgtccaccgcgcacggcctgaagttcgccgacttcaaggtgggctaccaccgcggctcgctggcggaggtgacgagccagttcgccaacccgcccgtggagctgcccgcgacgctggacgcggtgaagggcgcgctggcggacctgggctga

SEQ ID NO: 9298 - DNA, 306 bp, Myxococcus xanthus
atgggggccgttccggtgacgcccatgcccgagctggacaccgggcgtgccccggacgatggcgttcgcaccgccgcgccgctgggcgccgtcgtctgccgttactgccgcatcacccaggccgaggggctgctctgcgacaactgcggcatgcgcctgcctcgggcgaagcccaccgtggcagcggcgcctgggagaccttctggcgacgacgatggctggcgctcttgcgcatcgtgtcatactcgcgtgcggcccggtaaggcctgtccggagtgtggcacgcgggcacaggaggaggcatga

SEQ ID NO: 9299 - DNA, 639 bp, Myxococcus xanthus
atgggtgactggggaagggccgactacctgtcgcggcacggcatcaaggacgcgcgagtcctggaggccatcgctcggctgaaccgcgcggacttcgtgccggaggacctgcgcgaagaggcgagcgcggactcgccgctgcccatcgggcatgggcagaccatcagccagccctacgtcgtggcgctgatgacggaggcgctccagctccagggggacgagcgcgtcctcgaaatcggcaccggctcgggctaccagacggcgctgctgtccctgctgtgcagagaggtctactccgtggaaatcgtccccgagctggcccaatcggcgcgagaggtgttggggcggcagggcttcgaaaacgtctcgttccgggaaggagacggctcactgggctggccggaccaggcgcccttcgacgccatcctcgccgccgcggcgccaccagacgttccgcttcagctcctttcacagctcaagccgggcgggcgcatgatcattccggtggggccaagggggggcacccagcaactgttgcgcatccagcgagccctccggcccggagaggtgccccaggtggagtccctgctgtcggttcgcttcgttcccatgacggggcagccgctctcgcaggggtga

SEQ ID NO: 9300 - DNA, 2716 bp, Myxococcus xanthus
atgcccgagcgccgcaaggccgcgctgcggcgagtcgtggccgggctgaaggtcagcggggtggagctgcccgcggagttgcacggcgtgacgatggagggtgcggttccggctcggccgaggtccacacagggcgctccggtgggtgcgggaggcacgacgcctccggggtatgtgccgccctggaaatcggcggagccactgcccacgtcgggcccgcggccggacgcacctcgaggaccggcttcgcgtggagcctcggcccctgcgcgcgggagcggcgttgagggccccatgccgcgcatgagtcctgatgcgccgcgggggcgtcaggccggaatggactcggagctcctgcctgcccgtccaccgcggatggcgccgacgacgcagcctccgcaggcgaacgtcaccgcgccgcagcccgccaccgggcggcagggcgcgccgtcgtctcgggcgaagccggggctccgtcaggccgcgctcgacacggggccagaggcggttcccggagcgaagacgcgcaaggagaaggcccagcgaaagaagaagcgggcggtcgcggcggaggcctctcgctccgaggcgaagctcctctccatcgcgccgcgctccgggccgctggcgtcgccgctgaagacgctgggcaagcggctgggacccaggctcgtctcggcgctcgacaagaaggggctgcgccgcatgggcgacatcctcttcatgctgccgcgctgctacgaggaccgccgccagttgcgcaccatcgccgaactggagcccggcgagcgaggcgtcacggtgggcatcgtcaaggtggccgacttcgtgccgggccgtcagggccggcgcatgttccgcgccgtcgtgggggaccgctcgggcagcatcgccgccacgtacttcaacgcgggcccctggttgaagagccggttcaccgtgggcaagcgcatcgtcctctccggcgaggtccgcgccaccatgtcgggccgggagatgccccatccggaaatcgaaccggcggaggacatcgagtccacgacgtcggtccacttcaaccgcatcgtccccgtgtatccgggcttcgagcgcggcgagcagcgctcgttccgcgagctgacctcccgcgtgggcgagcagtacgcgcacgaactggatgacccgctgcccgccgacctgcgccgccgcttggacctgatgggcctgccggacgcgctgcgcttcatccacttcccgccaggggacgcggacctggaggcgctcgatgcgcaccagagccccgcgcaccggcggctcgccttcgacgagctgttcttcctccaactgggcatggcgctcaagcggcagggcgtgaaggcggaggtcggcatctccttcgacgtgtccgagccccggctggcgaaagcgcgcaacgcgctgccgttccagctcaccggcgcgcaggcgcgggtggtgcaggagctctctgaggacatggcgcgcccggagcccatgaaccggctggtccagggagacgtgggcagcgtcaagacgacggtggccatggtctccgccctcatcgcgctgcaggccggctaccaggtggccgtcatggcgcccacggaaatcctcgctgagcagcacgagcgcaacttccgcaaggtgatggagccgctgggctaccgcgtgggcctggtgagctcggcgggcacgagcgaaggccaagcgccaggtgcgcgaggccgtggcccgaggcgaagttcatctggccgtgggcacgcacgcgctccttcaggcagacgtctctttcgaccgcctgggcctggtcgtcatcgacgaacagcaccgcttcggcgtgctccagcgccacacgctgatgagcaaggggcccaagccggatgtgctggtgatgacggccacgcccattccccgcacgctggccatgacgctgtacggcgacctggacttgtccgtcatcgaccagcttccgccgggccgcacgcccattcagacgcgggtgttcaacgacaagcagcgcgcgctcgtctatgagtccgtgggcgcgcaactggccaaggggcaccaggcctacgtcgtctacccgctggtggaggagtcggagaagctggacctggaggacgccacgcgcggcgtggagaagctccggaaggtgttccccgacgcgaaggtggggctgctgcacggacggatgaaggcggaggagaaggactccgtcatggaggacttccgcgagaagcgcctgcacctgctcgtctgcaccacggtggtggaggtgggcgtggacgtgcccaacgcctccgtgatggtggtggaatccgccgagcgcttcggcctgtcacagcttcaccagctccggggccgggtggggcgcggcgcggcggcgagtttctgccacctggtggccggaagcgcccgctcctgggagtccgccgagcgcctgacggtgatggagcagagcagcgacggcttcgtcatcgcggagaaggacctggagattcgaggcccgggtgaattcctgggcacgcgccagagtggcctgcccgagctcgcggtggccaacctggcgcgggatggcgacctgctctccatggcgcagtccgaggcccggcgcatcctggagaaggacccggacatgaaggcgaaggagaaccagggcctcgtgaaggcgctcgaggaacgctgggaagggcggctcgcgctcgcacgggtggggtag

SEQ ID NO: 9301 - DNA, 495 bp, Myxococcus xanthus
ccgatgaccccgtccggactgcgcaagctgaaggaggaactgaagcacctccagtccgtcgagcgggggaagatctcgcgcgagatcgaggtcgctcgcgcacatggtgacctgcgtgagaacgcggagtaccacgcggcgaaggagaaacagtcgcacatcgaggggcgcatcctgaccctcaacgactggattgcccgcgcggaggtcatcgacccaaagaagctcggcggcgacaaggtcattttcggggcgacggtggacctgctcgataccgaaaccgacaagccggtgagctaccggctcgtgggggagatcgaggcagacctgaagaagcggtggattgccgtcacctcgccggtggcgcgcgcgctcatcggtaaaaaggtgggcgacatcgccacggtgcagagccccggcggcgtgcgcgagctggaagtccaggagatccgcttcgaggagcccgaggaagaggccccggcgagcgggagctga

SEQ ID NO: 9302 - DNA, 486 bp, Myxococcus xanthus
atgtggggcaccgacgccacctgcacggtgacgacgttggaagggcaggccaccgtcttcatcgccgtcgacgatggcactgccgagtgcgtaggcatccacgccgccaaagtgggaagccgcttcgaggctctcgagcccattcggcggggcatcaaggcgcgcttcggtgcgtacggccagggcgtggcttcggggctagctattcgccacgacaacggcagccagtacacctctgacgtctttcagaacgagttgcgcttcctgggcgccaactccagtccgtccttcattcgcagtcccgagggcaacggctgcgccgagcgtttcatccgccccccaaggagcaactgctctgggtgcgcaccttcgccaccatggaggaactccggctggacctgctggaatgggcccaccggtataacgagcactcgctacttgagcgccacgacttcctttcgccgagtcaggcccagcgggagctga

SEQ ID NO: 9303 - DNA, 957 bp, Myxococcus xanthus
gccctgctgagccggtacgacgtctccggccctcgctacaccagctaccccacggcgcccgagtggcggaaggacttcggtccggagcatctggtggagcggctcgagcatgcaggctcccgggagcacgccgagccgctgtcgctctacgtgcacttgcccttctgccgcagtctctgctggtactgcggctgcaacgtcgtcatcagccgggaccgggccgcggcggaccagtacatcgaccatctggagatggagctggacctggtggtgcagcggctcggctgccggcgctccttgtcccagattcactggggtggggggacgcccaccttcctggatgagcggcagctggaacggctgtggacggcgctcacccgtcgcttccgcatcgcgtcggacgcggaggtggccatcgaaatccacccggccgtgacgacgcccggccagctcacgctgcttcggagcctgggcttcaaccgcgtgtccatgggcctgcaggacttcgacgcgcgcgtgcaggaggtcaccaaccgcatccagtccccggaggagacgcgggcgctgctggagcacgcgcggctgctgggcttcaagggcgtgaacttcgacctcatctacggtctgccacaccaggacgccgaggggtgggcccgcacgctggacacggtgttgtcgatgcggccggaccggctggccgtctactccttcgcgttcatgcccgaagtgctgaagcaccaacggcgcatgcccgcggaggccattcccagcgggcgcgccaagctggagttgttccgctccgcctacgcggcctttgtgtccgcgggctaccggcccatcggcatggaccacttcgcggtgcccgaggacgaactggcgcgcgcgcaggccgagcgccggctgggccgcaacttccagggctacaccgtcaaggccgcgtcgtacttaggtagcacc

SEQ ID NO: 9304 - DNA, 1449 bp, Myxococcus xanthus
gatgcagtcatgtctgcggcaccgcagcgggatggcccgcgcatcgaccagctcacgtccatccacgcggatggttcgcggctggcgctccacccggcggacgtgcacggccggttcatcactcggcggcgggtgggcttcgcggtcctcatcgccatctacctggccctgccactggtggaggtggggggccacccggcggtgcacctggacgtggcggcgcgccgcttctacctcttcggcggcacgtacaacgcgcaggacttctggcgcgtcctgttcctgttgacgtcggtgggcttcggcctgctgttcttcaccgcgtggctgggacgcgtgtggtgcggctgggcgtgtccccagacggtgttcctggaggcgctctatcgtcccatcgagcggttcttcgatgggccccgggagcggcggctgaaggccgcgaaggagccgtggacgcccgtgcgcgtagcgcgggcggtgctcaaacatggcgcgtacgccgcggtgtcgctgctcatctcccacgcggcgttgagcctcttcgtctcggcgggagggctcatcgcgatggtggccgatggcccggtggcgtcgccggtggccttcacgtgggccatggccgtaacgggcgcgctgtacttcaacttcgcgtggttccgtgagcagctctgcgtggtggtgtgcccgtatggccgcctccagtcggcgatgcaggaccgggactcgctcatcgtcggctatgacacgcggcgcggagaaccccggggccgtctcatcaaggccgctccgggtgtcccggccccacctccgcgcggcgactgcgtggactgcttcaagtgcgtggccgtgtgccccacgggcatcgacatccgcaatggcttgcagatggactgcctcgcgtgcgcgcagtgcgtggatgcgtgcgacggcgtcatggacaagctgggccggccgcgtgggctcatccgctatgactcactcaacggattggatgggcagccacggcgggtgctccggccccgcttgttcatctacggcgcgttgatgctggtggcggtggtgggcttcacgctgagcctggtgcggcgcgtgcccttcgaggcgaacctgctgcgcttccagggcatgccctacgtcgtcgagcagggcacggtgcgcaaccagttcgagttgcacctggtgaacaagaacccctccgagacggtgctcaccatccgcgtggacagtcccgtgcccgcgaaggtggtggtgccacaggcgcaggtgacactcgcctcgctggagagcttccgggtgccgctgttcatcaccgtggaccaaagcggaacggagctgccattccacttcaccgtcgaggtggccgacgcggcctccggtgaagtgaagcgcatggaggcccgcttcctgggacctgtttatagcctccaacctgaggcgcagttgccgtga

SEQ ID NO: 9305 - DNA, 552 bp, Myxococcus xanthus
atgagcagtgacaagccgctggtgcactccgtctatgacggcatcgaggagcacgacaaccacctgcccaactggtggctgttcatcctctggacgtccatcatcttcagcgcggggtactggttctggtaccacatcgccgaggtggggcccggacagctcggtgagtacgccgcagagtccgcggaggtggcgaagcgcgcgtctggaaacgcgccggcgtctgacggcatgctgctcgcgctggccaaggacccggcctccctggagagcggcaagcaggtgttccaggcgaactgtgcggcctgtcacggcgtgcaggggcagggctccatcggccccaacctgacggacgcgtattggatgcacggtggcgggcccatggccatccacaaggtcgtggcggacggcgtggtggccaagggcatgcccgcgtgggagcgcaccctgggcgccgagcgcgtcaaggccgtcaccgcctatctgctcacactcaagggcaccaacgcgcccggcggcaaggagccgcagggcgagcccgagcagccgtag

SEQ ID NO: 9306 - DNA, 159 bp, Myxococcus xanthus
atgtcgctcaccgagctgcccctcttcgccttggtcctgttcatcgcggtgtttctcggcgtcgtcgcctgggtgttcgtggcgcggcgcagcggggacttcgacgcgctcgcgcggatgccgctgagcgagcagggggagggccgccatgagcagtga

SEQ ID NO: 9307 - DNA, 1995 bp, Myxococcus xanthus
gacgtggccatcgccgtcatctgggtcgtcttcgccatcaacttcttctggacgctggcgaagcgccacgagaagaacctctacgtcgccatctggttctacatcgcgaccatcgtcacggtggcggtgctgcacatcgtcaacagcctggcgctgccgctgtcggggatgaagagctactccgtcttcgcgggcgtccaggacgcgctggtgcagtggtggtacggccacaacgccgtcgccttcttcctcaccacgcccatcctgggcatcatgtattacttcctgcccaaggcggcggagcggccggtgtactcgtaccggctgtccatcatccacttctgggccctggtcttcatctacatctgggccggtccgcaccacctgctctacacggcgctgccggactgggcgcagtcgctgggcatgattttcagcgtcatgctgtgggctccgtcgtggggcggcatgctcaacggcctgctcacgctgaagggcgcctggtacaagctgcgcgaggaccccgtcctcaagttcctcatcgcgggcgtcaccttctacggcatggccaccttcgaagggccgctgctgtccatcaagtcggtgagcgcgctggcccactacacggactggattgttggccacgtccacagcggcgcgctgggctggaacggcttcatggcggccggcatgttctactggctggtgcccaggctgtacggcacgaagctgcactcgcccaaggcggcggacgcgcacttctggctcgggacggtgggcatcctcctctacatggtgtcgatgtggatcagcggcgtcacgcagggcctcatgtggcaagcggcgaaccctgacggcacgctgctctacccgaacttcgtggagacgctgctggccatccggcccatgtacatcgtccgcttcgtcggcgggtccatgtacctggtgggcttcatcatgatggcgtggaacttgtggaagacggcccgcgccggcaaggccgtggacggggagaccaccgtcgtcgtggagccgcccacgcccgtcgccgagcccgtccccgccaaggccccgacgcccggctgggtgcaggtcgtcacgggccggccgttggtgttcgccatcgccatcctcaccgtgacgatgttcctcggctgggcgaagccggtccgcgcggtggtgctgatgggcgccatcatcgcgctgggcgagttcgcctggattgtcacccgcagggaccgtgaagcaggccgtccgtcgtggttcggtctcatcgagggcaagccgctggccttcaccgtgctcacgctcatcgccatcctgattggcggtgtggcggagctgctgcccaccatcatgctcaagcaggcggtgccagcgcacggccaggcgcaggagccgtactcgccgctggagctccagggacgcgacctctacgtccgcgagggttgctacacctgccactcgcagatgattcgccccttcgtggcggagacgcagcgctacggcgacgtgtcccgcgcggaggagttcatctacgactaccccttccagtggggcagcaagcgcacgggcccggacctgcaccggctgggcggcaaatacccgaacctctggcactacacgcacatgatggaccctcgggcgacgagccccggctccaacatgccgccgtacccgtggctggccgagcagcgcatcgtcgtgaaggacgcgccgaagaagctcgcgctgatgcagcggctgggtgtgccgtacagcaatgcggacgtggacagcgccgaggcgcgacagaagacccaggcggagggcatcaccgcggacctggcggcgcagggtgtccaggtggcgtgggattcggagatggtggccatcatctcctacctccagcgcctgggccgtggaccgcaggacctgcccgcgccgccggagaaggcgcccgcgccgccggaccgtctgcctgccgccaccatcgccagtgaggagggccgctga

SEQ ID NO: 9308 - DNA, 471 bp, Myxococcus xanthus
atgagcggcatcaccctcgtccgtaatgtggtggccgggttggcgatgttcgtgggcttcacgagcatggccgcgcctgcgcccgtgcgcgcggagcccctctacttcgccgtcgaggtccgccgtgacgggcggctggtggcccagcccaagctgctgggcgagacgggccgcacccttcgcgccgagcgccgccgtccgggagcgccccttcccgactaccggctggtcctcacgcccaaggccgaaggccagtccttcctcctccagctcgacctgctcctgcccgaggcgaagggccactccgagctggcgctgctccacggccaggagcgcaagctccagcttggccgcgtccccggagagctcgaggtctccctgctgctgatgaaggtggactcgccggagttccgcgcgctcatgcagttgggcgaaagcggcggcaagtcgctgtccacctcgtccatctga

SEQ ID NO: 9309 - DNA, 1677 bp, Myxococcus xanthus
atgcctccgccaggagagcacggtttgaaggaaatctacggcaacaccctgggcctcaagtcgagcgaacagcaccggttgcgcaacaccttccgccggcgcgtcccaccgcacgaaatcgtgtcgcccgagcttgcccggcatctcaccgagctgtcgcgtgagctgaaccggcaggtgggtgtgctcgtcaaccggaagggagaaatcgagcacgtcatcgtgggcaacgctcacaagctcgagctcccggacatcggccgcgcccgcgcgggccaggtgcgtctgcgtggcctccgcctggtccacacccacttgaagggcgagccgctcaccaaggacgacctcacggacctcgcgctgctgcgcctggactgcgtggcggccgttggcgtgggccacgaaggcctgcccggcgtcctgcactacgcctacctcatcccggagaacggctccggcgacttctggcacgtcgagacgctgccctccgtccacgtggcgcaatcggacctcatggacacgctgggcgcgctggaggaggagttcaaccgcaaggcggcgtcgcgcaaggtgggcggccgtgagaaggccatcctcgtggcggtgtgcctggacggcaaccgcgccctggccgagtccagcctggcggagctgaaggagctggcgcgcaccgcgggcgtggaggtcatcgactccgtgctccaggtgaagcgcgaggcggacccgcgctacctcatcggccgcggcaagctggaggagctcaacctgcgctccatgcagaccatggtggacctgctcatcttcgacaaggacctcaccccgtcccagggccgccacatcggcgaggccaccagcctcaagatcctggaccgctcacagctcatcctcgacatcttcgcgcagcgcgcgcagagcgccgagggcaagctccaggtggagctggcacaactgaagtaccggctgccacggctggtgcagagcgacgattcgctcagccggctcatgggcggcattggcggacgaggcccaggcgagacgaagctggagatcgaccgccgccgcgtgcgcgagcgaatcacccacctggagaagcgcatcgacgcgattggccgggagcgcagcgtgcgccgggcccagcgcaaccggcgcgaactgcccgtcatctccattgtcggctacaccaacgccggcaagtccacgctcctcaacgcgattacgaacgcagaggtgctggcggagaacaagctgttcgccacgctggaccccaccagccggcggctgcgcttcccgcaggagcgggaggtcatcatcaccgacacggtgggcttcatccgggacctgcccaaggacctggtcgccgccttccgcgccacgctggaggagctgtacgacgccagcctgctgctccacgtcgtggacgcggcggaccccgcccgcgacgagcaggtggaggcggtggagaacatcctcgagtcgctcgacttgatggagaagccgcgcctcatggtgtggaacaaggcggacctgcttccgccggacgaagtggcggcgctgctgcgcacgcggggcggcgtggccatcagcgccgcgacccgcgagggcctggcgacgctgctggccaaggcggacaccacgctgttcgccgaaggcgccaccgaggccatcggcgccatctga

SEQ ID NO: 9310 - DNA, 102 bp, Myxococcus xanthus
atgcagcaggagggcctggtggtgagccacaccaactcccagcggctcaccgtgtggcgcgtccgcggcgccacgccggacgccgcgccgcgccgctactga

SEQ ID NO: 9311 - DNA, 1158 bp, Myxococcus xanthus
atgaccgacagtttcggcacgaagtcccagctcaaggtgggctctgccacctatgacctcttcagcctgggcaagctggcgaaaacccacccggcggtgaaccgcctgccgttctcgctgaaggtcctgctggagaacctgctgcgccacgaggacggtcgtgtggtgaagcgcgagcacgtggagaagatgctggcgtgggaccccaaggccacgccggacgtggaaatctccttccaccccgcccgcgtgctgctccaggacttcacgggcgtacccgcggtggtggacctggcggccatgcgtgaggcgctggcctccatgggcggcaacccggacaggatcaacccgcgcaacccggccgacctggtcatcgaccactcggtgcagattgactccttcgcgacgtccgccgcgttcaaggacaacgccgagctggagttcgagcgcaaccgtgagcggtacgcgttcctccgctggggccagagcgcgttcaagggctttggcgtggttgccccggacatcggcatctgccaccaggtcaacctggagttcctggcgcacgtgacgttccgccagggcagcaccgtgtacccggacacgctggtgggcaccgacagccacaccacgatgatcaacggcctgggcgtggtgggctggggcgtgggcggcatcgaggcggaggccgcgctgctgggccagccgattacgatgctgattccgcaggtggtgggcttcaagctctccggcaagctgcccgcgggcgccaccgccacggacctggtgctcaccgtcacgcagatgcttcgcaagaagggcgtggtgggcaagttcgtggagttctacggcagcggcctgaagaacctgtccctgccggaccgcgccaccatcgcgaacatggcgcccgagtacggcgccaccatcggcttcttcccggtggacgaggagagcctcaactacctgcgcttcaccggccgtcctgacgacctggtggccctcaccgaggcctacgccaaggagcagggcctgtggcggcgtgacgacgccgaggaccccatcttcagcgacacgctggagctggacctgtccaccgtggtgcccagcctcgccggccccaagcgcccgcaggaccgcgtgcccctcaaggacatgaagtcc

SEQ ID NO: 9312 - DNA, 1263 bp, Myxococcus xanthus
atgcgtgaccaggaggcgttgaccgagcagtcgggggaagtggacacgggcgcgccgcggcgtgcgcccacgcccccagcgcccgtgccggagcatgggccggtgtggagccccggcgtctccggggggctcctgacgcgctactacctgccgcgccgccacggggtggtgcagggcaacgcatgccagttgctgcgcgacggcgtggaggcctacccggcgatgctggaggccatccgcggggcgcgccgttatgtccgtatggagacgtacatgttcgtctccgacgccgtcggcgaactgtttggccaggcgctggcggaggcggccgagcgcggcgtgcacgtgaaggtgttgtacgacgcggtgggctcctggacgagccgccggagcttcttcgcagggctgcgcgcgcggggcgtggacatccgcgccttcaagcccttcagcctgtcacgcgggctgcggcacctgctgcggagggaccaccgcaaaatcctggtggtggacggcgaggtggccttcaccggtggggtgaacatctccgcccactgggcgcccgcggagatgggcgcggcgtggcgggacgatgtgctgcgcatcgaagggccggccgtccacgaactggagcggtgtttctccgccacgtggcggatgatgttccagggccgcttccaccggctgacccggcggctggagcgcctgcgcaaccctccgcctcggcgcggcgcggtggggctggtggtgttgtccagtcggcgaagcatccaccgggcctacctgcacgccatccgccgggcccggcgcagcgtgctggtggccgccgcctatttcattccggaccggcgcatggtgatggcgctgcgcgaggcggcccggcgcggggtggaggtccatctgctgctcaacgctcgcagcgaccaccccatcctggagttcatggcccgggccttctacgagcggctgctgggcgcgggcgtccgcatcttcgagtggcagcgcggcgtgctgcacgccaagacggccgtggtggacggggtgtggggcaccatcggctcattcaacctggagcgcctcagcctggccttcaatcacgaggtgaacgcggtcttcgccgaccctcgcttggggcagcaactggaggactccttccgcggcgactgcggggactgccgcgaggtgacgctggcggagttccgccgccggcccctgtggcagaagctgctggagcgggcactgtctctgcttcgcaaaatcatttga

SEQ ID NO: 9313 - DNA, 957 bp, Myxococcus xanthus
cagatgaaggccgccgccatcgaccgcttcggtgggccggaggtgcttggggtgaagacggtggccgttccggtcgtaggcgcgggagaggtgctcatccaagtggagaccgcgggcgtcggaagctgggatgcggcggagcgcgagggggaaatggagctgctcaagcctcgaaagtcatccttcccctatgtgctgggaacggacggggccggcaccatcatggcggtgggcgagggcgtcacgtcccgcaaggtgggcgaccgggtgtacggctccggcttcctcaatgacaagggcgggttcttcgccgagtacgcggtggtgaaggccgatgacacggcgctcgtgccgaagggcttgagcgcggaacaggcgggcgtcctggccgcggatggaatcacggcgctccaaggtgtgcaggacgcgctgaacgttcgtcagggcatgtcgctgctggtgtacggcgcgagcggcggtgtgggccatctggcggtgcagctcgccaggcgactgggcgcgcgggtcctggcggtggcttcgggctcggacggcgtggagttggtgaaacgcctgggggcggagaaggcggtggacggacggggtggtgatgacgtggcgaaggcgattcgggacttcgcgccggacgggctcgacgcggcgctggtactcgcgggcggcgagggcagggccccggcgctgcaagccgtgaagaaggggggccacatcgcctacccgaatggcgtcgaaccggaaccacgggctcccgagggtgtgaagctcaccgcgtacaatggcgagtcgaatgctgacgtcctcgcgcgcctcaaccggctcattgaagcagggcccttccatgtcgaggtcttccaggtgtaccggctagacgacgcgggccgcgcgctcgaagccgcgcgcaagcaccatctgggcaagctggccctgcgcatccactga

SEQ ID NO: 9314 - DNA, 1572 bp, Myxococcus xanthus
atgcctttccagctgacgatctccgagggtagagaagccggtaaggagttcgtcttcgaccaggactccgttctcatcggccgttcgacggattgcgacgtcgcgctgttcgacccgggtgtgtcccggcgccactgccgcatcttcctcgacggtgatgcctacgccgtcgaggaccagggcagcgccaacgggtcgctcatcaacggcagtccggtgaagacgcaggtgcttgaggacggcgacaagctgaccctggggccggtgacattcatcttcgccatgctgacggacgagccggccacgggcgaagaagagctccccgccggcgcccaggaaggcgatggcagcacgcgcatcgtctccctggattccctgaagcggcagcgcaacaagggcgtcgcgctggccccggaaggtgccgaccaggaggagctgaacgaaatccgcgagggtgccacccgctccaacctgcaggccctgcgccccgtgtcccaggggcagagcggctcacggccggcggccatcgagcgctcggcgccagcggcaccgcccgcgaagcggccgtccagttcgcccccgccggcccgggcccgtccggcgccgtccgcttcgggcggtggtggcctgtccgcggcggagcgcgcgcgcatccggcgtgagtcccccggcgtggtgtccagcgcgaagctcttctgggcggacgccagccagggcgtgcgcaccggcatcatcggtggcggcgtggccatggtgctcgcgctgttcggcgtcctctactggctggtgctgagcggcgaggacggtcagccggtgggcgaggagccctcgatgctgaccggccagcccatccgcgactcgttcggcctggggccgggcgtgacgtgggatcgcccggacatgaaggtcttcgagtgggagtacaccgccgccacgcgcgcggtggtcatccttcactaccaggcccagagcatctccaaggacgaggtcgtggtgagcgtcaacggcgtggacgtgggcaaggtgccgcccgacacgctggccagccaggaccgctccatcgaactgatgattccggcgcagcacctgaagaagggcgagcccaaccgcatcatcttcgacaacgtgaagaatccgccgggcgaagacccgtgggtcatctggaacatctgggtggagcgcgcgctcctgccggacctgctgcccgaggaactggtgcgggaggccaccgagtaccacaagcggggcttgaagcacttccagacgccggacatcggcgctcgcaaccgctacgaggcctggaagtccttccgcgtgtcgtggctgatgctggaggcccacccggagccgaagcccgacctctactacgacgcccaggagcgcatgaaggcggcgcagcaggagctggaccgcacctgctccaagctgctgctggaggtggagggctactacaaccagggcaactacaagagcgcctccgccaccctggaccacgtgaaggagtacttcccggagttcgaccagccgtgcgccacccgcgcggacgccaagcgcgcggagtacggcctctag

SEQ ID NO: 9315 - DNA, 930 bp, Myxococcus xanthus
atgagcaacgtccacgagcggctccgccgcctgctgttcctggttccctacgtctccaagcaccccggcgtcacggtggacgcgctcgcgcgcgccctcaacatcagccgcgaggacctgctggaggagctggacctgctcacctgcgtgggccggccgcccttcaacccggacgactacatcgacatctacgtggacaacgaccgcgtctacgtggacctggaccagcgcctcttcgcgccgccccggttgacgccgggcgaggccgcggcgctggccgcgtcggcggagctgctgcggccggccacgggggacgcattgcagagcgccctccagaagctggagcgcgtgctgccgcccgccacccgcgagcgttaccgggagatgtaccggaagattgatgcgtccacggaggcgccccaggccctggggccgctcacccgggccatcatcgagcgcctggaggtgacgttcggctatgccagccccggccggtcgccggagccgcgcaccgtgcgcccctacgagctgctcagccaccgggggcagtggtatctgcagggctactgccacacccggcaggacgcgcgcctgttccgcctggaccggatggaggacatcctcgtcacggacgtgtccttccagccgcccgcggacgcccgggcggacgtgcccaacccggcgcggggcctgacggactcctcggtgcgcgtgcgcttctcccccgtggccgcaccctatgtgaaggagcgcttcggccaggacgcccgcccgcttgccgacgggggcgtggaggtgctggtggcgggggacagcgaacgctggctcacccagtgggtcctgtctttcggtggcgaggcgcaggtcatggaaccggcctccgcgcgcgcggccgttgcccgagcggcgcgggcctctgtaggattgtaa

SEQ ID NO: 9316 - DNA, 621 bp, Myxococcus xanthus
atggagctgggctccgtgcatgagggccaggagaaggagatctccgcgcgcctggagcagctctgggatgcgtgcgcggcccgcaagtgggtggacctgacgtatgccagccccaagcaggcgggcaccacgcagcggcgggtggacccgtatggcctggcgctgcgccgcggcgcctggacgctggtggggtactgccacctgcgcaaggaattgcggaccttccacgtccaccggattcgcgaactcaaggtgaacacggcgcgcccgcgcacaccggacttccaggtgccggcggacttctcgctggaggcccacgtggcgtacttcccgtggcagcaccgcttccatgagcaggaggaggtggtgctccacctgtcgggcacgctcgcctcgcgggccgcgagcctgttgcccggcgccacgctggagccggcggaggagggggcggtgcgggcgcggctgccggtcacgttcgtggacggcctgatgcgcttctgcctggcgctggggccggactgccgcgtggagggcccggagcgggcgcaggcgcgtctgcgggagatggcctcgcgcatcgtgtcgtgccacgacgattcgctggacaaggtgagcacatga

SEQ ID NO: 9317 - DNA, 1089 bp, Myxococcus xanthus
cgggtggtggtgaaaatcggcaccaacgcgctgacgaacgccaccggacgtttcaaccgtcagcacttcgatgcgctgggccaggatttgttgtgggccgcgcagggccgcgagctggtggtggtgtccagcggggccattgccctgggggtcgagcggctgggcctgccctcgcgccctcgcgacatcccgggcaagcaggcgtgcgcggcggtggggcagagccggctggtgcaggcctacgaagaggccttcgccgcgcatgggaaggcggtggcccaggtgctgctcacccacgaggacgtgcaggagcgccgccgctacctcaacgtgaagcacaccctggagcggttgctgacggcgggcgtcgtccccgtcatcaacgagaacgacaccgtctccgtggacgagctgaagttcggtgacaacgacacgctggcggggctggtggccggcgtggtggatgccgacgcgctcgtcctgctgtcggatgtggagggcctctacaccggagacccccggcgcgacgcaggcgcggagctgctggccacggtgatgcaggtgacgcccgaggtcctggcgctcgccaccggtacgagcagcggggtggggacgggcgggatgagcaccaaggtgcgggcggccgcgcgcgcgtccgattccggcattcactgcgtgattacgtccggcgccgtgcccggccgcctgcgcgccgtcctggaaggcgcggacgtggggacccacttcgaacccaccggcagccgccgcagtgcccgcgccgcgtggattgcccatgccctgcgcgcacgcgggacgctcacggtggatgccggcgcgcgcgaggccattgtcaccggcaagcgcagcctgctgcccagcggcgttcgcggcgtggagggggacttcgggcgcggagacccggtggacctggtggacgcggagggggccgtgttcgcgcgggggctggcggcctacgacgccaacgagctgcgacgcatcgccggacatcgcacggcggacatcgaagcggtgctgggctaccgctacctcgacgaggccgtgcaccgcgacgacctggccgtgctgtag

SEQ ID NO: 9318 - DNA, 1008 bp, Myxococcus xanthus
atgcgtggcagtgtcatcggctccggctccttcggtaccgccctggcgaacgtgctcgcggtcaattgcgaggaggttcgtctgtggggtcgtgagtcctccgtggtggaggccatcaacacccagcacgaaaaccccacctacctgaagggcatccccatctcggagcgcgtgcgcgccacgaatgacctccaggaggcgctcgtgggctcggagttggtggtgctggccacgcccagccacgccacgcgcgaggtggtggcgaaggcccaggcgtacctgccgcgccatgtccccatcgttacggtgtcgaagggcatcgagaacgggacgctgctgacgatgacggagctcctggaggactgcctgccggaggagttccacccgtacctcgcggtgctgtccggccccagcttcgccaaggagctggcgcggcgcatgcccacggtggtgaccatcgcctcccactgggacaaggtggcgctgcgctgccagaaggcgctgcagacggagacgttccgcagctacacctccacggacgtggtgggcgtgcagtacggcggcgcgctgaagaacgtcatcgcgattgccgctggcatggcggacggcctaggcatgggccacaacgcgcgcgcggccatcatcacccgcggcctggcggagattacgcgcctggcggtgcgcaagggcgccaacccgctgacgctctccggtctgtccggcatgggcgacctggtgctgacgtgcaccggcgagctgagccgcaaccggcacgtggggatggagctgggcaagggccgcaagctgccggacatcctcgcggacatgaaggaagtggccgaaggtgtgaagacggcccgcagtgcgcacgaactggagctcaagacgggcgtggagctgcccatctgccaccaggtgtacctgattgcccacgagggcaagagcgcgcgcacggcggtggtggacctgatgacgcgccatccgaagtcggagctggcgggcgtctga

SEQ ID NO: 9319 - DNA, 531 bp, Myxococcus xanthus
atggggcccgcgcgagtcgcggggggcgtccttcgccgcgtggacgtgctggccggcgtggacagcgcttacgggttgatgagcgagctgcgcgtgggcgcgcggtggatggtgctcgacggcgggccccggtggagcgtgggcgtggcggtggagggcagccacgccttcttcctgcggcccgcgagcgtggaggaccggggcgcgcgctactacagcggacgtcgcaactggaacgtgctgcccggcatcgtcggcaatctccaactcccgggcgcccgctcgccgcgactgttcctggacgtccgctacctgatggcgctggacaccgagcccattcaaggggtgccgctgggcggcctgccccctgacgtagagctgtccggcgcctttccggtgcggctgggcgcggaaatccccgtgagtgagaaaacgtcctacgctctgacgattggcggggacatccggacccggcctgacgagacggatttcatgcccgtcatcacctttggcgtcgtgactggtttctag

SEQ ID NO: 9320 - DNA, 891 bp, Myxococcus xanthus
ctctacggtctctgtatgcgtcacgcggcatccacgccgcacatgctgaaccacaagccgggcgccgagggcatcgacccggccgtgttctccggcgaggagaatgtcatcgtcgacttccgctacagccaggacgcgcggctgacctggtggttcgaccaccacgcctccgccttccagcagccgggagacgaggcgcacttccgcgcggacaccagcgggcgcaaattccacgacgcgcaccgcaagagttgcacgaagtacctggcggacgtggcccgggagcgcttcggctgggatgcgtcgcccctggcggagctcatccactgggcggaaatcatcgacggggcccagttcccctcgccgcagatggcggtggcgctggaggagcccgcgctgcgcatcatgacggtgctggaggccaacaaggaccccagcctcatcccggaagtcatccgccgcatgcagtccgagtcgctggcggacatcgccacctcgccgctcatcgccgcgccgttggcgccgctgctggcgcgccaccagtcgaacatcgagctggtgcgtgcccgggcgcgctacgagcgcggcgtcgtcttcttcgacctggtggacgagggcgtggacagcctcaacaagttcatcgcctatgccctctacccggacgcgcgctacacgctgtgggtggggaagggcgcctcgcgggccaaggtgtccatcggctccaacccgtggaagccggagctgcggcggcacgacctgtccgccatcgccggacgctacggcggcggcgggcacccggtggtggccgcggtgagcttcaaggcggaccaggccgacaaggcgcgcgccgcctacgcggagattctggcggagctgtcctccgacgcgtga

SEQ ID NO: 9321 - DNA, 402 bp, Myxococcus xanthus
atgcagccgctggccgtgtgccgctcggacggcgcggccccgttggatgcgtcgcgtcgctacttcgaggaaggccgcttcgaggatgcactgtcctgcgccgcccaggccgccgcgctggagccggacctggccgccgcccacgcggaacgcggcgtggcgctggccgccctgggccgcgagacagaggcgcagctcgcctacgcgcgggcgctcgccatcgacccgggggacccgtccgcccttctgggctcggcgcacctgtacgccgtgcaactgtcctccacccgggagcggggacgaattgggcgccctctacgccgagcgcggcttgtcccagcccaacacgcccccggagctgattccgcacctcgcgctggtggccgccatggccttcaatga

SEQ ID NO: 9322 - DNA, 666 bp, Myxococcus xanthus
atggccttcaatgatttgggacaggcggagtcctcgctggcgcactccgccatcgtcctcgcgcgcaatcccggaagccgcgaggccctctacgagcgcgccctggccctcttcgagctgtgccgcttccgggaggcccgcaccgccttcaccagtctcgtggacgacccggagcgggccgcgcacgcccatcatcacctggggctcctgttggagcgcgagggcaagtggaagcaggcgcagggccacttcgacaaggcgcgcacgctggcgccggacgactttcccgagccgccgctgcccgcggaggaggacttccgcgccgaggtggtgagggccgtcgccgagctgcccaaggacatgcgcggggacttggacggcgtgcccgtcactgcggaggagctgcccgcggacgcggacctgctggccaaccagccgccgctgtcgcccacgattctggggctctaccggggcccgccgctggccgagccctgtgacggctccgaggtgccgtgccgctccgtggtgctctaccgccgcaacctggcgcgcgccgcccggacgcccgaggaacttcgcgagcagatccgcgtgacgttgctgcacgaaatcgggcaccttcgcggcgaggacgacgaagaactggccgctcgcggcctggagtga

SEQ ID NO: 9323 - DNA, 1194 bp, Myxococcus xanthus
atgcccccccatgcagccctgcccgtcgcgcgcgtcacccccaagggggcgcgctcgctgcggcacttcaatccctgggtgtaccgcaccgaaatcgccgccccgcccgacgtgaagggcgccggcgccgtggtgctggtggtggactcccagggcaatcccattggccaggcgctctatgcccgccgctcgcccctggcgctgcgcctgctgacgcgcaaggggcccgccgaggagccggtggacgacgccttcttccgccgccgcctggaggccgccctggcgcgccgggcgtacctgtccggccgtgacgggctgcggctggtgcacggcgaggcggaccagctcccgggcctcttcgtggaccgctacggaaagggcctcacgctccagacgctctccgagggcatggacgcgcgcaaggagacgctggcgaagatgctggtggagctcaccggcgccacccacgtcatgtgccgggacgacgcctccggccgtgacttcgaaggcctgccccgcgaggcgcgcctgctgcacggtgagggcgccgcgcgcttcacctaccacgagggggagaaccgcttcgaggtcgacctccagggcgacatgaagacgggcgccttcctggaccaggtggacaaccacctgcgggccggggagctggcgcgcggcgacgcgctggacctcttcagctaccacggcggcttcgcgctctcgctgtcacgcacctgcacgtccgtgctggcggtggagcaggacgagaaggccgccgcgcgcgccaaggccaacgccgaggccaacggccgcgccaacgtcaccgtggagaacgccaacgccttcgatgtgctgcgccgcttcgacaccagcgggcgccgcttcgacaccgtggtgttggacccgcccggactggccaagcgccgcgagggcctggccaccgcgctgcgcgcctaccacgagctgaacctgcgcgccttccgctgcctcaagccggacgggttgctcgtcacctgctcctgctccggcaagctggaccgcgccgccttcgaggagatggtgctggcggccgccgcggatgcgaagcggccggtgcagattctggagcggcggggcgcggggttggaccacccggtgctggccgggctgccggagacggagtacctgaaggccctctacgtgcgcgccctctagcgaggg

SEQ ID NO: 9324 - DNA, 2379 bp, Myxococcus xanthus
atgctcgagcacggttcgggcatcatggggttgccgctccgcctgctcgcccgcgaagtctatgaccgggtgaccgctcgggtgggtgagggccgcgtggcgctgatgacgggggaggagaagcgcgtgcccccgcgccccgactactggatttgcaccgtcgaggcgatgccgaccgacaagtccgtcgacttcctcgcggtggatgaaatccagctcgctgctcaccgtgaacgcgggcacgtcttcacggatcgactgctccatgcgcggggacgcaaggagacctggttcctgggcgcggacacgatgcgtcccatggtccagacgctcatcccccatgcctcggtgaagcgcgctacccgtctgtcacagcttcgttatgccgggcatcgctccctgaagagcctcccgccgcggtcggcggtggtcgcgttctccgcggaccgcgtctacgagttggccgagtcgctgcggcgcctccggggcggcgtggccgtggtgctgggcgcgctgtctccccggacgcgaaacgcccaggtggcgatgtaccaatccggagaggtgcagtatctggtggccacggatgccattggcatggggctgaacctggacctcaaccacgtggccttcgccgcgctgtccaagttcgacggcgccgaccagcgcgagctctatccggacgagctggcgcagatcgctggccgcgccggccgccacttgaacgatgggagtttcggcacgctgaacacgttgccggagctgccgccgcgggtggtctccgccatcgagacgcaccgcttcccggcggtccggagcctcatctggcgcaatgccgcgctcgacttctcgagcccagaggccctgctggattcactggcgcgcgcgccgggccacagtgccttcatccgggtggagcgcgcggatgatttcgatgcgctcaaggacctctcgcgtgttccaaccatccaggacctggccaccgggccggccatggtggagctgctgtggcaggtctgccagatacccgacttccggaaggggctcttcggccagcatgtcgcgttgctgcgtgagacgttcctgcaactcaccgcgggggacgggaagctggacgccgtctggctgaacaagcaggtggctccgctcgacgacgtgtccggagacatccacacgctgatggaccggctggcggccatccgcatctggacgtacatcagtcatcggccggggtggctgcacgaggcggaacactggcaggagcggacgcgcggcatcgaggatgcgctgggggacgcgctccatgaacggctcgtcgagcgcttcgtgcagcgcgccgcgaggcgcagcacgcgtcgctttgtgaaggccaccgcgcgccctccgtccggttcggccagtcccttcgccaagctggggcagatgctggaggagatgccgggcgccgagggcttcgcgatgacggaggagcagttcgtccagcgggtggtggacgcgagccatgatgccttccaggtggatgcgagtggcgccatctccttcgaaggcgagcccctggcgcgcctcgttcgcgggacggaccgccgctcccctttgctggcactggcggagccggaggtctggacgggcggcgcgcggcagcggctggagcggcgtctgctcgcgctggcgcgggacctcgtcaccgaggccatgggcggctttccctccgagtccttctccggagcggggcgcaacgcggcggcgcgtgggctcgcgtatcgcctgtccgaaggactgggcgtgattacgcagggcgaggcgcatgagcagtggcggctgttggatgaggaggctcgcgcgcgcttgacggagcaaggcgtctgcgagggacaccgcttcgtctacgtcgccgaggccctcagcccgcatgcgctggagcggcgctgcatgctcacgtcgctgttcctccagcggacatgtcccaccggggtgccacgagaacccgtgcttcagctctccgagttggatcgccgcgacgcacgtgcctatgggtacgaggtgctcgggagcgtggttcttcgcatcgacatcgtcgagcggctgtgcgaggccctgcgccacccgcatgggggccggcaggtgcaggcgctcatgcaggacctccgcctggaggggagtatccgggctcgggtgctgcgcgagctgggaggcgccattggaaaccctccgccgcggcggcgccgtcgccgacgtggcggcgccgcgcaagtgtccggcacgagcggcgctcacccaggttcgcctcggagcggggcctcggagcggaagggacgtcggccccgagagggggcggtccggaatgccacggcgtttcgagacggaccctcggaatcatga

SEQ ID NO: 9325 - DNA, 2076 bp, Myxococcus xanthus
atggacctctcgaagctcaatcctccgcagcgcgaggccgtggtgaccctggagggaccgctcctcgtgctggcaggcgcaggcagcggcaagactcgcgtcatcacccaccgcatcgtccacctgctcaacgagcggccgggcctcatcatggcccgcaacatcctggcggtgaccttcaccaacaaggccgccacggagatgaaggagcgcctggtccacatggcgggacctcgggcgcagggcgtgctggtgtgcaccttccacgcctttggcgcggagatgctccgcgaggacatccaccggctggggtggcccaagaagttcgccatcgccgacatgggcgaccagctggccaacatccggcgcgcgatgcgcgagcacaaaatcgacgaccgctcgttcgacgcgcgcaaggtgctcaacctcatctccaaggcgaagaactccggcaaggcgccggagcccaagccggaggggattggggatgattacgacctcatcacccacatggtgtacccggactatcagctgtcgctgaaggcgcaggggtcggtggacttcgacgacctgctgctgctgcccgcgcgcctcctgcgcgagcacccggacctctacgagaagtacaccaagcgcttccgctacctgctggtggacgagttccaggacaccaacaccgcgcagttggaactgctgaagctgctggcgggccgctcccgcaacgtgtgcgcggtgggtgacgacgaccagtgcatctattcgtggcggggcgcggaggtgcgcaacatcctcgacttcgaccgcctcttcccgggagggaaggaggtccggttggagcagaactaccgctccgtccagacggtcctggacgcggccaacgccgtcatcgccaagaaccccgagcgcaaggccaagcagatgtggaccgaccgcacggggggaacgaaggtgaaggtggtgacgtgtcccaatgacgaagaggaggcccgcttcgtcgcgcacgaaatccagaagcacatggccctgggcatctccgcggacgacatcgccgtgctctaccggaccaacggccagtcccgccccatcgaggagacgctgcgggagaagaacatcggctacgaggtggtgggcggcagcgagttcttcgaccggcgcgaggtgaaggacgtcatcgcgtacttcaaggtcatcgtgaacaagctggacgaaatctcgctccttcgcatcgtcaacgtgccctcgcgcggcattggcgacgtgacgatggagcgcctgaacgtccacgcgcggggcgagggcgtcacgctgtggacggtgatgaagaaggccaccgactacgaggacctgccgcccggggccggggcccgggtgatggacttcgtggacctggtggagcgctaccgcgccgcgtacgagcacggccagttggccaacgtgacgcgcaagctgctggaggagattggctttcgcgaggccacccgcgcccacgccaccagcgccaccgccgcggacaagaagctcaagggcgtggacggcgtgctcaactcgctggagaacttcgaaaagcgcgagggccccaaggcgagcctgccgacgtacctcaaccgcctgagcctggacacccggcaggaggaagaggaggtgccgggcgccaaccgccgcgtcaccttgatgacggtgcacgcctccaagggcctggaataccggctcgtcttcttcatcggtatggaggaggacctgatgccccacggaggcatgcagggcgaggcgcagaacctcgaggaggagcggcgcctctgctacgtgggcatcacccgcgccaaggaggtcctctacctcacccgcgcggccacccgcgtgaagcgcggcaaggaggtgccccgcacgccctcgcgcttcctggaggacctgccgccggaggtgattgaggtggtggaactggacgcgccgcgtcaggggcctcccaccacggaggagaagaacttcttcgccaacttgaaggagcgcttcaagaaacccgcgattccgggaacgcctccgggtggcaccgggccgtctgggggagcagccaggtag

SEQ ID NO: 9326 - DNA, 447 bp, Myxococcus xanthus
atgtcgcagaagacctacagcgcgaaggctggggacatcaagcgccagtggcacgtcgttgacgtgtccgacaaggtgctgggccgcgcggcgagccagattgccaccctgctgaagggcaagcacaaggccatctacacgccgtccattgacacgggcgaccacgtggtcgtcatcaacgccgaaaaggtgaaggtgacgggcacgaaggagcaggacaagatgtactaccggcacccgaacgcgggtttcccgggcgccctgaagatcaccaacctggagaagctccgccagcgtcaccctgaggacatcatcatcaacgccgtgcggcgcatgcttccgcgcaacgcgctcggccgccagatgatgacgaagctgaaggtctacgcaggtgacacgcacccgcacgcggcccagaagccggccgcgttcgaggtcgaggcgtaa

SEQ ID NO: 9327 - DNA, 369 bp, Myxococcus xanthus
accgaccgctgcaaggaggccaccgcccgcgtctgtattcgtcctggcagtggccttgtcactatctacggctgcgagctgaacgagtacttcgcccgtgagacgtccaagatgatcctcagccagcccctcgagatcctcgagcagaagggcaaggttgacgtgacggtcaacgtcaagggtggcggtctctccggccaggccggcgccatccgtcacggcatcgcccgtgcgctgtgctccttcaacccggagttccgtccggcgctgaagaaggccggcttcctcacccgcgatgctcgcgcggtcgagcgtaagaagtacggccagccgggcgcgcgtcgccggttccagttctccaagcgctaa

SEQ ID NO: 9328 - DNA, 1385 bp, Myxococcus xanthus
atggaactcaacgagatcctccagatcgccctgcgtggcggtgcctccgacattcatctcaaggcaggcctgccgcccatgttccgcgtggacggttcgctggttccgctgaaggacggccgccgcctccctcccgaggaggtggcgcgcatggccttcggcatcatgaacgagttccagaaggagaagttcaaggggagcaacgaggtggacctggcctacggcgtgccggggctcgggcgcttccgcgtgaacgtcttccagcagcgtggcaccgtgggcgccgtgctgcgtgtcatccccttcaaggtgatgaccatccaggacctgttgctgccccagattctcgccaagatttgcggtgaggagcgcggcctggtcctggtgacgggcaccacgggctccggcaagtccaccacgctggcggcgatgatcgactacatcaacgccaacgagaccagccacatcatgacgattgaggaccccatcgagttcctcattcgcgacaagcgctccatcgtgaaccagcgcgaggtgggtgtggacacgatgaccttcgcgcaggcgctcaagagcgcgctgcggcaggacccggacgtcatcctcgtgggcgaaatgcgtgaccacgaaaccatcgaaacggcgcttcacgccgcggagacgggccacctggtgatgtccacgctgcacacgctggacgcgacggagaccatcaaccgcatcgtctccgccttcccgccgcaccagcagaagcaggtgcgcctccagttggccagtgtgctcaaggccgtggtgtcccagcgtctggtgccgcgcgcggacggcaagggtcgcgtggccgccgtggaagtgctgcgcgtcacggcgcgtgtccgcgagatgattgaagacaaggaccgcacgaaggagatccacgacgccattgcccagggcacggacacgtacgggatgcagaccttcgaccagtcgctgatgagcctggtgcggcaggggctcgtcacctacgaggaggcccatcggcaggccaccaacccggacgacttcgcgctgcgcttctccggcatcagcggcacgtccgactccaagtgggacaacttcgattcgaagcccggcgagtcgcggcccattcctggctcgtccgccttcgcgcagaagggggcgcccacggctgtcgcggcgccgcaggccgcgcctgctccggcgcccatggcgcagcccatgcgaccggcggctccagcagcccagcagatgcgcccgggggggccgccgcaggccatgcgtccgggggctccggccggcgcgccggtggggcgtcccatggggtttaccgccgtgcggcccgcaggcgcccggtccgggccccgcagcggcagggggggaccacg

SEQ ID NO: 9329 - DNA, 582 bp, Myxococcus xanthus
gcccgtcccatgagcgaattgattctggcctccacgtcgagcgcccggcgggccctgatggatggactgaggcttccctaccgcgccgaggcccccggcgtggacgaggtcgtcgccccacacctgtcggtgacggaggccgtgcgggagctcgcgtcacgcaaggcccgcgcggtgcatcagcgccacccggaggcctgggtgctgggcgcggaccagctcgtcgaggtggcgggcgaagtcctctccaagcccgtcgaccggaacgcggcgcgcgagcaactgcgcaagctggtgggccacacccacgccatccacaccggggtgtgcctggtgggccccggaggcaaggtgctcgatgcagtggagacgacccggctgaccttctaccgggtgaaggaggaggagctggagcgctacctcgacctgaacgaatgggagggctgctgcggcagctaccgcgtggaggacgccggacaggccctgttggagcggctcgacggcgaccgctccaacgttcagggcctgcccatggtgacggtggtgcgactgctgcgggaggcgggcttccggttcttctga

SEQ ID NO: 9330 - DNA, 303 bp, Myxococcus xanthus
atgttctgcaaggactgcgacagttgcttctcgtgcacgcactgcacccggtgcgagctgtgcaacaactgctcgcactgcgtggactgcaagagctgcaacgcctgcgcgtactgcgtccagagcgagaactgctccaccagcgcgtacctggtgctgtgccgcaacctgcaggactgcaactactgcttcggctgcgtgggcctggcgaagaaggacttccacatcctcaacgtccccttcccacgaacggagtacttcaaaatcgtgggccggctgcgcaaggagctggggattccatag

SEQ ID NO: 9331 - DNA, 276 bp, Myxococcus xanthus
atgggcgagcgcattggcaaggccatccaggaggccgccgaccgctcccggggcaaggcggccagtgacccgtccgcccccatccacctggacgacgccgtgggcttcgtgcggtacgacgcggaggagtctgtggccgaagcgaacctccttgtgggggggcgctacgtggttgccgtcaccagccggggatttccgggtacggtggaggtgcgccgggtggcgcgcggcatcgaccttgcgggactggctcgcctgaggcccggtccgaactga

SEQ ID NO: 9332 - DNA, 231 bp, Myxococcus xanthus
ggcctgcgccgcatctccgccggcaaggcgaagagcggtgagaagggctacctggtcgacgcggaccgccgcgcggccatcgagcaggccatcagcctggcgtccgcggacgacgtcgtcctcatcgcgggcaagggccacgagacgtaccagcaggtcggcgaggagaagctcgtgttcgacgaccggcaggtggccgcgaaggcgctggccaaccgcatcgctggctga

SEQ ID NO: 9333 - DNA, 1401 bp, Myxococcus xanthus
atggcagcttccttcagcgacgaagaggtggtgcaggcgaccggggcgacccggcgtggcggcccggccccggccgcctacgctaccgtctgtaccgacacgcgggcactcacccccgggtgcctcttcgtggccctggtgggtgagcgcttcgacgcccacgctttcgtggacgccgcggcgaagggcggggcggctggcgcggtggtggcacgcgggcgcccgttgcccgcgctgcccgacgggctgacgctctatgaagtggatgacaccctgcgggccctgggcgcgctgggacggcaccaccgtcagcgcttccggattccggtgtgcgcggtgggtggctccaacgggaagacgaccaccaaggagatggtgggcgccatcctggccacgcgcgggccggcgctgaagaccgagggcaacctcaataacgagattggcgtcccgctgacgctcttccggctggagccgcgccacgtcgcggcggtcatcgaagtggggatgaaccagccgggggaaatcgagcggctggcgcgcgtcgtccagccggacgcgggcgtcatcacggtggtccagcccgagcacctggaagggctgggcagcatcgagggcgtggcggcggcggagggcgagctgttccaggagatggggcacggcaccaccatcgtggtgaacgtggacgacgcgctcatccccgcgcaggcggagcgcagcggagcgcagcggctgacgttcggccgggcggagcacgcggacgtgcggctcgcggacgtgaagacgctgggccgcgagggcatggtggccacggtgcggcacctgggccgcgagtggccggtgcggctgcacttcgtggggccacacaacgcgcagaacgcgacagcggccttcgcggtggcgctggcgctgggctacaccccgcaggagtgcgtgcgcggcctgcagtcggcgcggccgtactcgcggcgcctcaacgtggtggacgggcagcacggcgtgacggtcatcgacgactgctacaacgccaacccggcctccatggacgccgcgctggagacgctgggcacgctggtgcccgcgagcggccgggccgtggtggtgctgggggacatgctggagctggggccgggcgagctcgaggagcacgcgcgcctgggcggccagattccctcgcacgcggcgctggcggcatttttcggtccccgctccttgaaggggtgggaggccgcttccatgggtgaatccgccgcccacttcaccgacgtggagccgctgatggcgtggttggcgccgcggcttcgcgaaggtgacgtggtgctggtgaagggcagccgcggcatgcggctggagcgggtggtggccgccctgacgggcacggccgcccccggaggaaaccactag

SEQ ID NO: 9334 - DNA, 951 bp, Myxococcus xanthus
atgggcggcgcgctcatcctgctgtgcatcgcggcgggcacgctgctgttcgcggacctgaagagccgcgccgtctgggtgatgctgctgctgacgctgggctacggcttcatcggcttcctggatgactggctcaagctgtccaagcgcaactccaagggcctggccgggcgcaagaagatggtgttgcagaccttcttcttcctcgtcgccgtgttcggcctgctgacgacgtggacgctgccggacggctccttcggccccacgctgctcatcaataccaagctgacgctgcccttcatccccacgcgctggttcaacccggacctgggctggttctacgtcttcttcgcgtggattgttgtcgtgggcacgtccaacgcggtgaacctcacggacggcctggatggtctggccatcgtccccaccatcgtgtccgccatcaccttcgcggtgctctgctacgtggcgggcaccacgctgagcatcgcggactacgaggtggtgggcggcgcgtcgaagctggtggccacgccgctgtaccagtacctgggcatcctccaggtgccgggcggcgcggagctggcggtgttctgcgcggccatcgtcggtgcgggcatctcgttcctgtggttcaacacctacccggcctccgtcttcatgggcgacatcggctcgctggccctgggcggcgcgctgggcgggctggcgatgctgtccaagaacgaggtggtgtccgccatcatccacggcatcttcttcgccgaaatcctgagcgtgatgattcaggtcacgtccttcaagatgacgggcaagcgcgtcttcaagatggcgccggtgcaccatcacttcgagctcaaagggatggccgagccgaagatcatcgtccgtttctggatcgtctccatcctctgtggtggcgtggcgctcctgtccctgaagctccgctga

SEQ ID NO: 9335 - DNA, 1704 bp, Myxococcus xanthus
ctcgactggatggtgcttggtggcaccatcgcgttcatcgtggcgtggggcctctggaagtcccgagggacggccaccagcgacgagtacctgcgcggcggccgcgagctgaagtggcccaccatcggcctggcggtgatggccacacaggccagcgccatcacgttcctctccgtccccgggcaggcctacgaggacgggatgcgcttcgtgcagttctacttcggactgccgatcgcgatgatcatcatcagcgccgtcttcgtgcccatctactaccggctgaatgtcatcacggcctatgagtacctggagtcacgcttcgacctgaagacgcggctgttgggcgccttcctcttcctcatccagcgtggactcgcggctggcatcaccatctacgcgcccgccatcatcctctccgccattctcggctggccgctggagcccaccgtcatcgtcatgggcgcggtggtcatcctctacacggtgacgggcggggccaaggcggtgagccagacgcagaagcagcagatggtggtgatgatgggcggcatggtggtggccgccatcgtcatcgtctggcggctgccggagcacgtgtcgttcggcaaggcggtggacgtcgcgggtgccttcggccggatgaacgtggtcagcttcgacttcgacatgcaggaccgctacaacttctggtccggcatcaccggaggactgttcctgtccctgtcgtacttcggcacggaccagtcgcaggtgggccgctatctctccggccgctccatctccgagagccggctggggctgctcttcaacggcgtgctgaaaatcccgatgcagttcctcatcctcttcgtcgggattctcgtcttcgccttctaccagttcaacacgccgccgctgctcttcaacgaggcgctgcgcacccgcgtgcagggcacggcccaggcggccgagtacgccgcgctggagtcgaagtgggagcaggtccagtccggcaagcgcgcggaagtggagcgctacctgtcggccgtcgattcaggcgacgtggcggcaggggcggcgtcgcgggcgctgcttcagggccgcgcggaggaggcgagcgccgtccgcaaggaggccaaggacctggtgtcccgcgcgctgccgggcgcggagacgaaggactccgactacatcttcatctccttcgtgaagcgctggctgcccagcggcctgttcggcctgctcatcgccgtcatcctctccgcggccatgagctccatcgccagcgagctgacggccctgggcacgacgacgacggtggacttctaccggcgggtcttccagcgcaacgcttctgaccggcacgtgctggtggcgtcgaagctgttcactgtgttctggggcgtcgtcgcggtgggcttcgcgaccttcgcgtcgctcttggacaacctcatccaggcggtgaacatcctgggctccatcttctacggcacggtgctgggcatcttcctggtggccttcttcgtgaaacacgtgcgcggccatgccgtgttcgcggcggccgtcatctcccaggcgacggtgattgccctcttcttcctctccgacgtgggctacctctggttcaacgtcatcggctgcgcgctggtggtggcgctgagcctggtgatgcaggccgtcctgccgcgcggcgagacgccggccccggcgccgggggcctga

SEQ ID NO: 9336 - DNA, 428 bp, Myxococcus xanthus
atgctcggtgtcggttccgccacgggctcatgcgctgggcgaaggggattgtgccggggccatgccccgggtgatgaatccggaatgcgcctccgttcgtggtggtgggtcctggtcctgctcacggtgtcctgcgcggggcgacgctcctcgtccgaggaccttggggggcgagacgctcggtccgaactcttccgggcccgcggtgacgcggccatcgagacgaagcaatgggccctggccgcgggctacttcgcgtccgcgagacacacggaagactcacccacggcgcgctggggacaggtgtgggcggagaagcgcgcctcgtctctcgagtgggcgaagcagatcgagggttcggtgctggcgctggccttctcaccggacggcaggctgctggcgtcgggagggtatgacgcggtcctgcg

SEQ ID NO: 9337 - DNA, 1368 bp, Myxococcus xanthus
atgacgttggcgctgtccggtcagaaggtgctggtgttcgggctcgcgaagagcggcgtggccgcgctgcgcctgctgcgtcagcagggcgcggacgtcacggcgctggacgcacgtggcgaggacgcgctgggcgcggtggcccacgaggtgaaggcgctgggcgccacgcgggtgtccgggcccacgcctccggggctgctcgcgtcgcaggacctggtggtggtgagcccgggcgtgccgctggcgctgccggaaatccaggccgcgcgcgcggcgggcgtggcggtgtggggcgaagtcgaactggcgggccgcatgctgtccggcgtgccgctgttcggcatcaccggcaccaacggcaagagcaccaccacggcgctcaccggcacgctcttcgccagcggcgacaagcgcaccttcgtgggcggaaacctgggccggcccttcagcgaggcggccatgtccccgggggactgggacgcgctggtggtggagctgtccagctaccaactggagggcatccgcacgctgcgccctcgcggcgcggccatcctcaacctgacgccagaccacatcgaccgctatcccagccacgcggcatacggcgaggcgaaggcgcgcatcttccagaaccagcaggccggtgacttcgtggtggtgaacgcggacgacgcggacgtgctgggcctggcgcgtgccgcgaaggcgccggtgtacggcttcagcctcacgggcaagccggtggcggacgctccggcgctggcgggcctggcggtggtggagccgggcggcttccggctggccttcctgggcgagcactacacgctgacgaaccgcgcgctgcgcggcgcccacaacgcgcagaacgcgatggcggcggcgctgctggctcgcctgggcggcgtggcctccggcgcggtgcaggcggggctggacggctacccgggcctgccgcaccggctggagagcgtgcgcgtgctggatggcgtcgagtgggtgaatgactcgaaggccaccaacgtggattcggtgctggtggcgttgcgcgccttctcccaaggcgtgtggctgattgccggaggcaagggcaagggcgcgccgtacgcgcccatggtggaggcggggcagggcaaggtgaagggcgtgctcaccatcggcgacgacgcggacacgctggcccgggcctatgccggcgcggcgcaggtccacgcgtgcggcaccctggcccatgcggtggcgcgggcgcgggagttggcggagcggggtgacacggtgctgctgtcgcccgcgtgcgcgtccttcgatcagttcaagaacttcgaggaccggggcgattcgttcaagcgcctggtggaggcgctgtga

SEQ ID NO: 9338 - DNA, 1167 bp, Myxococcus xanthus
atgaagaacccttctcctccgtcctccgccctcgtgcgcttcgacccggtgctgctttgcgcggtgctcgggctcgtgagtttcgggctggtgatggtgtactcggccagcgcggtgctggcgcaggacaagctgggcgacagcctctacttcctcaagcgccagctcgtcgccgcgggcctggggctgggtgccatggccgtggccatgaaggtcggctggcgccggctggcgcgctgggcctatccgctgctgctggcggccatcgtcctgttggtgctggtgaacatccccggcatcggcagcacggcgggtggcgcgcggcggtggattcgcctgccgggctttggcctgcagccggcggaggtggcgaagttcgcctgggtcgtctacctgtcctactcgctggcgaagaagcgggagaaggtggcgaagttctccgtgggcttcgttccgcacctcgcgctgtgcggcatcctggtgttgctttgtatgatgcagcccgacttcggcagcagcgtgctgctggtgttcatgctcttcgtgctgctgttcgcggccggcgcgaagctgagctacctggtcggcatggtgctgctggcgttgcccctggcctacgtggccattgcctccagtccgtaccgcatgaagcgcatcctggccttcatggacccgtgggcgcaccggcatgacgtgggctaccaggtggccgagtcgctgatgtccatcggttcgggtggcgtggtgggcctgggcctgggcgacggacggcagaagctcttcttcctgccggaagcccacactgacttcatcttctccatcatcgccgaggagacgggcctcattggcgtgggcctgctggtggtgctgtacggcgtcgtgctgtggcgcggcgtccgggccagcctggcggcgggggagacgttcggaacgtacctggggctgggcatcagctccatcatcgcgttccaggccgcggtcaacatgtgcgtggccatggggttgctgccgacgaagggcctgacgctgcccttcgtgtcgtacggaggttcgtcgctggtggtgttgatgggtgcggctggagtgctgttgtcgttgagcgcgaacacccagggggtcgcgaggcccagccgggtgggaaccgacatgcgggaggtggcggcatga

SEQ ID NO: 9339 - DNA, 1152 bp, Myxococcus xanthus
atgatgaaggtgctcatcgcgggtgggggcacgggcggacatctctttccgggcatcgccctggcggaagaggtggtgacacggcatcaccgcaacgaggttgtcttcgtgggcaccgagcgcggcatcgagtcgcgcgtggtgccgaaggaaggttatccgctggagctggtgaaggtgcagggcctcaagggcaagggcttcttgtccctgctcaaggcgctcttcgcgctgccgctggccttcatcgagtcctttcgcatcctcgcccggcagaagccggatgtggtggtgggcgtgggtggctacgccagcgggccggtggtgatggccgcgtggctgatgggcatccccaccgccatccaggagcagaacgcgctgcccggcttcaccaacaaggtgctgggccgcatcgtgcgcgtggtgttcatcgccttcgaggaagcgcgcgccttcttcccggagaagaaggtccagctcatcggcaaccccatccgccgcaagctgatggacaactacctgcgcagccacgtcgcgcacgagcgcttctccgtgctcgttttcggcggcagcctgggtgcgcggggcatcaaccagcggatgacggaagcgctggattcgctgggcgacctgaaggacagcctgcacttcgtccaccagacggggaagaacgacctggagtcggtgcgcaagggctacgcggacaagggcttccaggcggaggtggtcgagttcatcgacgacatgtccagcgcctatgcccgcgcggacctcgtcgtctgtcgcgccggcgcgacgaccctcgcggagctgaccgtctgtaagaaggccagcatcctgattcccttcccgcacgccacggacgaccaccaggccgtcaacgcgcgggcgttggtggatgctggcgcggcgcttatgtttcgcgagtcggagctcaccggggaaaagctggcgcagacggtgcgtgagctgaagagccacccgttgcgcctcaagagcatggagaagaaggcgggcctgttgggccgtcccgaggccgccaaggaactggcggacgtgtgcgtggacctgatggtccagacgtggggccccaacggccgcgagcgtacccccatcgaagccgagaagaaggcccccaggagcaattcgtga

SEQ ID NO: 9340 - DNA, 1371 bp, Myxococcus xanthus
caggtccacttcgtggggctcggtggtatcggcatgagcggcatcgccgaggtgctgctgaacctgggctaccgggtgtccggctcagacttgcgcgagagcgacatcacccggcgcctggtgcgcatgggcgcgaccttcttcgaaggccaccgcgcgcagaacctgattcaggcggacgtggtggtgatttcctccgcggtgcgcaaggacaacccggaggtggtcgccgcccggcagcggaagattcccgtcatcccccgcgcggagatgctcgcggagttgatgcgcctgaagtacgcggtcgccgtggccggcagtcacgggaagacgacgacgacgtccatggtggccaccgtgctgagcgcggcggggctggacccgacggcggtggtgggcggcaaggtgaacgtgctcgactccaacgccaagctgggcaagagcgagctgatggtggtggaggccgacgagagcgacggcagcttcctccacctgcatccgtccattgccatcgtcaccaacatcgacccggagcacatggaccactacggcgacctggacacgctccagtccgccttcgtggagttctgcaaccgggtgccgttctacggcctcaacgtgctgtgcctggacaaccccaacgtccaggcgctgctgccgcgcatcgagaagcgcttcgtcacctacggcagctcgcacatggcggactaccggctggagaacatccaactggacggcttcaccacgcgcttcaacgcctatcgccgggaggagtcgctgggcgagttccgcgtgcggatggtgggcgcgcacaacgccttcaacgcgctggccgtcatcgccgtggcggaggagatggacatcccgctggagacggtccgcgagtcgctggccgagttcggcggcgtgcagcggcgcttcaccgtgcgcggcgaagcccagggcatcaccgtggtggacgactacgggcaccaccccacggaagtgctggccacgctggccggcgcgcggcgggccttcggacgccgggtggtggtggccttccagccgcaccgctacacgcgcacgcatgacctgatgaaggagttcaccacctccttcaatgattcggacgtgctcttcgtcaccagcgtctacgcggcgggtgaggagcgcatccatggcgccacgggagacgcactggcggacgccgtccgcgcccacggccaccgcgacgtcacgttcgtggagaagcgcaccgacctaccggcggcgctgctgccgcgtctgcgcgagggtgacctggtgctgacgctgggagcgggtgacatcacccacgtggggccggagttgctcgagctgcttcgcaccacccccctggcgaaggactag

SEQ ID NO: 9341 - DNA, 933 bp, Myxococcus xanthus
atggtggaagcaggcgtgaagacggcgctggcggctcgcgtggagtcgctgggcggctgcgaggtgaaggcgggcgaaccgctggcgcctctcaccagcgtccgggccggcggcgccgcggaagccctggtgcgcccgcgttcgccagacgccctggtggcgctgctgaagctggcgcgtgaagagggtgtccccgtttcgattctgggcggcggcgccaacacgctggtgggcgacggcggggtgcccggcctgacgctgaagctgccaggagacctctttccggaggtggccgacgtgggccccgaggaagggcggctcaccctgggggcgggggcggccatcgtccgcctcatcaatgtcatgcgggcccacgcgctggtgggcgcggagttcctggccggcatccccggcacgctgggcggcgcggtgtcgatgaacgccggcaccaagaacggcgaagcctttcgcgtcatcgaggcggtggaagtggccacggcggacggggtggggtggctgacgaaggcacaggtgccgtattcctaccgtcactccgaattgccgccgggcggcgtcgtcacccgggtgcgtttcgcgctgcgcaagggggacgtggtggcctccaaggccgtcatggacgctgacctgggttaccggaaacggacacagccgctcagtcagcccaacttcggcagcgtcttcaccaacccgccgggcgaccatgccggacggctcattgaactggcgggcctgaaagggtactcgctggggcgcgcgcaggtgtccaccctgcacgccaactggattgtgaacctgggcggtgccaccgcccgcgacgtgctgggactcgtcaccctcatgcagcagcgggtgctcgagcagtccggcgttgacatgaaacccgaagtcaagcgcctgggagacttcctgtga

SEQ ID NO: 9342 - DNA, 885 bp, Myxococcus xanthus
atgtccgcggagcgcgacgtgtccctgcgcaccggtgaggccgtctccggggcgctgcgcgggctgggctacgacgtggtggagattgacgtgggccgggatttgcccgcgcgtctggcggcggagaaggtggacgtggcgtggctggccgtccacgggcgttatggcgaggacggctgtctccagggactgctggagtcgctcttcattccttataccggcagcggcgtgctggcctccgcgctgggcatggacaaggtgtacgccaagcaggtctacgtggcccacggcatccccacgcccgcgtaccgttcctttaaggacgccgcgtcggcgctggcggcggcggacagcctgcccttcccgtttccagtggtggtgaagcccagccgcgaaggcagcagcgtgggcgtgcacatctgcaagacgcgggacgcctacgaggccgcggtgacggacgcggcgaagtacgcgggcaccctgctggtggagcagttcgtcaagggacgcgaagtgcagggtggcgtgctggacgatgaggccctgggcgtcatcgaggtacgcgccgcgcgcgagttctacgactatgacgcgaagtacaaggcgggcaccggcacgcagtacctcttccccgcgccccttcctccggatcagtatgcgcgggtgaacgaggtgtgcctggccgcgcaccaggccctggggtgtagcgggggctcgcggtcggacgtcatcgtcaccgacggaggcgatgtgttcctgctggaaaccaacacgctgccgggcatgacggcctcgagcctcttgcccaagattgccgcggggcgcggtatcgactttcccgccctgtgtgagcgcctgctgctgggcgcgtgtctcaaggcctga

SEQ ID NO: 9343 - DNA, 463 bp, Myxococcus xanthus
atggccttcggtaaatccaagaaccgccgccgtcaggacgccgcccagcagaaagaggcggtccggggcgcggtgcgctcgcacgggccgggcgtgctcaaggtgctggggctgaccctgggcaccgggctgctggtgtggggtggggtggcgctgcgggagtgggcgctgacgtcgccgcgcttcgaactggaggcggtgtccttctccggcctccagcgcgcctcccgggtggagctgctgcggctggcggcgctgacgaaggggcagaacctgtggacgctggacgtggacgcgctggagcgcgccatgcaccagcacccctggctgcgcacggtggaggtgacgcgtcgcttccccaaccgcgtgtcggtggaggtgacggagcacgtgccggtggcgatggcggtgctgggggagctgtacgtcctggacgaggaaggcgagcccttcaagcgggtga

SEQ ID NO: 9344 - DNA, 234 bp, Myxococcus xanthus
ctggatgccgcgcaccgggaaagagggtggcatcagccaggtgagcatcgccaggcgctggcggcgggcatcacgttccgtccggcgtctgacacgatacgcgacacggtggcctggttcaagacgctgcctcccgagcgtcaagcgaagccgcgctccggcctgtccgccgagcgcgagaaggaagtgctggccgcttggcaccaggagcgcggcaccgccaacgcgggctga

SEQ ID NO: 9345 - DNA, 1500 bp, Myxococcus xanthus
atgacgcccgacctgctgaaggacgccgtatcacccatcctccgtgcgcgcggcacgtccgtgctgctggccgcgctgctggctgcgtgcggcggcaaggacgtgcggccggaggcgccgcccgcgggtgactgtgcgccgctccggctggagcgggatgtgaatctggaaggcttccgcaccgaccgcttcgagtggcgcgacgcggactgcaagccccgctcggcgtcgctggtgcgcaatgacgccacggaccccaaggggtggacgggcggctacctgcgccgctacacctacgaggtcgcgggcgcgacgcgcgtctgtgatggctcggacggcatggtgccgggctggggcatcgtcacgagccacctgcgcgtcagcccgccgtggggcaactggacggagggcatccggggcacgtggcgcacgctcttcgagggccgccaccacgcgctgcatgagttccgctggcccatggagcttggtggccacgtcgtcgacgtgacggtgcattacctcttcgctaccgggcggagccatccgctctatgccatcacccatgatgcgtccggtgcgccgcccgacgtcatcaacgcggacgtgcgctcgccctacggcgacatcatcttcgatggggatggcaacgcggacatctccggcgtgggctggggagaccgctaccgcttcgtgacgctcggtgccgggccgctgacgcgggcgagcggttgggactaccgcgagcccaacgtggtgccctacacccgcatgtggattgcgtcgcccgacgcggagatgggcgtggtgcagacgcagacgtgggtgcagaagcccgcgggcggctactggcaatacccgtcctgggggcaggtggacgaggacggccccatgcccgaggactggaactggacctaccagctcaaccagtacgagctgcccgagcaggggcccacgcgctcgcaccggatggcgtgggggagcaacttcggcgcggtgggcttccgcgagtacccgcgctacagcgacgacgccatgctgtccggctacccgtaccagagctactccgtcttcatggtgctgggcacgcacacctcggacccggtgctgcggctggcggcggacgtggaggcctggcagggcgtgcggctgacggccaccgagggccgcgtcctggaccggggccccggtggggtggggcgggatgactccgtggcgcgggatgtgcccggctacaacccggtgtacgccacctgggaggcggaggtcggcgccaacaaccgcgcctcgctgcgcttcgagacgaacggccgcgccctggtgaatcccgtgctggtgctgcgcggttacaccgcgtccacaccgcccacccgcgtcaccctggatggccaggcgctctccgcggacgtggactacttcgcctccgtggacgacgccggcaacgcgctgtggctcacccttcaccggaccgtgacgggctcggcggcgctgctcgtggagtga

SEQ ID NO: 9346 - DNA, 4683 bp, Myxococcus xanthus
gtgctggcggagaagccctcggtggcgcgcgacatcgcgcgggtgctgggggcgaacgagcgcggtgagggctggctgcgcggcaatggctacgtggtgacgtgggccatcgggcacctggtgggcctggcgcagccccatgagattcgcgcggactggaagaagtggagccgcgcgctgctgcccatgctcccggcggactggccgctggtcgtctccaaggagacgcgcagccagttcgaggtggtgaagcaggtgctcaacgcgccggaggtgtcctcggtggtgtgcgcaacggacgcggggcgcgagggcgagcttatcttccggtacatctacgacgcggcgaagtgccgcaagccggtacagcggctgtgggtgtcgtcgctgacggagcgggccatccaggacggcttccgccggctcgcggacggccgtgaatacgaagcgctggccgccgcggccatggggcgcagccgggcggactggctggtggggatgaacctgtcgcgcctgtacacgctggcgcacgggggccatggagagatgctgagcgtgggccgggtgcagacgcccacgctggccatggtggtggagcgcgagttggccatccgcgacttcgtgccgcgtgactacctggagctcgtggccaccttcgcgcccagggcgaagggggttccgccggacgcgctgtacaagggcacgtggttccgctcggggccggatggcaagcccgtggcgcccccgggcttcgagggcgtgcgcgaggcgcggcggctggatgcgaacggcgtggaggcgcaggccatcatcgaccgggtgcgcgccgggcgggccatcatcgaatcgctggagtcggaggagaagaggatggcgcctccgctcctctacgacttgacggagttgcagcggcacgccaaccggctccatggcttcagcgcgcagcgcacgctggaggtggcgcaggcgctctacgagaagcacaagctgttgagctatccgcgcaccgccagccggcacctgtcacgcaccgtggcggacacgctgccggaggtggtgaacgccattcgcgggccctacgaggaggacctggccgtcggtacgggggctcgggcgctgggcaagcgctatgtggatgacgcgaaggtgacggaccaccacgccatcatccccacgcccacggcgccgggcggggtgcggctgtctccggacgagcagcgcgtctatgacctggtgtgccggcgtctgctccaggcgtggcacgaggaccacgtctggcgggtcaccacggtcatcaccgcggtgacgtcggcaggggcgccgcccgtggtggaccgcttccagagcacgggcacccaggtggagcaggtgggctggaaggtgctggacattggcggcggacagaaggcgccgcggctgaagtcggaggggcgcaagggcgaggacgcggagcgggagccggaggacgagccccagacgctgccgtcggggttggcgcgcgcgcagccgcagtccgtggaggacgtggaggcggtgaagaagcgcacgcgtccgcctccccgcttcacggatgcgacgctgctgacggccatggagtcggcggggcgggcgttggatgagaaggagctcgcggacgcgatgcgcgagacgggcctggggactcccgccacccgcgcggccatcatcgaggtgctgctggaccgcgagtacctgcgccgccggggcaaggtgatggaggccacggagaagggcatccatctcatccaggtggtgcacccggatgtgaagacgccggccatgacgggccagtgggaggcgtggctccagcgcatcgagcgcggcgaaggccagctcgatgagttcatccgtggcatcgaggcgtatgtcatcgaggtggtgggccatggcgccaccgcgccgcaacggcctccgcgcaacgaggtgttgggggctccacctggagcaggttgggggcagggcggcgcggcgcaggtggcgagcgagggcgcggccgcggcgcacggcgctggcgcgggagcgcgtggccctggcgggcagggggcgttcgcggagtcctctgctgagcgtttcggggatgcttcggcggggggggcggggcgtggccggcagggggcgttcacggaggcttctgccgagcgcttcgcggatgccgcgccgggtgtgcagggacagggacgcccgggcgcgctctcggaggcttcggagccgctcttcgggacgcggcggagcaggacctcgggctccgtgggtcgctcggagcctcatggcgagccgctgtcctccaccatgtcaccgggcggaggcgcggcctcgcgtcttcctcgggcggacggcacaggctggaacgccggggcctgggagaacacgggcgctgctcgcgctccagtgaaccgtgcgaggaccccggcgtcagccgcgtccaccgggcagcggccggagcgcgtgcggcgcgcaccgacggcgcccgaggcgctgcgtccgctgctgaaggaggcgttcggcttctcggacttccggccgtatcaggaggccgtgtgccgcgcggccacggcgggagaggacctgctgctcgtgatgcccacgggcgcgggcaagtcgctctgctatcagttgccgggtctggcgcgcgcaggcaccacgctggtggtgagtccgctcatcgcgctgatggaggaccaggtggcgcggctccagtcgctcggcttcgcggcggaccgcatccactccggaagagaccgggccatgtcgcggcaggtgtgcgcggactacctggaggaccggctcgacttcctgttcatcgcgcccgagcggctcggcgttccgggcttcgtggagttcctggcgcgccgcacgcccgcgctcatcgcggtggacgaggcccactgcatctcccagtggggacacgacttccgcccggactatcgactcctgggcgcgcgtttgcccctgctgcgccccgcgcccgtggtggcgctcaccgccaccgccacgccggacgtgcagcgggacatcgttcagcagctcggcctgcaaggccccgggggcaaggcgcgcaccttcattcacggcttccgccgcaccaacatcgccatcgaggtgcgggagctgaaccccggcgcgcgcggcgacgccatccagggattgctcgaggacgaggagaaccggcccgcgattgtctacgcggccacgcgcaagcacgccgagcagctcgcggaccagctcgcgggcgagttccccgcggccgcctatcacgcggggctccagccttcggagcgagatcgggtgcaggccgagttcctccggggctcgctggaggtcatcgtggccaccacggcgttcggcatgggcatcgacaaggcggacgtgcgcaccgtcatccacgcggcgctccccgccagcctggagggctactaccaggagctgggccgcgcgggccgcgatgggaagccgtcgcgcgcggtgctgctgcattcgtacatcgaccggcgcacgcacgagttcttccaccggcgcgactacccggaggcgtacgtgctggagcggctgttcaagtccacggcgccgcagctcgagcccaaggccgtgctccagggccgcgtgcgaggagaccccgaggtcttcgacaaggcactggagcagctctggattcacggcggcgtcgtcatgacgcctgacgagacggtgatgcgcgggaagccgggctggtccgcgtcgtactcggcccagcgcgatcgcaaactgctgcacctggagcagatggggcgctacgcggaggcccatggctgccgcatgaagcagctcgtggggcacttcggtgacacccaggattcgggtgagccgtgcggcctgtgtgatgtctgcgcgccggaggactgcgccacgctgcgcttcgccgagccgacctccgcggagcggcactggctggagcgcatcctggagtcgctccaggagcgggacggacaggccaccggaaggctccaccgcgagttgtttggagagtccctgccacggcgcgacttcgagcgactggtgggcggactggttcgcgccgggctgacgcgcttggaggtggactcgttcgacaaggacgggcaggtcatttcgttccagcgtctcgccctgacggacgagggccggcgcacgcgcgcggtggacccccagcgagtggtcctgccgttgcccctggagaaggccgcgaagcgcaagcggggcaagggcgcggagaagggcaccgcgaagcgggccacggccaagaaacgcacggtccgcgccaaggccggggccgcgacgcggcgcacggcatccgaatccgatgaggaagactcgccgacgcactggcgcgcgaacgctccctcgaagagcaccgccggggcgccacgtgcgtcccggagcacgggggctccgagtggctccgcgtcaggccgccgcgccgcggccgagccttctccgaagatggtggaggccttgaaggcctggcggctcgcggaggcgcgcaagcggcgggtgcctgccttccgcatcctcacggaccgggtgctggaggccatcgcgtcggcctgtccggagaatggctcggagttgatggccatccacggggtggggccctccctcacggagcgctacggcgcgcagattctttccctcgtggcgcgcaggagctga

SEQ ID NO: 9347 - DNA, 1536 bp, Myxococcus xanthus
atgggaggacccgacgagcaggcagacagcttcgcggagcaggcggagttggagtcgaagtctgtcgaacaggaaagcgtcgaagcgcagtggaaggacgcggagaagaaagtctattcagagaacttcgggaaaggcgcgggccccgagtggagccaccgcaccgtgtcccggacgccgaacggagaacgaaagttcctggggcccttcagcgaacaggaagtcacgctcagcctggccggcctgccggaccatgacgaggtcgaggtccagttggagctgttcgtcctcaagtcgtgggacggtaacgacacgacgaaggggccagaccgctgggtcgcgagcgtggacggcggtcccgtcctgctggatgccaccttctccaatgacgacgcgccgttcgacgcacgctacgggcagtcgtacccgaagccctacctccaaggcagccacccgggcctcaccggcgcatcgatgaagggcaagctcgggtaccgggacgagtccggcgatggcagcaaggggtacgccatctaccccctgtccttcaccttccggcacaccggagaccggctgacactccgcttcgcggacccgcctcgaggcgaggccaacaaacagtggggcctggattcggtgaaggtgaaggtccggaagaagaagaagggaggcgacctgctggtcagcaacaacgtgaacagcagcgtgctgcgctacgacgggaagacgggcgacttcgtgggcgtcttcatcccgcccggcgccggcgggctcaacaacccgcaggagctcgtctacggccctgacggcaacctctacatcgccagcttcgccagcagggaggtgctgcgcttcaacgggaagacgggcgcattcatcgacatcttcgtgcccgtgggcagtggcgggctgggcttccccggcggcctcatcttcggtcctgatggcaacctgtatgtcgcagacagctttggcggcaccaacagcgtgctgcgctacgacgggacgacaggcgccttcatcgacgtgttcgcttcgggtggcggactgctcgttccccagaagatggcgttcgacaagaaggggaacctgttcgtcgtcagcatcatcggcaacaacgtggtgcgctacgacgagaatggcgcgcccttccccgctgccggacagcccggtgccatcttcatcccggacatcgacgcggtgacgattgccactggcaagaaccacaagctctacgttggcaccacggccggagacgacgtcctgcgcttcaacgccaagacgggcgccttcatcgacgtcttcgtcgagtcggggagcggtggcctgactgacttcgtggacatggagttcggtcccgacggcaacctgtacatcccggacttcctcccggccacggtgttgcgcttcagcggaaagacagggaacttcattgacgtcttcgtgccggcgggaagtggcggcggcgccaatgcggccaccctgacgttcatgccctcgaagcgaaacaagccgcacgggcgcgaagcgaactga

SEQ ID NO: 9348 - DNA, 1395 bp, Myxococcus xanthus
atggaactgggcttcgagacgattggaaacgccacgctcatctgccacgaccacggtccggtgttggtgaccgacccgtggacggacggcagcgcatacttcgggagttggacgctgtcgcatgagattccggcggcgcagcgcgaggccatccaggcttgtgcctacgtgtggctgtctcatggccacccggaccacctgagcatggaatcgctgggcgcgctgcgctcgtgcacgctgctggtgcccaaccacttcggccaccgcatgcgcgatgacttgcgcgggcagggcttcaaggtgcacgtgctggcggaccgggtgtggacgcagttgtcaccgcgcatccgcgtcatgtgcttgccggacgtgaaccaggacgccgtcctgctggtggacatggacgggcggctgctggtcaacctcaatgacgcgggggaccgcggggccggccacttcgtgcgcaaggtggtcagcgggtatcaggagtcgtatctcctggccctgtccgggtacggcgacgcggacatgatcaacttcttcaccgaggacgggcagcgcatcgcgccccatgccgcggcgaagacgcccgtgggccggaccattgcccggcaggcggagttttacggggtgcgctacttcatccccttcagctccatgcacaagtaccagcgggccgacagcgtctgggcttccgagtacaccacccggctggaggactacggccggggcttcgagtcgcgcacctgttcgctgctgcccgcgttcatccgccacgacttcattcgcggtcagacggagcgaatccagccccgggagcgcgtcctgcgcccggtggaccccaaggccttcggtgacgactggagcgattcactggacacggatgaggtgacggcgctcacgacctacttcctcggcgtggagcacctggggcgcacgctcgacttcctgcgcttccgcgtgggaggccgggagcacgtcatcgaattccagaagcgccgcttccgccggggcatcaccttcgaggtgccacgtggctcgttgatgtcggccgtgcgctaccaggtcttcgacgacctgctcatcggcaacttcatgaagacgacgctgcacggcgacttcggcgcggggcggctctacccggacttcagtccctatgtggccaagtacgcggacaacgggcaggcgcgcacgcgcaacgagctgcggacctatttcgcggactaccgcaagcgcgacccgctgggcttcctgcgtgccaaggtggagacgcattgtgtgcggcccctgcagacgcagtccgcggagctgctgcgcatgctgctgccccaggactcgcggggctaccgtgccgccaaggagaccttctggcgggtccggcgcgctctgctctag

SEQ ID NO: 9349 - DNA, 822 bp, Myxococcus xanthus
taagggtccccgccgctcaccgaagtgggcaccgtgctcgcgcgaggcatcgcggacggcccggacgaggacttcgagacgctgcgcacggtgctgctgggggccctggccacggcgcgaacgtcggtgcgcatcgtcacgccctacttcctcccggacacggcgctcatcaccgcgctgagcgtggcggcgctgcgcggcgtccaggtggacatcctccttcccgagaagggcaatcttccgctggtgcagtgggccgcctgggcgcagttgtggcaggtgctgcggccgggctgccgcatcttcctcaccgccccgcccttcgaccacacgaagctgatggtggtggacggcgtgtggtcgctcatcggctcggccaactgggacccgcgctcgctgcggctcaacttcgagttcaacgtggagtgctacgacaccgcgctggccatgcagttggagggcgtggtggccgcgcggctgcgcaacgccgggcctcacggttggagcaggtggacgcgcgcgccctgcccatccgcctgcgggatgggctggcgcggctgctgtcgccgtacctctagagcagagcgcgccggacccgccagaaggtctccttggcggcacggtagccccgcgagtcctggggcagcagcatgcgcagcagctccgcggactgcgtctgcaggggccgcacacaatgcgtctccaccttggcacgcaggaagcccagcgggtcgcgcttgcggtagtccgcgaaataggtccgcagctcgttgcgcgtgcgcgcctgcccgttgtccgcgtacttggccacatagggactga

SEQ ID NO: 9350 - DNA, 603 bp, Myxococcus xanthus
atgaagcccacctacacagtcgccgccgtgcggaaccaggacgagttggagcacatcctggcgctgcaacagaagaacctgaagcaggcgctgtccgcggacgagatgcgctcacagggcttcgtcacggttcagcacgacctgccggcactggagcagatgcacgccatggcgcccagcatcgtcgcccgccacgatggagtgctggtggcctacgccctgacgatgccgcgcgaggcccgcgcgctggcccccgtcctggagcccatgttcgcgctcctcgattcgcttgagttccgaagcaagtcgctgcgcgactaccgcttctacgtgatggggcagatctgcatcgacaaggcgcaccggggacagggcttgttcgaccggctctaccaccagcaccgggaccacttccgagatcagttcgacctcatcgtcaccgagatttccgtgcggaacctccgctccctgcgcgcgcacgagcgggtcggcttcgagacgatccacacctaccgggacgcgacggacgaatgggccgtggtcgcctgggactgggcgccgccgcgccccccggacgtcacgcccgaggggaacacgcgctga

SEQ ID NO: 9351 - DNA, 339 bp, Myxococcus xanthus
atgaacggccggttctacaacttccagatcactgagtgcttcggcgaaaggacggagcgggtgtccgaaccgcataaccaccgcgggacgaatgctgacgccgccgaggttcgcgcccatgtcgaggcgttcgtcaacgctgccgcgagattcggaacgttggacccggaagtgaaggccgccggtctggccaacctgaacaccctgattgagggccgctcgttcttcggctgctcctacggctacgcccgtgacccctggagcggccacggcgcgacgttcttcgtcgacaccgagtccggattcagcgtgtacacggacagctactgggcggagtga

SEQ ID NO: 9352 - DNA, 381 bp, Myxococcus xanthus
atgcactacttgagcctcacggctgaattcaaagcatcccacgcagtcaccttcccggacggccagcgcgagcccctgcacacgcacgactggtgggtccgcgtctgggtgaaggcgcgagcgctgaatcattgggacgtcatcatcgacttcaaggatctccaggacatcatcgttcgggtgtgccgggagctgcatgacacgaacatcaacgagcacccctacttcaagacggtgaactgcacggccgagcgcgtcaccgagtacgtcttcaagcaggtggagtcgggcctgcccgagggcgtcacgctcgaccgggtgcacctgcgtcggacgggcggcgagcttccagaggccgagtacgcgcatgcgagggactga

SEQ ID NO: 9353 - DNA, 756 bp, Myxococcus xanthus
cgcgtgaaggtcgagggcctgagccgcaccttcccaggcaacatcgccgtgctgtcggggctggacctggacgtggcgcccggttcgttcgtggcgctgctcggtccctccgggtgcggcaagtccacgctgctgcgactggtggccggactggaccgcgccgaggccgggcacatctccttcaccccgacgctggagcgaacccagggcgagcgcgcccccatcgcctacgtcttccaggacgcgcacctgctgccctggcgctcggtgctggacaacgcggcgcttccgctggagctgaccggtgtgtcgaaaccggagcggcaggccgccgcgcgcgccgtgctcgagcaggtggggctcggtgatgccaccgaccgctttccggcggagctgtctggcggcatgcgcatgcgcgtgtccctggcacgcgcgctcgtcacccacccccggctgctgctgctggacgagcccttcgccgccctggacgagctgacgcgcggccggctggatgatcaactccgcgcgctgtggcgcaagctggggatgaccgtgctcttcgtcacccactccattccgaaagccgcctacctggccgagcgagccgtggtcctgtcgcgacgtcccgcgcgcgtggtgctggatcggacgctggagctgccaggtgagcgcagcgcgtccctgcgcacagaggcgtccttcgcccgcgaggcccgcctgctcaacgaggccctggaacaaggagagcgctggtga

SEQ ID NO: 9354 - DNA, 522 bp, Myxococcus xanthus
atggtggagcgcgccctctacccctacacgctcttcctgcagacagtgcccatcgtggccatcgccccgctgctggtgctgtggttcggcccgggccctcgcgccgtcgcggtgtcgtccttcatcgtctcgctcttcccggtcatcgccaacacgctcaccgggctgcgctcggtggagccctcgctccgggacatgttccgcctctatggcgcgcggcggctcgccacgctgtggaagctggagctgcccgcggcgatgccacacctgttcacggggctgcgcatcgcctcgggcctggccgtcatcggcgccatcgtcggcgagttcgtcgccggcttctccgagggcaccgcggggctgggaatcctcgtcctggccgcgtaccgtcaactgcgcacggatctactgttcgccgcggtgctggcggcctcggggctgggcttggtgttgttcggtgtcgtgagcctcaccggcgcccggctgctgcggcgctggcacccgtcggcgcagggaacatga

SEQ ID NO: 9355 - DNA, 888 bp, Myxococcus xanthus
aaggtgcggctcgcgctcaactgggtgccggagcccgaattcggcggcttctatgcggcgcgggagtcgggggccttctcccgccatgggctcgaggcggagatcctcggcggcggagccggcgcccccgtgccgcagatggtggccaccggcaaggtggagttcggcatcagcggcgccgacgagctcctcgtcgcgcgggcccgaggcctggacgtgattccgctgttcgcggtgtatcagacgtctccgcacgccatcatggcccacgcatctcggggggcgaagaacatcgcggacgtgctgtcctcgggcacagtggcgctggagccgggcctctcctacgtggccttcctcaagaagaagtacagcttcgacaaggtgaaggtggtgccctacgacgggggcgtcgcgcgcttcctggcggacaaggacttcgcccagcagtgcttcgtcaccgccgagcccatcgccgcgaagcggcagggcgccacgccaacggtgttcctggtggccgaggagggcttcaacccgtacctcgccgtggtcatcacgcggcgccagtactggaaggaacagcccgagcgggtgaagtccttcgtggcggcggtgcgcgaggggtggcggacctacctggacaacccggggcccaccaacgcggtgatgggaaagctgaatacgacgatggacgcggagacgttcgcggagggggccgagacacagaagccgctcatcgagacggaggagacgcgagcccgaggactgggcacgatgaaccgccagcggtgggagcaattggcccagcagctcgtggagctggacctcatcgagaaggcgcccgccgcggacgagttcctgctgccggagttcaccggctcacgcgattaa

SEQ ID NO: 9356 - DNA, 501 bp, Myxococcus xanthus
atgcgcaagtccatcgacggcctcatgtcgctggtgcgcaccgccgctcaccgcgagctgcgtcaactgcacagcgcccccgtcctcacgcaactgcacgtctggctcgaaacgcaggcgccgcgccacctgcccaagagtccgctgggccaagccatttcctacgcgctgaagcagtgggaggccctcacgcgcttcatcgagaatgagcgccttcctctcgacaacaaccgcgcggaagcggcgctgcggaaggcggctctgagccgtaagaactttctcttcgtcggccacgaggccgccggggaaaacctcgagggcctctacgccctggttgccacctgcgcggccaacggcgtcaaccccgagacgtacctaaccgacgtcctgctgcgcgcgcagacgcatcccaactcccgcatcggcgagctgctaccccacgagtggaaatgtcgacgcgtcgccgagccgcctgactcagtcctccagcccagtccctga

SEQ ID NO: 9357 - DNA, 303 bp, Myxococcus xanthus
atgattgccgactcaccggagatgatcgccgcgatgaagcagatgggccagccgacctctcacgcgacccgttcccgcttcaccgaggtggcgccacattcgcgactcgtcctcacgaacgtcatcgacttcctccccggtgtcgctccctacgagagcaagatcgccgtggacttcctccctagcggcgacggcgttcggatggtggtgatgctggacgcgatgcacagcgaggagttcacgaagatgcagcaggaaggcttcacgagccagctcacgaagctggactcgcgcttcgcctga

SEQ ID NO: 9358 - DNA, 729 bp, Myxococcus xanthus
atggcgcagaacatctacgacgaccctggcttcttcgaaggctacagccagttgcggcgctcgatggaggggctcgcaggtgcaccggaatggcccgcgctgcgggcgatgctgcccgagctgcggggcctccgggtgatggacctcggctgcggctacggctggttctgccggtgggcccgggaacaaggggcactgcaggttcacgggctcgacgtctcggcgcgaatgctggaacgggcccggcagctgacgtccacccgcgacatcgtctacacccaggcagacctggagacggtggaacttcctcgagccagcttcgacctcgtctacagctccctggcctttcactacatcgaagacctgccgagcctgctcgcgaaggtgcacgccaccctggttccgggtggcgcgctggtcttctccaccgagcatcccatctacatggctcccacccatccgggctggcgagtggatgaacaaggccagaagacatggcctctcaatggctaccaggccgaggggccccgcaccacggactggctcgccaagggcgtcctcaagtaccaccgcacgctgggcaccttgttgaacgccctgattcacaccggtttcagtctgcgccaggtcaacgaatggggtccgaccgaggcacagctctccgcccagccggaactggccgaggagcgggagcgccccatgatgttgctcgtgtccgcgcggcgttag

SEQ ID NO: 9359 - DNA, 160 bp, Myxococcus xanthus
atggcccgtgcggccggactcctgcgactggcggtggtctcccccagacaggtgacccgcgtggagcgcaccacggtgcggcactgcgcccagacacgggacggctccctgtacgtcctgtccactgcgacgcacgacaatgatacccctgtcacaatga

SEQ ID NO: 9360 - DNA, 150 bp, Myxococcus xanthus
atgtacgacctctatgagctgaatgggatccgaacgggacatgtcatgaacttgctactctaccacttgttggacgctgtcttcatctacaacccggcggtcctgcgcacccagagcgagaccgcgcacgtgagcagcgcgctgcgctaa

SEQ ID NO: 9361 - DNA, 201 bp, Myxococcus xanthus
tctaaggtgctctggttcgcggcacagttgaatgtgaagggcgacggaggcttgcccttcgacgtgcctcagcgactgggcaaggcgcgccgcaccctggtcgagctgcgtgacccggcctggcgttcgtacctggcgtggttcgaaatctacgctgcgctcgcggcgcccgccgccgaggaggcccgttcggccccgtag

SEQ ID NO: 9362 - DNA, 264 bp, Myxococcus xanthus
cccctcctgggggagggcgcccacggacagggcgcggggtgtccggagctggcgcaggagctgtcggagttcgccgcggaggaggtggaccaggccgcctgtgtgcgcctggaggaccatctgtcccgctgcccccgctgcagcgacgcgtgtgacgcgctcaagcgcacggtgtccctgtgccggcgcatccccggggatgaggtccccgcgcccgtgcgcgcggcggtacggcaggcgctgtcacgcgcgctgcccgcctga

SEQ ID NO: 9363 - DNA, 168 bp, Myxococcus xanthus
atggtggtgctcaccacggtcatgcccatggccatcatcaccacgacatggttcctgccgccgggatggaacctgctcggaacggccgccatgctcaccggcttcctgctggtgttgggaaaggccatcgcgggcgtgccgctggcgctgctcatcagtgagctttag

SEQ ID NO: 9364 - DNA, 313 bp, Myxococcus xanthus
  unsure (1)..(313): unsure at all n locations
gagcgcgccgtcatcttcgcggatggcccggtggtgacaacgggactcctggggctggagctgcccgacacggcggacagcttcggagcgtccaccgaatccgccgacaggagcnccggccgccgccgaggaagccagcggcgcctcaccggaatccatggaggagtacttccgccgcttcgtcatggagcaccaggagcacatgggcgagacggagctggcgaagcgcctgggcatcagccgcaaggcattgtgggagaagcgccagaagctgggcatccctcgcacgcgcgcctgaggcacggcgccctcg

SEQ ID NO: 9365 - DNA, 249 bp, Myxococcus xanthus
atgaacaacaccaccgccctgatcatgtacaccttcgacatggacgccatgcccttcttgatggtggaccatgtgtccaggatagtgcccctggagcgcaagtccatgtggtacacgctgctcaagagggcccacgacccggatgatacgagcctgccctgccggctgtaccagaaagtcgtggataagtccatatggcgccgtcatgccgtggccctgaaacactgcggccagcgcacgtccgagctg

SEQ ID NO: 9366 - DNA, 111 bp, Myxococcus xanthus
atgctgtactcctgttcggaccacggcgtggggctgcgcgtgaccctgcgggcggtcttgagcgtgttcttggaagcggttccgaccaccaagacgctgagctacggctag

SEQ ID NO: 9367 - DNA, 309 bp, Myxococcus xanthus
gtgcgcgtgctcggcctgtgtgctggcgcggttgacttcgtcttcgggtccgcgtccatggccggactgtccgcgcgcattgtgagcgtggtgcgccgccccggcgcttcggagcgcgtgcgcgagctgtttgctcgttgcacgtctgtcgcggtggtggaggtgatcctcttgagcgcgggcgcggtggtgctctccggcgagtcgcccgaggtggcgttgctgtttgcgggtgtgggtcaccttctccgccctgggggctgcccttccctccacagcaggtggtgggggttctcgggctggggctaa

SEQ ID NO: 9368 - DNA, 362 bp, Myxococcus xanthus; identical to SEQ ID NO: 1416

SEQ ID NO: 9369 - DNA, 1449 bp, Myxococcus xanthus
atgctcctgccgctcgtcatcttcacgagcggctcggcggccctgcttctgggcacgagcggcctgattcctgcgctctggggccgctatctgctggggagccagctcacgctggtgggctcgcactgcatcctgcccgcgctcgcctggttcatctccgacagcgtcctggagaaccggatgcgctggttccgctggagcgcctgggccgcgtgcgtgccggcctcccttcaagtcatcatcgtgatggccgacctgggcatggcgcagcggaaccttggcctcttcgtcctctactcggtgccttgcctgctcgggtgcgtcatcgtcgcgggaatctcagcgtggcggggcaaccccgacgcgcgaatcttctccatgggcctgggcgtgttcttcggtgtcgtcatccacaccacgctgccggtgttcgggctggcggaggccacggactccctcatgcactggggcttcctggcgctcacgctctcattggtgggcatcgtcgtgcgccgctcggtgctggtggtgcgcgcgctcgcgtcgcacacgcaccagctcgaggagcgtcgtcatgaagtgaagcggctcgcccaggacatggggagcggcgctggcgagctggccacggtggcgcaacaactgcgcacgtccagtgaggttcagacagcgggggtcagccgacaggccgcggcgctccgcgaggcggagcagacggtccaggaaatccggcagggctccctggtgacggcgaacaaggcgcggcagctcgcgggctccatcgaaaccgccgaggaggcggggcgcgatggcggcgcggccatcacccacacgttgaccaatctggaagccatccgccaggaggtctccgagatgtcgagccacatcctcgcgctggacgcacgcacccgcgaaatctccagcatcgtggacaccgtgaagggacttgcggaccagtccaacatgctggccatcaacgccgccatcgaagccgcgcgcagcggggagcacggccggggcttcggcgtcgtgtcgcgagaggtccgcagcctcgccgaccagtccatcctggcgacccatcgcatccgcgaggtgctcgacggtgtgagtctgagcatgcgtgaggccgcgaagaggagtgaacagggagagcaacgcgtgaaggcgagcctggacgcggtgcgcgtctccggcacccagctccagcggctcacgggcatcatcgacgacaccggcaccaatgtgcggcagatttccgcggcggtggcgcagcaggacgcgggcacctcccagattgcccaggccattcaagaattgtccgcccagatgcggcatacgctgcgcaccgccgaggagactcagaaggtgtcgggttcggtgcaagcgctggcggagaacatggcgggcacggcccgcatcgcgctccagacgggaacactcgatgactga

SEQ ID NO: 9370 - DNA, 83 bp, Myxococcus xanthus
atgagcgggagctgcatggagctgaactatcccttcaccaccaatggcatggcgacggacaaccggttcgcctggcgctccct

SEQ ID NO: 9371 - DNA, 316 bp, Myxococcus xanthus
gaaccgtactctggcgggcacaccgacggagcgaacctcgtggtggacatgtgctccgactcctcgcgcgagtgggtgctgcactcgcaggaggtgttgcaagcgttcccccacatgttgtgcaaccaagacctctacgcccgcggcgtctacgcggacctgcccattccggggcggccgcatgacgtggacctgtccactgctgaccgcaccggggaggggctgcttaacatggcgccgatctttctggtgatccccaacttcacaggctggatgcaagtggccagctactccattgcaagagagctcgagccca

SEQ ID NO: 9372 - DNA, 138 bp, Myxococcus xanthus
atggacatactggatgaggtggaccggctggacaacgacaatctggacctcaatgaggcgggtggccctgaagtagagatcaacgtacactccttcgttgccgactgcatacttggcccgttccgtacactggggtga

SEQ ID NO: 9373 - DNA, 519 bp, Myxococcus xanthus
gaattcctcgccatcaatcaaaagcaagagataggctccaaagttggtgtgcccccgagcgtccgcttgcattccatccagataggcagtggggacgacagtgcgagcctcgcagcggacccaacgcgcattggcaacgcagtcctaatcaacagcactagtgccgcgtgcgacattgaaatgcccctttccagtagcaagcgggacatggagaaggtctcaccccagtgtacggaacgggccaagtatgcagtcggcaacgaaggagtgtacgttgatctctacttcagggccacccgcctcattgaggtccagattgtcgttgtccagccggtccacctcatccagtatgtccatctggaatgtttcatccagcggcaacaccagaagatggaggaggaagcaccctccgggctgtttggggacgcggtcattgcgctgctggaacacaatctgttgccggtcgcggtccctaccggtaagacctttcattccaccgatgacgaaaccgccacgttc

SEQ ID NO: 9374 - DNA, 185 bp, Myxococcus xanthus
cacccgtatcagccggttctggagcaggtgcagcccctggtgaacgtctatgataagctccccgagccggatctgcctgaagacctgaaggtgaatgtggtcccgcatcatctccaccgcgtgaacttgctgaccttgctccgggaggcgggactgggtgaagtgctcgccgaccacacgcggct

SEQ ID NO: 9375 - DNA, 288 bp, Myxococcus xanthus
gacctgcccgcgctgggcgagctgtgcgcgttgcagcgcaagcgcgccgacatggcggggctcgccgacgcgctggaggtgcgcgcgcgggtggccgaggcgcagggcgacaagcggctggccgcggcggcgctgcgtgagctggccggagtgctggaggcccggctgggccgcgtgggtgacgcgctggtggcgctggagaaggccgcgcggctggcgccggacgccgcggtgctgctggacctggcggacctgtcgctgctctgcgagcgcccccagcatgagcgg

SEQ ID NO: 9376 - DNA, 381 bp, Myxococcus xanthus
ttccaacagacgctgggccgacggtatctgggggcccggtgcaccaacccgctggaccaagactatcacccgggcggtgggtcgctcacctaccgcaagggcgcggtgcacccggagattctcgacatggacgtgctgtccgagatcatgttcgcgggccacgtgcttctggacatcgggcggatggtcagtgaccacgacgatcgtatccaccggaacctcatccgggtgggcgacttcaatgaccacgcccatgctggtggcactgcgcacgacctcaccctcgatgagagctctggagacactaacgtgatcagggctgagcttctgcactcctgcgccctgctggggggggggccgcgctacatacgggcctacaca

SEQ ID NO: 9377 - DNA, 126 bp, Myxococcus xanthus
atgggcaccaacctgttgtcatgcaacaaccactccgtcaagcgctacctcgactaccagctgtgtccggaaagcccgcgctctaacttggagtgccgtctgtcggaacaggcgtgccagaacctc

SEQ ID NO: 9378 - DNA, 114 bp, Myxococcus xanthus
atgcagttcgtcgagtaccttctgaaggggttcggtgagtccaaggtgcacaacctggtggatattcagggcgggcagttgctgccgctgctgaaggtgaccctgtgcttctag

SEQ ID NO: 9379 - DNA, 194 bp, Myxococcus xanthus
atgcgggtgcaccaccccatccagaccggcaggcggatgggcgaggacttccccgtgcgtacgccgcgggagacccatgccgactgtggcttcgaccaggatgactgggaggtcctccacctggaaaaccacctgcccgaagaacatgacctgatggagcttctggatgtgcccctgcaaaatgacccggccgc

SEQ ID NO: 9380 - DNA, 2667 bp, Myxococcus xanthus
gcccgcttgcgcggccggctcgtgcgcccgggggacgcggactacgaggagcactgccgcgtctacaacgccatgattcacaagcggccagcgttgattgcccgatgcgccgacgtggcggacgtcctcgcggcggtggagttcgcacgcgagcagggcctcatgctcgcggtccgtgggggtgggcacaacggtgccggcctgggcacctgcgacggggggctcgtcgtcgacctgtcactcatgcgcggcgtccgggtcgcccccgaatcaggcaccgtgcgtgtcgcgggaggaagcgtctggggcgaagtcgaccatgccacccacgcgttcgggctcgccgttccctcgggaatcatctccaccacgggcgtcgggggcctcaccctgggtggtggcctgggccacctctcgcgtcgctacggcctcaccatcgacagcctgctcgccgtggacatggtgctggcggacgggcgcttcgtcaccgcgaacgcccagcagcacccggacctgttctggaccgtgcgcggcggtggcggcaacttcggcgtcgccacgtccttcctcttccaggcccacccggtggacaccatcctgggagggccgacgctctggcccctggaacgcgccgaggaggtgatgcggtggtaccgcgagttcatccccaccgcgcccgagacactcaccggcttcttcgccttcctggtcgtcccgcccgcggcgcccttcccgccccacctgcacttgcagaagatgtgcgcggtggtgtggtgctacaccggagacccggctcaagccgacgcgctcttcgcgcccgtgcgcgccatggcccccgcgctcgacggcgtgcagaccatgccctaccccgcgctgcagaccatgttcgatgcgctctatccgccgggcctccaatggtactggcgcgcggacttcgtgcgggagctgggggacgaagccatctcccgacacgtggcgttcgcccaccgactgcccacgatgcactccaccatgcacctctatcccatcgacggagcggcgcaccgggcggcaccaggcgacaccgccttcagcttccgggacgcgcggtgggcggaggtcatcgtcggagtggacccctctcctgacaaggccggggacatcaccacctggacgaaggactattggaatgccctgcatccctattccgcgggcggcgcctacgtgaacttcctcatggaggagggccaggaacgcgtccaggcgacgtaccaggacaactacgcaaggctggtggaagtaaaggaccgctacgacccgaacaaccttttccgcgtgaatcaaaacatccgccccagcaccggcacgccgcttcgccattaagcaaccattcgcacgcgccattgctcgcccggagcggcctcggttggtaccttccgtgcccgcagttcgctccaccaccaacggcgaggagacagaggcatggcgacgggcttcgaggcttacaggatggaggaccccacgctcctggcgaatgtgcgcgaggccctgctgcaatcctacttcgcggacttcgatgcaggcttcctgaagtcgccggccggccagtcggacatcgcggaccatgtggatggccgttacaaccggtgcatcgaccacgtactgccctggctcgcgcgctacacgaagctgggcaaggcgaacgtcgtcgagctgggctgtggcacgggctccagcacggcggcctttgcccaggttgccagccacgtcacggggtacgacatccacgcgccctccgtgcgcgcggcccaaagccgcatgaaggccctgggattgcgcaacgtcgacacgcgcgtcgtggaacccgcgaagttgctggaacaactgaggcaggagaacccccagggcgccgacatcttcgtgctgtacgcggtgctcgaacatcagacgcccgccgagcgactggagacgctccgcaccggctgggacctgctgcgtcccggaggactgctcgtcgtcgtggatacgcccaaccggctcgtgtacttcgacgcgcacacgtccctgatgccgttcttccacttcctgccgcctgaactcgggtggccgtatgcctcgcgttccccccgcgagaacttccgagattcgatggcccaggcgtctgccaaagacgcccccatgctgctgacccgatggggcatcggcgtcagccaccatgagctcgagctggcgctgggggacatcgaccccttgttggtggggacgggcttcgagccagaagtgctcgacatgttccctgtcacactcgacgaagaggtgctgcgtctatacgtggagaagagcggcgctcgcgtacccaaggccctcacccggaacacgctgaacttcgttcttcgcaagggcgacaacgccgacctcatcgcccgccggccttcgccgcctccggttcgacacctcgtcaacgagacgtcgaacccggtccaggcgcaacgcctccacgaactggaacatcgtctcctggagcaggcccagcgcatccgggagctggaagagcacatcgccaccccgcccctgcgacaccaactcgttgatcagctcaacggcgccctcaaacagacggcccttcaccgtcaggcccggaagctcgtcgaatggtcggtgggccgcgtcaagcgcgcctcgcgctga

SEQ ID NO: 9381 - DNA, 87 bp, Myxococcus xanthus
atggtgctggccgtgcttgcccatgacatcctggttgtgatgttcgtcgtggtggtgattaagcacacggcgttctcgttgctgatg

SEQ ID NO: 9382 - DNA, 324 bp, Myxococcus xanthus
aggcatgttctcgtggctggggctggaattggtggactcacgctggcttgcgcgcttcggcgcgcgggcctctccgtcactgtcttcgagcgctccgacgccttgaaatgggtgggcgcgggcctcacggttcagatgaacgcctcggcggccctgcgccgcatcggcctgtgtgacgaggtggcccaggccggtgcgtgtcccacggacagcgcgattctgaagccgtcgggttcggcgctcacgcggcttccggtgactcggattcaggaggagctggggctgcctctggtgtgtgtccacagggcgcggctccagtccgtg

SEQ ID NO: 9383 - DNA, 362 bp, Myxococcus xanthus
gccgccaacaggtacagcgacggaggccgcgccgactaccccacccacgaccacagcgacagggccgccccgcgagcgcccccccacaacccgagcacggcccagcacacgacgcacgtgaacaccgaggccgggcagcgccacccgctcgggcacgtgacggccaacgcgctcgaggccccggaacgctaccccgccctgcccaaccacacgaaccggccgcccgggcggccctaccaccgcccgaccgcggacccccacacgcccaccttcaacccccacgaggcacacgagcaccagctgccgaacgacaacatccaccacctgggaacgactgaccacgacgcgggcctgacccaggc

SEQ ID NO: 9384 - DNA, 402 bp, Myxococcus xanthus
tcccaggtggtttcctaaggtagggtgtgccacatccagaccaggagtgagcagttgtcgtccagcgacatgtatatgtcggacctcagggcgtgctccttcacgggtgatgcctggtttcccaccgggtacatgactgtcattcagcacggccacatgtccatcaagagccaccacaaggagttcttcatcctacagggcaacaaggtctactggcagtacatcaagcaggtggtgcagttgatctctggcgtcatccggtcgtactccgtggcctgccacattcggagcggtgcgccacagacggatgatctggctgtctggttcgtgccccaggtgcatgcacagatgctggcgcagatgctgcaaagcctctcggagaaggtgcgtcgtggagcttga

SEQ ID NO: 9385 - DNA, 228 bp, Myxococcus xanthus
ttctgcctttgcctgcggcgcaccgcctacctcgcgtgcaaagagaacggcgacgagggcaccgcgctctcctaccccatgatcggacagaagaggaccttcaagctgttggaggaaatgtacgggcgcctggggacgctggacaccagctacttggtgttgcccgcgatggaccaccgcaacgcgctcgactgctataagggactggagccactgtcccgctcctag

SEQ ID NO: 9386 - DNA, 252 bp, Myxococcus xanthus
atgcgctccctgtacgcgcagctagaggaccctttcccggtggtgctgacggtggcagtcacggtaacgcttctgttgatgacgcaccccatggacgcagcggccatcgcccagccgtacaagctggcgtccgatcgcgtggtgcatcttagcgttcagcacgcggtcgtggtggtccagagccatccccgggtcacctcggaccggctgttggatacgcccgaaatcctcctcctcttctttcgaatgtag

SEQ ID NO: 9387 - DNA, 369 bp, Myxococcus xanthus
ctcgcctccgcggagctgtacgacccgggcacccaggcgtggaccaccgtggcgtccgcggccggggcgcgcaccgcgcacgccgccgccctgctgccggatggacgggtgctcatcgcgggaggacgtgacgcgggtggagcagccctcgcgtcggcggaggtgtacgacgccaccaccaacacctgggcgcccgtcgccggcctcgcccagggacgtgagcgcttcacgctgacgctgctgcccgccggagagctcctggcggcgggcggctccgcgggaggcgtggcgctcgccaccacggagcggtactcggccgccgcgaacacctggacgccggacagcccgctgacgcaagcgcgctggcgt

SEQ ID NO: 9388 - DNA, 243 bp, Myxococcus xanthus
atgcgggaggtgaccagctgcaaccatgagggcatgccggcccacataggcaacaggagccatgaataccacaagagtgcgctggacctctaccacgcactgtcctacaccaacagcatcccgttgtggctgcttacgccgaacgaactcatgaacgtgcgcgggcgttactacctcaagggccatggcttgagcttggtcaccacttgcaacggtctgctgtacatgtggatgactgggtag

SEQ ID NO: 9389 - DNA, 501 bp, Myxococcus xanthus
agtgttccgaagatgttctcgctcctggcgggcgtccacatgctgggcgtgggcatgttcgtggtcgcgcacgtggatggtcaggcgcgcccgctgcgcgcgaccacccggccttggtccgtgttgcggcccggcgcgctgcggggcttccgctggatggtgttcctgctgggggcctggagcgcgctgttctggggcttgcaggtggggtcctcggacctgccgctgaagggcctctccctgcggatggccaccctggcattgccggcgtatggcgtgctcttcctgtcgctggcggtgtggttggggcggaaggtgcgcccggaccggctggccacgcccgtggcggtgcgcttgatgttcgtggcttccgtggcgctggcctcggcgctgcctccgttggtggcggtgttgatgggattcgatggggatgaccccatcctcaacctcttcaaccccgtggtgggcatcgcgaacttcgccacgtatgactacctttag

SEQ ID NO: 9390 - DNA, 504 bp, Myxococcus xanthus
gtcgcgctgtcgctgctgcccggctgcgccaccgtccccaagccgtcgatgtgcttcgccgaggcgggccccaacgcgcgctcgttccccacgccggacacctggttcgcgctgctgctccacggctacgacaaggacacgggtgccaacccgcgccccagcgtggactgcgccggtgccccggtgtggtggcaggacccggccgcggacgagtgcgtggaggccggtccggactcgcaggccctccctcccgcggagaagctctccgaggaggacctcgtcttggagacgctccaggcgggccagcggctggtctgggtgcagacgcggcgcttcaccaacggcgaggccctgggcccggtggccctggtggagagcaccgagcagggcttccgcgtggaggccctgggctcgctgcgcgccatggcgaagcacaccaagctgcgcctggagaaggtgaagggcacgccaatcctcgtcgcggaaggtgacgcgtgcacctcc

SEQ ID NO: 9391 - DNA, 302 bp, Myxococcus xanthus
atgggcccgctcatctccgcgcgaagccacctgaaggaccagacggactcgaccttgggctggatcctgcacacgattgaactccacgacgtgatcgtgctgttgtccaccttgttctccaacatgcatgctcgcttgcggcataaccacgagctgcaggcccgtgaggcgcagctcttccaggaccccttcgaccgccggacggagacgacacccatctgccaggtgaggctgatgcggctgtcctccgaggcggaggtgcgcccgaacaagcagacagtggaagaccacgcccggctgga

SEQ ID NO: 9392 - DNA, 171 bp, Myxococcus xanthus
atgcagtttgctgaaagcgactcgctgaactgggtgcgggccatgttccaacagccacgcatgcacgagatgaccgtgctgacggtggtcttccgctatgacgaccagaaggtcgttctgcactgcatgattggaatgccttacaccatgggaaacatgcgggtgttatag

SEQ ID NO: 9393 - DNA, 126 bp, Myxococcus xanthus
atgaactacaacgtgtgcgtgctgtacgatctgtggtggcgtaccaaggactccgtccagtacatgcataattcgatgaccgccaacctgcccaaggtgatcgggtgggttgacaccgacctcatg

SEQ ID NO: 9394 - DNA, 447 bp, Myxococcus xanthus
aagcccttctacatgctgaagttccgctccatggtggtgaacgccgaggagctgaaggagaagctggccgcgctcaacgagcagacgggccccgtcttcaagatgaagcacgacccgcgcatcaccggcatcggccgcttcatccgcaagttctccattgatgagctgccccagttcatcaacgtgctgcgcggggagatgagcatcgtcgggccgcgcccgccggtgcccaccgaggtggccaagtacgagacgtggcagcgccgccgcctgtccgtgcgtcctggactcacctgcatctggcaggtgtcaggacggaaccagatctccttcgaggagtggatgtacctggacatgcagtacatcgaccactggagcctgacgagcgacctgcgcctgctgctgcagacggtgccggtggtgctcacgggccgcggcgccagctag

SEQ ID NO: 9395 - DNA, 330 bp, Myxococcus xanthus
ctccagagggggcggggggtcataaccaaggttccagaagtcctcttccacaaggaggggaccctggcccattacgattttgaagttgcggatctggccgctgatgacgacttcccggtgatggtggtgaagtccatgccccagcacgggaaggacatgctcggggacacgaaccgggcgcccagcactgtggtggagctgctggccgacatagacctgctgggccatctgctggcggttgagggcacgattctggtgctgtgccggcgcccgccgctggacgagctgtttcacctctgcaatgagtggacccgatgcccggggatataa

SEQ ID NO: 9396 - DNA, 113 bp, Myxococcus xanthus
atgggcaagaccattggtaacaagggccgctcgaacgacgccttgctgctggccaacaacatgctggtcaaggcgagacccgtcaccaacgcatgcatgttgacgggacagga

SEQ ID NO: 9397 - DNA, 93 bp, Myxococcus xanthus
atgaagcccgacatcatccgcttcttacgccagccgtgcgggattgtgggcgcattcgagcacgcggacctattttggctcgtgatcggctaa

SEQ ID NO: 9398 - DNA, 171 bp, Myxococcus xanthus
tctaaagacgacatggtggtgttcatccacacgcacgtggacgaccagaccgagctgctccccagagggggccacgacctgggcaccccggtgcgccggctgctcttgctgacgccgctcgttccggagccaagcgcgcaccggacaacccatgaccattcggaccgttag

SEQ ID NO: 9399 - DNA, 552 bp, Myxococcus xanthus
gagcgcgggctgcgtgaacgtgtgccccaggcgtgtgagacttcgtttccgttccaggtggtggtggatgcgtcggagcagctcaatcccgacgcgcgcgggcgctcgctgcccaccgtggtgcagatcgtccagctcaaggacagcgtccggctggagcgcgcgggcttcaaggacctgtggggcaagccggaggagttcctcaaggaggacctgctccaggtggccgagctggtgattccgcccggccgccaggtgaagcgctgggtgcagcgtgatccgaaggcccgcttcgtcctggccatggggcacttccggcagccgctgggctattcgtggcgaacggtggcggcgctccccgtggtggaggaagcgcgctgcgtggagcgccccgcgggtgaccagggcgaggcgaagccgggggacgaggtcttccgctaccggctgcaaggctatcagattgacctgatgttccggcccatgacgcaggcgccggagcctcgactccaaccccaagcaggcgacggcgtgtcaccgcggagaggtgtatga

SEQ ID NO: 9400 - DNA, 72 bp, Myxococcus xanthus
atgatcagtgacgagccccaggtggtcggtgtgggagcctcggtgatcttcatggcgccccaacaggagtag

SEQ ID NO: 9401 - DNA, 1674 bp, Myxococcus xanthus
atgcaatccaccctgacgcggcggccccaggcgacggcattcagcatcgaggatctgctggaccgcgtccagcgcggtgaggtgcggctgccccacttccagcggcccctgcgctgggaggccggcgatgtgagggatttgctcgacagcgtgtaccgcggctatcccattggcacgctgctcttctggaagcgcgaggctcccgccgccagcgtgagcttcggcccggtgcgcatcgacgcgccctcccacagccaggcgctgtgggtggtggatgggcagcagcgcatcaccgcgctggccgcggtgctcctccacccggagcaggagcccgccgcgcgggacggcttcacgctcttcttcgacctggatacacacgaaatcgtccagcccgcgcacggcgagccgacgcctccgcactggctgccgctcaaccgggtgctcgacagcgagcagctgctgggctggctggaccgctacccggggcgcgagaagaacccagagcacgtgcgcgcggccatccgtctgggcaaggcggcgcgcgagtaccagatgcccgcgtacgtcgtcgaagccgcggaggagaagacgctgcgcatcatcttcaagcggctcaacacctccggaaagccgctcaccgacgacgaggtcttcaacgcgctctacggcggcaccgcgggctcgcgactgcccaacctgaaggcgctggccaccagcctgctggagctgggcttcggccgcatcgatgaatccctgctgctcaaggccgtgctcgcggtgcgcggcctggacttcacccaggacttccagaagcagcttcgcgaggaggacgacctcacgcagacgctgctccagacggaagcggccctgcgcagcgtcatcgtcttcctcaagcgcgacgcgggaatcccccacgggcgcctgctgacgaacccgctctacttcgtgctgctcgcgcgcttcttccacctgcacccggagccgtcgccgcgcacgcgggacttgctcgcgcgtgggttctggcgcggcagcctggtggacagcttcctcgacagccgggccctgtcgccacaggagttgctggccgccatcggccccgacgaggagcaatccgtccagtccctgctggcgcaggtgcggcccctgtccgacgaatggctggcccagcacgcgcagcccgcgacgttcggcctcgcgctgcgctcgcggggcatggccctcaatgccttgtacgcgctccagccgcggcacctgcgcaccggcgccctgctggagccgtcccagctcttcagcgacaccgaccccgccagcctcagccccgtgctcaagtccctcaccgtgcaggagcccgacgccgagctgaagctggaccccgcgctgtaccgctccttcctctacacccccgccaactacctgatgcacccgcccctgcccggtcagcccctgctggacgtgctgcgggacgagcccgcgccgccgcccgaggtcctccagagccaggccatcacccccgccatgcgcgacacgctgcgcgagggcggcacgctcgaattcctcatgcagcgcatggagctcatcgatagacacatcatcgagttcctgcgggcccgcacccgctacgaggagtcggaccgtccgtccctccaatcgctggtcgtcgaggaggaggactga

SEQ ID NO: 9402 - DNA, 93 bp, Myxococcus xanthus
atggctgacatctctgagcagggtgtgggcatgatccgggtgcagcgcgtggtggagcgcgtcgcaggtgacggtagcatggtgtcggcgagc

SEQ ID NO: 9403 - DNA, 96 bp, Myxococcus xanthus
atgaccgagaacgacctccagaacctgcctgagaaacaccccatcctggaccaggacacgctcgccatggtcaccgccgaccatgcgatgacctat

SEQ ID NO: 9404 - DNA, 94 bp, Myxococcus xanthus
atggacctgggcggcaaccatgacgagtggacggacacccacgtacgggcccaagcctacgcactgaacggtggtgccttgctccaggaggacc

SEQ ID NO: 9405 - DNA, 213 bp, Myxococcus xanthus
tgccgcgataccccaggactcaccagccgcccccagccgcccgacaacctccgctcccgcgtgcatgcggcgcggcacaagctggcgcaggtccgggcccacctcgtgtcacaccggttcaccgacggcctcgcggtgacgtcagccctgctcgaagagcagaaggggctcggctacaagccgttgcagccgcagatattcgtggcccggggc

SEQ ID NO: 9406 - DNA, 219 bp, Myxococcus xanthus
ggcgaagggcggatgtcgacgcgaaccgatgagcagttgatggaggccgcgcgcgctggcgacgacaaggccctggacgaggtcctcgcccgccatgagaagcaggtgtaccgatttggcctgcgcatgtgcggctccgaggaggacgccatggaggtcctccaggagacgctgttctccgccttccggggcatccacgcgtttcggggggacgcggcg

SEQ ID NO: 9407 - DNA, 273 bp, Myxococcus xanthus
gcgcgccatggcatggcgcagcggctggagggcctccgcgaggtgctgcgcgccgcaccgctcaagctgcgggccgcggcggtgggacaggtggcgcggcgactgcccgcgcatgccctgctggacctcacgcgccgctggcaggtccagcccgtgccagaagcgcccgtgacagacctggtggacgcggcgtggagcgagctgctctctggctcgcggaccctctggtatgcctgccggcgcagcctgccgtaccaccactccgctgtagag

SEQ ID NO: 9408 - DNA, 675 bp, Myxococcus xanthus
tctctaaagcgcgagtccgacctcgacttcgtgtcccgcctcttggaggaagaaggcatcttctactttttcgagcacggcgaggacgcccacatgatggtgattggcgacggcgcctccgccaatcccgagatgcagggcgagtccaagcttgtcttccgcgagcgcagccagatggtcgcctcgcaggagtacgtccacgagctggtctcccgcatggaggtgcagcccggcgcggtggccctgcgcgactacaacttcctgcgtcccgcccaggacctgggtgccagctccgaggcagaggacggcgaggccgcgctcgaaatctacgactaccccggccgctatgaagagcccgcgcccggccgcagcctggcgaaggtgcgcctggaggagctgcgcgcgcgggcggagacggtgacgggcgccagctacagccgccgcatctgcgtgggccactccttcgaactggcggagcacccggacgagtccgccaaccgcaagtacctgcccgtctccgtgcggcacctgggccaccagtcggaggcgctgagcatcgagcagggctcgctgcgcagccgggaggactaccgcaacgaattcctctgccagcccgcggaggtgcccttccgcccgccgcgcgtgacgccgcggccggtgattccgggcgcgcag

SEQ ID NO: 9409 - DNA, 309 bp, Myxococcus xanthus
taaacgcaccgagtgggtgcagcaggcctacctcgccggcggcgggagccggcttccctacgtcagcgcctacgcggtagcatcctggatggctcctacctggaacgggaggatgagacgacgcccctgaccgagcgccccatccgggactatctctacaccaaggtcgacgcggaccacacgctgctcttcgagaatgcgcccgacttcctcaacccggtggtgctgcccatcttaatgtggtgcgacctcgacacatacctgctggcggaggtgcaggaggacgagccgacccccctcttacggtag

SEQ ID NO: 9410 - DNA, 303 bp, Myxococcus xanthus
atgaagacgcccaacgccctcgacgccctgaccgctcaggtgccgcccgccccctctcccgctcctaccccgggcgggggttccacacagccgggcaccggcacgcccccctcggacagcttccccgcgggcgacgtcgtgggcattggcgccgccgccctcttcgtcctgctgatggtgctggccgcccggaagctgttcttccgcaagcgccccgaggagaagaagccccccaccgtcccccccgcagccgaaaagcccgccctccccgccgagcagcctcgcctgcgcgtggagctgtag

SEQ ID NO: 9411 - DNA, 684 bp, Myxococcus xanthus
gaaccatgtggggtcgagggcatgatgggcatcgcatacgacgtgcaggtccagacgcccgcgagcgagctgaacagcgagcaggaccttgcgcaggtgccgctgttgaagaacgcgagccgccccgtcctcggggacgtggcgaccatcacccctggcatcgcgcacggggagacgcacaacctggggaccatggcgttcgcctcggtgaccgcgaatatccacggcaaggacctggcgcaggcccggcgcgacgtgcagacggcgattgcatccatgggcgagctgcccaagggcgtcaacgtgcaactggcgggactctccgtcgtcctcgacgacaccatgcgcagcctcgcgaacgggctggtggtcgcggtcctggtcgtcttcctgctgctcgcggccagcttccagtcgttccggttggccaccgtggtcctgacggcggttccggccgtcgtactgggagcggtcatctccctgcgactcaccggctccacgctcaacctccagtcctacatgggcatcatcatggccgtcggtgtctccatcgccaacggcgtgttgctggtggcgagcgccgagcagcgccggaaggcgggcgcgaacgcgcccctcgccgcgctcgaaggcgtatcgctgcgcgtgcgtcccatcttgatgacgacgctggcaatctttaga

SEQ ID NO: 9412 - DNA, 1203 bp, Myxococcus xanthus
atcctcgacgtccacctgggcgacgtccacgtcggcacgctgacgctgctggaggacgaacgcatcgagttcgtcatcgcggaggagtaccgccagcgctacccacgcccggtgctgggacagattttcgaggacgacctctcgcgccggcacgtcagccgcctgcgcctgccttcgtacttctccaacctgctcccggaaggctcgctgcgcgagctcatcgccgaacgcgagcaggtggcccgccagcgcgagttcttcctcatcgcgcggctgggtgaggacctgcccggcgccatcgtcgtgcggcccgccagcgtgctgtcactcagcggaatggagccgctggaggagccccagccgccccacgcgccgcaggagcaggagccgctgcgcttctcactggcgggcgtgcagctcaagttctccatgctgcgccgggacaaggcgatgacgctcccggcgggtggacgcggcggcaactggattgtgaagctgccggacaaccgctacgaccgcgtcccggagaacgagttctccatgatgacgtgggcccgcgccgccggcatcaccgtccccgaagtggcgctgctggacgtggccgacatccagggcctgcccgaaggcatcaccctgcgcgagaacgtggcctacgccgtgcgccgcttcgaccgccccgagcccggccgccgggtccacatggaggacctgacgcaggtgctggggctgtacgcggatgagaagtacaagaagtacaactacgagacggtcgccaacgtcatctacaaggtcgccggactggacgcgctgcacgagttcctgcggcggctggtgttcatcaccgtcattggcaacggggacgcgcaccacaagaactggtccctgctctacccggacggcacccgcgccacgctgtcacccgcgtacgacttggtgtccacgctccagtacatgccggcggacacgctcgcgctcaacttcgcgaagtcaaagcgcttcgaggacatctccctgggcagcttcgaacggctggcgcgcaagctggcgctgccccccagcgacgtgctgccggtggtgaagtccgcggtggaagcgtcgctcgacacctggtcctcgcttcacgcgcaactgcccctgccggatgagagccgccgccgcatcgaagcccactggaagcgcgtgcccctgctccaggggcaatga

SEQ ID NO: 9413 - DNA, 365 bp, Myxococcus xanthus
ctacagcggacctccctcaaccagacgctctccggcccagaggcggagcagtacctccgcgtctccagcaacgtcacgccgctcttcggtgacgcctccaagcgcctgctgacgccctacgcccccgaggacgtacggctcctcgacgattcgaagggcgcccccatcaacccgggcgccgtggagcgcgtgctccccgccgggacgaagctgcgcatcacccgcgtggagttccccacctcctgggtcatcaccgagcgcgtgctctacagcccgcgcgcctggccctgggtgtacctcacggaagccggggcacccgccaacgcgcacgccgtcatgctggggaatgccgccaacctggaccg

SEQ ID NO: 9414 - DNA, 186 bp, Myxococcus xanthus
atgttccagttcgcgcaggtcagcttgtacattccggaggagatcatctacctcccgctttcggtgggcggcacggttgtgatgtggaacgccatcgagtacacgcgcgtcaagaatccgaacgtggaggacgccatcatcaccgtcatgagtgtgttccgctcgatcatccacgagatctttaga

SEQ ID NO: 9415 - DNA, 270 bp, Myxococcus xanthus
gcggacggcgccagctcgcgaggcttcctggcgcccgcgaaggaggacgtcgtcatcctccgcggtgacctgctgcacgtggacttcggcatcacctacatggggctgaactccgactggcagaagatggcctacgtgctcaacgagggggagacggacgcgccggagggcctcaagcgggcgctggccaacaccatcgaactccaggacgcgctgatgctgcgcgcctcccgtccgggccgcacgtccgcgcaggtgtacaccgtagag

SEQ ID NO: 9416 - DNA, 135 bp, Myxococcus xanthus
atgagcatcgtcgccaacaagcagcaaggtgcatccggactgcccctgtgcaccacggagttcgagcaccggatggctcgggccctcaatgacaccaccgtactgtgcctggcccagcgcgtgtggggcctttag

SEQ ID NO: 9417 - DNA, 69 bp, Myxococcus xanthus
atggagttcccggcgcgggtgtcccgcgcggagtcgtccggggaggccaccctgggcgtgctggtgtga

SEQ ID NO: 9418 - DNA, 88 bp, Myxococcus xanthus
atgcagctggggccggtctgccgcctcaacaagatgaagggcaccctcctgtactgcatgtggacgaaggatgacatgacttccatcc

SEQ ID NO: 9419 - DNA, 450 bp, Myxococcus xanthus
gctctcagggtgcggacgcgcgccggtgtggagcgggaaatgcggctggaggcgctccggcccacgcccaaggaggacatcgtggtcctcgagggcgtggagtcgcggaacgacgcggaggcgctcgtgggcgccaaggtgttcgtcttccgcgaggatctggagccgcccgcggagggcgagttcttccagggtgacttggtggggctcgatgccgtggacgccaacgggaacgcgttgggccgggtggaggagatctggaccaccggcgaggtgcccaacctggtcattcgcgcttccgggcgcgaggagctggtggttcccttcgccgacgagttcgtccccaccgtggacctcgaggcgcggcgcatcgtcatccatccgcccgagtacgtggaggcgggacgcaagggcgccgagtcaggaggaggcccggaggacgcggaatga

SEQ ID NO: 9420 - DNA, 174 bp, Myxococcus xanthus
atgagcccaccgtatccggtggagatcctcacgttgttccccggcatggtgaccggttacctgggggccagcatcctcgggaaggctcaggagaagggcctgctggccaccaccatcaccgatatccgcgagtacgccgagggcaagcaccgcgttaccgacgacgcaccctac

SEQ ID NO: 9421 - DNA, 216 bp, Myxococcus xanthus
ctcacggacgtagacggcgagcgctcggtcgcgcagatgctgacggacttcgcgcaggacccggaccacctgctgcggctcgcgatcatgctcaaggagttggactcggtgtcgttcgccgcacaggacaggttggcgcagtatgagggcccacgagcgcccggtgccggaggagcccagccctcctcgggtgccgctcacgcctcggccctatag

SEQ ID NO: 9422 - DNA, 285 bp, Myxococcus xanthus
atgggcggccggggcaccttcctcgccaccgcgggcggcagcctcatcggctggggcggcgcgctggtcggctccgccctgctgggcatcggagacaacgaacccggcggcgcggtgttcctgctgctgctccccgtggtgggcgccgtggcgggctacgagctgtcatcgccgggggaggaacaccccacgctcacgcgcaaggccccgagcacgttccaagtggtccccgtcgccgggatgggcgaacgcgggcctcgcctgggcctcgccggaagcttctga

SEQ ID NO: 9423 - DNA, 747 bp, Myxococcus xanthus
atgagcgaagacgccttcttcaccgtctatggcaacctgccccgtcacggccctggcagcgacgactgcacccgggaggccctgcgacggctgcctccgctgccaccgcacccgcgcgtggtggacctcggctgtggcgcgggcgcgcagacgctggtgctcgccgaggcactgcgcacccgggtcatcgcggtggacctgcacgagcccttcctcgaccaactcaaggcacgagcgcgcgagcggggcctggacgcgctcatcgacgttcagcggcaggacatgggcgcactgtcgctgcccgaggcttcctttgacctcctctggtccgaaggcgccatctaccacctgggcttcggtccgggactgcggcgctggcgcccgctgctcgcgcccggcggcctggctgccgtcaccgaatgcacctggctgaccgatgagcgccccgacgaaatcgcgcgcttctggggtgaggtctaccccaccatgggtacggttttggagaaccgcgccgccgcggaaaccgcgggctacgaggtgctcgacaccttcacccttcccgcctccgcatggtgggacacctactacacgcccctgctccagcgcgtcgcacacctgcgcgcccacggtgatgcgtcattggaagacgcgctctcggccgccgagcaggagacccgcctttatcgccagtacgaacacacctacggctacgtgttccatctgttacgcaacccgtcagcgctttga

SEQ ID NO: 9424 - DNA, 120 bp, Myxococcus xanthus
atgcatgccacggacgacacccacaccctgatggtactgaactgccgagtccgggagctggaatgggtcaccaccagccaccagcctgcagtgaagcaactcgcccgtgaagctgacgtc

SEQ ID NO: 9425 - DNA, 111 bp, Myxococcus xanthus
atggcctacaaccccagcttgctggccctggtggagggagtcctgttcacgctccgagacgaccagcatatgggctacaacctgggccagtacacatgctatgccgtctaa

SEQ ID NO: 9426 - DNA, 258 bp, Myxococcus xanthus
tgctctcaagaagcgctgctccgcgtccgccgcatccgcggtcagaccgaagccctggagcgtgcgttggagtccggagccgaatgcggaacggtcctccagcaactggctgccatccggggcgccatcaacggactgatgtccgaggtgctggagtcacacatccgggaggagttcggcccggcgtccgacgaggatccgcgccacgcccagcgggtgcgggacatgacgacgctggtccgcacctatctcaagtga

SEQ ID NO: 9427 - DNA, 216 bp, Myxococcus xanthus
atgaagtcccgtgccgctgttgccttcgaagccggaaagcccttgagcatcgtcgaactcgacgtcgcgcctccgcagaagggcgaggtcctggtccgcatcacccacacgggcgtctgtcacaccgacgcgttcaccctctccggggatgatccggaaggtctcttccctgtggtgctcggccacaaaggggccggcgtggtggaggcggtgggc

SEQ ID NO: 9428 - DNA, 582 bp, Myxococcus xanthus
tgcaagctgatggagttcgcagcgctgatgctgcttgtcatgctgtcgttgctgggcccctcgggccgtacgctgtcccgcttcgagggggagctgaaagttcccgtgttactctgtgtggggcttgttgcgctggtggtgtttctagcgcactggtccggtccgctcgccttcgccctccaccgtcgccacaagctcccgagggtggagggcttcctccaccacgtcagcgagggcctgggcaccgcgcgctccttcacgggcatggcgaaggtgttcgtcttctcggtggcgccagtgctggcctccgcgctggcctacggcctggcactccacggcatcggcatctccggcggactcttcgccggggcggtggtgctgggggccatctccctggggcagtcgctcccgggtgtccccgcgggcatgggcatctactacttcgtgacgagctgggcggcccgcagcctcggggcctcgccggaggacgcggcggccttcgccacgctcacgcacctgggcaccgtcatcagccaggtggccgtgggagccgtctccgtccatctgcgcaagaatcgcatc

SEQ ID NO: 9429 - DNA, 154 bp, Myxococcus xanthus; identical to SEQ ID NO: 1844

SEQ ID NO: 9430 - DNA, 153 bp, Myxococcus xanthus
atgcagtacaccgaggcggtgatggtagcgaccactgcccatggacgggggcggttgctggaggttcacatcgtggtcttcgtggatgtgaccggtctcgatacccggcccttggtgatgactggggcgggcgccaaccccctgctcacgtgg

SEQ ID NO: 9431 - DNA, 141 bp, Myxococcus xanthus
atgttcgagtcccagctgccgcacacggtgtcgtaccaggcgtccgccctcctgttggccatgggcatggtggggcccgcgcgcctgcaggacatgcaggagcggaagcccctttgctccgccgtcaacgcgcttgtttga

SEQ ID NO: 9432 - DNA, 117 bp, Myxococcus xanthus
ccgcaggtccacatctggttcgccatcctgctcagcctgatggtggaggccgtcttcaatagcctgcccggcagcctggccgtctgtggaacgatcttcttcggcgtgggtcattag

SEQ ID NO: 9433 - DNA, 300 bp, Myxococcus xanthus
atgttgctgtgcctggactgcacgaaggtggaggccgacactacctactggccgcacttcacggacgagctgcgcaagggcgcgtttccggcgaagttgattgaggtggcgctctttcacaacgtcccattgctcgcgtatgtgctggacacgctggcgttcccgatccccacgctcgtgggctttgtgggctttgggtttctgggcacgcgggagcatgggcgcattctcacgcacgagggctccgacttcggacagaccctggtgctggtaatcatctatgatctgtacgtgaaccat

SEQ ID NO: 9434 - DNA, 2277 bp, Myxococcus xanthus
atgtcgacagagcagtgggcccaccgcttcttcgagctgtccacggagccctacgtcatcctgggccgtgatggcgtgttgctcgaagccaatcctgcctttggccacctggtgggcctgtctttgacgtcactgcgtggcatggccttgcaggatttcatccccatcgaagatgccgccgtcctgttcgcgcatctgggttccacaagccccacctcgcgcacctgccgttggcgccggccggatgggtcctggctgcctctgtcctggcgcatcaccgccgcttcggagtcggagccactctactgcacggtgcagcgggccgaggaaccatccgccgccccctggccggagagtgactacctgcccttcggcctctacctggtcgacatccgcacgcgccgggtccactacgtcaaccaccgcttctgccaactgtggggcatcaccgagttggagggcgccatccagcggggtgagttgtcccatgacgaggtgatccaccattgcctcaaggctggcgacgcggcggagttcctgcgcctgtgcgcggccccggaccagggctgcgtgccgggcctggtggaggacgaagccaggctgtcggatggacgcaccctgcgacggctgtccacgtcctcctcggtcgcgggggacgccatgcgctaccggatgttcgcgttcgaggacgtcaccgagagcaagcgcacgcaggaggcgctgcgccgttcagaggagagcttccgcaggctcatcgaccgggcgcccgaaggcatcttcgtgcacacccagcggcgcttcatctacgccaaccccacgctgctgcgggccctgggctacgacgacccggccgagctgatggcaaagcccatctggagcatcgtccatccggatgacctggagctcgtgaaggaccgcgtgcacaccgcggccgtgaagggcgcgctggccccgctgcgggaggtccgctacctgcggcgcgacggcacctggtacgacgcggagagcgtgggcatccccatcgagttcgacggacacgaggccgtcgtggtgatggcgcgcgacatcaccgagcgcaagcaggcccagtcgcagctcctgcagaacgaccgcatggtgctggccggcacgctggcggcgggcgtggggcacgaaatcaacaacccgctgacctacgtcatggccaacctggcctcggccctggagtccgtgagccgcctgggcgcggagctgacgcgggccggagagcgcggtcccagcagcgtggcgtggcccgcgacgctgcatgacgcggaggccctgctgaaggaggcgcaagaaggcgccatgcgcgtgcgcaacatcgtgcgggacttgaagttcatctcccgtcaggatgaggagcggcgcgaagcggtggacgtgcggcagccgttggacttctccatcaacatggccgccagccaactgcgtcaccgggcgcggctcatcaagaagtacgagtccgtcccccgcgtgtacgcggacggctcgcgcctgggccaggtgttcctcaacctgctggtgaactcggcgcaggccattcccgaaggcaacgccgaggagcaccacatcaccgtgtgggtccgcgccggaccgccgggcagcgtgctggtggacgtgagcgactccggctgcggcatgacgcccgcggtgctctcccgcgtcttcgaccccttcttcaccaccaagcccgtgggcaagggcacggggctggggctgtccatctgccacagcctcatccgcaagcagggcggtgacatcaccgtccgcagcgaactgggccagggcaccaccttcaccgtcaccctgcccacggcgccggacgccgtcccgacccaggccgcgccggtggcgcccgcgccccacgccgagcggcggggacaggtgctggtgattgacgacgagcccgcggtgggccgctccctggcgcgcatcatcggcatgcggcaccgggtgacggtggtgaacaacggcgaggacgcgctggcggtgctgacatcgggcgcgccgttcgacgccgtcttctgcgacctgatgatgccgggcatctccggcatggacgtctacgagcgcgtccgcgagcgcggggatggcatcgccgagcgcttcatcttcatcaccggcggctcgtacaccacgcgggcccgtcagttcctggagcgcgtgccgaacctgcagattgagaagcccttcgacgtggagtcgattcatcagggcctgggacaactcctgggtgcctctcgtggtagcgaatga

SEQ ID NO: 9435 - DNA, 171 bp, Myxococcus xanthus
atgatgaacgataccctgctgtgcttcatctaccacatgatctccagcaccagggactacaacgtgttcatcctgctgtatgagacgaggatggatgacaccctgcacaccatcaaggtgcacgtctaccggggtgagtgcaacaatgacacgctgttgctctccatctag

SEQ ID NO: 9436 - DNA, 507 bp, Myxococcus xanthus
atgttcgcgaaccactcggcgctgctggccgagcagctccgcgacgcgctgtcgacgaagatgtatggccgcggccctcaccgggtgctgcgcatcgacgagccggaagggcccagtaccgcgggcgggaagttggcgcggcaggccatctccctggtgcctcgcaagggcgcggggacctcgctgacgtgtggctgggtggacgtgtccaagcgtgaggcccagctccgcaacttcgaggcggtggcgaagcggtacgcgcttcaccacggcgagccgctggagatgcaggccgaggagtatgagcgcttcctcaccgacgtcgaggccgtgctcacccaggccgtcatcaaggtccgcgtcatcgtccccgaggaagcgggcgcggtgcgcgtcgcgagcccttccgcctccgcgaagggcgtcccgcccgtctgggcgggactgctggccgtgttggccttcgtgctgggcctgctcgcggggcggatgggctcaggcggctga

SEQ ID NO: 9437 - DNA, 963 bp, Myxococcus xanthus
cacagcggactgtctggggacacgcaccgcgtccccacggcggaaggcttcctgaagaactggtccgtgaaggagctggcgcacctgctcttcgtggagagcggcgtcgacctggcggtgcaccacgtgctgccgctccagacgctgtaccacgacggactgtgctcctatgagaagacgctggagattcaccgcaactatccccaccgcttcctggtgtacgcgggcgtggacccgctgcgcggcacggcggcgctggatgatttggagcagcagtacgaaacgctcaagcccagcggcctgaagctctacccggcggcgtggctgggcgacaagttccgccacacgggctggcgcatggatgacccgaccatcgccttcccgctcttcgagcgggcgcagaagctgggcatcaagaacatcgccgtgcacaagggcctgcccatgggcgcggtgccgctggagccctacaaggtggatgacatcggcggggcggcggatgccttccccgacctgaacttcgaaatcgtccacggcggcatggccttcctggacgagacgggcatgcagctgtcgctgttccccaacgtgtatgtgaacctggaagtgacgggcgcgctcatcgtgaagcgtgaacgctggttcgccgagtccctggcggcgctgctgaagtgggccggcccggagaaaatcatgtggggctccgggacggtgttcagccacccgcacccggcgctgcacaagttctggcatgagttccagctgccggacgacctagtgcaggtggcgggcatgcaggtgacgccggatgtgaagcggatgattctgggcggcaactacgcgcgctacgcgggcgtggacgtggagtcggtgaagaagaagattgccaacgacacgttcgccaagctgagggcacgcggcgacatccagccgtacggctaccgggagagcctgtatgagtga

SEQ ID NO: 9438 - DNA, 369 bp, Myxococcus xanthus
atgagtgagcaggccctgcgcgagcgcatccaggacatccccgacccgtgcagctgcgccacgggcgtgccgctgggcatcggggagatggggctgattgagtcggtgaagcgcacggagggccaggtgacggtgcgcctgcacatcacctcgcccatgtgcatgatggccgcctacttcatgcgggaaatcgagcagcggttgctgacggtggacggtgtcaccgcggtgaacgtggagttcgaccacgacctgaagtggacgccgcaggacatcgagccggaggcccgccagcggctcgcggccaggcgcatcaccatgctgggtggccgcctgctgccccaggactcggcgcagcgccgctcctga

SEQ ID NO: 9439 - DNA, 1317 bp, Myxococcus xanthus
gcctatgcgcggctcgccgagctgacggacggcattggcccgcgcctgtcggggtcgccgggcgccgaggccgccgtgcagtgggcgctgcgttctttcaaggccgacggggtgaaggcgtggttggagccggtgaaggtgccgcactgggtgcgaggcgaggcgtccggcgaggtgctggcctccgagcgcacgcgggggcaccccctggcgctgctggccctgggcggcagcccgcccaccgcgcccgagggactcaccgccgaggtggtggaggtgacgtcgctggagcagttggagtcgctgggcgcggcggtgaaggggaagttcgtcttcttcaaccacaccatgacggtggccgcggactacgggcgcttcgcggggctgcgctcacgaggccccgccgccgccgcgaagcacggggcggtgggcgcgctggtgcgctcgcttgccacggcgtcgctgcgcacgccgcacacgggcgcgacgaacttccccagtgaggggccgcggattccggcggcgtcggtggccacggaggacgcggacctgctccaccggctgctggcgggcggcccggtgcgcgtgaagctgatgctgggcagttccgagctgccggacgcggattcctccaacgtcgtggcggagattcgcggccgggagaagccgcaggaaatcgtgctgattggcgcgcacctggattcgtgggacgtgggcacgggcgcgcatgacgacggcgcgggcgtggtgatggtgatggaggccgcgcgcctcatcgcgaagctgccgcaggcgccccggcgcacggtgcgggtggtgctcttcatgaacgaggagaacggcctgcgcggtgggcgcgcctacgcggaggcgcacgcggcggagttgccccggcacgtgggcgcgctggagatggacgcgggcggcgggcggcccgtgagcgtcagcgtgcgcgcgggcgagggcgggcaggacctgctgcgcccgtggctgccgccgctgacggcgctgggggtgacgcagttctccgcgcgcgaggcgggtggggcggacatcagcccgctgatgcccgcgcgcgtgcccttcttcggcgtggaggtggacagcagccgctacttcgacgtgcaccatacggaggcggacacgctggacaaggtggacccgcaggacctggcgcgcagcaccgccgccgtggcgtggatgacgtacgcgctggcggagatgcccggcacgctcacgcgccccgaggcgccggcaccgcgtgggcccgcgccggtaaccgtgcccgcgcagcagtcgaagacctcagggaactaa

SEQ ID NO: 9440 - DNA, 1497 bp, Myxococcus xanthus
  unsure (1)..(1497): unsure at all n locations
tcgtggggcgcgggtggggtgctcgcgcacgacatgggcttgggcaagacggtgcaggcgctgacggtgctcctggaccggagcaagctggggcccgcgctggtgttggcgccgacgtcggtggccttcaactggatggacgaggcgaagcgcttcgcgccgtcgctgcggatgacgctgttctcggacgcggcggaccggggccggacgttggagcaactggggcccaaggacgtgctggtgttgagctatggcctgctcacgcgggacatcgagcggctgtcgaagctgcgcttctccaccatcatcttcgatgaagcgcagacgttgaagaacgcgacgacgcaccggttccgggcggcgcgggcgctccagggggacttcaagttcgcgttgtcgggcacgccgctggagaaccacctgggcgagttgtggagtctcttcgccgtcgtcttctccgggctgctcgggagctgggaggcgttccgctcgcgctttgccgcgccgattgagcggggcgtggacccgacggccgcgcccgcgctggctcgggtgctccagcccttcctgctgcgccggacgaaggcgcaggtggaggcgcagcttccgcctcggacggacatccgggtgcccattgtcctctcgtcggaggagtgggcgctctacgaggacgcgcggctggcggcgctctcggatttggagacgcgcaagccgaagatgaaggagcaggagcggcgcatcgagattctggcggcgctcacgcggctgcggctcctggcttcacatccgcggctgtatgacgccgggtcgaagctggagtcggccaagctggagcggttcatggagttggtgcgggagctccgcgcggaggggcatcgcgcgctcgtgttcagccagttcacctcccacctggcgctggtgcgcgaggtgctggacgcggaggggattgattacgagtacctggatgggcagacgcccgcgggggctcgggcggagcgggtgcgcgcgttccaggaaggggacgtgccgctgttcctgatttcgctcaaagccggtggcttcgggctcaatctcacggcggcgaccacggtgattcatctggacccgtggtggaaccccgcggtggaggaccaggcgtccgaccgcgcgcaccggatcgggcaggagcggccggtgacggtgtaccgcctggtgacgcgggggaccatcgaggagcagatgctgtcgctgcacgagcacaagcgcgcgttggtggcgggtgtcctgnaagggaaggattcggcgtggacggttgtcgacacaggagttgctgggactgttgtcccagcggctggctccgcctggggaagaggaggggcctcggactcggcactgattcggactgttgtgctgggccctgggtgctgctgccagaacccaagtacgcatcgaggtgcgaacctcggggacgtgtggacgaccttgccaggaagattgctgcttggcgctaaagcgtga

SEQ ID NO: 9441 - DNA, 1404 bp, Myxococcus xanthus
ttcgatgctcgcactcggatgcccgtcacggccaaggacctcttcgcctggcatgcccgggagggggcgttcgaacgcctgacgcccccctgggaacggatggaggtactggagcgcaccggcgatggcatccgcaccggcgcccgcgtcgtcgtccgcatgcgcgtgggccccatcccccaacgcctggtggccgagcacaccgcctacatcgaagacgccatgttccaggacacgcagatgtccggccccttcgcgaagtgggtccacacccaccggatgtggcccgaacccacgacgggcacgtccatcctggaggacgaagtggaatacgtcctccccgtaggcactctgggcagcctcttcggcggaggcttcgcccggcgcaccctggagcggatgttcgcgtatcgccaccgcgtcacgctcgaggacctgaagcgtcacgccgccttcgcggggcaggggccgctcaccatcgccgtcaccggagcctcggggctggtgggctcgtcgctggtgccctttctcaccacgggcggccacacggtgaagcgcatggtgcgcggcaaggcggaccccgctcggaacgaggtcgcctggtcacccgacacgggcgaggtggacaccgacgcgctcgaaggcgtggatgtcgtggtgcacctcgcgggcgtcaacgtggccggccagcgttggacccccgagtacaaggatgccatcctcaagagccgcacccagggcactcgcaccctggccgaagccctggcgcggatgaagcgcaagccgaaggtgctcgtctccgcgggcggcagcagcatctacggggaccgcggcgacgaagtcctcgctgaggagagcagcacggacgggaagggctttctctcccaggtatcacgcgagtgggaagccgccgccgcgcccgccgaggctgcgggcatccgcgtggtgcacctgcgcatcggccccgtcctggacgcgcgcgagggtgccctggcgaagatgctgccagcgttcctcgcgggaggcggcgggcccatcggctccgggcaacaatggatgagctgggtgtcgctggaggacctgctcgggctcatccacttctctgtcttcaccgacgccgcgcgcggcgccatcaacgccgtggcgccgggggcggtgcggcaggcggacttcgcccggacgctgggcaaggtgctgcggcgtccggccgtcttcccggtcccctcgcccgtcgtgcggaccctcttcggacagatggggcaagaggcgctgctggatggcgcgcgaatcgcgcctcaggcagcccagcggctggggttcgccttcctccttcctgacctggaaagcgcgctgcgcttcacgttggggcgcacgacgaaaggccctgaataccaccattcttag

SEQ ID NO: 9442 - DNA, 930 bp, Myxococcus xanthus
atgattcaggtcgaagggctgaccaaatactacggtgagcatgcggcgatccgggagctggccttcaccatcagccagggagaagtcattggctttctgggcctcaatggcgctggaaaatcgacgacgctgaaggtcctggggtgcgtgctgatgccgacctcggggcgtgtcgtcatcgacggccatgacgtggtgagcaatgcccacgaggtccgccagcgcatcggctacctgccggacgtgcctccgctctatgacgagatgacggtgggcgaatacctgacctacgtcgcacagcttcgcggcgtcacgtcccgggacaccgccagccgcgtgggcgaggccgaggagaagacgggcctgcgtgacgtccacggcgagctcatctccacgctcagtcacggctaccgccagcgcgtaggcgtggcgcaggcgctggtgcacaagcccgccctgctcatcctcgacgagcccaccagcgggctcgacccccggcagattgtcgagatgcgcgacgtcatccgcgggttgaagggcgcgcacacggtgctcgtctccagccacatcctcccggaaatctcccagacgtgtgaccggctgctcatcatccacaaggggatgttggtggcgcagggcacggaggaggagctggcggcgaagatgggcggccggggcaccatcgaactggaggtgcgcggcgacaaggcgcgcgcggtggaggtgctccagcgctttggctcggtggaggtggaccgcgcgtcggacggcttggtggcgctgacggtgcgggcctcgcccgaccagcggccccaggtggcgcaggcggtggtgggcgcgggtctggagttgttgcggctggaccagggagccggtcagctcgaatccatcttcttgcggctgacacacggccaggaggcgcgcgcgtga

SEQ ID NO: 9443 - DNA, 711 bp, Myxococcus xanthus
ctcatcgcccgccgcgagctgtccgcctatctgcgcacgctcagcggctacgtcatcatcgcggtcatcctcgcgttgaacggcttgttcttcaacgcatatgccctggggggcgccagcaagcgctccgcggaggtgctgtcgcagttcttctattactcgagcggcttcaccgtcgtcgcctcggtgttcatctcgatgcgcctgctggccgaggagcgtcagacgggcacgctgtcgctgctgtactcgtcaccgctgcgcgaccgcgacattgtcctgggcaagttcctcgcgggattggccttcctcgcgttgtacctcctgtgcaccgtgtacatgccgctgctggtgatggtgaacggcaaggtgtccttcggtcacgtggcggcggggtacttcggtctgctgctgctgggcagcgcgtcgctggcggtggggacattcggctccgcgctggcgcgcaaccaactgctcgcggcgattacgtccgcggtgatgctggtggccctcatcctgtgctggctcctggcacgcatcaccgagcagccgctggcggatgtcttcagcgcgatgtcgctgtggaatcagcacttcccgccgttccaggcggggctcatccacgtgcgtgacgtcgtctactacctcgtggtcacctacgtggcgttgttcgcggccacgcgggtgctcgaggcgcggaggtggcgatga

SEQ ID NO: 9444 - DNA, 1485 bp, Myxococcus xanthus
atggtggaggtcgccgccgcggcgatgacgcgcgcacccgtgctggagacgggccgtgtccgcagcgcgctgtattccgggctggggctggccttcgtgctcgtcttcgccttcgcgtccatgttcgtcgccacccaggccgatgtgacgtgggacctgtcctacttccgcaccgcgaagcccggcgacggcacgcgcaaggtgattcgcggactcaatgagccgctccaggtgacgctcttcttcccgcccgcgaacgaggtgggcgaagcggtggggcagtacttccgcgacctgtcggtggagagtccgggcctgctcaacgtggtgcggctggaccaggcggtggagccggctcgggcgaggtcgctgggcgtccacaacaacggcaccatcgtcctggcgcgcggcgaccggaaggagccgctcacggtgggcctggaagtcgagcgggcgcgcggccagctccagcggttggaccaggaggtccaacgccgcctgctgacggtggcccggcctcgtcgggtcgtctacttcacgtccggccacggtgagcgcgccgagtcgcgagcggtgccgggcgagacgacccgcccgtccgtggagaagctgaaggagttgctgcgcgcgcagaacgtggacgtgcggccgctcggtgtctccgagggcctgggcaccgaggtgccgcgtgacgcctccgtggtggtggtggcgggcccgacgcaggagttcctccccgaggagctgaatgccttgcgtgagtactccgcgcgcggtggccggctgtggctggcgctggagccggagggaccggacttccagccgctgctggagcccctgggcctgaagtacctcaagacgccgctggccaatgaccaggtgtacttccgcacgtcgcggcagcagagcgaccgcggcaacctgggcacggcgacgttctcctcgcacccgtccgtcacgtcgctgtcgtcgttggcgggacaggcgccggccgtcttcctgagcgcgggcgccctggagcagattcagccgttgccgggtggcatggcgcaggacgtgtcggtgcgcgcgcacggcgccaccttcgcggacgccaatggcaacttcacgttggacgcgggcgagatgcggcggccctggcccctggtcatcgcggtggagaagcccgcgccggccggccaagcggcgatgcgcgccgtggtgatggcggacgcggacgcggtgagtgacttgctgatgggcaacatgggcaacgcgtacctggcggtggacacgctgcggtggctcaccggtgaggagtccatctccggcgccgtgtcctcggaggaagacacgcccatccagcacacgcgggagcaggacgtcctctggttctacgcgacggtgttcctggggccagccctggtgctggcggtgggcttcgtgacgacgcgccggcggggacgacgcgcgccgcgccccgcggtggcgggaggtgagcgatga

SEQ ID NO: 9445 - DNA, 1116 bp, Myxococcus xanthus
atgaaggttcgggacctggccctccaaggggccctggcggcggccgcgttgatcgccgcgttcgttgtctggcagcgcgagccctccgcgggcccgggtgaagtcacggtggtggatgtcccggcgcgcgcgctggacagcatccgctacgaggacgactcccgcttcgtggacgtgttccgcgatgccagtgagcgtgaccggctctgggtgcgtctgggctacaaggcctccagggcggcctccggcggtgcgaacgcgggcgccaccgacgcgggcgtggctccacaggcggcggacgcgggcggtgccaccgcggcagtgggcacggacgcgggcaccggcgccgccgcgggacagccgcccgtagccgcgcgcgaggaaccgccaccgccgcgcgagctgcgcgccaacgaggtggcggacaagctgttctcccgcttcgcgcccatgcgcgccatgcgggcgctgggtgagctggacgcgaagaagcaggaggaggtcggcctggccacgtctccgcgcaagctgacgctgacagtggccggcaaggcgcgtgtgttcgccttggcgtcgcctccgggcggctgggggacgccgtacctgcgcagcgaggaggacggccgcgtgtacctgctgggcccggcgatgctgccggacctggagaacgcgaacagccgtctggtggaccgccggctgcacaccttcgacctgggtgacttcgacgcggtgaccatccgcgcggggggcgccacccgtgccttccaggccacgggcaaggcgcccggcccggacgtcctggcgccggaggacgcaccggagcggccggacgacttcacgcgcaactggcatgaccccgtgtggcggatgatgccggtggacctgctcggccgcgacgagccgcttcccggaggcgagccgcaggagtccttccgcgtggactacctgcgcgcgggccgggccgttggccacgtcatggtggtgaagggcgaggggggcttctacgcccggaccgagcacaccacgggctgggcccggctccactccgggatggacgcgctggcggaagaggcggtgcgggtgacggcgcccgtgtccaccgcttcagggaagtga

SEQ ID NO: 9446 - DNA, 1173 bp, Myxococcus xanthus
atgcggacgacgacgcgggcgccggtgcggatgccatcgccggtgcgctccagtacctccatccgttcccaggggggcgtcaggcgttcgaacgccccctcccgggcatgccaggcgaagaggtccttggccgtgacgggcatccgagtgcgagcatcgaagacatgcgacttgcccatgttccctcctggggcgacagtgcggcggcgcatgattgctccagagtcccttgaacgcgcggcggaattgctgcggcacggtggtgtcgtcgccctgccgacggaaaccgtctacggtctgtccgccaacgcggaggacgaactggccgtgcgccgcgtcttcgccatcaagggccgccccgccacccacccgctcatcgtccacatcccaggcgtcgagcacctgaacacgtgggcacgtgaggtcccggaggccgcacggaagctggccgaagccttctggcccgggccgttgacgctggtgctgccgcgcacggcgcgggccacggatgccgtcacgggtgggcaggacacggtggctctgcgcgtgccgaatcacccggtggcgctcgcagtgctccaaaagctgggtggagggctggccgcgccgagcgcgaaccggttcggcaaggtgagccccaccacggcggagcacgtgcgggaggacctgggcggagacgtggacctcgtcctggatggaggcccgtgcacggtgggggtggagtcgaccatcgtggacttgagctcgaatgagcccgcgattctccggcccggaggtctggccgcggaggacgtggagcgggtgctgggacgcaaggtgccggtgaggacttcgtccaaggtgcgcgtgtcaggctcgctggagtcacactacgcgccgcgtgccggcgtggtgctgaccgagcctgtgcaggctgtagcgcgcgtccaggaactccgcggacagggattgcgcgtgggtgtcctcggaccagcgagccttgcgttgccacccgacgtgccgcgcttcgatgtgccggatgagcccgcgggtgccgcgcgtgtgctgtacgcccggctgcgtgaggcggatacacaagggcacgacgtgctggtggcgtgtcttccagcggaaagcggcctgggtatcgctgtccgcgacaggctgtcgcgtgccgccgctccgcgcgggtag

SEQ ID NO: 9447 - DNA, 807 bp, Myxococcus xanthus
atgagcgcgaacggcaccgcctacggcatcgacgtcctcgcctttggcccccacccggatgacgtggagctgttctgcggcgggctgctggcgagcatggccgcccgtggctaccgcaccggcatcgtcgacctgacgcgcggcgagaagagctcgcgcggcacgctccagtcccgcgcggaggagacggaagccgccacccgcgcgctggggctggcccaccgggagaacctggagctgcccgacggctggctcaatccgtgggcgggcttcgacacgcccgagcccgagcgcgcccgcaccgccgccgtggcccgcgtggtggaagcgctgcgccgcctgcgtccggagctggtcgtcgtgccctgggagcaggagcgccacccggaccacgaggccgccagtgcgctggtgacgcgcgccctcttcttcgcgggcgtgcgcaagttcgacgcggagcccgccgcggagcccttcacgccgcggcaggtcctctactacccgatgcggcacctgaccgagcccagcgtcatcgtcgacgtctccgccgtctatgagcgcaagctggcggcggtgcactgctatgccagccaggtactgccccgtccggacgccccgcccacgctggtgggctcaccgctgtcggtgtcctcgctggaagccagggatcgcttccatggcgcgcagattggcgtcacccacggcgagccctacatcctccgcgaggcgttgggactggccgacccgctcgaccattttcgcaggaatagcttcgccaagcccctgttcttcccgtcacgcacatga

SEQ ID NO: 9448 - DNA, 720 bp, Myxococcus xanthus
tatctctacggcatcgtccgtgacaccgcgcccctggacgtcgggcgcatcggattgggcattgttcccgcgcaggtgtacgcggtgagcgaggcgggcctcgcggccctggtgtccggggcgccaggccgcgtgggggacccgacgcgagcgcacctgctggggcaccagcgcgtcaccgaaaccctgctccgtgagcacaccgtgattcccgtggccttcggcaccgtcatggcgtccgaggcccaggtacgagctttactgcgcacggcccagggcgaactgtccggcgtgctggacgcgctggagggcaaggtggagctgggcctgaaggtgctctggcaccgcgagcacctcgcccagcggttggtgctggaagacgcccagcttctccggcgcgatgatgagccggaggccgagcacgagcgccgcttggaggccgccgtggaggaccgcgccgggcgtgacatgcgggcgctgctggagggcctgcgcccccgagccgccgccatgcgcgagcatccccccgtgggcgagcggatgctgctcaacgcggccttcctcgtcgagcggccccggctggagcccttcgaggagaaggtccgctccctggccgcgcgctcggacacgtacacgttccgcttcaccggcccctgggcgccgtacagcttcgtggacgtgcacctgggcctgcgtgacgaggacgcatcacttccctga

SEQ ID NO: 9449 - DNA, 1139 bp, Myxococcus xanthus
cgccggcaggccatccaggtggagcaggccagcgcgcccaagtcccagttcctggccaacatgtcccatgagttccgcacgccgctcaacgccatcctcggctacacgaacatgctgctgcagggcgtgtccggcgaactgaacccggcgcagaagcggaacctcacgcgcatcgactccaacggcagacacctgctggaggtcatcaacgagattctggacatcacccgcatcgaagcgggccgcatgcccttgaacctgtcggacttcggcatcccggagctgctccaagaggtgatggcggagatggaccccatcatcgcgcgcagcaagctgacggtgagcgcccacctcggtccgcgcgtgccggcggtgtacagtgaccggcagaaggtgaaacaaatcgtcctcaatctcctgtcgaatgcgttgaagttcacgcacgaaggctcagtgcaggtgcaggcggagtacgtggctgctacgtccacgctcaccatctcggtgacggacacgggcattggcatcgacccagcgaaccaggaaaaaatcttcgaggacttccagcaggtggacagctctccgacccgggcctatggaggcacgggtctggggctctccatctgccgtcgcctggccaccatgctgggggggcgcgtcaccctccagagcacccagggcgagggttcgacattcaccctgcactttcccagacgcgcgaggcgcgcatgatgaacccatctgagaccccgaagcccctcgtgctggtcgttgacgactatcaagatgcccgggagatgtacgccgagtacctggagttctcgggcttccgcgtcgccgaggccaagaacggccaggaggcgctggacaaggccttcgagctgcggcccgacatcatcctcatggacctgtcgctgcccatcatggacggctgggaggcgacacggcgactgaagggcgacgaccgcacgcgggccatccccgtggtggcgctcacgggccatgcgatgacggggcagtccgacgaagccaagggcgcgggctgcgactccttcgtcaccaagccctgcctgccggacgcgctggtggatgaagtccgccgcgtgctcgccacccacggaggcgcatcggcgaggtga

SEQ ID NO: 9450 - DNA, 171 bp, Myxococcus xanthus
ctgctgcggctgggcaccacgctccaggtgcccatgaagctcaacctcgaaggcgtggaggacgccatcctccccgccgcgccggggctggaggacttcacccagcccccgcccgcgccggggctggaggacttcagcgcgccccccgccccgcccgcgccggcgccctag

SEQ ID NO: 9451 - DNA, 741 bp, Myxococcus xanthus
atgcgcgccgacttcggcatcgcggtggaggcaccgtcccaccgggggaagcggctgcaccggctccgcttcctggagacggagctgcacctgggcgtgccctcgctcgacctgacggcggcgcgttacgacttcagcgtcgagcgcgacgacccgctcttccgcgtgacgaccttcttcggcaagccgcggcggcatgacctccacctcaacctgggcttgtggatggagacgctccgcgtggaggagctcgaacgcggcggagaagtggggcgcttcctcacctggggcacgctccacgccacggtggacctgtggcattcgaaggacctggtgtcctacgtgcgcgtgcgcgccggtccatccttcgagcgggactacgcgaatggcttcaacaccttcgtccctggcgcggcgctcgaagcagacctgacgctggaccaggacggcttccaccacctgcggctgggagtggaggcggagaaagtgttgctggccccggccgtcgtgggccgcccgctgaggccggagcggctgcggctccaggccggctacgaggtcatcatcctggccatcaacgaccagccgttgagcctgctcgtggatggccgcggcatgaagcgtggcgacatcgcgggcgtccccgagcagtgggaatggtccgcgtccgcgggcctgcgcttctccctctgggctcccgcgcgccgctccgcgcccatggccacgtccgtgaaggagtag

SEQ ID NO: 9452 - DNA, 879 bp, Myxococcus xanthus
atgctgatgctcggactggcgctgctgctggccactgccgcggacatgccgcggggcgtgcccgatgacgacgcctgcgtggccctggacgaacgcggtgagcgctaccccatctgcttcgaccctggcgacggcttcgtggtgggcatgcacacgcggctcagcggctcggcgatggcgcaggccgtgcgcacgggcgtgcacatccgaagcggacgcagcagccggagcaagggctcaccctggttcaacaaccaccgcctgctcggtctggaggcgtgggatggagagcagcgtggtctcaccttcacggcgtatgacgggacgctgcgccggcacctggaggaaggcttcatcctggtgcccacggcgcggccagcgcgcattcccttccccttcgacgtgacggtggcgctgcgactgggacacctggagcgccgcgtctgggagggccccggttggaccttggaaacgggacggctgggcctgctgctggacccgatgcgcgcggagacggagcgggtgtggttcggcgtggggcccgtcgccgggcacgcggtgcggcgttcccgggagggcgtctcgcacacggtggcgcccttcaccgagctgatgttcgacgcgggcgtggagtcacgggacggactgtgggccctgcgagcatcggggctcgcgggctggagcatcggaatcgagcgagggctgcacttccgcgccaggacggacgtgggcctggagcgcgtcgtgctcgcggtggcggaccaacccgtggtgctccaggtgagcggggcctatgtccaccgggacgcggggctggaccggcgcagtgagtggaccgcgaacgtcgggctcgcggtccgagttttcggcgcccgatga

SEQ ID NO: 9453 - DNA, 810 bp, Myxococcus xanthus
atgaaccagcagggcacccagccgacggcgccccccgtcatcgcgcacacgcccacgccccctctggacgaggatccgccgccggccatcgaggaacaggccgcggccaacgacaccccgcccacgacggcagccgcggcggcgcagacgcctgaaacgcctccgcccccacgtggcccctccatggaggagcagcgcgcggttgctgacaaggcgattgcggcgcgtgacttcgacacggccgtggacgcgctggagcgcatcaaggatgccaacggccagcgcccccgtgacgtggagacccggctcgacgaggcgcgcgccgagcagttgatgaagcggcggctcgatgacgtccgcaacgccctgggcgacggcaagctgccggaggccgaggaagccttgcgcgagagcgccgccaccaaggcgttcgccaaggagtacgcggcgctgaagacacaggtcgccgaggcccggaagaaggcagctccgcccgccgcggttccctcttccggcacggagaaggcgccgcccgccgcgcagtccgcggcggccaaggcccaggcggacggcttcgagcacatcaagggtctgcgctaccggcaggccatcgagcagctgaacaagtgcctcgagttggaacccacccgcgccgagtgccacctctacctcgggtccgcctacgcgaatgacaaccagcccgagaagggcgcggttcactacaagcgattcctggaacttgcgcccaatcacgcgtactacgagcgcgtgaagggtttggtcgagagttacgagaatcccaagaagtag

SEQ ID NO: 9454 - DNA, 591 bp, Myxococcus xanthus
cagattcgcatcctggtagttgatgatgagcaggacaactgcgactacctcaagctggtcctgacccgtgaaggctacgaggtcgtgaccacgacggaccccacccagacggtggaaatcctccggggctccgacttccacctcgtcatcctcgacatgatgatgccgcagatgtcgggcaccgaggtgctggagcagattcgcaagtacgacacggacgtggccgtcatcgtcgccaccgcgtaccccacggtggacacggcggtggcctcgctcaaggcgcaggcttccgactacgtcaagaagcccatggagccggagcagttcatcaccgcggtccgcaacgccctccagaagaagggcttgtcccaggacccggaggcggacctgcaccgcgccattggccgcaccatccgcgacgcacgcaagacgcaggagctcacgctcaagcaactggcgcggcgcacgggcctgtcggtgtcgctgctgtcgcagattgagcgcgcggagtcctccgcctccatctcctcgctgtacaagattgcctcggccctgcaactgcgcatgggcgagctcttcggcgatacctga

SEQ ID NO: 9455 - DNA, 2043 bp, Myxococcus xanthus
atggcgtgcgccgtgcacgagcgcgtgtgggacgtgtcgcaggagatgcgtattcctgcgggccggacgtccccgtgccagccatgcgctggccgctcgttcccagggagacaggcgttgatgccccttcgtttcaagtcccgctcggcgttgttgtggctcaccatttcactgtccgcttgccgtgaggatgttccgccggcgccggtcgttccgcccattgaagacccgcgggaagagcagtccgttccgtacgtgtccatcgatggcatggacaatgcgtccggcttcctgcggggcaccatccaggggcagggcgacatcagggccgtggaagtccacgtggacggcgtgctgctcggctgggccgaggtgaatggtgaccagtggagcatccaatggctgcccggcgcggcgatgcactccatcgaggtggtggcccatgacggctcgggcactccggcccgcgcgtcgctggcgctccagccgttggacttcgccacgccgcacgcgctctaccagcccccgtccctgctgacgctgcccacgagcgagtccgcgacgacgcgctacacgctggatggctcgacgccgacggcccactcgcccatctacacctcgccgttggtcctgatgcgttcacagggcgagcccacgcccctgtccctcatccccacgaatccgccggagacgccggtggagtggcgatggctgccgcctcgcgggccggtgagccgcgccgccgtggtgcggttccagcagttccaggacgccacgcccgtgggcgcctccggcacgcggagctatctcatcgacaagtcacatggtccgttgccggtgatgtcgctgacggtggacgcggagcacttctttggcttcgagcacggcatctacgtccccggacggattcacgcggaagaccccatgccggacgtgatgtggggcaacggcaactatcaccagagtggcaaggactgggagcgccccctccacgtggagtggttcgaagtggaaggccagccggtgatttcgcagggggcgggcgtgcgcatccacggctcgggcagcgcggcgctgccgcacaagagcctgcgcctgtacgcgaaggaggactacgggccgaagacgttccgcgcggcggtgttccccggcgaggcgctggatgaatacacgcggctcatcgtccgcacgtcgggccaggacctgctgtactccaagattcgcgactgtgcgctccagggtctgctgcgggagaccgcgctgcacctgcaggcttgccgccccacggtcctgtacctcaacggcgagtactggggcctgcatgagctgcgcgagcgatatgacgagtactacctcgcgtcgcgccacggcatcgaccgcaagaaggtggccatcctggagctggatgggatgctcgacaccggcgaggaaggcgacgagtcgcactacctggcgctgctggacttcgtccggaacaacgacctctcgctgccggagaacctggcccacgtggagtcgatgatggatgtggacgacttcatcgactatcaaatcgcggagatcttcttcgcgaacacggactggccccacaacaacgtcaagttctggcgctacgtccagccggagtccggcggggccgcggcgaaggacggccgctggcgctggctggtctacgacctggacaacgccttcctcggtgacccgggctacgactcgctggcccgggtgatgacggacgaggcactgccggagtggtccgtgctgctcatccgccagctgatgacgaacgcggacttcaagaaccgcttcgtgtcgcgcttccagtggcacctggacaacaccttcagcgaggagcgcgtgacggcgcagctggagtcgctggccgacctgatcgccgcggagattcccgcgcacatcgagcgttggggctatccggagtccgtggagtcgtggcgctactacgtggacgcgatgcgtgacttcgccacgcagcggcccacgtacgtgcgccagcacctggaagtgagcttcggtcccttctag

SEQ ID NO: 9456 - DNA, 678 bp, Myxococcus xanthus
atggtgtacggcgacttctccatccgcgtgacggacccggagcgcctggtggtgggcctggtgggcatgggccgcaccggcaacgacgagctgctcggctggttcaagaaccaggtgctgaaggtgacgcgcgaccgcatcgcggagctgctcgtcaagaagcgctggccgctgctcgacgtgacgagcggcgcgtacaccgaggagatcgagaccgaggtcatctccgggctcaagccccacgtggacggctacggcctcaccgtggtgcggatgggcaacttccacgtctccatcaaggaggaggacgaggcgacgctgaagaagctgggcaaggacgtggcgtactcgcgtctggccggtggcttccagcagtacgcgcagggccaggcgatgctcggcgcggccgagggcatggccaagggcggtggcggcggtggtggtgcgggcaacgcgctgggcggcatgggcatgggcatgggcttcggcatggcccagcagttcatgaaccagcagcagcaccagcagcggcctccggagcccgcgcccgcggcgcccccggcggacacgcgcagccccgcgcagcgcctgaaggaaatcaaggagctgaaggacgcaggcgtcctcagtgacgaggagtacaatgcgaagcgcgcggagctgatgaagctcctgtag

SEQ ID NO: 9457 - DNA, 1449 bp, Myxococcus xanthus
agccccgcgcgggagcgcaacctcgcgctgctcgcgaagcctggcaccgtggcggtggtgacggggcagcagatgggcctcttcctggggccgctgtacacgctctacaaagccgcatccgccatcgtcacggcgcgcgcgcttcaggaagaaactggccggccctgtgttcccgtcttctggctccagacggaggaccacgacctccctgagattgaccactgtgtcatcccacgtccgggcggagggccctgtcgcctggcgctcgagcttccggatgcagcaacgtctcgagcgcccatcgcccaccgccaccttggaccgagcgtcctccccgccctggccaccctccgcgccgagctggaagcagaaccccatgcggaggaattcctctccctgctggagcgggcttaccgccctgaagccacgctcgcgggagccttcaccgacgtcctgtcctctctcttcgccgacgagggactcgtcttcctcgacccgagagacgcacgactggcgcccctcgccgcgcccgtgcaccgcttcgccctccaggaagcgggggcactctcctcggtgctcgcggcccgagcggaggcgctcacccgcgcgggctacacggtgcaggtccatgtccgtccgggctcgccgctcagcttcttctcacccgatgcactcgatggccctcgctaccggctggacccggcggaagcggacgcctggagtctggtgggtcacccggaaagcagcgccatcacccaggacgcgctgcatgccgccctggagcgagagccgctgcgcttcaccacgtccgcgctgctgcgccccctcctccaggacacctggctccccacggccgcgtatgtcggcggcccgggcgagctggcctacttcgcgcaactggcaccgctctacgcgcacgcgggacgtccgatgccactcgccattccccgggcccgcttccgcgtgctcgatgaccgcgcgcgacggtggctgggcaaggtggggctccagccggatgaggtgaacgtgccgcgcgacgcgctgctcacgcggctggccacgcgtgatgccccggagtcgctggagacacccgaagccctggaggcccgcctcttcggcgcattcgcctccgagctggagcgcgtcgccgggcaggtgtcggcggtggacgcgaacctccaggacgcgctgcgccgcacccagggcacggtgcgtgtcgcggtgtcccggctgacgggccgttaccgccgcgcgctcgcccggcgtgatgccaccgcggccgaacaggtggaccgcctgcgcaccttcctcttcccggaggacgcgccccaggagcgaatcctcgggctgccctacttcgcctgccgcatcgggacgcgtgcgttcacgaagagggtgctggacgcgtgtgtccccttctccggtgactcgaaggacctgacgccatga

SEQ ID NO: 9458 - DNA, 336 bp, Myxococcus xanthus
atgggtatcttcgacagcatcaagggtgaggcgaagcgcaacttcatcgcccgggcggactcggcgaagggcgacatcatctacaagtatccggagaacaacgtccggatgctgacccagctcaccgtcgatgcggacgaggtcgccctcttcgtgaaggacggcaaggtggagggcaagctggggcccggccgcccactcgctggacacgaacaacatcccgttcctgtcccgcctcatcgaaggcttcacgggtggcaacctcttcatctccgaaatcttcttcgtctccacccgggagttcgccggcgtgaagttcggcggccccatcggtga

SEQ ID NO: 9459 - DNA, 801 bp, Myxococcus xanthus
atggcgttccgtccgaagcgggccctggcggtgttctggaaggacttcctggacctgcgaaaaaacgtgggcctgctggtgtccatgatggtgctcccggccgtcatggtgctggtgcccattggcgtggtgtggacgtacgtgcgcacgccagaccacgcggacctgcgcagcgtggcgctcttctacgaccccacgctgccgttgggcgccagcgccgcgcgcttcctcatcgacaagacgctcaccgactggttcggcatgttcctggtgatgccggtgttcgtgcccatcctcatcgcgtcccagagcgtggcgggggagaaggagcggcgcacgctggagccgctcctggcctcgcccgtgacggcggcggagctggtgacgggcaagagcctggcggcgctggtgccgtccgtggcgattacgtggacggccttcgtcctgttctgcgtgggcgtggacatcgtcgcgtggccgctggtgaagatgccgctgatgcccaacgcgctgtggaccttcggcgtgttcgtcatcgcgcccctgttcgccttcttcggcaacggggtggcggtgctcatctccgcccgggtgagcgaggcgcgcatggcccagcagctgtccgcgctggtggtgctgcccatcgtgggcatggtgggtgggcaggtggcgggcgtgctcaaggcgggcttcggctactacctgctccagggcgcggtagtgctggtgctggacgccctcctgctgtgggccagtatccgcctgttggaccgtgagcggctggtgagtcgctggggctag

SEQ ID NO: 9460 - DNA, 777 bp, Myxococcus xanthus
atgctcacggggctgcttcagcccaccgagggcgaggccaccgtgtggggccaccgggtggaccgcgacggcgagccgctgcgcaaggtggtgggcctgctcaccgagcagcccggcctctacgacaggctcaccgcgcgggagaacctgcgcttcttcatgaagctgcatgagctggacgaagccgcggcctggcctcgggcccggcactacctggagcgcttcgggttgggtgggcgcgaggaggagccggtgggcggcttctccaaggggatgcggcagaagctggccatcgtccggacgctggtgcacgacccgaaggtcatcttcctggacgagcccaccagcggcttggacccggagtccgcgcgcaccgtgcgtgacgccgtggcggagctggcgtcggaggggcgcaccatcgtcctgtgctcgcacaacctggcggaggtggagcgcctgtgtgagcgcgtggcggtggtgaagcgccgcctgctggccatgggcccggttcgcgagctgcggcacgcggggcaggcgctggaggttcgcgtggaaggggaggcggagcgcttttgtctcgcgctggcccagttgcccttcgcgcccaacgtgctggccgaagggccgaagctgcgggtgatgctggcggacgatgcgcaggcgcccgacgtggtggcgtgcctggtgggggcgggcgcgcgggtgcacagcgcggtgcccacccagcgtcccctggaagaggtctatctggagctgctgcgcgaagggagggggtag

SEQ ID NO: 9461 - DNA, 2007 bp, Myxococcus xanthus
atgtggatgcaggcgctgggcatgaacgtggtgggcgcggcgaacccgggtgggatgctgggcctctatacggagtggggcatgcggatgcccttcgcgctcctgagcatcaccgcggtggcgctgctgtcactggcggtggcacgcgtggtgtcccggcgcgcggggttggccaccggcttcgtgctggccaccatgccgctgtacttcctgctcacgcggcagacggtgacggacacgcccttcgtcaccaccttcatctgcgccatggcgtgcgcgctcatcggccaactggatgcgacgacgaagcaccgcgccgcctggtggtacggcttctatttcttcgccggcctgtccgcgctggccaagggcctgctgggcgtgggcctgcccgccgtcatcctggtgttgtacgcggccctgtccgtcattccctgggacagcgacagcctggacgcacacctgaagtggctcacgcagtcccgcttccgcaaggacgtgcgcgagggccgtcagcccatgcccgtgctgtgggggcagatgttcaagatgcacctgggcacgggcatcctggtgttcttcgcggtggcgggcccctggtacctgacgctgtccctcttcggctccgtggacgatgagggcaagctcttctggtaccgcttcttcgtccacgaccacctcaaccgcctcacggcgggcgtgcacaccaccacgccgggtggcacgttcatctacttcatcgagcaggggggcttcgccatcttcccctgggtggcgctgctgcccggcgccttctcggtggtggcgcggctgaagcttcgctcggagaaggcggcggaccacctggccatcatcgcggtgctgtgggtggccttctccttctggctgctgtcgtccagcgccaccaagttccaccactacgtcttcccggtgctgccgggcgtggccgtcctcctggcgctcttcatcgaccggctgtgggaggagggcatctccgcgcacgcggtgagcctcatcttcgggttcctgctcttcgtcctggtggggaagaacatcgcggagaacccgaagatcttcaccgacctgttcgtctacaactacgaccggacctatacgcaggacctggtgacgaagcccatcgcgttcttcacctcgcgctcgctgtggacgggagatttggtgacgctggtgctgctggccttcggcgtctacctgtccttcgatgccttctccgcgaaggggcgggcgcggacgacgccgagcgcgcgcgccgtggcgttgatgctgctcctgggcggcgtggcgacgctgggcgcggtgagcgcccaggcccaggtgtccgccaaggcgctggtgggcgtagcggtgctggcggtggctggttatctggcatgggagtccatgcggccgggcgcggaggggcgcgcgtcgctccagacactggccggcgtgctggcggtggtgggcatcgcgttcgcggtgcggggcttccgccagccggcggcggaggactcgctgctcaaggcgctgtcggagcccgtcaacatcaagaagacgctgggcttcaccttcgcggtggcgggcggcatggcggtggtggcgtcgctgatgcgagcgcgggcgatgctgttcggcaccttctgggtgctcgcggcgggcatggccctctggttcaactggagccactgggtggacctgtcccaccactggacgcagcgcgacctcttctggcgctactacgcgcagcgtcaggcgggcgagcccatcgtcgcgtacatgatgaactggcgcggcgagacgttctactcgcagaacacggtggagcagtaccgcgtgtcggacgcgaacgcgcgcatgcgcgccctggcgcagcggccgggtcgtgagtgggccctggtggagcacaaccggctcaacctgctgcgcaccgcggtgggctcggacaaggtcgtcacgccggtggaccgcgacatcaacaacaagttcgtcctggtgaccatcgattga

SEQ ID NO: 9462 - DNA, 369 bp, Myxococcus xanthus
atgagccaggtgggcagcatgtccggcacggcgaacaacgccatcaacgtggcggacaccttcgagtcgggcgtccgcgtcatcaaggatgggctgcagggcaacatgccttcgtcgatgccctcgacgaccgtcgcgaagacggtgggcaaggccgtgccgttcctgaacgtcttcagcacgctgtcctcgttgtccaacacgcgggacgtgttcaccaacccgacgtccacgccgtcgcagaaggcgcacgcggtcatcgactcggcgacctctgttctctccgcggtgccttacccgcctgtggcgctgggggcgacgctcgtgaacgtgttgaacggcgccgtcacgccgacagagccgaagtga

SEQ ID NO: 9463 - DNA, 759 bp, Myxococcus xanthus
  unsure (1)..(759): unsure at all n locations
atggggtggacgtcggtaggcgtggacaacgcggggcacctgggcggtttgctcgcggggctgctggccggcgtcttcctggagccgcgctggcacccggacacgggctggctgcgcccggtggggatggtggtggcggcggtggtggtnacggggggcgtggttgcggagcgctccgtctggcgcatggagcgggatgacggctttggcctctccgtggccctgccgcgcgactggcggggcgacgtggacgggcagggccggcgggccttctccaacggactgccggggcgtggccgcgcgaccttctcggcggaggccatcgaggcgggggagccaggagacggctcggtccaggcgcggcagttccagcaggaggtgctggttcagggcgctccgagccccgaggggcggacgctgaaggtgacggagccggtggcggcgcgcgtgggcgggcggagcgcgcagcggctgcatgcggagttggaggggccaggggggcccactcacctgatggcgctcttcgtgccacggggggagtgggtgtaccggctggtgttcacctggcccgcggcgtaccccgcctatcgcgaggtggtggaccggatggtggcggaggtccgcttcgacgagccgtccgtcctacgcgaggcgggggctacaccgctgattgctccaacgacccccccaccgtggcgctcctggccaacagcgttgagccgcactaagggcccgccccggaagcagtggcgccgttga

SEQ ID NO: 9464 - DNA, 255 bp, Myxococcus xanthus
ctctccaggttggatgactgcctggcggacgcggagacgcgcgcgctggcgctgtgcgccaccctggccggccatgcaccgctggcggtgtcggggatgaaggagtccttcgggcgcctggctcgggccccgttggaggaggcggaccgggcgcggctgcgcggcttgcgcgcggcggccttcgggagcgaggacgcgaaggaggggcgggcggccttccttgaaaagcgcccgccccgcttctccggccgctag

SEQ ID NO: 9465 - DNA, 384 bp, Myxococcus xanthus
gagtagtcactgcgcggcgccgcgctctgggacgaggtgaaggaccggctggacgaaagcgccctgggcctgtccggcggccagcagcagcgcctgtgcatcgcccgcgcgatggcggtggagccggaggtgctgctgatggacgagcccgccagcgcgttggaccccatcgccaccgcgaaaatcgaggagctcatccacgagctcaagtcgacgtacaccatcgccatcgtcacccacaacatgcagcaggccgcgcgcgtcagcgaccgcaccgctttcttctacatgggcgagctggtggaatgcggccccaccgagcagatcttcaccaacccgcgagagaagcgcaccgaggactacgtcaccggcaagttcgggtga

SEQ ID NO: 9466 - DNA, 678 bp, Myxococcus xanthus
atgcatacggacaaggccttcgaggcggacctgagggatttgcgggagaagctgctcgccatgggcgcgaaggtggagaccctcatcgtccagagcatgaaggcgctcacagaccgcgacagcgccctggccgagaaggtcgtcgccgccgacaaggacgtcaaccgcctggaggtggacatcgacgagctgtgccggaagattctggcgctgcgccagcccgccgccagcgacttgcgcctcatcaccacggcgctgaagatcgtcaccgacctggagcgcatcggcgacctggcggtgaacatcgccgagcgctccatggacctgaaccaggcccccccgctggcgccctacgtggacacgccccggctggcggagctggcccagcggcaggtccgcatgtcgctggacgccttcgtctccggcgacgtcgccaaggcggaggaggtgctccggggcgacgacttgctggatgccctcttcctcaaaatcttcaacgagctcctcgcctacatgatggaggactcgcgcaacatccgccgcgccacggcgctgatgttcatcgcgaagcacctggagcgcattggcgaccacgcgctgaacgtggcggagatggtcgtctacatggtgcgcggcaaggacatccgccacccgcagagccgcaacctggcggagtag

SEQ ID NO: 9467 - DNA, 1209 bp, Myxococcus xanthus
atgttgctcgcctccaccgtcctgctgcttgccgcctgcctcggactgttcgttctcaccgtccagttcgcgctcgtgctgcgtcaccggcgtgagccgtcccccaccgcgcaaccgggcacgccccgcccgggcatctccatcctcaagccgctgtgcggcgtggatgacgacctggaagccaacctggcgcagttcgcggcgctggactacgcgggcgcgtacgaggtggtgctcggcgtcaaggatgccagggacccggccttcgccgtggcccgcgcggccgtggcccgctggccccacgtcatgcgcctggaagtccaggacggcgagccgggccgcaacccgaaggtgaaccagctcatcaccctggcggaccgggcgcgctacgacgtgctggtcatcagcgacagcaacacgcgggtggcgccgggatacctggaggagattgcccaggccttcgaggacccggcggtgggctgtgtcacccacccggtggcgggcatgggcgagcgctccttcggctcgctcctggacaacctgcacctgggcgccagcgcggcggcggggatgattgccgccaagcggctggcgggccaggacatcgtggtgggcaagtccatggcgctgcgccgcgaggacgtggacgcgctggggggcttcttctccgtgaaggatgtactggcggaggactacgtcatcggccagtgggtgacgcggaaactgggccggcgcgtggtgatggcgcacacgcccgtgttcaacgtgtcgctgcgcaagagcgtcctgtccttcttccagcgctatgtgcgctggagcgtgattcaccggaccgcggtgtctccggggacgtacctggcccaggccctgctgaaccccacgccgctggccctgttgggcgcgatgctggccccctcctccgacaccgcggcgctctgcctggtggtggccctgggcaaggtcgcggtagacctctccaccgtgcgcgccctgcggccgcaggccctgtcgtgggacgcggtgcccgccgtcttcgccaaggacgccctgctcttcgcggcctggagctacgcgctcttctcccgcactgtgaactggcgcggcacccggctgcgcgtgggccggggcacccggctgatgccggtgcgcacggcaggcctgacgtccgagcccgcgctgccccagggcgaccgcatcctcgcgggctga

SEQ ID NO: 9468 - DNA, 2151 bp, Myxococcus xanthus
atgaaactgcgcaagccctcggcgaagacccggcccaccacgctcaagagcgaaagcctcgaaccccaccggatgcatgcggtggggaaggtcctcaccacggaccagggcattcccatctcggacacggacaactcgctgaaggccggcatccgcggccccacgctcctggaggacttccacttccgggagaagatgatgcgcttcgaccacgagcgcatcccggagcgcgccgtccacgcgcggggcgcgggcgcccacggttacttccaggtctacaagtcgctggagaagtacacccaggcccgcttcctcaccgacccatccctgcgcacgccggtgttcgtgcgcttctccaccgtgggcggctcacgtggctcggcggacaccgtgcgtgacgtgcgcggcttcgccaccaagttctatacggaggaaggcaacttcgacctggtgggcaacaacatgcccgtcttcttcatccaggacggcatcaagttcccggacttcgtccacgcggtcaaacccgagccgcacaacgaaatcccccaggcatcctcggcgcatgactcgctctgggacttcgtctcgctcgtccccgagacgacgcacatgatcatgtggctgatgtccgaccgcgccattccgcgcagcttccggatgatggagggcttcggcgtccacaccttccggctggtcaacgcggccggcaaggcgaacctggtcaagttccactggaagccgctactgggcaaccactcgctcgtgtgggacgaggcccagaagctgtccggcaaggacccggacttccaccgccgcgacctctgggagtccatcgagcgcggtgacttccccgagtacgagctggggctgcaaatcatccccgaaggcgacgagctcaagtacggcttcgacctgctggacgccaccaagctgctccccgaggagctggcgccggtgcagcgcgtgggcaagctgacgctcaaccgcaacccggacaacttcttcgcggagacggagcaggtggccttctgcgtggccaacgtcgtccccggcatcgacttcaccaatgacccgctgatgcaggcgcggctcttctcgtacctggacacgcagctcacgcggctgggcgggcccaacttcgcggagctgcccatcaacaagccggtgtgccccgtcaccaaccaccagcaggacggcttcgggcggcagaccattcccacgtcgcgcgccaactaccaccccaactccctgggcggcggctgcccggtgctggcgaaccccgcgagcgcctttcgccacacccaggagcgcgtggagggccacaagattcgcgcgcgcagcggcagcttcagcgaccacttcagccaggccaccctcttctacaagagcctgtcgaggccggagcaggagcacctcgtggccgcgctcgagttcgaggttggcaaggtggagcgcgtggagattcgcgagcgcgtggtgaaccagattctggtgaacgttgacccggagctggccgtgcgcgtggcgcgcgccgtgggcgtcacgccgccgaaagcgaccaggccccccaagccgtccaaggccgcgggcaagaaggcggcaccctcggtggaagtgtccccggcgctgagcatggagaactcgccgcatgactccatccggacgcggaagatcgcggccctggtatcggacgggttcgccggcaaggagctggacggcgtgcgcaaggtgctggaggagcgcggcgcgacgctggagctggtgggccccacgctgagcccggtgacgagccaggaaggccgggaggagcggcccctgcggaccttctccacggcgtcttccgtcatgtacgacgccgtctacgtgcccggtggagagaagagcgtcgcggccctgctgcgcgtgccgctggcggtggacttcgtgcgcgaggcctacgtgcactgcaaggcgctggcgctctccgcggacgccaacaccctgctggacgccgcgggcgtgcgcgacctggaggcgccgccgagcaagggcctggacgccacgcgcggcgtcgtccgcagcgcgaaggtggagacgaagggcttcggccagctcttcaccgagtccatcgcccgccgccactgggagcgtgaggccccgcccccggcgtag

SEQ ID NO: 9469 - DNA, 1269 bp, Myxococcus xanthus
aacggcgtcttcgccggtgcggagctggccatcatctctgtccgccggacacggctgcgggaactgattgaagaaggcagcacctccgctaaagcggtggaggccctgcgcggcaaccctgagcgcttcctggccacggtgcagattggcatcaccgtcatcggcgccacggcggccgcgttcggtggcgcgagcatcgccacgcgtctgggtgacttcctcacgagactgggagtgcccgagcagcaagcggacgaagtcgccctggcgggcgtagtggccttcgtttcctacctctcgctggtgctgggcgagctggtgcccaagtcgctcgcgctgcgtgccggcgaacgctatgcgctgctcatcggccggcctctgcgcggcctggcgtggctgatgcaaccggtggtgtggttcctcaccgccagctccaacgtggtgctgcgcctgttcggcgaccggacgaacttcaccgaaggccgcctgtccgcggaggagctccagcagttggtggaggaggcggcgaagcagggcacgttggatccgcacgccggcgaaattgcatcacgcgccttcgagatgggcgacgtgacggtgggcgagctgtcagtggcccgggatgagatggtggccctgcggcggcactccagtccggaggagattcgccgcgtcctgctggagggcggccactcacgcatgccggtgtacgagggcacgctggacaacatcgtcggctacgtcatcgccaaggacctgctgggggtggcctgggagggcaacctcatcatcctggaggacgtgatgcgtccgcccttcttcgtcgtggagacgatgcgggccatggacgcgctcaaggaactgcagaagcggcgcatgcagctggcggtggtggtggacgagcgcggcggtgtggtggggctcgtcaccgtggaagacctcgtggaggagctggtgggcgacatcctcagcgagtccgaggtgccggaggagtacgtcaagcgcgaggggccgaacaccgccctggtgctcggcaccgcgaacatccgagacgtcaaccgggagctgtccctggacctggacgaggatcaggactacgccaccgtggccggcctgtgcatcgccctgtccggcggcgccatccccgagccgggcacgaaggtccagacggagggaggactcgtgctggaggtcgtcgcatcctcgccccgccgtgtggacaccgtgcgcttccacctgccgcagcgcgaggagcccgtggaagcgtga

SEQ ID NO: 9470 - DNA, 1221 bp, Myxococcus xanthus
atgaacggacgaatccgactggtggctgcgctgtgttggggcgtgatgatgggactgggatgtggtggcttcgatgagcggccgccctcgcaggagccccaggcgacagtgccgcaggctccctcgttggtgatcgcggtgccaggcgacggccaggtcaccgtgacgtgggatgtcccttcggacggagggagcgcgctcctcgattatgcggtgcatgtgcactcggacgctgcggaggtccgcgtggtgacggcgcccgcgtccgagtcccgggccgtcatcacggacctgacgaatggaaccgcctacgctttcagcgtcgtcgccaggaatgcccgtggcaacagtgccgcttcggggcgctccgaccgagtggtcccccatgtgacgcccggtgcggtgcggaacctggtggccgtcgagagcgaccaacgtgtgacgctgagctgggatgccgcggatgacaagggcatgccgctggacagttacttcatcacgccctacttcggcgcgcaggaaggcgagatggtgagggtgcccgcgaccgagttggggaagacctttcacccgctgaccaacgggatggcggtgagattcgtcgtcgttgcctccaacgggcattcacgggggcccgaggcctccatcgaggcgacgccctatacgacgcccggcgtgcctgtcgtcacggtcttccccagtggtcagcgggtgcgcttggcctggagcgtcgaggacacgggcggcagccccatcacctcctaccgggtgacggtgtacctgggggacgaggtgattcgcaccgtggataccgccgcgacgggcacgctcgtggaagaactggagaacgccacgacctaccatttcaccgttgaggcggagaacgcggcgggctggggcggggtctcggagcgcatcgccgccatgcccacgcgagccccctccatgccgctcaatgcgatgtgccaggggggcgacggatggatctccttttcgtgggagccaccggagttcgattacggcaaccccgtgacggagtaccgcatcaacgctgtcgtcaatgggaacagcacggactggtacaccactgacttgagctaccacctcacggacattcccaacgacggcagggtcctctacttcttcatctccgcgcggagtgccgtcgggttcgggtcgtccgccgacctcacttgcttcacccagcccgcgcgtccatag

SEQ ID NO: 9471 - DNA, 4347 bp, Myxococcus xanthus
ccctatgcgggcaccgcgaccctcatgggtacggagttcgttgccccggctcaaccgaccatcacggtccccgctggctccatcgtgacgaataaccccctccccacgctcagtggcatcagcacggcgaactcggaagtggtcatctacgcgctcgaggggggcgttgtgtccggggtggagtacggacgcggcgttgttgggagcaacgggagtttctccctgacgctctcccggccattgcaaacgggagaaattacgcacctcgtggccgtgacggaagcccaggggctgcaaggcgcgccgagcgcctcgcgtgccttcacggtcgacacagaagcccccgatacgtacttcgccgagaacggagttccggcttctccctccaggctgtcctcggtgagcttcaccttcgcatcgaacgagctgacgggtatcacttaccagtgccaggtggtgtcagggattggcacgacggctccctccacgggttgggagccttgcgacagtccttacaccacgacgacgacgctcacggatggattgacgtacacgatgtgggtccgtgctcatgacgcggcggggaaccgggatccaacacccgctcgatattcctggctcgtggattgcacgcgccccgaaaccgaattcgccgctaacggcaccccggggggggcttccaacgtggtcaacccggtgttccgattcacgacggaggcgaacgccacctttgagtgcatcctggtccctcctggagcaacgacggctcccctggagaccgacagccgatgggccgcgtgcacgaatccctatgtcgcgcctactcggtcagacaacactgcgaacacactgtgggttcgggcggtggatgcggcggggaacgtggatgacactcctgccacttattcgtggacggtggacctgcgcgaccccgacacggagttcacggggacgctgcccgagccggtgaacaaccttgaatcggtgaccttcaccttcagctcgaacgagtcgaatgtcatcttcgagtgcagcttgaacggtgcgggcttttctccatgcacgagtggaagcagcatcgcgacgacggaactggaggcttcgttcacgctgctggttcgggcgaaggacccggcgaacaatgtggacaagacgcccgccaggtacgattggcggacggacaaggttcgtccggacacggtgttgcacaccacgatgggcagcttgagcaacgcgctgcaggcgggcttcgacttcaactctcctgacgcggacgtggtgggctttgagtgcattctggcgtcgccgtcgacagcgccgatgccggacgaagaggacgcgcgttgggcgggctgtgctgcctcgtacctgacgcccgagttgacgcacaacaccacctaccggctgtgggttcgggcggtggatgcggcggggaacgtggatggcatgcctgccagccatgagtggcgggtggacctggagcctccggatacggaactcacggcgccactgcccgcgccggtgaacaaccagacttcggtgcccttcacgttcagctcgaacgacccgcaggccaccttcgagtgcagcctgaatggggcgcccttcgccacgtgcacgagtggaatcatcgttcagacaccgggtgcggatgcgccgttccggttcctggttcgggcgagggatacggcgggcaacgtggacccgacgccagccgcctactcgtggcggacggacaaggttcgtccggacacggtgttgcacaccacgatgggcagcttgagcaacgcgctgcaggcgggcttcgacttcaactctcctgacgcggacgtggtgggctttgagtgcattctggcgtcgccgtcgacagcgccgatgccggacgaagaggacgcgcgttgggcgggctgtgctgcctcgtacctgacgcccgagttgacgcacaacaccacctaccggctgtgggttcgggcggtggatgcggcggggaacgtggatggcatgcctgccagccatgagtggcgggtggacctggagcctccggatacggagctcacggcgccactgcccgcgccggtgaacaaccagacttcggtgcccttcacgttcagctcgaacgacccgcaggccaccttcgagtgcagcctgaatggggcgcccttcgccacgtgcacgagtggaatcatcgttcagacaccgggtgcggatgcgccgttccggttcctggttcgggcgagagatacggcgggcaacgtggacccgacgccggccgcctactcgtggcggacggacaaggttcgtccggacacacaagtggtggccttggtggattcaccgagcaatgcactgcgtgcccggttcaacctgtcgtctcccgacacagacgtggtgggcttccagtgcatcctggttcgaccttcgtcgaccacgatgcctgaagaagatgatgaggactgggaggcctgcggggcctcacacctgacgtccgagttgatcaccagcacgtacacactctgggcaagagccgtggatgccgcgggcaatgtagatgccacgcccgctggtgcgacatggacggtggaccgagatcctccggacacggtgatcacgtccaagccggacgcgttgacgggcgagccgacgacggccttcgcgttccgcggaggggataacgatacggacgtcgtgggcttcgagtgtagctatgacggacgagacttcttgccatgcgagagtccctttgccctcccgaatcctccaggcatcccggtctatgcggagggtgatcacagcatgctcatccgggctgtcgatgcggctgggaaccgggatgagaccccggccaaccacatctggaggttggtggtgggggacccggtgacctattttcagacggcgcccccgacggtgactcggcaaaccagcgcgtcgttcagcttcacctccaatctgaccaccgtgatctatgcgtgccagttggacgacgagccgcgtgaggaagactgcgcgacctcggagtcgccgaccaagccgtatacgggacttgccgaagggggacacaccttgagagtgtgggcccgaggaggggggcgagaggcctcgtcgccctcggtttataactggaccgtcgacctgacggggccggtggcgccggtcatcaacgttcctgctcagaacgatgtctacttcaacgtccagtggcctcaattcagtggacgcgtttccgaacgcggaaccttcatcatcaagatggatggcgacatcgtaggcacgttccaggtctcggagcagtcgttgtcgtggagcttcgaaagcccggtgcaactggcggatgggccccatgtgctggccgtctcgctgaccgatgccgtaggcaacgacggtgcggaagcctttcgaacgtttactgtcgacgcgacgaagccggaaactcgactcaccgcggccccgccacacctgacgaatcagccgcgcgcggtcttccagttcgaatcgaatgaggtaggcacgacgttcgagtgcagcctggatggcggtgccttcgcgtcgtgtactggccccaactctcatgaagtcacggtgggggatgcacttcacacgttcgcggtgcgtgccgtcgaccgcgccggcaacgtcgcggatgtgcagggcgcgcacgagtggcgcgtggactcggtggcaccgacgaccaacatcattgaaatgcctgtcgcggatacgaacgtggcgcgggcggtcttccgtttcgagtccgacgagtcgttcgtgaatttcgagtgcagcatcgacggtgctgcgttcgacaactgtccccctgcgtacacgtgggatggcgtgccggaaggcgagcaccgcatcgaggttcgtgctcgcgatgaggctggcaacgtggatgcaacgcctgcggtgcatgtctggcgtttggacacgacgcctcccctggtgccggtggtgagttcgcccgcgcccgaggcggtcgtgggctcgctcacgccgacgttccagggaagcgccgagcctgggagtgaggttctgctcttcgttgacgggctcgactttggcagtgcgcgtgtcgaacccaccgggcagtggcgcctgacgttgacccgggccatcagcgagggagaccaccgattcagtgccttggcccgggatgccgcggggaacgaaagcgagcgctcggcagagagcgccttcaaggtggatccctccatcaacatcatccgggcggtcagttcccgcggtggcggattgagctgtgccgcgggagggcgggggagtgcgccccttctgctcctggggtggggcgtactggtgctgatggctgcccggaggcgccgcgtgtga

SEQ ID NO: 9472 - DNA, 1794 bp, Myxococcus xanthus
tttctgtccgccggggcccaggaagcacccgtgttgcaaggcttcaacctgaagcgcctgaagctgaatcccggcgcggagggttcgctcctcgtcggcatgggcgaactgcttcccgtgggggcgttccgcgcgacggtgatgatgcactacgcacatcagccgctcgtctacatggacaacctcattcgcgagcagcccgaggtggccatcgtctctggacgcaccacggcgcatctggctgccgcgtatgccccgttggactggctccaggtgggcctgcaggttcccatggtggcgttccagggcggcgatgacgttggcatggcgcgttatgggattgccgtgcccgccagtcaggcgctgtccacgccggtggtgagcgcgcgcttcggcttgctgaggcagacggaagcgggtggggtggacctggccctggatgtggcggcggggctgccgctgggcagcgagggggcctttgcccgcgatgatagcgggctccgcttgtcgccgcgggtgatggtgggacggcacttcggcttcatccgcgcgggcctggaggttggctatctgcagcgcccgcgcgtgctgctgacggaccgcacgggcgaaaccgaggatgaggtgggccaggagctgcgcctgggcgtggcgttggccacgacgggcaagcggttgcgctgggagctcaacgtccggggcatgctgccgctgacggatcagccgacctcggtggagttgcttcctggcgctcgctacctggtgggctcgtcgctggagatgttcgcgctggcgggcgtgggcgtgggcgcggcgcccggcacgccgctgttccggctgatggtgggcggggctttcggcaacgtgacgccgccgcggggcccgggtgagtcctcggtccggtgtgagatggggctgccgcccgaggcgaagattcaagagtgcccggacatggacgaggacggcgacggcgtgcgtaacgccgacgacaagtgcccgctggtgccgggagacgtggcgcgccaggggtgctcggctcaggacacggacggcgacggaatcgaagacatgttggacggctgcccgctggagcacggtcccgccgcgcgccagggctgcccgattccggaccaggacggtgacgaggtccccgacgaaatcgacagttgcccgtcggacccggggcccgcggacaaccggggctgcccggtgcgggacaccgacggcgacggcatcgacaacgacaaggacgagtgcccgaacgaggccggtcccatcgagcgcaatggctgcccggagtcggacacggacaaggatggcgtgcccaaccgcgcggacagctgtgtgaatgagccgggggacgccaagaacctgggctgcccgctgcacatcctgccgctggtggagattcgtccggaccgcctggtggtgatgggcaaggtcttcttcgagccgacgcaggcacgcatccagaagcgctcctatgaattgctggattgggtggcgcgcgtcatccgagagcacccggagattccgctcgtcgtggtgggcgcgcacacggacgaccggggcttcccggacgacaaccgccgcctgtcgcaggggcgtgcggaggccgtgcgccagtacctcatcggccgggatatcgcgcccgagcggctgaaggccctgggctacggtcaggagcgccccatcgacagcaacgcgacgtcgaacggccgtgagaacaaccgccgcgtggagttcctgctggcggacccacagcaagacaagtccgagcgcggtcagcgctga

SEQ ID NO: 9473 - DNA, 2310 bp, Myxococcus xanthus
atgcggttcgtcagccggctctgggacgtccgcaccgccagcctgctgcgcgagttcgagtccgtcgacctgtgcccgaaaggcgcgctcgtggaatgcacggacgcgctgtacgccgacatttcaggggaggacacccacgcctttggcttctcgcctggagatggaacgctttggctgggagggcgccgaggcaccctgttcaggtggagccaccagggcgctgtgccctccattccggatgcccaccaggacaggattacagccatttcgttctcggacagcggcgaccgcgtgctgtccgccagtcgcgaccgcacggtgaagctctgggatgcgaacaccggacggacattgcgcgagctgaccttccaggagccctgcacccaggcagtgctgtcgggcgactcgcgttacgcatgggtgggcggtgaagaactgacgtgcctctacgacctgacctccgatgcgcgcctcatccggtgcatcacgacgcatgacccgggcccctcggtcgccttctccccttcgagcaggcttgccgtgctcggcgaccggcgcggcgaggtcagcctccgtctgctggagctgccctctggccaggaccttcatcgcccgctcacgaaactcgaagggcacgcgctcatgccgtccttcgaagacgaatgcagcctctcggccttcgacgacaccttctcctcggcgctcaccgtgcgcttctgtgacagtgggcctggcaacgccaccggaagcgcggcatccccgcggatgcgaacacgctggaggcccattcccctccatggacgcctcttcgagaacgggcggcgcgccgtcgatttcgccgaaaatcccgtgggcgcccatcccttcatccgggttccccaggcaaccctgcgctggatgtttcgccaggggcctttggagtcccgggcggagcgggccctggtcgcgccggatggacgcacgctcctcgcccaggccgaacccggcctcacgcggaagaccatcgatatctccacctggaacgagtacgtgccgggcggcttcgccgtgtccaaggacctgcgttggatggtggtgagggagccgcaaagcggccagctctcactcgtcgacagggagagctcgagccagacagcactgggcgcgtgtgacgtcgaaggcgtgtatccgcccctggagggcgccttctctcacgacggccagttcctcgccgtccgctgcggcgtgaacgtccggttctgggacgtggcgcaggcgaatcgtggaccgcgcacacagccgccgcccatcgaagcaggaatcaacctgacctccctccccgcgcactggcgatggcggcacgtcacccccacggaggaccacgccaccgagagcttcctggcgtcgcctcgcacccgtgcgcacctccagcggaccgaggtgcctggcgatggcgcatgtcagacgcagaggacgttctcccagagcgccctcgtcgagttcgcccccagcggcagatacttcgcgattggggacgaacgctccgtctacctgggctccgcccgagactgccggctgacgcgggaagcacctctggccgcctctgcgataacatcccagggcgcctcgttttcaccggacggcgagcgtttcgtcaccatctccaacgtgcccgagtcctccgcgatctgggaaagcgccacggggacgaagctggcgccactgcccacgagcctgggagccgtcgtcatggcgttctcaccggactccaagtacttcgcggtcgccaaccatcccgacgtctactggatgggacaggcctacctcctcgacgccaccaacggcgagaagaagcccctggcggccatcgacgggaaggtcaaggcgctctccttctctcctgatacgtcgcggctcgtcgcggtgacagacgatgccatccacctcttcgacccgaactcaggcgcgctcgtgcgcagaatcgacgtgagcacggatatccacgtgaaggtccgccatgcacaagcgcgcttcggtgtctcggacacgtcgggcaagctccacttctggcgaacctccgatggccggcacgtggccgagctgcaccagggctaccgctccggcctggagatggagcccgatgaggagggcacgcgcatcgccaccttcgactcggacggagcctatgtcttctcgctccggccggacgacctgctgcgacaggcctgcgcgctcatgcgcggacggcgcgagtacgcaccggtccagtccatctgcgacaccttccttctcccagcggtccccctggcggacctgcagacgccgtga

SEQ ID NO: 9474 - DNA, 780 bp, Myxococcus xanthus
gaaacagtcgtcgccttcttcggacgccctgccctcgccatccggaacggcagcttcggtgcgccgcccgtggggtgggagatgttggagcaacaccgcgagcacatcgagcgaaccatcgacgccaccgggcgcatcgagctggccggaagcggcatgctcggcacgggcttcctggtgaccgatgagctggtgatgaccaaccgtcacgtcgcgcagcacttctgccggcgggcgacggacaagtgggtgctgcggctcggcgtggtgcctcgggtggactggctgggggagcatcagcgcgatgcccaggccaccttccccatccaaggcgtcgcggcggttcacgccgtgcatgacctggcgctgctgcgactgggggctcccaagggggcggtgctgcgtcccgccccgctgcggctcgccacccaagcaccggacgcgacagactcccgcgccttgtactgcgtgggctacccgatgaaggaccacagccggacgccgcccgaggtgctgctgcgcatcttcgaggacgccttcggcgtgaagcgactccagccaggagagctgctctcgctcgacccggcccggcagcagctctcccatgactgctccacgttgggaggcagctccggctcgcccatcgtcgagttggagacgcacgcagtgctcggcctgcacttcggtggcacccggcaggagaaccacgccgtcgcgctgtggcaactggcggacgacccgctgctgagccgcgcgggcgtccgcttcaccacgccgtga

SEQ ID NO: 9475 - DNA, 342 bp, Myxococcus xanthus
tactcgggctgcggcacctgcaagaaggcactgaagtggttgcaggagcaaggtattgcccaccaggtgcgccccatcgtcgagatgccgcccaccgtggcggagctgaagcaatggattgcgcgcagcggtgtctctgtccgcaagtggctcaacaccagcggccagagctaccgcgcgctcggcaaggcgaaggtggatgccgccagcgacgcggagttggtcgagtggctggccgcggatgggaagctggtgaagcgccccgtgctcgtcaccggtgacaccgtcctcgtgggcttcaagcccgaggcctacgagcagcacttcgcttcgcgcggctga

SEQ ID NO: 9476 - DNA, 471 bp, Myxococcus xanthus
atgccacgcgtcgaagcgcacatcgcctcggacgcggcgctggcccgtgcgctggcggacctctatggcatcgagacgcccgccgagccgcccatgcccccctcactcgcgcccgggggccccctgctgctctatggctggtcgcccgtcacggcagtgctcatcacccggctgctggcgaggaacggcctccaggcccgcaccgccacccccttggaggtgctgcacaccgggccggaggacgtcgtgctcgcgcccctccaggccatggagggcctgctggccggggaggtccacatcaagggcgccctcatcgtccacggcagcgatgacgagagcttcgaccgggtccgcgagctcggcgcacgcggcttcctggccagcccccgggacgaggagctcctgctgcgcgccgtccgccggctgaggccccacccgggctcgcccgactcggccccaccctcgcactga

SEQ ID NO: 9477 - DNA, 945 bp, Myxococcus xanthus
atgtccccccgcattggcaaccgcccgcagccgcccccgccgccgccgcccccgccgccggctcgcgacacccggccccctgcccagggcggacgtaacggcccgcgcgttgacacccgggcttccgcgtccggttcggtggagcagccgcggcacagcgcgctgagcggccagtccagcttcacggccggtggtgcccgcgccgatgtgagcggcaccggtcccggtggcatcgacacgcgcgcccacgtccagggtccgacgttctccgcggatgcgcaggtggacgcggacatcggcctgtccggcatcgacgtgagcgtcgacatcgacatcgaggccaacctcatcgaggcgggcgccggggcctccaagacggtcgagttcgagattgccggcgaggagtactccgtcgagctggacctggaggcgctgggcaagattggcgccgagggcagcatcgaactggacctgcacgtgggcaccgacggcaacgtgtccatcaacgcctcggcctccggcttcgcgggtgcgcaggcgagcctcacgggctccatcgagctgaagcacgaggacgacacgctcgcgtccggcagcatcaccgccagcgccagcgcgggtgtcagcggcgacgcgcacgccaacatcggcatcgagaatggcaacctggagttcgacgttggcgtggaggccaccgcgggcctgggcctgggcgtggaaatcgagggctccgtcaatcccggcaacgtgctgaaggccgtgggtgagacggccgccgccgccggtggcgaaatcctggagaacgtggtcgacggcgccatcaacgcgggcggagcggtggccgacgcggcgggccaggtcttcaccaacgcggcggacgccgtgacggacttcgcgggcgacgtgggcaacggcatcaagaacgcctgggaggccgtcttctag

SEQ ID NO: 9478 - DNA, 1173 bp, Myxococcus xanthus
atggccgtctccaagctggcatcctccgccgcgcgtctcatgaagcagggcctgctgaaggaggcggcccgcgacttcgagcgcgccatcgaacaggacccgaaggatgccagcgcgttgctgggactggcccggttgcggctggcccagcacgacgaaacggcggcccgcgcggtgctccagcggctggtggcgctgcatcccacccacccggaggcgctgagccacctggcccggctggacgcggagaagggtgatgcgcgccagttggacctgctggccgcgctcgccgcgcagcccaaggcgggcttcttcgaggtcatcaaccatggccgcgccctgctggggcatgaccggtacgccgccgccatcccggagctggagcgcgcgctggcgctgcagcccggcaatgcccagacgctgacgtacctgggcatggccctccagggtgacaagcagttggaccgggcactgcggcgctatctagaggccgcggaggccaacaagacggagcacctgccgctccagctcgccgcgcgtgtgcagttgctgcaagggcacgtgggcgcggccatcgtcacgcttcggcaggcgatcctgcgcagccctcgggagacggccctcttccgggagttcgcttcactgtgcctgatggccggcgcccccgaagcggcgatgcgcgccgccatcgagctgcgcctccagctccccgacagcgcggacgccatctacctgcacggcatctccgccttcgtggccggcaaggacgaggacgcggaccgcatcctccgcgaggcgctggccaaggccccggagtccgcgcccgtgcgcgtggcgctggccaaggtgcgccgcaagctgggtgacgacgcggaggcccagacactgctcgaggccgccgtggcgacggacccgtccgaggccggcgccgccaacgatttggcggtgctgcacctgtcgcgtcccggtggtgccgccgccgcgcgcgccatcctcaccgaggccttgaagcatcacccggatgacgcgggcgtccacctcaacctggcgctggccctggcggacagcgacaaggcccaggcgctcacgcacgccaggcgcgcccaggcgagcacccaccgcgacatccgcgagcaggccgagcggctcgtcaccgccctgagcccgcgctga

SEQ ID NO: 9479 - DNA, 378 bp, Myxococcus xanthus
atgatggcgccgcctgcgcctgagaaggcgaagcagcgtgaaccggggcagggccagccgcgcaagcgtcgcaagtccgccgtctacgacgcggatggccaagaggtgctcatctcgctgatgtgcatcaagtgcaagacgctgaagccgctggcgcagttcggcctgcggaagatggcggatggcgccatccggaatcagccttggtgccgcacgtgtcgctcgggcgcgggcagcaagaagcccaaggcgggcaaggacgccgctgccgtcgcgccggtggaagaggcggccccggtgctccaggtcgtgccggccgccgcgagccccgaagcgggtgaatcccccgccgtgcctgtcgccgccgcgcagggctga

SEQ ID NO: 9480 - DNA, 660 bp, Myxococcus xanthus
atgctcaagaagattctcgtcggcctcgccgccgtcatcctgctgttcgtcggcttcgtcgtcagccgtccggacacgttcacctatcagcgcgccgcggtgctccccgtgtccgcggacatcgccttcgcgctggtgaatgacttccgtcgctggacggattggtccccctgggacggtctggacccgcagcagcagcgcacctactcgggcccggagtcaggcacgggcgcgggctacgcctgggtgggcaatgaccaggtcggtgagggccggatgaccatcaccgaaagcaaggccaacgagcaggtcaccatcaagctcgagttcatcaagcccttcgccgccaccaacacctccaccttcgccttcagcgccgccgagggcggcacccaggtcgtctgggccatgtccggcgagaacaacttcatgagcaaggcgatgagcctgctcatggacatggaggccatgattgggaaggacttcgagaagggcctggcgaccatgaaggacgtcgccgtggccgacgcgaagaagcgcgcggaggctgaggccgcgcgcgtagcggaggagaaggctcgcgcggagaccgaggccgccgctgctgctgccccggccggggaaggtgctcccgccgtggccgcgcccgccgtgccgtga

SEQ ID NO: 9481 - DNA, 1317 bp, Myxococcus xanthus
atgaaagcctcccgcttcccgcgctcgctgttcgcgctccccgtggtcctggtgcttgctgcctgttcgtcggggccggatgacaggcccgctcccggagaggacgcgggcgtgctggacggcggcgcggatgcaggcacgccggacagcggcacggatgcgggcagtgacggcgacgcgggcacgccggacgcgggtccggacatcgaggtccccgaggatggcggcacgattgtcagggggacgttgacgggacggctcacggtggagggctcgccgtaccgggtggagggggattcaaacggggtcgtcaccattccccacgggcaggtgctgacggtggggccgggcgtcatcctggacttccgtggtcggccggaggtgtcggagcgggacgtggattcggacgcccccgacaatgtgatgaaccaccaggcgggccgcgtggaggtccgcgtgtacggcgccatccagatccggggcacggcggatgcgcccgtgctgctgacgtccaccaacccccatggctggtgggggatgaacttctacggtgccaactccgtgggctcgggcgacccggtgttcgagcacacgattttcgagaaggtgcgcaagaaccaatacaacagcgaccgcgattggacgcgtgccgcgctgtgggtctactacccgggggcggtgacgattacgggctcggtgttccgtgacaacgagtcctccgccaactgcggcgcgttggacctgatgttcaccgacggctcgcgggtggaaaaaaccatcttcgagaacaaccgcatccgtgaaatcgaccgcttcgcacagccgggcacctattcgatggccggcggtggagcggtgtgcatcacccacggtcgcaacacggtgctgcgcggcaacacgttccggggcaacttcgtgcaggccttcggaggctcgctgacgagcgacctctgggaccggcccatcctcacgtggcccaacccccagggcatctttgacctgggcggtggtgccgccatccactacttccagccggacaatgacctgctggagggcaacgtgttcgacggcaacttcatcccgctgggccccggcgcggccgtccagttggaggacatcggcgggtcgcgaaccgtcgtcatgcgaggcaaccgcttcgtgaacaaccggggcggggccggaggtgtcatcacctgcaaccgtgggtcgaatacgggcgaactggtcatcacccgcgacaacgtcttcactggcaacacggtgaatggacagccggccacgaacatgacgggcgactgcggcgtggtgacccagtaa

SEQ ID NO: 9482 - DNA, 642 bp, Myxococcus xanthus
aaggtgctgctgctgggggacagcctcatcgccactggcttcggggagtacctccaggcccagttggacgcgcacccgcgcatccagtcggcccgccgcgccaagtcttccacgggcctggcccgtccggacttcttcgactggatggacgtgggccgcgaggaggtggagcgtcaccagccggacgtcgtcgtcgtcatcctcgggggcaacgacgggcagtcgctccaggacacccagggtggcaaggccatccactggggacatgcggagtgggaggccgcctaccgtcagcgcatcaatgacttcctggccgtgctctcctcgcccggccggaagattgtctggttggagctgccggccacggggctcaagcgcttcgagcagaagctgcgcatcatccgcgccctccagcgcgaggtcatctcctcccgggaggatgcggtgcacctggacacgcgccccttcttcaccgacgcgaaggggcgagcgctgagtcaggcccgggtggatggcttccgcaagcccatgcgcctgcgcatggcggacggcgtgcacttcaccgtcgcgggcggccgttacttcgccaacaaggtgtaccccgaggtgctgagcgtgctgggcctgctccagcagggctag

SEQ ID NO: 9483 - DNA, 300 bp, Myxococcus xanthus
atgcgcagctccacctggcatcgcgccctggccatccggggcgaggcgcccccgccggagctgcgcaggctgcccgtgtcctgcgtctgtatccaggggacgcgggacgtgctggtgccgccgtccacggtggagcgcctggccgcgtcgctgccgccgggaacgccccggcacctgctgcggggcgcggggcatgtgccctacttcacgcatccggaggcgtgcgcggggctcctgcggccctggttggcggctctggacgcggcggcggcgcccgaagtggagagcagcgctgcctga

SEQ ID NO: 9484 - DNA, 765 bp, Myxococcus xanthus
atgattgaggtcgagaagctgagcaagcgctacgaggggcggccggtgctggagggcatcaacgccgtcttctccccaggcgaggtgacggcgttggtgggcccctccggtggagggaagagcacgctgctgcggtgcctcaacgggctggagtccttcgacgggggcttggtgcgcgtagggccggacacgctggccccgggcgatgtccgcgcgcagggcgagaaggtgcgccgcatccgccgccgcgtcggcttcgtcttccagcagtggcacctgttcgcgcatcgcacggcgttgggcaatgtgacggaggcccccatgcacgtgaagggcgtgggccggcaagaggccaacgagcggggccgggcgttgttggcgaaggtcggtctgtcccaccgcgaggacgcgtacccctccgaactctccggcggcgagcagcagcgggtggccattgcccgggccctggccatggagccggaggtgctgctgatggacgagcccaccagcgcgttggacccggagcgggtgggggcgctgattgacctgctggagcaactgctcgcggacggcctcaccctggtggcggtgacccacgagatgcgcttcgcgtacgagctggcctcgcgcgtgttggtgctgcacggcgggcacatcatcgaagaggggccgcccgcccgggtgctcgcaaatccacaccatgagcgcacgcgtgccttcctgggcctgggccgcgtccccgcgctgcgcaccctgggggcctga

SEQ ID NO: 9485 - DNA, 504 bp, Myxococcus xanthus
tgggcggcccggctgtccaccgcctacgtggagttgtttcgcggcacgccggtgctgcttcagctctacgtcctctactacgggctggccggagtgctccggttggaccccatcagcgcggccatcctcgggctgggcctgaactacgcggcctacgagtcggaggtctacagggcgggcgtgctggccgttccgcgagggcagttggaggcggcgatggcactgggcatgcccctgcggctggcgctgcggcgggtcatcctcccccaggccttccgcgtggcgctgccgggggtggcgaacgacttcatcgcgctgctcaaggacagctccttggtatccgtcatctccgtggtggagctcacgaagcggatgacgattaccgcggtggatgttcgaagctggctgatacctggcgcgttgtgcgcattgatgtacctggcaatgagctatcccttgtcccggctggcgaggcacctggaagcgaggctggagcgcggatga

SEQ ID NO: 9486 - DNA, 462 bp, Myxococcus xanthus
accaggtccgcggcctcctggctctcgcgtgccgtcccctttctcgagtcggtccgtggctaccgcgccacgtggctgaagcgggacacggtgggggcgctcaccgtgacagccctcctcatcccagaagggatggcctacgcggagctggcgggcctgcccccaacggccgccttctacgcggccccggcggggctggtgctctacgcgctcttcggcagctcgcgccagctcatcgtggccgtgtccgcggcggtggcggtgctgtccgccgcgaccgtgggcgcgctggcacaggcgggctcgccccgcttcgtcgtcctcacggcggccctggctttgatggcggggctcatctcgctgctggcgggcgtgctgcggctggggcgaatcgctcagttcttctccgcctccgtcctcaccggcttcgtcttcggcctcgcgctcatcatcgccatcaag

SEQ ID NO: 9487 - DNA, 387 bp, Myxococcus xanthus
atgacgccgccccccgtcgtcctcatctccgatgacgaacccctcatcgtctccgccctcgcccgcgaggggaaacgctccgggctgaactgcatctcggacaccacgtccgagcgcgtcctggagctcgcccgcgagcaccggccggccgtcatcatcctggacatcaaccagcaccaggacggccgggacttgctcgcccagctcaagcaggaccccaacacccgcgactgcaaggtcatcatcctcagcgccgtcgaggaccagttcacccgccacgtctgcttcgagctcggcgccgacgactacgaggtgaagcccttcgaccccaccttcatgacccgcgtcgcccggctcgcctcctccgtggcgcgccctcgcacctga

SEQ ID NO: 9488 - DNA, 1482 bp, Myxococcus xanthus
cagcccgagctgaaccgccgcctggcgaagctcacgtccatcctggatgtcgcgaaggcgatgagcgccgagcgcgacctcgacctgctcctgccgctcatcctcttcgaggccaccaaggtggtggaggcggaccgctgctcgctcttcatcctggaccgcgagcgcaacgagctgtggagcaaggtggcccagggctccaagagcgaaatccgcctcccggtgggcagcggcgtcgccggacaggtggcccagacgggcgccgtcatcaacatccccgacgcctacgccgacgctcgcttcaaccgctcgttcgacgtctccagcggctaccagacgaagaccatcctctgcgtccccatgcgcgacgccggcggcgaggtgacgggcgtcatccaggccctcaacaagctggacggcgccagcttcaacgccgaggacgaggagctgctgctcgccctgggcgcccaggccgcgggcgccatcgagaacgccctcctccacgaggacatcaaccgcctcttcgagggcttcgtctccgcctccgtcgtcgccatcgaatccagagacccgaccaccgccggtcactccggccgcgtggccgacctcaccgtggccatggcccaggcgctcgagcacctgtccaccggcccctacgcccacacgcgcttctccgccggggagattcaggagctgcgctacgcctcattgctgcacgacttcggcaaggtgggcgtgcgcgagcccgtgctggtgaaggcggagaagctctacccgcatgagctcgaaggcctgcgcgcccgcttccagctcgcccggaaggacttgcagctccagagctaccgccgccgcttggaagcggtgaagattcgcggccaggcgaacctggcggaaatcgaggccgaggaagaggagcggctcgcccgcgagtcgtggcagttggacgaggtgctggagttcatcctctcctgcaaccgccccaccgtgctcgcgcagggcaacttcgagcggctccacgagctgggtgcgctgcgcttcctggatgcccacgacaaggcccagccgctgctgctgccgggggaaatccagtcgctctccatcgcccgcggcacgctctcccccgaggagcgccgcgaaatcgagagccacgtcgagcacacctaccgcttcctgtcccagattccgtggacgcgcacgctgcgccgggtgccggagattgcctacgcccaccacgagaagctggatggcaccggctacccccgcgcggagaaggacatccccgtccagtcacggatgatgtccatctgcgacatctacgacgcgctcaccgccagcgaccggccctacaagaaggccgtgccgcacacgctcgcgctcgacatcctccggcgcgagtccgacgccgggcagttggacccggcgctctataccgtcttcatcgaggccgacatcccccggaaggtcctccagggaatcaagtag

SEQ ID NO: 9489 - DNA, 1308 bp, Myxococcus xanthus
atgagcgccaccgagcagaccttccccgcggacttcaccttcggcgtcgcgaccgccgcgtaccaggtggagggcggcatcgagaacgactgggccgagtgggaacgcgccgggaagctgaaggagccggacgctcgctgcggccccgcggtggaccactggaaccgctacgaggaggactacgccctggcccgggcggtgggcgccaccgcgttccgcatctccctggagtgggcgcgcatcgagccggaacgcgggcgcttcgacgaggcggcgctggagtcctaccgggagcggctcctgaagatgaaggcccatggcctgcggccggtggtgacgctccaccacttcacgcaccccacctggttccaccgggagacaccgtggcaccagccggccagcgtggacgtcttccggcggtacgcgaagcggtgcgcggcgctgctggaggggctggacgcgctggtcatctccttcaacgagcccatggtgctgctgttgggggggtatctgcagggcgccattcctccgggcctcgcggatggccccaccaccatgcgggccatggagaacctggtgcgctcgcacgtggccgcccgggaggaactgttgtcccggctgggccgcgtggagctgggcatctcccagaacatgctcgccttcgcgccggaccggtggtggcaccccttggaccgtgcgctggtgaggctcggggcccaggcctacaaccatgcgttccacgaggcgctggccaccggcaagctgcgcgtcaccatgccgggcgtggcctccacccgcgtggacatccctggcgcgcgggactccgtggagttcatcggggtgaactactacacccgcgcgcacctgcgcttcgtgccgcgcccgcccttcatcgagttcaagtaccgggacatccacggccggggcctcaccgacatcgggtgggaggactggccggagggcttcctccagacgctgcgcgacgtgaagcgctacgggaagccggtgtggattacggagaacggcatcgatgaccgcgtcggcgtccgccggccccactacctccattcccacctggcccaggtgctggccgcgcgcgcgcagggcgtggacgtgcgcggctacctctattggagcctgctcgacaacttcgagtggctggagggctggggcccgcgcttcggcctctaccacgtcaacttcgacacgctccgccgcagccccacgcccgcgtgtgactacttccgcgccgtggccaccggacggaagctggtagcgccagacgccgtccgcccctcgggcgcttga

SEQ ID NO: 9490 - DNA, 255 bp, Myxococcus xanthus
atggtggtctacatcctgtcgtggatgctcatcgtcttcgtgtccgtgctcatccatgagatggggcatgcgctggccagccgcctgttcggctaccggccaagcatcgcgctcgtctggatgggtggccacacgctccccaccgatgcgccaggcccccttccgtggaagcgggacttgctcatcactgcggccggccccttcttcgggctgatgctgggggtgacgagcggggtggactacctcctgctctag

SEQ ID NO: 9491 - DNA, 1416 bp, Myxococcus xanthus
atggccgtcagcgtcttcgacctcttcaagattggaatcggaccctccagctcgcacaccgtcgggcccatgcgagcggcgcgcatgttcgcccggaagctggcggacacgggcgtgctggagcggctcacccggctcaaggtggagctgttcggctcgctgggcgcgacgggcaagggccacggcagcgacaaggccgtggtgctgggcctgatgggcgagacaccggaggccgtggacgtggaggccgtgcccgccatcatttcccgctggcgcgcggaaggccgcgtggcgctgctcggtcagcgcgaggtgacgttccgagacggcgagcacctggtcatgcaccgccgccgctcgctgcccttccatcccaacggcatgcgcttcaccgcctccggcgcggacggcgcggagctggcatcgaccgcctactactccgtgggtggcggcttcatcgtcgacgagtccgccgccgcggcgggcaaggacccgctgagcaaggacaccacgccgctgcccttccctttccactccgccgccgagctgctggcccactgcgagcgcgagcgcatgagcttcagctcgctcatgctcgccaacgagaagacctggcgcgacgaggcggagattcgcgccgggctgctgcgcgtctgggacgtgatgcaggcctgcgtgcgccgtggctgcaccagcggcggcatcctccccggtggcctcaaggtggagcgccgcgccgcgggcatgtaccagaagctcatcagccgtcccgaggccggcctcaccaacccgctcaccgtgctggactgggtgaacctctacgccctggccgtcaacgaggagaacgcggcgggaggccgcgtcgtcaccgcgcccaccaacggcgccgcgggcatcatccccgccgtcctgcactactactggcgcttcgtgcccggcgcgaacgaggacggcgtggtgcgcttcctgctcaccgccggtgccattggcgtgctctacaaggagaacgcctccatcagcggcgcggaggtgggctgccagggtgaagtcggcagcgcctgctccatggccgcgggggcgctcacggaggtcatggggggcacgccgctccaggtggagaacgcggcggagatcgccatggagcacaacctgggcctcacctgcgaccccattggcggactggtgcaggtgccgtgcatcgagcgcaacgccatggcctccgtgaaggccatcaacgccacgcgcatggccctccacggcgacgggcgccacttcgtcagcctggacaaggtcatccggacgatgcgcgacaccggccgcgacatgaaggacaagtacaaggagacggcgcgaggggggctggccgccaacgtgctggaggtggccaacctgagcgtgggccttcccgaatgctga

SEQ ID NO: 9492 - DNA, 978 bp, Myxococcus xanthus
atgatcgccaacttcttctgggcgttcctgaacatgctgcccgtgctcccgctggatgggggacgcatcaccaccaccctggccacgcgggtgttcggcccgcggcgcggcttcgtgctggcgcaggggctggcgctgctagtgtgcgtgggggccgtagtgtacggcctgcggtcgggttggctcctgctcaccctcatcttcgccatgtacggcatgcagtccttccgcgtggtggcggaggcgctgcgcaacggacaggcgcagagcgtcccactggaagggccgctggcggagaagctgcgcgaggcccgggccgcgctcgacgcgggccgcatggacgaggcgcggcggctgggcgcgtccgtgctggaggccaacgagggcctgacgccgcgggtggccagccatgcccaccacctgatgggctggctcgccttgaaggagggccagggccgccaggcgctggaccacttctcgcaggtgcagggcctgcccgtggagccgcacgcggtggcggcgtccttctccctggtgggcgatgacgcccgcgcggtggagtggtggaagcaggcctggcagtcctcgtcggaccggaccgtgatgcacgagtacgccggcacgctcatccgcatgggccgcgagtcggaggccctgaagctcccgggcctggacccggaggcggcgttctcctgcgcggagcgggtgctcttcatccggggcgcgtactcggaagccgcggccgtgggcgaggcggcgctgcaacacgcgcccagcgccacgctggcctatgacgcggcctgcgcccatgcccgcgcgcgcaacgtgcctgacgcgatgcggctgctgcgacgcgccacggagctgggcttcgccgatggggcctatgccgcctcggacgaggacctggctccgctccatgggtaccccgcattcgaggagtggctgacggagctgcggcaatccgccgcctcctga

SEQ ID NO: 9493 - DNA, 1059 bp, Myxococcus xanthus
acaccgtctccagccctgcccgcggcggatgagcgcctcaactggctctcctccatccccttcttcgcagtccacctgatgtgcctgttcgtcttcgccgtcggcgcgaagccggtggacgtggccgtgtgcgtcggcctctacgtcgtgcgcatgtggggcatcaccgcgggcttccaccggtacttctcccaccgggccttcaagacgggacgcgtcttccagttcatcctcgccttcgtgggcagcatgtccgcgcagaagggcgtgctgtggtgggcggagcaccaccgccaccaccaccgctattcggaccaggcggaggacatccactcgcccctgcagaagggcttctggtggagccacgcggggtggattctctccgacaagtacaacgacacccgcatggagggcatcaaggacttcgcccgcttcccggagctggtgtggctcaaccgcttccacctggtgccgtccgtcctgctggccgtggcgctctacttcatcggaggcttctccatgctggtgtggggcttcttcgtcagcaccaccctgctgtggcacggcaccttcaccatcaactcgctcagccacatcttcggcaagcgccgctacaagacgacggacaccagccggaacaactggctgctggcgctcctcaccctgggcgaggggtggcacaacaaccaccacttccatcagaacaccgccaaccagggctggttctggtgggaggtggacctcagctactactcgctgaaggtgctctcctggttcaaggtggtggaggggctgcggcttccctccgaggccacgaagttcgcgttccagaagtacaccgacgaagagcgcgcggcgctggcggcccctacccgcttctggggtgcttcgggcgcgcgggcccagttcgtggccacgaaggccgcgggggatgcggcccgggccgccagtgatgcggcgaaggccgcgggcgacaaggtgcgagaggccctgacgaccgccgcggaccacctgcccacctccgcgccgccaccctccgccatgctcaagcggcgatag

SEQ ID NO: 9494 - DNA, 767 bp, Myxococcus xanthus
atgggccgcttcgtccacgccgcgctgagagcgtccaaccgcctgcggcttcccggcccctctgtcctaccggtagcgggcgcggtggtcggcctgtacagcgggctggcggccggcatcttctccaacctcatcgggttggtgagcgggctcaccttcggggcggcgtcgctgaagcacacgcttcgccaggaccagttccagtcgctcatggaggcgttcgccgcggcccgctggcatccggagtacgccttcatcggcgtgcccctggcatccggcgcgctgctgctggcgcgcatcatcgaacctggcgggccccgtgacgaggtgaagcgccggctgcgcctgctggccctgctggcgctgggcggactgtcgctctactacccgctggtggcgctgtccgcgctcaacagcgtgttcggacacagccacaacctgcccgaggcactgccccacctgccctggtggctgatgctgctggcgcccacgctgggcggcgtggtggtgggccggctgctgcgggacaagcccgagacgcatggccacggcgtccccgaggtggtgcgggcggtgaagagtggcgccaacgccctgccggcggaccggggcctgctgaagctcgtggcgtccgccatcaccattggcagcggcggctcggcgggccgcgaggggcccatcgtctacggcggcgcggcgttcgcttccaccgtgggccgggtgctgggcttcagccgcaaggagctgtccatcctcgtggcgtgcgg

SEQ ID NO: 9495 - DNA, 643 bp, Myxococcus xanthus
cgcatctctccttcgcttttgtcctgtgacttcggccgcttggccgaagaggtccgcgccatcgaagccgctggtgcggattggattcacgtggatgtcatggatggccgctttgtgccgaacatcacgattggccccgtggtggtggaggccatcaagcgggtggcgacgaagccgttggacgtgcacctgatgattgtggagccggagcgctacgtggaggccttcgtgaaggcgggggcggacgtgctgacggtgcacgtggaggccagtccgcatctgcaccggacgcttcagccagattcgcaatgccggggcgaagccggcggtggtgttgaacccgggcacgccgctgtcggccatcgaggaggtgctgggcgacgtggacatggtgctgctgatgagcgtgaacccgggcttcggcgggcagagcttcatcgagtccacggtggagagggtgcgccggctgcgcgggatgttggatgcgcgcgggctgaaggacgtggacatcgaggtggacggcggcatcaacgccaccacggcgaagcgggtggtggaggccggggccacggtgctggtggcgggcagctacgtcttcggctcgaaggactacgcggaggccatccgctcgctgcgctcgtga

SEQ ID NO: 9496 - DNA, 1434 bp, Myxococcus xanthus
atgcgaagagcgaagattgtctgcaccctcggtcccgccagccagagccaggagatgctcgaagcgctcctggagaacggcatggacgtggctcgcctgaacttctcccacggcagccacgagcagcacgcggagaacatcgcgaagctgcgcgccgcgtcgctgaaggttcgcaaggcggtgggcatcctcggcgacctgcaaggcccgaagattcgcactggccgtttcgtgaagggcagcaccgagctgaaggaaggcggcaccttccacatcaccacggatgaaacggtcccgggcacggacgaaatcgtgtccacgacgtacccgttcctggccgcggacgtgaatccgggggaccgcatcctcctggatgacggcctgctggagctgaaggtcctggagacggacaagcagaagctcatccgcacgcaggtcatccacggcggcacgctgaagaacaacaagggcatcaacctgcccggcgtggcggtgcgcgcggaggcgctgacgccgaaggaccgtgaggacctggtgttcgggatcaaggccggcgtggattacatcgcgctgtccttcgtgcgccagccgtccgacctggacaccgcgcgccaggccatggccgaggtgggccgcacggtgcccatcatcgccaagctggagaagccggaggccattgcccggctggacgccatcctggacaagacggacggcgtgatggtggcgcgcggcgacctgggcgtggagattccccccgaggaagtgccggccgtccagaaggacatcatccggcgctccaacctgcgcggcctgcccgtcatcgtggccacgcagatgctgaactccatgattgataacccgcgccccacgcgcgccgaggccagcgacgtggccaacgccgtgttcgacggcgcggacgcggtgatgctgtcgggcgagacggccagcggcaagttccccatcgagtccgtgcagatgatggagcgcatcatcctggcggccgagtcctccgcgcgcacgacgcagtcgctgatgcgcgtgctggagacgccggtggggctgcccaaccacttcccggacgtcatcgcgcgcgtggcctgcgaggcggccaaggcgagcaacgcctcgctcatcgcggccttcacgctgtcgggtgtgacggcgcgcctgctgtcgcactaccggcccccggtgccgattgtcgccttcagccccaaccaggaagtgcgccgccggctgtcgctgttgtggggcgtggtgccgcgcgtgctggagcccacccaggacaccgaggccatggtgaagcgcgtggaggaagagctcctggcgcgaggcctgggccgcaagggcgaccgcatcgtcatcgtgttcggcgcgcccgtggggcagccgggcaagatcaacagcctgcgcctgcacaccatccagggctga

SEQ ID NO: 9497 - DNA, 744 bp, Myxococcus xanthus
atgccgcagcgcaacctcccgcccgacgatgcaccccgcatcgtcacgcgtccgcccacgcgggaggagctgtggtcccgggctgaatcgctggcctggcggctgagcgccgagctgggcatgccggtgcgcctgtcggtgacggacaaccgctccaccatggtgtccttccgccggggctccgcggtgctggcgctgcggctgcaccacatgttcctggacgcgccggagccggtggtgcgcgcggtggcggactacgcgggccggggacaccgcaccgcgggcgccatcctggacgagtacatccgcggtcagcagccgcgcatccgccagatgcgccgcgaatccgacgcggacctcaacccgcgcgggcgctgtttcgacctccaggcgctttacgacgccaccaaccgagattttttccagggcctcatccaggcccggattggctgggggcgcatgcctccgcgccgccgtcgcaagtccatccgcctgggcgtctacgaccaccagacgcgtgagattcgcatccacccggcgctggacacccccgaggtgccttccttcttcgtggagttcatcatcttccacgagatgctccaccagctcttcccgagcacgggccggggtggccgccgcgtgcatcacccgcgtgccttccgcgaacgcgagcgaacattcccgcattacgccgccgcactgcgttgggagcgggagaacctgggcgtgctgttgcgcggatga

SEQ ID NO: 9498 - DNA, 1458 bp, Myxococcus xanthus
atgtcgctgcgtcccgtggagctggagcaggtggtggcggagctggcggagcgcctcactggcgcggtggcgcagaaggcctggtgtccccttcccaggctcgcctacgtggagcttcgcgtcccgggcaaatccatcctgttgtgcctgtgcgcggaaggtgacctggcccgggtgtccgtggcggatgatcgcttccccacgccgggcgagcccgcccccttccagcggtggctgcgtcaggagctgacaggcttcaagctccagggcgcccgcttcatggaagccgagcgcgtggtggccttcgacttcgagcgcgaggacgtgcgccggcgcctccttctggagggtggcgcgcccggtggtctgctgctgctcagcgacaccggccgcgtgctgatgctctccggtgagggcttcgcgcagcgccggggcctgcatccgggcgcggcgtggacgccgccggagccgccgccgcccgaggcccgcgagaaggcccggagccaaccctcgcggctcgctccccaggactcggatgcgctgccgtattcccaggccgcggagcgcctgctcggagcgcgcgacaaggccagccgctcggagaccatccgccgccggttggcgcagccgtaccgcgcgcgcctcaagcgcgcctcccgcacgttggagaaggtgcgcgccgaggcggcccgcggcccggacgcggagaagcaccgcgaagtgggcgagctgctggcgcagaacctctacctcctcaagcgtggcgccaccgaggcggtgctcaccgcctatacagaggagggcgcgaaggaggttcgggtgacgctggacccgaagcgcaccccgaaggaggaggcggactggcacttccaccagtaccggcggctgctgcggggcgtggagcaggcgcgtcatcgcgaggcggagctggcgcgcgaggtggcgcacgcgcagcaggcgctcacgcagattgagcggatggaggacgccgcgctgctgtcgcaggcggaggtgcttcagctccccagtgggggcgagggtgcgcgggagggccggcccttcaaggagtacgtgggccatggcggggcgcgcatctgggtggggcgcggctcggaggacaacgacgcgctcaccttcaaggtggccagaccctggcatctgtggctccacgcgcgcggtgtcccgggcagccacgtggtgctgccgctggagaaggggcaggaggtggcgcaggaggtgttgctggacgcggcgcacctggcgctgcaccactccggggccaagggcgagccgcgcggcgaggtgagctacgtgcccgcgaagttcgtgcgcaaggtgaagggcggcgcgccggggcaggtgaccttcacgcgcgagaagaccttcgtggtgcgcatggagcccgagcgcctggagcggctcctcaagtcccggcacgcggagccgcccgcaccgtga

SEQ ID NO: 9499 - DNA, 240 bp, Myxococcus xanthus
atggccgctaagaagaagaccgctgcgaagtccgcgaccaagaaggctgccaagaccgcgaaggccacgaaggcggcgaagtcggcgaagaagacgaccgctcgcaagacggctggcaagaccgcgaccaagaaggcggccgccaagaagaccacccgcaaggcggccaagaaggccccggctcgcaagcgcaccaccaaggccaagacggtggcggccccggttacgccggagtcctga

SEQ ID NO: 9500 - DNA, 1014 bp, Myxococcus xanthus
atgccgcagcttggtccttacaccctgccgaatccgtacatcctggcccccatggccggggtgagcgagatgcccttccgtgtgctcgccttccgtctgggcgcggcgctctgtcccaccgagctcgtcagctcgcaggggctgatgcgcgccaaccagcggacgttgaagtacctgcgctacgacgccgaggtggagcggccctactcgctccaaatctacggcggtgagccggaggccatggcccgggccgcggtggtggggcgcgaggcgggcgcgcaaatcatcgacatcaacatgggctgcccggtgaagaaggtggtgaagaacggggcgggcagcggcctgctctgtgacgtgccccgcgcggcggacatcgtccggcgcatccgtgaggccaccggcctgcccgtcacctgcaagattcgctcgggctgggacgcccgcagcctgaactatcttcaggtggctggcgcgctccaggaggcgggctgcgcggggctggccatccacccccgcacgcgcgagcagggctattcagggcaggcggactggagcgtcatcgccgacctcaagcgccacttcccggagctgcccatcatcggcaacggggacgtgaagacgcccgcggacgcggcgcgcatgctggagaccaccggctgtgacttcgtgatgattggccgcgccgcgctgggcaacccgtggatcttccgcgagctgctcggaggcccgcccgccacgccgcgcgagcgctgcgagctggtgctggagcacttccgggcgcacctggacttcatgggggacccgctgggcgccgtgcgctccttccgcaagcagttggcgtggtacgcccacggcttgtacggcgccgcggccttccgtgcggaggtgaacggcctggacctgccgtcagcggtggaggactgcgtgcgccgcttcttcgccgcggcccatgtggacctcgcgggccccggtgaggagcaggacgtggactaccgggcggccctgggctga

SEQ ID NO: 9501 - DNA, 471 bp, Myxococcus xanthus
atgcaagcgggcatgcgcctgttcgtcgtcagggacctgcacgccaagctctactactccgaacgccacgctctcatcacgtcgctcaacctcattgagtcttccttcaacaacagcattgaagtcggcatctgcatctcagccggtcgcgccgagtacgtgagaatcagcgacttcatcgagagcgaaatcaccccacaccgaaaggaagtccccttcaagccggccaccgagccgcgtcgcaggagcgccacgcccgtcccccggcacgccacgcagggattctgcatccgctgccgcgacgcaatcggcttcaacccggagaggccctactgcgacagcgacttcaacgtctggcgccgatacagcgaccccacctacgaagacaaccattgccaccattgcggcatggacttcgccgccagcaagaacaagcccctgtgccgtaagtgctacggaatgctcaggtag

SEQ ID NO: 9502 - DNA, 468 bp, Myxococcus xanthus
aaggagcgcacctgctccctgacctgcggtgagaagaagattcctctcaccatgctggacggtgagccggccgcggagctgctgcgcaaggccgccttccagcccaacccgcagaagttcgtgccctacgcgctactgcgtgacaccaagggcgcctactacttcgtggaccgtggcttccacgaggcggagaagaagaactaccgcgtcttcatcgggccgcgcggcaacctgaaggctcagaagatgaccaacgtcatctccgactccgaaggtgaaatcttctccaccaagcgcggtgacctccgcctgctgctcgacaaggcgaagcccgccatgtggattgaaaacaccaagcgccgcctggagctgcgccaggtgcccgtggatgagaacctgccgctcatctacaacgagctcggtgtgtacgaaggcgcccgcctgggcacgccctgcgacgaccagtag

SEQ ID NO: 9503 - DNA, 3837 bp, Myxococcus xanthus
atgagctccccgttcctgtcagtccctgaatcgcagtgggtcgcggccaacacgttcgctttcgccatccgggatggcttcccggtgagcccgggacatacgctggtgattccccggcggcaggtcgcgacctggttcgacgcctcgaccgaggaacagcgcgccatcttcgagctggtggacgaggtgaaacgcgggctggatggcgagctgcatccagacgggtacaacatcggcatcaacgtgggcgcggcggccggccagacggtgctccacctgcatgtgcacgtcatccctcgcttccagggtgacatggacgaccctcgcggcggagtccggcacgtcattccaggcaaaggcaactacctcgccgggcgaaacaagcccctggccacgggaggcctcggcgacccgttcctgcaccacctggagccgctgttcgcggatgcggtggagatttcggtcctggcggccttcgtgcaagacagcggactggagctgctgcgcgagtccgtggaagccgcgctcacccggggggcgacggttcgcatcctcacgggtgactatctggccatcacccaggcggatgcacttcgacggctgctcgactggatggaagaggacgccgcgctccaggcggagccaggccgtggccgttttgaagcgcgtgtcgtggaggtggagaagctccaactcacgtcattccacccgaagtcctggcgcttccttggcaccgggctcgcggtggcctacgtcggctcgagcaacatctcgcgcgccgccttgaagacgggcgtcgaatggaacctgcgcgtcgagcgggaccgggacccgcaggcctggaacgaggtggtggatgcattcgagggctggtggagccgggcctcccccttggacgcaaattgggtcgagcaatacgctcgccgcgcaccagcggcccgactgcgcctcccggcaggtgagacggaaccagaagcccccttgccccgtcgcgagccacacagcctgcagcgtcaggcgctcggtgcgctcgcgcgtggccggcgcgagggacggcaacgcgcactggtcgtcctcgcgacgggcctggggaagaccctgctcgcggcgctcgacgtggaacagttcaaccaggaacggggacgggcgagccgcgtgctgttcctcgcgcaccgggaagagctcctcgtccaggcagcggagacgttccgtcgtcagcagcaccacctccgattcggctggtacgtggggcaacgcgcgcagctcgtgggcgacgtggtcttcgcctcggtgcagaagctctcgcggccagaagaccttcacgcgctccgcctcgcggccgcgttcgactacgtcatcgtggacgaggtccaccacgccacggcggcgagctaccggtccatcctcgcctgcgtggagcccgcattcattctcgggctcacggcgacaccggagcgcgctgacgagggcgatgtgctcggcctcttcgatgaccacctcgcctggcgctcggaccttggagaaggcatccaggagggactgctcgcaccgttcgagtacttcgggctcaaggacaccgtgccctacgagaacatcccctggaagagccgccgcttcgacgtggcgctgctgacccaggcggttgagacggaagcacgtatgcggacactgtggcgtgcgtggcagaagcatcccgcaagccgcacgctcgtgttctgctgctccatctcccatgcccacttcgtccaacaatggctgggaggccaggggattcgcgccgtggctgtccacgccggggctggctcagcggaccgcgcccagtcgctgcgccagctcgcgaatggcacgctggatgccatctgcgcagtggacctgttcaacgaaggcgtcgacgtcccgagcatcgaccgcgtggtgatgctgcgccccacggagtcccccgtcgttttcctccagcagctcgggcgagggctgcgaaaggccaagggaaaagagcgggtcatcctcatcgacttcgtcgggaatcaccggctgtttctcgaccggctccgaaccctgctggccgtgggtaagcctccggtctccctgcgtgactttctcacctcggaccggcaacccgcgctgcctgctggctgcaccgtggaagtggagctcgaagccaaggagatgctccggcacttcctctccggaggggggcaggaggtcgagcgtgtctaccgcgagctgcgcgatgcacggggactgcggcccaccatcggagaactctaccgtcgtgggtattcacccgcgacgctgcgcaaggcgcacccggggtggttcgatttcgtgaggtcggagggcgacctgacggacggcgaggctcggaccctcgacaaaggccgcgactggttcaaggagctcgagctcgcgaacatgagccagtgcttccagatggtcgtactggaagcgctgctcgaagccgatgccctggaacaggggctgccgctgcccgagcttgcccggcgatgcctggccattctccaacgctcccccgagttgctccgggacctcgaagcagtcaaggccctgggcgacccacggctcccgaatcccgcccggttcctcacgtactggaagtcgaaccccatagaggcgtggacgaagggcgggaagtggttccgcgtcgaggaagagcggttcatccctcgccttcccatggccccatcgacccagaagtccttcgaggcgatgactcgcgagctggtggactaccggctcgcacagtatcggcgccgccaacaggcgcaggcgcaggactccgcctttgatgcgagggtcatctcgaacagccggggccccatcctcaagctcccggagcggagtgcgcgctcggacctgcccctgggaacgacagcggtccggctcgacgatggagcgcgctggcatttcgacttcgtgaagattgccgtcaacgtcgcgcgacccgatggcgcgaaacagaatcaactgccggacctcttgcgccaatggtttggccccaccgcgggaatgccgggcacggcctttcgcgtccggttcacgctcggccctgacgggtggagcgcggccccggttcaggccgagccgagccccctcgcgccatgggggacactggtcgcatttcccagcctgcgcgcggccgcgggcgccgtggagcaccccatctcaatcgaccaggctccggaagcggcgagggtccgccttccgagccgagtgcaaggcgaagggctgttcgcggtgcgcgcgtctggtgattccatggacggaggcgcgcaccccatccgcgatggtgactggctggtgatgcgcgacgcgaaagccgcgggggcggggcgcctggatgggagggtggccctcgtccaggtccccgacccaatcacaggcttccgctaccaggtgaagcggctcgtccggcaagacgggcactggctgctccgctccgacaatcccctgcgtgagtccttccaggctggtgaagcgacctcccccgtcgccctggtcgtcgaggtcattccacccgaacggctggcacctcctctgggcacgacgctcacggaggagcagctcagctcccacttcggattgagcacggcgcccagaacggggcgccatgaaggccacctgttcctgttcatcaaggacgcgcaagccttcacctcacccggccgcctggcgctgcgcgtcccagaccaccaccccagtgaaacagccttcgtgttcacacaggagaccgcgtccggtgactggacctaccagggagccgctgtctggcgagacgatgaagaccggtgggccctggagctccccaggtccgggtga

SEQ ID NO: 9504 - DNA, 900 bp, Myxococcus xanthus
atgagctggctcaactaccatcacctcctgtacttctggacggttgcgagggcgggcagcatcgccaaggcaggcgaggagctgcacctggcgcagcccaccatcagcagccagctcaagctcctggaggagtcgctgggccacaagctgttcgagcgccagggccgcaagctggtgctcaccgacgtgggccgcacagtgatgcgctatgcggacgagatcttccgcctggggaacgagctgaagaacgtcgtctccggcttgccgcccgggcagcaactgcggctcaacgtcggtgtgctcgacgtcatccccaagctggtggccgaacagctcctcaaacccgcgctcgaagcaggcccgtcgctgcgcatcatctgccgcgaagggcccttgccgcagctgcttgcctcgctggccctgcatgaactggacgtggtgctcgcggatgcgcccagttcggagccggtgagcgtgcgctcgttcaatcacttgctcggcaagtgcggcgtgtccttcttcgcggcggggaagctggtcgaactcagggagaacttccctcagtcgctggatggcgcgcccgtgctgctgccgtcagtcgagtcctccgcgcgccgctccatggacctgtggttcgagcgcaagggcctgcgccccgtcatcgcgggtgacttcgatgacagcgcgctgctccaggcctttggccagcgcgggcacggggtcttcgccatgcccagcgccatcgaggccgaggtggagcgtcagttcaactgctccgtcatcgggcgcaccgacgaaatcgagacctgcttctacgccatcactgtcgagcggaagattcgccaccccgctgtcgtcaccatcgccgaggcggcgcgctcgcacatcttcggcgagtga

SEQ ID NO: 9505 - DNA, 1311 bp, Myxococcus xanthus
atgctggacgtcgtggacatcggcaagcgttcgcttgccacctatcgcgggattgctcccgacgaaatcctcgacgaactgcactggctctccgaggacttgcgcggcgcccggtgcatgcacctgagctccacgccctacggcggcggcgtctccgaaatcctccgctccctggtcccgctctacaacgacctgggcatcgtcacggactggaagctcatccacggcgacgacaccttcttccaggtcaccaagcgcatccacaacggcctgcaaggcgctcccggcgaactcaccgagcgcgagaaggccacctacctggccaacgcccagctcaatgcccaccggctggtcacgaattcggagaactacgacttcgtcttcgtccacgacccgcagcccgccgtgctcgcggcgctgagtcctcatctcgatgcgcgctggatatggcgttgccacatcgacacctcgcaccccaacccgaccttctgggacttcctgtcgccctacctgcacgcctacgacgccgccatcttcaccatgcgggagttcattccaccgcaactccccatctccgacgtccgcatctacccgcccgccatcgacccgctcagtcccaagaatcaccccctgccggaggccctcgcgcgcgacgtgttggagtggattggcatccgcacccaccggccgctcgtcacccaggtcagccgcttcgaccgctggaaggacccgctcggcgtcgtccgcgcctaccagcgcgtgcgtccccacgtccccgacctccagctcgcgctcgcggggtcactcgccatggacgacccggagggctgggacgtgtacgaggagctccgcgccgccaccgcgggcgacagcctcatccacatcctcaccaacctggtgggcgtggggaacatcgaggtcaacgcgcttcaggccgtctccgatgtcgtcgtccagaagtccctgcgcgagggcttcgggctcgtcgtcgcggagacgctgtggaagagcacgcccgtcgtcggtggccgcgtgggcggcattcccatgcaactgccagagggcactggcggagccctcgtggacaccgtggaggaatgcgccgaggccatgctccacctgctccgccgtcccgacgaggcccacctgttgggcgcgcgcggacacgagcacgtgcgccagcacctcctcatgccccggctgctcgtggaccacctgcgactgctcaagcacctggcggccgtgcgccccctgccgcctcgcggcatcgtccccgtttccttcaacccggccagcctccagggggtgtga

SEQ ID NO: 9506 - DNA, 668 bp, Myxococcus xanthus
tgtgtcctcatggcggggctgctcgcgtccgcggccaatgcccccacgaggaacggccagcccaccgtggctcgctgcgacctggagggcgtggtcgacgccggcaccggcggctacctgtccgactgcgtggcacgcgccacggccgcgggacatgacgcgttgctcgtgcggctggacacccccggtgggtcgctggaggccacgcgccacatcgtccgggccttcctcgcgtcacctgtcccggtgctcgtctgggtcggcccctccggcgcgcacgcgggcagcgcgggcgtcttcatcgcgctggcatccaacgtcgcggccatggcgccgggcacgaacatcggggccgcgcatccggtcgtgggcccctccggccagtccccagaagccgtgggcggggagcaaatggctcgcaaggtggagaacgacgccgtcgcgttcgcggagagcatcgcccagcagcggggccgcaatgtgcagtgggccgcctccgccgtgcgagacagcgtcagcgtgtccgcggacgacgcgcgggcactgcgcgtggtggaatacgtgacgcccaccgaggcggacttcctcgcgcaggcggacggacggcaggtgacggtggcgggtggcgaatccgtgcggctctccacccgggatgcctgtagagcaca

SEQ ID NO: 9507 - DNA, 309 bp, Myxococcus xanthus
atgttccgtcagtcgttactctggacctcgtgtctggccctgctcgccggccccgtggcctgtgcgcagacgcagggcggcaagccggtggcgaagtccgccgtgtccgccgcgcccaagctcggcgccggcatcgagtcccgcaccctcaagaacgggctcaaggtcatcgtctggcccgaccacgacattcccaatgtcgtcctctacaactggttccgcgtcggcagccggaacgagtaccccggcatcaccggcctgtcccacttcttcgagcacatgatgttcaacggtgcgaagaagtacggc

SEQ ID NO: 9508 - DNA, 546 bp, Myxococcus xanthus
atggacgcgaacgcagtggcggagctcgagaaggcgggcgtgaaggtggaccagcccgagcgcctgtacgtggcggtggagtgggacgaggacggcaagcacgtgcgtccggtgggggagcgcgtccagattcgcgcgggcgagcagctggcctatgtaacgctcaagcccatctcccagctcttcgtgggcgacgtgaagccccccagcttcgccaaggcgccgccgccggagtaccagcccttcttcctcctcatcgaggccaccgccgccggctactgccgcgccgtgcgcaacaccgagacggaccaggaattcgagcggctctaccgccacctcctgcgccgccccgacggcaccgaccgcaacccgctcttctcgcacctccagggcgccgtccgcctctacatgtccctgcgcgacgtcagtcaggcggagttcgaggccgtcatccagcgcctccaccagtccgccaggcacttccagacgcacacgggcagcatcaactacttccaggaagtgctccgcgaagtgctcggcgcctga

SEQ ID NO: 9509 - DNA, 795 bp, Myxococcus xanthus
atggaagccatcaacctgaacgtgtcctttgaatcccctgagctcgtggttccggctgaggtcgctgaagcgcgcgtccgtgagcacctgaagttggtgcggcggttggcgtggaagtaccggtggaccggcctgtcgatggaagagctggtggcggaaggcaacgttgggttgatggaagccgcgggacgtttcgaggaacgcggggtgccgttcgcggcctatgccagccagtggatccgtgcgcgcatccgcgcctacgtgggccgcaactggagcatggcgggcggccgggcgccgtgggtggtgttccagctccggagggagcggtcgcggctggaggcccggtggggggagggtcacccggaggtggagaagcgcctcgccgaggccttggggaagcgggaggacgaggtggccctcgccatggaggcgctgtcgcgggacgtgtcgctggacgcgccggtgtctccggactcggaggccacgcggctggaggggctgatggcggatgccgactcgcaggaggaccaggtggaccgggcgaagtgggcgcggcggctccgggcgagcgtggacgcggcctggccggagctggatgcccgggagcgtgcgctggtggaagagcggatgcttgcggaggatggggtgagcgcggagctgctggcacgccgcttcggggtgacggcggtgcgtatccggcagatcgaacagggcctgcgggtgaagctgcgccacaggctgacggccggtctcacgtcctgggacggggaggcgatgtccctggcggcctga

SEQ ID NO: 9510 - DNA, 129 bp, Myxococcus xanthus
atggacgccgacttcgtggccctgtcggaagagccgctggaggcgctcgcctcggcgttggtgaaggcgcaggtcctcgccaccgtggtcgcgggcacggaggtgtaccgcgcgccacctcgggcctga

SEQ ID NO: 9511 - DNA, 234 bp, Myxococcus xanthus
gcgttctgcgactacgtgtcgcgagtcttcacccgcgccgacttccggcgttggacgcagtggggtgaatggaacgacgactaccgcacgttcgcggtggtggatgacggccgggtgctggccaatgcctcggtgatgcggatgcggttgttgctcgaagggcgggaggtgacgggctaccagcttggcgccgtggggagcctgccttccgaacgtgggcgggggctggcgcgc

SEQ ID NO: 9512 - DNA, 1026 bp, Myxococcus xanthus
atgtattcgttgaacgcgggcgcgttcggctacatgggcggcgccgccacggggcgccccctggcgggcgccacgtcgctctccgggctgagcttcgattacgcccacatgctcaacccggtgctgctcgacagcagccgcggggatgtgttctcgctcgctcagatgcggttgcagacgagcgcgaatggagtgtcctaccgcgcgatgcacaaggtgctcaacgcgagcatgacgcaggtggagggccagcccaccaccgtcaacggaaccttcacccagcccgtcgcgacaggcaccttcgaggtggactggagacgctcggccttcgaagccatgcgcacccaggtgaacccgggcgcggtcagcacgtacaacgagatctggatgtccgcccggccggccgcgctgagctcagcgttcgcgtccatcagcgggccgccactgctcgtgaagctcaatcctgacgcgcagcggaccgacatcgtcacggggagcatgacctacaacaacccgctcccggcggcgtggcagaaggtggcgaccgccgtcgcgggcttcacgcagagctacgcgctgggaaccgcgacgccctacaccatgaacgtggacatccgcgtggagcaagaggcgagcgcgttcaccgccgcgcccgtggagcccctcgtcgggccggtgcaggcgcccctggtgaacacgcgcggcgcgttccagaacctcacgggcgtggggactgacgcctcgctgcgctggtcgaagccgctgatcggcacggccacgaactacgtggtgaacatctaccggctcggcacgagcaacggctccaccaccgcgacgcgcgtggcgatgctgcacacggatctccaaagcgtgtacctgcccccggacgtgctgcgggcgggcgggacgtacttcgcggaaatccagagctggtaccagcccggctcgaacctcgcgacgagcccgttcaagcgctcgctgcctcgaggccgcgccagcgtgctcaccggcatgttcagcccgtag

SEQ ID NO: 9513 - DNA, 1134 bp, Myxococcus xanthus
atggccgccgtcgcggacatcatgatgcagtcgtatgccctgtcccccgcagacatcgccgcctgggtgcagcgggtgtcgcggccggacctgcggttgttgcgcgagggcggcgaggtggcggccacgctcgtgttcatccgcatggggcagtggtacggcgggcgcagcgtgcccgtcatcggcgtgggcggcgtgggcgtgtctcccgtccaccggggacgcggcaccgccacgcgactgatgcagcacctgctgcgcgaggctcgcgcgacgggcgctccgctgtcggtgctctatcccgcgacgcagccgctctaccggcgcgtggggtacgagcacgcgggcacgcggcaggagatccgcatccaggtcccatcgctgaacttcagtgagcggacgttgtcgctccgggccatcgaggagaaggacacgcaggccatcgtcctgagctaccagcgccacgcgcgtcaccggccgggctggctggaccgcggggacttctcatggggccgcgttcgcaacatgcgcggcgaggtggcacatggctacctggtggagggcagcgccggtgtggagggctacctctacgtcatccgccggcagctcaaggacttcaatcaggagctgttcctcaccgacgtcgtggcccatacgcccgcggcggcgcggaggattctgagcttcctgggggaccaccgttccctggccacggatgtcttctggtacggcggcgtggacgacccgctgctcctgctgcttcgcgagcagacgtacgcggtgaagcaggccacgcactggatggtgcgggtgctggacgtggcctccgcgttggaggcgcgcggctggccggagggactctccggcaccctccatctggacgtcgaggacgacctcttcccggagaaccagggccgcttcgtgctggaggtctcggacggtcaggcgcgcgtgcgccgtggcggcgacggaggcctgcggctgcacgtgcgatacctggcgccgctctacaccggtcacctgtccgcggcgtcgctgcgggccatgggcgcgctggagggtgatgatgcctcggtgcgcgcggcgggcagtctcttcgccggggcaccgccctccctgcgcgacatgttctga

SEQ ID NO: 9514 - DNA, 1348 bp, Myxococcus xanthus
gtcgagaaacagcgagcccgtttcgagacccgtgccacgctgccgctggcgtggcgacgggagcagttgcaggtactcgaacgggcggcacgcaagtacgaggcggagattctcgccgccctgcagtcggacctctccaagagccccgaggaggcctacctcacggaggtgggcagcatctacggggagctgaaggacgcgctgaagaacgtgaaggcgtggatggcgccgcgcaagggggcggcgccgctcgccatccaacccgcgcgcgtctggcagtactcggacccgctgggcgtgacgctcatcatctccccgtggaactacccctatcagttggcgattgctccgctcatcggggcgctcgccgcgggctgtaccgccgtgctgaagcccagcgagttgtccccggcgacgtccgccgtgctcgcgcggatgctgaaagaagccttccccgaggatgtcgtcgccgtcgtggaaggcggcgcggaggagagccgcgccctgctcgacgagcgctgggacctcatcttcttcaccggcggtccccaggtgggccgggtggtggcggaagccgcggcgaagcacctgacgcccaccgtgctggagttgggcggcaagagcccctgcatcatcgacaagagcgcggacctggaagtcaccgcgcgccgcattgcctggggcaagtacctcaacgccgggcagacctgcatcgccccggactacgtgctcattccgcccgagctcaagggccgcttcacggagctggtccagaaggctgtcaccgacttctacggggcgaacacgcgtgagagccgcgactatggccgcatcatcagttcgcggcacttcgagcgcgtctcgaagctggcgcaggacgggaccgtagcctttggcggtgagcgggacgcggacagtcgcttcttcgcgcccaccgtcatcatcgatgcgccgctgtccagcccgctcatgcaggaggagattttcgggcccctgctgccggtggtggactgtccgagcatcgacgaggccatccgcttcgtccgcgcgaggccgaagccgctggcgctctacaccttctccaaggacgcggcggtcaacgagcgcgtcctcacggagacgtcgagcggcggcgcggtggccaacgatgtatgcgtccacttcgccgcgaaggacctgtctttcggaggcagtgccgcagtccggcagcggcggttatcacggccagcccagcttcgacgccttcagccaccgcaagggggtggtgaagcggcccttcctgctcgacctgaagctgcgctacccgccctacacggggaagctgggcctcttcaaacgcttcctgtga

SEQ ID NO: 9515 - DNA, 2178 bp, Myxococcus xanthus
atgagcgagcagaacaccatccgctgggacaaggacgccgacggcatcgtcgtcttgacgttggatgacccgaaccagtccgcgaacaccatgaacgccgcgtacctgaagtccatgcgcgcgacggtggaccggctggtcaaggagaaggacaccgtcgccggtgtcatcctcacctccgcgaagaagaccttcttcgccggtggtgatttgaaggacctgctgaaggtgcgcaaggaggacgcgaagcaggccttcgagctggggcaggaaatcaaggcgcagctgcgcacgctggagacgctgggcaagcccgtggtcgcggccatcaacggcgcggcgctgggcggcgggctggagatcgcgctcgcgtgccaccaccgcatcatcgcggacgtgaagggtgcccaggtgggcctgccggaagtcacgctgggcctcttgcctggcggtggcggcgtggtgcgcacggtgcggatgctgggcatcgtggacgcgctgatgaaggtgctgctccagggccagcgctaccgcccgcaggaggcgaaggaggccggcctggtccatgaggtggtggactccgtggaggcgctgctgcccgcggccaaggcgtgggtgaaggcccatcccaccgcgcagcagccgtgggaccagaagggctacaagattccgggcggcacgccgtcgtctccggggctggcggcgaacctgcccgcgttccccgcgaacctgcgcaagcagctcaagggcgcgaacatgccggcgccccgcgccatcatggccacggccgtggagagcacgcaggtggacgtggacaccgcgttcaccgtggagtcgcgctacttcaccgagctcgtcaccgggcaggtcgcgaagaacatgattcaggcgttcttcttcgacatgcagcacatcaactccggtggcggccgtcccaagggctacccgcagcacaccgcgaagaaggtgggcgtgctgggcgcggggatgatgggcgcgggcatcgcctacgtctgcgccaaggccggcatcgacgtggtgctcaaggacgtgagcctcgcgtcggcggagaagggcaagcagtactccgtgaagctggtggagaaggccatccagaagggcaagtccaccaagcagaagggggacgcgctgctggcgcgaatcccccccaccacggacgccgccgacctcaaggggtgtgacctcgtcatcgaggccgtgttcgaggacgtgaagctcaagcaccaggtcttccagaaagtgcaggacgtggtcgccccggacgcggtgctcgggtccaacacgtccacgctgcccatctccgtgctcgccgagggcgtgaagcggacggaggacttcgtgggcatgcacttcttctcgcccgtggacaagatgccgctgctggagctcatcgcgggcaagaagacgagcgacgccacgctcgcgaaggccatcgacatcgcggtgcagattgggaagacgcccatcgtcgtcaacgacagccggggcttcttcaccagccgcgtcatcggcaccttcctcaacgaggccatcgccatggtgggcgagggcatctcgcccgcctccgtcgagcaggccggcctccaggcgggctaccccgccgccccgctccagttggtggacgaactcacgctgacgctgccgcgcaagattcgtcaggagacgaaggcggccatcctggcggagggcaagccctgggtggagcaccgcagctacgccgtgatggacgcgatgattgaccagcaccagcgcaagggccgctccaccggcggcgggttctacgactacgtggacggcaagcgcacgggcctatgggcgggactggcgcagcacttcaccaagcccggccacaccatccccttcgaggacatgaaggagcggatgctgttcgccgaggccgtcgacacggtgcgctgcttcgacgaaggcgtgctgcgctccgccgcggacgcgaacatcggctccatcctcggcatcggcttcccggcatggacgggcggcgtggcgcagttcatcaacggctatgagggccggacgggcaacgggccgcggggcttcattgcccgcgcgcgggagctcgcgcagcgctacggtgcgcacttcgagccgccggcgtcgctcgtcgagatggccgaaagaggcgaattcttgaagtag

SEQ ID NO: 9516 - DNA, 1212 bp, Myxococcus xanthus
gtgagccaggaagcattcatcttcgacgccgtccggacccctcgcggcaagggcaggaaaggcgcgctgcacggcaccaagcccatcacgctgctcaccgggctggtggacgcgctcaagaagcgtcacccgaacctggacccccagcgcatcgacgacgtggtgctcggtgtcgtgtcgccggtgggtgagcagggcgccgacatcgcccgtaccctggtgctggcggcggggctgccagagactgtgggtggcgtgcagctcaaccgcttctgcgcgtccggcctcacggcggtgaacatggccgcccagcaggtgcgctcgggctgggagcacctggtcatcgcgggcggcgtggagagcatgtcgcgcgtgcccatgggctcggacggcggcgcctgggccatggacccggccacgaacttcgacacctacttcgtcccgcagggcatctccgcggacctcatcgccaccatcgagggcttcacgcgcgaggacgtggaccgctacgcggcccgttcgcagcaactggcggcccaggcgtgggccggcgggtacttcaagaactcggtcgtcccggtggtggaccagaacggcctcaccgtgctggaccatgacgaactcatgcgcccggactccaccgtggcgtcgctcggcaagctcaacccgtccttctccgtcatgggcgaggcgggcggcttcgacgcggtggccctgcagaagtaccacttcgtggagcgcatcgagcacgtccacacgccgggcaactcgtcgggcatcgtggacggcgcggcgctggtgctcatcggctccgagcaggtgggcaagtcgctgggcctcacgccgcgcgcgcgcatcgccgcggtggccacgtccggctcggaccccaccatcatgctcaccggcccgattccggccacccagaagctgctggagattgcgggcctgtcggtgaaggacatcgacctgttcgaactcaacgaggccttcgcctcggtggtgctcaagtaccagaaggacctcggcattccggacgagaagctgaacgtgaacggcggcgccatcgccatggggcacccgctgggcgccacgggcgcgatgattctggggacgatggtggacgagctggagcgacgcaaggcgcgccgcgcggtcatcaccttgtgcgtcggtggtggcatgggcgtggccaccctcatcgagcgcgtctga

SEQ ID NO: 9517 - DNA, 105 bp, Myxococcus xanthus
atgaaggagtactccttcgcccacctgttcgcggacacgcgtgtgctgcgaatccttgccggcgcgaacgagatcatgaaagagctcgtcgcccgttccccgtag

SEQ ID NO: 9518 - DNA, 891 bp, Myxococcus xanthus
atggatacggcgagcgagacgctgggcacccagtcggacgcgttggtgtcgtccaatggcctgtccaccaatggcttgtcgacaaacgggctgtcgacgaacggcttgtcgacgaacggcctgtccaccaatggcttgtcgacgaatggactgtcgacgaacggcttgtcgacgaatggtttcagcacgtggttcagcgcggaccccgtcaaggccgaggaggtgatgcgatacatcgtccggtgcgcgctcgcctccggccaatccctgacgtatacgcatgcgggcaccacgcacacctggcagggttccctggggctggcgccgacgtggtcgaaccccacgcctccgcctccgtcgagcccgggcgctccggttgccccggagcccgagcagcagttggtgtcgagctgcctggcggcacacgtgaacaagtacggtgtgcacctgaacatctccgtgcagggcaaggactcgcagggcgtcgtcattccgacgacggccgaggaggtgcagacctacaaccagaatgaggccgtcttcttcggcaacctcttcaatggtcagggactcttcgcggccaatgacgcgccctatctggcctacgacgagagcacggtgcgcgcgtgcggcctgtcgtcgtggagcggggacccggactgcgcggccgtcatcacccacgtgggggctgccctgacgtactgccagcaggactccacgcggacgtactacacgcgctgcacgtacaacggcgtgacgtaccgcccgctcaccacgcgtatccgtccccaggacatctacaagtgcggtgatgggacgtgccagctctccgagagctgcggcaccagcaacacgccggacagctgcgccgcggactgtggcgcctgctag

SEQ ID NO: 9519 - DNA, 2896 bp, Myxococcus xanthus
cgggcccattccgtggcccgggccgccgccgcccggctgcagatgctcacggaagcgtccgacgccttcgatgcgacgaaccgcgacctgtccgtgctgctggacaccatcacccgccaggtcgcctacttcctgggggacacatgcaccctatgcctgctgtccgacgacgggacgcggctggaggtggcggccagccattccaatcagggggaggatggggcaccgctgctccccggcgaggggctgagcgacttcgtgctccgtggcggacggccgctcctcgtgcccgagctgtcggaggaccaaaagcgggagctgggacagggcgaggcgctgcgcagcctgctgtgcgtgccgctgaggacgcagggcagggtggtggggacgctgtcggtggggcgcatgggcccgggccggagcttcacccaggaggaccaggagctggtggaggagctggcggcgaaggcggcgctctccatcgagaacgcgcgcctgttcgcggagcagcagcggtcgcaagaggaactgcgccggcgcgccgagttcgaacagcaactggtgggcatcgtctcccacgacttgcgcaatcccctggcggccatctccatgtcggcggggctgctggagaagaagggtgcgttgacggagccgcagaagcgcatggtgtggcgcattggccaggccaccgagcgcgcggcccggatgattcgcgacctgctggacttcaccaaggcccggctgggcggcggcattgccctgcaccgtcagaccaccgatttgcgggaggtggtgcaccaggtggtggatgagctcctggtggccaaccccgggcgtcgcgtggaggtggaggtccagggcgaggtgcgcggcgaatgggattcggaccgcatcgcccaggtgctcacgaacctgctgggcaatgccctggcctacagccccgcggacgccccggtgcgggtggacacgcggctggagggcgaggccgcgctgctgtctgtcttcaacggcggcgcccccatcccccgtgagttgctgcctcgcctgttcgagccgctgacacggggcgcgttgaaggagggccagtccacccgcagcatcggcctggggctctacatcgtgcaggacatcgtgcgcggccacggcggcggcgtggaggtggtgtcctccgagcagcatggcaccaccttcaccgtgcgcctgccgcgtgcggcgggctgagtcgcccgtcccgtccatcgattggctctacgccgtgggagacctcaacggtgacggcccatacgtcctgtatcaggtcaaccggatgacaggtgccgccatgacgccggagcaggccttcctcggcggtgcctccggacccgagctgcgtgacatcgccatcatgtattgagccggagtcctgggcgagcgcgccggggccctggccgttcgcgcagggccattgcggaatgaggacaccgcggcgggtgccgggccgcgtggcgcgttggcactggcgcggagtgagcactgaaggtcgcgccggtacccacgtacaagttcgcgctcccggagatttgtcactcttgtcccgtgtgcgttccgcgaccgagcgtcgagcatcggggctggagggcgtgccagggggacgtcgatgggggtgtgtctgtcgtcgaagtggggctccgcctggacctggacgacgcatgcgggaggcgcagcgccctgcctgcgcttcgagccggtgcgagggacggcgggggaggtgctcgacttgcgccaggccgcgctcgatgcgtccgccgagccgacggcgcacgattgggtcctgcctccatgggtgtcgcgctgggagcaggagggcgtgcgagggctgcgcttggaggactgcgtgcgcgtggtggacacgggcgagccggtgtccgtcgtgctgtgcatcacccgagagggcatggaggcgcgcttccgggccgtgggcatgaaggcgttggatgccttcgtgctgtggctgctgcccgatgacacggacgacgcgcaggcgcttcgtgaggcgctggagcgtgagcgtgaggcccgccaccgggcggagggcgcgctggagcacgcgacggcccggctgacccgcgaggccctggatggcaacgcgcgccacctcgcgctggagcggctgaccgaggaggcggagtttcgtgagcggttcatcggcatcctcgggcacgacctgcgcaaccccctgaatgccattgccctgtccgcgcgagccatggcgcaacgcacgctgccggcggcccagcagcagcagtgcgcccagcgaatcgaggcgagcgccgcgcggatgggcgccatgatttccgacatcctcgacctcacccgcgcgcgtctggcgggcggcatccccctgcacctggggacggtcagcctggccatcatctgccggatggtggtggaggagctgtccgccgcgcatccgggccggcacatcaccctggacgtggagggcgcgtcggagggcttctgggacgcggaccggatggcgcaggtgctcagcaacctggtgggcaacgcactggagcacggcgccgaggacacgcccgtccggctcaaatgtatcgccgtggacggtgagcaggtcctggaggtccacaacaccgggacgcccattccgcctcaacagatggagacattgttcgacccgttccgccaggtgggcactgctcctgggaagggccaccgtcgtggcgctggtggcctggggctgggactcttcatcgtgaaacaaatcgtccaggcgcacggaggagctgtgtgcgtgtcctcctccgaggcagagggaacgaccttcacggtgaaaatgccacgagacgcgcgacagtcgcaggagcccgcacccttgggcgtgagacatcgcgtgtga

SEQ ID NO: 9520 - DNA, 111 bp, Myxococcus xanthus
atgctggtgggcaagacgcggcagcggcccgaaatggtcatcgagaacctgcgccagatgcgcacgtacttccaagcaatccaagcgcgcctgacgccgggcgcatcctga

SEQ ID NO: 9521 - DNA, 477 bp, Myxococcus xanthus
atgcagaagatcacgcccttcctgtggttcgacggcaacgcggaagaagccatgaagttctacgtgtccgtcttcaagaaggacgcgaagattctgagcctcaaccgcgccggggactcggacacggcgccggtcgtctctggcacgttccagctccatggacagcagttcatggcgctgaacggagggcctcactacaagttcaccgaggccatctccctgttcgtggactgtcagacgcaggaagaggtggatgagctgtggtcgaagctcctggagggaggaggccagacgcagcagtgtggctggctcaaggaccgcttcggcctgtcctggcaaatcatcccgtccgtgctggggaagatgctgaatgacaaggacccggagaaggcgcgccgggtgatggaagccatgctgggcatggtgaagctcgacatccagggcttgcagcgcgcgtacgacggtgcggacccgtag

SEQ ID NO: 9522 - DNA, 102 bp, Myxococcus xanthus
atgggagacctgctcacggaagctcagcggccggcttccgagaagctcaatctcatctatgcgcgtttggagctggctcaggcgcgccagggggaaggatga

SEQ ID NO: 9523 - DNA, 996 bp, Myxococcus xanthus
atgcgggcattcgtcaccggtggttcaggcttcgtgggcaggcacctcctcaccgcactgaaggtgcgcgggacgcccgctcgggccctggcgcgctccgccgcggcacgggcctcggtgacggaggccggcggggagcccttcgagggcgacctgtcggacgtggagaagctgaaggcgggcatggagggctgtgacaccgtcttccattgcgccgcggtggtgaagggctggggcgcgcgcagcgagttctacgagacgaacgtgcgcggcacggagcgggtgctggaggcggcgcgcgccgcgggcgtcaagcggctggtccacgtcagcacggaggcggtgctggcggatggctcgcccctggagcgggtggatgagacgatgcccctgcccgagcgccccatcggcgactatccctccaccaagggcgaggcggagcgccgggtgctcagcgtgaatgcgccggacttcgtcaccgtggtggtgcgtccccgcttcatctggggcgccggtgacacgtcactgctgccgcagttccaggaggcggtgcggaccgggcgcttccggtggttcggcggtggccgttacctgacgtccacctgccacgtggccaactgcgtggagggcatgctgctggcggcggagaagggccgtggcggcgaggcctatttcctcaccgacggggaacccgtggagttccggggcttcatcaccgccatgctcgcgacgcagggcgtggacgcgggcgagcgcaccctgccatacggcgtggccgcgacggtggcctcggtgggggacttgctgtggggcaccttcggcctgggcggcaggcctccgctcacccgcaccgaggtgctgctcatggggcgggaggtgacggtgcgggacgacaaggcccgccgggagctggggtatgagggccgccgctcccgtgaagaagggctccgcgagatgaaggcggagcatcaggacacggcgtcgcgtatgctctga

SEQ ID NO: 9524 - DNA, 750 bp, Myxococcus xanthus
atgcagcccaagggccgcgtcctgcgctacgccgtgaatgacatgacggccgcgacgcaaggcgatggcgtggctcggttcctgcccttggatgcggggacctacaccgtcacggtggatggcctctcggcggtggacgacctgctcctgaatccaggggcccgggagcagccggtgatcttgaacacctgcccggtgtgcctggtccctgtcgaagtgggggcgcgccccgagttcctgcttcaatggaagcacgatgccgcgggtgtcagcggcgtggaactcacgctgggggatgcccatcccctggcacaggccacggggacctcgggcctggcgggatggagcggggagccgctggtgcccgggccctatccgctcgccctgcgcttcgcgggaggcggcaagttccagctctattccgccacgggccagttgctggacgccgcacctgtgctgaacatccccgcgggccggtttcgcttccactaccaggtccagcaactgggacagctcaagctcgccgtccagctccagcagcccgacgggacgatggcgcccatcgaccggccgcacgtcaccgtccaatggccgccgagtgcctcgccaaaggagtgggtgctcgaccagggcgtcagtgaggacattcccctggtgaatggacctcagaccgcgttgacgctcgacgcactcgaactcgaggacgacggcgcccccgaagtcttcgagttcatggccttgaacccgtaa

SEQ ID NO: 9525 - DNA, 3153 bp, Myxococcus xanthus
atgcctcctgtcttcgcccgccggtcggactccaacaagattgatgtgacgcaccggcagacactgggtgagttgctcgacacgaacggtctcaccggccggttgaacgacgtggccctctacaactggggcaccctcgtcccggcggaaatcaaccgcgcgctgatcgaactcgtgggttgcgccagtccggagacggacccgctcgcgtcgctgctcgaccccgcgctgggaccgaagcctttcattcacaaacccgagccgtggaagcccgccgcaccgctcgccctggacacgtcgcacaccgtgcaggtgcggcgacggtttcctgctccggcggtgtccatccgcaagctcacccggtggttcctgccttcctccggcacctgcgaaacggagtacatgctggaaggtgtcgcctccagtgccgacaaggtggacttcgaggtccacgcccacgggtatcactcgctttcgcctcagggcgggcaggtggcctgcgacacggatgctacggaggggggctccatgcacttgtttcgccggcgcaaatgctacgaggtcgctgacaggcggccgcccgctgtggcccagcagctcccggactggaaaggggagagcgaggccacgcagggcgtgctgaagcgggagggcacggggaccttcatccaccacggctgcgcgccctatgacgtgctggtgcggtactacaaggatgaccgggacaacgcggcgaaaatcctcctgacgccgttcgctccacgctggaagcccgtcaagggcgcggaccccgagctcgacgaggacacgctgagtgtctcgtgggagctgcaaggcgaccacggcaagctcaagcgggggcaactcgtcgtctgggacaaggacgacaacgtggtgttcttcgcgcccctggacgagcagcagctccggacccggaaacgctacgagttcctgaaggatgcgcggaagacgtgggacaaggccgcgattcgccgcgaccagttgccctaccgggtgcagctccaggcgcacagtgacgaagacgaaccgcagggcctcgcgctggccgtgatgcccacccaggtccgtgccttcgactatgcgcaggtgcagttcattgccttcaacgtcaagccggggacgaagcctcgcgtgcctggccccggaatcgactacctgggcgacgcggacccggacgtcgacatccagacgcgctgcgatgtgatgaaggatgccattcggctcgcggcggcggatggccacatacgtcccgaggagaatgtcctcaagttgttcatggcgccagagttctacttccgaggaaaggacggtggatatccggtcgagaagctctgggacgtcacgcggcagctccggcaggagacggacaagctggagtatgcagactggctcttcgtggttggcagcgccatcggctatctcccgcacgaggagttggatgcggtgacgggggcacccaccgggacgccgctcacgcatggtggggagggggaggtccactcggtcctcctcgaggccgatacgtccggcgtggatgacgtcctcaaggtcaggctttcgcgccctcccgacacgacctggaaggtgcgtgagcgtgggaagaactacgcactcaatgccgtcgcgacgacgctcacgcccggcgagtaccagctcaccgtggacggcaagagcggccttgctccaggccctatcgttttgtccgaacccgtggcttggattgacaccgttgaccagacgggggcctgcacggaggtcgtggtcaactccagggtgtgctctcgcatcttcattccgtcatcgggcgccgcgcctgctgcgccgtggaagctgcgcacggggtctgaagaggacgacatcaaagggtgtgtgccgctgggggcgggccgataccgcctcacgcttgcgaacaagaaggtgggcttcgccagcgggtcggcggagctcgtcgagcccaggtcgacggaagtcttcaacgtcgtcatggtccagaagggctggccagcaccactgctcagccaggggttgaaaggggccgccgtctacaaggagtacgtctccgccatcgatttcgtgggacccaactcccacaatgccaatgcctggttcgacgcgacgggcttgggccggcgtatcgagatccatggcgccacggacaggctggcgcttcccacggaaggctccacggacgtaccggcggcgagccccaaccgggtggggctgggagccacctggttgaaccggccgaaccgcgtcgggtcggaaatcaacctgtcgggcgacggaggcggctcagtggtcacggtggatggcgtcaccctgggcctggaagtctgcctggaccacgccatgaaccggctggaccttttctatcacggggggaacagccccgttccccccttcgggccgcaggctcctggcgccgtggctggcgaccctcgggtacaggtccagctcatcccgtcgttcggtatgtccattggtcgtgggaagctgtgcaccttgattgggggcccgcggcccggcctggtgttcaacgtcgatggtcagcggtgcgcatcggtggctcgcgtaacggatggcgcttactcctgcgatgaccatccggccatgcacgcgaccgcgccgggcttttgcacccatgacaaggaactgcggtggtgtgtcggctgtaacaagatgcggagcgcgcccggggactgcccgactcacggtccgaccgaggcgcggcatctgtgcggctacccttggcaaaggtggcagtgtggggtggtcggctgtaccaataccatgccctgcctcgcacatccctatcccccagcgcctcctccgcttggcttcaactggtgtctgaaatgtagcaaggaattccccatgggcccgccttgcccaacctgcggtggcccgcccgcgccatgttctgagccttacatggcaggggcgacctgccccaggcacgctccagcgttcgctcagcgatgcaatgcgccgctggtctccatggggcagtccatcgccacggtgagtggtcccacccaggtgaattccagccacgacccggccttcttcggcgaagggggacacgtgctcgtctatcccgcgcaagtccttccgcgtcccgacgtcttctga

SEQ ID NO: 9526 - DNA, 1479 bp, Myxococcus xanthus
atgaatccgcgcacccaggtgttcgacgtggacggcgcgcaggtccgcatcacgaccgaggtctcgctcgccggactcaccgcgccgctcgtcgtcgacccaggctggtcctccaccgccgccatggcggaagcccgcgctcagcacaccggcctcctgctcggcaccggccagttgctggtcgtcggtggcgtcaaccgcctgggcttcgtggcttcgtccgaacgctacgaccccgaaaccgacacatggagcgcggcggccgccgccgggatttcaggcaacgtcaccctttccgcgcgcctctccgacgggcgtgcgctcgtgctggcggacggctccacgtcggggcgcatctacgaccccgcgacggacacctggtcggccacgggccccatggccgcgccccgccccctggccaccctcacgcggctcggctccggtcaattcctcatcgcgggcggcagcaatctcgcgaccgccgaactgtatgaccccgcgagcaacacgttcctccccaccggaagcctcctgagcgtccgtcgcgcccacaccgccacgctgctgcggagcgggcaggtgctcgcggtgagcggcttcaacaacgtgaacgacgaagtcccgggcgccgacctctacgacccggtggcgggaacatggaccgccgccgcgccgcccctggtcccaaggcactacgccaccgccaccctgctccccgatggccgcgtgctgctcgtgggcggattcacctcgggcggtatcgtcaccacgcatgccgagctctatgacccgacggccaacacctggacggccaccggcggcctgaatttcgcgcgcaacggccacaccgccacgctgctgcccgacggtcgggtgctcgtcgtgggcggctccaacgccgcgcgagatgcccaaccggcatccgaactctacgaccccgccaccggcacgtggaccctcgcgggctccatggcgactggccgggagaacagcaccacgaccctgctcccctccggcaaggtcctcaccgccggaggcttccactccaatccgtcaaccacgttctacgcggacacggaggtctatgaccctggcgtccagggctgggccgcggcgggaaccctgggcggtcctcgcattgacccgctgatggcgctgctgcccacgaaccgcgtcctcgtggcgggtggccgtgacggagcgggcaccgcgctggcgtccgcctcgctgtatgaccggacgacgaacgcctggtccgcgaccgcgggcctctccaccgcgcgagccgatgccacggcgacgacgctggcctcgggcgagctgctcgtcgtgggtggcacgaacgcaggcggcacgctgaactcggcagagcgctattcgccgaccacgaacacctggagccccgcggggttactcacccgcgcgagacacctgcacaccgggacgcgcctgccggatggccgggtgctcgtcgtcggg

SEQ ID NO: 9527 - DNA, 516 bp, Myxococcus xanthus
atggacctgcataccagctacatcttccccacgccgcacacctacaacacgctcgccaagccgaacttcacgaagatcgtcaagttcaagctaggcaactggctgttcgacgcgatgaacatcgacgtcaacatcaacgccctccgcttcaacctcactcaggcgcagatcaactcctttgtgaacaaccagctcaaccaattcatcggaggccaactcaacaacgtgtgggctggcatcgaacgaggaatcatcaacgcaatcgacccgacctacatcagccggtacgcggaatacaccaagaaggtcaactcactgaaagagcagaaccggttccgcatcacgctcggaaaggccgagaagcaccggggctacagccacaagaacagttggaccttcgactggaacgtggcggtcggccagagcacgtactcgtacgacatgaaggccggcagcttcctgggccgcgccagggtcggctgcagttggcacggaatccggatcgtgcggcagtaa

SEQ ID NO: 9528 - DNA, 1548 bp, Myxococcus xanthus
atgaataggaaacctgacgtctacacactcatcctgacatcctgggccgccctggccgtcggatgtggcacgcccagcgagcctcccacctccacggcgtccacggaggctggcttcacagcccaggttgaggaggcgaacgaagtctccgaggacgtatccacagaagggctcgacaccgcgttgtccagctcagccacggtcctggggcgcttctcgcgctactgcggcaaggtcaacagccaccagtctcctgggggcacctggacggcggaccccgactgcacctcgggttgcaacatcggcggcctcgcctactgccagaagttctggccgggctccaccgccatccgtcaggtcgccgtctcctcgaagcccaacaacgcctggcggacggctggctgtggcgtcatcgtcgacgactacgacggcaccgacgagttcgaatgtaccgtcgagccctactgcggcgacggcatctgtcacaccgacaatggcgaatcgccgtcgacctgcgccgccgactgcggcacgtgcggagacaacgtctgcaacaacggtgagaactacatcgtgtgctcggaagactgcggcccttcgagcgcctgcggggacggtgcctgcaacaacggcgagacgcacgccacgtgcgccgcggactgcgtggcccccgccctggtaacgactccagacttcccgactggcgtgctccagttcgcgacggaagaggccttcaactcgctctaccatgccctcgaggccacgcccgcggccgcgtcttcgctgcccaacgggttcaaccacctcaagggccacctgagccagttccccatcaacgaaaccacctatgaagtcgaccgggccgagtatctgcgcgacctgaagttccacatcatcccggacgagggtctccagtatctcgtcaacccggacatgcaggtgctcgcaggtggcaagctctatcagttcacggatatcggtctgttccaggtcgacctcaacaacctggcctggttcaagacatggctcgcggcgaaccaggagcgcatcgacttcgatccaaacttcaagacagtcccgggggaggtcgacctcggcgacgggcgctaccaggtgagcaccggcgtcgttcgcatcgacatgctcaaggagaagatggcgggcagcgacaccaccccggaccctactgaaacggtcctggggcgcttctcgcgctactgcggcaaggtcaacagccaccagtctccagggggcacctggaccggcggaccccgactgcacctcgggctgcaacatcggcggcctctcctactgccagaagttctggccgggctccaccgccatccgccagggtcgccgtctcctcgaagcccaacaacgcctggcggacggccggctgtggcttcatcgtcgacgactacgacggcaccgacgagttcgaatgcgtggccaactcccccttcgccaccgcggtggcgcaggagcagctcaagggcgaatcaggtggcgacaagtgcaacccgccgctgcccgcctatcaattgctga

SEQ ID NO: 9529 - DNA, 633 bp, Myxococcus xanthus
gactacacgcgagcggtggtggcgacgctggccttcgtgcccgagccctcgcgcctgctcgtcgtgggactgggaggtggcaccattcccaccttcctccgcgcggtgctcccgcatgcgcacatcgacgcggtggaaatccagccccaggtgctggacatggcccggcgctacttcgacttccgcgaggacgaggccctgcacgcccatctcgcggacgggcggcgtttcatcgaatcacccggggcgccgtatgacgtcatcatcctggatgcctacggcacgcgaagcatcccgccggcgctggcgacgcaggagttcctgcgggccacgcaggccaggctgacgccggacggggtggtggtgggcaacgtgctccggaagtcaggccggcccggctcactgatggacccgctgtggcaggccagcttcccgcaactctacgccttcgacgtgcaggcgtcggacaaccgcatcctcgtggggctgccccatgcgcgcaggctcctccgtgcgagattgctggcacgcgccgggcagctcgcgcgcaaatggggcgtgcccttcaacctccgcgcacgggtggcccgccgcgtgagcggcagccgcggccctgcgaacagccacggctga

SEQ ID NO: 9530 - DNA, 300 bp, Myxococcus xanthus
atgaacgtggacgccttcatcgtcgtgaaaatccaagggacctatgagggtgacgcgccgctgaagctgaagctgctggtcagcgcgcccaaggagtcctccgaagcggcgggtgaccggcctgcctggaaggtgactcagacgcgcgacctggcggtgctcacggagaatggcgtcacgcaggtgcccttcatcctcccgtaccactgcgcctccacggtcaaggtgacggccacgctgacgggcggcggactcaaggccagcaagacgctcgacacatccttcccctgcgccgagtag

SEQ ID NO: 9531 - DNA, 1581 bp, Myxococcus xanthus
atgaacctctcgcgagccgcccttctcgtcctgctccagccgctggccgtccaggccgcggagtaccgtgtgggccctgaccagcagtacacccgcctgggtgacgtgccttgggagtcactcgagcccggagacaccgtcttcgtccacgcacggcccacgccctacgcggagaagtgggtcctgggccgccggggcacagccgccgcgcccatcaccgtgcgcggcgtgaaggacgcgcagggcaacctgcccgtcatcgtcggcgagaacgccaccacgcgctcgcagctcaactattggggcgaggagcgcggcatcctgaagattggtggctccaaccggcccgcggacacaatgcccgcgcacctggtggtggagaacctccacctgcgccgggcacgcggcgccttcaccggccgcaacggcgcgtccacctacctggacaacgccgccgccatcttcatcgagaagggcgaacacatcaccatccggggctgcgtgctcgaggacagcggcaacggcctgttcgtcgccaaccaggcgtcgaatgtcaccgtcgagcacagctacatcctgggcaacggcaacaccggcagcatcctcgagcacaacgcgtacaccgaagcgctgggcatcacctaccagttcaaccgcttcggcccgctctgcagcggatgtctgggcaacaacctgaaggaccgctcggcgggcagtctcatccggtacaactggattgagggaggtaaccggcagctcgacctggtggactcgtccagcggcacgctgcgcgcggcgccgtcgtatgcgcggaccttcgtctacggcaacgtcctgttggagcccgagggcgcgggcaaccggcaaatcgtccacttcggtggcgactccggcaacacggccaactaccggggcacgctctacttcttccacaacaccgtggtgtccagccgcacggaccggaccacgctgttgcggctgtcgcaccagaaccagacggcacatgtgacgaacaacgtggtgctggtggcctcggccaatggcaacacgctgtccctcacggacgaggcgggcacgctccgacatgggggcaactggtacaagcccggctacgtgagcaccttcggcacgctcacgggcgccgtggtggatgcgggagggaatctcaccggaaccgaccccgggttcatcagcctcgccggacaggacttccgcctggccgcggcctccgccctgagaagtcaggcggtggcactccccgccgagaccagcagcgagcccgtcacctggcagtacgtgaaacacacggcgggtgagccgcgcgcccaggtgagcccggcccacatcggcgcgtatggggatgcctccgagccagggaccgagacaccggacgcaggcacgggcaccgagcccgacgcgggaacaggaacccccacggatgcgggcacgacgccgcagccggacgacgccgagagttcgggtggctgcgcggccgctggcgccagcttcgccggcccactggcgttcgcgattctcggcatcctgggacgccggaggcgaaacccggcgcgaggccagtag

SEQ ID NO: 9532 - DNA, 198 bp, Myxococcus xanthus
atggacccgcgcacgctcacgggtgacacgctccggttcgagcaggcgctggggtcgaaccccgcggcgccgctcacgggtgtcatctcctacgatgctccgagccagtcggtgtccttccgcgtcagtccgctgcccgcgccgggtgcgctcgtcaccggaacactctccacgggggcgaaggacctggcgggcaat

SEQ ID NO: 9533 - DNA, 1260 bp, Myxococcus xanthus
atgacggagtcgagggacattcgcatcgagcacctgttgcgcgaacacgcgccgcgggtgctcggcgcggtcatccggcggtttcgggacttcggagcctcggaggacgcggtgcaggaagcgctgctcgcggcggccttgcagtggcctcgcgagggcgtgccggacgacccgcgcgcctggctgattcaggtcgcctcgcggcgaatcacggaccacgtgcgcgcggagaccgcgcgccgccaccgtgaggagctggtggtcagcctggtgccgccggagctccagctcgtgatgtccctggatggcgacgagctggcgggccgggatgacgcgctcgtgctgctgttcatgtgctgtcacccggcgctgtccacggcgtcggccatcgcgctgaccttgcgcgcggtgggcgggttgacgacggcggaaatcgccaaggccttcctcgtgcccgaggcgaccatggcccagcgcatcagccgggccaagcagagcatcaagagctccgggattccgttccagaagcccacgccggaggagagcgcgcagcggctgggcgcggtgctgcacgtgctctacctcatcttcaacgagggctacacggccacctcggggccggagttgcatcgcacggacctgtcgggcgaggcgattcggctgacgcggatgttgcacacgctgctgccggaggacggcgaggtggcggggctgttggcgctgatgctgctcacggacgcgcggagggcggcgaggacggggcccgcgggtgagctgattccgctcgacgcgcaggaccggagcctgtgggacgcggggatgattgcggagggcatcgcgctcatctccgcgacgctgtcgaggggctcggtggggatgtaccaggtgcaggcggccatcgcggcggtgcatgacgaggcgtcgcgcgcggaggacacggactggccgcaggtgctggcgctctacggggtgctgatggggctgatggacaacccgatggtggcgctcaaccacgccatcgcgacggcgatggtgcacgggccgcaggccgggctgtcgctgctggaggggctggccagggagggccggctggaggggaaccaccggctcgacgccgtgcgcgcgcacctgctggagcgcgcggggaagacgggcgcggcggtggtccactaccggaaggcggccgagcgcaccacgagcctgcccgagcgcgactacctgctgacccaggccgcgcggctgagcgacgagatggcgtag

SEQ ID NO: 9534 - DNA, 867 bp, Myxococcus xanthus
atgcgaaggttcgagttcgtggaaggctccagctccaagttctgggagccggagctcaagggcaacaccttcatcgtcaccttcggccgcatcggcaccgccggtcagcggcgggagaaggctttcgcggacgaagccggcgcccggaaggaatacgagaagaaggtcgctgagaagctgcgcgagggttacctcgaggtgacggagggcggcgccgccgaggccgcgcccgcgtccgcgccaccgcctgcgccgaagaaggcggagctcccccgccgcgtgcccgcggccacgcccacgcccgagtcgctgaaggccgccgccgaggcactggccgcgctccgggcccggctggggtggcggagctgggaggtgacgtcgcgggcccggcgtgcgaagcgcgcgctgcgggccctgggcggcgtggaccccgcggcccactcggagctggcgggcaccttcaccgcgttgatggagcgcgtcgtcgctccgaagaaggatggccggctcccgctgcggcacgcgctcgcgttgctgggcgaactggacgtggctgccttcacccgcgctgccgaggtgtggctcgccgcgccggacgccgttcccgccgcgacgaccgtggcccggcaggcgtcggcgctggggcagcccgagctggcgctgcgcatgggcatgctgctggcggagcgtcccggtcaggcgggcgcgccttccgaggaggggtggagcaagcggtggacgcgcctgcggccgcacgtggaggagcagctgtcctccagcggcggctcgctggccagttgggcccagtccgtcgatgcctcgaaggacgcgcacctggccagccggttggcccgcctggaggcgtga

SEQ ID NO: 9535 - DNA, 393 bp, Myxococcus xanthus
aagtacatgctgatgatgaacaccccgagcggcggtccgtaccaggtgatgagctggccgaagaaggacctccaggcgcacatcgcgttcatggcgggcttcgcgacgaagctcggggagacgggggagctggtggcggccgaggggctggcggggccggaccaggccaagcgcgtgcgcgcgggcgcggacggcaagcccatcaccgatggcgtgttcccggagtcgaaggagttcctcgcgggctactggattatcgaggtggacagcccggagcgggcctacgccatcgccgcggaggcctcagcggcgcctgggctcggcggcaagccgatgaacatgcccatcgaggtccgccaggtgatgagcggtcctccgcccgacctgatgtga

SEQ ID NO: 9536 - DNA, 1743 bp, Myxococcus xanthus
atgggccgcttcgacacacaggtcctcgcggccgtcgagcagcagattggacgcgacaccgcggtcagcgaagcggaccgtcaggcggcgctcgacttctaccgcgcggtgcccgcgtccatggcctgcctgagcggtgacccggagctggcgagttaccgcaacagcctgggaaaggcgtgcgcggacctgaaccagttcaattgggcgtccctggcatcctgggggttgttggcgctaggccttgcctccaccgtggtcgcgcttctctgtggtctggccgcgttcgtctcgcgtccctttcagttcggcagcttcgtggtgggctggctcgtgctccgcgtcaccagtgcgattcaggtgctgggacagggcgcgctgctcgtgtggctctcctattggatgacggcgctatggatggagcgctactacccgaagctcatcggcatcatggcccttctggccggcggcgcggtgttcctggtggtggtggccatcttccgccgtccgccctcggacttcgacgtggaggccgaggcaatcaccgaggctcgcgccccggagctgtgggcttgcgtgcggcgcctctgcgagcggctccagacggcgccccccgacaacatcctcgctggcatcgatgccaacttcttcgtgaccgagcacgaggtgcgcgtgggtgagcgcacgctgaccggccgcacgctcttcgtgagcctgtcactgctgcgcctgctggagcgctccgaggcggaggcggtgctggcgcacgagatggggcacttgctgggcggcgacacggggcacagcaagcggctggcgcccaagctcgcgcacttcggccattacctgcagcagctctacgacggtggcatgacgcggcccgtcttctatttcatgatggcctaccgcggcctgttcgagctgtcgctgggccgcagccggcgcgccagcgaactcgcggcggaccggttggcggcgggggtgacctcggggcaggacatcgcccgttcgctggtgaaggtgggcgcgtacgcgagcttccgcgaccgtgtggaggcgaagctcttcgcccaggacgagcagcaccagacggtggccatcgcggaccgggtggcgcacggcttctccgcgtatgcccagtcggacaccgtgcatgatgacctgcagggggccgtgacgccgcatcccttcgactcccacccgccgttggccgcgcgcatggagaacgtgggggcccacctcaatcccgaggacatggtgcggttgctgctggagccggtgacgtcgtcgtgggcggacaccgttcaggacgcggacgccatcgaggcgcggctgtggggcgcctatgaggcgcgtttcgctcaggcccatgacctgtccctcgcgtaccgctatgagccctccacggaggaggagcgagcgcatgtggagaagcacttcccgccgctcgtgttcgagggcaaggaggcgggcttcgatgtccagatggactacgcgcaggtgagctacggggactgggaggcgcccatcctgttcgagcagatcgcctcggccaccaccgcggaccgcatgttcaagaagtacctggacctggaagtccccggggaagggcgcttcaagagccgccgctccatctgcctgagcaagctgagagagccggacgccttgctgcaggctttcgagcgctacctgtcgcggcaccgcatcatgaaggagcacctcgcaggcgcgcaggctgcttga

SEQ ID NO: 9537 - DNA, 1398 bp, Myxococcus xanthus
ccaatggtgtcgtggacggagacgaaacgggcatcgactgcggcggttcgaagtgcaagccctgcgggaacaagcagggctgtattcgccccgaggattgtgcatccgggtattgcaagaagcccgtggcgtccggagtcgattttgggacgtgcgtgcagaaccactgcaacacgggtgtcaaggacgccgatgagagcggcatcgactgcggtggaaatgactgcgcgaagtgcaaggtgaaagcacgatgcgcggtggcgggggactgcgagtccgagataagcgacggcaccttctgtgtcccgactcgctgcaaggaccgcatgaaatccggcgacgagacggacgtggattgcggcggctccatctgtgcacgttgcgggagcggcaagaagtgcaagcagaactccgactgtgtgctgcagcaggaggggtaccagatgtactgtgctccaatccccgtcatcggtccggtctgctttggcgcgcagtgcaataacggtgagaagaactgggatgagagcgacgtggactgcgggggaccctgcgctccatgctctcgcggaaaggtgtgtctccagcagagcgactgcgccgcgggtctggagtgtgatacgtcgaccagtccccaccgctgtgtgtcgttcctctgcgatgcgggccagtacctctccaatggtgtctgtgtcgacgtgggcatcgggtattggtctcccgcgaactccaatgctcgtaacgcctgcacgaacgcacccgcgaacgcggtgtatacgagtccgacggctgctcaggccaactgcccctggacctgcaagcccgggtatctgcgcgatgccacggggacgaagtgcgagaagaacgataccgtccaggtcctcacgtgcggggacgacgaggtggcggtcggaatccacgggcgggaaggcgcctggttggacgcgctcgggatgcgctgtgcccgcttcgactccggaaggatcatcggtgccgccacgagcgcccccgcgattgggggcacgaatggtgattccttcaccctggactgcgcagccggcgaagttgtccagaaggtcaccggaatcaacggttgggccagtggagcgcccaatcagacgtggtgcagtgcgcaaaacctgtcgacgattgtgctgtcgtgccggaatctcaagacggggacgctcaccgtgatgcccaaggtgggcggaaagaacgacggctgcacggtgggcaacctgcccgagtattccttcggctgtggcgcaaatggctatctccgcgggctcgtggtggatagcgcgaatacgtccatgtacgtcggctacgtgctcgacaggagttgccgctaggcgctcggcgaccttcgtcgcctccgccaaagccaggctcccaggccgg

SEQ ID NO: 9538 - DNA, 822 bp, Myxococcus xanthus
cgccggccctcgcggcccggagaggtgccccgcctggatgtgcgggtgaaaggcttcaccccggacgccagacaactggcccgttaccgggaggtgtgtgggtttcccgaggatggctacctgccgctgcctttccctcaggtgctcgcgacgtcgctgcacctcacgctgctcaaccacccggcgttcccctaccggttgctgggcatggtgcacgtgcgcaatcacatccagcagcatcaccgcctgcacgcaggggcccggctctccgtccatgcctgggtcgaaggccagcgtgaggcacggcaggggcgcgagctggatttgcacaccgtggtggaatcggacggcgcgcaggtgtggagcgccgtcaccaccatgctccgccgcctgcctggaatgggggagcggccgcgtgaggcggggcgtcctccctccaccgacgtggcgcaagtcttcgccaacagtcgtccggccaactggtccgtcccggagaacgcgggccgccgttacgcccgggcgtcgggcgactacaaccccatccatctgtatggcttcacggcgcgccccttcggctttccccgcgccatcgtccatggcatgtggaccgtgggccgctgcgtggcggagatgggcgaggcggcggaggctcccgcgctcacgttgtcctcggagttccgccgtccgctcctgctgccctcccgggtcatcttccagaccgccccacagccagagggcgccgttgcctaccgggtgatggcggaggacggccaactccacttgctgggccgcctgtcaccgggtgcgtcgccggcgcggtga

SEQ ID NO: 9539 - DNA, 573 bp, Myxococcus xanthus
atgaagaaggtcgccgcgctcgcatgtctgttggccttgttgggggcgattccctctcaggccgccgagctgaaggacgtattcggccgtgaggtccccgtcggcaaggggcggcccaccctggtgctgtacgccaaccggggctctcgggccgagctgcgccagcacgcctactcgttcatctacgagctgcgcgaggagcggcccattgtcctgattcacgtggacctgcgggacgtccccggcctcttcaagggcatggcgcggggcgaaatcaagaagagccaccgcgagtccatcgagcacatgcggaacatcttccgtcagcacggtgaggcgccgcctcccgaactggagtcgtcgctcttcatggtggcggacgccaagggcgagccgcaccaggccatggggctgaagaaggggttcggccaggtcgtcgccaaggtactgagcccgtcggggcgggagctggcgcggggccccttccccgagagcgcccgcaagctcggccagacgatggcctcggcctcggagagcctttcgacgctccgagtcgtggacatgtcccgctga

SEQ ID NO: 9540 - DNA, 183 bp, Myxococcus xanthus
atgtccaccagtgcctatgtgttctgggcggtggttccggaggcgcgcaggggcttcgtcatatggagctacggcgccacgacctacacctgccgctccgaggagcccaactgcaccttgatcttcgccttccggaccaacagccgcgcgaacaggcccggggactacaacctctgcagctag

SEQ ID NO: 9541 - DNA, 396 bp, Myxococcus xanthus
atgctgcccggcaagcacatcgagggcgatggcctcatcctggagctgcccggcttcgtgatgaatgtggtgaccccgtcagctcacgagttcttcaagctcccggccgacaagaagctcacccttcctcttcgcgccaacctcacgctcatgtgtggctgtcctaccgagcccaaggggctctgggactccagccggtatgagctgcaggccacggtgaagcacaacgggaagccgctcactcagctccccctgaagtacgccgggaagaccagcaccttcgaggcagcgctgtccgtccagcagcagggtatctacgaggtcaccgtgactgcatacgaccccatcaccggtaacaccggagtggactacaccacgttcatcgttgagtcgtga

SEQ ID NO: 9542 - DNA, 1449 bp, Myxococcus xanthus
gtggtgattgctggagggggcccgaccgggctgatgctggcggcggagctggcgttggcgcaggtggacgttgccatcgtcgagcggcgcgtcagtcaggaggtcgccggctctcgcgcgcgcggcctgcacgcgcgcagcctggaggtgctcgatcagcgcggggtcgtcgagcgcttcacctcgcaagggcaagcggtccagaatgtcgcgttcgggcaggcgcatttggacctcagcgacttcccgacgcgtcacaaccatgggctcgcgctcttacaggagcgcttcgagcgcatcctggcggagtgggtgggtgagctggcggtgcccatctaccgtgggtgcgaggtgacgggcttcacgcaggacgacaccggcgtcgacgtcgagctgtccgacggacgtgcgttgcgggcgaagcacctcgtcgggtgcgacggggggcgcagcctcgtccgcaaggcggcaggcatcgagttcccggggtgggacgcgtcgatcagctacctcatcgccgaggtcgaaatgaccggagcgccggcgttcggcattcgccgggacgagaagggcacctacgccatgggcaagctggaggacgggcgcgtgggtgtcgtgttgagagaggagcgggtcggcacgggcgacgcgccgaccctcgaggggctgcgcgaggggctcgtcgcgctctacggaacggactacggcctgcgcagtgccacgcacctctcgaggttcaccgacatgacgcggcaggcggcgtcctaccgggaccggcgggtgctcctggctggcgacgcggcccacgtgcattcgccgatgggcggacaggggctcaacctcggtgtgcaggatgccgtgaacctgggatggaagctggcccaggtcgtgcgcggcgtctcgccggagagcctgctcgacacgtaccaggccgagcggcaccccgtcgcggcccgtgcactgcggaagaccatggcgcagaccgcgctgagtcgcggtgacgcgcggatggacgccgtgcgcgagacgctggctgagctgctggggatggacgggccacgcaagcagtacgcggcgatgatgtcggggctggacgtccactacgacctgggcaacggacacccgctgctcgggcgccgcatgccggacctcgacctggtcaccgccgacggcccgcggcgcgtgttccacctgttgcacgacgcgcggccggtgctgctcaacctgggcgagcccggcactctcgacatcacgccctggggggaccgggttcggagggtcgctgctcgctacacgggggagtgggagctcccggcgctcggcgcggtcacggcgcccgttgcggtgctgattcgaccggacggacacgccgcgtgggtcggggagggcacggaccaggggctgcgtgaggccctggcccgatggttcgggccgccgcgtgcgacgtaa

SEQ ID NO: 9543 - DNA, 936 bp, Myxococcus xanthus
cccatgtcggattcatctcgctccgtattctttggcgccaatgctgcgcggaccggacacttcgagggaacggggccgctcgtggtcaagcgagcccgctggaagttcaagccgggcacgcttgcgaccacacgcaacacgcctgcaatccacgatggcgtgctgttcgcgaacttcgacaatgacaagctctacgcgcttgacctcgcgaagggaaaagagctctggagcgtgcgggtcggggggcgcgtttctgagagcatctcgaatccgatggttgcgcatggtttgctcttcgtcgtcggtggcgggcagtgtcacgccgtcgatcttggcacgcacgccatccgctggagcgtctcgtgtgactccgaggcgacctcctcgccaatcgttgtcgacgacgacgtctacgtgggagcgcggctcggtggggtggtcgccatcgacgcgcgtacgggagtagagcgatggcgcgtgcagctacgctgtggtgagagtgtggggtccgcggtcagcgtgacgcgcgatcaggtcgtcgtcgggaccagacgcgacttcgtcgagggccacgtcgtcgcgctcgaccgcgccacggggggcgagcgatggtcggcgaaggccggtgcgatggccaacggcggagcgcccgcgatcgaaggcagcacggtttatgccctgtccggtctggggcagtgccttcgcgcgctcgacctcgccagtggcaaagagcgttggttgtatgagacgggcggcgcgctgtggggaacgcccgccgttgcggacggcgtcgtgtgcttcaccggctatcacgggattctccacgcgctggaccaagataccgggaaagagatttggtcggtcgcgctcgacaatcccccgaaggatacgggctcacccgacgaatcgcaggggggcgtccgtctacatgggggg

SEQ ID NO: 9544 - DNA, 507 bp, Myxococcus xanthus
accgtgacgctggccgaaggattggccctgacggaggggcgcaccgaacccgacctgaccgcgggcctgttcgtctacaccgacgcgctgcagaatggcttcgccaactggagctgggcggaccactcgctcgatgagacgggggtggtccatgcgggctcggccgccatccgcttcgagccggacacgtggaatggcctgctcttccaccaccatgggctggacctggcgcagtatcaatccatccgcgtctgggtccacggcggtaccgcgggaggacaggcggtgcggctggtgctccatgatggcacgcagatgcttggcaccacccgcctggacaccgcgctgggggcgcccatcgctccgggagtctggcagcaggtgacgattcccctctccagcatcggggccaccacgggcacgctgcgggacatctacttccaggacgactccggcacggaccagccggcgctgtacctggatgacgtggtgctcctgccgcagtga

SEQ ID NO: 9545 - DNA, 1203 bp, Myxococcus xanthus
atgaagcccgcggtcctcatcatcatcggggtgctcactgcgttgggtggggccctctacctgtcttcgcggcgcgccgcggagcgaacggaagaggcgcgtcccgcggcgcaggcgcccgtatccacccgcgcggtgcggacggaaatcacgttcctctacagcacggagaagaaggcgtgggtggaggaggccgcggcggacttccagaaggcacatccgctcatccgggtgaacctggtgggccggggctcgctggaggccgcgcgggccatcctcgaaggcagtgagcggcccaccgtgtggagccccgccgacagcgcggtgctgcggatgctggagtcggactgggccacggacgccacgcgcgagccgctgttcgccacggagggcgaagcggcgccgcggccgttggtgaagacgccgctcgtcttcgtggcgtgggaggaccgggcggaggtgctccagcgcgccagcggcgggggcgcggtgtcctggaaggtcatccacgacgcggtgtccagtgaccagggctggcccgcggtgggcggccagccggagtggggcttcgtgaagctgggccacacggaccccacgcgctccaactccgggctccaggcgctgctgctggcgtcgctggagttctacggcaagcagagcggattgacggtggccgacctgctggagccgcggttccagacgtggctgagccagttggagcgaggcacgggccgcttcgagcagtccacgggcacgctgatggcggacatggtccgcttcggcccgtcccgctacgacatcgccgtggtgtacgagaacctggccatcgctcagctctcccaaccgcaggggacctggggggcgctgaaggtcctgtacccgacgctcacgtcctggagcgaccatccggcggcggtgctggacggggattgggtgctgccccgccagcgtgaggccgcgctggagtggctgcgctatctgcacagccggccggtgcagcagcgcgcgctggccttcggcttccgccccgcggatgcctccgtgccgctgacgcctcccggagaggccagcctctttcccccgctggccgcgcggggccttcaggtggacgtgccggacggcgcggcagtccctgatggcgcggtggtccgcaacctcctcacgctgtggacgcggtgggtgggcaacgcgcggtcgccgtag

SEQ ID NO: 9546 - DNA, 564 bp, Myxococcus xanthus
atgtacctgggctgggcccagcggcgcggctacgaggcggtcgcggtcgccgaggcggaggagccctcgcgcgtcgtcgtgcgaatcgccggcccgggagcctatggcttcctcgcgggcgaagcgggcatgcaccggcggctggaggacgagaagcgccagcgcgcctacgtgcgcgtccaccgcggcggctcgctctccgaggaggagctggcctacctggaggtccagggccggcccatgaagagccacgagggcgcctacctccagcgcgtccgcaccgaggtgacggtgaaggacgagtcctccggacgcgtgctcacgctcactggcgccacggagctcgacgaactgaaggacatcgccgcgcgtgtcgtctacggccagggcagcaacacagacgaggcacggcgttactacctgggacggggcgcccgggtggaggacccgcgcactggcgccggcaccccgcgcgtgaaggacgtcctgcgcggcgagttggacgtcttcatcgccgcgtggattacacggccccccaccgaacccccagcgcccggcagctga

SEQ ID NO: 9547 - DNA, 2010 bp, Myxococcus xanthus
atggcgacgaggaaaagcgaggaccaggagcggctcatcgaccgcgacctcaccgcgctggcgcgggagggaaagctaccggccgcacacggcgtggatgccgccgtgacggaggtgctgggcctgctcacgcggggcggcaagcatcccctgctggcgggtgagcccggcgtggggaagagcgccctggtacaggaggtggcccggcgcatcgccgaaggccgcgtggacgccgagctggcgaacgcacgggtggtggaggtgtccgtcgccaacatcctggcgcgcagcacccagcgccaggcggcggagagcttcgaggagctgctggcctacctctcccggcacccccgccccatcgtctacatccgggacctgcccgcggccctcggtggcccgctcgcgcccgtcgccgtgcgcggactgcgcaccggaggcctgcgcttcatcttcgagacagagcccaagcgcgtgcaggagctgcttcgctccgacgaggcgctggccgagcggctccacctgctgcccctgcacgagcctccgacggagaaggcccgctgggtgctgggccgcgtagcggaggaactggagcgcgagctgcggctgcccatcgacccggcggcgtgcgacctggcgttgcgcctgtcgtccaagttcctgctcgcgcagcgcatgccgcgcaaggccatcgagctgctgaaggagacagccgcggaggcggcgagcgcggccaaggaccatgtgggtcccgaggacgtactcacccgcttctgcgcggccacgcggctgcctcgcttcgtcgtcgacgacgcgatgccgttggacctcgatgagacagagcgcttcttcggcgagcggctgctgggacagacggacgcagtgggcgcggtattgcgctcggtggcgctgctcaaggccggcctcaacgatccgcgccgccccctgggcgtgttcctcttcgcgggtcccacgggcgtgggaaagacgcagttggccaagctgctggcggagtacctgttcggctcggcggacagactggtgcgcctcaacatggcggactaccccaacgacggtgacgagagcgtccccttcggtgccacctgggccccggcactggagacacggcggggagagctgagcgcgctgctggacggcaaggtgttcaccgtgctgctgctcgacgagttcgagaaggcggcgcgcagcgtccacgaccgcttcctccagctcttcgacgagggcacgttcgtcaacggggccggcgagacggtgtcgtgcaacaacacgctcatcgtcgccacgtccaacgtgggcgcggaggtgtatcgcgagtccggcatgggcttcacgggcgcgcgccgcgcggaggagatggtccccgaggtcgaccggcgaatcggagaggcgttccgcccggagttcctcaaccgcttcgacgccatctgccacttccggcccctgtccaaggtggacatccggaagattgcgcagcgcgaggttggccgcgtgctggagcgcgagggcatccgcgcgcgcgccctggacgtggaggtgacgcccgccgtggtggacctgctcgtggagcggggttactcgccccagttcggcgcgcgctacctgcagcgtgaaatcgagaagacgctcaccgcggcgctggccgtggagattgcgcgcaggccgctgcctccgggcacgcccgtccgcgtcgaggcccgcctgggcggccgcgtcaccgccgtggcggagcccgccgcgccgccgccctcccccaccgcgcaattgctgctgccgtccgctcgcgcggcgccggtgaagcggcggctggaccgcaagtcactcctgttcgagatggaccgactggtgggcaaggcgcgcgccctggcggactccgccggccggccgcagttggagcagcgccgcgcggagctgctggcggagacgcaggcgcccagcatctggtacgaccccacgcgtgccaccgaggtcatctgcgccttcagcgccgtgtag

SEQ ID NO: 9548 - DNA, 594 bp, Myxococcus xanthus
atgggacggtgggtgacggcgggctgggtcctcctgggcgtcgcgggaggtgtcggcgtaggctgcgggtcgaatgactccgcccagaaggagcctcccggaggagagcaggcccagattcccgtgggcgccgaggaccaggagcgcatcgatatcgggcttcgaatctcgcccgtgccgctgaagctggaaggcctggaccggaacctggtgggattggggagctacatcctcaatgcccagaccggctgtagcgactgtcacacccagccgggctatctccccggaggcgacccgcatcagggcgaacccgagcagatcaacaccacgaacttcctcgcgggaggaaagccgttcggtccaggcctcgtctcctccaacatcaccccagatgcgcagggtctcccaggcggcatgaccttcgaggcgttcctggcgctgatgcggacaggccgtgaacacggagccatcatcccggtgatgccctggcccacctacgcgaagatgcgcgaccaggacctgaaggccgtctacgaatatctccgggccatccccccggcccagccaggaatggccccgccgccagccccttga

SEQ ID NO: 9549 - DNA, 540 bp, Myxococcus xanthus
gagacgctggtcctgagtcagtctttcgaacctgtcgcacgtgttccctggcaacgcgcggtgatgctcatcgtccagggcaaggtcgaagtggtcgaagagtacgaggaccgcgtcgttcgctcggtgacggtggagattcgcatgccctccgtcatccgcttcatccgaggcctgcgccggcggcccaagggcgtgaagttcagccgggagaacgtctatctgcgggaccactgccgctgccagtactgcggcatcaaggtgacgcgcccggaggccacgtatgaccacgtcctgccgcgcgcacaaggtggcaagacgagctgggagaacatcgtcatcgcgtgcgtgccctgcaatcagaagaagggcaaccggacgccggagcaggcccgcatggccctgcgcacggcgcccatgaagccgaagaaggtgcccgaggcaatgcacctgacgttcctgttcgagaagggcatgcccatgtcctgggcgaagttcctcagggacgtcgcctactggcacgtggaactgcaggagtaa

SEQ ID NO: 9550 - DNA, 909 bp, Myxococcus xanthus
atggtagccattgcccgctcctccgcggctgcgtccagcagcgcgtctcgttccgcctcgcccacgctgcgcagcggagcgcgcggtgcggccgtgacgcaactccagaacaagctcagggccgcgggcttcaacccaggcgcctcggatggcgtgttcggtccgaagacgcagtcggcggtgcaagccttccagcgtgcgcgtgggctccaggtagacggcatcgtcggtcccaagacgtggagcgcgctcaactcggcgggcggagcgggcggctcgggtcccacgctgcgcaatggcgcgcggggtgagccggtgcgtgcgctccagcagcggctcaacgtgctgggcttcaagtcgggcacggccgacggcgtgttcggtccgaagacgcagtcggcggtgaaggccttccagcagtcccgcggtctggtggcggacggcatcgtcggtcccaagacgtgggacaagctgggcatcaacgtgcagggccccgtcaccaacccgggcggtggcggtggcggtcgggtcgtcacgggctatgtgaacgggaagccgcggcagatttcgctctcgtcggtcccgaacgggaaggagatgcgctcggacgcggcggcggcgtacaaccgcatgtacgcggcggcgcgcgcgcagggcatcaccctgaaggtgaacagcggcttccgcagcatggcggagcaggaagcgctgtaccgcgcgtacaagaacggcaccggcaacctggccgcgcctccgggctactccaaccaccagggcggcatcgcggtggacgtcaacacgggcggcacgggcacctcgacgtaccggtggatggccaacaacgcgaagaacttcggcttcgtgcgcaccgtcccgtccgagccctggcactgggagtaccggccctga

SEQ ID NO: 9551 - DNA, 993 bp, Myxococcus xanthus
atgacggcagcctacgcggacccggccggccaccccgagctgcgcgaggccgtggcacgccacgtgggcgtctcccgaggcgttcgtgccgaagcgtcggacgtgctcatcacacatggagcgcagcaggcgctggacctcgcgggccgggtgctgctggagcccggagaccgcgtcgccgtggaggaacccggctacccacccgcacggctcctgttccagtcactcggagcccacgtggtgccggtgccagtcgacaaggaggggcttgacgtgcaggcactgccggatgacacgcgcctcgtctacgtcacgccgtcccaccagttcccgctgggcatcgtgatgtcgcccgcgcgccgcagggccctgctcgactgggcacggcggcgcgacgcagtggtcatcgaggacgactacgacagcgagttccgcttcggcggccggcccttggagacgttgcacagcctggatcgttcgggtcgcgtcctctacgtgggctcgttctccaaggtgctgctccccgcgctgcgactgggattcctcgtcgcgccgccctcgctccaacgagagctccggctggcgaagcaggtgacggactggcacagccagcttcccgcgcaggcggcgctcgcgcgcttcatcgacacgggagcactggcccggcacctgcgaaagacgcggcgcgagtacgagcaacggcacacgcggctgtcggagaagctccgccaccactttggagacgcccttgagcaactgccctccgtcgccggactgcatctgtgcgtcaccttcacgcggggcggcgctcggttggagcgggagctcacgcggcgagcccgtgacgcgggcatcggcatcgaagcgctctccggctacttcgccggggcgcccacccgccatggctgggtgctgggctacggcggcgtgacggtggaccgcatcgacgagggactctggcgcctgcgaacgcgcctcgccggagccctctga

SEQ ID NO: 9552 - DNA, 831 bp, Myxococcus xanthus
atgttctcctcccagacgttcttcttcgccgtggtgggcgacgtccacgggcacatgcaccagatggtgagtcacctcactgcctgggaggaacgcagccgcaggccgctcgacttcgtgctccaggtgggcgacttcgagccccaccgtcacaacgccgacctggccaccatggccgcacccacgaagtacaggcacctgggggacttcgcggcctaccaccagcgacgacgccgcttcccctggcccgtctacttcatcggcggcaaccacgagccctacggccacctcgacctgtaccccgagggattcgcgctggcgccgcactgtcactacctgggccggagcggcgtggtggagttgaacggcctccgcgtggcgggcctgtccggcatccaccgagaagccaccttctgcaagtcccgcccgccgctggcctcgatgggcgacgtgtccaacaaggacttcaccttcttcaacgaagaggacgtcgagcgagtcctggcgctcgggcgcgcggacgtgctcctgctgcatgactggccctccggcatcatcccgcccgaggaggccgcggacttccagggacagcgccgcggcgcgagccacgacctcgtcggcaacgcgtacgcgcggctgctggtggacgcgctccaaccccggctggtcctctgtggccacctgcaccggcgctacgcaggcaccgtccagcaccccggcggccagcgttcgctcgtgcggtgcctcgccagcgtggagcagggcgcggaagcgttcgcggtcttccagtgccgcgagggcacgctccaggaaatcgccatgtgggagtga

SEQ ID NO: 9553 - DNA, 1705 bp, Myxococcus xanthus
atgtccgtccccgccctcgaactccagggactctccaagcgttacggagagttcacggcacttcacaccgtggacctcgccatccgtcccggtgaaatcttcgccctgctgggccccaacggcgcgggcaagacgacgatgattggcagcgtctgcggcctggtgaagaagtcctccggcagcatccgcgtcttcggcaaggacctggaccaggacccggtgggtccgcgctacgacatcgggctggtgccgcaggaaatcaacttcgaccccttcttcaccgtggccgaatcgctgcgcatccagttgggcttctacggccgccccgcggatgaggcgcgcatcgacgaggtgctcaccgccctcaacctgcacgcgaagaaggacgcgtacacgcgcgcgctgtccggcggcatgaagcgccggctgctcatcgccaaggcgctggtgcacaagccccgcctcgtcttcctcgacgagcccaccgccggcgtggacgtggagctgcgccgtgacttgtggacctacgtgcgcaagctcgcctcagagggcaccaccatcgtcctcaccacgcactacctggaagaggccgaggagctggccgaccgcgtgggcatcatcaacgaaggccgcctcctcatggtggaggacaaggccaccctgctgcgccgcttcggcgagcgccgcgtcatcatcaccttcgagcagccgcagcccggcctgtccgaggccggcaagcgcttcgccgcccgcctcagcgaggacggccgcaccctcacctacgtggagcgcgacggctgcgcccccgtccggcgagctgctccgcgccctctatgccgaagggcagctcatctccgacgtggagacgcgccgctctcgcatggaggacgtgctcatcgaaatcctccgtggccgcccacagcaggccgcctgagccctcatcatgaacgtccttgggatgaagacccttctggcgaaggaggtccggcgcttcatgcgcgtgccggggcaaaccgtcctgtcgcctctcatcagcaccacgctgtatttcatcgtcttcggcgtctccatctccggccgcgtccagacggtggaaggcctgccgtacctgcacttcatcgtgccggggctcgtgttcctcggcatcgccaacaacgccttcctcaacagctcctcctcgctgttcatcaccaagattcagggcaccgtggtggacctgctggtggcgccgctggggcccggtgagttgatggcgggcttcatcggcggcgccatggtgcgcgggctcgtggtgggtctgctcacctgggccgtggccaccttcttcaccggattcagcctggagcacgcgggagtggcggcgtacttcctcatcctgtcgtcatacgtcttcagcgtgctgggcatgctcgcggcggtgtgggcggagaagttcgagcagatcaacttcttccccaccttcgtcatgctgcccctcaccttcctgggcggcgtcttctattccgtgcgcgagctgcccgcgccctggaacaccgtcagcctcttcaaccccatggtctacatggtggaagggctgcgctacggcatgctcggccgcagcatctattcgcccctgggcgccggaagcatcctcttcgccgtcgccgtggcggccaccgcgctcacctacgccgtcctgcgctccggctacaagatgaaagcctga

SEQ ID NO: 9554 - DNA, 1468 bp, Myxococcus xanthus
atggctgtgccattcggtaagtacgagctgctacgcaagattgcctctgggggaatgggtcaggtgtttctggcccgcgaacatgggacggggttcgagcgacttgtcgtcctcaagctcatccttccccacctcgcagaggatgatgagttcctctccatgttcctggacgaggcggggctcgtagcgcgcctgacgcacccgaacctcatcaccatcctcgacctgacagagattgagggccgccactgtctggcgatggagtacgtgcagggcgacgacgtgcgccgcctggaaaagacgtcccgcgcgcagggcaaggcgctgccggtgggactcatcctccgcatcatcgcggacgcggccgccgggctcgactacgcgcaccaggcgcgtgacgcccagggcaagccgctgcggctggtgcaccgcgacgtgtcgccgcagaacatcctggtcgggttcgacggcggggtgaaggtcatcgacttcggcgtggcgaaggcggccaccagcagtcagaacacggccaccggcgtcctcaagggcaagtacccgtacatgtccccggagcaggccagcgggctcgccatcgacgcgcgcagtgacttgttcgcgctgggcgtcgtcatgtgggagctgctcaccggcaagcgcctcttcaagggcgagtcggacatgatgacgctgcggctggtgaaggactgccaggtgccgcggccgtcgcagctcaacccgcgcctgccgccgggcctggatgaagtggtgctcaaggccctggcgccctcgccagaccagcgctacccggactgcggcgccttccggctggcgctggaggactacgcgctcaatctgcggctgccctccagcagcgcgcacctggccgccttcctgcgggagctctacgcggaccgcatcgcccatgagacggacccggcgaagctggaccagctcgcggaggacgcggacctggactcgcgctccaactcgtcgctcagcggcgtgccggggctgctgggccccgcggggcgctcctccgcgtcgcgggccatgcgcggctccccccatggcgccgtccccgggacgcgctcgcggcagaccgccgccgcgccgcagccgaaagagaagacgcgaggcaccgcgcccctggcccgtccgcctccggagccggcccgacgcatcccctggctcccggtggccaccgcggggctgggcctgctcatcgcgggcgcgggcatcgtcttcttccgctcgcccgcggacgccaccccggcccgtccgccggtggaagtggccgtaccgcaccagccggaaatcgcgccggaagcgcagccgcctccaagcatggaccccgagccggcgcgccacgtgaagctgcccgtcatcaccgagccccctggagcccgggtgagcgtcaacggcgaggagcgcggcgagacaccgctgcgcctggagctggaggccgggg

SEQ ID NO: 9555 - DNA, 903 bp, Myxococcus xanthus
atgagccgcatcctggtcatcgaagacgagcccatcatccgcacggagctgcgccggctgctcgtgcgcgcggggcacgacgtgtccgaagcgggctccgtgcacgaggcgtcgagcgactacccactggactcgttcgacctggtgctgtcggacctgcgcctgccgggcgccccggggacggacatcatcgtcatgtgtccgggcgtgccggtgctcatcatgaccagctacgccaccgtgaagtcggcggtggacgcgatgaagctgggcgcggtggactacatcgccaagcccttcgaccacgacgagctgctgatgcaggtggagcgggtgctgcgcgaaggactgctgacgcggcagaacgcggcgctcaagcgcgaggtggagcaggcccaccccgtcagcggcatggtgggcaacagcgccgcgatgcgcgaggtcttcgagcgcgtccgcaaggtggcgccctccccggccaccgtgctggtgctgggcgaatccggcaccggcaaggagctggtggcgcgggccctccacgcccagagcccccgggcggacgggccgctggtggcggtgaactgcgcggccattcccgaaggactgctggagagcgagctgttcggccacgagaagggcgccttcaccggcgcgcaggccgcgcacccggggctcgtggaggcggcgcacggtggcacgctcttcctggacgagattggcgaactgcccgcccccgcgcaggcgcgcctgttgcgcatgctccagcacggcgaagtgcggcgagtgggcgccacgcggccccgcaaggtggacgtgcgcatcgtcgcggcgacccaccgggacctgccccgccgggtgcaggaggggtccttccgtcaggacctctacttccgcctgcgcgtg

SEQ ID NO: 9556 - DNA, 591 bp, Myxococcus xanthus
atgaacttcgtcttcatctccccccacttccctccgcattactttcacttcatctccgcgctgcgggagcggggcgtcacggtcctgggcatcggtgacgcgtcctacgagtcgctccgtcccgagttgaaggcgtccctgcgcgagtactacttcgtccccagcctcatggacgaggatgcgctcacccgcgcggcgggctacctcacgtggcggcacggccgcatccaccgcatcgactcgctcaacgagtcctggctggaggtggaggcgcgcttgcgtggggacttcaacgtgccgggcctgcagcccgaggacatccaccggctgcgctccaagtccggcatggcggaggtgttccacgaagcgggcgtgccacacccggacctcatccgcgtccgggacgccgcgcaggtgatggcgttcgccgcgcgcgtgggctacccgctggtgctcaagccggacgtgggcgtgggcgccgccaacaccttcaaggtggccagcgacgaggaggtgggacgcggccctgtcccatccgctgcccaccacctatgtggcgcagtccttcgtgcgcggcaccatcgtcaccta

SEQ ID NO: 9557 - DNA, 1632 bp, Myxococcus xanthus
atggagccgctgatgactggtagcaactcctatcgaatccgccagggagatacgctcagcgctatcgcccggcgcaacaacacgaccgttgatgcgctggcgcgagcgaacaacctccagagcccggaccgcatcatcgccgggaagaccctggtcatcccgggcgccaacgatggtttcgaggccaatgcgcctcgtccgatgccgcgcccggccaaccggccgacggggacgtcacagaaccgtgacagctttgagcctggtaccgcgcagggcaccgtggcgcagggcgtcacgccggcgggcaccgctggggtgtctggcacccagaatggctatcgcaacgtcgacctgacggccttccgccaaggcgggtccaactccgagtccgccattgtcgttggcacctcggaaggcaaccgcacgccgaacggtggcttcacggcgagctacgggggccacaccgacccaggcaatgccaagcacaaccggggctcgttctcttaccaggggggcggcgcgaactccccgtcgcacgcggacgaaatctggaaccgcgagctgggccgcgtcacgccgcagtaccagcgcgccgccgagcgcgcgggcctggacccgaacaacgcgctgctggcctccaccttctacgacctgcacacgcagtcgccccgcgcggcgcagaacttcctcaaccgcgagctgcccaggctggcgcaggacccgcgtggcgtgacgcccgaggcgctcgtcgatgcgcgcgtgaatgcgttccgcacggacaacgggcagatcagcgcctccggcttcgaccacaacgagcagcgcctgcgcgccgaccagacgcggcgtgagacggcgctggtccgagccctggacgcgcgcggcttccgcgacggtggtggtggtggtggtgcggtcgagaacgcgcccatcccgcgcccgcgcccggagaacctcacggcgggcaccacggcgctgcccgccgaggtccccatcccgcgcccgcgcccggagaacctccaggcctccaacaccaccgggggcgcgacgcccaccgacttgaacgacacggcggagattgcgcccgcggcggaccgcccggcagtgcatacggccacgccgtgggtcagccagtacaacgcgtcgaaggtggagcgcgccggtgacaaggcctgcttccgcgccgcggtggtgatggccgcgggcgccggggccaccgtgacggggccggacaaccgcatccaggtggccacgggggatgacccgaacggcggcgtcacggtgaacgccgcggcggcgcgccggggccgtgagtacatcgatggccagctcgacgcgggcaagcccgtcgtcgtgggcgtggaccaccgctccggcaggaactcggacaacgtggacggcatcaccgaccacttcgtggtgattacgggccgcggcacggacgagcagggccgcacgtactacacgttccacgacccggcgacgaaccaccagcagcgcggcgcggacaccaacccgaacaaccgcttctacgtggaccaggacacgggcaacctctaccgggagggtcccaccaacggcaacgtcgtccagcggcacttcgaggtgtcgatggtccggccgaacgcctag

SEQ ID NO: 9558 - DNA, 417 bp, Myxococcus xanthus
atggtggacgcacgcgccatcgtcagcctggttatctatccgcagccgctggggctcctggccgagttcaacctgggccgcggtccctcgctgggcgaggggcccgtcgagggcctgctcatcgacagccgccggctccggggtggttatgcgcagctcatgtacaagctggacggcgtgctgggcgtgtccctcatcccctacatccggggcaccctctacgacggcggcaagaagttcgagacgaacgcgccgctctacgacgtgcgggagctggagatgggggccgagtggcagctcaacaaggccttggagctgacgggcacctacctcatctcggaccgcacctcgtcccgctatccgtacatccaggagcagggacacgtgacgcgcatccagctccaggtcaactattga

SEQ ID NO: 9559 - DNA, 525 bp, Myxococcus xanthus
atgcccgagccggagacgaagccccaggccaagaaggaggagcgggcctggtacgaccgcatccgcattcggggctacacgcagttccgctacaaccggctgcccagcttccgggtgaatgacgaactggtcaacgaccagggcgaccgcttcctcggcaagaacaccggctttggcatccggcgcgcgcgcctcgtgctgttcggtgacgtccacgaccgcgtgtccatctacctccagccggacttcgcgtcggtcatcggggaccagtacaacgtcaccatcatgcgggactggtacgcggacatcttcctggacgcgaagaaggagttccgtctgcgcgtgggccagtcgaaggtgccgtacggcttcgagaacctccagtccagtcagaaccgcctcgcgctggaccgcaacgacgccatcaacagcgggctcaaggacgagcgcgacctggcgtcttcttctactgggcgcccgacgaaatccggaagcgcttcaagttcctcgtggacaacaacctga

SEQ ID NO: 9560 - DNA, 918 bp, Myxococcus xanthus
atgaagggaagcttcgccaagcgcatcacacttttcgtcctgaccaacctcgcggtggtcgcgatgctggcgatcgtcgggcagctcatcggggtggagaacctgctcgcccgccgcggcgtggggctgaacctcccgggcctgctcatcatggcggcggtgatgggcttcggcggcgccatcttctcgctgctcatctccaagcccatggccaagtggagcacgggggcgaaggtcatcacgtcgccgcgctcggaggacgagcgctggctggtggagacggtgcaccggctggcccgcgacgcgggcatcggcatgcctgacgtggccatctacgacagcccggacatgaacgccttcgccacgggcgccaggcgcaacagcgccctggtcgcggtgtccaccggcctgctccatggcatgaagcgggacgaggtggaggccgtgctcggccacgaggtggcccacgtggccaacggtgacatggtgacgctcacgctgctgcagggcgtgctcaacaccttcgtcatcttcctcagccgcgtggtgggcttcttcgtggaccgcttcctcagccgctccgacgatggcgaggagagcggcggctcggggccggcctacttcatcaccagcatcgtgctccaaatcgtgtttggcatcggcgccagcatgattgtggcctggtacagccgccggcgtgagttccgcgcggatgacggcggcgcgcagttggtggacccgggcgccatggcgcgagcgctgaaccggctgcgcatgcagcagggggagccggccatgctgccgtccaacatgcaggcgttcggcatccggggcggcgggatgatggcgctcttctccagccacccgccgctggagctgcgcatccagcgcctgatggacggcagctggaagcgctga

SEQ ID NO: 9561 - DNA, 1680 bp, Myxococcus xanthus
atggcccagaatttcatcttcacgatgcaggacctgcgcaaggtcaagaacggcaaggagatcctcaagggcatctacctctcgttcttccccggcgcgaagattggcgtcattggccccaacggctccggtaagtcgacgctgctgcgcatcatggcgggcgtggacacggagttcttcggtgtcgccaagccggaccccagcgccaaggttggctacctggcgcaggagccacagctcgatgcctcgctcgacgtgaagggcaacgtggagctgggcctgaaggagattcgcgccacgctggaccgcttcaacgaggtcagcgcgaagttcgccgagcccatgagcgacgcggagatggagaagctgctggccgagcagggccggctgcaggacgccatcgacgcggtgaatggttgggagctggaccgcaccatcgagatggccatggacgcgctgcgcctgccgccgggcgacgcggacgtgacgaagctgtccggtggtgagaagcgccgcgtggcgctgtgccgcatcctgctggagaagccggacctgctcctcctggacgagcccaccaaccacctggacgcggagagcgtcgcgtggctggagcaggcgctcaaggagtacaagggcaccatcgtgtgcatcacccacgaccggtacttcctggacaacgcggccgagtggattctggagctggaccgcggcgagggtgtgccctggaagggcaactactccagctggctggagcagaagcagaagcgcctggagctggaggagaagtcggagagccaccgccagaagacgctcaagcgcgagctggagtgggtgcgtgcctccccgaaggcccgtcaggccaagagcaaggcgcgcatcgcggcctacgaggagctgctcaaccagacgcaggacaagcgcgacgcgacgggcgaggtcatcatcccgcccggcccgcagctcggggggctggtggtcgaggccaaggggctgcgcaaggcgtacggcgaccggctgctcatcgaggacctgaacttcaagctcccgcgcggtggcatcgtgggcgtcatcggtcccaacggcgcgggcaagacgacgctgttccggatgatgacgggcgtggagaagccggacgagggcgagctgaacatcggcgagacggtgaagctggcctacgtggaccagagccgcgacgcgctggacggcgacaactcggtgttccaggaggtgagcggcgggctggaccacctggacctgggcaaggcggggcaggtgcccagccgcgcgtacctggcgggcttcgccttcaaggggcaggaccagcagaagcgggtgaaggacctgtccggtggtgagcgcaaccgcgtgcacctggcgaagatgctcaagagcggcggcaacctcttgctgctcgacgagcccaccaacgacctggacgtggagacgctgcgcagcctggaggacgcgctgctcggcttcgcgggctgcgccgtggtcatcagccacgaccgctggttcctcgaccgcatcgccacgcacatcctggcgttcgagggcgacagcaaggcgttcttcttcgagggcaacttcgaggactacgaggcggacaagaagaagcgcctgggccccgaggccctggagccgcaccgcatccgctaccgcccgattacgaagagctga

SEQ ID NO: 9562 - DNA, 396 bp, Myxococcus xanthus
atggggcccgcgggcctctccttcaagccgctgcgcttcttccaggatggctccggctggatgtacctcttccgcttggagcccggcaccgtcattccccggcaccgtcacaccggcgaggcgcacggcttcaacctctccggaactcgcgagctgctcgacacgggggaggtgattggtcccggtggctacgtctacgagccgcccggcaatgtcgatagctggcgggtgacgggcgacgcgcccgcggtcttgctcatcaccgtgcgcggggccatcgaatacctgacggaggatggccaggtctccaagcgcgtcacgtccgaggagcgtctccagacctatcgccgctggtgcgaggcgaacagcgcgccgttcctggccaccctcgagtga

SEQ ID NO: 9563 - DNA, 1080 bp, Myxococcus xanthus
gcactggtcttgaatggttctccgcacgcgacgcgctaccgggatgaagccttcttcgtggacgcggttctcacagcgccgggctcgccggtggaggtggccacgcgcgacgcggaggtgggcctgcgcgaggacttctccgcctacgatttggtgctgctgctcaacgtacccgcgccgagcgccgacgaggcgcagaagctggcggccttcgtggagaacggcggcggcctcttcatcagcatgggcgaccgggtgaacccggaggcgtacaaccagcggctgggcccggtattgccgcgtccgctgcgcctggtgcgcaccagcgccgagcgcgacgatccggacgcggacaccaagagcgcgcggctggcgcaggtctccgtggagcacgtcctcttctcgcccttcacggggcaggcggaggaagggctcgtgggggcgcgcttctacaagtacatgctgctggaggcggactccccgggcgctggcggcgccagtcaggtgctggccacgtatgaggacggcgcgccggcggtggccgtggcgcgcaagggcaaggggcgcgtggcgctgcttaccagcacggtggaccgcgactggagcgacttctccatccgcacctccttcctgccgctgatgcagcgcttcgccgcgtacctcaccggctccctggacgagcgcgaggaggtgcgcgtgcgcgtgggcgaaagcgccacgctgcgcccggagggggcccagaaggtgtcctcggtgcgcgcgccggacggcaccgaggtcaccgtgaaggagcagccggaaggcgcgctggtcgccgggccggtgacggagccgggcgtgtattcggtgctgggcgcggacgggaaggtgcagccggacctgtccttcgccgccgtgctcgatccttccgagagcgacctgggacgtgtgccgacggacaccctcaccgcctacttcggagaagagacggtgaaggcctccacgggtgacgcggacaagccgacggtgccgctgtggacctggctcatcctggccgcgtgcctggcgttcttcttcgaaggcacgctgctgcgcaagtag

SEQ ID NO: 9564 - DNA, 591 bp, Myxococcus xanthus
atgaccttctccaccttcggcatcggctgcggtcccgcggatggcagcagcggcccgtcggccggcatcacccagaaccaggccctgtccgggcagaacctgttcaagggcatggccttcggcctgggccccgcggcgcactacttcgacgacctctggcagcgtccggagatcaaggcgaagctgggcgacgagacgctggccaagcgcgaagaggccgccgaggccgtcatcgcgaagatgagcgcgctggacccggcgttcttcgagcgcttcggcaacgacctgcgcagcggcaaccacctggtcatcgaccagctgctgacggacacgcgggagctgacggttgcagcggcgaacgcgctgcgcaaggacgcgggccaggcgggtgaaatcaacgccgccgccctgcagcaggtcgaggcgggcctgtacctgtacgtggagacggccgtggccgtcgccatcgtgctgatcctcatcctgacccagatcgacatgaccccggtcatggaaggcccgcagtccagccagctccagcgtgacgtgtgggtggacatgctggcgaagcggttcgccgccgctgagtag

SEQ ID NO: 9565 - DNA, 486 bp, Myxococcus xanthus
gtctacgccctgcacgcggcgctgccctacaaccccatcgagctgcccttcgagaagcacttcaacatcaagctgctgctgccagaggggtgggccttcttcacccgcgacccgcgtgatgaccggatgctgccctacctccgcaccccggacggccagtggacctggggaagcgacacgcccaacttccagttgaagaacgccttcggcatcaaccgggccgcgcgggcacagggcgtggagctggggttgctcctccacgacacagcgacccttccccgggaggactgcaaggaagccccctccgtctgcctggagcgcgcccccgtggccaagacgctccgcaacaccagcccgcggcccacgtactgcggccagctgggcatcgtcttccagcgggccgttccctgggcctggagccgcaccaaccaggggaagcccatcaccatgccctcgaaggtcctgaggttggacgtcgaatgctga

SEQ ID NO: 9566 - DNA, 2973 bp, Myxococcus xanthus
atgacgctcgagctcggttcgctcgtcgccgcgtccgtcgcctacctgctggtgctcttcctggtggcctacgcggcggagcgaggcgccatccccgcgcgcatcacccagcatccgctcgtctacgcgctggccctgggcgtgtacgccacatcgtggtcctacttcggcagcgtgggctacgcggcccggcatggcttccgctacctgggcatctacctgggcgtcaccctggcgtgcctgctgatacccgtgctgtggcgcccgctgctgcgcctgtcccgcgagttgcagctcacgtcgctagcggacgtgctggccttccgctacccggggcaatccaccggtacggcggtgacactgttcctgctggcgggcagcctcccctatctggcgctccaggtgcgggccgtcgtggagtccgcgcgcgtgctcagtccctccgcgtctcccacgctggtgggcctgggcttctgcgcggtcctcaccgtcttctccgtcctcttcggcgcacggcacctcactccgcgcgagcggcacgaaggcctgatgctggccatcgccttcgagtccgcggtgaagctcgtcgcactggtggccgtgggtgtctgggcggtctccaacgtgttcggcggcgtggacgggctgttggcctgggtcgacgcgcatccagaggccatcgacgcacttcagcgcccggcgcgagacgcctcttgggcaccgctgctggtgctctcttgcgcggccgcgttcctcacgcctcgcagctaccacgtggccttcaccgaggccccggagcgtgagggactggccaccgccacctgggccttcccgctgctgttgctggtgatgaacctggtcgtccccgtggtgctctggagcggcgaggcgctgggactgccctggcccgcggacttccacgtgctggcggtgcccgcgtcacgcggcgccacgtggctggcgctgggtgccttcctgggcggtgtctccgcggccagcgccatggtcatcgtcaccacactggccctggcgcccatgtgcctcacgcacctggtgctgccgctgggctacgcacgcgggcagccgcatctatacggctggctgctgtgggcgcgccggctgttcatcggcatcatcatcctggccggctacggcttccactggctgctgaacatccgcggcacgggactggtggacctggggctggtgtccttcgtcgcggtggcgcagttcatcccgggcgtgctggggctgctgttctggaagcggggcacgcgcgccgggctgctgacgggcctggcggtgggcgccagcctctggctcctgacactggtggtgcccctgtgggcgtcgccgggcgtcgtcgcgtggacgcatcgcatggcggcgctgctcgggttctccgacagtgagccctggggcttcgccaccttcgcctcgctcacgctcaacgggctggccttcatcggcgtgtcgctggcgacgcgccagtccgccgaggaagcagaggccgcgcgggcctgcacacgcgaggaggccgcgcccgccgcgggcggcgtggtggcgggctcgcccgacgagttccgccgcaagctggccccgctgctgggtgaggaggccgcgacggcggaggtggaccgggcgctgaattccctgtcgctgccgcaggacgagcgccggccctccgagctgcgccgcctgcgcgacggcgtggagcgaaacctgtcgggactgctgggccccgtgctcgcgcgcataacggtggaggaggcgctgcggctggagcccggcgcgcgcaccgccctggccgaacaactccgcttcgtcgaggagcgccttcgcgacgcgcggggactgcaaggcccggtgcccgcgctggaggccgtgcgccgctacctgcgccgcatcctggaggacctcccggtgggcgtctgcgccgtggggccggatggtgaggtcgtcatctggaacgcgacgctcgagcagctctccggcgtgccggtggacaccgtgcgtggccatcccctggatgccctgcccgccccctggggcccgctgctgtccggtttcgccagcggtgtggacggagacacggagacacgtgtcaccgtggcgggcgtcgagcgcattctccggctgcaccgctcgcggctctctcccgcggagcagggcacgggctcgtccgagggcatggccctcctggtggaggacttcacggcacgaaaggccgtggacgcgcgcatggcgcatcaggaccggctggcctcactggggcgcgtggccgcgggcgtggcccatgagattggcaacccgctgacggccatcgccagcctgacgcagaacctcaagtacgagttggaggacccggcggcggtgcaggagcgcgcggggctcatcctccagcaatgccggcgcatcgacgccatcgtccggacgctggtgggcttcagccacgaaggcacggtgggcggacaggcgcggcccttcacgcgcgtcgccgtggcgccactgctgagcgaagccgtgcaactggcgcggctggcacgcaagcagcatggggtgagcttcgagcatcgctgtccagagggcctggaggtgcaaggcgacgcgcagcggctggagcaggtgctcgtcaacctgctgaccaacgcgatggacgcctcacccgagcacggcgtggtggagctggaagcggacatcgacggtagcgcggtgcgcctgcgcgtcatggaccggggacacgggattcccaccgagctggcgcagcgcgtgttcgagcccttcttcaccacgaagggccccggcgagggaacgggcctgggcctggcgctcgcggcgggcatcgtccgagagcacggcggaacgatgcaggtggacaagcggcaggggggagggactagcatcgtggtgagccttccggagccacgccggatggaagccagcgtgaaccccgagcgggaggccccggcatga

SEQ ID NO: 9567 - DNA, 975 bp, Myxococcus xanthus
aaccgtgcccgcgcctgggtggcgggcccctccccctggagcaacgtctacggcctggcgcgcacgctggtcgcgctggggacgggtggcacgctggccttcagcgacaccacgacgctgttccggcccgtcgcgggcatccccgaggcccccgtctgcgagggcatccgcgcggcgtccttcttctgcgtgctcccctccggctggctggaggtagcgcggtgggcggcggtgctactgctgctcgtcgtcgcctccggctggcgcccgcgcgtcacgggactggtgcactggtgggtggccgtcagcatgccgtggtccgcgtcgctgacggacggcggtgaccagattgccgccatcctggcgctgctgatgctgcccctggcgctcacggatgaccggcgctggcactgggacacgccccgcgaatccacggggaacgacgaggcgaagcggctcatcgcccggtcggcctgggtgatgctccgcctccaggtggcgggcatctacttccacgcctccgtcggcaagttcaaggtgacggagtgggtggacggcacggccctgtattactggctgctggaccccagcgtcggtgcaccggactggctggccggcgtgatgctccccgtcctgagcagccccgtggtggcgctgctcacctggtccgtgctgctgctggagctggggctcgcgctgggcccgctgctgaacccgtccctgcgccgcgtgctgctgcccctgggcatcagcttccacctgggcatcgccgtgttccatgggctcatcagcttcgtgctcgtcatgtgcggcgcgctcatcctgctgctccgtccgttcgacgagctcttccgcttcgagggcctccgcgcctgggtgcggcacatgcggaccccgcccgtgcccaccgccacgccgtccttggagccggtagcggtgcaggtggcgtcggtgccccccaccgacggcgcatga

SEQ ID NO: 9568 - DNA, 1086 bp, Myxococcus xanthus
atggacatccatctggcggaggagatccgcaagcaggtcgaagaggccttccgcaagcgcggccgggtcaacatcgtcatcgcgggccgcagcggcgtgggcaagagcacgctggtcaacgcggtgttccacggccgcatcgcggacaccggccagggccgccccgtcacgaaggagacgcgcgagtacacgaaggacgacatccccgtcagcatcctcgacacccgcggcctggagctgggcgcctttcaagagacgctgaagctgctggaggagttggtggccgcgcgcgcgaaggacgcggacgccacgcgccacctgcactgcgcctggttgtgcatcagcgaggactcacgccgcgtggaggacggtgacgtgaaggcggtggagatgctcgcgcggcacatgccggtggtggtcgtcgtcaccaaggcgcgcagcgaccagggcttccgcgcggaagtgcagaagctgctgcccatggcccgtaacgtcatgcgcgtgcgcgcgctccaggagacggacgacgagggccatacgctccagcccaagggcctggtggagctcgtcgagctcaccatggagctcgtcccggaagcccagcgcaacgccttcgccgccgcccagcgcgtgagcatcagccagaagcgcaagcgcgcgcacggcatcgtcgccagcgccgcggccgccgccggcctcattggagccgtccccatccctttcgccgacgccgccctgctcgtccccacgcaggtcggaatgctggcgggggtgagtagcgtcttcggcctcccgctgacggaggccttcctctccacgctggtgggcgcgggcatcaccggcctgggcgccaccttcaccggccagtccatcgtatccggcctgctgaagctcgtccccggcccgggcacggtgattggcgcgctcatctccgccaccaccgccaccgcgctcaccacgctgttcggcgaggcctacgtcgccgtcctctccaagttgatggagaagcgctgtggcgagttgcccacggaggaggaggtcatccaggccttccgcgaggagatgtccctgcgcggcgccgcgtag

SEQ ID NO: 9569 - DNA, 831 bp, Myxococcus xanthus
atggagttacagcaggcgccgctcaccgcgcccaccgccacggtgcgcttcctcaacggctggacgcactcgcagcacggcgccatcgtccgcggcggcacgctcgtcgtcgactacgacctgtaccggatgacggactgtcaccacagcacctacgccggccagcaggcgtgggacacgctggcctatgtccgcttcctccccagcggccagctcttcagcggcagcgtgaagcaggccacgggcagcacctcgttcgtgaacaagcccttcgaggtgactgtgccttcggacgccacgagcgtggagacatggttcttcacctccggccgcacctgcgcgccgaagtacgacagcaactacggccagaactacgtcttccccgtggaggcgcagtcgccctccgccgtggtgtgggccggtgactggggcggcagcttcgctcgcgactgcgagcaccgcgacgggctggcggaccccatcgtcatcgacagctacgtcatggagcgcgcctgcaagttcgtggacgcggacgtgtacgtgcccggcgtgacggatgccgccaccgcgcgtccggagctcatccaggcgcaggtggagttcagcgtggatggcgcggccacgcagcaccggtggctggcctatcagggccgggtgggcaacaactaccggtaccgctggaacctcgccgcggaaccgctcgcgtatacgccgtggaacgcctatgcattcgggttccgatattcaacggatggcgtgagctggtatcgcatcgcgagcggcgcgggccccacgggcggcaccgcgcggaccgtgcagcgtcacttctga

SEQ ID NO: 9570 - DNA, 1512 bp, Myxococcus xanthus
gaacgcgaaatgaccgaaggcactccacgcgtggcggagcggatttccacgggcattccaggcctcgacaccgtgctgcacggaggcttccgcaaggcccgcacctacatgctgatgggccttccgggctcggggaagaccatcttcgccaaccaggtgtgcttccaccacgcgaagcgccacggcgggcgcgtgctctacctgacgctgctggcggagtcgcacacggagctggtcggcaacctctcctcgctgtcctacttcgaccccacgctgctgcccaacgccatcacctatctgagcgccttcacggtgctggagcagggtgggctggatgcgctggcggagctcatccgcaaggagacgaagaatcaccaggccacgttgctcgtgctggacggactggtggccgcggaggaggtggcgccgtcgcagcaggccatcaagaagttcatccacggcctccaggtggtgacgggcctcatgggctgcacgacgttgattctcaccaccggccgcggacaaggcctgcgcgccgagcacaccatggtggatgggttgatactgctccggcagcgcatgttcggcgcgcgtgccgtgcgcgagctgttcgtgcgcaaattccggggcagcccctatctgctgggcaagcacagcttcgacatcacccaggacggcatcatcatctatccccgcctggagacgctcgcggagtccgggcctccgccggggccgccgcaggatgcgaagtgcgcgtttggcatccccgggatggacgcgatgctgaccgggggcatggcccagggctcgacgaccatcctcctggggccgtcgggcagcggcaagacgctgctgggactgaacttcctcgcggagggcgcccggcgaggcgagcgcgtccacttcttcgccttctacgactccccggagcgcatggtggcgcaggcggcgggcatcgggctcgacctcaagccgctcatcgaccggggcgacttcgaggtcagcttccggccgcccacggagaacctgctggacaagctgggcgtgcagttgctggacatcatccggacccgcggcgcgcgtcggctcttcctggacggctacgacgcgctccgcagggcggccgtccggcagtcccgcgtgtcgcgcttcctggccgcgctggtcaatgagtgccgcatgcgcggcgtgacgctgctctactccgtcgaatcggtctccgcgtttggcccggaggtgaccttcccgatgaggggcatctccatggtggcggagaacatcctcttccttcgccaggccgagctggactcccggctgcgccgcttcatcacggtgctgaagctgcgcaacagcccgcatgacacctccctgcgcgagctgtgcatcagcacgaaggggatggaggtgaagggtgccttcacggatgtcgaggcgatgatgaccggcgtgccacggtcgaccacgtggtccgagccccggcatcctcccggcggcgggcgccaggagccttag

SEQ ID NO: 9571 - DNA, 366 bp, Myxococcus xanthus
atgggccccatcctcatcgtcgatgacgagttcggcatcgtcgaggccatgcgcgacctcctgagcgacgaaggctaccggaccgccatcgcgctcaacgggaaggaggccttggagcggatggccgaggagcacccctgcctggtgctgctcgattacatgatgccggtgatgaacggcccggccctgctggaggccatggagcgcaatcccctgctgcgtgacatccccgtcgtcatgatgagcgccagcccgccggactactggaagcacctgcgttgcgcggccttcctgcccaagcccttttccctggacgagctgctggtgatggtgaagcgcttcgcccagggcgccatcctccagtag

SEQ ID NO: 9572 - DNA, 1074 bp, Myxococcus xanthus
cgcctcttcatggtgggctttcccggcactcacatcgacagcgagctggccgcgctgatggatgacggcatctacggcgccatcctcttcaagcgcaacgtgggcagcgccgcggacacggccgcgttgtgccacgcgttgaaaacacgcgcaggccggcccttcatcctgtcggtggaccaggagggcggccgcgtggcccgccttcgcggcgcgcccttcaccgcgctgccgcccatgcgggagctggggcagcgcggcgacgcggcccaggtggagcgcgtgggccggctgctggcgtatgagctgcgcgcgctgggcttcgactgggacttcgcgccggtgctggacgtggacaccaacccggccaaccccgtcattggcgaccgcagcttcagccgcgaggcggaggaagtggcgcggctgggcgtagcgctcgcgcggggactggaggcgggcggcgtggcttcgtgtggcaagcacttccccggccacggcgacaccaccaccgacagccacctgacgttgccgcggctgccgcacgacttggagcggctgcgcagcgtggagttggtgcctttccgcgccttcgcccaggcggggctggcatccctgatgacggcgcacgtcctcttcgacgcgctggacccgggggtgcccgccaccatgagtcagcgcgtgctccagggtgtgctgcgcgaggagttgggctttgacggggtgctcgtcagcgacgacctggagatgaaggccattgccggccactactccgtggaggaggccacggtgcagggcacgctagcgggcgtggacctgttcctggtgtgccacaacgcggacgtgcaacgccgcgccatcgaagccctggtgaaggcggtggagtccggtcgcgtgtcacgggagcgaatcgcgcaggcgcaccggcggctggacgcgctcagtgcccgcttcgcgcacccggcggaggaccggctcgccctgctggggagcccagagcatcacgcgctggccgaggggctcgtcagcaccttcaccggccgcgacccgaccgaggtgatgctggcctcccgctga

SEQ ID NO: 9573 - DNA, 543 bp, Myxococcus xanthus
atggcggattgcttgctggaagacgcctgggccgacgtcctcccagcgcgctacttcctggaggccttcttcgccgccgcggacttcttcgccaccgcggacttcttcgcgggcgccggcttcttcccggccgaggccttcttcgcagccgcgggcttcttcccggccgaggccttcttcgcagccgcgggcttcttcgccacaggggctttcttcgcggtcgcggccttcttcgccgcacggggtgccttggcggccggagccgacttcttcgccgtcgccttcctggtcgcggcggacttccccgagacagtcttgcccgccggcgccttcttcgcggcggccaccttcttccccgcgggcgccttcttcgcggcggacttcttcacagcaccgcccgccgccggagcttcacccttcagcacggccagcacctcggcgacgtggccgttcaccttcaccttgggccacacctgcttcagcacgccatccgggccgatgaggaacgtggcccgggtgatgcccaggaacttgcggccatag

SEQ ID NO: 9574 - DNA, 747 bp, Myxococcus xanthus
atgacggcggacagccgtcgggtgatcatcctcatgaagggtcggttctcctctcctgctggcctcccgattgaagcacggctagggtgccgcgtcgtgcagcccattctcctcgccttcctgcttggcctgtcccaaggcatgctccacgccgtgggcccggaccactgcgccgccatggccaccctcggaaccctggggggaggccggcgccgcgctgccatcgccaccaccgtacggttcgcgatgggacacgccgtgcatgctgggcggcatcggccgggctctgcattcttggggggcgtgggcctttcagaaaccttcgagcgctgggccgagattttcggcggcgccgtgctggtggccctcgcggtggccgccctgctgttccccagcagcctggaccacggacacccgcacctgcccggccacacccaggagccgcaccagcacgtgcacacggtgagcaccaccgctggcgcgctgatggccgtcagcggcgtgcgctcgctgctactggcactgcctccgctgctggtgggtggcagcatgagcgcggccgcatggatgtacctgcccggcttcgcgctgggcatcctcatcggcatgggcgtggtggggttgattttcgcggagggcatcgcccggctgaacgcgcaaatcacccgctgggtgcagcgcgtggtggccgtgggctccggcgcgctggggctgttctggattggctcgcggctggtcggcggctga

SEQ ID NO: 9575 - DNA, 1380 bp, Myxococcus xanthus
ttttccgcgcttgcgctatctccccccctgctccaggtcctggaggagctggacttcaagacggccacgcccatccaggcgcagagcatcccggtgctgctccagggcagggacctggtcggccaggcgcagacgggcagcggcaagacggcggccttcgcgctgccgctgctccagaaggtccagttgcagcaccgcaaggtgcaggcgctggtgctgtgtccgacgcgagagctgtgcgcgcaggtggcgggcgagattcgcaggttggggcggcggctgcccgggctccaggtgctggtgctcgcgggaggccagcccatccgcccgcaactggaagcactggagaagggcgcgcacctggcggtgggaacgccgggccgggtgatggatgtgctggaccgcgaggcgctggagacgcggcagttatccacggtggtgctggacgaggcggaccggatgctggacatgggcttccgcgaggacatggagcgcatcctcggagccatgccgccgcggcggcagacggtgctcttctccgccaccttcccgccggacatcgaggcgttgagccgcgatttccagcgtcagcccgtccgcgtcacggtggaggccgccaccgcggggcccgacatccagcaggtgcgctacgactgcgagccgggagacaagcaggccctgctgctgcgcatcctccggcactaccagccggcgtccgccatcgtcttctgcaacctcaaggcaaccgtggtggagttgaagaagtcgctctccgcgtcgggcgtcagcgtggacgggctccagggggatttggagcagttcgagcgcgaccgggtgatggcgaagttccgcaaccagagcacgcgggtgctcatcgccacggacgtggcggggcgcggcatcgacgtggaggcgctggatgccgtcatcaacttcgacctgcccatgcaggccgagccctacgtgcaccgcatcggccgcacgggccgggcggggcgcgcgggcctggccgtctccatcgtcacgcctcgggatggccgcaaggtggacgacatccaactggccaccggcgtgaagctggagcgtggggacgtggagtcactgccctcggcggatcctcgcaacgcggtgtccctggagtccacgtgggacacgctctacatctccgccggacgcaaggacaagatgcggcccggggacatcctgggcgcgctcacgggcgaggcgggcgggctcgaagcgaccgacgtgggcaagattgaaatccaggaccacgtggcctacgtcgccgtcgcccggcgcgtgtcgcgggtggccttccagcggctgagtgaaggccgcatcaagggccgccggtacaaaatcgagcgcgtgaagtag

SEQ ID NO: 9576 - DNA, 333 bp, Myxococcus xanthus
atgaagaacatcgagggcggcaacaccaacaagccgctgccgccttggacgctgccggcgaaccggggctacaacggcactatcgaccagattggctccagcatcgacccgcgcacgccgaagaacgacggcacccagggtcgctccatcgtggacgacgccgggaagatgatgaacgaccggtaccacgtggagggcggcgccgcgtactcgcccgcggcccatggcttgggtggtgaggacggcgccacgctgggcggcaagcgcggcggccaccacagcggctacagcccgctgggctggcaggaccgcagtggcccctaccgccgctga

SEQ ID NO: 9577 - DNA, 162 bp, Myxococcus xanthus
atgccgtcgctgctcgtcttcgccgtcgcggtgctcctcttcggctctcccctgcgccgactgtggctggcggagggcgcgccggggtacctgcccttcgcggtgtggctgggcgtcatcctcctgggcggctgggcggcgcaccggagtcgtggcccatga

SEQ ID NO: 9578 - DNA, 825 bp, Myxococcus xanthus
atgcccatgccccaagctggtgaccaggcccccgccttccaactcgccgaccaggatggaaacgcggtatcgctcgcgcagttcgcgggccggagtgtcgtcctctacttctacccgaaggacgacacccccggatgcaccgtggaggcgtgtggcttccgtgacgagcactcggcgctggaggccgcgggcgcggtggtgctgggcgtgtccgcggacagcaccgcgagccaccggaagttcgcgaccaagttcaacctgcccttcccgctgctggccgacgtggaccacacgttgtccgaggcctacggcgtctggggggagaagtcgctctatggccgcaagttcctgggcatcacccgggccacgttcctcatcggcccggatggcgtgctgaagcaggtgtggcccaaggtgaaggtgaacggccacgtcgccgaggtgctggccgtgctgaagggtgaagctccggcggcgggcggtgctgtgaagaagtccgccgcgaagaaggcgcccgcggggaagaaggtggccgccgcgaagaaggcgccggcgggcaagactgtctcggggaagtccgccgcgaccaggaaggcgacggcgaagaagtcggctccggccgccaaggcaccccgtgcggcgaagaaggccgcgaccgcgaagaaagcccctgtggcgaagaagcccgcggctgcgaagaaggcctcggccgggaagaagcccgcggctgcgaagaaggcctcggccgggaagaagccggcgcccgcgaagaagtccgcggtggcgaagaagtccgcggcggcgaagaaggcctccaggaagtag

SEQ ID NO: 9579 - DNA, 474 bp, Myxococcus xanthus
atgccgctcgcgctctgtctgcttctgtcgcctggctgcgacaagggccccgaccagctccgggacgcagagaagtcctaccgcgacctgattgaccgccgcgtgtcccccctggacccggcatgggaccccgtcatcaacgccttcgaggcgattcccaaggactccaaggttcgcccggaagcggagcagcggatcgccgccatccgtcgcctgcggggaaagctgccgccgcgccccctggccacgccgggcgccacgggccccgggacgtcggaggtggacaccaagcgcgccgcgtgtgaggccctggcgatccggctgggccagacgccggagggcgcggaccgggagccgttgcatcaggccctgacggactgccagaaggagctggtccggttggaggcccacagccatccgcccggggagcatggtcatgaccatggcggtgagccggggcaccccgcgcactag

SEQ ID NO: 9580 - DNA, 624 bp, Myxococcus xanthus
  unsure (1)..(624): unsure at all n locations
ttgggcgtgcagaagggcaaggtgaagaaggtcgtctacttcgagaagggcacgccggtgttcgccctctccaacctgctcgcggaccgcttcggtcaattcctcgttcgcgtggggaagatcaagccggagcagctccagnacgcgtcggcggtggccgcgcagtccaaccgccgcaccggtgacgtgctggtggagcgcgggctgctcaaggacaccgagcgcctctactacgtgggccagcaggtgaaggccgtcatctactcgctcttcgcgtgggatgaaggcacgtacgtgctgagcttccgggagaaggcgagcgcggagtccatcaagctggacgtgcacccggccaacctcatcgtccggggcatcaagaagctctacaagccggagcgcctgcggcgcctgctccagccggaggaccgcctcatccccgccgtggccccggcctaccagctcaacgaagtggagctggagcggtgggaggcggagctgctgccgaaaatcgacggcaatcgcaccgtggcggagctgctggccttcgccaaccgccccgagcacgtcgtctacggcttcctggtggcgatgatgtcgctgggcatcctggacaagcgcgggtag

SEQ ID NO: 9581 - DNA, 765 bp, Myxococcus xanthus
atgagcgcacgcgcctatggcatgggcggcgcctaccgtgccctggggctgggcacggacgccatcatgggcaatccagcggcgatggtcctctacccgtcctaccgggttgaaggcaccggcgcgtgggatacgcggcggaaggaagggttgctgggcgtctccgtcgtcgacgccgccacgagccgcctggggatgggcgtggactaccactgggtgagcgtggggcgcggcggcgcgcgcgccagcgcccacctcagctcgatgggcgtgggaatgcccatcagtcaggcgctcatgctcggcgccacggtgcgttatctgcgcatgagcggccagtcgcggttcgccaactccgtcaccggcgacgcgggcctgatactccggctgtcgccgtcactgatggcgggcttctccgcgcacaacatcgtggacactggcaatgaggagctgacgcgctactactcggcgcacgtcggggtgatgacggggctgctgacgctcgcaggcgacgtgcgcgcggacttcacgacgaacgacaccaagacgttcacgtaccacggcggtctggagtacatcctgggcgagctgttcccggtgcgcatgggctactcctacgacggcttcacgcggacgtcgcaaatcagcacggggctcggcttcatgtccgagggcggaggcggcctggacttcggctaccgccacgacctgggcggccccaaggggcgcatgctggcgctcaccatcaagctgaacatgaactga

SEQ ID NO: 9582 - DNA, 1392 bp, Myxococcus xanthus
atgggcgcaccggtccttctcgtccacgacgacatcgccaatatcgccgccgtgcggcgcctgctcacgcgtgaagggtacgaggtcatcctcgccacctccgccgcggatgccctcattgcgtacgggcaccacctgcccgtgctgctcgtgctcgcgcccggcgtggagagtggccggggccatctcgtgctggaggagttgctccagcacccggatggcaagtcggcccgggtgctgctcctgggcgagtccatccccggcttcagcgcccccgtggcccaactgccgctggaaggggcggccttcgtcgagctggtggattcgctggtcaatgcccccgcggatgcggacgcatggcacgtggtggagaaccgggagctgcctccgtctggtggtggctcggcggccacgggtgcggagacggagtcctggcacgcgaccccaccgccctcggtggcgggcgactccgcgctggcgaatgcgctctttggggacctggcgccgctgcaccagacggactgggagctggcggccatgacggacgcggagcgctccgctcacgaggcggcgcagaaacgcgagcgtcagagcacgcgcgacctggacaccgccatggagcgggcccacctggaggtggaagcccaggcgatggcctccatcgactcggcgcttgctccggattcttcggatggatggggcgagccttcgcaggggcaggactggggctcggccgtggacgctgagacggccggagacgacgcgcagggagcgtccgcggggcttgagggagaggacgccgcgccggccgaggatgcgccgccagtgggacaactggcttggacggaggaggctgtttctcagccttcgatgcgcacggcggccctggcgcctcggttgggcgatgaggggttcttcgacgtcgacacgccggaggccccggcgggggatgccctctccgcggcggaggcagagctggctgccatgcgcggcgggccttccttcgactccgtgagcacggagggctcgccctggacggagctgcctccggaccccgagatggagcacgcagggcgcgtgggctcggggggggatggtgcgggcgatgtacccggtgaggcgccgtccacggagcccaagctggcggcggacgccgagccgcaatcaccgtcatcggagactgaagacacgtggggcacggaggcggcgctcggtgagcccgcggacacgccggagccggacgcggcggcggtctccgcgtccaactgggagttgctggaggcggagctgcaatctgcttcaggcccgtcccaggattacgaggaaccgcaggcgtcgggcgtgggggatgactggttcgacggggagtccactgaaacgccgaaggaggag

SEQ ID NO: 9583 - DNA, 2187 bp, Myxococcus xanthus
ttcacctacaccctgccggacgagctggcgggccgcctggagccggggcagcgcgtgctggtgcccttcggccggggcacggcgctgggcttctacctggggcccgcgtctccgccgactggcgagaaggtgcggctcaaggccgtccagcgcgtgctggaggactctccgtccttgcccaaggacctcatcgcgctgctgcgcttcgcggccgtgcactaccgctatccgctgggtgaggtgattcgcggcgcgctgccgcctggcctgtcgaaggctgtggatgagaaggaagccaggccggacgtgcagcacttcgcggtggcgctcgtcaacgaggtgccgccggagctgtctcgcgcgcccgcccagtccgccgcgctcgcgtatctgctggccgtgggaggcagcgcgccgctggaagaggtcgcccacgcgattccaggcgcgcgcgagacgctgaagaagctggccacgcgcggcttcgcccggctggaggagaagacggtggaggccagcgtgaaggagggcctgattcagggccgtccggaccacctcacgccggagcaggacgcggcgggcgtggtgctgcgcgcggccctggacgcggccaccttccagcccttcctcctgcacggcgtcaccggcagcgggaagacggaggtgtacctgcgcgcggccgagcatgcgctgtcgctggggaagggcagcctcatcctggtgccggaaatcgcgctgacgccgcagctggtgggccgcttccgcagccgcttcggcgcggaggtggcggtgctgcactcggcgctgaaggaccgggagcggctcttccactggcaggcgctgcgccgcggcgacgtgaagattgccgtgggcgtgcgctcggcggtgttcgcgccggtggacaacctggggctcatcgtcgttgacgaggagcacgacccgtccttcaagcaggaggagaagctgcgctaccaggcgcgcgacctggccgtcgtgcgcggcaagcaggccggcgcggtggtggtgctgggttcggcaacgcccgcgctggagacgctggagaacgtgaagcgcgggcgctaccagctcctggagctgaagcaccgcgtggatgaccggcccatgcccaccatcgagctggtggacctgcgcgtggagcgtccgcgtgagggcgtggtgacggaagaggcgcccatcctcagtcctccgttgctggaggcgatggcggagacgattggccgcggtcagcaggtcatcctcttcctcaaccgccggggccacagcaccgtccttctgtgtgaggtgtgtggcctgtcgctcaagtgcagcgagtgtgacgtgtgcctcacgcaccaccgctcgcagaaccgggtggtgtgccactactgcggcctggccatgccggtgccggagcagtgtctggagtgcacgggccccatgctcaagctgggcatcggcaccgagcgtgtggaggcggaggtgctggagcgcatccccaccgcgcgtgtcgcccggttggaccgggactcggccagcagcgccgagcggctgacggagatgctggcctcgttcgcgcgccgggaactggatgtcctggtgggcacgcagatggtggccaaggggcacgactttccaggcgtgacgctggtgtgtgtcgtcatggcggacacgtccctctccatcccggacttccgtgccgccgagcgcaccttccatctgctcacccaggtgtccggccgcgcgggccggggcaaggacccgggccgggtgctggtgcagacctacaatccggacgcggagccggtgcggcgcgtgctggcccatgacttcgacggcttcgccaatcaagaactggagtggcgcaaggcgctggcctaccctccctattcacgcatggccgccgtccgcctggagggggagcaccccgaacagacggccagtgtggcgcgctccctggggaacatcgtctcccggcacatgccccctgcgtccgcgggggtccgcatgctggggccggccctggcgcccatctcccgcatccgtggcaagacgcgctggcagctcctcttgaaggggccaacgcatacggcgctcgccccgctgctcgcccggctggaagcggccctggtcgatgttccttccgcggtgaaggtcgtgatcgacgtggatccgggggccatgctgtag

SEQ ID NO: 9584 - DNA, 627 bp, Myxococcus xanthus
atgaaggtgtacggcctcccgatgagcactgccacgcgttcggtcctcaccaccctggcggagaagggccaggaggcggaactcgtcgtcgtcgacctcacgaagggggagcagaagagccccgcgtacatggagcaccaccccttcggcgtcatccccgccttcgaggacgatgacggcttcaagctctacgagtcgcgcgccatcatccgctatctggaccgcaagctgccggggccctcgctgacgccgtccgacgtgcatgcgtacgcgcgcatggagcagttcatcagcgtggagcagtgttacttctcgccctccgcgatgaaggtcatctgggagcgcctcttcaagaaggtgatgggcggcggcacgccggacgaggcgcgcatcagcgagggcctgcagggcgtcgagcgcgtcttcggcatcatcgagccggtgctgggcaagcagcagtacctggcgggagacggcttctcgctcgccgaggtgacgtggatgccctacatggatttcttcgtcgccgcgggcggcgcggagctcgtcggtaagtacccgaacgtggcggcctggtgggagcgcgtccggagccgtccttcgtggaagaaggtcaccggggcctga

SEQ ID NO: 9585 - DNA, 408 bp, Myxococcus xanthus
atgtcggcgcttgtctcgcaggtgtgcccgctgctcgccacgggcagcggcaacgtgcaggaactgaaggaggcggtgattcgccacctccagggcctgggcatcgacacggggcgcaccggactggcgcgcttcggcggcgaggtggcctacgtcatcggcgacatggccgagggccgcccgcagttctgggtctacaaggactccttccgcccggcccgggtgcgttactcggacgcgtcggggacggcctgggacgtccgcttcctggactacaactcgcccgccacgggggagtggctgccccgcaccatcgaggtgtggcgcggcggtcagcgcaacctgcgcttcaccgccttgaagggggacaaccgggccagcctgcccgactcgctcttcaccctgtag

SEQ ID NO: 9586 - DNA, 870 bp, Myxococcus xanthus
atccgcaagtgtgtcatcccggcagccggcctgggcacgcgcttcctgccggcgaccaaggcggttcccaaggagatgctgcctatcgtcgatactccgacgctccagtacatcgtggaagaggcggtatccgccggcatcgaggatgtcgtcctcatcaatggccgcggcaagggcgccatcgaggaccacttcgacatcggcttcgaactggagacgacgctgcgtgcgcgcggcaaggattccgaggccgacaagctgcgcgccatcgcggacctcgtgcgcgtcgtcagcatccgtcagaaggagcccaagggactgggccacgcggtgctgtgcgccaagagcgtcatcggcgacgagcccttcggcgtgctgctgggcgacgacatgattgatgccgaggagccgggaatccgccagctcgctcgcgtgtaccgccagtacaaccaggcggtcatcgcgctcatggaagtgccggagagtgagacgcacatgtacggcatcgccgcgggcacggacctgggtgatggcgtcatgcgcatcgaccgcatcgtggagaagccgaagaagggcactgcgccctccaacctcgccgtcatcggccgctacgtgctgccgcccgacatcttccccatcctggagaaccagacgccgggtgtgggcggcgaaatccagctcaccgacggcctggccacgctccagcagtcgaaggggctgctcggctaccgcttcaagggtcagcgctatgacgcgggcgacaaggtggggtacctgaaggccaacatcgcctacgcgctcaagcgtccggacctgcgtgccgggctgctcgagtacatgcgtgaagtcgtgaagacggagaagccgtga

SEQ ID NO: 9587 - DNA, 4335 bp, Myxococcus xanthus
  unsure (1)..(4335): unsure at all n locations
gcccggcagttgcgagagggctccgccgcgcgtgcgttcggagagcttgcgcgcgccagccggaccttgccgatgacgccgcgcctggccgccggaattgtgcgcatggcgctgctggcgggcacggaggcggcggccatcaccttgctggaggtggcgcctacggtggtctccagcaggcgcgcggtccggcgtcagctcgcgcgggtgctgcgacgggtggaccaactgccgcgtgccgccgccgcgctcgaagccctcctggtggaatggcccgaggaccggcgtgcccggcgcgtgctccaggtgttgcgtgcgcgcatcgggggcaaggcggtgcctgacgctggtgcgagcgccccgaaggtggatgaggacgaggagggtgtgctggcgaagctcccagcgcggagagaaggcgcgcaggccgcggcctcttgggagaatgacgacgccgtctacctcatcgaaacggtggtggggccgccgctctccgcgagggcggtctcggcatcagcttccacggtcggtgcggtggaggcacgttcgcggtcttcggtgtcgcagttcccagcggtgggtggaggagcgcctgcggccgtgtcacctgcgcgcggcgcggatgggcttcaggcggaagctccgcccgtctcggaacaacgtgggcctgtgtcgatttccgttccaccgcctggggctgatgtgagcgcgacggcttcgtccaaggggggcgaagcgctgcccgataccgatgcgcgtccgccgcccgtgaaggcgccacccactgagtcgctcaagacggtgttggagatgccggcggtggaattacccgcggtgactccgcgcggtacctctgcttccgaagcacccaggactgtcgtggaaatgccggcggtggttgttccaccgggggcatctgacttcgaggcgcgcaagacggaagtggagatgcccgcgctaggggacgtcgccatgcccccgtcttcaggtgtggccaagacgtttgttccggggcgcgcgccactgcccgtgccttgggccgatgccccagacgacgacgcggtcgcgcctgcgcctgtcgctcgctttgacgatgccgacgaaagtgaagtcacttcggaggcacagccctttctcgtcggcgcggatgtatcgagtcctccaccgcgccagcagactcctgcctcttcgaagagcgagcggcggaagaccccgcccccgtccgaggcgctgccacctcgaatcacgtccagtgccgcacccgagccggatgcccgctcaggcaccatggaggtgtcgttggcggagctggaggcagcgctcgcctcggcttctggcgatgcatcgaacaagaaaggccgcgcttccgaggcgagcgcggggcctcgtgaagaagacaccgaggagctgacccgctcgcagaaggtcgaggctcagctcatcgctcgacgggcctgggccgagctggctcagctctacctcaagcgagcggaccgggcgaaggacgcgtccctgcgcgccgatgcgttggcgcgcctcgcggaggtgatggagaacgagctccacgaccccgcgggcgccgctcgcatgtaccgggaaatcgtggagctgacgggggaccgcgccgcgcttcgagatcaggtgcggttgctcgccgcgagaggggacgcatccctcgtccgccgtgcgctggacgaggccatccggcgcgcgcccgctggccgcgcacgtgcgggggctctgctcacacggggcgagcgctggctccacatgggcgagctgaagaaggctcgcgcggacttcgaggcggcggagtcctccgcgccgggactgcttcccgtgctcgcggggatgctccgctgtgtgtcggacgcggaacgtccgtccatcgcggaacggctccgggtggcactggcggcggcaccccgccgtgcgctggaccgcgtggaagcgctgcgtgtcctggctcaggtcgcggaggagtcgctgagcgattggcggctcgcgcagtgggcctggagcgaggtgctcacggagagtcccgacagtgagcaggcgcgcgtgcagctcacgacgctgacgcgaaagctcggcgacacgacggtgctcagccggcttctgcgtgcgcagctcgcccgcgaatcccgagggcccgccgcgcgtcaggcccggctggagctggtcgccacgttggatgcccagggcgacgccgatgccgcgctcgaggagttgcgtcaggccgtgcgctacgagccgggccacaaggaagcgtggctgatgctcgtggagcgtctcctcgctcgtgacctcctgggcgaggccgcttgggccctggaacatgcggccaccgccatggacgacgaggcggagcgggagcgcacctgggaccggctcgcgcgtctgtggcgcgaggtgatgggcaatcccgagcgcgcgcaggtctacgcccgccgggcggagggaatccggcaggcacgcgcagagcgtgaagtgccgccccccgagccgccgcgctccgcggctcctcgccgtgagtcgagcggcccccgtgcgccactcatcgcggcgcccccggtgctgacgcaatcgtccggaaacctccagagcctcgccaacgaggatgcgtccaccacggacatcggggttgctccatccgcgtccgaaagcgtggagccaacccgcgatgaagtcgggagaaatgccccgggcgccgcggtggagcagggccgcaaggcttcgccggagcccgtcccttcttcggggcggaaggggaggcgggaggcccgttccgacgcggatgcgccgcttcccaagggcgcggcgcgcgccaccgtctcgccagcgcaaggtgaaccgcgtgttccatcggaagccttcgccgcatcgcctcccaaggcagaagcacgtgcagccgcgtcctcccccaggggcgaggcccgcaacccgccttcatccccgggcaacacagccgctccgccgccacgcgctcccgctgagtccgcggacgccgccgttgcccccaaggcgccggctgctcaacgcgcccccgcgccctcgcgcggagacaaggccgcgccacgcgccgccgngtncggaagcgaagtggagcaagggcctgcttctcgcgacgcggaggctcgagcccagcgccctcgggccaccgacctcatcacaggcgaggtcatggacctcggtgatgcccccgtcccggagacccgcgtcatctcctgggaagcgccccccggccggatggacccggtgcgccgcgttgtccgcgcgcgcccggagggcacggtttccgccccggcgccgggccgcacgttcatcgcgaagccacccgcggcgcccgagcctcctcggcctgtccccggcgtcacggacccgcgcgaatcacccgcgcccgcctatgtgccgtcaccggacaccgagcccgatgccttccggcacatccgcgagcgtccgctcgacgcgaagccctatcgactcctcgccgagtacttcgaccagcgaggagacccggcgcgtgcctcgctcatgcgcgaaatcgccaatgcgctcgacgggctcgaaacgcccgcgccgcgcggccagcgtccaccgctgacctccgacgaacgcgctggcctgcgtcaccccggtctgcgcacgccctcgggcgaactgctggcctgcaccggaatcgcgctctgccgcctgttcccagcggagggccgcgccgccggctcctcggagctgatgcgcgccaccgcgggcccctgcgcgcccgccgtgctcgacgcgctgcacaccgccgcgcggatgctggacgtccacctgcccgaactcgtgctcgcagaggacgacggcccgcccttcaccgccgtgcacgcgggccacccgcgcctcctcgtgggccggctcctgctgcgtgagcccatgccgctcccggagctgcgcttccacgtgggccgcgccttgctgtccctgtcgccggacctgctcgcgctccgggccctcaaggggggccagctcctccgcgccctggcgctgctggccaccgtgctgaaggacccgcgtgcgtccggagccgaggcccgcgtggtgcgcgagtccctgtcgccgcgcgccctggagcgcgcgatggccttgctggaacccggcacccagaacttcaaggcttcggcgctcgcggatgccgcgcgggattccgccaaccgcgcgggcctggtggcctgcgggagcattggccccgcgctgtccgtcctgcggacccgccggggcaacgaggcggagctggtggagctgctgcgcttcgccgcgtcggagcgctacctgccgctccgggcgccgcgctga

SEQ ID NO: 9588 - DNA, 531 bp, Myxococcus xanthus
aggtcgcccatgagcgaagcagaacaacagcggttcaccttgttctggcaggcgcactcccccttctcccagtggcacccttccgacttcaccgtggacggcgtgcgctacgtgtgcgcggagcagtacatgatggcaggcaaggcgcggctcttcggtgacaacgaggcgctggcgagcatcctgtcatcgaagtcgcccaagacgcacaaggccctgggccgcaaggtccgcgatttcgacaacacgcgctgggagaaggcgcgtgagcgcatcgtctacgagggcaatcgcgcgaagttcacccagagcccggagttgttgaaggcactcctggccaccgcgggaacggagttggtggaagccagccccgtggatcgcatctggggtgtggggttggatgaggaggacccgcgcatccttcaccccgcgaagtggcgaggactgaacctgctgggcaaggtcctcacgaagctgcgcgaggacctgctggcggagggcgtcaccgaggcgtcctccgctgagtcgtag

SEQ ID NO: 9589 - DNA, 741 bp, Myxococcus xanthus
atgtctcgggcggagtaccgggactacaagaaggcgaaagcggacccctgtgcgtcctcggaaccgcggtggctggcggacgagctgacgacggtgaacagtacgatggcgcgcttcctccgggagacggagcagctctccaagctggacgcgccggaccacgctcgccaactggcgatgatgcgggaggccaccggctcacttccgcccatcatggaggtgcaccgctacacgctcaaccggctgaaggagtgcggcttccgcaacaccggggccttcccggagattgcccgtcgtggccaggagttgctgacggaggtggatgtccggctggaagaagggcccaaggtgctggccgccgtggcattgaaggatgcccgccggcagtggcgcgaggagatgcccgagcgggaggaggccgcccgccgcacctggtgcccgcccaacccccaggtggggcagacggacctgttctacgcgcggcaggaggtggacggccgcaagctgtggcgcttctgcgacggacacctggtggagcagcgcgccgaaggtgagcccgtgctcgtgcagcccgacaacctgtcgtggcgcatgcgccggcgcatcaagccccagtcctacctggatgccgcgcgcgcctatccgacggcggagatggaccgtcagcccgacagcgtcccgtcctcgggccagggcgccgccaagaagtcgtccgcgcccagcgacggcggcccgggctag

SEQ ID NO: 9590 - DNA, 3354 bp, Myxococcus xanthus
cgccgcgtccagctgccactccatgttcgatgtcagcagctccaccggacatcgtattccacttttcagcgacctgaaccaatcacacatcgccagctccaggctgcagatgcacgtgctctgacagcaggatccacttgtccacgcactccatcatggagtggggcgtctcgcgcgaaggaagccgggaggccagcggagacgtccaacgccaaatgggcggcgccgcatccatcgcataggtctggcccgggacgggggactccagcgtcaccgcctgggagctgtcagtgggccggccttgcgctcacctacacgcaggtcgcggacgaggcgcacaggctcgcggaggagctcggcgcccggctcgcgaaggccggctggcccgagcggcccgtcgcggtgatgctggagcgctcggaagccttcttcgtcgttgtcctgggcatcctcgagctgggccaggcataccttcccatcgaccccggactcccgccggaccgaatccgactgctcctgcgtgacagcagctgcgcggtgttcgtcacgcgagcctcgctgctcgccggcccttgccccgaaggcatcgagctcgtcgacctggatacgcagggccccgtcgcgccacccgggcggcgagaggagcggcctccgcgaggagccagtccgctggcctattgcatctacacctcgggctccacggggcagcccaaggccgtcggtgtgacgcgggacaacttgagcaacgccgtggcggtgtggcgccaggactacgggctcgttcgccctgtcgtcctgcagttggcgaacttcgccttcgacgtgtcggtgggggacctcggacgctccctgctcatcggcggcacgctggtcatcgccacggacgaggaacgcgtgagtcccgagcgcatcctgtcgctcatcgaacgccaccgggtgacgttcctcgagacaacccccgtggtggcgaatgccatccgggtgcacctcgaagtcatggaccagccgccccctccgctggaccttctggtggtgggctcggacacctggcggatgggagacctgcgcgccctgcgccgtcgcctccacgccagcacgcggctggtcaacagctacgggacgacagagaccacgattgacagcagcttcttcgagctcgacgccacggcttcgggaagccccatgagcgacgacgccatggcccccatcggacgcccgatgacgcacgtggagttcctcgtcgtcgaccccgcgggccggatgctgggcatcgggacaccgggcgagctgtgcatcgcggggccgtcggtgtccctggggtacctcggccggccggacctcacggcggaacgcttcgtcccgcacccgcgccacccaggtgagcgcatgtacaggacaggagacctgggcgtcctccggggagacggcaacgtcgccctgctcggacgcgcggaccagcaagtcaaggtccggggctaccgggtcgagctgggagagatagagcgcgtgctcctccagcacccggacgtccacgcgggggtcgtcctgttgctgggcagcggagcccaagccaccctggtgggctgcgtcatcggcgtgcccgaagaggcgctggcgggactcgagtcctggctggcggcacggttgccacactacatggtgcccacgcagtggctggcgcaggagtccttcccggccagcgccaatggcaaggtggaccggcgcgcgctccaggcggctgctgcgcatgcgcggcgcgcgcgtcaggcgcaggtgatgccgagcactccgcttcagcaggtcctgctcgaaggctggcgcgaagtcctgccgcaagtgcggagcctgagtgtcacggactccttcttcagcctggggggcgactccatccaggccatccagctcgtgctggcgctccgccgccgcggactggagctcagcgccgcggagctgttccgccaccccaccatcgagagctgcggcgcctacctcgagaccaggcaaggccagccggcgcgggcgctcgacctggcggcgtccgaggtcgacgcggtggtgcgccagcggctgctgcgcccgggagaccaggaactctacccggccacggcggtgcaggtcctcatgctcgaggcccatgcgcaccaccgccccgtggacgccgtctacctcggttacaccgtctgggagttcgaagacgaacggctggagctggccatcctgcgcgaggccctgctgcgccagctctcgcgccacggcgcgctccgcacgaccttcacgcgcgacaccgatggccggtggtaccagcgggtccggcccgtagcggcggtggagctcgcggagctcgacctgtcggaccggcctcgctccgcccaggacgccgacctcgacgagcgcgcccagagggagctggcgcgggacattctcgccgacgtcgatgctcccgcctgccggattctcctggtgagacgcggaccaggggcttgcgcgctgctcatgacgacgcaccacgccgtggatgacggctggggattgacggccttcgagaatgccctgctccaggactacgcggcgctgcgccgcggcgtggcgcttcccgtcccgccaccgcttccaacgggacgccagctcgtcgcgctggaggcagagcggctgcgcgacgagcgcgcacgcgcgtattgggcagacatcctccagcggctgccacctccgccctacgccacccgcgctcccgtccctccgtcccgctcccgcttcgagggcttctcgctcaccgtccccccagccacgcaagcgcgggcggcgcagagggcgcaagacgcgggaagctccctcaaggcgctctacctgtccgcgctgctccacgcactcgccgaggaggcgcgcaccgacacgtcgagcgcctgggtggtgatgaacggacgctcggaacgcctcgatgccgcgttggacgcggtaggcctcttctggagcctcgtccccgtcatcggaagcaacgtgggcactccgcggacacgcctcaaggcgatggatgaacagctccgtcaagcggagctgcacggcgcatggttcttcccggacctctttggggactgcctgggcgcgggcttccccgtctgcttcaacttcacgcacttctggaacgaacagccctcccctgagggggtccgcgtggccgcgcggcacatgcacaacgtgtggcacttccctttgactgtcacgctctcgctgaactccacatccggcaccgcgacgctccacgtcatgcatgacgccacgtcgctgtcccggccccatatcgacgcgctcctggagcgggtgctccaggctctcgccgaccgggagtcctcgccatga

SEQ ID NO: 9591 - DNA, 1023 bp, Myxococcus xanthus
atacgcgccctcctctcctcggatgccgtcacggcccacatccggcaggcctattccctggcggaacccatccaggcgcagctcctggccaccggggacaatgactcctatttgattgagtctgccggctggcgcggggtgtgccgtgtctactcactccggctccaaccgggcttcagccacgatgagcgccggtgcgagctggcctggctcctccacctcgccgagcgaggcgtccgcgtgtccacgcccgtgccacggcgggatggcgcgctgctcggcaggctcgacgccccggagggaatgcgagacctcgccctgttcacctgggcggagggagaaagcgccgcgttctccaacctggaggggatggagcgcttcggacagcggctcgccgagctgcacctggcctcgatgcgctttcagacgcgcctcccccgcatggccattgaccggaagcggctggtggacacgcccctggagcgaatcacgggcctcctccaggagctccggctggaaccggagctggcgcggctgcaggcgctcgccgagcccatccggcgccggctggattccttcccatccgatgaggcgagccacggcttcatccatggagactgcaacggtgagaaccaccacctcaccccagacgggcaggtggtgttcttcgacatggacctgagcggcccgggttggtttgcctacgacccggcggtgttgctgtggacgatgcgccgggccggcgtccccgcgcccgacatcgtggagagtggagcccggtgtatcgcgggctaccagcgggtccgcccccttgcgtcctgggagttggaggccctggatgacctggtgctggcgcgccacttctgggtcatgggcgagcacatcgtcgacatccccagcctgggcgctctcagggtcggccccagctactggcggctggccatcacccgaatcctcgaatggcaacaaacgcccctcgtccccttgattcgcgagcggctctcgcgggaaggcgctccatga

SEQ ID NO: 9592 - DNA, 1128 bp, Myxococcus xanthus
atgaacgacccagtgaataccgaagcgacagcgcaccagaccgaagcgttccgaagggagggctacgtcgtcatcgagcaggcattgagcgacgacttccttgacgtgctgcgcgctgacttcgagcaggcgttgcacgcgaaggtcgcacgcttcgacctgaagcccgcgccccgggatgcgcgctgcgaggcgaacgacggcgttctgaatgacttccagcccgacggcggcaaccacgacttcaaccgctggaacatgcacctgccatcccggcgcccgtacttcgaggccatgctggttgacaaccctcgaatcaccggcgtcatcgaccaactgctgggaccggactgggtctactacatcatcgcgtccgacacgccctttccgaacgcgggcttccagacggcccatcaggactacacgcgcttcagcatcgccatcaacatcccgctcgtcgacgtcacgcccgacaacgggccgatggaggtctggcccggaacgcaccagccaccgtcggagggacggctcgcgccgttcaccaccggggcacaccgcatcgacgagcccacgctgaagtcgcttgtccggcggattccgtcacgcaagctggtgatgcgccgcggcgccgtgctgattcgcgaccaccgcatggtccaccgaggcacaccgaacctggcggacgcgccccggtacatgctctcgctgtactgcatcgccgcggagcaggtaccctaccggctcctgtccgacgccggcgccacgctggcgctgagcctgcgccggatggggcggggaagcggcgccgccgtccggcatcgccgcctcttcgacctgggcgccgtcctggggcgcgtggtcgaggagtgcagcctgagcgaccgggactaccgccgcaccttctccgcggagctctgggccagcctgggtccacgcgcccgtcaccacctccggttcgcgcgggtccagggcgaggaccgggtccgtggccagggcgacctgaaggggagcggggcattcctcaagcgctacgcccagtccatttccgaggccctccagcgacccgacgggcgcccgcggctccctgaccactacgcggaaggacggcctggaacggacgcaccttga

SEQ ID NO: 9593 - DNA, 996 bp, Myxococcus xanthus
atgggcgcgcaggcgtatggcgaggtggaccaggacttcgttcgttcggtcgacgtcgaggcgcttggagagcgcctgtatgacttcaccgacaaggtcccctggcgcggcagggtccccatcgaaaccccggacttcttccagttcgacaacccgagcttccgggactggctgtcgaccgtccacgcgttgctggcggctcacacgcaggcgcacttcgcgcgcttcgcgcgcccggacatggccattgcgtacgcggggggctgtgcgcagaacgtcgtcatcaaccaggagctgttcctccgctatccccggctggtcgttcctccccatgggtatgacggggggctgtcgctggggtgcctggagctgctccgcatccagctcggactgccgcgcttctccaccgagggctttccctactggcaggaggacgactgcgaggacgctcccacggagagcaccatcgcgcaggcggtggagttgctggcccaggggaagattgtgggctggttccaggggcggggcgaggtgggaccgcgcgcgctgggcaaccgctccatcttcatggacccgcggcagcatgatggaaaggaccggctcaacttccgcgtcaagcaccgtgagacgtggcggccctacggcgccaccgtgctgctggagcggacgcccgagtggttcgacctggcggaggagagccgctacatgcttcgttcggtgcccacgcgccctgagcgccagcgggagattcccgccatcgtccaccaggacggcacctgccgggtccagacggtggggcgagatgcgccgacctccgcccggcggctggtggagcggttccagcagcacacgggcctgccgatgctcctgaacacgtcgctcaacgcaggcggcagccccatcttcgcgacccgggcgcagtgccgggacttcttcgccgccgtcgacatggacgcgctcttcatggggaacgaggtgcttgtccgccagggctga

SEQ ID NO: 9594 - DNA, 1401 bp, Myxococcus xanthus
atgaggctgacgctcatcgggcacgcatcgctcctcatcgagacggcggactgccgcgtcctgatggaccctgtcctgtgggatcctcaccaggaaggactgttccacgtccatcccgcccgggaggtgctgcacgcacggctccctcctctcgatgtgctggtcatctcgcatcggcatctcgaccacttcgacatccggagcctcgcgcacctgccccgccaggttcaggtcgtcgttccccaggacccgttgctcgagaagtcgttgcgggcgctcggcttcgaggaggtccatgcgctggctccgctcacggagttcttcgtggggggcacgcgcttcgtgacgaccccgtcgcgggcgccggtgcgtgagttcggcctggtgattcaggacgagacgggcacctgcttcaacgccgtggataccgtgctggatgcgtcggccgtggcggcggtccggcaggtcgctccgacgctcgacgtgtttctggcctcctggcagccgatgctggaggtggacttccagtggaacaggccggtcgcgtttccagtccagcgctatgccgagctgctcgggcacgtggcggcgctcgagccgcgggcagtcgttccgggcgccaatgggtttcgctactgtggcatctcctcgtggctgaaccaggtggtgttccccgtgtcccgcgcgcgcttctgcgtggacgtgaagcgggcccggggggactgtgcggtgttccccatggacccgggggacgtgctggagttcggagcggcagggtttcgcctcgacgcgggaggcgcctccttcgtgcggcggctcccggaggcccgcgtgtccctggactaccgtccggtggacttcgatgggcgcctggtggatgggccctgcgcaccggatgaagcggcggccatccgcgcctccgtggagcgagtgatggacgtcgagttgccacgcttcctggaggaagccgacgcgacgtgctggcgccttcaccagcaacatggcgtcgtccagcagctcgaggtcgtgttcccggacgagcggctgtcctggtgtatcgacttcacggcgagccctccgcggatggcgcggggcgccagctcgctggccacggtccattccctggtgacggcctcggtgctccacggcatcgcctcggggacgcggacgtgggactacgccatcatgggtggcttctaccgccggttcttgacgttcgagccgcaggcgcctctctcggatccgctgcgtctgcggtttccctcaggccaggcccaggcgagcgtcatcgaggccgaggtggcccgctgggccggtgtcaggccgctttcctcggcgcgtgctccgcgcgcgctgctccagcgatgtggggttttcccgacaggggctacggcacgatga

SEQ ID NO: 9595 - DNA, 2130 bp, Myxococcus xanthus
gtgcgagtcgagcacgcagcgggcctgcgcgccgagcacatcgccgacctcgttgacgcggccattcgcgaggcgctggaggatatcgctccggacacggactcgcgtgcgctggagtccacgcgcaacgcgcccccacgcatccgtgtcctggtcgtggcgctcgcggtgagcgccagtgggtatgtcgtgcactccgtggtcgggtcggcgatgcgcatctttccccgctggtccgtgtggggagggattggcgcgttgctcggtaccagcgccgcggtcatccacgcggcggacgacgacgtcgaggacgagacccggactcaacgtgaccatgcgctccgagagttgctgaaggcctcgcggccctatcaccgcatgttgttgctcgccatggccgccacggtggtcagcagggcgatgcaggtgggctacgtggcactggtaggggtgctcacggattcgttgctctctccgcaccgggtgatgttgttcgggcggcgattgcccatcgggcggctcggactggggaaggtcgcggcggggttggtggcgctgatcgccggctgctcgttcttcgagtacgtctcccgaatcctctggatgcgcgccgcgcaccgcatcacccatgacctgcggctgcgtctgtacgagcatgtccagagccttgaattgaaggcgttcgccgacaccagccgcgggaactacctgaccctgctcaacgaggatctcaaccgaatcgagttgctcttctcctcgacgtggggcgtctggaacgaggtcgcctatgccacgtgcagcacggtgggcttcttcctggtcagccccgggttcgcgggcctggccgcagtgccgatgcccgccctgctgctcctggcgcagtcgctggagaagcgcatccgcccccggtacgccgcgctgcggcagcaggccggcgtgcttcagggcgtgctcaacaacaacatcgatgggattcccaccatccgcgccttcggcgccgagcggatggcggcccgatgggtggatgaggcgagcgtgggcttccggggggagcaggacgcggcgacccaaattcattcctcatacaacccggtggtgctcgccgcggcgaacacgctccgcatggtgaccgcgctggcggcggggttccatgcgtccagggggcatctcacgccgggcacctatgtctcgctggtcatcctgagcacctccttgtccctgccgatgctcagcgtggcccgcgactttccgcacatcttgtcgacgctggcctcgctcagccgtgtgttcaaggcctttgagctgccccgcgagcgccgggacgagggtgccgcgctggacgcgggcgccgttcgtggcgccatccgcgtggaggacgttcgcttcgggtatcacccgggcctgccggtgctcgacgggttctcggtggatatcccggcggggaagatgaccgccttcgtcggggagacgggttcgggcaagagcacgctcgccaagctcctgctgcgcttccatgatgcggacgcgggccacatcctgctggatgagcaggacatcgcggggctgcggcgaggcgacgtccggcgggccatcgcctatgtcgggcaggacatcttcctcttcaatggcagcatccgggacaacatcgccttcggcatgccggacgtggggctcgaggccatccaggaggccgctcagagggcgggggcgcatgaattcatcatgcagctaccccagggctatgcgtcgcacaccggcgagctgggtcagaagctctcgggtgggcagcgccagcgcatcggcattgcccgcgccctgctgctgcgcaggcccatcctcatccttgacgaggtgacctcctcgctggacgccgtgacggaggcccaactgttgcgcgcctggtccgaggtcctggcgggtcgcaccgtcatcgtcgtcgcccaccgcctgtcggcggtccgggacgcgcaccgaatccacgtgctcgaacgcggacggattgccgagtcgggctcgcacgaggagctccttggacgaggaggccgttacgcgcggtactgggacctccaggtcaaccagaaggagctcccgccggacgcctttcctgggcgcggagggctgccttcatga

SEQ ID NO: 9596 - DNA, 1758 bp, Myxococcus xanthus
atgagcggagcctgggaaggcaagctgtatgatgtgattgtcatgggcggaggacccgcgggagccacgctcgccgcgcgtctgcggaaggaccccggcctctcggtggccatcttcgaatctgagcgatttcctcgtgagcacatcggagagtcctttgtcccctccgcggtttcctcactgcaggagagcggggcgctcgggcgcgtgctgtccagcgactgttggatcaagaagggcggtgggtactactcatgggacgcggtgcgcccctggtccaccttcttcgaacacaaagcctacgaacgggatgggtaccgccgctgggcattccatgccaaccgggcggagctcgacgacatcctcttgcgtcatgcggaggagaacggggcggaggtcttcgaggggacgcccgtcaagcaggtctaccgccgcgacggcttcacggaggtcgacctgggggagaagggcagtgcccgctgcaaggtgttcgtcaatgcctcgggccgctactcggtgacatcccttggggggccgcgcgaattcctgtcgtcctaccgcaacatcgctatctggagctacatccgcaagggcaagcccgcgcagtcgctcccgggggactggaacatcttccgcgagtccggcgtatcgccgataggaagcttcgcgttcgaggacgggtggttctggtacatccccatcccgctcgaggtggacggcaggagggaggtcgtccactcgctcgggttggtcaccgacccccggggcctgaagagcaagcgcgattacatgtccccctccgtgttcatggagaccgcccggaaggtgcccttcctttgcgacctcgtggcggacgccgagctcatctacgatgagttcaggacaacggccaactactcgcgaatcagccaccagatgtgctcctgggagaatcgtgagattcgcgtgggcgacgctgccttctttgtggacccgttgttctccacgggcgtccacttcgccctgcaccacacggccgcggcggcggtgctcgtgcgggctgccttcgacgaggccatgcccgagcagcatcgtgaggacctctggcatgactatgaccagatgctgcgcaaacaggcgcaggtgttctcgctcgccatcgaccagtggtacaacgagatttccctggcccaccccggcagcgtctactggcgtgagcgcagcgagcgggcgacgttcgaggtccggaacgcaaccttccattacctggtcaatggttctctggatgaggacctgttgcatgtcatcagccaggggaacgatgcggtagaggcgctgagcgagacgggcgcctggcggacgagtttcgctcagttgcagcgcctgcggcccgcggatgacgcgctcgtgcagttgatgcccaatgtgaagttccgccagagcgtcacgttggagcaccccatcgctgactccgccgaggacaagctggacgctcggccccaggcattcgaccacggcccctactgggagtcgccggagcggcacgcgcacgaggtcgccccacgcttcggacgccccagcccgtgccttcgcttctacttcgaggacggggaccatcaggataccgtccgcatcctctggaatcgtccgaactcggcgctgctggagcgcttgtcgcaaccgcatgcctatgggcccctgctcgccgggtgctcgctctccgaacgggggctgctggatcaacttctgctcaaggggatgatgagagtcatcccgtga

SEQ ID NO: 9597 - DNA, 14462 bp, Myxococcus xanthus; identical to SEQ ID NO: 1090

SEQ ID NO: 9598 - DNA, 132 bp, Myxococcus xanthus
atggcggacgtggccccggtggcgcgcgaggtgctggaggcactgccccacctggcgcccctgcgcgtcgacttcaccgccgagctgacgaccgccctcaccacccttcttcgcgggctggagtcccgctga

SEQ ID NO: 9599 - DNA, 983 bp, Myxococcus xanthus
atgaagccactcgaaggacgcgtcgctctggtcgctggagccacccgaggcgcggggcgtggcatcgccaccatgttgggagaggcgggcgccaccgtgtactgcaccgggcgcagcgtgcgcggacggcccgcgacgggctcgcgtccggagaccatcgaggagaccgccgaaatcgtcgacgccaagggtggccggggcatcgccgtccgcgtggaccattccgtcgaatcggaggtcgaagccctttgcgcgcgcatccagcgggagcaggggcggctcgacatcctggtgaacgacatctggggcggcgacggactcaccgagttccgcccggcgttctggaaacagtccgcccggaagggcagcaaatgttcgaacgcgccggttttacgcacctgctcaccagccgccacgccgtgccgctcatgctgggcggtgagcgggggctcatcgtcgaaatcacggatggggactcgttcggctaccgcggcaatcctctgggtacgaacctggggtcaagaatggtccggtcattccgggcttcggcctttcggggaatgttccttgggaaggtttggccgccgcaccgaagggttcaccggcggctggcggctagatcgcccggcttcctccgctccgaggagatgctggagaacttcggcgtcacggaagcgaactggcgcgagggcgcggcgaaggatccgcacttcatcgcctcggagagtccctgctacgtgggccgggcggtggcggcgctcgcggcggatccgaacgtgggcgccaaggccggccgcgtcttcagctcctgggccctggcccgcgaatacggcttcacggacgccgacggctcccagccgcattggggcgactacttcgcgcgcgctttcggcaggccgtaccaggtcgcggacgaggacgcctacacgtcctggcgcgacggccccatggagattgccagcccggattggcccctgggctga

SEQ ID NO: 9600 - DNA, 2930 bp, Myxococcus xanthus
atgctcgaagcagcgtctcaagccaacacgcagcccaccgcggacaccgagcgcatccgcgcggtgttcgaagcccagcgcgcgcaccgctggacgatgtcccgcaccacggccgccgaacgcatcgcccggctgaagcggctgcgtgaagccatcatcgcccgccgcgcggagctggcggacgccatccacgcggacttccgcaagcccgcgatggaggtggacctgacggagctgcaccccacgctggaggagctgaaccacacggtgcggcacctcaagtcgtggatgaagcccatgcgggtgggcacgccgatgctgcttgcgggctcgtccagccacgtgcgctacgaggcgcgcggcacggtgttgctgctgtcgccgtggaactaccccttcaacctgctggtgtcgccgctggtggccgccatcgcagcgggcaacaccgtcatctgcaagcccagcgagaagacgccgcacacctcgcgcttcctggcgcagttggtgaaggacgtgtttcccgagaacgaagtggcgctgttcgaaggcggcgcggagacggcggaggcgctgctggagctgcccttcgaccacatcttcttcaccggcaacacgcgcatcggccgcaaggtgatggaggccgcggcgaagcacctggccagcgtgacgctggagctgggtggcaagtcgcccgtcatcgtcgatgagacggcggacgtcgccgccgctgccgagcgcctgtgctggggcaagttcgtcaacggcggccagacgtgcgtggcgccggactacgtgttcgtgcacgcgtcgaaggagcgggcgttcctggacgcgctcaaggcgtccatcacgcgcttctacggcggcaccgagcaggagcggcaggcgagccctgacctgacgcgactggtggacccggtggcgtggcggcgggtgaaggacctgctcaagcgctcggtggccgcgggagcgaaggtggaagtgggcggggagacggacgagccctcgcgctacatcgcgcccaccgtgctgtccggcgtgacggcggagaacccggtgatggagggcgagattttcgggccggtgctgccggtgctcaccttccagtcccgtgaagaggtctacgcgcacatccgcgcgggcgggaagcctttggccctctacgtgttcagccaggacaagcgggcggtggaagacatcttccagaacaccacgtcgggtggcgcggtggtgaacaacgtgctcgtccacctcgcgaaccccaacctcccgttcggcggggttggtaccagtggcctggggaactaccacggtcatttcggcttcaagacgttcagccatgagcgggcagtgatggttcagtggatgaagtcgctggcttcggtgttcttcccgccgtatcgcgggaaggcgcaggaattggcctcccgcgcgacccggctgatggagtaggcaaccctggccggggcacctccggaaggagccgggcgatgcgcgtggtgaagttggaagaagcacggatgccggacggtgtgcaggaggcgttcgaccgcctccatgcgcatcgctgggaggtggcgcgccgcggcatgaaggaacggctggcccggctggagcagttcaagacgctgctcgtcgcccggcgcgaggccctggccgaggcgctccacgccgacttccgcaagccgcgcgcggaggtggaggccaccgaggtcctccccgtcctgatggagttggcctccatccagaagcacctcaagacgtggatgaagccccggaaggtctccacgcccctgctgctcaccggcacgtccagcctggtgcagtacgagccccggggcgtggtgctggtgatggccccgtggaactaccccttccacctgctggtgtcgccgctggtcgccgcggtggccgcgggcaacgccgtcctgtgcaagcccagcgagaagacgcccaacacggcgcgcttcatcgcggagctggtgaaggatgtctttcccccagaagaggtcgcggtggtggagggaggcccggaggtgggcgaggcgctgctgcggcttcccttcgaccacatcttcttcaccggtggggcccgcgtgggccggcgggtgatggaggccgcggcgaagcacctggccagcgtgacgttggagctgggtggcaagtcacccgtcatcgtcgatgagacggcggatgtcgccgccgctgccgagcgcgtggtgtggggcaagttcctcaacggcggacagacgtgcatcgcccccgaccacgtctgggtccacgcgtcgaaggaagaggccctgctggaggcgatgaaggaggccctggagcgcttctacggccgcaccgaggaggcgcgtcgcgcgagcctggacctgtgccgcatggtggatgacagcgccttcacgcgggtgcgccagttgatggaccgcaccgtgcaggccggcgcgcgcgtggtggtgggtggtggcgtgggcgcggagtcgcgttacatcgcgcccacggtgctcgcggacgtgacgccagacacgcccatcatggccgaggagattttcggaccggtgctgccggtgctgcgcttcgagtccctggacgaagtcgtgtcgcacgtgcgcgaggacggcaagcccctggcgctctacgtgttcagcaacgacgaggccacggtggagcggctgctgcgggagactcgcgcgggcggcacgtgcatcaacacggtggtgctgcacaatgtgaatccgaacctgcccttcggcggcgtgggcgccagcggtgtgggcgcgtatcacggcgagacgggcttccggaccttcagccacgagcgcgcggtgctgcgccaggggcgcacgtccctggtccacctgttcttcccgcccttcacgggcaaggcgcagaagctggcgcggctggcggggcggttgttcgaatag

SEQ ID NO: 9601 - DNA, 117 bp, Myxococcus xanthus
atgcccgccggtgaccatgacgcgctggcggccacgctccgcgagattgccgaggaggtgcgcgccctacggctcagcctgaacagcggcgccacgcgggagaagcaggatgtctga

SEQ ID NO: 9602 - DNA, 768 bp, Myxococcus xanthus
atgtctgacgccgcgcctgcctggctcctgcgcctgctgaaggtgccccccgcgccgcacatccccgaaggggcggcggttcgcgtgttccgcgccgccccgacccatcgccagctccagttgctccgttggggcctgcggcaggccggcgtcgtggtgggcctgattttcacctgggtggcgatgaagaaccggttcgtcccgcacctgccctacgcgcatgcggacacggtcttcttcgtcttcgaaatgttcgcctggctcgcgttcgccgcgcaggcccccatcaccttcctggtggcgtggctcgactacgagtaccgctggtacatcctctccgaccgcagcctgcgcatccgggaagggctcgtctccatccaggagaagacgatgaccttcgccaacatccagcaggtctccatccggcagaacccgctccagcggctgttcggcatcgccgacgtgaaggtggagacggcgggcggaggcagcaagcgcggcgcgcaggacgcggacgcctcacacaccgaaggactgcacgaggcccacttccggggcgtggacaacccggaggagattcgcgacgtcatcatggcgcgggtacgcatgcaccgggacgccgggctgggtgagccgcagaatcccgagccggcgctgcccgcgccagtggccccttcagccgcgacgctcggcgcggcgaaggagctgctgggtgagatgcgggcgctgcgaagcgccctgacggcccagggccacgtggagcgctga

SEQ ID NO: 9603 - DNA, 459 bp, Myxococcus xanthus
atgctccgccacggcggctacaagcccaccgggcgtggcaagcccgcgtcggagtacctggtgcgcgcctcgggtgacggctcgctgggcgccatcaacctggccgtggatgcctgcaacgcggtgtccctgcacagcggcctgcccatcagcgtggtggacctggaccgggccaccgcccccttccgcgtgggcgtggccccggagggcgcgcagtacgtcttcaacgcgtccgggcagagcatcgacctggcgggactgctgtgcctcttcgacgcggaaggcccgtgcgccaacgccgtcaaggacgcgcagcgcaccaagacgaacgcggacacccgccgcaccctcaccgtgctctggggcgccaaggccctgggcgagcggaccgcgcgcgccttcgactggtatcgggagctgctggaacgcgcgggggccacggtggagcgcctgccctga

SEQ ID NO: 9604 - DNA, 492 bp, Myxococcus xanthus
atggagcacgtccgctaccgctacggattcacggagcggctctccggcgaggtgttcctccaacacgagttcgacaagttccgccgcatccagttccgggccctgctgggcgcgggcccccgggtgagggtgctgaccgacaaacaggccacgctggtggtggggctcgcgctgatgctggagcacgagcgcatccgccgggattccgaaccggatgccggggagttccgcaccgacccgcgcctgtccagctacgtgctggggcggctggagttcatggagaacgtcttcctggtgcagacgctctacgcccagccccgcgtgacgaaccccgccgacatccgcctgctcaacgacaccatcttcgaggtgaagcccaacgaacgcctctcggtgggcatcggcttcaacctcaccttcgacaactccccgcccctgggcgtccccaagctcgacacccagttgcggacctcggtgggcatccggctgtag

SEQ ID NO: 9605 - DNA, 339 bp, Myxococcus xanthus
atgacggagctgtacgtggagcgcgaggacacggtggcgaaggcagtgacgctcttccccaaggacacggtggtgagggcactgtcactgatgcagcggtatggcctgagccggctgccggtggtggacgacgtgcacggcgagctcatcggcgacgtgacggccgacgacctcacccgggtctggcagcacgcgccgctggcctgtatgtcggaaattctttcactgaaatccctgcgggttgaagacctggaggacgccacccgttgggggccgcgcctcaccctggtctcccccctggtggacgtgtaccagaccagcaaacgctgggtgcagtag

SEQ ID NO: 9606 - DNA, 615 bp, Myxococcus xanthus
atgcgtcccatcgaggcggagctcctgtcgggcagcgcgctgtaccgggaggtggtgttggagaagctgctccacgcccgggagtcggtgtggatggccacggccaacgtgaaggcgatgttcgtggagcacggtggccgcttcgtcccgctggtggacgtgctggacacgctcgccgcgcgtggcgtggcgctgcggctgttgcacgcagagctgccgagccggccctttcgcgccgccttcgaccggcaggcgcggctggtggcggggggcttgtcgctcaaggtctgtccgcgcgtgcacttcaaggcggtggtggtggatggcgcctgggcatacctgggcagcgccaacctcaccggcgcggggctgggcgccaagggcgactccgcgcgcaacttcgagctgggcttcgtcaccgaggacttcgacgtcatcgaccgggtgacggcgctctacgaagcggtgtggagcggcgccgagtgcaagtcatgcaagctccgcgcggtgtgtcccgaccccattctgcccgcaggcaagcgagcgcccacgccgcgccgtcctcgcgcggatgccccacgtctgggcaaggcgcgccgtcttcagcggggcacg

SEQ ID NO: 9607 - DNA, 1623 bp, Myxococcus xanthus
atgattcgtctcgacaacatcagcaagcagaacggccagcagattctcttcatcgaggcctccgcggcgctccacaagggggagaaggtgggcctcgtcggacccaacggggccggcaagacgacgctgttccggatgattaccagccaggagcaccccgacgagggccaggtcgccgtcgaccggggcgtcaccattggctacttcagccaggacgtgggtgagatggagggccgcagcgccgccgccgaggtgatggacggcgcgggcccggtcagcacggtggccgccgagctgaaggagctggaggccgccatggccgacccggaccaggcggacaacatggacaagctcgtggagcgctacggcctggtccaggggcgcttcgaggagctgggtggctacgcgctggaaggccgcgcgcgggagattctcgcgggcctgggcttcacccaggagatgatggacggcgacgtgggcgcgctgtcgggtggttggaagatgcgcgtggcgctggcccgcatcctcctgatgcgtccggacgcgatgctgctcgacgagccgagcaaccatctcgacatcgagagcctcatctggctggaggagttcctcaagaactacgacggcgcgctgctgatgacgtcgcacgaccgcgagttcatgaaccgcatcgtgaacaaggtggtggagatcgacggcggctcgctgtcgacgtacaccggcaactacgagttctacgagcagcagcgggcgatgaacgagaagcagcagcaggcgcagttcgagcgccagcaggccatgctcgccaaggagctgaagttcatcgagcgcttcaaggcgcgcgcctcgcacgccgcgcaggtgcagagccgggtgaagaagctggagaagattgagcgcgtggagccgcccaagcggcgtcagacggtgctcttcgagttccagccggcgccgcgctcgggcgacgacgtggtgagcctgaagggcgttcacaaggcctacggctcgcggaccatctacgaggggctggacttcctggtgcgccgcacggagcgctgggccgtcatgggcgtcaacggcgcgggcaagtccacgctgctgaagctggtgacgggctccacgcagccggacacgggcaacgtggcgctgggtggcagcgtgaagatgggttacttcgcgcagcacgccatggacctgctggacggcgagcggaccgtgttccaggcgctggaggacgccttcccccgcgcgggtcagggctcgctgcgggcgctggccggctgcttcggcttctccggcgacgaggtggagaagaagtgccgcgtgctgtccggtggtgagaaggcccggctcgtcatggcgaagatgctcttcgacccgccgaacttcctggtgctggacgagcccaccaaccacctggacatggccacgaaggagatgctgattacggcgctctcccgctacgaggggacgatgctgttcgtctcccacgaccgtcacttcctggccgcgctgtccaaccgcgtgctggagctgacgcccgagggcatccaccagtacggcggcggctacacggagtacgtcgcgcgcaccggccaggaagcgcccggtctgcggagctga

SEQ ID NO: 9608 - DNA, 1701 bp, Myxococcus xanthus
  unsure (1)..(1701): unsure at all n locations
atgaagaagctggtcaacgcccctcgcgcggtggtgcgggagatgctggaggggttggtctcgctcgcccccgggcaggtgctgctggacggggagtcggtggtgctccgcgccgacacgccttccgacgtccgcgcgcgcaaggtggctgtcatctccggtggcggcagcggccatgagccggcgcacgcgggctacgtgggcgcgggcatgctggacgcggcggtggccggtgacgtcttcacctcgcccagcaccgatgccgtgctggccgccatccgcgccgtcgcggggcccgcgggcgcgctgctcgtcgtgaagaactacaccggggaccggctcaacttcgggctcgccgccgagctggcgcgcgccgagggcatccccgtggagacggtggtggtggcggacgacgtgtccctgcacgacacggtggagcccgcgcggcgccggggcatcgctggcacggtgctggtccacaaggtcgcgggcgcggcggccgaggcgggcgcggcgctccaggacgtcctccgcgaggccaccgcggcggcggaggtgctgggcaccatgggcgtggccctggggccctgcaccgtgcccgcggcgggcaagccgggcttcacgctggaggaggacgaaatcgagctgggcctgggcatccacggcgagcagggcgtgcggcgcgtgccgatgcagacggcggacagcctggtggacacgctgctcaccaccatcgtcgaggaccggcgcatcacctcgggagacagggtggtgctggtggtcaacggattgggcggcacgccgcccatggagctggccatcgtcgcccggcgcgcactggccgctctgcgtcagggcggcatccgcgtggagcgcgcgtggagcgggacgttcctctccgcgctggagatgcccggctgctcgttgacgctgctgaaggtggacgacgcgcggctggcccgcctggatgcggcggtggatgcgcccgcgtggcccggcgcgggacggctgccgaaggagccgggggtgtaccggccttcgtccacggcgtctccagcatcgcttccggcggaggcgccgcaaccggggatggaccgcttccggaaggccgccttgcgggtggcggacgcattcgagcagtcggagccccggctgaccgcgctcgatagcgccgcgggcgacggtgacctgggcctcagtctggtgcgtggcgccgaggcgattcgcgctcttccggaggacgcgtggacgagccccgcgcgtgcgctgacggccattggcaatgccttgcggcgcagcattggcggcagctcggggcccttctacgcgacggcgctgctgcgcgccgcgcgcaggctggcggaagggcccgtggatgccgccgcatgggccgaggccttcgacctcgccgtcaccgccgtatcggagctgggcggcgcgcggcctggggaccgcaccatgctcgatgcactccggcccgccgccgacgccttcgcgaaggcggtgcgttgcgggcagggggctcgagaggcttgggcatcggcggtgcacgcgnccgaggcggaagaggaggcgacgtcccggatgcagccgcgcctgggacgcgccagctacctgggtgcgcgcgccgtcggtgtgccggacgcgggcgccgcggccgtggtggtgtggatgaaggcgctcacgcctggcatcggctga

SEQ ID NO: 9609 - DNA, 768 bp, Myxococcus xanthus
accctggaacaagccgtcaaggcccggccgatgccgcgccacgtgggcatcatcatggacggcaacgggcgatgggcggagtcccgagggctgccccggctggaggggcaccgggaggcgacgtcgagtgtgcgtgaagtgacgcgcaccgcgcgccgcctgggcatccaggcgctgacgctctacgcgttctcgtcgcagaactgggcgcgtccggcggaagaggtcgccggattgatggacctgctccgggagtatctggagcgcgagcgctccgaaatcctggacaacggcattcgcctcaacgccattggagacgtggaccggctgccgcgctacgtgcgtgatccgctggaccggctccgggccgactccgcgcacaacaccggcatggtgctgtcgctggcgttgtcctacggcgggcgggaggaaatcctccacgcggcgcggcggctggccgaggccgtggagcgaggcgaactggcggcgggacggttggaggagagcgacttcgagcagttcctctggacgcagggactgcccccgttggacctgatggtgaggaccagtggggagctgcgcgtgtccaacttcctgctctggcaaatggcgtacgcggagatgtgcttcaccgacgccttgtggccggacttccgtactgacgagttccttcgctgcgtgtcgcagtaccagcagcgtgagcgccgcttcggcctcacgtccgcacaggtgcagcgggaggacgctcctcagcaggccaaggcgtga

SEQ ID NO: 9610 - DNA, 603 bp, Myxococcus xanthus
gcccttgcgcgccttcgggagggcaatcagcggttcgtcctgaacgcgcgcaacatggagaacccgctcggccgctccgcccggcaggcgctggtggcggggcagagtcccttcgccatcatcctctcgtgttcggactcgcgcgcgccgtcggagtacatcttcgaccaggggttgggggacctgttcgtcatccgcgtggcgggcaacgtcgtcgcgccgtcgctggtgggcagtgtggagttcgcggcggcgaagttcggcacgcgcctggcggtggtgatggggcattcgcactgcggcgccatccaggccacgctggactacctgcgtgacggcaagagcgaggcgtccgagaacatccgcgacatcgtggagcgctgccgcgagccggtggcgacggtggtgagcgccgccgggccgaaggcggacccggagttcctgatgaaggagtccgtccgcgccaacatccgcaactcctgcgacaatctccgccatggcagccgcctgctggagcgtctgtgccgcgaggaaggcatgctcatcgtcggcgccgagtactcgctggagacgggcgctgtcgatttcttcaacggcgtctga

SEQ ID NO: 9611 - DNA, 111 bp, Myxococcus xanthus
ctggagagtcagatggcggccatggagctgccctcgcgcgcgctcagcgtggacgtgacgcgcccgccagcggacatcgtgaagcacatccgtgacgagctgggtgtctga

SEQ ID NO: 9612 - DNA, 711 bp, Myxococcus xanthus
atggccgagctgcagtccttccgcgccgacttccgcgtgcgcatcggcgacctcgtgtacctcaccgcctcggccttcgccgacgtgcgccgcgaagaggtggtgcccggctacgcccaccagctgggcgcacgggcggcgctgcgcgcggcggcggcggacctgcgccgctccctgcaaggccggctggagcgcgcggcgaaggcggaggcccgcgcgcgcccctcgctggcacggcaggtggcggagagcctgtccgccttcgtatcccttcccgcgtcagtggcgctgcgcacgccgcagaagcaccaggtgctggagctgcgcgcacggctgctggacacggccacccagtcggagctggcgccggacgcgctgccagagctggtggagccctacctcacgacgttggatgagcagatggaggaggtgacgcgcacctggctcgtcgtccatgaccgcgcgatgtgggccacctgcggcatgaagctggaacaggcggacatgcacctcacgctgggctcacgaggcgcggagcgcgtgctggcggaggcggtggaggcggcgggcgcgctccagggccgctcggcgcccttcgacgccttcctgcgcaaggcgaggcaggaggcgggcgacggactggacgaggcaggagcgcgggagctgctcggccggtttcgggagcggctcgcggccctgcccttcagttga

SEQ ID NO: 9613 - DNA, 525 bp, Myxococcus xanthus
atgtcggagcagttggaggccttgctgtcgctgacggacgcccaggccatgttcgttccgcagccgcgcacctactccagccaactgacgtatggcctggatgagctgatttccactgtcgcgaagccacccacccacccgctggtagaaagcgaagtcatggcgaacgtgaagcagtccctggaagagacgctgaaaatcgagggggccttcgcggcctgtctggcggactcgaagagcggcatgtgcctgggcagcgttggcggcagccccgccttcaacatcgagacggcggcggcggccaacaccgaggtcgtgcgcgccaagacgaaggccatgagcatgctgggcatcaaggaccgcatcgaggacatcctcatcacgctcggcgagcagtaccacctcatccgcccgctgacgggcaaggagggcctgttcctgtacgtggccctgcaccgcgccagcgccaacctggcgatggcccgctacaagctgtccgaggtcgagaagtcgcttcaggtgtga

SEQ ID NO: 9614 - DNA, 237 bp, Myxococcus xanthus
atgtcctgtccacagccacgacccaccgagttccgccttccgctgcgggccgagtccttctccatcgacgagcaccgcaacgtgcactgccgcttctacggcggctgcatcgacgtcgcggtgaagaaggactgggatagcttcacctgcgccaagtgccctctgttccacgaggaccaggccccgggcgccagcgcgtacgccttcaaccagcccgcggatccgggccggccctag

SEQ ID NO: 9615 - DNA, 638 bp, Myxococcus xanthus
atgctgcgccagctcctgctctccgacttccgttccgagggccccgccgccggacatggctggccgctggtgcagcacacgtttcccaccgtgcagctcgcgcccctggccgccgggcgcgggggccgcgtgctccacctggacgcttccgaatggaacgcgccagccttcgaccccatcgcctgggacgctcgcgtcttcgaagcggcggagagcaccgaatggctgtccttgcatctggacggcgcgagctgtgaggcgctcgtcgtggccgcgctggaaatcctcacccgctaccaatgtctggtgcggcgccgcaacgcggcctcggccacaccgctcttcagccggctgctggcgcggtaccgctcgctgcatgatttagagcagccccgggtgcgcgcggagttccaccgcgcggtggatgcctggcaatggacgctccggctgcggccagatgtggaccttccgccgcaggccgcggccttcttccatgaaggggaacaacccacgacgccgcttcacgccgtccgcccggtgcgggtgttggaggaggcccgtccggatgaggtcacctgccggcgcgtccgggagttgcttacgcgcgacgcgcgcacaaccaagcgcggggggtgtcc

SEQ ID NO: 9616 - DNA, 2262 bp, Myxococcus xanthus
atgatgaaggccctggtgacaaagggcacggccgccgtgttcctggtggacggggaggggaaggagacgccgcttccgctgtcgaaagggacggagtggacgcgcaccacggacgaccgggggctgtcggcccgcgttgtgctgccggaggtaccggacggtgactaccagctccgggcccgcgtcacctcgccgctgggtacggacaccgtggatgcgccgctgccgctgtatgccaatgccctggcgcatgtgctgacggaccggcccctgtacgagccgggccacgaggtcctcttccgcgcggtggtgctgagggccaaggacctggcgccgttggatgggcggccggggacgtgggtggtgcgggattccaccggcgaagtggtgctggaggagcgcgcgccggccgggccctggggtgtggtggccgggcgcttcccgctggaccggggcgcgccgcaaggaagctggacggtgagctgggtgagcggcggggcgcaggcctcggcgtccttcgaggtgaagcccttcaccctgccgcgcttccgcgtggaggcgcgcagcgcccggcccttctggcgcgtggacgaggtgccggtggtggatgggcaggtgacgtatgcctcgggcgcgccggtggccgacatcgaggtgggcctgacgtgggacatccacggtgactggcccgcgcccacggagtggcaggcgggaggcctgccaaatcgtgcgcgcacggacgccgcggggcgcttccgcctgtcgctgccacgtgtgcccatggacctgcgcggacaggcccaactggtggcgcgtttggtggcgcgggacgcggcgggagaccgcatcgaaggcggcgtgtcgctgctgctgtccgaggacgcgctgcaggtgtcggcggtgacggaggtggagggcggactggcgccgggcttcaacaaccgcgtctacgtgcgcgcgacgacggccgcggggcaggtgctgccgggcacggagttgacggtgaagcgcgcctgggatccgcgggacgaaggcgtgcgcgcgatgacggacgaggacggcgtggccgtcttccagctcgaccccggacctcccgtcaacgtcgtggtgccgcccatgcccgtgcgtccgccgctgcccgagcccacggtgcggctggggcagacgcgcaacctgctggcgccagggagggaggcctcgctcgaggatctgctcgcgttggagaaggcgttgcccgcgctcgagccctgtgcgcgcttcgtagcgagcgagcagggagagattgacgtcgagctcggcctgcgcgtgagcgcttcgggcgcggtgctggacgtggcgacaggggcgagctcattgcccacctgcgtggcctccgtgctgcgctcacgcacgctgcccgctgggcgagagcgggtcctccacgtgggcctgagcgtcatggacccgggtctgccggagttggccgtggaggtggagtcggcctatggcgcgcctgaatcgctggtggcggctctggccgacgcggcccgtgatgcgcgcacgtgtctgcctcgggacctgggcatggaagccccgttgtctgcggccttgagctggcggctggggaagcgaggcctggagtcgctgacctgggtgacgctgccgaagcagtcgggctcgctggccgcgtcagccctgccttgcgtccaggagcgcttcgcgcgcgtccggctgccagaatcggcgcggacggagaatgccctgggcgtggcgtacctcaccgcccatccatccgccggaatggagcaccaggacgtcgcccaggccaccaccttcctgggctacgagctgaaggtgagcggcacgcagggcggtgaggtcgtgggcgaaacgaagctggtgctgcgtccggcggaggtgccacctacgcgcctgcgcgccacgccggtgctggcgcgcggcggcgaggaggtccgcatcgagctgatgcgcggcccccagttcgagggcccgctgcccggcaccctggtgctccaggcgggcaaccaacgaatggaagagaaggtggacaaggcgacgcgctcggtccgcttcaagctgcccgaggacttcgagggctgggcgatgacgtactgggagggcgcgcaggggcgggtgtacgtggcgccgcgcgcgcagctctccgtggaggtgacgccggacaagcagcgctactctcccggcgagctggcccggctccagttgcagacgcgggtggatggccaggactttagagcacactgg

SEQ ID NO: 9617 - DNA, 294 bp, Myxococcus xanthus
atgagtgacgcacccaagcccttccttcaccgtcccaaccgccagctcatcaccaaggagccggaccccgcgggccgttggtccaagcagttcccggacatgattggctacgccagccagggcggcggcaaggtgccggccgactacggctggaacaccaaccccaagcagtggcaggaggagatgacgtcggagtcgctggccgcgcgctacggcgagctgcgcatcctcccgccgaagcccgagtcgcccgcgctgcccgagggcgcgaaggccgaaggcaccaagccgtaa

SEQ ID NO: 9618 - DNA, 204 bp, Myxococcus xanthus
atgggtggggtgctgcgggtggagctcctccatgaccggcgaggctggggtgtggaggtggagacgtgggccggggccgtgcgtcgataccggtatggcagcgaggcccaggcccgcttcttcgccgcggtgttcgaaatgggcccccgcgtgctgccgccggtgagcaccgggcgccgcaagcggacccgccgggcggcctga

SEQ ID NO: 9619 - DNA, 192 bp, Myxococcus xanthus
atgggcggatgcaactacacgctgtccgtgacgggagaagggtattcgggctggcgcacctgccagcctgggacgacgctccagccgggccccgtctccctgtccctgcccgaggaagtgctgcgcctcgggcagggcgagagggcgaccctgctggcgctattgctgtcggagacgatgttgccgccgtga

SEQ ID NO: 9620 - DNA, 609 bp, Myxococcus xanthus
atgcgggacgcggcgcgcacgggcgagacggccttctggctcaccatcgtcttcgcgttcttcgcgtggatctaccacctcttcaagggaccgctggcggaggcgcccacccgcacggcgcacctggtcaacggcttcctctacggcgcggtgggcctcacggccgtgtccgcgctgcgcctgttgcccgaccacggcttggcctgggtcatctgcgcgctggtcatcacctgggccaatgacaccgccgcctacttcttcgggcggttcctggggaagcacaagctctacccggaggtgagccccaacaagacctgggagggcttcttcgggggcatgctgggctcggtgggcggtatgttcattgcccggcagttcttcttccccgtgttcacggtgtgggactgcgtgctgctgggcatcgccggcggcatcctggggccggtgggcgacctgtgtgagtccatgctgaagcgggcctacggggtgaaggactcgggcgtcctcatccccgggcacggtggcgtgttggatcgcatcgacgcgctcctgttcaacgcgcccctggtgttcgtctacgtgcagttcgtccggggtctgctgccctag

SEQ ID NO: 9621 - DNA, 801 bp, Myxococcus xanthus
atggaggttcggcggccggtcgccgagctgggcgcacgggcctatgccatccaattgttgtctgacgcgcgaatcccgttcctggtcggcggcgcctacgcgttcgcccactacacgggcatctatcgcgacacgaaggacctggacctgttcatccgcaaggacgacgcggaccgcgcattggaagtgctcgcgcgcaatggctggagcacacagagcaatgtccacggctggctgcacaaggccttctgggacgacttcctcgtcgacctcatcttcgcgtccggcaacggcatcaccgtcgttgacgacggctggttcgagcacgcggtccgtgcccggctgctgaactgcgcgtgcaatgtgcctccggcggaggaaatctattggagcaaggccttcgtcctggagcgagagcgcttcgacgggcacgagctcacgcacttgctcctgaagacggggcgcacgttcgactggccgcggctgctggcgcgcttcgaccggtactgggaggtgctgctcgcgcacctgatgttcttccgcttcgcgtaccccgcggaccgcgacatcgtcccggagtgggtgatgcgcgagctgctctcccgcgccaacagctcgctggcggagggcaactgggactcgcagctgtgccggggccggctgttgtcgcaggtcagctaccaggtggacgtcgacgagtggggctacgaggacggccgcgcctgggatgaatccgagcgcaggcgcgagtgcgagcccgaagcggtgcccgccgcgagcggtacatacggcggccactga

SEQ ID NO: 9622 - DNA, 873 bp, Myxococcus xanthus
atggtgctgggcgtcctggcccggcacagtgggaagttcccggagggctccgccggggcgttcaacaccttcgtgctgtacgtggcgctgcccgcgctggtgctgcgggccatgcaccagttggtgttcgtgccggagctcctggtcgccgcctcggtgccgtggctctactacctgggcgcggggccgttcttccggctgctggggccccggctggggctgtcgaagccgtccatcatggcgttggtgctgacggcggggctgggcaacaccgctttcgtggggctgcccatggcagaggcgctgctgggtgccaagggcctgccggtggcggtggtggtggatcagctcggctccttcctggtgctgtcctcgctggccacggtggcggcggcccgggcgggcgcggacacgccgctgtccctgcgccaactcgcacgcaaagtggccacctttcccgcgttcctggcgctggtggtggcgttggcgacgcggccatgggcctatcccgtctggctggacggagtgctggagcggctgggctcgctgctgacgccgctggcgctgttcgccattggcctgcaactgcgcctgtcgggcatcaagccccggctgcccgcggtggccctggggctgtcgtacaagctgttgctggtgccggcgctgacggccgcggggctgctggccctgccagggctggcgcccacggtggtgcaggccacgctgctgcagtcggccatggggcccatggtgagcgcggccatcctcgcggccgagcatgacctggacccggacctggcggtgttgatggtgggagtgggcgttccgctgtccttcgcgacggcgccgctgatgttgatgctggcgcgctga

SEQ ID NO: 9623 - DNA, 1485 bp, Myxococcus xanthus
atgtcacagtccaagttcgtcggcgccctcacgggcctggcgctgctcgccggttgcggcggtagcgatggcaccacccccgcctccgaggagacgctcggtcaggggatgtcgtgggaggagttcctctctctcgtgtaccaggagcccgacacgggcatcttcatcgctgacggtgacacgacgttcgcgaccgagaagcacctgcgcgagttctatgacaacaacgtcaagaacgggcagctcatcgtccaccgcgtgggcggggcggacgcgaagtggaacgacacgcagaagctgaacctcacctactgtgtgagcaccaccttcggtagcaactaccaggcggtggtcaacgccatggccagcgcgacgggcgcgtgggaggccgccggccacgtgaagttcgtccacgtgagcgcgcaggactccaactgcaccgcctccaacaacaacgtgctgttcgacgtgcgccccatcaacgtgaatggccagtacatcgcccgcgcgttcttcccgggtgacgcgcgctccagccgcaacgtcctcttcgacaacagcgccttcggccccatgggcgtctggacgctggcgggcgtgacgcgccacgagctgggccacgtgcttggcttccgtcacgagcacacccgtcccgaggccggcggccagtgcttcgaggacagcaactggggcgtgctgacgacctacgacagcgcgtccgtcatgcactacccgcactgcaacggcacgcagacgggtgacctcgtgctgaccacgaaggacgtccagggcatccaggcgctctatggcacgccgaacggtgagccgcccccgccgcccccgccgcccccggaaggtgtgcccaccacggagacccgcacgggctctgtcggcgcgaacgcgaacgtcaactacggtcccttcaccgtcgttccccgctcgaccttcaaggtcgtgatgacggggacgggctcgggtgacccggacctctacgtccgctttggcgcggctcccaccacgaccgcgtacacctgccgtccgtacctcgccggcgccaacgagacctgcgagctcgaggtcccggaaggcgagaccagcgcgtacatcatggtgcgtggctactcggccgccagcttcagcctgaccatcaactacctcgcgcccctgggcggtggtagcggcacgcccacgagcgagacgcgctctggttccgtgacctcgggtggcagccagaactacggccccttcagcgtgaaggccggcaccaacttcaaggtcgtgatgacgggctcgggtgacccggacctctacgtccgctttggcgcggcccccaccacgagcgcgtacaactgccgtccgtacctcgccggcgcttccgagacgtgcgacatcgccgtgcccgcgggccagaccaccgcgtacatcatggtgcgtggctactcgtccggtacgttcaacctggccatcaactacaccaagccgtag

SEQ ID NO: 9624 - DNA, 1506 bp, Myxococcus xanthus
atgaagcgcctggtgcgcgcgctggaactcaacgcggacaacgtttcggcgcgggagctgcttggcgccaccctggatgcgcgcgtggcggcgggcaacgtggcgttgaaggcggaacgattgcaggacgcgcgcacggagttcgacgcggtgctgtcggtggcgccggaccacgcggccgccaagcggggcgtggacggcgtgcaggtggcctgggcgcggcgttggttcggcacgggtgagggcctggagaaggccggcaagctgggcaacgcgctggtggcctacgtccgcgcggaccaggagcgcgtgggcgccaccgcggcgcgggagcgggccgaggccgtgcgccagaagctgcgtgacgaggtggccttcctggtggtggcctcgccggtggaggaccgggccggagcgccggacgtggcgcagcggctggcggccggccggctggcggcgaggctgcccacgcaactgcccctgcgcgtggtgacggaggccccggcgggccgcgaaggcgtgacgctggatttgtcactggagcgggtgctgccgctccaagtggtggaggagtctcagcgcacgcagcgctacctcgccggaaatcgctccgtgcccaacccgcgccgcagcggcttcgagacccagctcctgaaggccgagcgcaccctggaggatgtggagcgcaagcaggccgccgcgctgcgggagtacctgcgcatgcaggcggagctgtccatggtgcgcgtggccgcggagcgctgccgcgagcgggagcgccgccagtgccgcgaggccctgcaggattgcggcgaggccgcccgcgaggtcagcgggccggggcagttccccagcgagtgcaacccctcacgctgcgacaacaaggcgtgcgtcgccgaggaggtgctgctggtggccaaggccgccgcgtccctgcagaaggagaaggcgctggaggaggcgctggacaagtccgaggggcagcgcacgcaggtgcagcgccaccgcgacgccaccttccgcgagcccatcaccgtggaggagcccatgtattcggacttcgtgttcgacgtgcagctccaccggctcaccgtgacggcctccgtcaccgcggtgatgcgggacctcatcaaggagcagcaggtgcccgcgcccaacacgcaggactacgcggtgatgcacgaggacacggcgcacaagggctatgaccggtacggcgtgctcgcggacccggtgcaactgcgcaacgaattggagctgcgcgtggaggtgggcgacaaggcggtgtccgacgttgcccgccgcgtgaaggagcgcttcgacgcctaccgcggcaagcgcgtggaggatgcccgccgcggcatggtccgccccggtgccgaggacgtggtggagaccgccgtgcgcgcgctcctgctcaccgcggacgcgccgccgcaggacatcctccagccgctgggccgtgcccgcggcctgaatcgtccggagagcctggtggggctgtag

SEQ ID NO: 9625 - DNA, 198 bp, Myxococcus xanthus
atggactcgctgtcgctcaacaagttgaaggagggctcgctcgtcatccacgacgcgtccttcgtccgcaagctggcgcggtgctgggccagggacctgcggcactcgaaggaaatcacgctggagaatgggggccgcaccaatccctggcggcggctggcccgccgggcgacgcagctcgtggggcaggaccggtag

SEQ ID NO: 9626 - DNA, 3636 bp, Myxococcus xanthus
atgaatcgtgacgatgagacggagctctggctcgcgattgacgaggggatcctgtcccgcgaggaggcagcggccctgcttcaggatgcgcgacgcctgggacgaagcccactggagttgcttcaggagcggggccggatttcggaagagacacttgcctctctgatgcgggagaaccttgtcctggaggagcgcccgtcaggtgagcagccctctcccgagcagaccgttacggtcgacccggtccgggctgaacaggcattggccccaggggacgccgacgtccctgctttcccgctcctcgggagggagcgataccaacccgtgcggttcctgggacagggcggaatgggtcgtgtgttcctggcctgggacccacggctgcgccgacaggtcgccctcaagttcgtccgcgacgaggaatcgcacactcgccgcttcgtttccgaggcccgtgcccaggccaaggtgaaacacgagcgcgtatgtcaagtgtatgaggtgggccacgtcggggggaaggtcttcatcgccatgcagtacatcgacggccagtcgctcggcgctcaggtgcgctcgctcaccatcgagcagaaggcactggtgatgcgcgaggctgctctgggtgttcatgcggcccaccgcgtcgggctcatccaccgggacatcaagccttccaacatcatggtggagtcctccgacgacgggactcccaggccctatgtgatggacttcggtcttgcgcgtgaatggaacgagtccgtcacggccagtggcgccgtcttggggacgccgcactacatggccccggaacaggctcgcggagaggtgagcgggctcgaccgccgcgcggatgtctacagcctgggggccaccctctacttcctcctcaccggcgaggtccccatccctggggccaatggcctggaagtgctcaacagcatcgccaccgaggagccgcgcgcgccgcgcctgcttgctccaggactcccggcggacctggaggccattgccctcaagtgtctggagaaggatcgcgacgcccgttacgactcggcgcgtgcattggcggatgacctggagcgtttcctgggcggcgagccggtgctggcacgcacgagcttcgcgtactccctgcgcaagcgcctgcgcaaacaccggctcctgaccacggtgggcgccgccgcgctggtcacggcgggaggggccctcggttggggcatccgggcccgccaggaggccgccgagcgtgagcgaatcgtccagcgattcaccgagctggtggagggcatcgagtccaggggccgctactccgcgctctcgcggctgcatgacatccggcaggaccgccgggcactccaggcccagatggccgaactggaggcggagatacagcgctccggtccacaggcgctgggccctgggcaccatgcgctggggcgtggccacctcgcgctcggagacgaggcgaaggccctggagttcctggagtcctcctggcgcaatggctttcgctcgccccgggccgcgtatgcgctcgcgctggtgagcgggcggcgctatcagcagcaactcctggaggcgcagcgaatccgtgtgccggcgctgcgggaggccgcgacgcgtgaagcggagcgcctctaccgggatccggcgctcgcgtggttcaagcagagtgaaggcgctcaggtgccctcgagggaatacgtggcggcgctggtcgccttctacgagggccgcttcgatgacgccctgctcctggcggatcgcgccgccagcgagctgccctggtttcatgagctgcccatgctgcgcggggacgtccatgcggcacaggctttcaaacgctggaacgggggagaccccgagggagcccgagcgagcttcgaagccggtcgcaaggcctacgccgccgccatcgccaccgctgaaagcgaccccgccgtctaccggtccctggccttgctcgaaaacgatgcgatggtcatggagctgtatggcaggggggatgtcatgcctgcgtaccaccgctccctggacgcgctctcccgttgtctcaccattgctccggacgacgcccagtgtgttatccgcatggcgcgcgcgcaccaccgcctggccgagcaccggctcacccatgggggcgatggggaggagcctctcgcgaaggcgctggaggcagcgcggcgtgccctcttggtggagcccgggcttccggcggccacattcaacctggctcggagcacctggctccaagcgcgctatcaaatcgagaggggcgaggacccacgcgcgctgctcggagaagccgccgcgttgttcgcgagcatcggcgtggcgcaccgggaccgcgcctaccacggcgattcaggtctcgtcttcacgacatgggcggactacgaggagcagattgggagggattccggcgggaacagggacaaagccatcctcgcctacgaggcggccatcgccttggacaatcgtgtccccgaggactggatcaacctgggtcgtgcgtttttttcacgggcttcccgtccactcaatgcggaggcggagcaggacctgcggcgggcggcggcggcactcgaggaggctcgggccctcaacccccagcatatggcgctgtacttctatgcggggcaggtcgacgagcagttggctcggcggcggggtcgtcgcggcgaggatccgcgacccgtcctggcgcatggattggagcagtatcagcggggcattgaaatcaaccgccggatccccaacttccataacggaatgggcgtggtgcacttgctgcgggccgaggattcctggaaccggggtgaggatcccctgcccgcgctggagcaggctcggacgtgcttcgaacaggccatcgctgtcgcgcccggacagggctttgcctatgcgaacctgggctctctcttcgtccggcgcgcgcactacctgctcgcgcttggcgagtcgcctctttcgagcacgcatgaggcaagggaggcactgagacaagcctccgagaggatgccgggggccgcgtggctgctggtcctcctcggcacggtgcatgtcatccaggcccgcgtcgagtcggaccaagggcgagaccccggggctgccatcgctcgcgccctgaaggaactccacgccgcgttggaggtgaactccttggaggcggagccctggctccagcttggcaaggcgcaggccctccaggcgcactggaaggcacagcgcgggtcgctccagaccgagtccatggaggcagcggcgaagtccttcgacagggccctcacgctctctccagacgacccggaatatcgcctggaggctggccgcttctaccgacggtgggcggaacaccagaatcgcacgggtcgtgaaaacggcccgctccttctgcggggcctcgaacacgccgagcaagcgctgaagctccggcccgactgggccgcggcccgcgccctgcgggccggtttgaagttggagtgggttgaagccgagccccccggggacccgtgcacctggaggcgccaggccctcgatgagctgacccaggcgctcacgcacaattcaaacctctctaatgagtggggtggcccactcgcgggcgcacagcggcttgccgcatgcccctga

SEQ ID NO: 9627 - DNA, 4824 bp, Myxococcus xanthus
  unsure (1)..(4824): unsure at all n locations
atgtggttcgtcggggccttcctcatcctctccagtgccctctacctcgtgttcgagagttgggtggggatgtcgtccggcttccgctcgctcacggtgttcgggctgacggcgagctgctccgcgggcttcaccggttggggcgcatacctcgccaggcgcgaggcgttacgcaagcctgggtacatcctggggctcatcggtacagccgtggctccgctcgctggtatcgcactggggcccatgggcttgggggacgtcttccaactgggaggcgtcggcacggtgtggctcatccccgcgctgctggcatgggcggcagttgcggccttcctggcgcgcaagccgctggaggccttcgattccacgtcccgtcccttcatccaactggcgctcgtggccagtaccttgatgatggggttggcgccgctcgccgcggggcagggcggcctggcgctgtggctcaacgtcctgccgtgcgcgctcttcttcctcttgtcctcgcgtccgccaccagcgccgcgtgagggcaccgcgctcgctttcgtcctcgccgcgccgctgtacctgctgctgctctatttcgcgcgcctgcacgtcgcgctggcaggcgcggacgtggcggtctccgttggcacctatgccccgttcggcgcctttctcctggccaccgcgttgcgcttccgcacgctggatgccgagcggggcgcggattcgctgtccattggcgcggtgtcactccaggccacctgcctcatcgccgcggcactggctccggcgccggcgctcttcgtcacagcggcggtcatctcgtggacgttgctgtcgctgtcgcgcggcggcgtcgctcgcatccggtgggtctacgcggcctatgcgagcacgtacttggcctatgcctgcttctgccagctcatccccgggccggtgcggcgcatcatcaatgcggtgaaggcctggttcggttacaccaccgagccgctgccccttcagttcggagcgctgtccgcgttgcccttcatcctcgcgggcgcgttgttcgccgtgtcgcggctgtggcgaggtcagcgtacgggcaatgcacgggacctcgcgctggcggaggtgctgctgcgcgccaccgcggtggcgagcccgctcttcgtcttctttggcctgtcgggaccggacgctcggccctccttctggagcgcgctggcgctggcggtgctgtgtctcgtcctgggcctgctggtggagcgtttcttcctgacggtggtgggggcggggctgtcgctgttccttcccttccaggcctacgccgtcctgggggcgtccggcggcgcggtcgcgtcgggggcgctggccctcgtgctcgccgcggtgagcatgctgtgcaccgcgcgcacacgcgggttgctgggcgctgtcgtgggcgtggtggccacggtggggttcctcatgggcctgactgccggtgacggcttcacggccgtgacgggcatggccctgtgtggcgccgccgcggtgcttgtcgcctgggtgcttcagcgtgcctccctcatggcgttggcgtccgtgctggcggcggccgcgcttccgcgcctggcgggagagctctcgcccacggcggtggcgcccacgctcgcggcggtggcgctcgggctctcgttgctggggatgcggggtgggctggcgcggtggctgggcctgccgggcgtcttctacgcgatgctcgcgattccctggggcgtgctggcccaggcgccggggctggccggcatcatcctggtgtccgcgggcgcggtggccgtggcgtcacggaccttcccggtggtgcgtcccctcgcggtgctcatgtcggccctggcgctggtgcacgacatcccggggctctattcgccatgggggggatggatgtcaccgggcctgtccgtggcgctgttctgctgctgggccctgggggcttccgtcgcggcggcgcggtggggtcgaggcatcagcgcgacggtcgccgggctcatcgcgctcgtcttcccgctgacggccctgctgggcgcgcgttcgtcggagcaggcgcccctgttgctgggggcggcgctcgcggcgctgctcaccgcgcgcgtactgcccgcggggctgagtgtcgccgtggccgcgctctatgcgctcaccgcgacgttcagtttcggcgccgtgccgttgttgtgcctcgccggggtgttgagtctcctggccgtgctggaggaggtccccgcggtcttgcgcgtgggggcgggcggtcaccgcttcgccctggcggcgacgttgtcctccgtcgtggtgctgggcgtcgcggtggtgaagtgggacgacgcggggctgccgttgctgctcgtgggcacctgtgtgctgcccctgctctgggcgcgagccaatcgccagccgttcttcgcgtcgctcgctgtcccgtattccttcgtgggcatcgtggtggtggggggcgatgtgccctcgtgggttcgggcgcttccgctgctgagcctggcgctggtgcgtgtcgtggcgcacgtccccgccgcggcatcgctgctgctgcgctcgcgtgaggaggcgcctcgccaggcgctgtcatcgtggatgcagggatggctcgccgtggtggccctgcccgtgctcctcgtcgcgctcaggccgtaccatgtccccacatcgctctatgtgctgttggcgtccctggcgctgatgcccggaccgcgtcccgtcttgcgcgtgtgcggctccgcgctggccctcctcttcttcctggaggcacgtcccatcgtcattggcctgctgctcgcgctggccatcgcggagagtcatcggcccgctcgcgtgtgggcgttcttccggagcgcgccggacacagcactgcggcccggcgccgtcatcacggcgctcatcctcgcgacgctgcccaccctctattcgcccacgccgtctcatctggccacgctggcgggcgtgttggcgctggccgcgttcctgctgtctcagcggtggctgctgactcccgccatctgggcgttggcgttggcgcccatgggcgcggtcagagtgaacgagctgttcgagcgggggctcgacgcgggcctgtccgtcatcgccgtggtgttgggcgcggccgtggcgtccgccgtgttccagtccggacgcctccaacgcgcgctcacccaggccttcgcgaaggtgttgcctccgctggaagacacctggagcgagccgctgtgggtgggcagcgccggtgcgttgggcgcgctgctgctggagcgcctgctcctgtcaggccctggctcgctgcctctgccggtggcggtgggcgccgcggtgacggcgtgtgtgttgatggtggcgagggagcggtggatggccaacgtggccaccgcgttgctgggggcctcgctcgtcgccgccgtggacccgctgtgggtgcccgctgtcgtcagtggaacagggctggcgctatgcctcatcgggtcgctcgtggacgctcgcggtgtgcgcgtgggcgcctcgttgcaccatggcggctgggtgctggcgctgctgtcgctcgcgggcttgcgcgaactggagcacgtgggcaccccgctgacgttcctcttcggcgtgggcgcggcgtggcctgtggtgtgncggcgtcgcgagcgcgaggtggtggggtggctggcctcgctcgccgccgtgcacggatggctgctgtacctgggcgcggtgtactccagcggccggggcgcggcgttcatcctgccgtacctcggagcggccagcgcgctgttggcggccctctcgctcttcgtggccagcaagtcgcggcgccggagcgtggggcacggcttcgccggggtggcgctcttcgaggtgatggcggggttggcgctcgtcgacacgtcgctgggcgcgctccgcgagggactggtggcgagcgtggcgctgggcgtgctgctcttcgccctggtccgccgcgcggccacggagaaggaagaggcgtccgcctacatggcgcaggtggtgctcgcgctgggctatctctccgtccgcatgctgggaatgggggcgcacccgggccccggcgacagcctggcggccctggtgggcggtgcgctgttcaccggcctctacttcttcgtgcagcgcgagggttcctccctggcgtgtttccgacgccccgccttgttgggcgcatatctcttcccgctggcggggttgctctccgctccatggagcgacccccttcacgtggcggcgttgatggtggggtatgccgctcacttcgccgcgctggccacgcacccgcggcatcggggcatggcgtcgctgacgtcggtggtggcgttcaacgcggcgctgctgcttgtgtggcaggggacgggcgcgggagaggcgcagttctatgtcatccccgcggggctctccctgctcgcgttgctgcgcgtgttccgcgaggccatcgaggtggagacctatgcccggttgcgtgcgctggccgtcaccgccatctacgttgcgggtgcctggaagccgctcatgttcaatgatggcggttcgatgctcctgtgcgtcacgctctgtgtggtgggcgtggcgtgtggcatcgcgctgcgcatccgctcctatatgtatctgggcacggcgttcctggtgacgtgcatcgtcgccaacctggtgcgcttcggcatgcgggaccaccggattgccgcggcctcactgttcgttctgggactgatggtcattggttccatggtgatgctcagtgcgcaccgcgcggcgctgctccagaggtatgcacgggtgcgagccatgctcgcgacctgggagggctga

SEQ ID NO: 9628 - DNA, 84 bp, Myxococcus xanthus
atgtcgcgctccatcgtccagcgctccctccagctcgtgggcatgcgcagcctgcgccgagtcagccgcggcgttccggcatga

SEQ ID NO: 9629 - DNA, 960 bp, Myxococcus xanthus
atggacagcgtcgcgagggtcaaccgcctgtacatcgacggcatgcaggtggctcagaccaccacccctaccgcgctcactccggcgagcctgggcacgctcgcgaatgcgtggttgggtcgttccgcctattccgcggatccattcttcaagggctcgatctccgagttccgcgttcacggcgctgcgctgtcgtcgaatgacctcaccgccagctaccaggctggcccggataccgtgatggcgcctggcacggagcacgtagtcatcgacgggcgaacggacgtcgcgggcatggccgcggacaccacgagcgtgtactgggtcgagaaacgaaccaacggccaggtgatgaaggcgtcgctctccacgggtagagcgcaggtgctcgcctccggccgcgaaaacccgagcgccgtgaccacggatgccacgtttgtctactgggtcgaggacgacaaggccatcttcaagatgcccgtcaatggcgggagcatcacctccctggcctcggggctatcggggattggccagctcgtcacggatggcgcggaactcttctggacccagggaggctccatcctccacatgccggtccagggcggcacgcctgccattctctatacgacggccctggctggccccctcgcagtggatggtcatcatctctactggatgcagccgggcggcaccatcgtgaaggcagccaggcccggcggccctgcttcatccctctggaattcgtcgaacgccaccacgggtatcgccagcgacggaacggacctcttcatcgcggagaacctgagtccatacgacatcctccggctcccggtaggagggagccagtgggcgctagcgtttgccgtcaggtacggcaacatcacgagccttgccgtggggcccaaccgcgtcgcctggttcgaccccagcctcggtgcgattctcgccaagggcaagtag

SEQ ID NO: 9630 - DNA, 1066 bp, Myxococcus xanthus
gtcctcatccggggcgaaaccggaactggcaaggaactggtcgccccaggcccttccaccgagccggagccagcgccgaagtcccttcgtcagtgtcaacctgggcgccctcccgaaggaactggccgcggcggaactcttcggcagcgtccagggagccttcaccggtgcccaacgcgaccgtaagggcctcttccaagccgcggagggcggcacgctcttcctcgacgaggtgggagaggcctcatccgacgtacaggtcatgctcctccgagtgttggagacgggggagctgtacccggtgggggccagcaagcccgtggcgacgaacatccgcctcatcgcggccacggatgcggacctggaagcgcagatcgccgaggggcgcttccggtctcccctccttcaccggctggccggctatgagctccggcttgcccctctccgcgagcgccgggaggacatcgctccactgttcctccacttcgcccgccaggagttggacgcgctcggagaggcccaccacctcaccgcgagagaccctcatgcactaccttggatgccatcagacttggcggcgcagctcctgctgcatccctggccgggcaacatccgtcagctccggaacgtcgcccgacagctcgtcatcggcagcagggggcagtcctgcctggagcttgatgcacgcctcgcccaggagttgaggctcgacctggcgccgccggcccggccctccgcctccgccgtccccccgaagcgtgaggttgcggcccgtcgcaagtccacggacgtgggcgaacaggaactcctcgtggccttgcgtgcgcacgactgggacgtcaagaaggccgcccaccacctggagatcgcccgctcctccatctatgatctcatcgagcgcagccccagcatccgtctggctggagacctgagcgtggaggagctcacccacgccttccacgcgtgccagggcaacctggatgagatggcgcggcgcctggaggtgtccaaacgggccctgaaccggcgtgtcaaggaattggggctgtattcgaaggagtcctga

SEQ ID NO: 9631 - DNA, 1632 bp, Myxococcus xanthus
atgctccaaaacatcgggttcttcgtcattctgctcggcgtgctcgtcacggtgcacgagcttggccacttcctggtggcgaaggcctgtggtgtgaaggtcctgaagttctccatcggcttcggacccaagttgatcggcttcaccaagggcgagacggagtaccagattgccctgctgccgctgggcggctacgtgaagatggcgggcgacatgccccacgaggagctcagcccggaggaggccagccggggcttcctggcgcagcccccatggaagcgcggcctcatcgtcctggcggggccggccttcaacctcatcttccccatcctcgtctatttcttcgtcttcctgggcccgcaccaggccacgtccacctacgtggggacggtgagcgagggcatgcccgcgcaggccgccggcatccgccctggagaccgcatcctgtccgtggatggcgagccggtacgcacgttcaacgacatgcgggaggcgttcgtcggccgcttcgagcggcccgtccccatcgtcctggagcgcaatggccagaagctgacgctggacgtgacgcccacgaagaacgtggagacgtcccccatcgacacggtggagcgcggctccattggcgtggaggccgtgtcgaagccgcccatcgtcggcgtgccgccgggctcggtggcggagcaggccggactgcggaccttcgaccgcatcctggccgtcaacggcgtgagcgtggagacggaagcgcgcttccagcaggagctggacaagcacgcggagggcacgcccctggagctcaccctccggcgcatggactccgtggcggcgggcgtcgtgacggggcgggtaccctccgtgctgaagctcaccgtgccgaagcagccgggagtggggctggcgacggtgggcgcggagacgtccgacctgtacctggccaccgtggcgccggggagcgcggccgagaagggcggcctgcggcccggagaccgcatcatcgccctggatggcgagaagccggagtccttcgtcaagttctcctcgaagctgaacgccctgaaggagcgttccttccagttgacgtggcggggcgctgacggcgagcgcacggagacgctggcgcaggcgccgctgaagacggaggacgagatgggcacggcgagctcgcccatcgtcctgggcgtgcgcaactgggtgctctccgcggcggacatgccggtgctggacgaggtgacggtgcatctggggccgggcgccgcgctgaagcaggccgcgctcatcgtcccgaagattgtcgggcagatggtgcgggtcctcggcgggctgctggtgggctcggtgccgatgaacaccgtgggcggccccatcatgatgtaccaactggcgtcgaagagcgccgagcagggcctggacagcttcctccacctgatggcgctcatctccatcaacctgggggtgatgaacctgttgcccatccccgtgctggacggcttccacctgctttccgccgcctgggagggaattcgccgccgccccatccctgttcgcgtccgcgaggtggccaacatggtggggctcgcgctgctcgtcctgctgatgctgttggccgtgaccaacgacatcacccgctag

SEQ ID NO: 9632 - DNA, 723 bp, Myxococcus xanthus
atgcctagccggcaggcgcccacgaagcccggccgcgtcgtggaaccaccgccccggccggacaagaagccattcgacatcgacgaggtgctcggccgcatccgagaggcggtgcgccacttcgcggacgcggcgatgttcgcgctcgcggcccgaggacatgacacgctcttcgagcagctcgtcgcctgcatcctctccatccgcacacgcgacgaggtgagtctgcccgtctcgctcgccctgctccagcgcgcctccacgccggaggccctggcgcgcatgtcgccggaagacatcgacgccctcatccagcccgtcaccttccatgaagcgaaggcgtggcagcttcacgccatcgccacgcggacgcgggatgaattcggaggcgcgctgccgtgtgatgcccaggtgctccagtccttcaagggcgtgggacccaagtgcgcgcacctggcgctgggcatcgcctgcgggcacgaagccatcagcgtggacatccacgtccatcgggtgacgaaccgctggggctatgtgcaggcgcgcacgccggaggccaccatggaggcgctggaggccgtgctcccgcgcgcctggtgggtggagctcaaccggctgctggtgcccttcggcaagcacgtctgcacgggcacgcggccgaagtgctccacgtgcccggtgctgagcttctgccggcaggtcggcgtaagggacgcgcgctga

SEQ ID NO: 9633 - DNA, 507 bp, Myxococcus xanthus
atgagcacggaagagctgacgctgcgacgcatcgaatcgagggatgacgccgcggtggccggcatcatccggacggtgatgccggagttcggcgcggacggccctggcttcgccatccacgaccccgaggtgtcagcgatgagcgccgcctacgcccggccccggcacgtctacttcgtcgtggagcgggcggggcgtgtcatcggtggcggtggaatcgccccacttgaaggaggagacgcgggcgtctgcgagctgcggaagatgtacttcctccccgaagcccgaggcctcggccagggcgagcgcctgctccgacgctgcctggagttcgcacgtgaagcgggcttccagcgctgctacctggagacgctggccggaatgcagcaggcccagaagctctaccgccgcatgggcttcgagccactgtgcgcgcccatgggcagcacgggccacttcggctgcgaccactggtacgcccgggacttgtcaaagccgctcgactga

SEQ ID NO: 9634 - DNA, 1020 bp, Myxococcus xanthus
gacctcgttgaactgttcgccctccagccccgcgtctcgctggaggactacgcctctccggcggccttcgccgcgcgacaccgtgcgctggccgcgaaggtggatgccctgcgcgcccgggatgcgtcaggccagccgcgctatccagcgctcgccgtgtggccggagtcggtgggggcgccgttgctgttcctgggccacatgcaccgcgtgcggcaaagcacctcactccagggtgcactgaaacgcgtgcgcctctccgaggcctggggggtgtggaatgcctggagcgacttccggccaccgtcgctgacggagtgcatctacgccgcgcgagcgcccctcgtgcaccggacgctgtggaacaccttctctggcatcgcgcgggatttcggcctgtgggtggtggcgggcagtgcgctgctgcccgccggccgccggggggagggctcgccggacttcgagcccttcagcgcgcgcacctacaacaccagctacaccttctcgcccgaaggcaactgcgtcgcggctgcgcgcaaggccaacctggtgccctcctgggaagacgggctgcacctgagccctggccgcccggaggacctggccgtgctccagacgcccttcggaaagctggcgaccctcatcggttatgacggcttcgcccagccgcatacccgcgacgagccctggttcgccccctgcgcgcaatacctcgacgccatgcgagtggatgtcctcgcccatcccgccatccacgccgggccatgggcacgctctgcccaaggcgagcgctggcgacacgaaggcctgcccgcgcagctccgcacgctccggaacgtgcgctacgtggtgagcgcgcagcaggtgggcagtctgctcggcggcaccttcgaagccgcctcacacatcctggagcgcacggcctccggcgacgtgcgcgtgctcgcccaggcccagacgacgcaggaggaggacgtggtgcacgccatcgtccccaccgcggcacacggcacgccttag

SEQ ID NO: 9635 - DNA, 3066 bp, Myxococcus xanthus
atgacggcgaagaagggtcgggcggagaaggcggtcttgtcccggcaggaaatcgcgacgcgccgcagggcgctggcggacaagcggatgaaggccggcaagggcggtgacgtcaccacccgagccatcaccggcgtgttcctgctggcggcgtcgttgattgccctgctggcggtggccactttcgacgcgaaggaccgggtgggcccgggcttcaacaacgcggtgggccccatggggcacctcatcgcggagtccctgcgcggcttgctgggcgtgtgcgcctacctcatcccggcgggtggcatctacacggccatggtgctcttcgtgggcagccgcgaccggaagcgaggaccgcaaatcatcagcctggcgctgctgacggtcagcgtgtccgtgctggcgcagttgatgttcgccggtgacaagggctgggcgcacccaccgggtggcgcgctgggcgccagcctgggcggcatcatgtccggcctgttctccacggtgggcaccgtcatcctggtgacagccatcagcgcggccgccctcatcgtgggcacccagtacaccttcctcaagctgtgctcgctggcgtgggccgggctctgcgtggtgggccgccgcgtccaggagtccgccagcgtgttctgggaggctcagaaggtggcctaccaggagcgccaggaacgcgccgccgaggagaagctcgaggaggccgccttcctcgcgcagctcgaggccgacgaggaagagctcgccgaagccgagcgcctggccgaagaggcagaggccgccgaggccgaagcgatggcggaggaggccttccggctgtcgaagcagcaggagaaggagcaggccatcgccgcgaagctggcgctcaaggagtcccgcgagcgcgagaaggcggagaagctggagaagaagctgctcccgccgacccgcgaggccgattcgctgccccctgcccccgcgcccgtgctggcccttccggagaaagcgccggcgaaggcggagaaacgcccggccctcggtgccgacccggcctgggccgcgtccttcctgccgccctcgcccaacctcatcattcccgccgacggcgccgacgccaccgaaacgccgcgcgcccgccgcaggccgaacatcgtcaccggcccggcgccggtccccatggctgacatggaggccgagcctgtcgcgcccgtcgccgccgcccccatcgcgccggtgccgcccgcccccgccgccccggccgacatcgtccccgcgccgccggccgcgctggcgcgcatgccgctcatcgtggagcccaaggccccgcccaagcccaccgtcaagaagagccaggaccagttcgagttcgtcggcgaccgcaagagcttctcgctgccgccgctcgacgtgctcgagtacgacaagacggagcgctccgcgctggacaaggacgtgtacctgtccacggcggagaagctgcgcgcgaagctggcggacttcggcatcgtcggcgaggtggtggagattcgccccggccccgtcgtcaccatgtacgagttcctcccgggccccggcatcaaggtgagcaagattgccgcgctcgcggacgacctcgccatggccatggaggccatgcgcgtgcgcatcgtcgcccccatccccggcaagggcgtggtgggcatcgaggtgccgaacagggaccgtgaaaccgtctacctcaaggagattgccgagcaggacgccttcaacaagggcgccagcaagctgaccatgtgcgtgggcaaggacatcgagggcatgccgtacgtcctcgacctggccaaggcgccccacctgctcatcgccggcaccaccgggtccggtaagtcggtggcggtgaactccatgatcatgagcatcctcctcaaggccacgcccgaggaggtccgcttcatcatggtggacccgaagatgctggagctctccgtctacgagggcatcccccacctgctgctgccggtggtgacggacccgaagaaggcggcgctcgcgctgcgctgggccgtggaggagatggagcgccgctaccagatgctgtccgaggcgggcgtgcgcaacatcgccggcttcaacaagctggtggagagcaccgcggtggaggtgaagacgaccaccgagtccgcgccgaagaagaaggcgaagccgaagaacgtgctcgtgctcgatggcgagagccccaagtcctccatgcccgcgggcggtgagagcctgggcgtcgccgcaccccgggacgacgaggacgacatgctcgacgcgcaggcgcccgaggaagccgaggctccggagctggaggacgagtccgaggacaccgaggcgatggaggccagcgagtccaccgagccggagaagaagcagctcaagaagctgccctacatcgtggtcatcatcgacgagctcgccgacctgatgatggtggccagccgcgaggtggagacctacgtcgctcgcctggcgcagatggcccgcgcggccggcatccacctgatggtcgccacgcagcgcccgtccacggacgtcgtcaccggcgtcatcaaggccaacttccccacgcgcgtcagcttcatgctgcgctcgaagccggactcgatgacgattctgggcacggtcggtgcggaggccctgctgggcatgggcgacatgctcatcatgccgcccaccagcgcgcacctgcagcgcgtgcacggcgccttcgtgtcggagaacgaaatcaagaaggcggtggaccacctcaaggcccagggcaagcccgtctacgacgactccatcctcaagccgcgcgacgaggacgtggaaggtggcggcgaggaggacgagctgtccgacgagctgtacgaccaggcgctcgcgacggtcagcgagatgcgggccgtctccatctccatgctccagcgcaagatgcgcatcggctacaaccgcgcggcccgcatgattgagcggatggagcgcgacggggtggtgggcgcggcggacggcgccaagccccgcgaggtgctcatccggggcctgggcgacatgcccggcgccggggccatgtaa

SEQ ID NO: 9636 - DNA, 285 bp, Myxococcus xanthus
atgattgtcgccatcgcccgcttccggccagcccccgaggaagcggaccgcctggtcgcccgcttccaggcgcgcacgcgggcggtggacggatacccgggcttcctggggctggaggagctgcgctccttcgaacggccgccggagctgatgctggtgacgcgctggcgggacaaggcctccatgcgggcctactttcagtccgaggacttccagcgggcgcgggaggcgagcgcccagcaggaggacgccaccttcgccctctacgaggcggtgggcacatga

SEQ ID NO: 9637 - DNA, 1236 bp, Myxococcus xanthus
ttcgccaccgccgctcgcggcaccgaggacctcctggccgacgagctgaaggagctcggcgcccgccgcatccgccaggaccgcggcggtgtccgcttcatggccacgctcgacgaggcgctcatggtggcgctctggtcccgcatcgccatgcgcgtgctctacccgctgggcgccttcgaggcccggggcgcggaaggcctgtacgaagccgccgccagcatcccctgggaggagcacctcacccccgaacacaccttcgcggtggatgccacgctgaaggacagcgagcacagccactccggcttcgtggccctcaaggtgaaagacgccatcgtcgaccggatgcgcgacacgaagggcgcccggccggacgtgaatacgagggacccggacatccgcgtggtggcgcacctcgcccgtgaaacgctgtccctgtccctggatttgtgcggcgagccgctgcaccgccggggctaccgcgtgcgccccacgcccgccccgctgaaggagacgctggccgcggcggtgcttcgcgcggcgaactacacggggacggagggcctggtggacccgatgtgcggctccggcacgttgctcatcgaggcaggcctcatcgcccgccggcgcgcgcccgggctcaaccgggacttcgcggtggagcgctggccggagctgggcacccgggcccgcgagctgctcgcggacatgcgcgcggatgcccgccgcaacgagcggaaggtggaagtaccgctgctcggcttcgacaaggacccggaggcgctggaggccgccagccgcaacgtgcgcgccgcgcgactgacggaggaaatccagctggccgagggtgacgcgacccggctgccgccgctgccggagacaggcggattgatcgtcaccaacccgccctacggcgaccggctcggcacgggcggccagaagggcatgaagagcttctacttcaagctgggcgagtcgctgcgcgtgccgggctggcgcgtgtgggtcatctgcggcaaccccgccttcgagagcgccttccacgcgcgcccctccgcgaagcgggacctctggaacggccccatcgcctgctcgctgctgggctaccgtcctccagacggcggcagcgctcggggtgacaccgggaacggctcagaagcgccgctcggtgcgccgcgccagccggaggatgttgccccggtgcgtccacagcatgagggcgaagaggagggctga

SEQ ID NO: 9638 - DNA, 561 bp, Myxococcus xanthus
atgaacacgctccgcacgtccctgatgctgctggtcgccgttcccctggttgccgctgcgggtgacaagtcgtccgccaaggcgggcaaggccgccgaggccgactgccaccacccgcccgctccgcaggcgcagaccgcgcccaaggccgaaggcgcgcccgatggctggaagctcacccgcggcgagcccctcaagggcgccaaggcggtgaagctcgcggacgtgctggccaagccgcaggctcatgacggcaagacggtgctgctcgaggggcaggtgcgcaaggcgtgtgagcgcaagggctgctggatggagctggcggcgaacggccaggacaagggcccgggcgtgcgcgtgacgttcaaggactacggcttcttcgtccccctggactccgcgggcgcgcaggcgcgtgtggaaggcgtgctgaaggtggccgagctgaccgacagccgcgcccagcactacgagtcggagggcgccatcgtcccccgcggcgccgatggcaagccgcgtgaggtgcagttggtggccacgggcgtcgaactgcgccgctga

SEQ ID NO: 9639 - DNA, 564 bp, Myxococcus xanthus
atgcgcggcgtgcagagcgcggcggaccgcgccgtgcagcacgcccgcgcatggatgttggagacggagccgggctcgcgcgtgcatgacgtgcagttggacccgcgcttccagcaccggggtgtggacctgctctgggagctcccctcgggagaggtgcgcggcatcgaggtgaagggcgaccgcaacgccacccgccgccgctacttcttcgagttggtgtccaacctggagaaggacaccccgggctgcttcctctacagcggtgcggacctgctggtgtacgtcttcctctcgcagggagagctgcacgtcgtgcccatgaaggcggcgcgcgagtggttccttccccgggcgaaggagtacccgctcaagcacgccttcacgcagacgggcgccatccgctacaccaccgtgggcgccgtggtttccgtgcgagacgtggcggaaggtgtccccggcgtgcttcgcgttccgctgaagcgccggggtggcgcgaaggacgtggaggaagaggtgccgcccacctccgaatctcctcagggacaggagtcgaacggctag

SEQ ID NO: 9640 - DNA, 1440 bp, Myxococcus xanthus
atgcccgtgagcgatttccagcccgtcatcggcctcgaggtccacgcgcagctcctcacgcagtccaagattttctgtggctgctccaccgcgttcggcgccgagcccaaccgcaacacctgtccggtgtgcctgggcatgcccggtgtgctgccggtgctcaaccagcgcgtggcggagttcgccgtgcgcacggggctggcgctggagtgcaccatccgcccgacgagcgtgtggagtcggaagaactacttctatccggacctgcccaagggctatcagattacgcagttcgaccagcccatctgcgagcacgggcggctcgtcatcgacacgccgcagggcgagaaggccatccgcatcctccgcatccacatggaagaggacgcgggcaagagcgtgcatgacgccggtgggggccagagcctggtggacctcaaccgcgcgggggtgccgctgctcgaaatcgtcagccagccggacctgcgcgacgcggacgaggcggtggagtacctcaaggcgatgcgggacgtgctcgtctacctgggcgtcaacgacggcaacctggaggaggggagcttccgctgcgatgccaacgtgtcggtgatgccgaagggctccaccacgtttggccagcgctgcgagctgaagaacctcaactcgttccgcttcctcaagcaggccatcgagtacgagattgcccggcaggtggacgtcatcgagtcgggtggcaaggtggtgcaggagacgcgcctgtgggacgtgaacaagggcgtcacccgctccatgcgcagcaaggaggaggcgcacgactaccggtacttcccggagccggacctgccgccgctgcacgtgagcgcggaggccatcgccgccgcggcgaaggcgctgccagagctgccgcgcgcgaagctccagcgcttcaccagccagtacggactgcccgcgtatgacgcccgcatcctcaccgccgagcgtccgctggccgactacttcgaggcctgcgccgggcactacaaggactacaagaaactctccaactggttcctcggagagctgatgcgcctgctgaaggaagagggtacgccgctgtccgcgctgcgcttcacgccagcacagctgggggagctgctgggcgctgtcgaccagggcatggtgtccgccaacgcgggcaaggatgtgctcggggagatgttccgcacgggcaaggcgcccgcggacatcatcgcggagaagggcctggcccaggtgagcgacaccggcgccatcgaggcggtggtggacgacatcctcgcgaagaacgcgggggagattgagaagtaccgcgccggcaagaagcaggtgttcggtttcttcgtgggccaggtgatgcgggccatgaagggcaagggcaaccccgccctggtcaacgagctgctgaagaagaagctcggcgactaa

SEQ ID NO: 9641 - DNA, 1461 bp, Myxococcus xanthus
atgcagctcacggacctcacgatgctggagctggccgcgaagctggccgcgggagaggcctcctccgaggaggccacccgcgcgagcctggcgcgcatccagcaggtggacccgaaggtgcgcgccttcttgcgcgtggatgaagccggtgccctggccgccgctcgcgccagtgacgcgcgccgcaagtcgggcagtcccgccagcgccctggacggcgtgccgttggggctcaaggacatcttcctcaccgagggcgtggagaccaccgccggctcgcgcatcctggagggcttcgttccgccctatgacgccacggtggtgcgcctgctgaaggaggcgggcctgccgctggtgggcaagctgaacatggatgagttcgcgatgggctcatccaacgaatccagcgccttcttccccagccacaacccgtgggatgtgtcgcgcacgccgggcggctcgtctggtggctcggcggcggcggtggccgcgcgcgaggtgttcggcgcgctgggaacggacacgggcggctccatccgccagcccgcggcgctcaccaacaccgtggggctgaagcccacctacggccgggtgtcgcgctttggcgtcatcgccttcgcctcgtcgctggaccagccgggccccatgacgcgcacggtggcggacgcggcggcgctgctccaggtgattgcgcggccggacgcgcaggacgccacgtccgcggacgcgcccgtgccggattattcggcggacctggaggccggcgtgcggggcctgaagctgggcgttccgcgcgagtacttcaccgagggcatggacccggaggtggaggccgcggtgcgcgaggccctgcgcgagtacgagcgtctgggcgcgacgctggtggacgtgtcgctgccccacacgaagtacgcgctggcgacgtactacctcatcgcgcccgcggaggcgtccagcaacctggctcgctacgatggcgtgcgcttcggcctgcgggcgaaggacgcgcgcagcctgcgggacgtgtacgcgctgacgcgggagcagggcttcggcgcggaggtgaagcgccgcatcatgctggggaccttcgcgctgtcctccggctactacgacgcccactacctgcgtgcgcagaaggttcgcacgctcatccgcgaggacttcacgcgggccttccagcaggtggacgcgctgctgtcgcccacctcgccggtgccggccttcaagctgggtgagaaggtcgaggacccgctgtccatgtacctcatggacatctacacgctgccttgcaacctggcgggcctgcccggcctgtcggtgccctgcggcttcacgaaggcgggcttgcccgtgggcctgcagattctggggcggcccttcgacgaggctggcctgctgcgcattgcccgcgcctacgagcgcgagcacgacttcttccgccgctccgcgcccctgtag

SEQ ID NO: 9642 - DNA, 348 bp, Myxococcus xanthus
atgccgcgctcgtacctgggcgaagggctggcctcgttctatggccccggcctgcacgggcggcccaccgcgagcggggagcgcttcgaccaggaggcgatgacggccgcgcaccgcaagctgcgcttcggctcgtgcctgcgcgtggtgaacatggagaacgggcgcgcggtgaaggtgcgcgtgaatgaccgggggcccttcatcgacgggcgcatcgtggacctgtccaagggcgccgcccggaagctggacatgctggacaaaggcgtggtgcgcgtccggctgtaccgctgtgcggaccgggtgtcggagattccgcaggaaatgtgggccgcgccggtgtag

SEQ ID NO: 9643 - DNA, 336 bp, Myxococcus xanthus
atggccgacgcccgtaccgacaagccgtcatccaccgaggaggagtacttcgcccgggaggagattgagaagaagcgcaagctggctctggagcaggccgcggcgagcgcggcgcagcagcgcgaggagctcaagaagctccactggatgaagtgccccaagtgcggcatggacctccagacgctgaagcaggggaatgtcgaaatcgagacctgcttcaactgccacggcatcttcctggacgccggggagctggaccagctggtcgcccagcacggccacgagggcagtggcaaggtgatgggggccatcctcaacctcttcaagaagaagtag

SEQ ID NO: 9644 - DNA, 63 bp, Myxococcus xanthus
atgctgtggacgcaccggggcaacatcctccggctggcgcggcgcaccgagcggcgcttctga

SEQ ID NO: 9645 - DNA, 381 bp, Myxococcus xanthus
atggggctcgccggcgtggtggggctgctcgtggcgcgctacatcccggtggcccgcatcatccccttctggggctgtgtgctcagggagcagaccgggtggccctgcctcggctgcggtctgacgcgcgtggccgaccgggtgtcccacctcaacttcgccggcgcctgggaggccaaccccctgggaacggtggcggccatcgtgttcgcgctggcggcggtggtcatggtgctgcacctggtgttcgcgatgcccatcccccaggtggaactctccccccgcgagtggagcgtcctgggcgtcgtgacgcccatcatcatcctggtcaattacgcctacgtggtggtgaagacgcgcttcccccacctgctgctgtag

SEQ ID NO: 9646 - DNA, 1652 bp, Myxococcus xanthus
atggccgacacgctggcgaacctgatgcagcaactgtcgttcctgttgggtgggcggcaggacgcggcggtggacgccgccttcgagaagatgaacgcggtgcgcgcgaagatgccgctcgacgagaagggtgcgccgcaggagcgcttcatgcgcgaggcgctggcgcccttcacggagaagcaggccgaaatcttcgacagcctcgcggaggcgctggcgtcgtcgggccacgtgggccacgcggagtctttcgcggacctggaggagttcctcctgccggaccgccgtggaatctcgcgggccatcgtccgcgcggcgaagggcgagctgcagcccgccaccgaggacatggtgaagctcaccgaggacaccgagcgctcccccatcgcacgcctgctggcggtggacggcctcatccacatcaaggcgcacggtcaggcggcggccgcggcccgcacgctgctcgcggcggcggagaatggcggtgacctgcacctcgcgctggacctcgtcccccgcctggagcacgtctacaaggcgcagaacgaccgcgagtcgctgctggagctgatgggcatctccgagcgcctggaggcggcccacgacaagattcaccccggacaccgccgtctccgtcactgaggcacgcgcgtgacagggggcctgcgtggcctcctgtcacagcccgtgggaagaggggcccgtccgcggctccgcgcccaggaaagagggtgccagggagccgcgcttccaccccttcgtcctagccgttcgactcctgtccctgaggagattcggaggtgggcggcacctcttcctccacgtccttcgcgccaccccggcgcttcagcggaacgcgaagcacgccggggacaccttccgccacgtctcgcacggaaaccacggcgcccacggtggtgtagcggatggcgcccgtctgcgtgaaggcgtgcttgagcgggtactccttcgcccggggaaggaaccactcgcgcgccgccttcatgggcacgacgtgcagctctccctgcgagaggaagacgtacaccagcaggtccgcaccgctgtagaggaagcagcccggggtgtccttctccaggttggacaccaactcgaagaagtagcggcggcgggtggcgttgcggtcgcccttcacctcgatgccgcgcacctctcccgaggggagctcccagagcaggtccacaccccggtgctggaagcgcgggtccaactgcacgtcatgcacgcgcgagcccggctccgtctccaacatccatgcgcgggcgtgctgcacggcgcggtccgccgcgctctgcacgccgcgcatgctgaagcttcgtgccatgtcgtctcagcggcgcagttcgacgcccgtggccaccaactgcacctcacgcggcttgccatcggcgccgcgggggacgatggcgccctccgactcgtagtgctgggcgcggctgtcggtcagctcggccaccttcagcacgccttccacacgcgcctgcgcgcccgcggagtccagggggacgaagaagccgtagtccttgaacgtcacgcgcacgcccgggcccttgtcctggccgttcgccgccagctccatccagcagcccttgcgctcacacgccttgcgcacctgcccctcgagcagc

SEQ ID NO: 9647 - DNA, 1572 bp, Myxococcus xanthus
aaaaggctggacctgtactggagacacatggagggccgttactcactcatcgagcgcgttcgcagcttgctagcggacgaacagggcacgctgcacaaggcggcgccctaccgggtggccctctgctaccccagcccctaccacgtgggcatgagctcgctcggctaccaggccatctaccgtgaaatccacgagcatcctggcgcgacggccgagcgcgtcttccttccggatgacgtggacgccttcaagcgcacccggacgccgctcttcacctgggagtcccaggtccctgtcgccgacttcgacatgctggccttctccgtggcctatgagctggagctgacggggctcttctccatgttggagctgacgggcatcccgctcctggcggaggagcgccaggatggccgctatccgctcgtggtgggcggcgggccgttgacgttctccaacccggatccgctggagcccttcgtggacgtgctcgtccagggcgaggcggaggatttgatccacctgctggtggaggccgcggcgaccatggagcgcgaggccctcctggcgcacctggcgcgcatcccgggcttccgcgtgcccgggcggggcggagcgcggtaccacgtggccaaggccacggattcacggctgcctgctcggtcgcaaatcgtgacaccgaacaccgagctgcgctcgatgttcctcatcgagccggagcggggctgctcccggggctgccattactgcgtcatgcggcgcaccacgaacgggggcatgcgcacggtgccgccggagcggatcctgtccctgattccggagcatgcccgccgggtggggctggtgggcgcggcggtgacggaccatccgcgcatcgtcgagttgctccggacgattgtggagtccggccgtgaggtgggggtgtcctccctgcgcgcggaccggctgacccaggagctggtggatcagctccggcgcggaggggccaccaacctcacggtggcggcggacggtccgtcacagcgcctgcgggacatggtggaccggaagcactcggaggaacagattgtccgggccgcgaccttcgctcgtacggcggggatgaagcagctcaaggtgtacaacgtcgtgggtctgccgaccgaagaggacgcggacatcgacgagctcatccgcttcaccagcgagctgtcccgcatcctaccggtggcgctgggcgtggcgcctttcgtggccaagcgcaacacgccgttggatggcgctcccttcatgggcattcgcgaggtggaggggcggctggagcgactgcgcaaggggctccgggggcgcgccgaggtgcgcccgacgtccgcgcgttgggcctgggtggagtacatgctggcccagtgcggtccggaggcggggctggcggccatggatgcctggaaggccggagggaacttcgcggcctggaagcgggccttcgacgcccgggagtgtgagccgtacctggcccggcgggtggaggacggtcggcgcaaccccgtcctgtggcccaccgtgccgaggaccgcgcccccggcgtccgccgcctga

SEQ ID NO: 9648 - DNA, 711 bp, Myxococcus xanthus
atgaccaagaacatcgtcaatactgcgttggttctcgtgggcgcgggaagcctgctgacgggctgcaacttcgaacaacctgagaccaactgcttcgtgcaggagtcgcccagctgggcggtgaagtacgacgtcgtggattcccccaaggacgcgaatggcgacgagtgcaccacgactgcgccgctcgtggagttgatgggtgtctacaagtacgtgaacccggagacgggggccgcgcagctcgcacttcgtcccgcgactctggcgagccgcgcgattgctgacacgacgaccacgtcggcggatcagacttcgctcggttctctggacaccgaacccaaggaccatggcttctgccacgcgaacgacttcgctcctgcgttcgtcaacgtggcggcctcggatactgcggcggcgaacaccatccgctacgagttcactaatgttcgcgtgtactcggcggctgtggcgccgggaacccagttcacgggcgagctcaagtacaccagcaatggttgcacttcgtcctacgtgatgcgcgctgtgtggccgcccgcaccgtgcgataccgcctcgacggagcccgcagagaactgcggtgtggggtccggcctgaacccggaattcgccgtggtgtgccagccgaccagcgcgactggaaccacgggctactgcgtgccggcgggtgacatcccgtcgttcaagtag

SEQ ID NO: 9649 - DNA, 465 bp, Myxococcus xanthus
aacgccctgacggcgagcgtgggtgtctcctaccgcggtagctctggtacgccgatcaactactggggtagccactgggcctacctccaggacgagtccttcgtcctcccccgtggcgctggcggccgtacgccgtggatcaacaccatcgactccaacattggcgtgaactaccgcgtcagcaaggacagcgtggagtcgttcaccctggacgtgttcaacctcttcaacttccagggcgtgaacacggtcgaccagacgtacaccctgcgcgacatcaagcccatcccgggtggcacgcctgcggacctggagaacctcccgggccgcgtggagttccaggaccaggcgccgcgtgacgagcccttcggcagtgtcgacggcgacgtgaacaagaacttcaagaacccgctctcgtaccaggcgccccgtcaggtccgcttcggcatccggtacacgttctaa

SEQ ID NO: 9650 - DNA, 1410 bp, Myxococcus xanthus
cccacctgcggcaacggcacggtggacaacggcgagcagtgcgacgacggcaacaccacggcgggcgacggctgcagcggcagctgccgcgtggagaacggctatacgtgcagcggcgcgcccagcacctgcgccaccacctgtggtgacggcacccgcgcgggcgccgaggtgtgtgacgacggcaacctcaacaacggcgacggctgctcctcgcgctgcctcctggaggacggccagccctgcaatgcgtccggcgtctgcgagagcggcatctgcaaccccaacaccaacacctgcatcagccccaacgtctgcggcaacggcatcctcgacgagggtgagctctgcgacgacggcgacaccacggcgggcgacggctgctcggccacctgcgccatcgaggacgggttcggctgcaccggcatcccgtcggtgtgcgccgtgacgtgtggtgacggcatcaaggcggacagcgaggcctgcgatgacggcaacaccaccaacggggacggctgctcggccacgtgcaccgtggagagcggcgccgcgtgccagacggcggacgtgagcgtgttcatcacccaccagggcaacgcgaactgcacgcaggtgtcggacatcgacgcccccgtgctgcccgacgcggccatccaggccgggctggacgtgccgggccgctaccgcatccggtacgtgtccggcgcggtgagctactcgggtggcgtcaactggtaccccggcgtcatcggcgtcagcgccaacgcgggcacgcaggtgcagggcttctcgctgggctacacgccccgcagcggtccgggctcggccacgcgcgccgaggccatgcccctgggcttccccctgtcccgcgacttcacggcggccacgggtgacgtgcgcatcgcgctggtcgacaccgactgcaacctggccaacaactccgacacggcggtgacctaccgcgtggacgcgctgtccatctgccagacggcccctgtcgtcacgtctccgacgccgggcggcaccgccggcgaggaactcgagggcaccgccacgccgggcgccaccgtggacgtgtacctggacggcaaccccgcgccggtgtgcacggtcgtcgccgacgcggaggggaactggagctgcacgctgccgacggacctggaggaagggccgcacaccgccgtcatcacctccaccttcccgggcgcgccgcagacctccacgacggtggacttcatcgtcgactactcgccgccggcgcctccggtcatcaccggccccacgccgggcgccgtgctggacacgcagacgcccgtgctgagcggcacggcgaccccgggtgacgaggtgacggtgtacgagggcggaaccgccctctgcaccaccacggccgatgcggcgggcaactag

SEQ ID NO: 9651 - DNA, 720 bp, Myxococcus xanthus
atggccgaaggcccgcacacggtgacggccaccgccacgcctccgggcggcaaccccggccccacctccacgcccgtcaccttcaccatcaccctgaccgcgacggagccgccggtcatcaccgggcccgccgacggcgcggtgctcaacacgtcgacgccgcccctgagcggcacgtcggctccgggcacggtggtgacggtgtacgagggcgacacggtgctctgcaccaccaccaccaacgacgtgggcgcgtggacctgcacgccggcccagccgctggaggatggcccgcacacggtgacgggcaccgccaccgacagcgagggccgcaccagcgagccctccgcgcccagcgagttcatcatcgacacccaggagcccgacacgcgcatctcgcgcacgccgccctcgcgcggcggcaaccggacggcgaccttcgagtacggcgcctccgaggaggacgtcacctacgagtgcagcttgaacgggggccccttcgagccctgccgggacagctatgacgtgggcgagggtcagcacaccctgcgcgtgcgggccacggaccgcgcgggcaacgtggacagcacccccgcggcgtactcgtggacggtggagctcacccgggccttcgccggtggcggctgcagcacggcgcccgccgcgtcctggctggcgctcctgggcctgctcggcctccgccggaggaagcgcggctaa

SEQ ID NO: 9652 - DNA, 3618 bp, Myxococcus xanthus
atggacgaaggactgctctccggcgaggaggtggcgctcctgcgtgaggacgcgctccgcctgcggcgtggccccctggagctgctgcgggagcgaggccggctgtccgaggactccctggtggcgcttcgtggcgagctcgcctccgagagcacggacccgagcgttggccggccgctcgaggccgccaccctgacgcccgtcaccccgggcgtgtccccgccccccgccgtggagccggacggccccaccttcccggtgccggactgggaccgctaccagcccgtgcgcttcctgggccagggtggaatgggccgggtgttcctggcgtatgaccccatgctccgccgcaacgtggcgctgaagttcgtgcgcggggacgacccggagctggcccggcgcttcctctccgaggcccgcgcgcaggcccgcgtccgacacgagcgggtgtgcgaggtgtacgaggtcggcgaggtgcgcggccggggctacatcgccatgcgcttcgtggacggccagtcgctgggacagttggcgcgctcgctcacgctggagcagaaggtgctggtgctgcgccaggccgccgagggcgtgcacgccgcccatggcgcgggcctcatccaccgcgacatcaaacccggcaacatcctggtggagcgcaccgaggacggcgggctggcccccttcgtcatggacttcggtctggcgcgtgactggcgcgaggaaggcgccgcgcccaacgccgtgcagggcaccccgcattacatggccccggagcaggcgcgcggtgaggtgtcacgtctggaccggcgcgcggacatctacgcgctgggcgccacgctctattcgctcctcaccggccggccgcccttcaccggcgccaccgaggcggaggtcatcacccggctccagcacgaagagccggcgccgccgcgcgcgctcgatgccgacattccatcggacctggaagccatcgtcctcaagtgcctggagaagcaacggcccgcccgctacgactcggcgcgggcgctggcggaggacctggagcggttcctcgaaggagagcccgtcctcgcgcgacagggactgggctaccgcctgcgccgcaaggcccgcaagcaccgggtggcgctgacgctgggctccgcggccctgacgatggtgttgctggcgctcatccaggcgggcatcgcccgcggcgaggtggccgagcgcgaacgcctcacgcgccgcttcaccgaacgggtggagcgcatcgaggcctccgcgcgctactccgccctgtcccgcctgcacgacacccgtgaagaccggcgcgagctgcgcgccagcatggacgcgctggaggccgaggtgcgcgaggcgggccctcacgcactgggccccggccagtacgccctgggccgcgcgttgctcgtgttggatgagcgggactccgcgcgcaagcgcctggaggccgcgtgggcccagggctaccgcgagccccgggtggcctgggcgttggcgcaggtgctgggagacctctaccaggagcggctgctgctggacgtggagcgccgcagcccggagcagcgcgaggtccgccgcaaggagctggagcagaactaccgggacccggccctggcctacctgcgccaggccgaaggccccgacgtccctgtcccaccgctgtatgtgaaggcgctgttcgccttctacgagggccgccacgaagaggccctgacccacctggaagccatgggccgcgcgcagccctggttctacgaagcgcctctgctgcaaggcgacgtgctgctggcgcgggccacgcagcgctggcaccagggcgacaaggccggctcgcaggaggacctggacgcgggccgccgcgcctatgcctccgccgtcgccaccgcggagagccaacccatgggccactacgtcctggcgcgcctggagctggccgcgctggtgatggaactgtacggcgaaggcaacgtgctgcctcactatgagcgcggcgtggaagcggcgacccgcgcgctcaccaccgcgccggatcaccaccgctcgctggtcgtcctctcccgcctgcaccgccgtctcgccgagcagcgcaccagccagggacgcgaggacgccgagccgctgctggagaagtccatccacgccgcgcgcgaggccctggccctggcgccgcccagcgaccgtgtcgcgctggagctcgccatcacccaccggctgtgggcccgctaccgccaggagcgtgggcaggacccgagcgagcagctccgcctgtccatcgaggccttcgagcgcctgcgccccgaggagcgcgactatgccttccacgccaacctgggtctgacctatcaggtgtgggcggacgcggaagccgagcgcggcgtggacccgctggagcaccagggcaaggcgattgacgcgtacctggaggccatccgcgtgcgggagaaccaggccgacgcgtggatcaacctgggcaacgccctgcgccgccgcgcttcgaatccacgcgccaccgacgccgcgggagatttgacgcgggctcgtgacgcactggcgaaggcactggcgctcaatcccggcaacgtcgtggccagcttccgcggcgcggaaatttccgagcagttggcgcgctggcgctggagccacggcgagcccttcgaggcggacctggagcaggcgctggccctgttccggcaggggctgggaatcaacgcaaagctccccccgctccacaacgggctgggcgcggcgctgctgtggcaggccgagcaacgctgggaggaaggcggcgaccccgagcccctgctccagcaggcgcaggcggccttcgaggaagcccggacgctggcgcccagacaggtgtacgcccacaacaacctgggcgaggtgtggaccctgagcgccaccttccagtccgcgcgcagggagaatccagggccgagtggccgcgccgccgtggaagcctaccgtcaggcactctcactccagccccaggacgccgacctctgggccaacctcggccgcgtgcagacactgctggcgacgtggagcttggagaccggcggcgacccacgggcggagctggcgaaggccgaggagtccctcgcgcgggccaccacgctgaatccccgccagggccacacgtggcgcaatatgggcgaggcccgcgcgctcaaggcccgctggctggcgcaccggggcgccgctcaggaatcggacttcgagctcgcgtcgcaggccttccagcaagccctgtcgctggagccccgccggcatgactaccggctggccaccgcgcgattccagctcgcctgggccgcgtggcgtcagcagcggaacgaggacgccgcgccgctgctgaaccaggggctcgcgctcgtggcggaagtcctggcggaccggcccaggtgggcgcgggcccaggcgcttcgtggcggcgggctgctcgccctggcggagacgcgcgcctcctcggagcaacggcaggcctggcgcatcgagggccaggaggtgttgcggcaagcactggcccgcaaccctcacctggaatccgaatggagaggccggctcggcgcggctcgcgagccgctggccggccctcctacgccctga

SEQ ID NO: 9653 - DNA, 738 bp, Myxococcus xanthus
atgttcctctcgctggacacctcgacgttgacgttgtcgctggccctggtggagcgagcgccggatggcgcgctgcgcacgctggagcacgtggtggtgggtccgccgcggaagcagagcgagctgctgcccggcatcgtcggggagctgctcgaacgccatggcgccacgctgcccgccctggaggggctggtggtgggcctggggccgggctccttcacggggctgcgcatcggcctggcgacggtgaagtcgctggcctacgcgacgaagctgaaggtggccggggcctcgtcgctggcggcggtggcgctggagggccccgagggcgtgccgctgtactgcctggcggtggcgcgcaaggacgacctgtacctgggggcctacgtgcgccagggcgggacggtggagccgctggagccggagacggccatgtcacccgcggaggtggccgcgcgcatggccgccgagccccgggccgtggcgctggggcccgcactggtggactaccgcgccgccctggagtcgcagggcgtggcgccacaccggctgctggcggcgccgaccttcccgtcggcggtggcgctggcgcaactggcgcgctttccggaagcgcagtcactggaggcgctcttcgccatggagccgcactacgtgcgggcctcggagccggagcgcaacccgaagttcccgccgctgcccgggccggcgcccaccgcacggttgaaggaagactga

SEQ ID NO: 9654 - DNA, 219 bp, Myxococcus xanthus
atgcgcctgaacgtcaaggtcgaccgggccgaaccgagcaaggtcgccatcgtcggcgcggccatgacggcgcctgtcggggccttcgtgctccagggcatgccttccgcgggggacccggtgaaggcgatgcaggaccttcagtcgctgatggacaaggggctcatcaccccggaagagttcgaggtgaagaaggcgcagattctcgcgcgtatctga

SEQ ID NO: 9655 - DNA, 513 bp, Myxococcus xanthus
atgttgcccttcctgctcttctcgctcgtcggcctcggcgctgcggggtacttcttctattcgcacgcgcagacgcagcgcctccgcgagcacgggaccgctggcgaggccaccatcctccggatggaccgcacgtcgatgcagatcaacaggagttacgtctacgacttcctgctggagttcaaggtgccgggcctccccacgtacaggcggcagcaccgcagccgggcgcatgattggaaggccttcatcctggagcccggcgtgcgcctcaaggtgaagatcgacccgaacgaccctcagcggttcgtcgtcctggggcccgtcgatcagcagcgtccccagagcatccaggccctcgtcgcggcggccactggcttcaccgaggtcaggaccctggcggctccggacccggtgaaggccttgaaggacctccagtcgatgctcgacaacgagctcatcacgcaggacgaatacgcgcagaagaaggcggagattctcgcgcggctgtga

SEQ ID NO: 9656 - DNA, 351 bp, Myxococcus xanthus
atggccatcatcactgttctcatcaacaagtccgggaacctgagctacatccccaacaacaaggtccggcacggagacacggtccgcttctccattgaaatgattggcgccgcatcggacgtgacggtgaatccccccgcgtgcctggattcgacggcgtcgttcaacttgaacaacacctctctggccgcagcccagcgcgaggaccccgtttccgacggggccgcggtcggctcgtacccgttcacggtggtgactggcggctcccccgaggcgcgcagccacgggctcgagttggagacgaagaacggcaacctggacgtgacgacggacccgcccaaggagtactga

SEQ ID NO: 9657 - DNA, 324 bp, Myxococcus xanthus
atgaagtcggggaatctggtctacgagcccaacaacaaggtccggcgtgggcaacccgtccgcttcgtgctcgaccaaatcaacggccctttgtgggcgaaggtgaatccgcccgcgtgcctggtcgcaacgaatcccgtcaccttggaccggacctccgcggcgccccccatctacgaggacccggtctccgaatcggccgcgttcatgacgtatgggttcaccgtggaggtccctcccgtgccggagaagccgcacctcggaggcgaggcggagacgaagaacggcaacctggacgtgacgacggatccgccggagctctga

SEQ ID NO: 9658 - DNA, 1590 bp, Myxococcus xanthus
atgtcgaccaccgcgggccgcgcacaggccgggcagagcccggtggcgctctccgtgcctgccttgacgattgtgtcccatccccagccgcagcgcattggcgagcggctattgctggaggtgctcgcgtcccaggggcgcacagcggccctgtctcgcaacgcgccggacttctcccggcccggggggctcatggccctcccgctgggagacccattcctcagccgcaagccggtggagttcgagcccggcccacgaggcggcctccggatgttggtgccggaggacggcacccaggtgcgcgtggcgaacgagcccgtcgtgggcggccgggagttctctcgcgaggagctgtccgatggagtgccgctggtgctggccgaccgcgtggtgctgttgctccacctggcctcgtccttccgccagccgggcgtgttggacctgggcatcgttggccacggtgagggcatccaccgcgtgcgcgaggacatcatccgggtggccgacctcgccgtgccggtgctcatcctcggcgagacgggcacgggcaaggagctggtggcgcgcgccatccacaccagtggtccccgccgcgccggtcccttcgtcagcgtcaacctgggagcgctcgccaaggagctggttgccgcggagctctttggcgcgcagcgcggggcctatacgggcgccagccgcgaccgggaaggcttcttccgcgcggccgagggcgggacgctcttcctcgatgaggttggcgaggcgccgcccgaggtgcaggccgcgctgcttcgcgtgctggagacaggcgaaatctatccggtgggcggccatacgccggtgcctgtcgacgtccggctggtctccgccacggacgcgcatctggaggcccgcatccaggagcgcaccttcaaggccccgctgctgcaccggctggccggctttgaaatcctggtgcctccgctgcgtgagcgccgcgaggacgtgggcctgctcttcctccacttctctcgccaggagctggaggccatgggggagggcggtcaactgacgacttcggacccgcgcgccgagccctggctgcccgcggccctggccgtccagttggtgcgccacgcgtggtccggcaacatccgccagttgcgcaacgtcacccgtcagctcgtcatcggcagccggggcacgccggggctgcgcgccgatgcacggctggagcaggtgctggacgcggacgcgcagccagtccccgggcgtccgttgaccgtgcgcacgggtgaggaggcgggcgatggcgcgaaggcaccgcggcgaaagcccgcggacgtgggcgagcaggagttgctggaggcccttcgcgccagctcctgggacctcaaggccaccgcggactggctgggcattccccggccgtccgtctacgtcctcatcgacaagagctcgctcctgcgcaccgcgcgcgatttgagccccgaggaaatcacgcgctgcttccacgagtgcgagggcgacctcgaccggatggtgcagcggctggaggtctccaagcgcgcgctccagcggcgggtccgggagctgggcctcagtggtgggtag

SEQ ID NO: 9659 - DNA, 846 bp, Myxococcus xanthus
atggatgacgcgctgctggagggcatgcgtcagtcggacgaggtgaaccggctgatgcccggcctgccgccgcgccacacgcggctgatgctggcgccggacgcggacctgcaaggagaccagcatccggtgacgcagcaggtggtggacctgcttcgccagccacgcgccctgggcgaggtgctggacctggcgccggccaccgacctggaggtgctcaacgtcctcaccacgctcatgcagcggggcgtggcgagagccgcggacggggacggcgtggaggctgcgtccggcgagctgctgggcgcggcggaggtgcacgcgctgcgcggccggattctccgcacgcgagcgcccgcgaaggtggccaccgcgaaaatcttcgtgtgcggcagtggcgcgagcgcggcccggcgggtcctctcccgcatgcccggcatggaagcgctgtcggccgagcccaccgcggtgaagagtggtttcggcacgctggggcgcctggtgctcagcgaggtgctgcgcctggacttctgcgtgctgcctcccgcggaggcggcgcggccgctgtggcgtcccttcacggcgggcgccatgggcgcgctgctgatggatgtggccgagccctccgtgcggctcgcgcactacctggcctgggaggtccggatgccggtggtggtggtgggcgcggaggtccccgcggcgttgcagggggctcccgcgggagccctgggcgcgacggatgacctggcggacgcgctgcgctcactgttggtccaggcgctcaatcccgcgcccacgctgcccggcgtgccccaggtgcagcgggccgccgcgtccatcgtgtag

SEQ ID NO: 9660 - DNA, 1524 bp, Myxococcus xanthus
atgctgctcgccgtggaccgggcgctggagcgcgcgtccctgcgccgcgagcggacgcagcttcgtgacgagaacctggagttcgcccgcttccacaacctgcaccagcgctgcctggagctcctgtcccatcccgacctggagtggctccaggagcggctcacctcggagctggcggccatctgcgacgcgcagagcgccgcgctgtgggtggtggacgaccggggagacctggtgctgcgggcctaccgcgggctgctggaccggcagtttctcgcggagaagatgagcccggaagggccgctgtccggacgcctgagagaggcccagccgtggctggcccgcgacgagcgctcgtcggtgatgtacgtgcccctggtggcgtcgggggaagtcgtcgggttggcgcaactctccgacccgctgtcaggagacttccggcccgagcattcgcgcgatgcccgcctgctgggtgacttcgcggcggtgggcctgaagaacggccggaagatgctcgcgctccagcgcctgggcctgagagaccgcgagacggcggcgtacaacctcagctacttcaccgactacgcgtccaaggaaatctacaaggcccggcgctacgggcggacgttctccctgctgaccttctccatcgacaacctgccgctggtgcgcgtgcgccagggcgcggcggacgcgaagaaggcggtgcgcggcatcatcaaggcgctcagcaagatcatccgcgactcggatgtcatcgcgaaggcgagcgaccaggagttctacctcctgctgcctgagacggacttcttcggggcgttgatgttcgtgcgccgcgccgtggccgccgtgcgcgaggagcccgaggccatggaggtggaccagcgcctcccgctggcgatggtgggcggggccagcaccttccccaaggacggcgaggacttcgacgagctggtgcaccgctgccgccgccgcatggacgagcggcgcgcgtcgttgcagcgccggctgatgctggacgggctgcccttctgggacgaggtggacctgctcctgggcacgccgaacagcccccggctgccggtggacgagcgctccgagccgagccgccggggcaaggtgtccgacgtcctcttcgacgaactccaggcggagattgcccgggagatgatgcgggacccaggctcgcgcggcctgctgtacgtgggcgggccggagattcgcacggacctgaacatcgccgccgggctggagtccgcgcctccagatttggcgtcgcgcatctacctgctgggccgccgcgtcgacctggagtcacaccccgcgctgacgcctgtgttcctggaaggcgacgaccgcatcgcgcggcacgagttcatcctctggctctccgagaacgcggcctacgcgctcatccagcggcggggccacggagcgacgtgggggttccacacctcggacaccgcggtggtggacgggctcatctccaagctgcaggccgaatacgacctgcagccctactga

SEQ ID NO: 9661 - DNA, 828 bp, Myxococcus xanthus
aagtatcagggcctgggcaatgacttcgtcgtgctggaccggcgcggctccggcgaggacatcgacgccgccacgtcgcggtggatgtgcgaccggcgcctgggcattggcggggacggggtgctggcgctgctgccctccgagcgtggcattgcccgcatggtcgtgcacaacgccgacggcagcatcgcggagatgtgtggcaacggactgcgctgcgcggtgaagttcctggtggatgattcgggccagacgccaggccacatcaacgtggagaccggggcgggcgtgctcacctgctacccctcgtatggcgagggcggcgtggtggccgtggacatctccatggggcccgcccggctggtggcccccaacctgccttcgggcgccacggggcagccctttctggatgccttggtgccgggccatccgcccctgcgcgcctacgcggtgagcatgggcaatccccacatggtcctcctggaccagccgctggaggatgcctcgcgcctggggcccctgctggagcaccacccgtcctttccggaccgcaccaacgtggagttcgtccgtgtggactcggacggcctcaccgtggtggtctgggagcgaggctgcggcctcacccaggcctgtgggacgggcgcctgcgcgtccgccgtggccgccgtgctggccaaacggctcccggccgatgcctggctgcgcgtcaccctgccagggggagacctgagcatccgcgtccccgccgacctgtccgacatccgcctccgtggaccggtggccttcgtcttcgagggcgttgtcgcgactccctcgggccggtaa

SEQ ID NO: 9662 - DNA, 1332 bp, Myxococcus xanthus
cgcgccgaaatcgaaggaaagctgtcggacgccgtctcgcgttctgatgctcagcgcgccgaacttgaagcgcagctcgcggaagccgtcgcgcgttccaacgcccagcgctccgaactcgaggcgcagctcgcggaagctgtctctcgttccgatgcgctacgtgtggaggcggcgcagcagttcgcggaggctgctgctcgcaccgaggccgaacgcacggcgctggaggcccggctggcggaagtcgcggtcaacgcagatgcacagcgcggcgcgctggaggctcagttggcggacgccgtggccggctccgaggcgcagcgtggcgaactggaggcccggctcgcggaggccgtggcccacgcagaggcacagcgcgccgagtcggagacccggcttgcggacctcaacgcccggttcgaggcacagcaagccgagctggaatcgcggctcgccgaggcctccgcgaatctcaatgcgcaactggcggaggccagcgaccgcgcggcccggctctccgacaccgctgaccgtgcccaagccgacagggccacactggaatcccacgtcgccgagctcacgtcccagctcgatgtgctccgcgccgacctgaccgccgccacggagcgggcggccacgcttcagtccgcccaggagcgcctcgcccgtgcggactccgaccgcgagcgcctccagtccgacctgtccgtcgcccgcgccgcacgggtccgcctcgaaggccgcgtcaccgccctggaagccgcgtccaccgacgccgtccggatcctcgacgccgagcgcgccgagcgcacccgcctgtcccaggcgctcgaagtggccaggcagcagctccagcagcacgacggcagcgcggccgggcagctcgcattgctccagaccgagcgctcccagctcgatgaacagctccgggggctcgaaacccagctccagtcccagaaggcccgcgtggacgcgttggaggcggagcggaccgaactcctgtccaccgtggagtccctcaaggtgtcctcccagcccgaagacgtcctggagatggccgcggagatggagctcctccagtccctggtggaggacctccagcagaagctcgcggaccgcgaggccgaactggccgcggcaaagcggccggcgtcccgcgcggacagcttcgccctgttggacgcgcccgagccggccaggaatgagctggtccccccagccgggacggagcagggcgccaaggccccggcgcggcgcccccgaggcgcggtgcccgcgctggacctgccgccccagacatcgcccacgaagccggacgagcgcgaatag

SEQ ID NO: 9663 - DNA, 2893 bp, Myxococcus xanthus
atggcgaatttccaggacacgtttctttccggcgccaacatcgatttcatcgagggcctctacgcccgttatctggaggaccccgccagcgtggatgcaagctggcgggaggtcttcgaccgcagcaacggcgccggacgacccatcttcagcacccggctgctggagccagtagcggctccagcggcggccaagggaggcggcaagggcgccgcgcccaaggcccaggtcgcgccggcgccgcagcccgccccggtggccgctcccggccagtccgtccaggacatctcgctgcaggcgcgcgtggaccacgtcatcttcgcgttccgcctgcgcggccacctgcgcgcgaagctggatccgctcggccgtccgcgcccggcgctggcgcacgtggcggatgtggccctggtggatgacagccacttcaccgacgccgaggcccagcagctcgtggagaccaatggcgtgttcggcgagcagcgcgtgcgcctgacggagctgctggcgcgcctgcgccgcacgtacacggacaccatcggcgtcgagtacatgcacatgctcgacagcgagcgccgccgctggctgatgcaccggatggagtccaacgagaaccgcaccgacttctccccggacgagtgccggcacatcctcaccaagctgtcgtacgcggagggcttcgagcacttcctccacaccaagtacgtgggcgccaagcgcttcagcctggacggcggcgaggcgctcatccccatgctggacgcgctgggcgaagtggccaccggcatgggcctgagggagatcgtcatcggcatggcccaccgcggccgcctcaacgtgctgacgaacatcctgggcaagcagccggatcagatcttcagcgagttcgacggtccccggaacccgcaggactacctgggccgcggcgacgtgaagtaccacatgggcttctcgtcggaccacaccacgcgccagggccgcaagctgcacctgtcgctggccttcaaccccagccacctggaagcggtggacccggtggtggagggccgcgtgcgcgccaagcaggaccgcggcggcgacaccgagcgcaccagcgtgatgccgctgctcatccacggcgacgcggccttcatcggccagggcgtggtggcggagacgctcaacctgtccggcctcaagggctacaccacgggcggcacggtccacgtcgtcatcaacaaccaggtcggcttcaccaccgacccgcacgactcgcgctcgtcgctctactccaccgccatcgcgcagatgctggacatccccgtcttccatgtgaacggggatgatccggaggcctgcgtccacatcgcgaagctggtggccgagtaccgccagacgttcaagtcggacgtcgtcatcgacctggtctgctaccgccgctacggccacaacgaaggtgacgagccctcgttcacgcagccggcgatgtacgacatcatccgcaagcacccgacggtgcgcacgctctacgcggcgaagctggcggagcagaacaagattccggctgaggagtcggaggccatcaagcagcgctgccagcaggagttcgacgcggcgctcacccgcgcgcgccaggagagccagttcaaggaacccagcgcgctggaaggcctgtggaagccctaccagggcggcgcgctgaagagcgcgccggacgtatccaccgcggtggacaagcaggtgctgtgtgatgcgctgcgcaagctgtccacgctgccggagggattcaacgtccaccgcgacgtggagcgcaccgtcatcaagaagcgcctgggcatgctggacagcggcgagctgcagtggagcgagggcgagtcgctggcctacgccacgctgctctccgagggctacaacatccgcatcaccggccaggactgcgagcgcggcaccttcagccaccgccacgcggtggtgcacgacgtgaagacgggcgagaagttcgtcccgctgcgccagttcatcagcggcacgggcaggaacggcttccacatctacaacagcccgctgtcggagatgggcgtgctcggcttcgagtacggctacagcctggacgtgccggacggtctgacggcctgcgcaagcgcagttcggcgacttccgcaacggcgcgcagatcatcatcgaccagttcatcgccgccggtgagagcaagtggcgccgtctcagcggcctcaccctgctgttgccgcacggctacgaaggccagggcccggagcactccagcgcgcgtctggagcgcttcctggacctgtgcgccgaggacaacatccaggtctgctaccccacgacgcccgcgcagatcttccacctgctgcgccgccaggtgctgcgcccggtgcgcaagccgctggtcatcatgtcgcccaagagcctgctgcgccggccggaggccaccagcaaggtggaggagctggccacgggcaccttccaggaagtcatcctggaccgggtggacccggcgggcgtgacgcggctgctgctgtgcagcggcaaggtgtactacgacctggtgaaggcgcgggacgagcgcaaggacgagagcatcgccatcgtccggctggagcagctctacccgttcgcctccgacgtgctggcggggctcatcgcgaagatgccgaagctcgccgagctcctgtgggtgcaggaagagccgcgcaacgctggcgcgtggcacttcatgttcccccgcctgcacgacctggcctccacgcagtcgaagcagcaggtgaagatcggctacatcggtcgcgccgaagccgccagccccgccacgggcttccccaagacgcacgaatacgagcagcagctcatcatcgaggaagccatcctccgagggaccagaaatggccgttga

SEQ ID NO: 9664 - DNA, 1035 bp, Myxococcus xanthus
atgagagacgacttgacgattggcgtggtgggcgcgacgggcgtggtgggccgcgaggtgctcgccgcgctgtacgcgcaggacgtgcccgctgaacaggtgcgcgtcttcggctccgagcgctccaagggcatggaggtggagtacggcgaggactcgctcgaggtggagcaggcgacgccggacgccttccggggtgtgaagctggtgctgctcgccacgcccgccgaggcctctcgcacgctggctccggccgcgcaggccgcgggcgcgtgggtggtggacgccagcagtgccttccgaggtgacggcaacgtccccatggtgctgccgggcttcaacacggatgtgctgggcgcgggcttcaccttcaagggccgcatcgtgtgcctgccgggggcggtgacgaccgccgcggtgcacgtggtggagccgctgcggaaggccttcggcgtggcgcgcgcgcaggtgacggcgctgatggcggcgtccagcgcgggtgtgcgcggtgtggcggagctggagaagcagacggcggacctgctgtcgggccgcgagccggagccgcacgcctttccccaccgcgtggggttcaacctggtgccccaggtgggcggcttcatggtgaattcgccctggacggaggaggagggcggctggacgctggaggcggcccggctcttctcgtccaagggggatgtgcccgtcatcgccgggacggcggtgcaggtgcctaccttctacggccatggcctcaccctcaacgtgcagctcaagaaggcgggcccggtggagcaggtgcgcgcggccctcaagacgtccggggccttgaaggtgctggatgtgcccggtgagcgtgtgtaccccatgcccatgctcgtcacgtccgacccggcggtccatgtgggccgggtgcgcgcattcccccaggcgccggagtgggtgacgctcttcgcctcggtggacaacgccagccggggcgccgccctcaacctggtggaagccggactccgcctggccgagcgccccgcctga

SEQ ID NO: 9665 - DNA, 678 bp, Myxococcus xanthus
atgacgccgctgcgcaagcgcgtggccgagcgcctcatccaggcccagtccaccgccgccatgctcaccaccttcaacgaggtggacatgggcgaggtgatggccctgcgcaagaagtacaacgacaagttccagcagaagcacggcgtgaagctcggcttcatgagcttcttcatccgtgcctccgtcgaggccctcaaggccttcccgcaaatcaacgcggagattgacggtgaggacgtcatcttcaagcactactacgacatcggcgtggccgtcagcggcagccgcggtctggtggtgccggtggtgcgcaacgcggacaagcagggcctggcggagctggagaagtccgtgggcgagctgggcaccaaggcgcgcaatgacaagctggccctggccgacctccagggtggcaccttcaccatcaccaacggcggcatcttcggctccatgctgtccacgcccatcctcaacccgccgcagacgggcatcctgggcatgcacaacatcgtcgaacgccccgtggcccgcgacggccaggtcgtgattcggcccatcatgtacatcgcgctcacctacgaccaccggctggtcgacggccgcgaggccgttcagttcctggtgcgcgtgaaggagtgcatcgaggacccggagcggctgctcctggacgtctga

SEQ ID NO: 9666 - DNA, 207 bp, Myxococcus xanthus
atggcaaccggtaccgtgaagtggttcaacgacgcgaagggctttggcttcatcacccaggacggcggcggtgaagacgtgttctgccaccacaccgccatcaacatggacggcttccgcaccctggccgaaggccagaaggtggagttcgaagtcacccgtggccccaagggcctccaggcgcagaacgtccgcgccgccggctaa

SEQ ID NO: 9667 - DNA, 657 bp, Myxococcus xanthus
attcgggtcctcgtggtggacgattcgcccaccatggcgaacatgctgacggccctcctcacggaggagccgcgcatcgaagtcgtgggccgtgcgggagacggcaaccgcgccgtgcagttggcgcgcctgctgcgccccgatgtcatcaccatggacctgctgctgcccggcctggatggaccgggggccatcgccgccatcatgtcccagtcccccgcgcgcatcctcgtggtgagcgcggtcgcggagcagcgcggcgtggacctgggcttccaggcgatgagcgccggcgcgctggagctcatcggcaagcccaacgtgacgaacgcggaggagctgcgccgctggggcaaggagctggcgcactcggtgtgcctcatggcggaggtgcccgtcatctcccgccggccgcgtgcggctaccgcgccgccgccgcccactggcgcgcgggtggacatcttcggcgtggtggcctccacgggcgggccgcccgcgctggcggacgtgctgtccaagctgcctcgctcgctgccggtgccgctgctcatcgcccagcacatcaccgtgggcttcacccagggcatggtgcgctggctgtcccaggtgacgccgctgccggtgtccatcgccaaggacggcgagcggctggagcca

SEQ ID NO: 9668 - DNA, 1722 bp, Myxococcus xanthus
atggtcgccgccaccgggggcctggccgccgtcgccgcgccggtgccgtccgcggagcccgtgctcgtgccggacgcgctgccggagtccgcgtacgcgggctggcgcgtgtcgtcgtggcaggtgacggcgctgatgcgcgaggtggagcgcctgcgcgaggtgcgcctgcgcgtggaggagcggggccgcgaactggagcgggtggccgtgctgctggcgaagcaggggctgctggcggagacggcggaggcgcgtacggcgctgtccggcaccgcgcgctcgctgcgcaccgacggtgaggagacgagtgacatcgtcgacgcgctggaggatggcctcaaggccatcaccacgcgcccggtgcgcaccatcctggacccgctccagcgcatggtgcgtgatttgtcccgtcagctgggcaaggaagcgcggctgtcggtggtgggcgcggaggtgtcgctggaccggcgcctgctggagaagctgcagggctcgctggtgcacctgctgcgcaacgccgtggaccacgggctggagctgccggcggaccgcgagcgcgcgggcaagcaccacgagggcgcgctcaccctgcgcgtggagcagcagggcaacctgctctacctggaggcgtccgacgacggcgccggcatcgacgtggaggtggtgcgacgcctggccgagcagcgcggcgtcgtcaccgcggaggagacggtgcgcctcaatgaaaaccagctgcgggacctcatcttccggtccggcttcagcacccgcacggacgtgacggacacgtccggccgcggcgtgggcctggacgcggtgcgcgcctcggtggaggcactgcagggccgcatcgaggtcgcgagcacgccggggcagggcacgcgcttcatgctgacgctgcctacggacctgggcagctcgccggtgctggtggtgcgcgtgctggagcagctggtgggcctgcccatgctggcggtggaggccacgcagctggcgcgcgcggagtcgctgcgcctgggcaagcgccgggcgcatttggagtaccagggacagctgttgtcggtggtggacctgggggcgcggctgggcctgcgcgccctggcgccgccggccgaagggcagccgctgttgattgtccagagcggtggcaagcgcgtggcgctggtggtggacgcggtggtgggggaccgggacctggtcatccgcccgttgccgtcggaagtccgcgacgtgccggcctggcagggcgcggccacgctcagccgtggcgagctgctgctcatctgccgtccggactggctggtgacggagacggtgcaggtgcaggtgtcggcgcagcggcgggcgctggtggtggacgactcgctcaccgcgcgggcgctgcaccgggccatgctggaggcgggcggcttcacggtgcacctggcggccagcggagcccgggccctggaccggctccagtcggacacctacgacgtcgtcatctgcgacctggacatggaggagatggacggcatccagctcatcgcgaagctgcgggagcgcccggagacggcgtcgctgcccgtcatcctggtctccgcgcatgacagttcggtggcgcgcgagcggggcctgaaggcgggcgcggacggctacctcagcaagcgcgagtgcgccgcgggccgtctgctggcagaggtgctggacgtcatgagccgccgggggagtcgcgcgtga

SEQ ID NO: 9669 - DNA, 549 bp, Myxococcus xanthus
atgaaggtcaccccgcggacgttggaagcggcccaggaggccgaggcgctcgagctgttggagcggcgcgcgtcccgcctgcgtgagcagggggagaacaccgtcgaggaggcggtccactggattgccgagttcccgctcggtgaggagcgctacgcgctctccctggagtcgctgcgcgccgcgctgcccctgaagatggtgtcgccggtgccgctgtcggcgccgcacgtcgtcggggtgctgcgcttccagggccaggtgctggccgcgctcagcctggcgtcgctgctgggcggccacgggtggcggcaggacccggcggtgctgctggtggtggaccgcggtgacggcgagctgtgcgcgctggactgcgaggccattccccgccccaccacgctgcccatgagcgcggtggaagccgcgcgggtgcgcgcggagggggcggtgatggaggtcttcacgcaggaccggcagctcatccacctcatcgacctgaagcggctgttctccgccacgcgcggcacgggagcccgtcatgcccgttga

SEQ ID NO: 9670 - DNA, 1242 bp, Myxococcus xanthus
  unsure (1)..(1242): unsure at all n locations
atgagcggagcgctcgacccgcggctgctggcccgcgcgcgggaagtggtggccggcatcactggctttcgcaatgacgccattgcctccgaggcggtggaccgcgtcgttcgcgcggagctggcccgcgggcgcaccgcgcccgacttgctgggcgaactgctccatcccgtctcccacctggccaccgcgctggtgaaggccatcctggtgggggagacgtacttcttccgccacccggagcacttccgcttcatctcccacgaggccgtgcccgcggcgctccagcggggtgccctggccctgcggggctggagcgcgggctgcgcgtctggcgaggaggcgtattcgctggccgcgtgcctccaggcgtcgctgccgcacggctttcccgtggaggtgctggggacggacatccacgaggccagcctggaggcggcacgccgcgccacctacgggacgtggtcccgccgcgagtccgcgccgcgcctcttcccgctctactcggagacgggcgagcgcgaggtcaccatccttccccccgtccgccgcatcaccactttcgcccaggcgaacctgctggcgccgctgcccgagcgcttcggccgcttcgacttcatcctctgccgcaacgtgctcacctatttcactcccgccgcgcgtgacgcggccatcaccctcctgtcgcgcacgctcaaccccggcggctggttgttcctgggcgccgtggaggtggaccgcgtccccgcgggcatggtccgcgaggggccgccggagctgcaggccttccgcctcctcacgcaggaagagctgaacgcccgcgccgccgccgcgtcccgcgccgccgccctcgcccgtccggtggcggcgccgtcccgccgtccggtggcgccgctgatgcccgctccggcgcgcgaggtgcccgtggtgccttcgccgccgnccacgctgttgcacctgaatgcgctggagcgcatcgaggaaggcgacgaggtgggcgcgtcctccgtgctggaggccctggtccgccaggcgccggactacttgccggggctgctggagctggccctgctgcgggagcgctccggggcgcgggaaggcgcggtgccgctgatgcgcgccttgcgctcgcgcgcggagcggcttcctcctgaccagctcgtggaggggccggaggccctgcccgcgcgtttctaccaggcgtccgctgacgcctacctcaaccagggggcgctcgaatga

SEQ ID NO: 9671 - DNA, 693 bp, Myxococcus xanthus
atggacggcgacgaggtcctccagcggatgaaggcggacccggccacggccgacatccccgtcatcatcatctcctcggagaagtcgcgcgcggaggcgtgcctgggcctgggcgcggagaccttcctggccaagccgttccgcgcggacgagctgctgcagacggtgggcgaggccatgacgagcgcgtggcagcgggcgcgcacgggctcgttgttggtgcttcgcgtgacggtgggcgagctggagttcgccattccgctggacgcggtgcgggaggtcctgctgcatccggcgacccggccgctgcccaccgggccggcgtacctgcgcgaatacgtggaggtgcggggcgcggcgctgtgcgtgctggacgtggcgcgccggctgggcgtggagcacaagctgacgcgcgtggagcgcatgctcgtcgtcatcgaggcggagggcgtgtcgctggcgctcgccgtggacacggtgaaggaccccgaggagtacgcggcggcggacatcgaccggcgcgagcgcgtgggcggcgccgaccatggcccgctgcgcgaggggctcatcggcatgctgcggtcgggagggcgttcgctgcccatcctggacccgcgggtattcatcgcgcgggggctcctgcgggagctgcccgcgatgctcgaggccgcggaggccgggcggaacgcatga

SEQ ID NO: 9672 - DNA, 312 bp, Myxococcus xanthus
atgaacctcaaggtctcgaccgtcgaggcggacgatgcgacccgggggctgcagattctccggctggttccggtgagtctggtcatcgcggacatcaacatgccggggatggatggcatcaccttcgtcaaggaggtgcgcgccagcgcgatgccgcaggtccgctcggtgcccatcctgctgctgacggcggagaagaacgtggacctgcgtcagcgcggcaccgaggccggcgccaacgccttcatccagaagccggtgtcccaccacgagctgacggaaacggtccgtcagttcctcaccaaggcctga

SEQ ID NO: 9673 - DNA, 825 bp, Myxococcus xanthus
gtctccatgctgctccaaggcaagaagctgctcatcaccggggtgctcacgcctcagtccctggcctacggcatcgccgagcacgcgctggctcagggggccgaggtcctcctcaccggcttcggtcgggccaagtccctcaccgagcggagcgccaagcgcctcaagccgggaatggaggtgctggaattggacgtcaccaactccgcccacttccccgcactcacggacgccctgcgccaacggtgggaccgggtggacggcgtgttgcattccattgcctttgcgcccgaagatgctttgggtggcaactttctcaacaccccgtgggagagcgttcagacggcgttccgcatctccacgttctcgctgaaggagctgtcggtggcgtgcctgccgctgatgacgcaggggggctccatcgtcacgctggacttcgacaaccgcgtcgcctggcccatctacgactggatgggggtgtgcaaggcggccctggagtccacggtgcgctacctggcgcgcgacctgggccccaagggcatccgcgtcaacgccctggccgccggtcccctgtccaccatcgccgcgaagggcattccaggcttcaaggccctggagcgtggctgggggcagcaggcccccctgggctggagcgcgaaggacagccacgacatggtggcccgcaccgcgtgtgccctgctgtcggattggctgccctccaccaccggcgaaatgatccacgtggacggtggctaccacgccattggcgcgcctccggtgacgccggatgcggacgagctcccgcccaagcccgccggcgagtaa

SEQ ID NO: 9674 - DNA, 900 bp, Myxococcus xanthus
atgcgcctcactctcgttggcctcttgctcttcgcgtcgactgccctggggcagaccgtgacgttttcagcctcggccgaaatcctccagaacgatcagattgtcgtctcccaggagaactgcggcttggaccgcacggtcaactggacgcgtgtcgccggcaattgcgacgtgctccacctctggctctcgaacgaatcgagttgcacggggacgccaggggcgggcgacctgtctctcgctgatatcccggtaaatgatactcggctgacggggacggtgaccttcaacgcgtccgacgcgctggtggcggacggcgccaagtgcgagtcacagacgtcaaccaagacgttccggctctgcgccacgaccaagcggctggggactttgggcggttgcgacgactcgttcgtttcggttgggacgccctccatcagcttcatctatgacccggagccccctgcggtgccggagaccccgagcgtcacggggctggacgccgcgctgagtgtctctgtcaaggtgccgagcgatgcggtgtccatggaagtgcaggtccttcagtccgttccgggcgaggacggtggtgtgggcgcgggtgaagtgatttcgaagaagcggcaggtttcgtcgaacgcggtcttccgcatggatcaagggctcgagaacggcgtcgagtatgccgtccaggcgattgccatcgacagggcggggaaccaaagcgaaccttcgcccgcggcgacagggacgcctgttgcgagcaacggcttctaccaagggtacctcggagccggcggcgcggagacaggtggctgcgccgcggcgggtggtggcatcacgggatgcgcgatgctggcgtccctcggagtctggctgtcgtcgaggaggaagcggtcatga

SEQ ID NO: 9675 - DNA, 2946 bp, Myxococcus xanthus
gtcctctgggagcaggaactcgcgaatcacctgccggggccaggggagcaccgtcgtcgggtccgcgtcgctcagggacgtgaagcagtccaggtccacgtccagcagcacccggccggccgcgtccagcacgtcgcgcacggcgtcgccgggggcagggcggctgtaggcctccgccgcccggtccacggtgggcaccgccaccagccggtgcggccggccccggctgtccacgtaggtgtcccccgtgaaggcgccacgggggcgggcgcgggcaatcagcagcgcgtcccccaccagccccgcctccatggccgcgaggatgtggtcgtagttgcgcacgtccagcgcccagcgggcatgttcatccagcgcgcgcagaccggcagtccggtccggcacggccgcgggggcccggggcatcacggtgtccaggtgccggtccagcgtcaccagcagggcggggccctccgtgtcacccagggcgcaggcccaggcggggagggcgagccggtgcgggtcgaacacgtaggcgtctcgggggccacgtcccccgcccaggcccagtcggatgatgccggccaggcgcaggtgccgcggggcgtcgtcttccgtttccattgcgtcgggaatcctccagcacgccaagcgtttgctccggccgcgaggccgccgagtgtaggctgtcccgcacctttccacgaaaggagccccgcccttcccgcggggattcgacgacgcatgcgccacgtcctcaccgccgcgctcctgcttgcgagcgcttcgtcctccgcccaggagcagaagcccctgaccatgtccaagacgcagcggtcgcaagaccccttcctgcgccagttctcggagacgcgccgcttcatgagcggccggcccggcggtgtgcgcatctcccccgacgagaagagcatcctcttcctgcgcacccagcccacgtccaacgtgcagacgctctacgcgttcgacgtggagagcgggcagacgcaggagctactcacccccgaggccatcctcaagggcgccgaggagacgctcacccccgaggagaaggaccgtcgtgagcgcatgcgcgtcagcgcccggggcttcaccagctatcaggtgtccgaggacggcaatcggctgctggtgcccctgtccggccgcctctacgtggtggaccgcgccagcggcaaggtgacggagctgaagacgggcccgggcacgttggatccgcgcttctccccggacggcaagcaggtgtcctacgtgcgggaacacgacgtgtaccgcatcgacgtggccgccaaccgcgagcagcgcgtcaccaagggcggcaccgaggcgaagtcgcacggcgtggccgagttcgtcgcccaggaggagatggggcgcttcaccggctactggtggagcccggacgcgaagtccatcgcgtacacggaggcggacacgacggaggtggagaagctcaccatcgtcgacgtgatgcaccccgagcgcggcggcgaggacttcgcgtacccgcgccccggcaaggccaacgccaaggtgcgcctgggcatcacccccgtcaccggtgggaaaaccgtgtgggcgcagtgggatgcggcgaagtacccgtacctggccaccgtgacgtggcccaagggcggtccgctcaccgcgctggtgcagaaccgggagcagaccgagcagaagctgctcgcggtggacccgcgcacgggcaagtcgcgggagctgctgacggagcaggacgccgcctggctcaacctggagcaggtcttcccgctgtggctggaggatggcagcggcttcctctggtacacggagcgcaacggcggcccggaggtggagctgcgcaaggcggacggcgcgctggtgcgcaccctggtgaagccggacgcgggcttccgctcgctggcgcgctacatccagaaggatgacacgctctacttcaacggcggccccaaccccacgcagagccacctgtggcgcgtgaaggccggtggcgcgccggagaaggtgacgacggggctcgacatcgagtcgggctcggtgtccaagagcggcgggctgatggtgatgaatggccagggcctcaagtccatgcccaaggtgcaggtggtgcgcggcgacggaaccaccgtgggcgagctgccctcggtggcgaaggagccgccctacacgcccaacgtggagcagcggcaggtgggccccgagcgcttctggacgtccctggtgcgcccgcgcgacttcaagcccggcaagaagctgcccgtcatcgtcgaggtgtacggcggccccaccaccaccgtggtccacaagagcatggccgcgcacctgatgtcgcagtgggtggcggaccagggcttcctcgtggtgaagattgacggccgcggcaccccgctgcgcggcgcgaagtgggagcgcgaggtgaagggcgacttctccggcgtcacgctggaggaccaggtcgccgcgctccaggcgctggccaaggaagtcccggagctggatttgtcccgcgtgggcatctccggctggagcttcggcgggtacatgtccgcgctggccgtgctcaagcgcccggacgtcttcaaggccggcgtggccggcgccccggtggtggactggctggactacgacacccactacaccgagcgctacctgggcgtgccgcagcagagcccggaggcctacgagaagagctcgctgctcacgtacgcgaagcaggacaagcccatgggcaagctgctgctcatccacggcaccgcggacgacaacgtctacttcttccacacgctgaagttgagcgacgcgctcttccgcgccgggaagccgcatgacctgctgccgctgagcggcctgacgcacatggtgcccgacccgctcgtcaccgagcgccagtgggagcgcgtcatggaccacttcaagcgcaacctgtag

SEQ ID NO: 9676 - DNA, 623 bp, Myxococcus xanthus
atggaaacggaagacgacgccccgcggcacctgcgcctggccggcatcatccgactgggcctgggcgggggacgtggcccccgagacgcctacgtgttcgacccgcaccggctcgccctccccgcctgggcctgcgccctgggtgacacggagggccccgccctgctggtgacgctggaccggcacctggacaccgtgatgccccgggcccccgcggccgtgccggaccggactgccggtctgcgcgcgctggatgaacatgcccgctgggcgctggacgtgcgcaactacgaccacatcctcgcggccatggaggcggggctggtgggggacgcgctgctgattgcccgcgcccgcccccgtggcgccttcacgggggacacctacgtggacagccggggccggccgcaccggctggtggcggtgcccaccgtggaccgggcggcggaggcctacagccgccctgcccccggcgacgccgtgcgcgacgtgctggacgcggccggccgggtgctgctggacgtggacctggactgcttcacgtccctgagcgacgcggacccgacgacggtgctcccctggccccggcaggtgattcgcgagttcctgctcccagaggactc

SEQ ID NO: 9677 - DNA, 4217 bp, Myxococcus xanthus
accggcccggtgacccgctccggcgtgctgaaggggaagtattcgtacatgtccccggagcaggcggcgggcatgcgggtggactgccgcgcggacatcttcgcgctgggcatcgtcctgtacgaactgctcaccagcacgcgtctgttcaagcgccccaacgacatccagacgctgacggcggtgtcggagtgccgggtgttgccgccctcgcacgtgacgtcgcgcgtgccggcggatttggacgccatcgtcctcaaggcgctcgcgaaggagctgccggaccggtaccaggaagcggcgcacctccagcacgcgctggaggagtggctgcgtgtgcaccaggcgcccgcctcgtccgcgcacctgtccgccttcatgaaggaggtcttcgcggagcggctggccgaggaggcccgggcgggcgacgtgctgggcgaggactcggattcgggggcgtcgaggcaggaggctccgccgcgccgcacgggcctgcggcccgcgttgccgccgcgtccgccgccgatgtctccggaggacgacgcgacggcggcgctgcgtccgcgaccgacgtctcgcacgggccgcttcgaactggagccggagaagcccgcgccgcggctgacgggacagcgccgggcggtggagcccgagcgaccctcgcgctctggcatgaacgtggcgtctccgctgccgccgcctccgcgcgtggaggaggacgcgcccacggtggatgcgcgtgcaccctcgtcggtgacccggacggacgtgaagctgggcggggccgctgctgccgcgccgacggagcctcgcggcgctccgcggcctttcggcggcacgggccgcttcgacgtgggggcgccggtcctccccgtggatgacgaggacgcccccacggtggatgcccgcgctggcgcgcgctcgcaggtgcgaggggggtacgtcgtggaggaggacgcgcccaccatcgccatgatggatacgggccggcccgcgcgggtggtgattccgctgcgggacggggagccgctcgaggaggacgcccccacgctgtcgctgggcatgtcgcgcgcggcgaagcgccccgtggctgccgcgggcagcaagacgtggctgtacgtggggctggtgttgctggtcgtcgcggcggtgggcgtggtgctctggtcgatgcggtcgccggagcccatgccggtgtcgttggacccggaggccgcggtgcccgcgcccgtgcccatgcaggccgaggcgccggtccaggctccgacggagctgcggcccccgcccgtggtgcccccgcctcccgtggaggccgcgcccgcgccggtgcggctgcgcatcgaaacgaagcccgcggacgcggtggtgctggtggatggccaacgccacgacgagcggccggtgatgttcgaaacggcggtgggccagcaggtcgccgtgcgggtggaggccgaccggcaccaggcgcagacgcgcacggtgatggtgggtgaggacgcggagcaggtggcgcgcttcacgctggagcccgagccccgcgcggtggctgctgctcccgtggcggcggtggttcgcgagcgtcccgcccggcccgagcccaggcaggaggtgcgactggcccgggtgcgcttcgtcgtacacccttgggcggaggtgacgtgcggtggcaagcggctgggcgaaacgcccttcgaggccgtggagctgcgcgtgggcagctatgactgccgcttcgtcaaccccgacctcaagaagacgctcagtcgacgtatcgaggtgaagcccatcgacctcaacgtcgtgagcgtgaagttcgaatagcacatgccttggatgctcccgtgacgctcgaagccggcactcacatcggcaagtacgtcgtccgccgcaagctcgccgagggcggtatggcggaaatctacctgtgcacggcgcgcggcgcggagggcttcgagaaggaagtcgtcatcaagcgggtgcgcgccttcctcgccagcgacccggagttcgtggggatgttcatcgccgaggcccggctggcctcgcggctgaaccacgcgaacgtggtgcagatattcgacttcgacaagcatgaggacacgtactacctggccatggagtacgtgcgcggctgctcgttgtgggagctgcgcaagcgcggcaaggagctgatggagccggtgccgcccatgctggtggcgcacatcggcgcggaggtcgcccggggcctgcattacgcgcaccgcgtccgcgtgaatggccagccgctggacctggtgcaccgggacgtcacgccgcacaacgtgctgttgtccttcgatggcgcggtgaagctgacggactttggcatcgccaaggcgggcaacaagctgacgcagccgggcgtgctgaagggcaagttcgcgtacatgtcgcccgagcaggcccggggcgaggccgtggatgcacgcacggacatcttcgcgctgggcgtggtgctgtgggagatgctcacgggcggccgtctgttcgacggggactccgaggtggcggtgctgcgcgcggtgcagcagagcaccattccgcctccggcccggctgaatccggacgtgcccgcggacctggatgccgccgtggtgcgagctctggacagagaccccgcgctccgcttccagacggccgcggagttcgagcgcgccctggcccagtgcgtgctgacgcatgcgaggtccttggacgacacggacctgagcgcgttcatgcgccgcttgttccccaccagcctcacccaggcgattcccaccgtgcaggagcgcacacacgtcgtggaaggggagccggcacctggggcagaggcgtcgcccgtgccgcgcgagcccaccgcggtgatgatgtctgctggccgcagcggcctggcgttgccgacgtctccggacgaagacgtcaatgcgccgaccttcgtgttgccgcgcaggggcgaggcggccgcgctggatgcggcgccactgccgcccatggccacgccgatgatgccgctgccggcggtggcgtcgtcgccggtgcctcgcggtgcttctttcgaaggcgcgccttccactccgggccggcagagccgtccggagggcatggtcgcggtgtcggggccgcgctccggtggggccgaggatgctcgcggtgcagcctccagcgaggatgcacgggccgagaagacgccgagcaggggatcaggtgtcccggcggtgtccgggagcgcgcggacgccgagtcgtccggaagggggcgccgccgtcgcgtcaccgtcagggtcctccgggagtctgaagttggcgagcgcctgggacgatgaggacgacgacgaggaagggaccccgtcgaatacggagcctgaggcgcatcccgggatgagggcagccgagcctggagcttccgaggtgcctgcggcgggtgcccatgcgtccggagccgagggccctgcggcgagtgcccgtgcgtccggagccgaggggcctgcaggtgcccatgcgttcggatccggggttcttgggacgagtgctcggggctccggagccgaggtgcctgcgggggcccatgcgtccggcgccgagtctctcgaggcgggggcccgtgcgtccggccccgtagcctcggtggccgtgccggcggcgcgccgacagtgggcgatgggactggccgtggcgttggggctcgccgtcgtcggaggcggcgtcgctgtgatgcgggggaccgaagaagcagctcctccggcggtgccggcagagcccatggtggccgcacccgctgttgatgaacccgtgccgaccgcgcagcccgcgccttcagcagtatctgagaacgccgagggcggggagacggggcccgccgaaaccgccgataccgaatccgaggtggatgggctgatgcgcgaggaggtgctcgccgctgccgccacccacccggcctccgaccccgcgccgagtgcggccggcacccagcaggagccggagcgcgtacgcgctgcgccggccagcggaacgctccaggtccaggccgcgccctatgccaccgtgttcatcaacggcaagcgcatgggcgaagtaacggggcgggcgtcgtaccggttgcccgtcggcaaccacaagctcgtcttccagcacccgtccggcgagcgccgctacgacgtcgccgtcaccgcgggcggcaccgtcagccgcgagttccgcgcccccagggggcgctga

SEQ ID NO: 9678 - DNA, 593 bp, Myxococcus xanthus
gtggtctgccttgacacccaaccgctcgttctggcactcagtggcccccactcagtggattatattcaatggaatccatggacctgctggctcctgaggagattgctcggatcgagcgcgagaacgcgggcggcctgcccgcgagcgccatcctgaaaatcttccggccacggggcgtgcgcctgtcggaggcgacgttccggaagtacgtgcaggcgggcttgctacccaggagccgccgggtgggcaggaaggggaagcaccaggggagcgtcgggctctacccggtggaggcggtgcgccgcatcaatgtcatcaagaagatgatgtcggaggggcacaccctggaggacatcaagcggtcctatgtcttccacagcaactatatcgaccagttggaacgggaccttgcaggcctcctgaacgggttccaggaggaactgggggaccgcgcctttgggggggagcatcggcgtacgcttgaggcacagctagcaaccttgcggcaaagagcgcaggatctggtccgggatgtcgcccggctcggtagcgccgtgaccgcacgcgcagacgaaaccatccgttcgcaatag

SEQ ID NO: 9679 - DNA, 492 bp, Myxococcus xanthus
atgtcggaagtgaagcagctacaggaggaggggggggaccaggaatcggaccaggcgcaggagcgccgccgttccaagaccatgtcgcgcaaggagatggcgcgcgacctgcggaggcgtcgcctcacgggtcaagtggaccccgaagaggccgacctgctgaagcagatggacgacacgcggccgcgtacgcgcgcggactgcatcaacggtccccggccgtgcaacttcgtctcctgcaagcacaacctctacctggacgtgaatccggagacggggtccatcaagctcaacttcccggacaaggaaatttgggagctggagcacacctgcgccctggacgtggcggagaagggcggcatcacgctcgaggaagtgggagagatcatgaacctcacccgcgagcgcatccgccaggtggagacgcgcgggctgatgaagctgcgcgaagccaccgaagccgagccgccggtttcggctcgcaagccctga

SEQ ID NO: 9680 - DNA, 1545 bp, Myxococcus xanthus
gtgctggctctcctgagcgtttctgataagcgaggtctggttcccttcgcccaggggctcgtccgcctgggcttccggttgttgtccaccgggggcacgctggaggcgctcaagggcgcgggggtgcccgtcaacaaggtgtccgagcacacgcagagccccgagattctgggtggccgcgtgaagacgctccacccccgcatccacggcggcatcctgggacggctggagctggaggccgaccgggaggagatgaaggcgcacggcatcgagcccatctccctggtcgcggtgaacctgtatccattccggcagacggtggcctcgggcgccgcggagccggaggtcatcgagcagattgatatcggcgggcccgcgatggtgcgcgcctccgcgaagaacttccggcacgtctcggtggtggtggacccggacgactatccggcggtgctggcggagctggagcagcagaaggcggtgagcgaggacacgcggcgccggctgatgcgcaaggccttcgcgcacacggcggcctacgacgcctccatctccgcgtggctgtccgcgcaggcgggcgagccgttcccgggggagctgtcgttggcgttccagaagtcgcaggacctgcgctacggggagaacccgcatcagcgcggcgccttctaccgcgagcacgccgcgccccaggagccgacggtcgccttcgccaaggtgctgcagggcaaggagctgtcgtacaacaacatcctggacctggacgcggcgctgggcctgctgctggagttcccggaggcccccgcggccgtcatcatcaagcacaacacgccctgcggcgtggcggtggacgccgccttggtgaaggcctaccgcacggcccgcgcggtggacgaggtctccgccttcgggggcatcgtcgcgctcaaccgcgaggtggacgcggccacggcccaggccatggcggagacgttcctggaggcggtcatcgcgccgtcgtactccccggaggcgttgcaggtgctggcgacgaagaagaacctgcggctcctggaggcgggccccgcgttggccagtccccaggcccggccgcgtgcccaactggacgctcgcagcgtgtccgggggcatgctgctgatggaccgggactcggtggagccgccgctgtcgtggaaggtggtctccaagcgggctcccacgccggaggaggagcaggccatgcgcttcgcctggaaggtgtgcaaacacgtcaagagcaacgccatcgtcttcgcctccggtgaccagctcctggcgcagggcggggggcagacgaaccgggtggattcggtccgcatcgcgatgcagcgcggcggagcggccctcaggggcagcgcggtggcctcggacgccttcttcccgttccgggatgggctggacgaggccgcccgggcgggggccacctgtgtcgtacaacccggcggttcggtccgtgacgcggagttgattgccgccgcggatgaacatgggatggccatggtgctgacgggagtgcgacacttccggcactga

SEQ ID NO: 9681 - DNA, 2841 bp, Myxococcus xanthus
atgcgcatcgtctgtcagaaatgcgcggccgcctacgcgattgatgacaagctcatcaccgccaagggcgttcgcgcgcagtgtcctcgctgccggaacctgcagttggtccggcgcgatccctcggccgtgcccgctgctggcgcgccggctccggcatcccagcccgcggcgcccgtcacgctgacgcccgtctccggcgccgcgcccgcggacgacctcttcggcgacttcggtgcgccgccgcccgccgcgcccgcacctggcgctgctccggctcccaagcccgcccggggagagggccgctcgggctcggacctgttcggcgacttcggggcaatgccctcgcctgctcccgcgtccgcgccgcccgtggaccccttcgcgagcgtggggatgccggcttcgggaggcggtggggcggccggtgcggaggacccgctgctcgacttcctgggaccgccgccctccgcgccgcagggcctggagtcccagccttcgcatccggcgaagcccgccgccgcgaagcccgcgacctccggctgccgcgtctgccagaagccgctgacggattccttcgaccaggcgctcggcatctgtgatgactgccgccagcctggttccgctcgggcgccggccggcacgagccgtccggccgctccgggggggaactcggacttgctgccgcccatggcggacctgggtgggggctccgcatcggtggcgcaagcctcggagccagcgcccggtgccgagccccgtagtggcgcacgcgtgcccatcagcaccgacatcattccggacatggggccggagcctcgcagtggcctccgcgcctcctcgccgcagttgggagcggagcctcgcagcggctcgcgctccgcgccggtgctcgtcacggatgggcgctcccgtgggggcaagggcggactggtggcgggcctcgtggggctcgtcgtcgtgggcggaggtgtgggcggttacttcctgtaccaacagcagcaggaggcgtcgcgccgccaggccggtcctccgcccgtggccgccatcccggacgcggtgaaggccgtgctgcctcgctggaagttgaagtacctggagattctgggcaccagcgcggaacggctcgcgcaggggcagcagcagctcgcccgtgacgagcgcttcgcgtacgcggaggcggaggagtccttccagcaggcgctggtgctggacccgaccagcgatgccgccatcgcgggctacgtccaggcgctggccctgggacgcggcgcgcgcatggacgacgcgacgttccaggaggcccgcgcgctgctgtcggcggcggagtcgcggtctggccgcacggcgccgttgctgctggcgcacgcgaacctcctgctggcccgctccggtcagcccgagcaggcgcgcccgctcgcggaggagttgctggcccgcgcggagctcgccgacgcgcagaaggccgaagcgcacctggtgctgggccgcacgtggctgtcgtcgtcccgcgagctggctcgcagtcacttcgactccgcgcagaagctgtcgccggacatcaagcggctgcactactaccgcgcgctcgcgcatgcgtcgggcggtgagtattccgccgcgctggacacgctgcgcaagcggctggagacgagcccgaaggactgggagagcctggcgctcaccgcccgcatctaccaggaggtgggggagcccgcggaggcgcgcaagttgtacgaggcccgggtgaaggcggagcccggcgagctgcgcgccctgttgccgctggcgatgctgcgctaccaggcggaaggcaacgccgcaggcgcggtgcgggacttgcgcgcgctgatgaagaaccgggcgcgctacgacgagcccgaggtggccgaggtgctggtgcacctggcggccgcggagcgcaccgcgggcagtcaggacgcggcggtgaagtcggcggaagaggccctgcaactcgtgaagggattgccggaggcgcacctccagctcttcctggtggccctgggccgccgcgacgcggagaaggcacggacccatctgccgggcttccgcgggcagttggaggacggcgcgctggagaaggtgctcgaaggccggctgctgctcctggagaagaagccgctggaggcgctggagggatttcaggaagcggtgaagctggacgcgcggcggctggacgcgcagctgctggcgggcgtcgccgcggcgagcgcgaagcgacgggacgatgccttccgcgcgctgcaccaggcgctgcagtcggacccgctccggctggagccgcggcccgcgacgtctgcctactggctgcgcccgcgcgagacggtggagggcgtggagggtgccatcctcgcgctgtccgagggaccggaggacccgtccccgctgttgtacgaaggcctgctgcgcttccaccagcaccagttcgacgcggccgagcgtcacctgcgcagtgtgttggaggtggacgcgaacaacgcgggggccctggcctaccgctcgctcatcgcgctgcagcgaggtgctctcgcggacgcccggcgcctgggcgaacgctccgcggcggcggggcggcagatgccggtgtcgcatctggcgcacggcctggcgttggcggatgcccggcaggtggaaccggccaagcgcgcgctgcgggacgcgctggccctggcgcccacgctgctatcggcgcaggcgcgactggcgcagttggagtcggcccagggcaaggacgtggcacgagacaccctggtgaaggtggtggggttggatccggcatacctccccgcgaagcggatgctctacctgttggaacggtga

SEQ ID NO: 9682 - DNA, 1260 bp, Myxococcus xanthus
gtgaaggtcctgctgctcggttccggtggccgtgagcacgcgctcgcgtggaagctgtcgcagagccccatgttgacccagctcttgtgcggtccgggcaacccgggcacggcgaagctgggcacgaacgtggccctgcgcgcggacgcaccggaggaagtcgccgcgttcgcgaagcgcgaggccgtggacctggtggtggtggggccagaggcgccgctggtcgcgggggtcgctgacgcgctggccgacgcgggcatcccctgcttcgggcccgtggcggcgggcgcgcgcatcgaagggtccaaggccttcgcgaaggagatcatggccgaggccggcgtgcccaccgccgccttccagaccttcaccgacatggcggcggcggaagcctacgcggtggcgcagggccgcatcgtcgtcaaggcggatggcctggcggcgggcaagggcgtcatcgtcgcccacgacgtcgaggccgcgcgcgcggcggtgcgcgccgtgggggccatgggcgtggcgggccagacgatggtcctggaggagctgctggagggcgaagaggtgtccgcgatggcgctgtgtgatggcgagcgctacgccatgcttcccttatcccaggaccacaagcgcgtgggcgaaggcgataccgggccgaacaccggcggcatgggcgcgtacagccccgcgcctttcctgtccgccgcgcagctcgccgaggtgggcgagcgcgtggtcgccccgacgctggccgtgttgcgccggcgcggaattcccttccggggtgtgctgtatgcggggctgatgctcacgcgcggcggcccgaaggtgctggagttcaacgcgcgcttcggtgacccggagacgcaggtgttgatgatgcaactgggggaggacctgctgccgttgctggacgcgtgtgcccggggcgcgctcgtgccgcggacgctggtgtccgcgcttggtgcctcggtgggcgtggtgctggcggcgcggggctatccggacgcgccggagaagggccagcggattgaagggctggacgcggtgccacccgacgccacggtgttcctggcgggcgcggaggcgcgcgacggcggcgtcgtgacggccggaggccgggtgctgacggtgtgcgcgcggggcgaggacctggctcaggcacgtgagcgggcctacgcggcggtggcgaccgtgcgcttcgagggcatgcacttccgccgggacatcggcgcgcgagggatgaaggccgccccgtga

SEQ ID NO: 9683 - DNA, 1026 bp, Myxococcus xanthus
atgcagttcctgcggggcaccgacgtgctgctgggctcgtcggtgacgctggtggacatggcgcggttgctggcctacctggcgccgcacttcctgatgatggcgctgcccatcgccttcctgctggccatcctcctggggctggggcggctgggcgaggaccgggagctggtcgcgctccaggcgctgggcatcgggccggtgcgcctgctggccgcgccgatgggcatcgcggtggcgctcagcgtgctgatgctggtcatcacctccacggcgcagccctggggcctgacgggcttgaaggtgctggtgagcgaggtcatccggaagaacgccgtgggcgacgtgaagtctggcgtcttctacgaggacctcagcaacttgacgctgtacgcggagcaggtgtccgcggacgggaagtggaccaacgtgctcctgcatgacgaccgggaggcgaattcgccgctgctggtgctggcgcagcgggggcaggtgggcacgtccaccagcggcgaggtgctgcgcttcgcgctggaggcgggggaggtgcaccgctccgcgggccgcgagacggaggagtacagcatcatccggttcgaccaggccgaaatcagcgtgggcgtgggcgcttccatgggcaagcgcagccgcttctcctactcccgcgaggagctgacgcccggcgaactgatggaggcggcgcgcgaggcggaagcgcagggcgaggatgcgcgcatgtaccggatggcgctgcacagccggttggggaacgcgctggcgcccatcgccttcgcgctgttgggcacaccgctggccatgggccggcgccagtcgggccgggcgtggggctacctgctgacgctggggggctacgtcctctactacctgctgagccgcgtcttcgagcagatggggcagaagggccaactgcccgcgggcctggcggggcagatggccaatctggtgttcgtcgcggtggggctggtggccctgtaccgggtgagccgctcggggacggtcaagtga

SEQ ID NO: 9684 - DNA, 1473 bp, Myxococcus xanthus
atgtggctgcccgagctgcgcggccacgtggagccgctgatggacttctacgcgcggctcgtggggccggagaatgcgcggcgggccgtggagtcatctccgctgctgccgctgctcttcgcggacctggagaacggcaccggctcggtcgtggaccccgacgagggcttcggcttcttcctgctcccggagttcgacggcgtcgtgacgctgctgggcatcacggagccagaggcggccctgaaggccgttgccgatgagctggagcgggcggggcacggcgtgatgccgcagccggacggctccgccaccgtggagcccgcgtcaggcgggcccccgatgttgctcttcgaggaccgaggctacctctatctcgccgtaccggaggggctggaggagcccgacgagggcgagtctcagcaggcgcaggtgctggccattcccgacgcggaagtggcccgccaggcggtgcgaagcctcacggggccgggcatctccgaggacgtgctcctgaccgagcttcgagggaaggtggcgagcggcagcgtgtatctcttctccgggctgcagcccggagtggcgcctgatgaagaaggcacccagccgattcggggcttcgccgcgtcgctggcggtgaagccggagcggatggacctggatggcttcctgtcctcctcgacaccgttgttccagggcgcccgcgcgcccgcgtcggcgttgctgaaagacgcggaactggggcccatcgccgcggcgcagatttccgtgccgcccgaggagctggctcggctggcgttcggtgcgccgggctccgagcgccgcgagcgcatggtggcgtcctggcgtcgtgaaggactggatgtggaggcgttgctcaaggcgctgcgcggcgacgtggtgctgcgcgcgtacttcgacatcccggccttcttccgcaacttcatccggaacaagcggcccgacatcaagggctccatcgtattcgaagcggggctgatggagtcggagcccgtgcgggcgctcgtgcagaagcaactggaggactccgtgctgcgctacacgacgcagcaggaggcgaatggcacgctcttccggacgcggattcgggagcatccggtggagctgcgcatcacgcccgagcgcgccagcctgctggcgggggagctgctgcagggccgtcctcgcggagacgtgggcgccgagctgcgggagcgcttcggtggtgaggccttcagctcgggccatgtgtcggtgatggtggacctgggccggctgcgcgcggacctgcgcgcggcggagaaggtgcccggagtgcccaatatgctgctcggggcgacgaaggcgctttcgggggcgctgctggatcggattacgccgctggactcgggcttcctcgacttcagcccggtggagggcgggggccggctcaagggacgcctgtccttgcgcgcggagcaggaggcttcgcgttga

SEQ ID NO: 9685 - DNA, 537 bp, Myxococcus xanthus
atgttcccggtggaaggcatgcgctggcgcctgacggacgtggtggagcgcaccttcgacggcgaggggaagacgtccgtacggcagctcccggaagcggagtacgacctgggcgtggccgtcaccgcgttccgcatccggccggggcggccggagcagatgcgggcgtccgagctgcgcgagcagattgtcgcgcgccgcgacgtgggcctggcgacgaagcagttcgagctggccctgcacaaccgcttcgcctacccgatggcggcgttccccgcggcgctgctgggggtggggctggccctgcgcgccaaccggcgagggcatctcacggccgccatcatcgagggcctgctgacggcggtggcgatgtggggcttgatgatggtgtgccggaccctggtgctcacggagcggttgtctcctggcgtcgccgcgtggacgcccaccgtgctgctgggcctcatcgcgggcgccgtgtggttgcagcgcgagggccggttgcacctgccgcggcgctcgctgctggtgagatag

SEQ ID NO: 9686 - DNA, 16448 bp, Myxococcus xanthus
cagggtgaaccagcatgtcggaagggtgagctggacacgatcctccagggccatgctcgccgcgcagacggcgcaggagagggagacggcatgagcaccccggctgacaacatgaagggcctctcactcgaggcgaagcgcaagctgctcgcggagctcatggcgaagtccggaaaggcggccccccgcctctccccgctcgcgtccggccagaaggcgctgtggctcctgcaccagcaggccccggagagcgcggcctacaacacgcccttcgcactgcgcatccgctcgcaaatggatgtggcgtcgctcaagcgcgcgttcggaatgctggccgagcgccacgcgtccctgcgcaccacgttctcgtccaccgcggaagggcagctcgtccagacgtgccacccgaccctcgagccgagcttcacccacgtggacgcgcagggctggagcgccgagcagctccagtccgaggtggcccgcgcctaccgtcagccgttctccctggagcggggcccgctgctccgggggaacctcttctccctggggtccgaggaccacgtcctcctgatgaccgtccaccacatcgtctacgacgggtggtccgcgggcatcctccagcaggagttcaatcagctctatcaggccatcgcgcgaggcgagcagccgtccctgccgcccgtcacgggcagatacgccgccttcgtcgcgcagcaggcggagacgatgtcgggtgccgcggggcgggcccactgggactactggcagaagaagctcgatggtgagcttcctatcctggcgctgcccgccgaccgcagccggtcggcggtctccgcgaaccggagtggcgcgagcccgttccgcctctccgcggagctgacggcccgcatcaaggcgctcgcacagagcgccgagtccacgcccttcgtcgtgctcgtgtccgcctatgccgccctgctggggcgtctggcgcggcaggaggacatcctgattggctcgcccacggcgggccggcccggctccgccttccatgacgtggtgggctacttcgccaacgcggtggcgctgcgcgcggacctctccggtgcgccgtccacccggaccttgctgggccggatgcgcaccgtcgtccacgaggcgctcgcgcaccaggacttcccgttcgcatcgctcgtggagcgactgaacatcgagcgccgtcctggcgtgtctcccctcttccaggcgtccatctcgctccacgcctcgcgcgagggcggcggcgccatggcgctgtgggcctcgcccgacgaggacgcccgcgtccattggggcaacctgcagctcgagcccttccccatcagcgaccaggagtcgcagttcgacctcacgttggagatgtgggagacgcggggcgccttctccggcgtgctccgcttcaatcgcgccctcttcaacgacgacaccgtcgccctgtggcgcggctacttcgagaagctcgtcgaggagatggtccgcgcgccggatgagccggtggcccggctgtccctggcggtcaaggccccgtcccccgtgcacgaggcgcgcgttgaaagcgccccggccgtcaccaccgcccagaccctcaccggctggttcgaggcccaggccgagcgcagcccgaatgccaccgcgctgacgtttggcgagacgcacctcagctacgccgagctcaacgcccgggcgaatgtcctggcgcatgcgctgcgcgaccacggcgtgggccccgagtcactggtgggcatctgcgtcgaccgcagcgcggagctggtcgtctccatcctcggcgtgctcaaggccggcggcgcctatgtgccgctggaccccgccagcccgaaggaccggctcgcgttgattctggaggacgcggaggtcgccgcgctggtgactgagtccagccgcaccggcgagcttcccacccagcgtgtgcccaccgtcttcgtggacgcgctcgactggaagggcggccggcgcgcgccgaatcccgagccggccatcacgccggacaacgccgcctacgtcatctacacttctggttcgacggggcgccccaagggcgtcgtcgtcacccacgccaacgccacccggctgttcacgacgtcggagccgctctacggcttcgggccggatgacgtctggacgctgttccactccgcggcgttcgacttctccgtctgggagctctgggggccgctgctgtacggcgggcgcctggtcgtcgtgccccactggatgacgcgcgcgcccgaggccttcggtgagctgattgcacgtgagggcgtgacggtcctcaaccagacgccgtccgcattccgagcgctgacgcgcgcgccgtccatcgcggatggcaagggcggccgcggcctcaagtggatcatcttcggtggtgaggcgctggacgcggcgaccgtgcgcccctggttcgagcggtatggggacgccgggacgcagctcatcaacatgtacggcatcaccgagaccacggtgcacgtcacgtactaccgggtgaccgaggccgacctcacctccgccgcgagccccatcgggcgcccgctcccagacctcgagctgcacctgctcgacgagcacggccagcccgtaccggccggcgttccgggggagatgtacgtcggcggcgctggtgttgcacgcggctacctgaagcgcccagagctcaccgcgcagcgcttcatcgaggacccgtcttcgccgggcaagcggctctaccgctcgggcgacctcgccatccgccttccggagggcggcttcacgtacctggggcgcatcgacgaccaggtgaagattcgcgggttccgcatcgagctgggtgaaatccagtcggtgctcgccacgcacccggcggtcgcggatgcctacgtcaccacgcatgagcggagcgcggatgaccgccgcatcgccgcctacgtcgtgcccagggacaacgccgcggagacgctcctgtcctcggatgcggacggcggcgtcggcgacacgcacgtgggcgagtggaaggcgctctacgacgacctctatgcacgctccgccagcgagccgcagttggaccccagcttcaacatcgcgggctgggacagcagctacaccggcgcaccgctcagcgcggaggcgatgaaggagtgggtcgaccacacggtccaccagattctcgtgcggaagccccgccgcgtgctcgaaatcggctgtggcaccggtctgctcctcacgcggattgcgccgtccacggaggcctactgggccacggacgtctcgggtgtcgtcgtcaacatgctccggggcaacacggcgaagtcggccggactcgagcatgcgaagctcttccactgcgcggcggaccagttggacggcatcgacttcggcgacatgcgcttcgacgcggtgatgctgaactcggtggtccagtacttcccgagcgcggagtacctcgcgcaggccctggagaaggcttcacagcggctggacacgggcggcgtcatcttcgtgggtgacgtacggaacttccgcctgctggaggccttccacgcgtccatcatcctggcgcaggcgtccggcacgctcgacccacaggtgctcaagacccgcgtggcgcagcgcatggcggcggaagaggagctggtgctcgccccggacttcttctgggccctcaagcagcgcatccctcgcctcacccacgtggagattcgcccgaagcggggcgcgtgcctgaacgagctgacgcgtttccgctacgacgtgctcatccacctggacacccctcccagccccgcctccgacgtggcctggggcccgggcaacgtgagcctgcccgagctccgcgcccggctgacccaggacggcacccggcgtgtcggcctgcgtggcatccggaacgcgcgagtcgaggcatccttggacgccctggcgagcgtgacggatggagcatcctcgcggcccggttccttcgagaagctccgtcggcgtgtgctggaccgcgatgccacgacgcccgcgagcgatccggagcctggcatcgaccccgagtctctccaccagctcgcggaggccctgtccctcaacgtcgccctcgactggtcgcgcggcggcgtggatggttccttcgacgcggtcttcaccccggctgcgaagtcggcgcacgggcccgtggccctcttcggcagtgcaccggaaatcgtcgtgggggcacgccgcgccaatgacccgctccggagccgggtggatcgccgcctggagagcgagctgcgcaagcggacgcaggcgagccttcccgagtacatggtgcccgcgagcatcatggtcgtcgaccggattcccctgaccgagaacggcaaggtcgaccggcgcgccctgcccgttccatccgtctcacagggcctggagacggcctacgtcgagccgcgcaacggcgaggaggagatcctggccagcatcttcgccgaactgctcggcgcggagcgcgtgggtgtgcacgacagcttcttcgacctgggcggccactcgttgctggccacgcaggtcgtgtccaggattcgcgccgtactgggcgtggagattccgctgcgcacgttcttcgcgagccccaccgtcgcggggctcgtgacggccgtccaacagcagcgccagcgccccggagtggccgcggtcgacttcaccgggcccatggagcgcccggagcgcattccgctgtcttcctcccaggagcggctgtggatcgtggaccgcatcgaggagacgcgggcccccatctacgtcatcccgctggtgctccggctccgaggccccctccatcacgaggccctgcgactgagcctggacgccatcgtccagcggcacgaagtgctccgcacgtgcttcccggcggatggcgcgcagcccttccaggtcatctccacgaacgtcacggccgagcttccgcccactgaggagctggtccacccggccggcgcttcggaggcggagctgctcgagctcatccaggtccaggcgggcttggaggtctcccggccgttcgacctcgagcggggcccgctgctgcggatgcgcctcttccgcatctcggagtcggaccatgtgctggtcctcaccatgcaccacgtcgtctccgacggctggtccgtgggcatcctcgcgcgtgagctcgcggccggttacaacgcgctgcgctcgcagcgtgagctggccttgccgccgctccaggtccagtacgcggacttcgcgctgtggcagcggcagctcttgcgggacggtgcgctcgcggagtccatcgaagcgcacaagcaacgcctgacgggggcgcccacgtccctcaacctccccagcgaccggccccggccggagacgccgacgtaccggggtggcgtggtccgcttcgacgtggaccgttccctcacggcgcgcctgaaggagctgagccgccgggaaggcgccacgctgtatatgacgctgctggcggccttcaccgcctacctgtcacggctgagtggccagaaggacctcatcatcggctcgccggtggcgaaccggaatcgcgcggcggcggagccgctgattggcttcttcgtcaatacgctcgcgctccggatggacctgtccggcgaccctagcttcctggaattgctgtcgcgcgtccggcgcacggcgctggacgcctacgcggaccaggacgtgccgttcgagaagctggtggaggtggtcgcgcccgagcggagcctcagccgccagcccctggtccaggtgatgttcgcgctccagaacgcaccgttctcaccgcccgcgctggacgggctcgacgtgcaactgctcgacctggacagcgtcaccgccaagttcgacctgacgctgtccatgcaggaatccgcggatggcctctccggcctgctcgagttcagcgcggacctgttcgaccgcgagcgcatcgagcggatggccgagcacctcgtcgtcatgctccgcgaagcggtgcaggctccagagcgccgggtgcccgcgttcgcgctactgggtgcgaacgaagccagcctggtggcgaagtgggagcaaggccccagtgccccgctcgcgcccggctcggtgatggagctgttccaggcgcaggtcgcgcgcgcaccggaggccattgccctggagcatggcgacgtccgcctgagctacggcgagctcgacctgcgggcgacgcgccttgcccggcacctggtttcgttgggcttcggacgggagaagcgggccgccatctgcctgccgaagtcggtggacttcatcacctgcatcctgggcgtgtggaaggccggcggcgcgtatgtcccgctcgacccggagtacccccaggcgcgcctgggccacatgctggacgactcgggcgcggaggtgctgctcacggagcgcgccctgggcgagcggccgggcttccagggccagacgctgtggatggatgagcccctgccggagcacgccgagccgtccaccctcccgttccccgacgcggactccgccgcctacgtcatctacacctcgggttccaccgggaagccgaaggggccggtgctggaacaccggggcgtggcgaacctccccgtggcctcggccccgctcttcggtctcggaccggacagtcggctcctccaggcggcgtcgctgtccttcgacgtatccgtctgggacatcgtgatggcgttcgccagcggcgcccggctggtgctgcccaccgatgagaccgcgcgcgtgggcgaggccctggccacggtgctcacggagaagcacatcacccaggtggtgctgtcaccctccgcgctcgcgacgctgccggagggtgcctatcccgatctccgcgtgctcatcacggccggagaagcgctccccgcggagctcgtgaagaagtgggtgacggacacccgtcgcttcgtcaacgcgtatggtccgacggagacgacggtcatcgcgacggtcgccgagctcaagaagggcgacacgggcgttccgtctatcggccggcccctgccagggctcgtggcgcgcatcctcgacgccgaccagcggcaggtccccatcggggttcccggcgagctgtacgtgggcggtgtggcgctcgcgcgcgggtaccacggactcgacgagctcacccggacgcgcttcatcccggacccgtactccgacgctccgaacgcccggctctaccgaaccggcgatctcacgcgctggagtgccgacggcagcatcgacttcctgggccgcatcgacgaccaggtgaagctgcgcggctaccgcatcgaactgggtgaggtggaaaccgtcgtcgacagccaccccgaggtccagcggtcggtcatcacggtccaccaggggcagctcgcggcctatgccgtgggccgtccgggcacgtcgctgacgattcagtccctgcgcgaccatgccatgggcctgcttccgaactacatggtgccggcgcacttcgtcgtgctggaaaccttcccgctgacgcccagcggcaaggtggaccgcaagaagcttccggaccccgtgcaggcccaggcgcccgccgccttcgccgatgcgcggacgcgggaggagcagatcctgtccagcatctgggccaccgtcttgaagaaggagtccgtgggcatccacgacaacttcttcgcgctcggcggcgactccatcctcgggctgcagatcatctcccgcgccacccagcagggcctgcggctgcgtccgcgccaactgttcgagcaccagaccatcgccgacctggcgcgcgtggcctccagcacccaggtcatcaacgccgagcaggggctcgtgacgggcagcgcgcccctcacgcccatccagcattggttcttcgaccagaaccgcgccgggccgcagcacttcaacatggcggtgatgctcgacgtggagccaggaatcgacctggccgcgcttcgcggcgcgctcgaagcggtggagcgccaccacgacgcgctccgcttccgctaccgcaaggacggtgacggctggacccagttccacgcggaagaggcggcgctgactggcattcccctggacacgctggacgtggacgggagcgagcacgtggaagaggcgctcgccgacctccacgagtccctggacctggagcagggcccgctcatgcgcgccgccctgctgcggctgggtggggactccgcgcggctcgcgctggtggcccaccacctggtggtggacgccgtgtcgtggggaatcatcatcgaggacctgctgacggcgtacagccaactgtcgaatggccaggaggtcggcctcccgccgaagacgacgtccttccagcactgggcgaagcggctcgaagcgtatgcggcgacgcccaacgcccgggccgagctcgacgcctggctcgccaccgcgcagcgggatgactcgcaggacctgccgctgaacgacccccacgccccggacacggtgagcgacgcgggcacgctcgtcacgtggctggaggcggaggaaacccagctcctgctgaacgaggtcccgacggcgtacgacgtcaaggtcaacgaggccctgattgccgcgctcgcccggacgctcacgggttggtccggcaacagcactgtccgaatcgacctggaaggccatggacgcgagttcctgttcgaggacgtggacctgagccgcacggtgggttggttcaccgcgctcttcccgctccgcctgcacgtgggtgcccgggaaggcgtgcgtgagacgctggcccgcgcgaaggacgcgctgcgccggacgcctcggggcggcatcggctacggcgtgctccgtgcgctgtcgccggatgcgtcgattcgttcgaggctcggcgcgattccgaacgcgggcatcgtcttcaactacctgggacagatgggcgccgtgccgacgcagggtgtggtgcgaggccgcgccaaggagggactgggcctgctgcacgcgcctggcgccacccggccccaccgcatcgagctcaacgccgtggtcgaagcgggtcagcgtctccgcctcgactggaccttcggcgccaaggtcttccacaaggagaccatcgagcggctgaacgcggagttccacgccaacgtgcgagcgatgattcgcgagcgcgcggagcccgccgcggcggtccgggtggcgtctgacttcccggcggcgcgtctgagtgccaaggatttgaagcgcgtgctcacgctgaccaagaagccgcgatgagccaggtggaaggtgaggggcaggacagcgccatgacgtcagaagagtcgatcgaggacatctacgagctcgcccccatgcagcacggcatgctcttccacgcgctgatggagcccggcgcgggcatgtacgtggagcaactgagctgcgaggtccggggggacctgcccatcaaccgttggaaggaggcctggcagcacgtcctcgcccggcaccccatcctgcgctccggcttcctctgggaaggcctggagaagccgctccaggtcgtcgcggtggaggccgaagtcccctggcgcatcgaggacatccgacatgtgccggaggacgcgcagcagcggtggattgacgacttcctgcgcgaggaccggctccagggcttcgacctgggcacgccgcccctgattcgttgcgcgctgatccggctcgatgatgcgcgccacctgttcgtgtggacctaccaccacctgctgctggacgggtggtgcttctccatcgtcctccgcgaggtgctcggtgccttcgaggagggcgtcgcagcgctgccgccagccgcacgcccctaccgcgactacatcgcctggctccaggagcaggacccctcccgcgcggagtccttctggcgcgagcggctccagggcttcaagcaacccacgccactgcccttcaccgagcgacaggacaccagcgaaccggccggcgatacgcagccggaagtcacaaagcggctgtcgccagagctgaccgcgcggctcacgggcttcgcgaaggcgcaccggctgacgctcaacacgctggtccagggtgcgtgggcgctggtcctggcgagagcgacaggcacggacgacgtcatcttcggtgtgacggtctccggccgtcccgccgaccttgccggttccgagtccattgtcgggctcttcatcaacaccctgcccctgagagcgcggctggacggcacggcgccggtcgccacgttcctgtcggggcttcagactgagcaaggcgcggtcgagccgtacagctacgcctcgctggcggacatccagcactggtcggacgcgccgaaggaccggccgctcttcgagagcatcctggtgttcgagaactatccgctcgacgcctcgacgctcctgcctcgcagtggcctcaccatcagctcggtcaacacgcacgaccgcatcagctacccactggcgctggtcgctatcccgggcgagtcgctggagttgcgcgtcatgtatgcggcggacgcgttctcccgcccgatggcggagcgcatcgcgcggttgctggaagccgcgctcgagtcgctgccgggcgcgaagacggtcggcgatatcgacctgatggacgaggccgcccggcgcgtgctggcggagtggggccagcatccccgtgcctacgatgtcacccgccctgtgacagccctgctggacggggccgcacccgacgcgaccgccgtggtgggccccgacggccaatccatcagctaccgcgaactcgaccgccgcgccgagcgcgtggcgcggcacctccgacagttgggcgccggtcgggagcgcatcgtcggcgtgtgcattggcaggtccgtggagatggtggtggcgctcctgggcgtgctcaaggcgggagcggcctacctgcccctggaccccaactatcccgctgagcggctggcctacatcgtgggcgatgcggcgccggtcgccatcctcaacacgggtgcggaccccatcgcggacacgcgcgttccccggctcgacgtctcccgagtcctgaacgagacggccacgcccgacgtccccgcgaaggagccggtgcagctggatgacctggcctacgtcatctacacctcgggttcgaccggcgcgcccaagggcgtcctggtcacacaccggaacctgatgaacctggtgtcctggcacacggaggctttcggcctcacggcgaaggaccggacgacccagctcgccagcaccgcgttcgacgcctccgtctgggaaatctggccgacgctcgctgcgggcgccacgctgcacctggtcccacccgagctgtccagtgcgccctccgacctggcgaattggctggtggcgcagcagatctccatcagcttcctgccgacggtggtcgcagaggccgtgctggccttgcagtggccttcgccgtgcgcgctgcgcttcgtgctcacgggcggcgaccggctccacgccacaccgcccgcgggacttccgttccagctcgtcaacaactatggccccaccgagacgacggtggtggcgacatccggaaccgttgcgccggatggcaaacaagggctgccctccatcggccggccggtcgccaatgcccgcatctacatcctcgaccgccagcggcgtcccgtccttccgggtgtcatcggagagctgtacatcggcggcgtgggcgtcacccggggctacctgaaccggccggacctgaacgtggagcgcttcgttcccgacccgttcgcgggcgtgcctgaagcgcgcatgtacgcgagcggtgacttcgcccggttcctcccagatggaaccatcgcgttccacggccgcgcggaccgtcaggtccagattcgcggcgtgcgggtggagcttggcgaaatcgaggccgcgctggcggcccaccccgacgtcaccgctgctgccgtggtgagcgaggcgcagcggcagaacggcgacgttcggctgattgcgtttgctgtcagcgacgtggtgcctcagcccgacgcggccgtgctcacgcagtttctggcgacgaagctccccacggccatccttcccagccgggtcatcgtcatcgaccggcttccgctgacgcccaacgggaaggtcgacaccgcggcgctcgaagcacgtgccctggaggcccagccccaggtggcttcggccgcgccccggacgccccatgaggagattctcgccggcatctggagcgcggtgctcggccaggagcgcgtgggcatccacgatgacttcttcgacctcggtgggcattcactgaaggcgacgcaggtcatcgcgcgcacccgcgaggccttcggcgtcgacattcccgtccgagccatcttcgagcgccggaccatcgcgcagctcgcggagacgctctccggacagggcacggcggtcgagcccatcccgcacgtggagctgacgggagacacgcccgtcgctccgggccaggagagcctgtggttcatcgacgcgctcggaggagacagcgcggcgtacaacgtcccgttggtgctcaggctccaggggacgctcgatggcagcgcgctcgcaaggacgctccagctcctggttgaacgccatgaggcgctccggagcaccttccacgaccgtggaggcacgcccgtcctgcgagtccaggcacctgccgcctccgtgctcgtgagcgaggacgtctcccctgccctcctcgacgcacgcatcgccgaggaggtcgccgcgccgttctcgctgacggacggcccgctcttccgcgcgcggcacttccggctcgcacccgacaaccacgtcctggtcctcaaccagcaccacatcatcgcggacgcctggtccgtcggggtcctgctgcgcgagttctgcatcgtgtacgcctcgctggtgagcggcacggagccggccctgcccgcgttgcccattcgctacgcggactgggccgcatggcagcggcagcggctggaatcaggacgcctggacgagagcgttgccttctggcgtgaagccttgaaggacgccccgcctgtccttccgctccccaccgaccatccgcgaccggaacggcagcggttccatgggaagactcatggcttcgtgctggacgcgccgctgggccagcggctcgaagcgctctcccggagctcgggcgcctcgctgttcatgaccctgcttggcgccttcgccgcgtacctcgggcgcatcagtggccaggaggacgtggtgattggctcgcctgtcgccaatcgcgaccggcacgaaacggagggagtggtcgggtacttcctcaacacgctcgcgctccgcgtcgacctgtctggagacccgacgttctccgagctgttgctgcgcgtccgcaagacggcgctcgatgcctacgcgcatcaggacgtgcccttcgagaagctggtggccgcactcgagctaccgcgtggacttgcgcacaacccgctgttccaggtgatgttcgtcctccaggggcagagcggtggcgagctccagctccccgatgttcgcgccgagattcaagcgccggcgagctcgacgtcgaagttcgacctcaccttcttcgtagagccgcgtgagggcgcgctcgcctgcagcatcgagtacgacacggacctcttcgacgcggaccggattgaccggatggccgcgcacctcggccggctgctccaggccatcgccgaggagcccgagctccacacctcagagctcccgctcttgtccaacgaggagcggcgtctgtacgccgacctcaaccgcaccgagcgcaggtacaccggccgcaccctccccgagctgttcgagcgtcaggcccagaggacgcctgacgtggtcgcgctggagcaccagggcgagacgcggacctaccgccagctccatgaggccgcggaagccctggccgaccggctgggcgcattgggcgtgggcccaggggtccgggtttccatctgtctggaccgctccatccatgcgcaggtcgccctcctcgcggtcctcaaggccgggggcgcatatgtgccgctcgatccgacgtacccgcctgagcgccttcgctacatgctggaggacgccaggccgcgcgtcctgctcacggagaagaagtacagcgagctgctcccgtctcagggcctgacgcaggtcctgctggatgacacggaggcacctgccacgaagacaccgcggccccgggtggagccgcatcatctggcctacgttctctacacgtcgggctcgacgggcaagcccaagggcgtggccatgccgcaccgggcactggtcaacctcatcgagtggcagaccgaacacgccagccccctgcgcacgctccagttcgcgccgctcaacttcgatgtgtcgttccaggagaccttctccacctggtgctcgggtggcacgttggtcctcatcgatgaaggcacccgacgcgacccagacgcgttggccgacttcctcgatgtggcgcgcgtccaacgcctcttcctgccggccgtggcgctccaccatctggcacaggccgcgctgcgcaccgagcatcgcgttccagggctcacggaagtcatcaccgcgggagaccaactccgcatcaccgaccccatccgccgctggttccaggaaggtggcaagcgccttcacaaccactacggccccaccgaatcgcatgtggtgacggcgctcgagttggagggcgacccgcggcattggcctgggctgccgtccatcgggcggcccatcgccaacgcggcggtccacctgctcgacgcgaaccagcgccccgttccggtgggagtgcccggagagctctatctggcgggcacgtgcctcgccgacggctacctgtcacggccggacctcaccgccgagcgcttcgtcgagctgcccctgtctccccccgtgcgggcgtaccggaccggggaccttggccggttgacggtggacgggagcatcgagttcctcggccgcgcggacgaccaggtcaagattcgcggcttccgtgtggagcccggcgagattgagcgcgccctgtgtgcgcaccccgatgtccgcgatgcggcggtcatcgtcgacggtgatgccacgcgcgagaagcggctggtggcctacgtcgtcccggagacggtgcggttggccgagctgcccgacttcctcgctagggacctgcccgagtacatggttcccgcgctgttcgtgccgatgcccgagctgccccggacgcccagtggcaaggtcgcgcgccgtgcgctccccgcccccgtcgcgcccgtgcaggccgagagcccatccgagccgcctcgcacgcctacggaggcgaccgtggcacgggcctttgaacaggtcctgggacgcggcgttgtcgggcgggagcaggacttcttccaactgggcgggcactcgctgctcgcgatgcaggtcgtctcgcggattcgcggcgacgtggacgctgcgttccgcgtctccgacctcttcgagaatccgaccatcgcctccttgagccgggtgctcgatgcgcgccggggaagccagacgctgacgcttgcccggattgaaccggcgcccgagggcgccgccattccgctgtcattctcccaggagcggctctggttcctggatcagctctaccccggcaccacggcctacaacctgcccatggcgctgcggctgacgggcacattggacgtcagcgccttccaggaaagcctgtccgacatcgtccggcggcaccccgtgctcgggatgcgcttcgtcgagcgagatggccgcgtgtggcaagagccgcgggcgaaccaggacgttccgttcgagcaggtcaccctgggagagacgtcccccgaggcgcttcgcctgctcatcgcggaggaggccgcgcgaccgttcgacctgacaaacggcccgctgttccgcgcgaagctgttctgcctcgacgaggcggcacacgtcgtcgtcgcgacgatgcatcacaccgtcggtgacgggtggtccatcagcgtgctcgtacgcgagctctcccagctctatgccggacgtgtctccggccagccggtgacgctgcccgagctccccgtcgactaccgggacttcgcgtaccagcagcggcggcacctccagggcgaggtgctggagcagcggctcgaccactggcggaagacgcttcatggcgcgccgtcggccctggacctgcccatggaccggcctcgtcctccccggacgagcatgcgcggtgccaccgagcgcatcgccctgggcaaggcgctgagcgaggccatcgaagccctgagcctgcgcacgggtggaaccagcttcatggtcctcatgggcggattcgcggcctacctggcgcgcatcaccgggcaggatgacatcgtcatcggtacgcccgtggccaaccgcgaccgcgcggagctcgagtccctgattggcttcttcgtcgggaccctgccactgcgcatcgacctgtcccttagagca

SEQ ID NO: 9687 - DNA, 960 bp, Myxococcus xanthus
atcgagaacccggggcccctcccggggtccgcgcgaggcaagcgcgggcctgcccaccgtggagcgccgcctcgccttggcctacgacggcgccgcccgcctcgtgctcgacggcggcgaggcgcgcacccgtgtcaccgtcaccctgccccgcgcgggcccccaacctggagtcctcacctgagcgccccacttcgcgtcctcatcgccgatgacgaactgctcgcccgaaagcgcctgacgcggctgctcgcggcgctcccggacacggaggtctgcggcgaggcctcggacgcggatggcgtcctttccgccgtgcgcgcgggcggcgtggacgtggtgctgctggacatccacatgcccggcctcagcggcctggatgccctggccctgctgccggaaggcggcccgcgcgtcatcctctgcaccgcccacgccgagcacgccgtgcaggccttcgaacatggcgcggtggactacgtgctcaagcccgtggagcccgcgcgccttcagaaggccctggagcgggcacgcgcacgcggtccggccacatcacccacgagcacggtcagcaccccaccgaagccacctggctcgcccgtccgcggcctgggccgcctgcccattcccacgcggcagggcatcgtcctggtggatcccgaagccatctcccacgcgtcgctggaggacgagctggtgaccgtgttcaccacgcagggagacttccttaccgacttcaccctcaacgagctggtggagaagctgccgtccgagcacttccaccgcgtccaccgccgcgcgctgctcaacctcacgcacgtggcgcgactggagccgctggacacaggtggctacctggcgcgcacgctgcgaggccacgcggtggaggtgagccgtcagtccgcgcgcgagctgcggcgcatgttgggcctgcgtcgcggcgtcgaggaagagggctga

SEQ ID NO: 9688 - DNA, 1080 bp, Myxococcus xanthus
atgccgtccgacacgtccgccaacctgtacgatttgacgcggcccgcgctgggggcgctgctctccggttggggcttcggcccctaccaccgcgaccagctctggaccgcgctgtaccgccggcacgcgaccactttcgacgaactggacggcctcaagccggagctgctgcgcatgctgcgcgagcacacgcgcctgggccagttggccacccaccacgagtccttcagcagcgacggcttcacgcacaagctgctgctgcgactggacgacgggcagaccattgaaaccgtgctgatgcggttcaagggccgcgccacggtgtgcatcagcacgcaggccggctgcgccatgggctgcgtcttctgcgccaccgggcagatggggctctcacgccacctgacgcccggcgaaatcgtggggcagatactccacgtcaaccgcatcctgcgcgcctccggcgagacgctgcgcaacgtcgtcctcatgggcatgggcgagccgctccacaactacgagcacacgatgtccgcggtggacgtgctggtggatgcgctggggctcgccatgggcccacgcttcatcacgctcagcacggtgggcgtcgtgcccggcatccggcggctcgcggatgaagagcgccccatccacctggccgtcagcctccatggcgccaccgacgccgaacgcgcggcgctggtccccgctggacgccgctggcccctcgacgagttgatggacgcgtgccgctactacagcgagaagcgcaagcgccgcatcttcttcgagtggacgctcatctccggccgcaacgacaccgccgagcacgcgcacacgctgggtcaactgctgcgcggcatggacgcgcacgtcaacgtcatccccctcaaccccacggtgggttacgacggcggccccagccgtccggagtccgtgcgcgccttccaggacgtgctcgccacctatgacgtgcccagcacggtgcgtcagcgccggggcatcgacatcgacgcggggtgtggccagctcaaggccaccgtggaacggcgttcacgccgttcacttcccaccagcgcctga

SEQ ID NO: 9689 - DNA, 384 bp, Myxococcus xanthus
atgctttccatccaggagcacgcaacggtggatgaggcgagcagtgagctgctcgacttcgttctcgagccgtacaactggctgtcactgccacgaacaggcatggacccggcagcatggcccgggcagaacacgctctatcagcgccgcgtggggtcgctgcgcatctgcgcgtccgtggacgtggcggccacgctggacgttttcctgcacatcgccttccgtgcaccgggcctcacgccggtgaaggcggcggaccatctggagagcttcctcaagcagcggctgccactgacgcccaactccgaatggcaggtggaggtggacgagcgccggtggattcacttctcgcggcgctacgcgggccctcacctcaaggcgtga

SEQ ID NO: 9690 - DNA, 939 bp, Myxococcus xanthus
gtccgaggccgcttcgcccccagccccaccgggcgcatgcacctgggaaacatccgcagcgcgctgctcggctggctccaggcgagggcggcccacggccgcttcctgctgcgcatcgaggacctggaccgcgcgcgctgcaagccgcagtacgtggacgacctgctgcgcgacatggaatggctggggctggactgggacgagcagcccgtcttccagagccagcgggacggcctctaccgcgacgcccaggcccggttggaacaagcagggcgcgtgtatccctgcttctgcacacgcgcggagattgcacgggccgccagcgcgcctcacggactctccgacgaaggcccccgctacccgggcacctgcgcgcacctcacccgcgaacagatttccgagcgcgcccgcacgcgcccccccgcgtaccgcttccgcgcggtccccggcgaggtccgcttcgtggacggcttgcagggctcgtactcgcaagacgtggacgcggtggtgggcgacttcgtcgtgcggcgcaacgacggcgtggccagctaccagctcgcggtggtggtggacgatgcggccacggacatcacccacgtgctgcgcggggatgacctgctctcctccacgccccggcagctccagctctacgccgcgctcagcctgcgcgcgcccgacttcctccacgtcccgctggtgctgggcgaagacggcaagcgtctcgccaagcgcgagggtgccttcgcgctcgcggagttgcgtgagcgtggcgtggctcccgagcgggtgctgggcctgctcgcctcatggagtggatggggagacggtggccccctgacgctcgccgaactggtgcacagcttccgtcccgaaagactgccgcgcacgcccatcgtcgcgggagaggccgcgctccgagaagcactcggcctggggtga

SEQ ID NO: 9691 - DNA, 597 bp, Myxococcus xanthus
atgctgctgtcgtccgtcgtcggcaccgcgctgcgcgcgggcggcgcggtggtgggggccaccggctcggcggtggcgggcgcggcctcgggaggtggacaggccgcgcaggccttcgggttggatgccaatgacgcgctcggccccatcaaccggcgcctccaagcggagggcaagccgaccatcaccgccaaccaactccaggccgccacgtccgaagtcctcagcaccgccctgcgcaccggcaacctcgaccaggaggtgctcgtcacgtccatcgcggacaacacgcgcctgtcgcgccaggacgcgcaggagatcgcgggccgggtgagcggccagttcaccgcgttccagggcaaggtcggtcaggtgggtgagcaggtccaacagggcgcgctgcaagcagcggagcccaccagccgcgtcttctggggcatcttcgcgtcactgctgctgggcctcatctccgcgatgcttggcgccaccgtgggcgtgagccgccgccagcgcatcgccgctgaaggcgccgtcatcaccacgccgcccacccgccccacggagccccccctgccccgccgcgaggtgtatccgtag

SEQ ID NO: 9692 - protein, 174 aa, Myxococcus xanthus
SLPGGGQAHATITKPPELVQQVEAQYPPEALAQGLTASVRLIMTIRDDGSVAEVLPTEPVGNGFDEAAIAAVRQFRFSPAEVDGVPAPVQVEYVYHFTLTAPEPEAGAEAVEAEQPKATLTGQLISRGSRSRVPNATVSCGDHADAPEVMSDEDGRFTLEVPAGTCEVRVVATG

SEQ ID NO: 9693 - protein, 226 aa, Myxococcus xanthus
MADARNVRITVLYFAAARERTGQVREALDLPEGSHVRDVLRLLSAKYAALAPLLPHLRVAVDQEFVGPDAPVRDGAEMALIPPVAGGAPGKFLVVDRPLRLEEVVEAVRGESYGGLVTFSGSVRNQTKGRRVLRLEYEAYAPMAEKKLAEIGAEAAERFPGVRVSIIHRVGTLVPGELAVVIAAASPHRKEAFGGCEYAIERLKQDVPIWKKEFFEDGEVWVGLGP

SEQ ID NO: 9694 - protein, 612 aa, Myxococcus xanthus
MNQSTTYLLCLTALATVSSGCFLRTGYILDALNTPGDPQAAPLPVPIQERAARITRTHLVDAYADPTEAARWMSAMGNAPQPILEQLDCLKQSAGGSNSACYERFLKTAMEPPQWGLPSLPTTVDPAAPSPREVDAARFLANTLGIAASLVALRDAQGDRVPIQVLTRGIREGAESAAQYVSVRKWNRTLGRPSNAIVLSGGGANGAFSAGAIWRLLGVLEQCRGKPAPEGCGDARIDLAAGSSTGALISTLVDLFHTPGHEEAARQLLVSNYTCSVESDLYCVNNTWIWKIASNLRGLVQFDGIYGKLRAAVVPEQLTNGTELVAVSVDFDTGDVFGISDQDPANFDPNATEQQRVEGIINGVVASIVEPVLADPVPWLPSHTGRMKGSFFDGGVRSGLPLLQAVQRGAERVLVISTGGVEPSPENPPDNAVSVLMRTIDLFVAQPRVGEVQQGEMAAVGRRFAEHNVCVERLANVADAASVNAFCRRTGMGFVPREPAALKAATSMWLGSARFDQVASSWRSSWMFRPDSQLQMASGYGFSPEVMRPLFKEGVKHFQQRCREVLRLFEIQGTLAAAECDKPVDDAVSEAEARFAPLAQCMKGKPEQRSCK

SEQ ID NO: 9695 - protein, 96 aa, Myxococcus xanthus
MTNAGTSQFSSAYIPNPALGGTVEWDADRRIIVYTTTSLRPGEDGEVRVITFDRNYDVATAYSLGTGFGPVWTERGTVVYSRNEGERVVSVEVRVK

SEQ ID NO: 9696 - protein, 443 aa, Myxococcus xanthus
MFVEAAAIYDDLIRQSPYDQELLLAREGLRSRALAQLLSNAREARLEGDDEEAEAWLLRFLNHRTAWNAKLNGGLESSLHEEVDGTRRHLQRLVGNPARQGHALTAEQALRRKQPLLAHRELALISRDMEWLVLQSGKTSCQRLRDTSTDDSPHWRELVFRYCGHWREYAPRPATAPELFGPPSWTGTVEGLDEAQQAQLEARLTQAFESSPWFAPGGSARPVFSLEGRFVTQRDSHPVELTAPWTESVPYTDHEDRTETIEEPYEAEEEYTDSKGKTKTRKVTKYTKHTHTYSVPVTRYRDVPRKFEYHALRLSQAHHVTVASSVVLDARRGPFTVTLQDQLSESGHEHDVTFKEGNVRPQRPNFTLAEAWLEAKVEALRVAFSRRLAEHWRESYCSTPSLTLDEAARCARAGIAVPIQASRVLSDILGADATQVPALFALP

SEQ ID NO: 9697 - protein, 496 aa, Myxococcus xanthus
MGMAIHQEEFRPEDHERFSRRLAESLEALRALLARPGFGVGAPTVGAELELYLVDRLGFPLPVNRAVLARAEDPRVTLELDAFNLEVNLRPCPLAGRSFSALRQEVESAVSAVRRAASMLGARVAVIGILPTLREADLGSGALTSEPRYRAMSTAIRQRRSAPFHVSIRGEEEALSLTWKDVTLEGANTSLQYHLRVAPGDFARMYNAAQLATAPVLAAAGNSPLFLGRKLWDETRVALFRQAVDDRGEPGEGGFQPHARVSFGHGWVREGAYQLFAEAVALHPPLLPVSGDEPLRERVAAGEVPDLEELRLHQSTVWSWNRAIYDPKAGGHLRIEFRALPAGPTLVDMMANGAFLLGLTLALAERVDALLPALPFVHAYGNFIRAARQGLDAELLWPSSTAPSPRPMAATELVKRLLPDAREGLVRAGVDAEEADTLLGILEQRVVLRRTGATWQRQMLARLESQMPRRDALAAMLERYLQRSESGAPVHTWPVE

SEQ ID NO: 9698 - protein, 531 aa, Myxococcus xanthus
MTDITLEEYKALRTLQRAVDDALEDSLRGRETLTQTFKRCFPLVLSLTGAKAVAITTRDEELVEQTWNEGDWSDRHPGALLEGAVGVRRLGADTLVSQPLDVAGTRVGVFGLLFANDATAPDSSARLLRVLDTVAEQLDTVLCLVHTASEKHQLILQCNSHLANPVFEAGMDLAVLTLAQRVRLPGFLLLYRDAVQPHVLHYRTYRNGHLEFESGEQPHAGLEAAIRQHGPRLLLSEESTLRRLFSGRTTEAVLISGAAAQGPLGKIVVWNDSGFSSYAMDLIRVLASTLSQRLQDYNRERIHLSQFFPNAIIDALLHDPAYAQYLRAQDQEVGILFADINGFTRICEQGFDSPRNIGRFVDEWSQRAVGCIWEHGGVFDKMVGDCVIGLFGPPFFKGTPRERAQAAVRAACDIQAFTASLGAREEVAALCERVKLPGLGVAVGVNLAHANCGLFGPNRQYTAFSSGMNQAARLQSLAGFRETLVMERVHDALVGSDEPFFQGLRFGPLTETPVKNVAQPLRHYRLEPLTP

SEQ ID NO: 9699 - protein, 284 aa, Myxococcus xanthus
MRIAHCSDVHITEDYFALPLHRLGWRRWMALAELTVGGRARRYARAPQALAAIARDAQAAQVDHFILSGDLTAYALDAEFSGARQSLGALAEDPRRCTVIPGNHDVFTPGSHRTGRFAKYFGHLLESDLPEYRREGAFPFVRLLGTEAAVVGLLSARVPRTPGLSYGVIGEAQLGGLAALLKDARLEGRAILVVVHHAPLNPHGRPDRWHHGLRDADALLKLLPGPRYAVLHGHIHRRYHHPATADRPHVFGAGSSTESGHEGYWLIDVADGQVSGGQQQTPAL

SEQ ID NO: 9700 - protein, 31 aa, Myxococcus xanthus
MNSQLELSAHPEEDSASKPVAADEQAPAEIL

SEQ ID NO: 9701 - protein, 63 aa, Myxococcus xanthus
QALEGPNKLLAAMRPMPDILAAFSKRLAALGTPPPPPPVQAVDYVSLIHHALPRNHKGRTKPQ

SEQ ID NO: 9702 - protein, 62 aa, Myxococcus xanthus
TEERVFKGRVPARSVVIPGMREKQFPAGKYMVPCALIIGQRTKSTDQKTSLNAALRDFAVAV

SEQ ID NO: 9703 - protein, 45 aa, Myxococcus xanthus
MGHLDAARGKALGANILFGVAATAAAGAVITYFLGNEATAQREAR

SEQ ID NO: 9704 - protein, 209 aa, Myxococcus xanthus
MAHHLDDILPEWALGMLEAPARASVEQHLAECARCREVADRLVSTHAALASLVVPPPAVLARLMDQMEGPGRLARFADRVAAFFDLSRERALALLDAVSDPAAWMPGPVEGSELMPVETGPAREGTMAAILRLHPGVRYPRHTHHGREWNLVLEGGFREDDGHEVWPGEELEKTDGSAHGFTALTEGPACLCASVLEGVTSFEEAFADG

SEQ ID NO: 9705 - protein, 362 aa, Myxococcus xanthus
MASIDLATRLARTTLELCRIPSPITQEGPIADHVERWALQHFPREEVFRVGHTLLLGKLEDARPTVALIGHLDTVPAHPSDAGREARIEGERVFGLGASDMKGGLAVMMALAEDLRRDTLPVNLAFLFYEREEGAYAESGLIPLYEKRPDLAKVRFGIAMEPTDSVVQVGCVGSMQVTVRFTGRSAHSARPWQGENAIHKAGPFLAELLGRQRVEVNVAGFPFYEVINATLAKGGRARNVIPEAFELNLNYRFAPGKSIEQAKADVHALVAGRAEVEFTDASPSGPVVAGNPLFQKLMALTGLPAASKQAWTDVARFGEWGVDAINFGPGETAQAHQANESAPIAPLADAYEKLAAFLKGAS

SEQ ID NO: 9706 - protein, 426 aa, Myxococcus xanthus
MQREGTPQDDLALGAAVDASGDLLTLSLHDIDDLDSLQPTDDRAKLVLTRRAPTGEPRWQKAFDVRAPEAPPERRAFVRGRIAADPAGGIVIAGTTEGVLDLLSHKLGDGTFVVRMDADGNVLWTNTPVGTGLAVADLAVDTQGRTLVAFNAPGSTDFGNGVTGAGAVVVTYAHGGLAESAVSVGEPQGGGRVALTTMAVDGAGRMAVGGQYEGAVRFGSQQVSAAESGSPFVALYQQGSLTWTKAMSQARGTMRDVAIDGEGTVVAAGPFLGTVRWGDMQVPGHAFRETPFVVSAKAEGQETWAKGLGDGLQVDALALAPSGELMVAGFTFNRIENGVAGKDGMGSAQPVALRYDAAGTSLLTTMFLADPPRPRGELYGLEAIPSMGVLPDGDVFLFGHTDRETDFGTGRQSFARGDVFLLRLKR

SEQ ID NO: 9707 - protein, 369 aa, Myxococcus xanthus
MVAMGGAYVGIAEGAAGLPSNLASLAHRGPALEKDWDLGVTLSWLDLPFTGSRKRDVDNDGQPDESHDSRQLLGGLLLQYKRFGIGFAMRNSVVSYCATAACAGPGERIRVSLTQSVLAGAMSFGQDDFILALGIYAAQASFRLDSGGTDLRYGDTGVAVDILYRPHGRPWRMGVTVRPEVVGDWRREPKQLPELAGRTLFGAVVSPAVLSVGASWRLGEGAERYNRLSPAARRQLLVEGDALPVPEAEPLDAPAGRWLISAQVDLISSVDNAVPARTFASTADEAMVGKGTSFAPRIGVEHDTVPGMIRLRAGAYAEPSPFDKRPARPHVTGGFEVFVFRYWEDWSVTASFDLARRYTNVGLSVGFWR

SEQ ID NO: 9708 - protein, 103 aa, Myxococcus xanthus
MASKPTLLAPEALQSFLSQHTEWKHEGGMIRRTFEAPTFLAGIAFVEQVAQAAEKADHHPDIDIRWRKVTLALVTHDAGGLTARDTALATEADRLFTEATRAR

SEQ ID NO: 9709 - protein, 413 aa, Myxococcus xanthus
MVGVGQPQALTVHGVFSRCDSSQEDRAQSVSVEVRDPQNRVVPATAQLAVHGRSAIVRFTPEQTGRHHLVVAFSPVGSIRQSSLYAVEDHSAQAPLADLSTVLECRGVDRTSSGTWLCGSQALRTPDQEPQPLGDYFAPAVVAGDVVWVTEAARVRRYVDLGNGPLATSADAPFPATGAPADAPPHARLATATELLLLDETHLHRYAFSEEEGLRATGSPPVPPSRLATFSDDIPSLLMRAGERLLVVRIADAPAPATMAIEACPYQLDAAGAPQPVPGEPCHSVPGLPVGHEEGVLWVRAASGPQSLALLRYSAASGRLRLDGVMEMTSSFHFQGAERLRTTGFGVPVVSPATGSSRPYAVPRWSAETGTVVLELLPSPDGRRPPFVGRRYFHLEHWNILYGVKVYARPSTP

SEQ ID NO: 9710 - protein, 496 aa, Myxococcus xanthus
MPKAKYVLALDQGTTGTHVSILDTKLQVVGRSYKEFTQHFPKPSWVEHDLDEIWASSEWCIARALKSAGLRGKDIAAIGITNQRETTGLWMRGSGQPLSHAIVWQDRRTAEQCRRLKEQGVEPRVREVTGLVVDPYFSGTKLTWMFDHLKGARAKAEKGDVCFGTIDTWLVYKLTGGAAHVTDVSNASRTLLMDLTTLQWSDEMRAMLSVPAACLPQIRGSAEVYGTTRGMRSLPDGIPVAGMAGDQQAALFGQACFEPGESKCTYGTGAFLLMNTGSEPVRSSAGLLTTVAWRLGGTGTTTYALEGSSFIAGAAVQWMRDGLKVIKRAPDIEALAASVKDSGDVVFVPALAGLGAPHWRPEARGLFAGIDRSTTVAHMARAVLEGIALQIHDLAEAMRRDSGRDIPVFKADGGAAANNLLMQFQADVLGVPLVRPRNLETTSLGAAFLGGLGAGIWDSPEAIRRAWKAEKTFKPKMKPDARERHLAKWKRAVERA

SEQ ID NO: 9711 - protein, 232 aa, Myxococcus xanthus
MEHIHPAIAMGDGTSEDSRLAGDVWGVAVRPDGDVWLATHIRTTRFKIMTNAVGHVGTGAPWNFEMARKQSEEKKHVANRIDLWPDAVAEPQFPTHAQRKDDLVSDLVLMPDGTVWVSSFAWGLAKMSDAGLVTGYLLEGDGDRNISSLELDPRDGSLWIGHRWGKGLRRMHGEGEFVSHNPALGGLSALPVWDIQMVGSGDARKVLVAFSAQRDAAGTIVRPGAIGIYSGK

SEQ ID NO: 9712 - protein, 169 aa, Myxococcus xanthus
MHVDGGEYTSWFPDGRIQRRGLKGELVYGLNTRDDGHLRELVLRDASFLDMEILSALTPTEEFQMLGGAVDTAMLHTLREQTDIGAVPRLRLVQTRVGAEGVEILAAFKNLREVWFDGNPGLGLQEARKLERLRPGCVAHHVDPDALPPVRRPRVLSSAANGHTARPRG

SEQ ID NO: 9713 - protein, 412 aa, Myxococcus xanthus
MSNGRGLVVGTVVVLVGLAAAVVAITREQPLPALRQGGTLTVASAMSGSTEGYARAKEPRDFHFPEDHGPHPEYRTEWWYWTGNLETEDGRAFGYQFTLFRNALAPEAAPRDSAWGASQVYMGHFAVTDVASGGFHASERFSRVALGLSGATSQPFKVWLEDWEAASAGPSTWPMRLRARTDAVTLELLLEPGKPPVLQGDRGLSQKSAERGNASYYYSMTRMPSRGTVRVDGRTYAVKGHSWMDREWSTSALGATQVGWDWFSLQLSDGSELMYYQLRHRDGSPDAFSTGLWVPPEGTGEAVHVGRDDMKLTVLDTWKSPHSGGEYPSRWRMQVDSLGLDLTVTPRLADQELPVSVLYWEGTVGLEGTRAGQPLTGRGYVELTGYADTQGPRRRESQARGAPDAQTTQNIR

SEQ ID NO: 9714 - protein, 264 aa, Myxococcus xanthus
MEGWRTQLTGFTRAELHALAAVAAPGALDDLGLTSALRSGLVKMAASLPALQQPALEYARQRLHVDASSWFPEREAVPHLATLRDAVWQDRRVSLTYRDFEGKPSRKVVDPYALVIKADRWYLVASTGEDEPRVYRGSRVDGARIRPETFIRPARFDLPAFWKAWCSRFAEKRAQYEVTLRLTPEALEALRKIRPRAEGARLDSAPCSADGRKTVVVDFEREAIAFSQLCDVGSEFEVLAPEALRTKLLKLATGILDTHRSATP

SEQ ID NO: 9715 - protein, 236 aa, Myxococcus xanthus
MFCLFGAQALASYATVLDGTVLLSADNTSRYLVAGGARFFIPSTQWSLYSSANLVVMSQSSIDAITQIPRDGTLAREKGQIAIYVFVGGMPWWIPNPTELDFWDDWKTINEIPSYWEAPFQDYSIQQVLLRERTGTQIYIWTTGLKIPITNASDLAYYGGESNVKTVPLGTLANHSDSEPYCGAILRERSSSTSYYLGYSAGLMRRYATTSAPHAVVPDGALSSFPVTTSGPYCIQ

SEQ ID NO: 9716 - protein, 131 aa, Myxococcus xanthus
MRTRVVSNLIMGACTVALGVVPHLGVYLAAMGIFGVALPLYNTPATVMLQERVEPAYLGRVFSVMTMLSTALMPLSMLLFGPLAEAVSIEPLLQITGVLVIFLGLLAPLHRRLMSFGEPKRPPVESQDLAS

SEQ ID NO: 9717 - protein, 436 aa, Myxococcus xanthus
MRGPSKQTRGWSALLLGGLLSLACGGEAEVLEGNSPSREDVEAGLHGPGSQGPYPNWATPTFATDAQVAEDGNQFFVAWSDGRPGRFYAARVSKNGRLLDPDAIPLNPGLRPDAYYHATAFDGRQFLVVWTGDTSIFLTRVNRNGTLDGPPVTLFTPTDHQPAGSPGIACHERKCLVAWIGFGGTATGAVRGITLNTAKPGFDVQEVFISNQLSAINSYGVAVAWSHDRYLATWTDSRFGGQDIFAARIRRTGAVLDPDGFVISAAPGNQNFSAVTATKQGFFVAWSDARNGTPDIYGARVKDGTANVLDPSGIPIATSSTNDITPKVASEGHQVLVTWSALTADTGRVRGARVKLNGDVRDRHGFAISRGAAARQLVSGNVAYANDKYFVVYGRAPVLDEPPYQVIVGTRLKQDDVLDIPAIRISHAPSVEQLAP

SEQ ID NO: 9718 - protein, 190 aa, Myxococcus xanthus
MMALERLSPLERAAFLLHDVFGMDFEEVAKAMGRAPAACRQLASRARAHVREARPRFPVSEAQGSELASAFYAASRSGDMGALQALLAQDVVVYSDGGGKVKAALNPIYGQEKTVRFFEGLLRITGVNASQLVHEGFIDGLPAFVTLEKDGTLQTTALDIEDGRVATIYVTRNPDKLQGIRGLVGDKLPS

SEQ ID NO: 9719 - protein, 150 aa, Myxococcus xanthus
MNAFAVAPDAMKLTLDYGQKLLELGLEKSLQELVKIRASQLNGCAFCIHMHSRDARAHGETEERIYLLDGWRESPLYTERERAALAWTEALTHVSQTHASDEDYAALAPHFSEQEIVHLTLLIGMINTWNRISVGFRSIHPVTTPRTEAA

SEQ ID NO: 9720 - protein, 332 aa, Myxococcus xanthus
MRYDFAGSTAGFLSSTWAGVDLSRHCCTYFLWGVPRVELVAALAATFQRVYMVIDIGCFSEQQRLEQMGRGLLKPCAKDRELLEVIDACRKYPNLDIEISGIGGLPFASKATLAEELRLVERIISLDCVVGYQRLEAQPGALVTQHPARFDMVTEAKTFAEFLDYFERREPGDVSVPMIRFRDAGLEAAVQHTSDRVDALAWKHRHTRKSVAIQGRTRLRNTAPWTQRFTLGEWLGSHRAPAKLAGEAVTVLRSVDGITMSCAPSVSPKRFSDPTLTQGEDGAILLAALAAFEHPTTVSSAVSKLGAKARLDPHSAREVIDHLVDGRFLQPA

SEQ ID NO: 9721 - protein, 382 aa, Myxococcus xanthus
MRATVLTSPALDAWADRFVWLAVDTDADTSMAFLQRYPVDTWPTFFVLEPEHGAVLARSLGAVSLPQFLGLLEQSERTFQQGRLGTEALVRADALALSGQHGEAAVAYQRALEQLAPEDARRAGALVSWSKSLAATGASADCMRVAASELPKLSRVDDRTRLLYVGMGCALDTNTDEARAVRGQFADEANRALGAPETELTPLQRSSLYELACEAREASGDEAGLRDQARTWWAFLQLQATHANGAEERAALDSHRVMATALLDQPDAAIPLLERSERELPGDYNPPARLATLYLMAGRKDEALTASKRALALAKGVSRGTVLAGHARILMAHGERAHAERLLTEALSEMDRTPGIPQDHLQRKVLERTLARLRASNGASPK

SEQ ID NO: 9722 - protein, 323 aa, Myxococcus xanthus
MLVTEKPTGSLYIVTPQGAKSPAVVGLPNVDGRGQGGLLDVEVGPDYAQSQLIYWTYSEPRQGGNGLAVARAKLVDGAQPRVEDVQVIFRMMPTLESTLHSGGRLVFTPDGKLFVTLGERSILAGRVQAQELNSHFGKVVRINPDGSVPQDNPYVNTEGAKPEIWSVGHRNVLSAALDSQNRLWTVEMGPRGGDELNRPEAGKDYGWPTIGYGEEYSGAPIHESPRGPGMEQPVYYWDPVISPSGMTIYSGTLFPEWRNNIFIGGLSSQALVRLMMRNDRVVGEEHLLKDLGVRIREVVQGPDGALYLLTDATNGKLLKVTPR

SEQ ID NO: 9723 - protein, 229 aa, Myxococcus xanthus
RALQGPMLPPAMNTKAGGGLFCELYWGNNLSEAWSYGPEHSNVHAAPDETAPLPLYGFTLPEEPFLLAERTAQGWRIHLPPAARAERAVKGNAYAAVPQTDLRQHDGRTTVELAEGMTLRLSEGQLSLRIQGSVVKEQVNRLQWKDFGWLIIVSILFLSLPVGFLIAGPTPQRIEESKVRAMKIAADKEAARRKAMGLDTPLRPLTDEELGMQPDGGDDVTVPAFLRVR

SEQ ID NO: 9724 - protein, 43 aa, Myxococcus xanthus
MLFPVYIATLLWLGLWLRDARLRAVLPGRATSPKSSGRPGVEP

SEQ ID NO: 9725 - protein, 164 aa, Myxococcus xanthus
MAIWTTFAGYTLGENTLSREVWVTPAPQLQTFCKTVPEEKLVGRLNQYLGLPPPTENDNARYVVELWVRPENLFRPCPDAEIDDASCGLQFPASATSEHRNWINAYYAYSYGFWQSTHYPWTGLGYTYDWCNADTRVGASEYVVRADSIVEVTGKFERAIYCAP

SEQ ID NO: 9726 - protein, 157 aa, Myxococcus xanthus
MRQAYDGVRPYLGFLLTVARSTAIDLMRASGRVSREAVPMDDAPELPHLPTEGRTPEEEALSTEVRDLVRAFLDTLTDEGRALAQLRFVEGLSQESAAQQLQLTRGEVRVRERRMRTQFTEHLKDSGWLDASAEPGRMELGVLLASLALCAIGSMPS

SEQ ID NO: 9727 - protein, 343 aa, Myxococcus xanthus
MGAADINGDGKVEYSELGAFVTASLQGVKGLPARLSLHAFAPTREPRRPLVGPAPKGPSLPLPAGLEHSRISVEDSDGRRLADVRRSKEQYVLLRLPERDVYWIRTPTQEARITLAKLSTNGIIDMGDRELQERGPAEEALRKGLFAVPLDKDFYERYVAVTGLAPVGVSQAFPPSAGGTFPRFMAQRPDTMGGWDLGWTGQQAPLGLSTLATGPTVTWRREAPLPSLYYGARASYGLTPLATDDIRTHRGALLGLLGAQAPAHLRVPLFLEAGAGWGFLGITRGQVRMGDPTVLSTYTAAGVTGALAGVRLRLAATLTYDRVTLDQRNYWDRAFGFELALRR

SEQ ID NO: 9728 - protein, 615 aa, Myxococcus xanthus
MVMLVLVTGCDGIDLDRLVRQHPPLTRLEPEPAGANCAQGGHFVRTGLDLNDNGVLDDGEVTVTQYACVTAIPGVLMRVQDEPPGENCTEGGRVYRAGQDSNRNDELEDSEVTREVYGCASSEAVVTRVRAREPFVFPCGKHGAVVEAGQDQDGNGVLDDSEVRATSNLCVLPSEVRVRQSPAPAGAACPTPSTQVDVGTDADADGLFEDEEVMSSMFVCQPLHTLDGTYRVRNAVDLVALEGISRVRGSLYFDSGSVTEARLPDLMMVEGALEIIDTSLERVEMPSLRLVAGPLTVARNPVLTTLTLGSGSRAPLRVWGDFSLVSNPLLPTLAGVSAVLPGSNIVLRDNDALEGGYFTFVSALLGSITLEGNAKLSTLPFRHLEWLGGSLNIIGNSALSTLSGTVLHTVVGDLVIENNEVLSGLWGMPALTSIGGGLRVRDNANLRSVEGMNELTQVGTLEFDRNPALEAAGEFPKLARVTSGMRFNANAVLKDLWGLQKVQNSGFLFIGNNPQLSRLMGFDRLLSLKVLTLENNASLIDLSDLALLHSLEELHVISHENLLRLDLNALENVTLIFTVTENPRLPTCLAVSLAARVNTGGAPEIRGNDSSSPCD

SEQ ID NO: 9729 - protein, 365 aa, Myxococcus xanthus
MESVCVEPTRLMVVYVPEFAGATCPQGGTGIRLGVDSNDDGVLLGPEVYKTAFVCEALHTLHGDYTVQTPADLAALQRISRIQGSLLINDASITELSLPGLAVVDRTLRLWNNQLLTWVDLPVLRFVGDDLDVTANPALDRLQAGGADHQRLFVGQGVVVSNNDRLRSLSGLVSVSPRESLLVVGNDALAFHPKEDSVLVNVDNLMGSLTIADNNALQALPFSNLFHVGGNVRISGNPALRSLEGLSPRSIGGALVISENEALQTLSSLEPVRHLSELRVMGNSALTTLEGLSGLSTLASLRVSDNTSLIRLGLSSLYQVGQAFDVTNNLELPTCLATSLATAVYTGDAGQLHISGNDDTATCGE

SEQ ID NO: 9730 - protein, 264 aa, Myxococcus xanthus
LALVLATGCDGIDLRRLVGQHEARTRVADEPSGPNCEHGGKAVCSGLDRDDDGVLDDDEVTGTEYICTTLSPGVLVRTRQLPPGEPCALGGQLTLAGADLDGNGLLSDDEVTREVHGCMEPAPVLARVRPLLAQPFVCRYDNALLEAGVDLNGNGVLDDNELRAAARFCADPAVTLLRQRPEPAGPNCTTGGTQVEAGVDTNLDKVLDETEILSSAFVCQLSATHDGTYAVENAADLEALKSLSIIRGGLAIEHTDVTDGGAAR

SEQ ID NO: 9731 - protein, 423 aa, Myxococcus xanthus
RAVLIRISEAVSVLHLTLHHIASDGWSGGVLFRELVAGYEALAAGRPSPLPELPIQYADYAVWQRGWLEGPGMEAQLAYWKKQLAGAQVLELPTDRPRPARWTGRGGRLQVSVDKPVMDAVWAVGRREGATPFMVLTAAFQTLLHRYSGQDDVIVGTSAAGRNRPELEGLIGCFLNTLAIRGDLSGAPTFVELLRRVKVASIGAYAHQEIPFERLVDELRVPRDPSRMPLVQAMLTFHNTPPVEVRTPGLGVKMVELDIGATKVDLSLELRETPQGLTGALEYPADLFDLSTVELLWERFVRLLQGIAANPSQRVSELPLLSDAERQRMLVEWNDTREPFAGDATLHGLFEAQAARTPDAVAVVAEGQQLTYAALEEQANQLAHHLRTLGVGPEVRVGLCPERSVELVVGLLGVLKAGGAFVP

SEQ ID NO: 9732 - protein, 2324 aa, Myxococcus xanthus
MQGEDSSSDIAVIGMAGRFPGARNLGDFWNNVRGCVESISFFSEDELERSPLIPEDLWRHPHFIRAGGILEGADGFDHGFFDIPLREAQWMDPQQRVFLQCAWTALEDAAYDPSRYKGRISLYAGAGSSGHLLNLLSEARKDAGAGLELATAGPESLAMKASFKLQLRGESVAVYTACSTGLVAIHMACQSLLTRQSDIALAGAVRIASPQRTGYLHQDGLIFSPDGHCRAFDHRAGGTVAGNGAGVVVLKLLSDALRDGDHVHAVIKGSAVNNDGQQKVGYTAPSIEGQTEVVADALAYSGLGGDDISYVEAHGTGTSLGDPIEIAALTRAFRKTTERSGYCAIGSLKTNLGHLDAAAGVAGFIKVVLSLQHGELPASLHFERANPEIDFERSPFFVNTALKAWPRENGPRRAGVSSFGIGGTNAHVVLEESPPEAEKARGHRPLHVVTLSARTPSALEVMARELATHVESAPGLALEDVAFTRNVGRRSFEHRRAVVAADGAELAERLRKPAAVEAGRNRRVAFLFPGQGAQAVGMGRELHAVEPGFRKDVDAALARLELSLAAEVRALLLPAQGQEAVAAQKLADPRVALPALFVVEHALARLWMSWGVRPHAVLGHSFGEYAAACVAGVLSPEDGLRLAVVRGALMARMPVGAMLAVGLEEAEVLPLLGEGLSLAAVNGEGRCVVSGPVQAIEALQATLSSRGVGMVRLPSAHAFHSSAVEPLMVDLARAVSSLRLQAPTLPYVSSLTGTWIRPEEATDPTYWARQMRQPVRFAAGLETLFGEGCSVLLEVGPGTDLTSLARGRARKERQLVVAPSLRRRPTESDARGLLQSLGDLWAAGVDVAWQKFHGAEPRRRVSLPTYPFEEKSCRLESSGAPLVLPAASGPVAGAALAGTSSVLPLATPGASDPVTVGEIQQRVMDIWRERLGAVEVGPDDDFLELGGNSLMAAQMLTRLRETFSVQLPLSALFEAPTVAGISARIEAMLQAAGPLEGRAASEVMFRIDRAGELPLSVVQERVWRMEQLDPGNPSLNMPLAVRISGALDVPVLERSVNEVIRRHEMLRATYRVEDGRVRQRFSAEVRIQVPVVDLRSHGGDRKAEALRLALDEAVRPFSLEHGPIVRASLLRLAETEHLMLLTVHHIASDTLSMVAFFREAAANYQAFLAGQPAPLPELAVQYVDAAAWERRSLAGGTLAAQEAYWREVLADLPPSLELAADRPRGAELRLRGARFPVAFSRELSAALMGFSQREGVTPFMTLLAALASVLARYSGREDIVVGTPVGNRARGELEPLIGFVAHAMALRTDLSGDPSFRELVARARETTVGASSHQDVPFEHLLPLVASGRDPARSRLCDAALVLHAHVTTAPPSVAGLDMQLVEVPGTPAQFGATLGELTLLLNESESGGFHGFIEYATDLYDEPRIARLSAHLQTLLGAALANPDLRVSRMPLAAPEERSAAARGPASSVQSLQAEGLAISSMPPAGGSSSIGHRDLADAAVLARFASWVKRTPDAVAISMGERRLSWRELSERARGLAARLKQEGVGRDVPVAVRITPSVESVIALWGVLEAGGACLPVSAGEVAELASLLPAQGPRLLLVPRTEDVPALPKGIRAVAVDSVDSSADSMEPVPGERLAFIVPAPDALGGYGRVMLSHRNVAHVLASLDARTGAGGGDVWLAVGGPSADPSGLDLLWALARGMRVVLPPEQLAACFAVLGRKPDTRRPLDFSLSYFANDEDSLGEEKYELLLEGAKFADAHGFSAVWTPERRFHSFGGLYPQPSVVGGALAMLTRHVQIRAGSVVLPLHDPIEVAEQWSVVDNLSRGRVGLSFATGWHANDFSLSPGTFDRRREVLIERLEEVRRLWRGGTVLRRNGAGNEVELALRPKPKQAELPVWLTSTGNPETFRKAGEVGAGILTNVLGLGSNLDELATKVALYRETYRKAGHGPGQGHVTLMLHTFLGQDLDEVREAVREPLLRYFRSSVDVFANLVASQGLQVDVRGLTPEDVEVMLAQGVEHYIKEGGLFGSVEDCVRVVERVRALDVDEIACLVDFGVALEPMMSSLRLLDVVRQRSQVQALPADAVLAEGDAGFGALLSLVQDEGVTTLRCAPSQARALAELPGAEAALGSVRLWVLGGESQDLTSSAQHVAIASSLVGAAWPSPTSAPVYVRDASGEPVPVGVVGELALAGAAVPLGFWNDPEATRARFISVPGSDERFLVTGQRARFRVAGEVECVAPARATKARRPTSQPARGTVGTRPPTRQTVSAEVSSATATPVVRVGRDKPLPLSFPQQRIWYLHQLDPAGIAYNNTVTLRVDGPVA

SEQ ID NO: 9733 - protein, 2942 aa, Myxococcus xanthus
CSKGGHREPAYLTDTIARERITTLHFVPSMLRPFLEETELAVSCASLRRVFCSGEALPPELRDRYFSCLLAELHNLYGPTEAAVDVTAWACAREDRGHVVPIGRPIANARMYVLDARLRPVPAGVPGELYIGGAPLARGYWQRPDLTAERFLPDAFAAQPGARMYRTGDQARFLANGAIEYLGRLDDQVKLRGFRIELGEIEAVLSLHPGVRAAAVAIREDVPGDRRLVAYVVAPSGDVASELRAFLGERLPEHMVPSAFVTLDALPLSPSGKLDRRGLPAPVRAVQGRGAAHVEPRNALELEIAQIWAGVLGVERVGAEDRFFELGGDSILALQVIARARQVGIHLTARQLFQHPTVAGLAQVATSRRRLGDQGPVVGPVPLTPIQRWFVERELPEAHHFNQALMLEPRERLESDVLACALRALVDHHDALRLRLSRSDTGWAQSCAEPGRDVPLRLVDLSGLDAAARAVAMERTATEEQAGLDLNAGCLLRAVLFDPGPNRRGRLLLVIHHLAADGVSWRVLLEDLETALRQLARGEPVALPAKTTSFQAWARRLEVHAASGVLAEEGAYWRDVLSADVAALPRDVPGGVNSQGSERVVTVALDADVTHSLLRASATMSQPGLEDVLLTGVASALARWSGERRLRIDLEGHGRDELFDDVDLSRTVGWFTALFPVRLELPEGLASASVLASVRAAREHRKGRGVGYGLLRYLRHDAGASSEVLFNYLGQLDSGTRDSALFSLAPESTGASQGTRGLRSHVLEVVARVVGGRLELAWHYSEALHSRARIEALARHCVETLVELAGATEECHALSPLQHGLLFQVLLEPGTGAYFEQRSWTLAGPLNAGALRRAWEAVSERHSSLRTSFLWDGLEAPVQVVHARATPVWAELDWRGRSSEEQSQSLAAFLREDRAQGFVLSQAPLMRLALIRLEDHAWRFVWSFHHLLLDGWSLARVLGEVLDAYAAIAAGADWLPPAASMDFRTYVEWLGRRRPEQDEAFWREQLEGIEAPTPLPAAGGSTAAHDTGEHALDLGEADTAALQEFARSHGLTPSTLVHGAWALLLSRYGGGQDVMFATTLAGRPPELPGIEEAVGLFIHSLPVRARIQHGAGLLPWLSELQSLLVELGQREHVPLTRLQGWSDIPRGTPLFESLLVFENYPVDAALVRGASGLELRDFAAFERTHYPLTAVVVPGRSMRLKLLYRQERISKVAAEQLLTHWRGLLQAMWSRPEQRLGDVSLLSEAERRRVLVEWNATATTYPREATVHSLFESQAARAPETVAVRYGGTSLTYAELNAWANQVARRLGALGVRRGTHVGLCVERSAELVVGMLGILKAGAAYVPLDPAYPRERLAWMIADAGAPVLLTQERLRGAVPSEGVSVLTVEEVSAQGDVAETAALGAGVGAADAAYVIYTSGSTGTPKGVCVSHQAVVRLVVETDFIRVVPEDRVAQASNASFDAATFEIWGALLNGARVVGVERETALSPSAFASWLREEGIRVLFLTTAWFNQVAAEVPDAFSGLRQLHFGGEAVDPRPVRRVLREGAPERLLHVYGPTENTTFSTWHLVTDVPEGAVSIPIGRPLANTVQYVLDEDMAPVPPGGVGELWLGGDGLAWGYLGQPALTAERFVPNPFSERPGTRLFRTGDRVRLLADGAVTFEGRVDAQVKVRGFRVEPGEVEAALLRHPDVRQAVVLAREDEAGGSRRLVAYVVPTAEAAATPEPSLLRTFLAAHLPAYMVPAAFMVLGRLPLTPNGKVDRRALPAPTVESEVIAPRGPEEELLAQLFGELLGVSRVGASDSFFDLGGHSLLATRVVTRIHATFGVALSLRELFDDPTVARLAGRIREARQSSGTARPPPIVPVSRDNPLPLSAMQERLWLLEQLQPGTALYNVPWAAWLAGPLDVPALERALAGLFLRHEALRTTFSSNAGEPVQIIHPSANVALLVVDLEGLPEEAREAQAVIAASEEARRPFDLVNGPLCRALLIRTADDSHLLVLTLHHIVSDGWSLGVAVRELSALYAAELQGRPSSLPVPTIQPADHAVWQRQWMQGEALAAQVGYWRRQLAGAPPVLELPKDFPRPSLQRFRGDTLAVRFPAELSEAFRALCIREGVTPFMGLLAAFQLLLSRVSGQEDVCVGSPIAGRQQPGLENLIGFFVNTLVLRARLPRSSSFRELLRQVRETTLDAYAHQDVPFEKLVEALQPPRSLSHAPLVQVVLALHEASRQDVAPQGLALRPVELASGTAKFDLTLSLTDAAEGFTGTLEFDADLFTRETAARLMKGLRVLLESAVADAGQRLGELPMMDSADRQRLLVAWNDTAVEYPREACLAELFEAQAARSPEAVAVVCEEARLTYAELDRRANQLAWYLRNRGVGPGTPVGLCVQRSLDLVVGMLGILKAGGAYVPLDPTYPRERLAFMVEDTRLPVVLAQQSVVALLPSGSADVVLLDSAWDEIAREPTVSPRVTVPAESLAYVMYTSGSTGRPKGVCVPQRAVARLVLGSRFARWGADEVFLQLAPICFDAATFEVWGALLHGAKLVLFPAQPPTVDTLKDVLARHGVTTLWLTAALFEALSAARPDALDGVRQLLAGGDVLPPAAVRERLGRGGILVNGYGPTEGTTFTCCHVMEGAVAPGAIPIGRPIANTRVYVVDAALRPVPVGVPGELLIGGDGLAWGYQGRPELTAERFVPNPFGSEAGGRLYRTGDSVRYREDGTLEFLERLDGQVKVRGYRVEPGEVEEALRLHPSVAEAVVVARPDPAGGKRLVAYAVPRAGETLDPRGLRGFLAESLPEFMVPSTLVPLMALPLTPVGKLDRRALPEPEVSRPAGSAFVEPTTALERQVAALWAKVLGVERVGVEDHFFADLGGSSMSVVKACALLRDELKRDVPATRFFEHPTVRAFVMSLERDGETAADTQDNEAHVDRAQQRRQAIRRQGRRGNHGNG

SEQ ID NO: 9734 - protein, 263 aa, Myxococcus xanthus
ARKVAASADSALSITLARARAHWLRTQGLAEPLKGSLEEVVATTGWVRTLGGVDVYLAVRARVPGLRRADLDAAAEASQLQVIPAVRGCIYLVPRAHVPLVMRVAEEAYRKRADREHEKVGLGAKELADVAEAALVALRKGPLSTDALRKAMPAGVVRSLGEVGKKVGLSSTLPPALRHLEFEGKVERRTEGGRLDTERYLWRLTARNPFTGAKVPAAAEERNARLAALFFRQFGPATVEDFAAWSAFSQRDAKAAVARAGLV

SEQ ID NO: 9735 - protein, 437 aa, Myxococcus xanthus
MHAFANGCTAMTGIEAVSNGVPIFREPRVRNARRTLLGIVSILVMLLCGVAWMSHAYDIGATAPGQAGYQSVLSQVVAAITGRGVFYYVALAAIVCVLCLSANTSFADFPRLCRALALDSNLPPAFAHVGQRLVYSTGIVTLSLLAAVLLVLFNGVTDHLIPLFAVGALSAFTLSQLGMVMHWRRMSGRGARRFQWVNGVGAACTALALAVVATAKFEEGAWLTVVFIPLTYVLLRTSRRHAERIHAATETPHPIPVQPLAAPVVVVPLRRLDRVAQKGLRLALSMSPDVYAVQVRGQPDAQEQLVQRWEWQVAAPLRKAGRPVPRLDVLVPTYRQVVDPLLGYVRKLAAEHPGRFIAVLVPELVERRWHHFIIPSHTATLLKMMLLVRGGPHIVVINTPWYLREPSGRKRRLRRGSACGRPGSCRGAPACSHHPWE

SEQ ID NO: 9736 - protein, 377 aa, Myxococcus xanthus
MNLRLMLKGLTDVCDTGDDALVGIRFDNATGSVINTQIFNIRQGDGTGGCQEGTGILIRNQGPLSPTQHVGVQNNLLLGYQKAGVVAVGDVVVDITNNRVVGSGPIGNVAQSGIQVGLGATGSIVNNLISGHSYTGEGVASGILVYGGPMYGGPLSTDVLIQGNQLFNNDIGVYLSQGNADQSPPAVLTNIQVVDNVLHFDGVTNGYVYQAGISDLGTGNVIHSNIITGAGYDPATLPGSTFAVDVLAGPAASLAFLNPPRQVPVGLCSGPLIVQTQDVSGNLVVPTTTGFNITSAGPASPGIQFYADPACAGPAVTTLDLGNPQAQGRFYFRAPTPGSVTVFVWNSDWTQGQTQQVFIPLESAPPPAGALRLELQH

SEQ ID NO: 9737 - protein, 182 aa, Myxococcus xanthus
MQLFQRMFGEKWFYILYFQEPGVAEAEFEADVPRTVRAILTGTPGFDVTNPAVLAKKKGEGFLARLDVPETLPGWLTEADVAYFAKELAGSGFRGGLNRYRNMDRDWHELPELATAVISQPALYIVGEKDPVRAFSPVDPMKALVPNLADIHVIPGAGHWVQQEHAAEVNAALLAFLKKLPA

SEQ ID NO: 9738 - protein, 181 aa, Myxococcus xanthus
MKKTMLSTCVCAALALTACGGGSDRLDSVQGEPPAPSGPVQTEDGQRFELRLRGSAAEGYDKLELPIGAVRVTANGAPLKVELVQDSADVARADHAHLVAYFYVPEGADRVRVTLQLEGLGGYARAEGSGFVDASVAPVTFEAPVHELALRGRAVVQLDVARSIMDMGSHRLLLPNGVVNY

SEQ ID NO: 9739 - protein, 317 aa, Myxococcus xanthus
MNEVGTMRMKQKKQWVSAVCAVVVGGSGVANAHDLICEKKVNGESVVVADDYPYTANYTFKVTNVHPTLPSILLTATDDVLSSEGFTFSPPPPVSIPVNGSLTSDFALHIGSYDECVTIAAQDGVADNHIDNTFTVTFDLGSAMCSARLTCEREEPPPVECTGPTRTLGFYKNRILTVTQCLAQGPIDLGAIGTITTLPAAEGILWGSPAMYPAGGMRSQLDRLRFLLARQTLVGICNQRLFGATPDPTSLLTDAVAALNTTQCDVISGLIDPVDAFNNGCDSLPLPPGFIPGPSTPQAAEAIAVDPTSNSGQSCSP

SEQ ID NO: 9740 - protein, 590 aa, Myxococcus xanthus
MMHVVGVTPLALRLASLLGHLAAAVSIYLIARRPAGRFWAVLGAAGFLAMPFGWQLVQGRIFGDVTDCTLTGCNAVAVALLFHATRQGSWRWGLAAGAAVGLGFLCKTGLALTPLGIAATLWALGRLRFCPGPRFSTVVAMVGMAVLLAAPWSFYSAWRWPELHDLEARVTRAHLFADPTVDVGPWHRPVDALLNEVNTQSLAPLPAVLPLLAFVWLLVRAVRRRELEVVGLALWVGATWLVLSLSVVKVPAIAWGAVPAVLAALAIAGADARRHPALAAALLAAVATPWFVKHLPVLGAVRAVLPTVLVQTRARPGLAEGLVVAAAAALLVALVCWRLPRKLSWAPLGLGLLASGVLAWLLAVTFPVAKADYQARHLDDLYVTYSREVGRALYQQTPARSVLFLAQDSDVPGSMEYLSLMFWSNRMAYRRPPDVVSARKHGYHPYLVSPLAEHYAPVPGVPPDAALRAYDLEAPRSEPAPLPDGVMPLAFREKDMEVLGVAAGHAGGGRDRYAFYVRAQGVPRALRVVFHGPGGSVERMLEPGAALRQPATLRRANWFIVPVLGPPSAGVTHLELGANGQRVTFSRPGA

SEQ ID NO: 9741 - protein, 162 aa, Myxococcus xanthus
MSCIYGPRQFGTEDQGWVAHFLLCMLEGRPLTLYGDGKQVRDILDVGDLVRALGLAQQHIGRLKGQAFNIGGGPSRTVSLLDLLGLISQRTGLRPALQFEDGRTGDPRYYVSDPRKFQAATGWAPQVGIAEGVDRLHDWLRTLMLERPVASGQGGAREVLVG

SEQ ID NO: 9742 - protein, 60 aa, Myxococcus xanthus
MGDIRHCFADISLACELLGYAPRVSFHDGLAELSSWLEDQVATDRVAEARAELETRGLTV

SEQ ID NO: 9743 - protein, 31 aa, Myxococcus xanthus
MLWTLLAEDYRASPAAASDLEAFDVLGQKLL

SEQ ID NO: 9744 - protein, 621 aa, Myxococcus xanthus
MVELGSLPSGEVQYGDSLQLQAEGRDEDGDTLTYAWTASCEGTFDDASARSPRFTPSTPPSGACGACQFHVTMRDGRGGEHVGLVDVCVVQRLPPIIVSTAQSRTEAVSAEPVLLQAVAEDPRGEALTFQWSANTGLLGTATQDGTRSEVPWSALSCIPAGVEPSVRLTVTNVSGMSATHVFRIRWDDRRCGAFPPCSARWENDRVTLTADCTTEGTLYIPDGVTFDGAGHVVTAVDPEGGRFQGAVLRNRGDTAHVHDVTVAARGLSDLACDAGEAGLSGIRFIGASGSITDSEVRALHQGAGESGCQEGVAIEVRNAQDASRVVQVEVLRNHAVGYQKGGIVASGRVDVAVEGNVVEGGGPSAVIARNGIQLSFGATGQVLGNRVTGNVYTGTGYVAAGILVAGGAYYGGPVCEDVLIQGNTLEANDIGIDLSQAEADGGPLAQSSRLLVVENTLSHGVVANGVPYQAAISDLGGANVISRNRISGAGYARETLPGSTFDVDVVAAAAAQVAFLTPQQDVAAGACSEALVVQSQDAMGNLSALASSLLVVEAQGNVGGVTFFRDAACTQALVPLNGSGAMDLEGPQQEAVFYFRAEQSGALEVRVRGDGVSASQMHVVR

SEQ ID NO: 9745 - protein, 316 aa, Myxococcus xanthus
ELSVPLCAALFASGLATAVPAAAFELKHETGTLSVPATPSRLAVYDLGVLDTLNALGIRAVAVPKATFPATLSAYNSNGVPQAGSLFEPDTKALAELKPDLIVVGGRSRKQAESLSALAPTVNMSVRADHFVEDVTGQTLALGKAFGKQTEADTLVKNFEKERAALKKLTGGKSAVMLFTLNGNVMVHAPGDRFGYLHELTGFNAVVPKAEGSNDGPRPPAGSPEAKARQEAAAALLKKAVAANPEWLVVLDRGAATGGGENKALETLAKHPELSQTRAFKQGRVIVVDAPSWYIVGGGIANVTRIVQDTTRGLKK

SEQ ID NO: 9746 - protein, 231 aa, Myxococcus xanthus
RAGRSSARIPESARVLLETAQVPLRRPGELVSDHVRAILRVRAADLLGLQDVQGLLEGLEAQAPVLVKEALQKVPLPLLTDVLRKLLQEGVSIRDLRAILEALVSPTTEGDAVALAERCRQALRRYLSHKFAPTGPLYAYLVDPEVEEVLRGMGPRGLAPDPERVAEILEGVRQVATEGRAVLLTAPDVRRPLRRLCEGAFPDVAVLTYGELDGALQIRPIGRLSPVAVGR

SEQ ID NO: 9747 - protein, 420 aa, Myxococcus xanthus
MQVIKLNDLKRMKITDLSKMAHDVGIEGYQGLKKQDLIFALLGGIADKRFEVHAEGVLELLSDGFGFLRSADSDYQPSPDDIYVSPSQVRRFNLRPGDTVTGPIRQPREGERFFALQKVDKVNFADPMSDAARERILFDNLTPLYPTRKLKLEHESSEMTTRIIDMFCPIGLGQRCLIVAPPKAGKTVLLQNIAHAISRNHPDVYLIVLLVDERPEEVTDMERSVRGEVVSSTFDEPATRHVQVAEMVIDKAKRLVEQKYDVCILLDSITRLARAYNTVVPASGKILSGGVDANALHKPKRFFGAARNIEEGGSLTIIGTALIDTGSRMDEVIFEEFKGTGNSEIVLDRKLMEKRIFPTLDINKSGTRKEELLLGPGDLVRITALRQVLHPFTPIDAMEFVLKHMRPTPSNADFLGSMNR

SEQ ID NO: 9748 - protein, 208 aa, Myxococcus xanthus
MAKVDAKLPGCSGHVHQSLWDLDGEQNLFHDAKAPHGMSKLLRHYIGGQVALMPELTALYWPTINSYKRSVENTWAPTTVTWGLENRTTAIRVIGESAKAMRLEYRQLGADMNAYIGMAVSLAAGLWGIENEVEPPAPCESNAYAKNDAPPLPRNLKDAVALLKGSERARELLGYGFVDHFVRTREWEVRQYERAVTNWELERYLELI

SEQ ID NO: 9749 - protein, 155 aa, Myxococcus xanthus
  unsure (1)..(155): unsure at all Xaa locations
KPFDIPSEPRVTEMAWPTRIVFGAGALLRLPAQAQRLGIQRPLLVTDAGVVKAGLAARVADVLNTAGLACEVFDRVEPNPTERDVFAGLEAYRSHSCDGIVALGGGSALDAGKLIQLLTTHEPXLSRYDDAKGXDQYVRDDLPPLIAIPTTAGTV

SEQ ID NO: 9750 - protein, 117 aa, Myxococcus xanthus
MLKSDLINILVAKRGVTQKQAEATIETIFESMKDALCRGENIEIRGLGAFHVKNYQGYQGRNPKTGQVIPVKPKRGLLFRTGKELRDRVNRPAPQQAQTELPPLPESKGPGNTGTGL

SEQ ID NO: 9751 - protein, 395 aa, Myxococcus xanthus
MFSLVPLLTVALVLLTAFHQDEFKEKLRFFFSEVLNPGVRGKSSQFLDRFLNPTHTVAIGSVGFLAVLLSAGSLLRQLDGAVNELWGIRRQRPWRIRLLIYSGLLLVGPFFLALSFSGTGKVRVFLQSHAPYAGAFILLGTTLVTVASLTLLYYWTPYAHVRVRSALAGGLVAGLGWTFAKQVYAAFAERSFQYNPLYGSLGALPLFLAWVYVSWLLVLFGARLSYAVEHTAFRHSLFAFGSHPRAHELVAARVAQEATLAWVDGLPPPSPRELATRLRVPESLVHEVVDRMVTAELLERLRKGGLRPAKDPAVLTLADTTLAVHGVMLTGGAEGWNGPRAPGFEQMEPIFQAADCAGVDLLRRTRWLDLVVPLRPGLAEPAPAPPPRVAAGGNP

SEQ ID NO: 9752 - protein, 715 aa, Myxococcus xanthus
MAEAAVEPDANVESPEAALAVAAASEPDAAGVAVPAESAMEAAEGEATGLPVEPPPPSAAALGDIIPSPAEEGAQAAKPSEVSGERRTPREAREAREPRNREKERGEKDKGRRPQEEKRRGDKHEDKEKAKPRRTDKIEDLLKVGQEVVVQISKDPIGTKGARLTSHISIPGRHLVFMPTVDHVGISRRISNEKERRRLRDIVDRLRPPGTGFIVRTVAENVPQEKLESDIRFLIEVWNQVVRKNEKRGGPGLLHPDLDLILRATRDLFAHDVEKLVVDDREEYERILGFVTAQDPALRDRVALHEGDDTVFDAYGIEQELQRATQRKVWLKSGGYLIIDQAEALTAIDVNSGRYVGKKSLEETITKINVEAAKEIVYQLRLRNIGGIIICDFIDMEKAQNRDKVFKALQEALGRDKAKTNVLRISELGLVEMTRKRVRESIGRMLHEDCPYCDGNGFVKTATTVAYEIFREIRREAPGYKDSTLVIICKAEVARLLQVEERNELRHLMDRYNKSIQVKAQQNYLREQYDIYGRSASGPEHKVASSPGSGDGELAMQQRKPDSNGGGYGRQEQGRRGGGGGGGGGRDRGGERGNERSERGERGGDRREGRREGRSGGDRPRGDRGGERGDRSERGGERGERGGERGERSERGGERSERGERSERGERGDRRGDRGERGERGGSQNTSGGGENAGGSTPPPPPASGGGSEPSGGTT

SEQ ID NO: 9753 - protein, 147 aa, Myxococcus xanthus
MTPYALASLPAMLGIRAGSKVSVINPPRGFVQKLNPLPDGVEFLITAVTGLDVILFFTEDPQELVQRLPALARAMALTGGIWVCWPGGEGARRDLSEDFVRHAALDIGLVDNKICIIDATWTGLRLVRRPRGRPDKPGERKRATAQA

SEQ ID NO: 9754 - protein, 95 aa, Myxococcus xanthus
MSGTRRASLRIEGKVQGVFFRESARVEATRLGLTGWVRNRPDGAVEAVVEGEPAVLEEFIHWCHRGPAQARVSGVQRTDSKATGEFSQFNVERTS

SEQ ID NO: 9755 - protein, 514 aa, Myxococcus xanthus
MSLFPQDDVKVPDVLEVRGEVFIRKKDFQKLNEKREEEGEPLFANPRNAAAGSLRQLDPRMTVARPLCVFLYECVPGEGVPVFKTHIEKLEYLKTLGLPINQYRRAEGLEGVRQAYDASLKGRHELPFEVDGMVVKVDDEDQRKRLGQVSKSPRWAVAYKFPPEEESTEVMDIGIQVGRTGALTPVAHLKPVKVGGVTVARATLHNEDELRRKDVRKGDTVFVRRAGDVIPEIVSVVLSKRPADSAPFEFPKHCPVCDAVATKDEDGAIIRCTGASCPAQLVEKIRHFASRLAMDIEGLGDKLAAQLVSTGRVKAFADLYALTKEDLLTLERMGDKSADNLIASLERSKQTTQRRFLYSLGIRHVGDATAKALAEAFPRSEMLFEASLEDISRVKDVGPIMAQVIHTFFQEPQNQEAIRALLAAGVQPAAPQVATGGPFVGKSVVLTGAMTGMTREQAKEEVERRGGKVAGSVSRKTDFVVAGEDAGSKLKKAQELGVRILDEQAFLQMLQTNA

SEQ ID NO: 9756 - protein, 168 aa, Myxococcus xanthus
MSNAYSKDLERWMPRLIAVWRASRGRGGGGGPETRLTPQEVKEVAAGVRQLSLGLTRERQLAGARYMDDPKLLGAYLLFYWPVSYAQARQVLGELPNRPRQVLDLGSGPGPVAFAALDAGGGQVTAADRSKAALTLARNLPPRPVRPWPPATGTRRRRAPRCPTASST

SEQ ID NO: 9757 - protein, 207 aa, Myxococcus xanthus
MLFFVLMVAAFFSIDAHAIRRYFGTLIPPEYAIDARQLLERIDRSLSGVVRGQVTICIVNGILTFMGLLLFGVKFAFLLATIATFFSLIPIFGTILSSVPIVLIALADGFQKGLAILAWIIGIHAVEAYFLNPKIMGQAAHLHPVIVAFSLIAGERLFGLVGALFAVPVASVLVACFDYARLKAQPAPAVALATPGPLPAERQPPAA

SEQ ID NO: 9758 - protein, 152 aa, Myxococcus xanthus
MASRWDHLFDLKPTSLLEHLLEEVAKLLHKDLLQWPPPVEELDLDTGGHFATLFTEPRPRPSRAVYTEAFRLAQWELARETDAYDDYMRNKRYLERGLVPSDRLPLLLLSRWLTEQMLGLGEATEGRVKRKHMRDCLERLQSKLGAFPVPGV

SEQ ID NO: 9759 - protein, 298 aa, Myxococcus xanthus
MLSLGTRNEKVSQQAPVMWVPRSTRARSTATGQERTRGARHGRNGDAMRQPTAVKNVLLLKAGEAAEAVRVSVGDYDRWFLQAIGLSGYRFDIVLAHRDAPLPTRADGYDAVMMTGSPLSVTALEPWMKRAADFMVEAGERGTPVLGVCFGQQLLAHAYGGRVSRNPQGRETGSVEVTLTEAGKQDPLFDGVPERFIAQATHEDIVSHLPDGAQVLAGNANTAAQALAFRPTVRGVQFYPEASVDTLRAVIEARWEGLERDSVARGAAPGEYVRQLLAGLTPSPAGRRILLNFLERFT

SEQ ID NO: 9760 - protein, 202 aa, Myxococcus xanthus
MLSPYVDGELSSGERVNVERHLAACRDCTGRAADLRAESGLLRVGLDMAVDDVDFKDFTQRVMARVTPDKPPLMERLKLAVSEMFLYQRTAMISSLATAAVLLLVGVPLLTSDRAPVGYASERMTVKSIQPYRNAQVAPVVMETDNGGTIIWLVDEDSDVLSPGAEKGERQDQTGVGQPDASGRNVPARPAPDAPRPSGGSL

SEQ ID NO: 9761 - protein, 142 aa, Myxococcus xanthus
MLWALLGLGLLLPMAASAQDAKVQVQVEVVLASKKGTEVDPPELEKMKEQFQKQNFSFTSFKRLSNEVLTVSAKSASEVKLPNGANATLQLQGIKDGTATVRVAIPRQPTLDVELGRQGAVYQKAGKYVGGELILVLSPPAR

SEQ ID NO: 9762 - protein, 79 aa, Myxococcus xanthus
MAKTQKRGQVIRREAQQMEVSAASAVKGAGRGARQVQVTLGDLIAAAFDTVGGEVKKVAQVMSSKDMAVATGKHIVFVG

SEQ ID NO: 9763 - protein, 419 aa, Myxococcus xanthus
MLDELCRANPELRVYVLAWDFSLLLAMEREWMQRLIFNWTANGQVCFRFDASSPLYGAHHQKLVVIDGAVAFSGGMDVCDCRWDDREHRVHSELRCDSGRDPHGPYHDVQSVLTGPVVDRLAELFEARWAHSGGGELRLPRVSRDDVDFTPSLPAPLGPVAISRTFGKTLLPPQPPVQEVAMLYLDAIASAERFIYIENQYFSSRAIFQALVKRMRSSWRGRLQIVLVLPRQPEALREQLAMGIAQVRLLRTLERVAHETGHAFGVYCSAGHDARTGEDIYTYIHSKVMVVDDRFLTLGSANTTNRSLGLDSELNLSWEAEAPNDATTRAIRRIRVSLMAEHAGLEGLAALRLLAAADSGLVEWLDDVAVMGLRRLRVHPMSTVFDQSPLLKSLEPEQLIIRPGAVGGERVPLGGAPPS

SEQ ID NO: 9764 - protein, 164 aa, Myxococcus xanthus
MKLPLAPAVTALAFWGCSSNSANTRADDSAIGGSGTETTAPESVDTSSEWDDRSAGEAADVTKNERRDRQDAPTVYDGEATGGSGPGMGAGTSVTTPDGEKYDVQDGPLLGGQQSEEARKDGVGGSGNIQREPVDGKSDVKELDASDVETREVEADEVEVDGNR

SEQ ID NO: 9765 - protein, 165 aa, Myxococcus xanthus
MASGTQVSVTVQGRKQGGRFRFGMFGPDYELGRFSGVGMSETPIADEVLPSGFAGYVELSVAKGNPNELLLLGSVAAQYFGFGRTDTDVSAGFELPGGRTRALGRVVLTGLGDRPRYSAGVELRQRIVNHVYAWGSGGTVHFPQPDGTLVRGVTAGAGVGVDFQR

SEQ ID NO: 9766 - protein, 203 aa, Myxococcus xanthus
MGVNQLGSLPGDSVFKTNGRNVIRSPGGQVDRSQTWVNVGVPYVMEDSVYVDGATTPTLTLSPGVTLRFGRLSYFEIGTGEGGNLRAEGTAEAPITLTADAEFPMSGHWQGLAFGEMATAASKLTQAVVEYGGAPASDGNPNANVRVIVDKGPIITQTTLRHSMGCGITRATTPNYDTFTTDFTAPSLGNVFSDNSGSAQCGP

SEQ ID NO: 9767 - protein, 179 aa, Myxococcus xanthus
MVAKGYAVRAPCMYRGPCPALVKETDWCHAERAWPMPRVVEELARAASLHKESLKMSYLVLAPKDEAWPELTPGRLFRIVSEPLEGKGRHRYIGCGPEGRVGLAMQERHRNERNERFLKLNRGDVISVTETEPKGDGLALDERTEVRVVAPAGKGVPPPPPEEDAPSSPGTGPRPGAPS

SEQ ID NO: 9768 - protein, 375 aa, Myxococcus xanthus
MGQTQDAVKSFQKGLSIAPNDVDCLLGLVRVHLSTGAAADAEAAVLRLLEAKPDHTEGQAHLAMLRAQAGNPEALESLKALAAAPTAGYFERFNLGSLLFERGDLAGARAAFESVLQISPGSTHVHFELGRIRLQQNEPDGAVSHFLRAAEGAPQEAMPLLMLSRAHAACGQLGLAIQAATQALEKARGGLQRAVLEDLFKLYLSAGSSDGAKRVAQELRKLDPSSITYLYLLGLATMSAGAFAEAKDVFAEVLRQAPGSWQAQHALAQMHLALGERAEAVKLLEAAVATVPTDPGPTNDLAVVLMQDNEHSRVAALLAPVLGAHPNDAGTHLNMALGTFPADKELSARHAKQAQALGAEDVRARAEQLLKQLGA

SEQ ID NO: 9769 - protein, 234 aa, Myxococcus xanthus
MALKLAARGTGIILTYRTGADEAAAVVKQIEAAGGKAVALPLDVGDTRGFGAFVEAVRTELGRHFGRERLDFLVNNAGMGIQVSFAETTEAQFDALMNVHLKGTFFLTQRLLPVLADGGRILNISSGLARFTFPGHAAYATMKAGVEALTRYLAKELGARRISVNVLAPGATATDFGGGVVRDNPELNKTLAAQVALGRVGQPDDIGDAVAMLLSPESAWVTGQRIEASGGMML

SEQ ID NO: 9770 - protein, 261 aa, Myxococcus xanthus
MKEVLQHIAVREARFAAHPFFSDMRMDRPIEQVMAFAPRLTFWVMTFQDVLRLNAHFIQDAHLKALATRHHAEEGGHDQWFEDDISALTGGSLSIGTMYGRAHVKTRDAAYAIISEVYRPVDDRLRIVLLWALESTSHVFFSRTAIISAAQGADDRLKYFSDHHMQAEAQHAMFEQELAAELEAMQLSPEVRADALAMVDRIYAAFDTMFDGLRVNLEREHAEAPAPGLQAHTATAEVLPLEMEEDLEIIVLEEDGEARAA

SEQ ID NO: 9771 - protein, 175 aa, Myxococcus xanthus
MSFQGIEVIGQSILAIVNGMELAQSRALRILGENGIAPLKADAWYPMPALLKSFRLVFDKIGPSTVRTIGRKIPDSAHFPPDIDTLEKGLRAVDMAYRMNHRGKGAIGGYRFEPVDKRNARMVCDNPYPCDLDLGLIEAIGDRFRPKDSLWVRIEHEAKSCRRRGDSACTYSINW

SEQ ID NO: 9772 - protein, 209 aa, Myxococcus xanthus
MLYAGTGDARDPDRSQNANDPAGKLLRLTPEGAVPQDNPIPGSPAFLTGIRNLQAFDWRDASTLYIADHGPSGETLRRGHDEVSVARRGDNLGWPGIYSCETREGQITPSITYKDAMPPGGAAIYTGTAIPEWKGSLLIGTLGSRHLQRVEFAPDSSRVTRHEVYLRNTYGRLREVIMGPDGHLYVTTSNCDGRGDCGPDKDVILRLKR

SEQ ID NO: 9773 - protein, 225 aa, Myxococcus xanthus
SKASPRAPPPKLGTFTRQGNTARFQPAPGVTFTRNGQPFTGGALQSDEQGTPDVLKLGNVSFQLILRGDKLGVRVRDSGAAARKQFQGIPTYPASNDWRIEARFEPAQTPRMLQVPNVLGTIDEMKAPGTLVFTVAGKEHRLTPVEDGSGKLFIIFADETNRDATYGAGRFLSADMPTDGRVVLDFNRAYNPPCAFTKFATCPLPPRGNRLATRVEAGEKRYADH

SEQ ID NO: 9774 - protein, 102 aa, Myxococcus xanthus
SKAPNALKYSPAESTVRVGAEGSEREVVLRVHNRGTPIPAEDLPHVFGAWRRGRRAASDAGAPSGLGLGLDITRQIVRAHDGDAQVASSATEGTTFLIRLPR

SEQ ID NO: 9775 - protein, 199 aa, Myxococcus xanthus
MASEKLMFAQSVEALFVRALGPYLTRDGRQRLKAVGLDLSEPLRPQYTLEQWRAFLRVAAQDVFPALPPHEASFALGARFLQGFRQTSVGRASLSLVTQLGPRRTLERVPYNVRAGNNFNEVRVEESTQDSATLWMKDVTADTPDFAAGFLAETLRSAGAGHVEVKPIAFDGTAATFRVTWSKAASRAPVAGAGPRRVH

SEQ ID NO: 9776 - protein, 351 aa, Myxococcus xanthus
MARLFVEDLHVRLGANDILKGITADFRDGEVVALLGRSGSGKSTLLRSVAGLETPVRGRIHIGERTVFDAAAKVNLPPERRDLGLVFQSYALWPHKTVFDNVAYGLRLRKQPREQVERAVREVLQGVGLEGYGDRFPSQLSGGQQQRVALARALVYGPPLVLLDEPLSNLDAKLREEARVWIRALIKRLGLTALFVTHDQVEAMAIADRIMLLDGGRMVQDGTPEQLYTEPRSLFAADFMGVNNTLSGRVVERRGGEARLQVGSQSLWGLRRGDGSGGDTATGVIRVEELQLASGPGENRLPAALVNSIYVGGRWEHQFHAAGQTLRASTRQVLAPGAYTLAFPKERLWIF

SEQ ID NO: 9777 - protein, 1442 aa, Myxococcus xanthus
MAPQISLDFATEYAAHPALAPFHPVVRRWFAERLGEPSRPQVEGWPLIQAGQDVLIAAPTGSGKTLTAFLAALDALFRLALEGTLPDCTQVLYVSPLKALGNDVQKNLLQPLEELLARARAEGFRPQELRVQVRSGDTPASERAQMVRRPPHILITTPESFYLYLTAEKARATLRSVRTVIVDEIHALARDKRGSHFALSLERLKALTDARPQLIGLSATQKPLDAIAGFLTGASHRECKRVEVGHLRPWDLTLEIPDAELSSLASHEMWGQVYDRLVELTGAHRTTLVFVNTRKMAERVAHDLGERLGEGTVAAHHGSMSREIRLAAEEKLKSGQLRAMVATASLELGIDVGNVDLVVQLGSTRAISVLLQRVGRAGHHKAGISKGILFAMTRDELMECTALLNAVREGDLDAVRIPEKPLDVLAQQIVAACACEEWDERALFSLFQRAYSYRNLTWEEYQGVLELLSEGVAARRGRAGIHLHRDRVNQRLKGRRGVRITALTNGGAIPDTFTFNVTAEPEGKVVGTLDEDFAVESSPGDIFLLGSTAWRIQRVSGSTVQVEDARGAPPNVPFWRGEAPGRTDELSLQVGRLREELTQREDAPAFLQKELRMPPPAVDALMGYLRTGQKMLDAVPSHTTVVAERFFDEAGGMQLIIHAPFGSRINRAWGLALRKRFCRSFDFELQAAATEDGILLSLGEQHSFPLAEIFDFLHPDHVEEVLVQAVLQAPIFGTRFRWVATRSLALHRMMGGKRVAPNLQRARSEDLLASVFPEQVGCQDNHGGGDLELPDHPLVTQTMDDCLREAMDVDGLREVLRGMRDGRIRLLARDVPEPSLFAHAMIHSQPYTFLDDAPAEERRVRNVALRRAMPAEDVTAFGALDATAIATVVTDAAPPMRDEDELHDALLQLILLPAAEVPRGMATPLFEQGRVAWMDLPAGRFLVSAERGSALRVLFPDAPMQPPLPVLSHDRPVERDAAVLQVVRGRMEMLGPTTVAELARLIVLDEDSVNRHAPVGGPGQRLAPFPPWRSPADGPAPVEWCNRRLLQRIHRLSVGRMRKEIEPMSAQDFMRFLFRWHHLEELDALRGSTGLLKAVRLLQGYEAPASAWERFLLPARMRGYTPDLLERACYAGEVAWGRLTTKEAKPAPGPRRGAPVTPPEPAPTRSRASPTRNASLTFTLREDLEWMLTAARPHAVLADGDVWTPPDLSAAAKDVVTVLERRGACFFQDLVSRARRLPAEIEDALWELVARGLVTADAVQNLRVLQSPAHRKRQKLLQRGGPGRWSLLTPAEPKSQDDVLDSLARLFLQRYGIVWRDLVMREALAPTWRELLFVYRRMEARGEVRGGRFVSGFVGEQFALPEAVDMARSVRRQPPSGVRVQLSGVDPLNLTGVVTPGPRVPAMPGNVVTYVDGVPRDVGALDDTADGNVGEDTEDGGEAMAS

SEQ ID NO: 9778 - protein, 133 aa, Myxococcus xanthus
MGSDVKAQQEAARAWSVWEGRTSCLYPNAELVARNSGDTFALAFARIECHYFVNRGFLRSDTQLLDDVHRIRKIPAVIVQGRYDVVCPPESAWALHKAWPEAEFVMVSDAGHSANEPGNTSALVDATDRFRGR

SEQ ID NO: 9779 - protein, 765 aa, Myxococcus xanthus
MPGLPIIPSQPAAAPLERASREDPTIPGDVILRFEEAGLTPERVLAAVQRPGFRAVHKGYASEYVHLVGYEPLDGKAVTAAKTQEWAAQLAQVPGVTYAVRNERMRATAAPNDRGYSLQWHYPTLNLPAAWDLVPDASSVVVAVLDSGIVPHPDLTNVLPGYDMISDPENAGDGDGRDSNPRDEGGDTPSGGSTWHGSHVAGTIAADTNNQVGVAGVAWNARLLPVRVLGKKGGSSFDIAAAITWATGGPVPGVPPNPNPAKVVNMSLGGRAPPQALYQDAIDAALGRGAIIVVAAGNEDVDARTSTPCNQQNVVCVGSTSLAGQRSSFSNYGVDVDVVASGGEMREDLNGDGYPDGVLSTVLDENGQPAYAFSQGTSMAAPHVTGVVALMAASRPDLTAALAERILKETATPLTNAQCPEGCGAGLVNARAALARIANVDPGTLDPQLNVTTSTLFFRGSGTQPLILSNVGGNRGGDLTVSASVSGPNASAVSFPQGNTVRVPAFSSAPLSVAVDASGLAGGDTVVTLSLVGSGTAGSATVAVKIGVAGAANDLDALIAFVWQDARGEWQASKDAIAVARASADYAYSISLAPRTYFALATIDDDQDGNFFEDGERTGYWRNVDSFEPLELEAGDRIENVSFDLIPLAPIDDDPALVVGSACGSNVDCPGGVCVTDYPGGYCSMDCTSSACPAGSRCYIVDSSSGLKACLATCTRQVGTGQGDCRPGYVCYSDGTGSGACQPNCRTSGLTCGLGRTCTASGFCR

SEQ ID NO: 9780 - protein, 425 aa, Myxococcus xanthus
MDGAKIKAFKHPNPDSKPALTELKRCTLDLELRNGLKGNYGVQRGCVLREGFVNKAAPYWATDKTPESVKVCAIDAQERTHNPWNMASCETSRFSTDRSCGCGVGMRRCETPAITAQDIRDVHSLRVAAFNDEPLRIAESVVQRDEPYFNILTTRRSFVNGTLSEYFRSQQGVGVFNVTTPTAQGAVPVVAYNDTEAWAEYTRDEGHAGVLTTPSFLYRFPTHRARVNHFYEAFLCKTFAPPPGASSPAPEDACNRENNLAVRCGCNYCHATMEPTGAHWGRYAERSAQFLAPDQFPRYDPKCRDCALNNDTNCGGECSQYIMQAYDGDGASSLGMLKTYLYRTADEEQNIEAGPALLVQKMLQSGDLERCTVRRIWTEFLGRPMTAEEQRLYLVPFAQDFARNGHRLKALIERVVTSDAYRRID

SEQ ID NO: 9781 - protein, 219 aa, Myxococcus xanthus
MRRLVLTAALLALASGCTKDDTQPADGIIEPIANPHQPGDFTPLPDPEDQDGSVGRAPRRLTVAQLDAAIVGAVGQRWSELDSRATSMGRADYALVVSENIEPNLVFAKFLEDGARKVCISQASAEMRMTDASARTMGRLLPEKWDDLTKLTDAEVRAQLVYMSTRFWGSPLSGEELTKWASFFTQAASRVQTLSSSKRHETLAVVCIAMLTDPRFITY

SEQ ID NO: 9782 - protein, 77 aa, Myxococcus xanthus
GSTLLGGLPFRAFAQAAEMAPADRCFVFVYFNGGWDQLLAFDPRDPTEFTADRASETKILPGYDQINDTRFEARPLI

SEQ ID NO: 9783 - protein, 390 aa, Myxococcus xanthus
MSEASYDVAIIGGGPAGAAMAVALRDLAPFLSVVMLERTDYDTHRPGETLSPDLRIPLSRLGVWSSFLRDGHLASRGTSSCWSRAEPRIQDTQMSPWGSAWHLDRARFDERLSLEAARQGVRVLRLTTLLDVESIAKEGYRLHLSQRKTGALTLRARFVVDATGWKATFAMTQGARRRIRDRCFTVHGAFQLRPGESFPTDALVESCPEGWWHSARLPSDCVAVTLVGDGDSLHGLRWATPEPWAALLEQAPVTQARLAACDFAGEPLVAAPVLVGELDQMHGERWLAVGDAACTHDPLSAQGIFSALDSALLAAEALEQYLRGEEDALCAYEQTLHLRFNEHLHRRSRTYLEEQRWPDAPFWKNRHTAFPALTPAAGQRSAPAPTGLAP

SEQ ID NO: 9784 - protein, 101 aa, Myxococcus xanthus
MVSAFTASALFLVCYLSYHFVHGDTRYVGDWRGLYLCILASHVLLSMPVVPMALVAFYFTWRKDFVRHRKVTRWLAPIWVYVSATGVVVYFMLRGSAPAVL

SEQ ID NO: 9785 - protein, 478 aa, Myxococcus xanthus
MDGLIRVETAGWTRVPGALGQGPYSQVAWLEGARLGALAFNRVELLDARNGEVLRAHPYPSDGRERGAAFLPSGKRFALTAANGRTHVRDLDADPSPTLLAEQDRVMNLWGHAEGAWGITRLHSETRVIDSQGQATALPPGSPAAYAQTWQVSPDGAWLAQPELSSHERRYRLGILLLDARSLAPVRTLLAPPGEQAAKAQTLLVNKLPIAFSPDGKLLAAAIEEGAVHLWRVADGTLLHRLRGPGGPITWVDFTPDGTCVVSGHAASERVYVHEVRGGKVIVNTEAVVEPSPAYAAAASAPVIVVGRASGELVLITLPTGAQQVLTVSQEPVIALGLSADGTRVAASSMDECVRVFDVRTGARLHELPHPSLPFSIALSSEVLVTLAEDMHTRVFDLATGELRTELDGSVTTDDFVSQRYWETLGEGPVTFHLQRDTTPRAHFQDAMEKTLILKDGLVLGRGRTERDFLYVLKLHIP

SEQ ID NO: 9786 - protein, 249 aa, Myxococcus xanthus
MATRNKAGATGGPKRGRPRGRTEQGHETRQRLYATALGFISARGYEATHLRDIAKEAGVSVGLLYRYFPSKRAIVLALYDELSSAYAARAEALPAGSWRERFLFALRASLGVLGPHHEVLKALIPVLVGGEEDGLFAPQTAFSRQRVQAVFEDAVAGATDVPSNATVAHALGRLLYVAHLAVVLWWLLDKSPRQRATEGLVSMLAGLLPPASLLLRLPGAGSMVLGADALCRQALFGEPARAQAEEVTR

SEQ ID NO: 9787 - protein, 300 aa, Myxococcus xanthus
MNTATLGHAEVSLNGKGTGEPRASTASLVPPEVGRLRFDAARTLWLWGMLIPGVTVGLAAATPTTVVVSLLLTFATLCLGHSVGLHRGVIHRTYEAGPLTRGVLAYLFVLSGLGGPLSWARLHAVRDYWQNRPDCPPYFAYEHSMARDFGWNLHLRFEPADDRALARLPPDVLTDPWLCFLERTWPLHVLGLTGVVLAVLGPEAVALCVCARTAAGILGHWAVGYAAHVWGERRYALPGAAESGTNIWVLGVLSFGEGFHNNHHAFPGSARMGQKAHELDLGWWVIRGLCRLGLVRDVRT

SEQ ID NO: 9788 - protein, 329 aa, Myxococcus xanthus
MVGCGPTGSESEPSSSSTEHQDAPLTTTDVDVAPECQGLLTFVNMASLSTLDAYLPSDVAQNLVGYRATAPFSTLAQVSAVRGVGPVRLTQIEGGARALGYITSTCAGILDELALSTDDAAALVNLVNTIDSSALYAVLPYAWNGATNLLNLRPFTSAQAISEVTGIGTVSLRNLRNAATQGYALTALIAVINAQEESLWTSRLSQDFDIQDVIDGAHGNGEFKSAQCFGIDPSLFPAGQVWTVRPELATGTEVYNEIKSTVDYADRNEPLPETLYTDGLAELQARTAGRTFKGCFISYGKGPWGGIQVKFYVDTVTGYRILSEQHWSE

SEQ ID NO: 9789 - protein, 282 aa, Myxococcus xanthus
MAFTPYNASVADFKADIALLKSQGRKVLISIGGANGTVHLDDATARQDFATTMQALIDTYGFDGLDLDLEGSSLSLNGGDTDFRNPTTPRIVNIIQATRQLLNQNGPGFILTMAPETAYVQGGMAAYGGPWGAYLPVIHALRDRLAYLHVQHYNTGTVMALDGRAYAQSTPDFHVSMAEMMLQGFPVGGNTGVMFPWLRPAQVLIGLPSSPQAAGGGYTTPANVHKALDYLLKGQSFGGTYVLRNPAGYPGFKGLMTWSINWDAFTNFEFSNSHRAYLDTSP

SEQ ID NO: 9790 - protein, 241 aa, Myxococcus xanthus
MAIEKALLLIADIGGYTRFMSHHRFSLAHAQETVAQLLEAVIDASGPLKLAKLEGDAAFFYAVGDDFPAFARMVADIRRAFVSRREQFIADRMCKCDGCMQVSSLTLKFVAHAGEVAFQRVKHLTELAGVDVILVHRMLKNDVPVTEYVLMTDAVHQGLAPELRQLTQGLEHDFEGMGRTATHYLDLNAFVLAAPEPVRPSLPRKLWAKLKLELSSMKYVLGLKQPCENFRNVEVVDAQKP

SEQ ID NO: 9791 - protein, 33 aa, Myxococcus xanthus
MPTLQRVTVVLFSDRDLDVYQRARQALEPTPSA

SEQ ID NO: 9792 - protein, 139 aa, Myxococcus xanthus
DQALGGVSIPAPRYAEVSRALAKDRFWLKYGPWAALGSFVGQGVFLGPLFAPEAPLRLWAIVSAVGVLFAGGLVLTLRGLQRRAIEAASVGVDAWMAQRRARIDTELKDLTTLLWLFPAMTVAMAGTAFLMRDKGLPRS

SEQ ID NO: 9793 - protein, 122 aa, Myxococcus xanthus
MPPERINRGDVFWVEPDDSRGPVPSYSHPHVVVQDDVFNHSRITTVVVCALTSNLHRASEPGNVLLEVGEGNLPKQSVVVVSQVSSVDKARLGERIGALSDARVEQIHADLRFQQVSLFARP

SEQ ID NO: 9794 - protein, 94 aa, Myxococcus xanthus
MGALLAVGCGGPLPEESQEPQESIAIPEQYLEQADPSTEDGTVSALKACCFIRCSDKVWRGPYPNVVYGNCRNHGKYQCAKRGLGYAGADWKDC

SEQ ID NO: 9795 - protein, 118 aa, Myxococcus xanthus
MQELEHARKDEVESLRTAILAAHPGIAERIKWNAPSFCFKDDDRVTFKLKPKDCVQLIFHRGAKVKATQGFSFDDTSGLLQWAAPDRAIVTLRDLAEVKAKKKALCQVVVQWMEATSQ

SEQ ID NO: 9796 - protein, 352 aa, Myxococcus xanthus
MVEEQAESVAPATIEQDIVGGTTTTINENPWQVSLRYGGHWCGGSILNKDWILTAAHCVDGYAVTSIVAGSTSSTSTSTGQTRNVAQTIIHEDYGASGNDVALLRLATSLDLNGTTVAAIPRISAADAASGATDPAVVARVTGWGATSSGGSGSATLRTVDVNVISNTEAQQSYPNEYIGPDQIGAKAPGKDSCQGDSGGPLTVNHNGTRKLAGVVSWGYGCADARYPGMYARVSYFESWIDSKLSGTTPPPGTTLLTQTNLSGSSSTWKHFAITVPSGTTSLKVVQSGGSGDADLYVRSGSQPTTSAYNCRPYLAGNEETCSFSNPQAGTWYVSVRGYSSYSGVSVTATIP

SEQ ID NO: 9797 - protein, 523 aa, Myxococcus xanthus
MNVIKTPEVATKEGKVQGLVEGKISVFRGIPYAMPPTGALRWKAPERATPWPGVREAFNFGFSAYQSRQACIEAGGGDPGEMHEDCLFLNVWTPKLDAGAKLPVVFWIHGGAFVIGSGRLPPYEGIHLASRDVVLVTFNYRLGHLGFFMHPALEKENPGGPANFGLLDQVLALEWVRDNIARFGGDPGNVTVMGQSAGAKSVLSLFTSPQVREKNLFRRGVAMSAYVLQEKPLADARLAGMAFAWRNGLDRLLATMKDLRELGPEKFWMLPADTANAPSPIYGDSVLPEPIRETFARGEQLSLPLILGSTSDDSSVVSSFGIDPATILERLGAFAESIRQLYPDVDDDREIGRRMCRDFVFTVMPRLLATRHAERGAAVWRYYFEYRAKMLAPRQRLGVPHGGEVPYFLETAADVPPTGALFTEEDGTFMRHLVDSLVQFARTGAPGPVAQVSWEGHTETQDRLLRLDGSPQGVTDFERDILQAAENLMPFLDSLAKPPPPKLPRATSAAATASSNTRQEGRP

SEQ ID NO: 9798 - protein, 97 aa, Myxococcus xanthus
MVHNHSFGDATLTREQVEWPGTADSVRDLISRRYTEWRAAIEQLSDEDLRSTERTRWPLQGKPFGDIVAWVNLELMKNAAEIGYARFVLAVAPRPPG

SEQ ID NO: 9799 - protein, 239 aa, Myxococcus xanthus
  unsure (1)..(239): unsure at all Xaa locations
GMVPPMRSASGSATKFLAXVGVAGXVGSSLALDVVRADVRVAAKALPMLCLLLWQWPPLGRYGRWIFAGLALSLLGDVLLDVGPGLFLPGLGAFLLAHVSYVAAYVTVSRQPRWGRALPFVFLAVGASVFLWSHLGEMALPVTAYVAVICAMTWRAWAMLGSPGLSRRAQGFALAGALLFAVSDGLLALKLFVRPLPGSGYAIMLCYWAAQWCIAVSAREPRQSGASRTLQAEGVGSSA

SEQ ID NO: 9800 - protein, 59 aa, Myxococcus xanthus
MVFTYVIPLALMTTFPAQAMLGRLPPQSLVGAVVGAGLFAWGSRQVWLRSIRRYTSASS

SEQ ID NO: 9801 - protein, 739 aa, Myxococcus xanthus
MIRLNDILQRVSQYHPDPDLDIIKKAYVYSAKVHQGQLRKSGEPYLVHPLEVAGILGELKLDEASIVTGLLHDTIEDTLATEEELTELFGSEVAHLVDGVTKLSKFSASASLSQEEKQAENFRKMIIAMAQDIRVILVKLADRTHNMRTLDHMSEEKQARIAQETLDIYAPLANRLGISWIKTELEDLSFRYVKPQEFFALQAKLNKRKKEREKYIEDTCDLIRSKLAERGLKGEVSGRFKHVYSIYKKIKSQGIDFDQIHDIIAFRIIAPTAPSCYEALGLVHEMWKPVPGRFKDFIAIPKPNMYQSLHTTIIGPLSERVEVQIRTSEMHKIAEEGIAAHWKYKEGKAVISKDDEKFAWLRQLMEWQQDLKDPKEFLETVKVDLFTDEVFVFTPKGDVRSLPRGATPVDFAYAIHSDVGNRCVGAKVNGKIVPLRYKMKNGDTVEVLTSPQQHPSKDWLTFVKTSRAQQRIRGFIKQQQREKSLQLGRELADRELKRFQLNFNRLLKSGEMKKAAVDLGFRVEDDMLVAIGYGKVTPQQLSHRLVPQEKLNAAEAGGRADANPAATTSGGAGNSVLPGLSRVTDLAKRLVGRSNRSGVQIGGVDDVLVRFGRCCNPVPGDPIAGFITRGRGVTVHTVGCEKALATDPERRVDVSWDVRGDFKRPVTLRVLTADRPGLLADITNTFSKKGVNISQANCRATGDDRAVNTFEVIISDLKQLTDLMRTIERLQGVYSVERI

SEQ ID NO: 9802 - protein, 128 aa, Myxococcus xanthus
MARKAIHSDQAPKAIGPYSQAVQVDAGKMTFLSGQIPLDPATMEMVQGDVVAQAERVMENLKAVLAASGLDFSHVVRCTIFLTDLGDFARVNEVYGRYFTGAPPARATVQVSALPRGSKVEIDAIAVS

SEQ ID NO: 9803 - protein, 61 aa, Myxococcus xanthus
MPILELAKAMRALAPGTLVELVSTDRGLEADLPAWCEATGNPLVRMERRERLYVGWVRKAG

SEQ ID NO: 9804 - protein, 483 aa, Myxococcus xanthus
MRFHRRLLSAAVLLPLVLVIGATEPEQPASAGASEDGGVGVAAPDTTSHAAQADAGTSGAATASQGAQPDAGTSGSAAVSAAAVLGGESPDGGLAALAAEPGMVPPVPVPSREKAPPIATVKSLPRSADLMARAALEDGKLVVKEKGGKKKQLTIDPVLQASLTQILRNYETPYGAAVVLEPSTGRVLALAEHSAARPELRGLPVRAVFPAASIFKVITGGALLEAGVTPDTEECFHGGKRRISEKHLQDSERDSSCYSLALAMGKSANVIFAKLTNKHLTVDSLRRMAARFRFNREIEFPVPTDVSLAAIPEETFSLANTGAGFGDVYLSPLHGALVAAVAANEGRWVDPILFEPEGPAPLLPVEGEPVLTPEVAKDLTALLEETVTSGTARAVFRERGFRVDDAVGKTGSLADREPFRDYSWFVGFAPKDNPRVAVAAIIVNDPKWRIRGTWLGREALRLGLERMPAPVEMTAPASAAGKH

SEQ ID NO: 9805 - protein, 92 aa, Myxococcus xanthus
MRVDIYSKPNCSLCDKAAAVVESVRARIPFELRIISILEDAEAFTAWRYDIPVVVIEGVPAFKHRVDAAEFEARLHEVKGGTTIAKSAAQHG

SEQ ID NO: 9806 - protein, 113 aa, Myxococcus xanthus
MAERLLVYSAVVLGQTVRDADAVARVGDCQFALMLPGTPAESVPEVVSRVAARFDTARFQVEGKVVRTSLELGTVSFPDSVGTPTQLLSAAQQDMRRAREFRRMVGSTSRLSV

SEQ ID NO: 9807 - protein, 553 aa, Myxococcus xanthus
MDRIAVLVVDDEEAVRTFLSELLGSAGYQVRCAASGTQALEMLSGGSFDAVLLDVVMPEMSGLEVLRRYQSMGGGAPVIVLSALAGADDAVRAMKMGASDYLAKPFGNDELQDALARALGTRAPERQAVAPILPSRTVLPVVDSAQEQRVLISTSPAMRRARALVERIADTDVPVLLLGESGTGKEVIAREIHARSQRRNRPFIKVNCAALPGELLESELFGHERGAFTGATAEKPGKFELADQGTIFLDEIGEMAIRLQAKLLQVLQDEEFFRVGGKKSVRVDSRVVVATNRDLEKEIALGNFREDLFYRLNVVAIRLPALRERREDVVPLTDHFLKKYGRGYLSGVSELPTEVLHAFADYDWPGNVRELENMVRRLCVLKDPTLVLDELRAAVRAPASAPSLPTSYAGDDGGPFGRAHDEGFRTPPPAVQVLEMPSRGAAFGLASVAPLAPPAHAPMVMESANAVVSAPRYVNPFDVPQPPPPPAPTGELSLKDIGKRAAMLAEREAILAMLQRTAWNKRRAATKLRISYKALLYKIKECGIIDPRASAEL

SEQ ID NO: 9808 - protein, 112 aa, Myxococcus xanthus
TPPLVLLGSGYTLTRLAVAEARAGRDVLAATRDAARRAELERAGARVTDLEDALTRTAGAHVVVSVPPDAGLDTRIASALAGQVPARLVYLSSTGVYGRARGHVDALEHTRF

SEQ ID NO: 9809 - protein, 228 aa, Myxococcus xanthus
SQLLLSSLAVVCPNCDGYNSPRSAACVLCGQALGEPAAAPRPAATKPPLAVARPGTPPGSRPVAVSNFPGGKVAEPVVPPAPSAIPPGLRPSARTPPPTAAGLTVERPPQQRTPTAPPGIMARTGGASGPATTRPPPPVPDSAMPSRAGAATTAPRPAPPAASRFGLAVIAGSTRGQRYKLPVTGCVVGRQRGAILFADDAFVSPLHATFLVKDGALYVRDESSASGV

SEQ ID NO: 9810 - protein, 656 aa, Myxococcus xanthus
MKPNVIVALLVGLVLGFVGGRVTTGPSTKSEVAKAAPNSPAAPAPGGRRPVDPTVFKVPIENSPTHGSADALVTVVEFSDYECPFCSRANVTIEKLQEQYGKKLRVVMKQNPLSFHPRAKPAAIAAMAAGEQGKYWEYHAKLFANQKKLDDVSLEQYAKELGLNLDKWKAELGNPKFQDIITRDQALAGQLGASGTPAFFINGRFLSGAQPIANFQALIDEELVKAENLVKGGVPASQVYAKIIEKGSERAAPKAQPQQPAATVRKVEIPSDSPSFGPANAKVTIVEWSDFECPFCSRVGPTLSKIKESYAKDVRVVFRHQPLPFHPNAKLAAEASHAAHEQGKFWEYHDKLFANQKAMDRASLEKYAQELGLNVAKFKAALDSGKFKAKVEADMAAGNAVGANGTPTFFINGREFVGAQPFEAFKRVIDEEIGKADKLLAAGTKPEELYAKLNAENVANAPTAPAAAPGAPAEPPVQKVDVGNAPVKGDKNAPVTIVAFSDFECPFCSRVVPTLKQLEDQYGGKIKVAFKNQPLPFHANAKLAAAAALAANEQGKFWEYHDKLFANQRALDRASLEKYAQELGLNVDKFKAALDQGKFNAQIEADMAQASSVGASGTPTFFINGRTLVGAQPVDAFKRVIDEELKKLGGAVADSK

SEQ ID NO: 9811 - protein, 374 aa, Myxococcus xanthus
MPLKDLVVYLGNRRATGSLKVERGDVRKQLELREGHVVSASSNQPREFFGQFLINMGHLTEDQLEKAFSTQAQTRIFLGKILVMTGLVPEATVRGTLSHKFREMILDAFHWEDGDFLFEAADTAPEVAGLEVSVDLLDVHREGEFRETAWQAIHAVFPSGAVRLSVDERKLPERKPGSMDERIVQLIKEGLTIDGIALALHATDFFLYQRLYALYRLDAVKVSDEPPESEMSVVEEENGERGIIGSETSSDEVLQAAQLFLDAGNARDGEALARRAHEMSPSPRTAEFVKAAQEKLLVHLRRELADPPRVPTLQVAPGHLKTLQLSAPERYLLSRIDGRRDVAAIVHVSPLQELDALKFFAGFVDATLVKLTPR

SEQ ID NO: 9812 - protein, 231 aa, Myxococcus xanthus
HTKASKQGLWVLAAVAMALALLVNCGSSDEDPTPVPDAGQTDSGTNPMPDSGTEPEPDAGTEPEPDAGTEPEPDAGTEPLCQSDVPCREQSIDRLNLLTTPSTTAMYEEEAPAGEFRSYIDARAGGLTVNQSYTYARFTPEGLARVNIDDQTSLGDHGWDIAFRRYYIRLNGGTSGPSCIGVARLPTGTRFETVTSVPADLTFQSDAWYTDTCEFIPDNSGLARPTMALSS

SEQ ID NO: 9813 - protein, 30 aa, Myxococcus xanthus
MLCKELLDWRGFAKRDVRSKAYWADGERGL

SEQ ID NO: 9814 - protein, 110 aa, Myxococcus xanthus
VYSHPVGNQGHALGASIDFRSASRQEEAKTLRLGSYIAIELNTATSVPEWDGQKVFVMQEDPAYLTEEGWKFFVSRQESFYLLGRDGQGGQRSQGAKGGKGVTTRGMPML

SEQ ID NO: 9815 - protein, 411 aa, Myxococcus xanthus
MSRINGNYEVLSDEAGRPIKAWTVGVPFEDEAKKQLRNLRGLPFIHKWVSVMPDVHRGYGATVGSVVPTVGAVVPAAVGVDIGCGMIAVRTTLRADQLPDSLRGVRSAIERAVPHGRSDNGGRNDVGAWRVAPARHQKEWARLVEGYDRIVGKHPRIGRGPELSHLGTLGTGNHFIELCLDESDGVWLMLHSGSRGVGNRIGSYFIELAKEDMRRWFINLPDGDLAYLAEGTEHFEDYVFAVSWAQDFAATNRALMLQEAVDALQLSGELPPFELKDAAVNCHHNYIAREHHFGKNCFVTRKGAVRAREGDLGIIPGSMGARSFIVRGKGNADSFHSCSHGAGRVMSREAAKRRFTVEDHVKATAGVECRKDVDVIDETPAAYKPIDAVMAAQADLVEVVHTLKQVVCVKG

SEQ ID NO: 9816 - protein, 338 aa, Myxococcus xanthus
MVRIDGSLGEGGGQVLRTSLSLSLVTGKPFTIQNIRAGRKKPGLLRQHLTSVKAAEAVGAAEVSGAELGSRELTFRPSALAAGNYHFAVGTAGSATLVLQTVLPALLLAKGPSTLMLEGGTHNPMAPPFDFLQRAYLPLVRRMGPSVEATLERAGFFPAGGGRFRVDVRPAPLKPLHLLERGRVVRRDLKAVIAMIPFDVAQRELGTAGAALKWRPDELRTEELKRPLGPGNVLVAEVESEHVTEVFTGFGERGKRAEAVAGQVAEEVKRYLDADVPVGEHLCDQLLLLVALAKGGVFRTLPLDGHAETQLQTIAQFLDVKVKVREVSREVREVEVRA

SEQ ID NO: 9817 - protein, 736 aa, Myxococcus xanthus
MWFIGALVDPHARVDEVSEENNAHAGDSVTFDALPDFTVESVAVPSVVRPEWPFYVAARVCNRGQGSEQATVYLYRSSDAHIDTDDVVMRDQSWLFLDAGRCERVVFVGVLGEPGTSYLAFMVDPLNERPEADETNNLSVVSPLEVGSIPDYVVAALRAPAMESINGSLPVRATVCNQGTAPASATQVQFQLRASEPSAEGVLRVSSRNIPALEANQCIEWEESLGSMANAARSWRLVATVNPVGAQTEAHSGNNDRSVNVLLGSSADLSVTRIEPLTHALVPGASFTTEVTVCNTGTLSASALAVHVALSDGPDPRAGIRVGTRAFGALGKGCAVLPVVGTVPTQGLPATVHVKASVELVAPVGGEAHLENNALTGPVVGLGTGPDLVVTRIVAQGRAAWPEGKLPVSVTVCNQGNVRTPRAAVQTLFVPEVLPEISAGIQGAKLSVESLAPGACITLDAEARVPYYTGAFRLAARADIDNAITELVESNNDALGDIIQVTQLSGLVVTDLQAPTAINTNATINATATVCNRSPVAQPGTAVGLALRTEDDFPVSALSEYVVVPALVPGACAQATLRGWSNVPQEGAYRLVAYLGDPWDVYAPEQWRALLFSVPIAVGGWSDFAVTAVSAPVVVQAGDAYSTEVSVCNRGFGQASASVRAYLSRDEHLDPAVDVRVGQMSVTLARGQCRTVSVSSRATVSSGDVWYVAADVSVGSLPDLVSANDGQVGARMVVTP

SEQ ID NO: 9818 - protein, 458 aa, Myxococcus xanthus
MSAPHPLLLVDDDAAFRKVYGGLLRDAGYEVVEAADRPSARAAFDARDFPLVLLDLMLPPDGSVSAGLEGLAALLSAKPGTKVIVVSGAGDTRHTLEAVRLGAYDFLTKPVDPDVLLVVVQRALARVTLERQVETLRSSLTRAAGGVSLVGQSASFLAATSLAERVAASELPVLVTGENGTGKELLARTVHLKSRRHDGPFVPINCGALPESLLESALFGHVKGSFTGATKDHRGLFAEADGGTLFLDELGDMSPSLQVKVLRALETGDILPVGADRPVQVDVRLISATHQDLGRMLQEGAFREDLYWRVKGVEIRLPPLRERSADLPLLAKHFLNQCAHLCPDGRARLLSDAAAEALLAHAWPGNLRELRHEMQRATVLAGERREIQPEDLSFTGSERLHATRAPGTTTLAQKVEALERREIEEALRRLNGNRTHTAEALGLSRQGLLKKLERFGLT

SEQ ID NO: 9819 - protein, 234 aa, Myxococcus xanthus
MAEGQGWFAFRHGLVVDAVFNGERGSLAFRRMLCFGAGDYAVTLGPELHKGSFTMDRPYLCETVLQGLERFDALRARGLPLASRLTVDFARLAEMLASLPEDVGEVVRLFDGRRTLRAMLLECQFPEAVAYEASTRLFALGILVPACLLEERERAHCGSTVPGFFEPAPSVDAEPVDAREPAPAACGGDGASAPFTLVGGSQPPVILDFPKKVPGASSGAEGLEGAVRSDDAGV

SEQ ID NO: 9820 - protein, 249 aa, Myxococcus xanthus
MSGHNRWSKIKRQKAAMGATKGKLYSKVVKEITVASRLGGGEPSGNARLRVALAAAREANIPKDTIERAIKKGTGELEGENYEEVTYEGYGPGGVAILVECLTDNRNRTAADMRSTFSAYGGNLGAEGAVAWMFQKKGVISVKYGPSEDQLMEQAIDAGAEDVIMLGDEGSEVRTAAADLHTVAGRLQESGLPLGQQRWVFLPQNTVALDVDTVKKLLKLLDALEENDDVQNVHGNYEIEDAMLDSLLQ

SEQ ID NO: 9821 - protein, 179 aa, Myxococcus xanthus
MGFGVVEEKRGRLVHVGHGVIKGDPALPLSDRLRDLHGALTAALVKYRPAAVAVEGVFTFRNARSALVLGHARGVALLAAAQAGLPVFEYAPAKVKKAVGAGGADGKDAVARMVRTFLELDASVLERADASDALAVALCHLNHGRAAVPAASASGKKRKGAAALLADRLAPAYRRPEAR

SEQ ID NO: 9822 - protein, 202 aa, Myxococcus xanthus
MISRLRGTVLEKDLEDATIDVGGVGYRVNFSSLALGKLPAEGQPVDVRVRTVVREDAFDLFGFLTKGEEEVFLLLNSVSRVGPRLSLMVLSGMEVPELVAALSRGEVARLAKIHGVGKKTAERLVLELKDKVKTIHLEAVSRGTAPAAVSGAHADLVSALLNLGYKQPQAEKAADLASERLGAEATFQALFREALKALRSGG

SEQ ID NO: 9823 - protein, 35 aa, Myxococcus xanthus
PKELVALGGELYFTADDGVHGRELWRTDGTAQGTI

SEQ ID NO: 9824 - protein, 540 aa, Myxococcus xanthus
MAKSRARKTVVLGMLGTTLDNGQGPQRWARWRPTVALCQQEDLLVHRLELLHPPNATSLAATLAGDIRQVSPETEVRGRPLRIQNPWDLEETYGALLDYVRGYAFNPEAEDYLVHITTGTHIAQICMFLLVESRLIPGKLVQVSPDPRDRAGAGTHTLIDLDLSQYDTLAARFRQEQREGLAFLKSGIDTRNAAFNRLIERIEQVAVQSRAPLLITGPTGAGKSQLARRIYALKKSRRGVAGPFVDLNCATLRGDGAMSALFGHVKGAFTGALSDRPGLLRQANGGVLFLDEIGELGADEQAMLLRALEDKRFLPVGADREVESDFQLIAGTNRDLQVEVERGRFREDLLARINLWTFRLPALRERPEDIPPNLLFELDQSSEAVGTRVTMNKEAQERFLDFATSTEARWAGNFRDLNAAVLRMATLAAGGRITRDVVDEELERLREQWRPSGAKAAVVAGDLVAEVLGENLASELDRFDRVQLADVLSVCRASRSLSDAGRLLFAQSRAQKKSVNDADRLKKYLARFGLTWADASGRGA

SEQ ID NO: 9825 - protein, 239 aa, Myxococcus xanthus
MRPGCFGPLVSALLLVSLESAAQAPAPAPADETPRVTTSDTALLRGTSEDPLGAVLAPVTLPDGATALYGFVGAPEIGVGFRQGISGFELEARARLQWFQLSASLELAVRRKVLEQGILSLAPTLGLGVVLNSGATYMDDRNYSGVLFRVSPGLVAGWRVADTVSVLGLLDVPVDIGLSNGQSRRIQALGGGGVEVYLGSNLSALAAGQLGVESFQERSGESHTRLGYSVRLGLGVRLF

SEQ ID NO: 9826 - protein, 603 aa, Myxococcus xanthus
MALSKVNNEKAKAYLTLQYGRRGRATRQVIVQALKNANVPGAMAEVVAAEARSQWDRNQLALTEGALPERVGAAEELGKSGRPDAVNRLLPLVRDSQVILAAAAVRGLGDAGDKRAVSPIALLLEENFPELRESAIHALMKLQDPVATQRLQLVAVEKSAVSPLAIDAIVSFPRTPQTDASLCAIVMEGAPAEALVAGRSMRTRGGCSVDTIGERLARPATAASGLQAVEGLGPAALPLLGKVVPWLSHSDATLRLLAVEAVAEVGDASVVPALQKLYEQEVKGLEALRADWVTQALPEKFGVGFDPSTMPPTPSTPGLKDERPSRHADLLGRVKELNAARVRESGRDVVRHRVPTELYDDVAPERLVPLATLLRALGALKAPGALELLTGYTQDSSAALRVAALVGLARLGPEGVNVAKAGLVEPDRDLQKALAQVLAEAGEAGQAALIEMLPKMGSEKLLVLDALTRAGAVPGSASTQLQAVVREGGPEAALAAALLGRIQAKDAVPTLVKALDEPNSVARRDVLLALGSIGDAQAADAVAKDLFHDLPEIRAAAASSLRKLGSAAHADQLEALKADYFRTVREAAGAAPASASTASEGAP

SEQ ID NO: 9827 - protein, 483 aa, Myxococcus xanthus
MTSELATSVEASTIVAASIPPAMALREPEAPPLATRIPAVQPGGARPATSALPPGLAPRASQRLPAVGAARAPEPAPSAPPRSVSNSGRWQALSSPITTQAAPAASEAAAASAPPGLRARRADPPVPAGATALPGHDLSPALGASFRTAASPSSFTELELEADSLLHAVELAAQAGLDRQGLGATSISDGLEEELYSLTEEVPPDAGSLDALPTIPLFSDLPRDAFIELFERCPLRRFGPDERIIDQGSHGDAFYVICEGAVRVFRTEEGQRQDIATLEGGTFFGEMALLSGAARTASVESASDDTQLLEISASVLAELSGSHPQVAQALKKFCRQRMLTNVMNTSELFRLFGRKDRRALVERFRSRDVERDTVIIRDGDPTDGLYVVLSGEVEVRKDGHLLTQLREGDVFGEISLLQKTPATATVTATRDTTLLRLPRADFDALMCSHPQMLALISDLSDERLRRTQRVLTEAGVEEDLILV

SEQ ID NO: 9828 - protein, 94 aa, Myxococcus xanthus
MDQVAEGKEHLDPFKVGKDPSLFRAAMTSMLDEVARMFVKDLTPTDRAGAPPPRASAAASDVVPGKAGAPAPAPEATKPPEDELAPGELPDPDP

SEQ ID NO: 9829 - protein, 335 aa, Myxococcus xanthus
MISVRGLRKHYKVHKRPPGLKAALRSLIHRSYTTVKAVDGISFDIRPGERVGFLGPNGAGKTTTLKVLSGLLYPSDGEVTVDGHVPQKREEAFLKKIMLVMGQKQQLLWDLPPAETFELNRAIYDVPQAQYKKTISDLIELLEIGDLIGKPTRQLSLGERMKCELAAALIHQPRVLFLDEPTIGLDVAMQATMRTFIKEYNEKYGATLILTSHYMDDVAALCPRVIVIDKGLLSYDGGLDALVQRVRPEKRVVLRLSEEVDAGRLSPLGRVVTHEPGTAVLQVQQEAVNATITRALSTLPVMDLTVENAPLEEVMSELFAESKARRTAVSEPVPA

SEQ ID NO: 9830 - protein, 549 aa, Myxococcus xanthus
MLGRDVTLVSESGAPSGERRVMVFNPPVVNAELGIRASYLKTAARLTADLVRAGVSTLLFGQTRNNIEVMFKTLRDRLFDEKLDPSLIQGYRGGYLPGTRCATEAALRAGEVRCVVATNALELGIDIGSLDAVVCAGYPGSVAALMQRFGRAGRRGEGSLALLVTSSAPLDQYLAGDPRFLVGSPVEHARIDPDNVEILVQHLKCASFELPFEEGEPFGDVPPESTTEALGFLAQHEVVHPTVGEAGRRVFHWSTDAYPANHVSLRSVGWDNVVIIEKGTDRTLAEMDFRSAHTMLHEQAIYQHEAEQYQVERFDYENHKAFVRKVAPDYFTDAMTYVRVHVIQEDQAAPMGPDLQAGMGEVSVIEKVVGYKKIKYHTHENVGYGDVALPEMQMHTTALWLTVPETVVRAMRAPRPAVIDALRGLTTALRTVACVGLMIDPRDIGKTLGSRDDAEGPPRKDGGVGFDPTLFLYDNVPGGVGLAARLYDQRDELLSRARRLLESCACEDGCPACIGPAAGAMPGQAPVDPHPRKRLALEVLSALGIAGMQ

SEQ ID NO: 9831 - protein, 412 aa, Myxococcus xanthus
MLSDWSERQGLAAARRGTPPPAPPGPLPVESRATAHGTVHISERILSPEHHHGSAPLAAALDVEGPLVASLALHADLAGVDFQRMLFLDTETTGLAGGTGTVPFLVGLAWFEGRSLKVHQLFLRRLGEEAPMLRSLAERMAASSCLVTFNGKSFDWPLLRTRFVLNRVPAPVELPHLDLLHCARRVFKHRGAGTRLVHLEDQVLGFRRVDDVDGSLIPDLYFRYLRGGDGSALTPVLEHNVNDLLLLAALLGELVRRFRAGGADASVPRDADPRDLLGFAGVALRARDYARAQAFARAAAAGDTGAVGIEALALASRLSRKAGDASTAAAHLHQALKTAQGFQAATLHLQLTKLYEHGLKDLARALHHAKLASAAELPVDHHRRILRLETRLARSTRAASLDLGMGSPRSGT

SEQ ID NO: 9832 - protein, 174 aa, Myxococcus xanthus
MIEAHATAVRYEGPMKITKDSVVSIDFRLHLGDGKAVDESEPGEPLVYLQGHEEIVPGLEKALEGKSRGDTLQVTVGPDEGYGDYDPEGIEEVPKTEFPEGLELVAGGVLSATDPDGDEVDFFIKEVKADSVLVDFNHPLAGKTLHFEVTVRDVRAATAEELEHGHAHGPHDSH

SEQ ID NO: 9833 - protein, 169 aa, Myxococcus xanthus
MPEVPGPEALASEQELLSRVSARIPEALREKFLGEKPIEIRPVAPEDPFNPEAQAPIKHVWFRANGDLPEDPQVHRYVLAYASDFNLISTALLPHAASFFQPRILGASLDHALWFHGDLKVSDWLLYSMDSPWAGNARGLSRGSVYTRDGRLVASVAQEGLLRIRKPTA

SEQ ID NO: 9834 - protein, 413 aa, Myxococcus xanthus
MFHSAGVVPNQWFPTTEGANYALTPTLSPLAPVKDDVLVLSGMRLGAWDYYERTHEGGFWMMLTASERIVAGSTDSIDQVIARATSAQVRVPALTLSVENNGYYNPGYRDANGDGFIDPKTSSYDDTQDHCSGEDHCMVTFSRGRRLPNVYNPRVIFDRLFGSLPAEGPTDAERRLWMYRRSVLDRMTGQAKALQAKVGQADKLRLDEYLTGIREIEVAIQKAEQGAPAAACTTGARPVGIPMDGTAYANLMCDLIVKSFECDATRVATLMLGMCVSPMMFTVNGRAFSHHGDASHHGNDPVKLAAKVEIDRWQVARFAHLVQRLKAVPEGEGTLLDNVAVFYSSDISHSDWHNHYDMPVLLAGRAGGAIRPGRHMRAQGKRCGDVLLSILQAFEIPRGTFGPLAQGPLAGLA

SEQ ID NO: 9835 - protein, 225 aa, Myxococcus xanthus
KTRSLLFGIPLLLTACSDELPVARTQDPKPVVAAQNCSDGAHSLRRLNRAEYDNTVRDLLGETGRPATTFPADPTGHGFDNEASLLGMSPALVEAYEATAGRLIDQAWARDGAASAGGGTVRIEAESASATTGASEQNGTVWNLWSNGDLSATFTFAQAGEYQLSVRAWGTQAPPDPVRMQWLLDGVVVASLDVPATTPTVYTQPVRVDSPGQKRFTERFTNDTY

SEQ ID NO: 9836 - protein, 345 aa, Myxococcus xanthus
MLLAAYMSQASFFRTAGAWAVRRAHTPRRLLLAVTFISAALSAFLVNDTVCLMLTPLVLATVEDARLPPAPYLLAVCMGSNSGSVATFTGNPQNMLIQGASGLSYASFAAYMALPALLSTAVVAAGLLYLFRHDLPVKQFEPNPPPPPVDRGLLVLTLTVLSGVVVAFFAGLPMSWSALAGAALVMALARREPREALERVDWVLLLFFASLFVVVYGVNKHGYAEDIRVLFEPLMAGPPLRETLGFAGLTLVASNLFSNVPFVMLARTWVPTLHDVELGWHVLALGSTLAGNLTLVGSVANLIVFEAARGKVNMSFLRFLRVGLPVTLVSFVVGLSVLLVEHALF

SEQ ID NO: 9837 - protein, 251 aa, Myxococcus xanthus
METQNRLILQKRMFDGESMLTRDNFVNGAFAIKANPASVKIGPVFEIQPLAIFNLRATYEYVRYFGTFGFLQSYNNPMLDFSDDARDLTEDAAYSTSGHHYMVEPTLQARFGSFVVRSKASIEYWNVALREGNGASFYDALLDTLIPGRGWVFTNDTDLMMLTTPQLTLGARFSGVWPRYENGSGGAQNVDNSHTRIGPILAYALNTREGSSFNRPTILLNFAWYLNHPNRGGALPYMMGAFAFTSDFLGG

SEQ ID NO: 9838 - protein, 297 aa, Myxococcus xanthus
MPLALAVIMLGLGLTLTLADFKRVIVYPRAILVGLGSQMLVLPVACLLIAHAFRLPPELAVGLMLLAASPGGATANLFSHLARGDVALNITLTAVNSALSLVTLPLIINLSLAHFMDEGRAVPMQFAKIVQVVLIVLGPVSLGMFIRSRSAAVAQRMDKPIRILSTLFLVAVIAASVYTERANALSFFRQVGPAALAFNLVSLGVGYFVPILLRLPRRQAVAIGMEIGIHNGMLAIAIALSPTLLANSTMAIPPAIYSLIMYFTAAAFGFYVSRRYADEQDPAVHRTPTSLPEKVSR

SEQ ID NO: 9839 - protein, 62 aa, Myxococcus xanthus
MGADKHYLTDVATGALLGSAFGVAVPLLLHGRKGEASPDIQSGQIQMAPVASARMMGISGTF

SEQ ID NO: 9840 - protein, 62 aa, Myxococcus xanthus
MNIASLIRPATSPHTPAPRRLRLVRVQATVLAQGAVGAMKDGVKAFRHMCDVLTGGYAQARH

SEQ ID NO: 9841 - protein, 519 aa, Myxococcus xanthus
MQTRDARFDGRFFTAVRTTRIYCRPICPGPGRPGFENCTFYPSAAGAQEAGYRPCLRCRPETSPDLAFWRGTSNTVARALALIAEGGLDDDDAGVEELAGRLGVGDRQLRRLFQQHLGASPVAVAQTRRVLFARQLLHETTLPMAEVALASGFRSVRRFNDVFRALYGRPPSALRRSRAPVGDAAAGVTLFIPYQPPYDWEAMLAHLEARALPGLEHIEAGRYRRTVATAGGQGAVEVFRAPGRDGLLATLRLPQVQALPTVVGQVRRVFDVGADMDVIREHLSRDPHLAPLVSLRPGLRAPGGWDGFELAVRAVLGQQVTVAAARGLGARLVAAYGEPAGVASTGDARLMRTFPRPERLAQEDLSSLGMPAARARTLSSLAAAAAADPRLFQPRATLEEAVERFKRIPGIGDWTAQYIALRAVRETDAFPSADVALLRALTGEDGVRPSPDEALRRSAAWSPWRAYAAQHLWAADAARPGPTPHLSRSSSRQRDDDAPTAAFAHGPRPHAHRLDAGRL

SEQ ID NO: 9842 - protein, 175 aa, Myxococcus xanthus
MDRAPTPIGSMLVVCDEAGSLRALDWEEYEPRMLRLLRLHYGVNGYVLEPASDPFGRTTAMQTYLRGDVSVIDSLPVATAGTPFQREVWRALRDIPAGATTSYGQLAQRIGRPKAVRAVGMANGANPIGVVVPCHRVVGANASLTGYGGGLERKQWLLDHERRHASRGTTRPPTR

SEQ ID NO: 9843 - protein, 774 aa, Myxococcus xanthus
MSEPDVISLRGAKEHNLKNVSLDIPKKKLVVFTGVSGSGKSSLAFDTLYAEGQRRYVESLSAYARQFLGQMEKPKYDTIRGLSPTISIEQKAASNNPRSTVGTVTEVHDYLRVLYASIGVQHCPNCGVKVGKQSAQQIVDEILKAPAGTKLQVLAPLVTNRKGEHKDLLAEAQKRGFSRARIDGALKSLEERIELDKKSKHDIALVIDRVVLKPDVKTRLTDSVETALREGKGTLIITDEKGTLASDRVMSELNACSKCGLSFGDLTPASFSFNNPLGMCTDCNGLGTKPEMDPDLIVPDTSRSIRDGAIEPWAGSMNRGEGWTADFVESLAKAFKIDLDVPYAKLTKREKDTLMYGASGKSFTVAWGEGGKYKMEWEGLVERMMRNFKTTTSEARRTELQKYFSDKPCPSCKGERLKPESRAVKVHGRSIVELSRLTISDSLGFLGDMALSAHERKIATELLKEIRSRLSFLVDVGLGYLMLDRTASTLSGGESQRIRLASQMGSELTGVIYILDEPSIGLHQRDNGKLLLTLKRLRDLGNSVIVVEHDEETMEEADWLVDFGPGAGELGGQVVAQGTPEQVMANEASSTGAYLSGRQEIEIPQERRKPDPKRKLVIQGAQENNLKNVDAEIPLGVFSAITGVSGAGKSTLINEILFPALARHLYESRESPGKHKAVLGMEHLDKVIDIDQRPIGRTPRSNPATYTKLFDNIREVFAMTPEARAFGYGPGRFSFNIKGGRCEACEGDGVKLVEMHFLADVYVPCEVCAGKALQ

SEQ ID NO: 9844 - protein, 777 aa, Myxococcus xanthus
MAGAGAGKTYSLVTMTLHLLAGARVAGGAVRPSRLCMLTFTDKAAAEMRSRVRQRLDGLAQGDTRLDQEVDLRESLARLDKPFPLPDAWRQLREELGAATVGTFHSLCGQLLRRAPPAVGIDPNFEVLDSLEATGLVQDVCERVVLDALEAGDAQVRELCQELGFSGSGFSDGLVAALMAVYGKLREEGLRAENAAVSDAAEARAELESSVTRCLELCAEARGLDAKGEWSRLLGGLERALNGMTPENFGQGERFPWLRACFKADGRNFARLSKGAAGPVREFYWRVFGKSDGSVPRLDDAWAAWRTAPFEVTFRELLTRVETRHDTELSRRNVLDFTSLLVKSRDLLRAHPEFRRQVQERIGALLVDEFQDTNRLQLELVLLLAEKREDGPRELAPDADLVTALPLEPAFLCAVGDRKQSIYEFRGADVSVFSVLAKKLVDEGGTRGFLQHNRRSVPGLLSFFNRTFAGVLVAADARAPRPFEVIYVPEQDDLAAVRPSLSETPVVERLQLEEADTAADLRWLDADAIARRLRCLLAPGAPASVAREDGEGLRPARGGDVAMLFRTFTHLEVYRQALIRHGVPHRVLRGRGFYGAQEVLDLASLLALLADAEDALAFAAVLRSPLVGLKDASLFLLAGDAPLSLSSPRLTDPEVLVSLSERERQRLERFLAALPGLRRERDRMGVRELLVAALDVTGYREALAGSPYAEQASANVEKLLALASRRDERGTGGCVAFSRELRMLAENNPTEAQEDLLDASDPRAVQLLTMHSAKGLH

SEQ ID NO: 9845 - protein, 1037 aa, Myxococcus xanthus
MLQALGGARELNRRPCPAVAARAVVASLGLELGPTPFGDYVREPAFARAALDVVLDLKAGRLSARELQDAVEILPQERRTRIRVIARLYHLYEQRMAELCLADREDVLRGAREALGRGAWPVGWEGLSTLVLHGVYDVRPSGLELLLALAAACESRRVTLRVETPVGGSPAADAALTALFRAFENRGDSMTHVDLFKADVTFEGRPFIDLGRHLFSPRAPRDVLKDAVPSLRVWNAATARDEARLLARDVRRLLAEGVAPGDIAVAYRELGPEAGWLAESLGELGVPVRLPWGEPLGLAGPVRLALDLPLLVEDGFPVERMAELMGSRYAPKLSRGGPDAPATLFAQAAVRDDRLGAVRGRGAYDVRLDGLARRLLALNGTRKAQDSTRVDAVKLLRERCLLLVEACRRIPEEGTAAELLAAWWQVVERLGLVDSEGALAPREEGGLGARAADARARDDAAREALRLRVQGLTRMMKAVGGGPKMRRRTFGRWLRDAMADAHLPPRGPRGAAVEVLDVAELPGRSFQDLFLAGLTEGRFPGRDAPSPLLADAERAALNKHLGRDVFRLTGGEFDERAAWRLTEDRLLFASALAAAEANVSLSFAVESAGGQEQVPSAFLEEVRRLTALKWEPRSLSPIPPLDEVLTESELRRCVALEALSQPKLRVTEPDAAAAVLRRRFAPEAWYAGARELSEVEMERLFFFGDPKVQPGPYSGSVDLDTQRESLRETFRFDITRPLSASALARFGNCGFQGFLSYGLKVAEPDVPGEEFDARGRGTFWHKVVEEVFAALKEKQLLGKAPEEVPDEVLDAALKAAIKDFERVHHVGHPELWKLAHERARAMARRILVDERRGLPFDTMTPENFEFRFGPAARDDKWSNVVLHAGEEPVYFEGTIDRLDKSGGEVGVIDYKSGRLDKRSLKERLLTSDFQLPLYLYAARESGHTEARQAAWFSLRTGMAIRLSEVISDAELDELLSKDPEVRAKVAEKEGLNLPNAVEALVGTLRQGQFAARPQDCGTCGYRAVCRITDRRITEDGG

SEQ ID NO: 9846 - protein, 273 aa, Myxococcus xanthus
MQLTSASELPLRTLSTLFARAFEGYFVTVPDAPGLFDARVRSEHISLEESRVARVDGEPVGLVLMARRGRESRVAGMGVVPAWRNRKLGGAMLRPLLEDARARGDTRMLLEVIEQNAPAVTLYERLGFQRVRRLVGFMGTPEPWVGASALEEVDPWECARLLPEGLPWQLAPATVMGLALPARAFRLGPAVAMVADVSAPTLVVRSVGVEPSARGQGAGRRLLGALAARWPGKALAVSAVVPEGPLARFFQGAGLGATPLTQLELELPLEVRS

SEQ ID NO: 9847 - protein, 165 aa, Myxococcus xanthus
MVKQAGYFRTPEVEQVAELRDVDLMLVHEWPRGIVQRAREENPSPPRPLPSYWIGNPVTRRLVDTVLPKWMLCGHSHKGFAVTLEGPGRPATRIACLDQAARAQESIFWLEYEDRQALRAGWGLSGAISWTAGQRWDMNSLPPLAAEGEGAPAEFGLGEAMPARN

SEQ ID NO: 9848 - protein, 981 aa, Myxococcus xanthus
MRRAFGLVALVAVMVAGGACERPASQRAKSAFVVRPETVDFGPAALGHTKTFKLRIANAGRASYRVEGAVSSVPNVNIPPFEPFILSAGGEQDIEIHFLPQVEGEIQGVVEIITDAEVGGRVPVSGRGVKAFIEVSSEALDFGNVAMGLVEMREVTVRNPSDVDSSLTLSVQGADADQFTAGQGLPSSLAPGEALVVPVAYAPRRLGAAEAALHVVVCDGCAPVMVPLTGTGVASRLEVTPLRVDFGRVALGATAEQVITVRNQGTQPLSFSGSQLVDSSEGVFRIASEPVVANGQLAPGAAVELRVAFTPAAVGKVRDGRVEIGVREQGSSAPGPKVSLAGEGGGSCVTVLPRRLAFGTVAEGMTATRDVTVYNRCRADVSVTDLQLDTHQGGYFTLAQAPASVMVPAGQNARVSVTFRPKAGSTDASKGQLSVTVRDSGSAATEAVALEGRSRVFAPCQYVLPQQLDFGKVPVGAEVALGVTLRNSGTEACYLASMQLVQGSDRVFSASPVRNGVLEPGAKATLVVRFRPSEEGGFSGLAEAWVNSPTQGHPLVELQGEGVVGCFAVQPTTVDFGVTKLACGPRTRELVAVNSCVGPIQVSQVAIDAGAGEFTVDGGGNAPWTLASQSARALTATYAPVDDGADTAALRFTLADGSVYTVGMVGWGVTQAEQTDRFFQESQAKVDVLFVVDNSGSMMEEQQNLGQNFAAFLSAADGAAVDYRIGVTTTGLDPSPGGWSECPGGSQGGDNGRLFPVDGSRPRIITPATPDAAGVFASNTRVGVCHWNEQGLEAAYRALADPLLYNEDDPRTAQPNDGNAGFLREDARLAIIFVSDEEDFSAQPVSFYETYLLALKGNDRSKLSVNAIVGPSDLARCPTSSSSGTRYIQLAEATGGVVESICTPNWASSLEKLSDSTFGANRKFPLSETPEAPGSIVVDVDGVRVTSGWEYDARENAILFDRFTAPEAGSLVEVTYPLGCG

SEQ ID NO: 9849 - protein, 55 aa, Myxococcus xanthus
METAREQAYAEASAACPAGYCNAVEQELRCEQTPYGDHHALFQLTYSCKDPVTCQ

SEQ ID NO: 9850 - protein, 189 aa, Myxococcus xanthus
MVRWEQYAGSRVGAVALDPDAPRALSAALTDGDGPDAATLLVSVVGRGFSASPSDREEFASAVMQHYQRELGLSLAAERVERLGGVTPRVEVLGTLREAGQVRTVLVAGLASEGEHAVVMVSAPAVRWQALEPQVRASLETFRHEPPSAGGPVPRRVLGALAGTLAGALVVSYTAWRRRRLRHAAGNPT

SEQ ID NO: 9851 - protein, 339 aa, Myxococcus xanthus
MASAFRLGEKLHPSERGSACFSGQNRKILAVRRFPLDSGGASLVSSRLGFKSLCFLEGRDRVDAVDTRLVASYAVAITFDVLMPVGMVLWARRRLGVAWKVVGWGAAAFALSQLFTRLPMVQVAQYFMRDALKTSSVLLGVWIVVLSLTAGLFEETARLWAFRKPLKDFRRWRDAVGFGVGHGGLESALLVGGLTALGLVNVIALSKLDPSTLPLKPEQVAQVVEAKATIAALDWWMPLLGAYERLGSMVVHIALSVVVLQRFIRGEVKWYWLAVGAHAFFNALTVVVGKLATAAWGPQAGAFAGEAMVTVAALVSLWVILYFRRVDAERDTAAVPARE

SEQ ID NO: 9852 - protein, 440 aa, Myxococcus xanthus
MFAFILAAVLTQSPVVPAAPSPPPAPGTPEAVPAVPLSTLPPATHELFQRIEGQVAQVRIIERRSGTRSSIGSAFFVSAAGHAVTNYHVISDVVIHPEDYTAELVLKGGAEPVPVRLVDVDVVHDLAIIQTATPVQSFFDLDDREPPQGARLFAMGNPRDLGTTIVEGTYNGFIHDALYERLHFSGAINPGMSGGPTLTGEGRVVGVNVATMGNQVGFLVPVKHARALLARALEAKDSGAQALLDTVRAQLLDNQQRVTERLLGAPVPQQTLGSYRVPGRWGTFLKCWGDTPHDPEVPYTVTNYQCSSEEDIFVSSRHRTGVVAFLHQHATSQKLGALRFSALYSALFSQDPDAVEATRQDVTNYRCQSEFVDVAGLPVRAALCMRAYRKFPGLYDLVLRAATLNGSTSGVDTSLTLAGFTADNGRKLARRYLEGLSWTK

SEQ ID NO: 9853 - protein, 70 aa, Myxococcus xanthus
MAWGLYWHLRYVTRWEPGRLIRVIAVVTLSFGALSRADAWLGNESFSTELGFRRSLLPPVFRLVGTEPLG

SEQ ID NO: 9854 - protein, 88 aa, Myxococcus xanthus
MIIALGPVAAQAFLGVGFRMHLSRGQLLDTRWAEGWMATFDPEAVLRLPEGRARAEARIHFEADLRSAAAWLRQRLTGDARARRVEGP

SEQ ID NO: 9855 - protein, 1182 aa, Myxococcus xanthus
GLIGGLIQALYRDIPSVLLPPMSFLHRPLRWLEAMSRFGATVCGAPNFAFDLCVRKTTPEQRAALDLSRLEVAFSGAEPVRADTLDRFVDAFAPAGFRREAFYPCYGLAEGTLIVSGGTRSAVPVVRRFARDGLLRGEARAPEVDAPATALVGCGQALGGQDVRVVDPETGRPCAPGRVGELWVRGPSVADGYWQRPDETERTFHGRLAGSGEGPYLRTGDLAVIDGGEVFITGRLKDVLVLRGLNYYPQDLEHAADRCHPGVRPGCGAAFAVDAGDEERLVIVQEVAAKVATPEAAAEVVASIRAALGEAHGLAVHAVVLITAGTLPKTSSGKVQRRATREAFLAGTLDEVHGWKEDAAAASLDIKPDAAPEAADVLAVLRSRLASLLGANGPALSVDVPLTHQGLDSLRALEVLHAVDEAWGVSPPITAVLQGQSLRELARWVERARTEGAEARPEAPAVMPGDPAAFVSDGQLALWFLQRMAPGSKAYHVSQAVRFVTPVDPGALARAFSVLVARHPALSSAFPEVQGAPARRACVAPPELARVEASTWTDEALRERLDADAREAFDMERGPLVRARLYTGAPRGDVLLLAMHHLVTDFWSLEVIAGELGALYTAEVRGTPSGLSPPPPVAPILLSLARRSTGAQGEALLAWWREHLGGELPVLELPTSFPRPRLQSFRGAQVTFRLPRETSTRLKALARTHGATPFMVLLAGYLAFLRRYSGQEDLIVGTPTTGRPRADLSRQVGYFVNPVALRARVPRTLSFSGLVARVRTTVLEVLEHQDLPFTRLVEQLQSRRDPSRAPIFQTMFALQSPRTENELLGAFAVGASGASARLGDDLTVESVPLSHPGAAFDLALMMTELEGAFVARLEYCADLFDAATAERMARHLGALLDAAVAQPEVPLGDLPLFAPDERRTLLALGRRTQDTRGALVPGIIHRIEDWAAKTPQAPALVAGASSWSYREVAAWVARLAARLRRHGVGPEVRVGTLLERGSSEQVVAFLAILKAGGTVVPQEPSYPPARVAWTLADCGARVLLAQERYAQRLALPEGVTLLPWEAHGEGDDMPDMSLWEAGEPPPDCAAYITYTSGSTGKPKGVMVPYRGTAHLCESMVSDLPVGPGSRVLQFASPAFDMSAWDYFLALASGGALHLSPRGPPAGDALYRMLREQRITSATLPSP

SEQ ID NO: 9856 - protein, 59 aa, Myxococcus xanthus
MARTALALAQRHLPDVPVVAIIHRDNEASLRVAERSGMRFERVIDYEGTPSRLYVPAPP

SEQ ID NO: 9857 - protein, 101 aa, Myxococcus xanthus
MVPYLVLAGLMAAEVSGALAAALLLYGLTLAVATVFLFRRKRWAWSLSSALAVVAFLAGAGVAWMPPSWVGGIHALGAAAILGALSAGRPAIAAPPALTAG

SEQ ID NO: 9858 - protein, 370 aa, Myxococcus xanthus
MGFVWDKDDFSTNQFAHPYHGSTYFNAARDHGFNYWGAMGFTLVGSLQWELFAENHLPSYNDLINTTMGGWAHGEVIYRLSSMLLDQRATGTRRVAREVSAGLLNPIRGFNRVVRGDAWRSAPTPKDWQPPVFAVLARTGYLNIDAGTTLNQFFAELDLRYGDAVRFPVDTPFDAFNMGVQFTTGENRLISRAEVKGALAMLPLENSGNERVLLGAFQHFDYNDTQAYELGGQSIGAGLVYRYLTQGGRELRLALHLRGVVLAGITSEYADKVGRDYDYGPGLGFHFEASYGRWPWEYLKLHAGSTWLHTLNGADGNHLVHEGTLLLDVPLFANLGLGASFTFFERNSFFRDFDTVSRGVPQARVFLSVH

SEQ ID NO: 9859 - protein, 306 aa, Myxococcus xanthus
MSYGTPKWRPWVLDEEAAQPFFRRAVELGINFFDTADMYSLGASEEITGRALRRYARMDEVVLATKVYFPMGDGQNMRGLSRKHIVQGCEASLKRLGVEAIDLYQIHRMDPNTPLEETLAALDQLVRQGKVRYLGASSAYAWQFARALGVADLRGWTRFVSMQGHYNLVYREEEREMLPLCEAEGIGVIPWSPLARGLLAGSRKSLKDRDATTRAKSDTLSPMLYDQASDWDVAEANRSVAEKRNVPPAQTALAWLLSRPAVTAPIIGATKLEHLEDAVRAVDLKLTADEVKALEAPYQPHAVRGL

SEQ ID NO: 9860 - protein, 107 aa, Myxococcus xanthus
ERLGLKPGDKVPVIVDAIQDHPGPARYNYSFVIALPREQGEQQLPGARIGGRLYVTKHRVFGRYDRIFLPESGAMSVPFCGILLDFVRDNDQPADHARPECQRFKQR

SEQ ID NO: 9861 - protein, 290 aa, Myxococcus xanthus
MDWAAATWLNLSLSYEVENNRLRSRAGVLELLNRADRERLRYPFGDFALHSLRPSVTLDFRDDPANPRRGVVLVSSAEFTRGLSVRPTDVAGNRVDAYPIDGVKLSGSLSGYIPLGRRASVALSARAGTIIPLEEQAQAIGSKLFYLGGSSSLRGFREDGVLPEDVRGALQQRLRDCRALISPSGCSAELKAVLAGQVPASQGGELFTLGKAELRLPALSSVDLGLFFEAGNLWLDRTQFDPGRLRYTAGAGLRYVTPVGPLAFDVGFNLDPDESVNEATTQFHFSIGTF

SEQ ID NO: 9862 - protein, 139 aa, Myxococcus xanthus
MDGSGLRYMADALLFLGQVDEARRHVDQALVAMERDLGPSSSERIEALLVLGDVHLARGQPAEALAPLRTALADLTARQVVSARVPRLRRRLARALRLTGAVEEACGEARRAWEELSVWRKAYVQETADARTELGHCRG

SEQ ID NO: 9863 - protein, 447 aa, Myxococcus xanthus
MFQLTPVSRLARLRFEGNSVLSDGELLEASSLLEGGPLEAEELQGAVSSVLQAYQRKGYDSTRVSVTQEPVTDGIAVVLTVDEGLPTRVRQVTFSGSPGLPLSRLLEVLALHPGQVFDRARLSSSLEELRTLLRGEGYWRAQVGAPAVLVEGSFASVAVPLMAGPRYVVRFHGNRHFPHGVLERVLAHDVSEPMDEVVAGRLARRMEAFYRYRGFHDVRVRPREVLRPDGEVAALVFDVEEGHPLRVADVRFHGNRGLPVETLRALLAEQVLAGMTRPELDLRMLDDPLNTEGRHGLELPGVAPPPPASTVYVEDAWLEAVEAMNEAYREQGFLSAVVAFRGLTVDVVGRTAVADFDVEEGPQARLVKVDFEGVPPGLTAWVMGRRMREGAPLSFDTVESSRQALEQELEQELGRQGYSSRASPRRRAWARTERRRPSSSARTRARR
